United States Patent 10,766,935 (PLANT TRAITS CONFERRED BY ISOLATED POLYNUCLEOTIDES AND POLYPEPTIDES) - sequence listing, part 8

SEQ ID NO: 12722 - DNA, 945 bp, Nicotiana tabacum
acctcttaaataaatatttcgcgttagtctcaggcttccatctctctctctctttgttttctcgtgctctctcactagatccctctttccaaagctatcttcagggatcattaagaagaaagagaaatggggctgacattcaccaagctgttcagccggctatttgcaaagaaggaaatgcgcattctcatggttggtcttgatgcagctggtaaaaccaccatattgtacaagctcaagctgggcgagatcgtcaccaccattcctactattggtttcaatgtggagaccgttgagtacaagaacatcagcttcaccgtttgggatgtcgggggtcaggacaagatccgtccattgtggaggcactatttccagaacactcagggtctcatttttgtggttgatagcaatgacagagaccgtgttgtggaggcaagagatgaattgcacaggatgttgaacgaggatgagcttcgggatgctgtgctgcttgtgtttgctaacaaacaagatcttcctaatgcaatgaatgctgctgaaataactgataagcttggactccactctctcaggcagcgtcactggtacatccagagcacttgtgcaacttctggagagggactttatgaggggcttgattggctttctaacaatattgctaacaaggcctaaaccaacgtagagttgttgcgggttgatcctggatgcaggcgggtttttatctagttctttttcctcattctcagaatctgtgtggttatgaatatcccttgaaagtgatttgcttcttcttggtaggacctcttgatatgtttttgtaatacagtggttggatatatgaaattgctgtttgtttggtttcaagtataatgctataatttgtaacagagaatagatgtttcattggtaaatggtaatggaatacttccctgtttgttccttctc

SEQ ID NO: 12723 - DNA, 914 bp, Nicotiana tabacum
ggcaatcaaattcctttccgctttctacatattttccagcgttaatctcaggtttctcctctcattagatccctcctccaaaagttcttttcagggatcatcaacaagaagtgaaatggggctgacattcaccaagctcttcagtcggctttttgccaagaaggaaatgcgcattctaatggttggtcttgatgcagctggtaagactaccatattgtacaagttgaagctgggagagatcgtcactaccattcccaccattggtttcaatgtggagactgttgagtacaagaacatcagcttcactgtttgggatgtcgggggtcaggacaagatccgtccattgtggaggcactacttccagaacactcagggtctcatctttgtggttgatagtaatgatagagaccgtgtcgtagaagcaagagatgaattgcataggatgttgaatgaggatgaacttcgggatgctgtgctgctagtttttgctaacaaacaagatcttcctaatgcaatgaatgctgctgaaataactgataagcttggactgcactccctcaggcagcgtcactggtacatccagagcacttgtgcaacatctggagaggggctttatgagggacttgattggctttctaacaacatcgctaacaaggcctaaagtgatgcagatttgttattgcgggttgatcctggatgcaggcgggtttttatctagttatttttttcttctcaagtcagtgtggttatgaacatctccttaaaagcattttgcaacttcataggactttttgtaatggctgtgtaagacgatggtcgaatatatgttttagtgctgtctgttttaggtatattttcataaatttgtataacaaagactagctttcatatgacatagcatttgttaatgattg

SEQ ID NO: 12724 - DNA, 1164 bp, Solanum lycopersicum
acgcacccaccattggaatcgagtggcattctcgtaatttaatgaaccccgtaatgccattttggtaacattaaaaagatctcatttcctttatttattgcatcaattttacgctctttacatatttcagcgttaatctcaggtttctctctcaatagatccctcattctaaaagctcttttcagggatcatcatcaaggaagcgtgatggggctcacattcaccaagctcttcagtcggcttttcgccaagaaggaaatgcgcattctaatggttggtcttgatgcagctggtaagaccaccatattgtacaagttgaagctgggagagatcgtgactactattcctaccattggtttcaatgtggagactgttgagtacaagaacatcagcttcactgtttgggatgtcggaggtcaggacaagatccgtccattgtggaggcactacttccagaacactcagggtctcatttttgtggttgatagcaatgatagagaccgtgttgtagaagcaagagatgaattgcataggatgttgaacgaggatgaacttcgggatgctgtgcttctagtatttgctaacaaacaagatcttcctaatgcaatgaatgctgctgaaataactgataagcttggactgcactccctcaggcagcgtcactggtacatccagagcacttgtgcaacttctggcgaggggctttacgagggacttgattggctttctaacaacattgctaacaaggcttaaagtgatgcagatttgttattgtgggttgatcctggatgcaggcggagttttatctagttgtttttacttctcatgtcagtgtggttatgaatatcatgttgaaagcattttgtgtttccttagggctttttgtaatggctgtgtaatacaatggtcgaatatatgtaattgctgtttgattaggtatatcatcattatcatatattattattattataaatgggaagatctttaacttcaaagtttgattataaatccttcagtaaaattaaatatttttaaaaactaattaataaaatgttaaaataaataatcatatggaattctaaaatggagtttagcagatgaagtgttattatttaaaaaaaatgaattaataaaatattaaataataattatattttaataaaa

SEQ ID NO: 12725 - DNA, 902 bp, Tragopogon dubius
ccctcttattttacaaccccctttctctctttctctctcttcttctcaatctcatttcaaaacgatcgattgatccttctcgaacaagcttttctcaggaatcctcacgaacaagaggatggggctaactttcaccaaactcttcagccggctttttgccaagaaagagatgcgaatattgatggtgggtctcgatgcggctggtaagaccaccattttgtacaagctcaagctcggagagattgtgaccaccattccaaccataggttttaatgtggagactgtggagtacaagaacattagcttcacagtgtgggatgttgggggtcaggacaagattcgtccactatggaggcattatttccagaacacacagggtcttatctttgtggttgatagcaatgacagggacagagttgttgaggcaagagatgaattgcacaggatgttgaatgaggatgaattaagagatgcagttctccttgtatttgctaacaaacaagatctcccgaatgcaatgaatgctgctgaaatcactgataagcttggcctccactcccttcgacagcgccactggtacatccagagcacttgtgcaacttctggagagggactttatgagggactggattggctttccaacaacatagcaaacaaggcgtaaggcgatggttggttatattgctatatgaagcaagttttggccgtggttttggaattggaacttgttcttcaaaaaaagtgttatggttttgatatatatatataatatagtacaagtcatggaatatattgtttgttttgtttgaactccaacaatgtcttaggttttcattctttgtaagaggttaagtttttgtgcaatttctgtaaactttattattatatcatgctaatttcat

SEQ ID NO: 12726 - DNA, 822 bp, Tragopogon dubius
tttgtcggtgatcgacggtctccgattcaaacgatctccgtcactccctacaatcgccggtctatcatatcaagatggggttgtcgtttaccaagctttttagccgcttgtttgccaagaaagagatgcgaattttgatggttggtctcgatgcggctggtaaaaccacgatcttgtacaagctcaagttgggagagattgtcaccacaattcccaccattgggtttaacgtggagactgttgagtacaagaacatcagctttacagtttgggatgttgggggtcaggacaagattcgaccattgtggaggcactactttcagaacacacaagggcttatctttgtggttgatagcaatgaccgtgaccgtgtggttgaggctagagacgagctgcacaggatgcttaatgaggatgaattaagagatgcggtattgcttgtgtttgccaacaaacaagatcttccaaatgccatgaatgctgctgagatcactgataagcttggccttcattctctccgacaacgacactggtatatccagagcacatgtgccacatctggagaaggtctatatgagggactcgattggctttccaacaatatagctaacaaggcataaacaggacttggatggttttggattatatctgtgttagtttgatttgagttgagatatttttttatgttattgttgttaatggtgataaaatttaaattcctccaacctaggttgttgttgacatgatttaagatggttggaattgtgtaaatctaaattgcctacttttggtaaaaacttattaagaatgttttattaatct

SEQ ID NO: 12727 - DNA, 795 bp, Tragopogon dubius
cccccatatttcacaagcccctctctccttcacttttcgatcgatccctctccaaaagctttttctcagggatcttcaccagcaatagaatggggctaacatttaccaaactctttagccggctctttgccaagaaagagatgcgcatactgatggtgggtctcgatgcagctggtaagactaccattctgtacaagctcaagcttggtgagatcgtgacaacaatccctaccattgggtttaatgtggagactgttgagtacaaaaacatcagcttcactgtgtgggatgttgggggtcaggacaagattcgtccactatggaggcactacttccagaacacacaaggtcttatctttgtggttgatagcaatgacagagatagagttgttgaggcaagagatgagttgcataggatgttgaacgaggatgagcttcgagatgcagtgttgcttgtatttgcaaacaaacaagatctgccaaacgcaatgaatgctgctgaaatcaccgataaactgggcctccattccctgcgacagcgccactggtacatccagagcacctgtgcaacctctggggaaggtctttatgagggtctcgactggctttctaacaacattgctaacaaggcgtaaagtgatattgaaagtgcgagctttttctggtttacgtggtcagctgctgctacttgttcccgattctggttctttgttggttaaacagttttttatgcttttaaaactattattgtttagattttttttccttcataaacctaaagttgtaacagagctt

SEQ ID NO: 12728 - DNA, 922 bp, Trigonella foenum-graecum
ctctctctctctctctgcgatttctgctacatcaacttttcttcttcaaaggaaggatcaacgaagtgaaggaaaaatggggctaacattcacgaagctgttcagtcggcttttcgcgaagaaggaaatgagaattttgatggttggtctcgatgctgctggtaagaccaccatcctctacaagctcaagcttggagaaattgttaccacgatccctaccattgggttcaatgtggagactgtggaatacaagaacattagcttcactgtttgggatgttggaggccaggacaagattcgtcccttgtggaggcactacttccagaacactcagggtcttatatttgtcgttgacagcaatgacagggatagagttgttgaggccagagatgagctacataggatgttgaatgaggatgaactgagagatgcagtgttgctagtgtttgccaacaaacaagatcttcccaatgcaatgaatgcagctgagattactgacaagctgggtctccactctctcagacagcgtcactggtacatccagagcacctgtgccacctctggggagggtctttatgaaggtttggactggctttccaacaacatagccaataaggcataatgctttttgggagtgttttggatcggtatttctgggtcctcttccgaaacaacttgaatttgtgttcatgtattgcggtttaggacatattggtggctataattgtagtaggaatttaattcatgggttgtttaatacttttgagttttctattgggtttggatgcaatgctctaactgtaaggagatactaattctatgcgccatcaggttctgatttatacttttgtcatggtcaatcatatacctttactataatgtattggatggagattttgattcttgtatggtaccaaagaaa

SEQ ID NO: 12729 - DNA, 827 bp, Triphysaria pusilla
accaaatctagcgatctcaggttagaacacaatggggttgacttttacaaagcttttcagtcggctttttgccaagaaggagatgcgtattctgatggtaggtcttgatgcggctggtaagaccacaatcctgtataagctcaagctcggagagattgtcactaccattcctactatcggctttaatgtggagactgttgagtacaagaacatcagtttcaccgtctgggatgttgggggtcaagacaagatccgtccattgtggaggcactacttccagaacacccagggtctcatatttgtggtggatagcaatgacagggaccgtgtcgttgaggccagggatgagttgcacaggatgttgaacgaggatgagctgagagatgcagtattacttgtatttgcaaacaaacaagatcttcctaatgcgatgaatgctgctgaaataaccgataagctcggcctacactcactcaggcagcgccactggtatattcagagcacctgtgctacctctggtgagggtctctacgagggactggattggctctccaacaacattgctaacaaggcttaaaatgcttcatggagctgttgaagtgagctgatgcaaaatgcaggcgagtttttatctagtattacacctcttttatggcttctatatacataagaatttgttggctttgtgcttttacgtttaggacctttgtattggctgtatagcagacaattgtgtgcttcctatatttgcaatcatttgctttttttttttatactttttcttattgtaatacgcagtgactaagactatggtggtattgaatttt

SEQ ID NO: 12730 - DNA, 872 bp, Triphysaria pusilla
aacattttaccaaatctagcgatctcaggtataaaaaacaatggggttgacttttacgaagcttttcagccggctttttgccaagaaggagatgcgtattctgatggtaggtcttgatgcggctggtaagactacaatcctgtataagctcaagctcggagagattgttactaccattcctactattggctttaatgtggagactgttgagtacaagaacatcagtttcaccgtttgggatgttgggggtcaagacaagatccgtccattgtggaggcactacttccagaacacccagggtctcatattcgtggtggatagcaatgacagagaccgtgtcgttgaggccagggatgagttacacaggatgttgaacgaggatgagctgagagatgcagtattacttgtatttgcaaacaaacaagatcttcctaatgcgatgaatgctgctgaaataaccgataagctcggcctacactcactcaggcagcgccactggtatattcagagcacctgtgctacctctggtgagggtctttacgagggactggattggctctccaacaacattgctaacaaggcttaaagtgcttcatggagccgttgtagtgagctgatgaaaatgcaggcgagtttttttctggctatatatatacaaattatgtttggacctttgtgatagctctgtatagcaggcaatggtttgtttcctatgtttgcaatcattttttttaaattgtaacgcgtgactaagaagactatggtggttttggaattttgtatccgtttcttaatatgtatgaacctttctcgacttgggtgttgatggttttcgttaaatgttggaaatagataaattcatattcgaatgc

SEQ ID NO: 12731 - DNA, 951 bp, Triphysaria pusilla
aggtgccccgaaaaaatagattcgcattagcctcaggcacctccatatttctctctttccaaaaccagcaaaaacactctcaacattttaccaaatctatcgttctcaggtataaacaacaatggggttgacttttaccaagcttttcagtcggctttttgccaagaaggagatgcgtattctgatggtaggtcttgatgcagctggtaagacgacaatcttgtacaagctcaagctcggagagattgtaactaccattcctactattggcttcaacgtggagactgttgagtacaagaacatcagcttcactgtttgggatgttgggggtcaagacaagatccgtccattgtggaggcactactttcagaacacccagggtctcatattcgtggtggatagcaatgacagggaccgtgttgttgaagccagggatgaattacataggatgttgaacgaggatgagctgagagatgcagtattacttgtgtttgccaacaaacaagatcttcctaatgcgatgaatgctgctgaaataaccgataagctcggcctacactcactcaggcagcgccactggtatattcagagcacctgtgctacctctggtgagggtctttacgagggactggattggctctccaacaacattgctaacaaggcttaatgttcttcatggtgccgttgtagtgagctgatgaaaatgcaggcgagtttttttctggctatatatatacaaattatgtttggacctttgtgatagctctgtatagcaggcaatggtttgtttcctatgtttgcaatcatttttttaaaaattgtaacgcgtgactaagaagactatggtggttttggaattttgtattggtttcttaatatgtatgaacctttctcgacttgggtgttgatggttttcgttaaatgttggaaatagataaattcatattcgaa

SEQ ID NO: 12732 - DNA, 988 bp, Valeriana officinalis
tatcaggcaggcttcatcgctctattttcttttctctgagtctctcacacccggagatccctttcttcaagcttctctacagggatcatcagcaagaaagagaatggggctaacgttcacaaagcttttcagccggctttttgccaagaaagagatgcgcattcttatggttggtctcgatgctgctggtaagacaaccatattatataagctcaagcttggagagatcgtgactacaattcctaccatcgggttcaatgtggagactgtcgaatacaagaacatcagcttcactgtttgggatgtcgggggtcaggacaaaatccgtccattgtggaggcattacttccaaaatacacaaggtctaatctttgtggttgatagcaatgacagagatcgtgttgttgaggcaagagatgagcttcataggatgttgaatgaggacgagcttcgagatgcagtgctactagtgtttgctaacaaacaggatcttccgaatgcaatgaatgctgctgaaatcactgataagcttggcctccattccctcaggcagcgtcactggtatatccagagcacttgtgcaacttctggggagggtctttacgaggggctcgattggctctctaacaacattgctagcagggcataaggtgctgcagagcgttttcttgtgatgttacatggatgcagacatatttttatctagtcttactctctcttttttgtcttttttcgttatctgtctgtccctgcacttctctcttgatctacccccagctcgcctaggcagcgtgtgcttatgaatttggttttgagtggcaagaattctttgtaggatttatttttatttggctttgtaatggaatgactgatttcaatatatgcacttgcatatgtctaaagtttcaatgactgatttcaaagctgtaatacatctaatttggtcttgctgtcctattttctctgttaaatgtttagcaccggttat

SEQ ID NO: 12733 - DNA, 838 bp, Vicia sativa
aaacaaacgagtcgtaggaaagaaaaagagatctcgtcttcatttcacaacaaaaatatctttctctcaaatctcaaaggtagttgaaaatggggttgtcattcacgaagctttttagccggttgtttgcgaagaaggagatgaggatacttatggtgggtctcgatgcggctggtaagaccaccattctctacaagcttaaacttggagaaattgtcaccaccattcccaccatcgggttcaatgttgaaactgttgaatataagaacatcagttttactgtctgggatgttggaggccaggacaagattcgtcctctgtggagacattacttccaaaatacacaagggcttattttcgtggttgatagcaatgaccgagatcgtgttgtggaagctagggatgagctgcacaggatgttaaacgaggatgagttgagagatgctgtgcttctagtttttgctaacaaacaagatcttccaaatgctatgaatgctgctgaaataaccgataaacttggacttcattcacttcgtcagcgtcactggtatatccagagcacatgtgccacctctggcgaaggactctatgaaggacttgactggctctcaaacaacattgcaaacaaggcatagatattgttagtcatggcctctgcatgaagttcagatgagtttagagtttatgatttcagatgtttcaatgtggttaccctatttagaattttacccgcacttgcatgtattattgtttcatttgtctttgaaaaagaacaaacttacctaggtttaatacatttccaattttttttccatgtataacctaaagtctttgtttc

SEQ ID NO: 12734 - DNA, 846 bp, Vinca minor
cgaaggtcatctcagggatcatccataagaaagcaatatgggattaacgttcacgaagctcttcagccggctctttgccaagaaggagatgcgaattctgatggtaggtcttgatgcagctggtaagactaccatcttgtacaaactcaagctcggagaaatagtgaccacaattcccactattggttttaatgttgagactgttgagtacaagaacattagcttcactgtttgggatgtcgggggtcaggataagatccgtcccttgtggaggcactacttccaaaacacacaaggtcttatttttgtggtggatagcaatgacagagaccgtgttgtggaagccagggatgagttgcataggatgttgaatgaggacgagctccgtgatgcagtgttgctggtatttgccaacaaacaagatcttcccaatgcaatgaatgctgctgagataaccgataagcttggtctgcactccctccggcagcgccactggtatatccagagcacctgtgcaacttctggagaaggactttacgaggggctagattggctttctaacaacattgctaataaggcataaagcaagacaggaaatattttcaatgggttgacactggatgcaggcatctttttatctagaattttcctgttatggtgtcaaggatttaaattttattcagtatatcttttaaccgactagttgtactgaagtgctcggttttatgtaattgcaatgtgtttgtctaggttttttaatataatgcccagaagatgagtatgtgaacacagattttattgctggtattattgtaaacagagattttaagctgttattcaccttgg

SEQ ID NO: 12735 - DNA, 956 bp, Juglans hindsii x Juglans regia
ggccggggaacctcgttgcgaaggacggacggctcccttttctagttttctttgtgtaccgagagagagagagagagagagccagagagacagagcgaggacagagggtagatctcagtcatcctcctcagaaaaccttgaagaaaaaaatggggctgtctttcaccaagcttttcagtcgtctgtttgctaagaaggaaatgcgtatactcatggtgggtcttgatgctgctggtaagaccaccattctctataagctcaagctgggagagattgttaccaccattcctaccattggatttaatgtggagactgtggaatataagaacatcagcttcaccgtttgggatgttgggggtcaggacaagatccgtcctttatggagacattacttccaaaacacccaaggacttatatttgtggttgatagcaatgaccgagaccgtgtggttgaagctagggatgagctgcacagaatgttaaatgaggatgagttgagggatgctgtgttgctagtgtttgcaaacaagcaagatctccccaatgctatgaacgctgctgagataactgataagcttggccttcactcactccgtcaacgccactggtatatccagagcacatgtgccacttctggtgaagggctctacgagggactggactggctctcaaacaatattgcaaataaggcatagatgtcttggcactgagttttaggttgcaacaacagctggaatataaagtcgttctttccttttggactactggattttgccttcctgttcagtgtaaccttttctactagtttattgtttcccttgcagacatcatcattactacctgtagttttccggatttgtttttttcttttcatggtattacttgggacagaattgtttttacgattgtcttgtgaatgtaaacggcatacattatctctgctacctctttgttcc

SEQ ID NO: 12736 - DNA, 812 bp, Juglans hindsii x Juglans regia
cggggggagggaggggtagatctctttcggttttcattctcaggcctcagaataccattaagggaaaaagatggggctgtctttcaccaagcttttcagtcgtctgtttgctaagaaggagatgcgtatactcatggtgggtcttgatgctgctggtaagaccaccattctttataagctcaagctgggggagattgtcaccaccattcctaccattggatttaatgtggagactgtggaatataagaacatcagcttcaccgtctgggatgttggtggtcaggacaagatccgtcctttgtggagacattacttccaaaacacccaaggacttatatttgtggttgatagcaacgaccgagaccgtgtagttgaagctagggatgagctgcacagaatgttaaatgaggatgagttgagggatgcagtgctgctggtgtttgcaaacaagcaagatctccctaatgccatgaatgctgctgagataactgataagcttggccttcactccctccgtcaacgtcactggtatatccagagcacatgtgccacttctggtgaagggctctatgagggacttgactggctctcgaacaatattgcaaataaggcatagatggcttgattctgagttttaggttgcagtactgctggaatataagttgcattttttttttttggttctgaactcgctatcctgtttagtgagaccttttctaccggattgtagtttcccttgcagacatctttattacttgtagtttcagaagaattcttaaaattttctcggtactatcacctcgactctctgg

SEQ ID NO: 12737 - DNA, 1005 bp, Citrullus lanatus
aggccatcttcgcagttttcttcctccaccgccatattacgcgttgctctgaagctcgatttttcttgctttctccatccctttcaatacacctctgtgcagctctcagagaaaatcaggaacttctacgttacgtacagaaatggggctcaccttcgctaagctcttcagtcggctgtttgccaaaaaggagatgagaattctgatggttggtcttgatgctgctggtaagacgaccattctctacaaactcaagcttggagagatcgtcacaactattcctaccatcgggtttaacgtggagactgtggaatataagaacatcagcttcactgtctgggatgttggtggtcaggacaaaattcgtccattgtggaggcactatttccagaatactcaaggtcttatatttgtggtggacagtaacgatagagaccgtgttgttgaggcaagggatgaattgcatagaatgctgaatgaggatgagcttcgagatgcagtattactggtgtttgctaacaaacaagatcttcccaatgcaatgaatgccgctgagattactgataagcttggtcttcactctcttcggcagcgccattggtatatccagagcacttgtgcaacctccggggaagggctttatgagggattagattggctctcaaacaacattgctaacaaggcataaagctgttaatctgagttgtcttgtagactggcaatcctggatgcaggggtgaatgttatctacttttttttgtttctttttggggaatagtctttcatacctttttttagggattgatatttcgtagtttcggtctacggtcatattgtaatggttgttcgtatactcacctgggattgtgtgtttaatgagatgatgtaattcaaactttaacccctcacttcctcatccgaaatttgttttattttgcattcttttgaaaaatgtctatctcatcttggcttgaagtaatcgcaattagaagtcctcaccaaaag

SEQ ID NO: 12738 - DNA, 1102 bp, Citrullus lanatus
aaaatagagtcctcataattcgcgaattcgcatttgattgtgaaggacagcctctctctgtgcaagagagagatctatcattctatttggggccgatctcttcaattccgtaagtttttcattcaatctcctttctcatttctctccaagatctgtccacaatcctgccgattttacccttaattttgatccttcctgcttcgatctgtgctcctgtttacttgaaaaatggggctgtctttcaccaagcttttcagccggctctttgccaagaaggagatgcgtattctcatggtgggtcttgacgcagctggtaagaccacgatcctttacaagctcaagctgggagagattgtcaccaccattcctaccattggttttaatgttgagactgtggaatacaagaacatcagcttcactgtctgggacgttgggggtcaagacaagatccgaccattgtggaggcattatttccaaaacacccaaggacttatttttgtggtggatagcaatgacagagaccgtgtagttgaagctagagatgagctgcacagaatgttgaatgaggacgagctgagggatgcagtgcttttggtatttgccaacaagcaagatcttccaaatgccatgaatgctgctgagatcaccgacaagcttggtcttcactccctccgacaacgtcactggtacatccagagcacatgtgccacatctggtgaaggactgtatgaaggacttgactggctctcaaacaatattgccaacaaggcgtagatggggtttcctttgagctgggattggttctggaaattcatattgatgtcatttgtccattgtttacgggcatttttgttggattacctgatctatacgatgttcctagtggatgatttctaggttggtgttggattctgaataatgaaagaaattttgaagtatttgtcatgttatagactcaatagcattgtttttatgtaatgaattaatgatggttcttaaaataggtgtatttgtatgagaatcatgtttgttatttggaatggattgctgaaaagaattcactttgggacttttattgtattactctcttcttctgcttcca

SEQ ID NO: 12739 - DNA, 900 bp, Jatropha curcas
atttgtgattaaatttcggatcgatttactgatttcaatatgtagcttttgattctggaaatggttgctgatttattgaattttttttatgtttgatctgatttttgattttccctaaagctatagatagagaatcagagatggggctttcctttgcgaagctatttagccggctttttgccaagaaggagatgcgaattttgatggtgggtcttgatgctgctggtaagaccactattttgtacaagctcaagcttggagagattgtcaccactatccctaccatcggatttaatgtggagactgtggaatataagaacatcagcttcactgtttgggatgttggtggtcaagacaagatccgccctctgtggaggcattacttccagaacactcagggtcttatatttgtggtggatagtaatgacagagatcgagttgttgaggcaagggatgagttgcatagaatgttgaatgaggatgaactgagagatgctgtcttgcttgtgtttgccaacaaacaagatcttccaaatgcgatgaatgctgcagaaataactgacaagcttgggcttcattctctccgtcaacgccactggtatatacagagcacatgtgcaacatcgggagagggcctttatgaggggctggaatggctgtccaacaatattgcgagcaaggcttgaaacgaactcaaggattctgatggtgttgtagactttttgagacctgcgagtctggaaagccaagcttcccttctgttcagtgactgttgtaataacagaatggtttgtttagatctactttacctgaagtgtgggtttgagtaatatttcttagctagtacatttatctcttcaaacataattataaaagaacttggcacgtttggcaaaaaaa

SEQ ID NO: 12740 - DNA, 715 bp, Brassica oleracea
gttcagatcttttcgcatcaagctcgaaaggatcagtagctgaaggggaaaatggggctttcatttggaaagcttttcagcaagctatttgcgaagaaggagatgcgtatccttatggttggtcttgatgctgctggtaagaccaccattctttacaagttcaagcttggtgagatcgttaccaccatccccaccattgggtttaatgtggaaacagttgaatacaaaaacatcagcttcactgtgtgggatgtcgggggtcaagacaagatccgtcccttgtggaggcactacttccagaacactcaaggtctgatcttcgtggtcgatagcaatgacagagatcgtgttgttgaagcaagagatgaacttcacaggatgttaaacgaggatgagcttcgtgatgcagtacttcttgtgtttgctaacaagcaggatcttccaaatgcaatgaatgctgcggagataaccgataagcttggactccactctctccggcagcgtcattggtacatccagagcacgtgcgccaccaccggtgagggactgtacgaaggtctggactggctctccaacaacattgctaacaaagcttgagctttgtgagacgaaagctttggcttctgggagaagcattatctctgcttcttgttcaaaacctttttctctctctttttgttttgaattttggtggttatggagtcgtataagttgc

SEQ ID NO: 12741 - DNA, 909 bp, Brassica napus
agttgaaaaaagctgctggtaccggtccggtgacccgctgatcgtcgacccacgcgtctcgcgtttctcttaagcttctctctctctctctcagagtttaaaaggacaagatggggttgagtttcgcgaagctgtttagcaggctctttgcaaagaaggagatgaggattctgatggttggtcttgatgctgctggtaagaccaccattctctacaagctcaagctcggtgagattgtcaccaccatccccactattggtttcaatgtggaaactgtggagtacaagaacatcagtttcactgtgtgggatgtcgggggtcaagacaagatccgtcccttgtggaggcactacttccagaacactcagggtctgatctttgtcgtggacagcaacgatagagacagagttgttgaggctagagatgaacttcacaggatgctcaatgaggatgagctgcgtgatgctgtgttgcttgtgtttgctaacaagcaagatcttccaaacgccatgaatgccgctgaaatcacggataagcttggccttcactccctgcgtcagcgtcactggtacattcagagcacatgcgccacttcaggtgaaggactgtacgaaggtctggactggctgtccaacaacatcgctggcaaggcgtaatgatgtaaaacagcatcgcatcgggatgattcttcctgccgtatgttggtaaagtttctggatgcaagagaaagattataaatattatatgaacctttttgctactggctattatatgaatgttctgattgtgcaagtatagatgtgtacctaaaaaccttatgagcccctttaaatagttttcgtgcattttgatttgttcaaaccttggattgatgattgaatgttattgctttcttgttactattattgt

SEQ ID NO: 12742 - DNA, 885 bp, Manihot esculenta
ctctctctctctctccatccatctactgaaagaagagagagtcgcatctcttctcagaacacgtgatttgcttccatcgtaacccactttcttcagatccttcttcaaaagtgctactaatacgcatacagaatcagagatggggcttacctttacgaagctatttagccggctttttgccaagaaggagatgcgaattctgatggtgggtcttgatgctgccggtaagaccactattttgtacaagctcaagcttggagaaattgtcaccaccatccctaccattggatttaatgtggagacagtggaatacaagaacatcagcttcactgtttgggatgttggtggtcaagacaagattcgtcctctttggaggcattacttccagaacactcagggtcttatttttgtggtagatagtaatgacagagatcgaattgttgaggcaagagatgagttgcatagaatgttgaatgaggatgaactaagagatgctgtcttgctcgtctttgccaacaaacaagatcttcccaatgccatgaatgctgcagaaataacagacaagcttgggcttcattctcttcgtcaacgtcactggtacatccagagcacgtgtgcaacatctggagagggcctgtacgaggggctggactggttgtccaacaacatcgctagcaaggcttgaaaatgaaactaaaagaattttggtggttgtctagactttatgatgctagcgattgtggaaagcctatatacccctttttgttcagcaactgttgtaatagcagaatggttgcttagatcctacttatataatatgggtttgtgctaaaactttatcttttaaaaaattataaatgacactaatgcttattttggattgtc

SEQ ID NO: 12743 - DNA, 943 bp, Cedrus atlantica
ggtggtgaaaatggggctcacttttaccaagctttttagccggctcttcgcaaagaaggaaatgcgcattttgatggtgggtcttgatgctgctggtaagactaccatcttgtataagctgaagctgggagagattgttaccactatccctaccattggattcaatgtggaaactgtggaatacaagaacatcagcttcactgtgtgggatgttgggggtcaggacaagatccgtccactatggagacactacttccaaaatactcagggtctcatcttcgtggttgatagcaatgacagagaccgtgttgtagaagcaagggatgagctacataggatgctgaacgaggatgaactacgtgatgctgtattacttgtgtttgcaaataagcaggatcttccgaatgctatgaatgctgcagagatcactgataagcttgggctgcattcccttaggcagcgccactggtatatccaaagcacttgtgcaacttctggcgagggcttgtatgagggcttggattggctctccaacaacattgcaaacaaggcttgaagatatatggtgaactgggttcctggaattttgtagggcaatgtcgtcttatttcatttttgtcagacagtttgaagaaataatgttctaattctgcagtcaaactgacttttgactagctacatttattcaatttcttctatggttttgattttgccagtctgctaggaatgaactaatttatatagctcactgagcttaaatgacaaagcatgagtagttactattaaagcaggtgatgattatgataatgcctttgtgtagggagcatagacattattaagcatgtttaagctgatttgaaacttaaattcctattacaagctttattgtctcagatcacgctcaattctttctaccagataataagtatacaggttggtttgt

SEQ ID NO: 12744 - DNA, 989 bp, Cenchrus ciliaris
gttgacgcaagggttggctccctcctctggccccgtataaaataggcgagacgcgcatcaccgctcgaaggaaacaacacccggaagcctctccttccccgtctccggccgttgcctcctcctcctccgtcccagcccgcgtcgccggcgatctcaccgcgaatcggatccgccgacaaggcgagagggaagagatggggctcacgttcacgaagctgttcagccgcctcttcgcgaagaaggagatgaggatcctcatggtggggctcgacgccgccggaaagaccaccatcctctacaagctcaagctcggcgagatcgtgaccaccatccccaccatcggattcaatgttgaaactgtggagtacaagaacatcagcttcaccgtctgggatgtcgggggtcaggacaagatcaggccgctgtggaggcattacttccagaacacacagggtcttatctttgttgtggacagcaacgatagggaccgtgttgttgaagccagggatgagctccaccggatgctgaatgaggatgaattacgtgatgctgtgttgcttgtgtttgctaacaaacaagatcttccgaatgctatgaacgctgctgagattactgataagcttggactgaactcacttcgccagcgtcactggtacattcaaagcacttgtgctacatctggcgagggattgtatgaaggcctggactggctgtccagcaacattgccagcaagtcctaagttttcaagaggtttggatctaggagcttttggatgatgatattgctggatatttagggttggattgctattcccgtatgtaaggtgtatgccctgagctcaatagttattttggttaaaatttcacagttaaattgtttgtgtaatttgggcccttgagatgtttccgaaccaaactgctaaatggtgctccgttgagttaattcgttggggaatgcgtgctggtatgcagcaacacattgctgttat

SEQ ID NO: 12745 - DNA, 817 bp, Cleome spinosa
aatttcgctctctcgctcgtcgttgcgaggtctctcttcctctctctaagatctccctgggactttcttcagaggtaacgcaggatggggctgactttcaccaaactctttagtcggctttttgccaagaaggagatgcgaattctgatggtgggtcttgatgccgctggtaagaccaccattttgtacaagctcaaacttggagagattgtgaccaccattcctactattgggtttaacgttgagactgtggaatacaagaacattagtttcaccgtgtgggatgttgggggtcaagacaagattcgtccattgtggagacactacttccagaacacacagggtcttatctttgtagtcgacagcaatgacagagaccgagttgtcgaggctagggacgaactccacagaatgctgaatgaggatgagctgcgtgatgcagtgcttcttgtatttgccaacaagcaggatcttccaaatgctatgaacgccgcagaaatcaccgataagcttggcctccattccctccgccagcgtcactggtacatccagagtacatgtgccacgtccggtgaggggctatacgaaggtctggactggctgtccaacaacattgcgaacaaggcgtgacgagagagagggagagaaagaaggttggctggcgattctatctaaattgttttgtttctttcatctgttgctgtttcgattgcgtggctttttgtgcaagtgtctttgtatgtaggcagcccctttttcattgttgctatattgtaattctaagaacgggttttgatgaatgtacgtgttagtttat

SEQ ID NO: 12746 - DNA, 887 bp, Cryptomeria japonica
ggtcttctgcccttcgttttttctcctgcgttggagaagctctccacttttctctcttgcctccactctgaccagatctgagattcgaagccgagatctataccaggttacacgatggggctcacatttaccaagcttttcagcaggctttttgctaagaaggaaatgcgcattttgatggtgggtcttgatgctgctggtaagactaccattttgtacaagctgaagcttggggaaattgttactaccatccctaccattggattcaatgtggaaactgttgaatacaagaacatcagttttactgtatgggatgttgggggtcaggacaagattcgtccactatggagacactacttccaaaatacacagggtcttatatttgtagtggatagcaatgacagagatcgtgttgtggaggcaagggatgagctacaccgcatgctgaatgaggatgaactacgagatgcagtgttacttgtgtttgcaaataagcaggatcttcctaatgcaatgaatgctgcagagataactgataaacttgggttgcattctcttaggcagcgacactggtatatccaaagcacctgtgcaacttctggtgagggcctgtatgagggcttggattggctttcaaacaacattgcaaacaaggcttgaaatgacagtggactgggcttcaagaattttgtattacaaaaatgtcttgtatctttattgatagagacagtttgaggagataaaaatttaacatatgcagtcaaactgactcagaagagtgactgctattttcacctgtaatttgacttcttacatttgtttgattgtttttatggatttgattgtgccagatgcactaatttatatatcttacgaaattaaatgac

SEQ ID NO: 12747 - DNA, 891 bp, Cyclamen graecum
tttgcgcgtcgatctcaagcttccaatctctctctcttgctagatcccttttaccccaagggatcaatcaccagcaaagagacatgggtttgacattcaccaagcttttcagccggctttttgccaagaaggagatgcgtatcctcatggtaggtcttgatgccgctggtaagaccaccatcctctacaagctgaagcttggtgagattgtgaccacaatcccaactattggctttaatgtcgaaactgttgagtacaaaaacatcagctttaccgtgtgggatgttgggggccaggacaagattcgtccattgtggaggcactatttccagaacacccagggtctcatttttgtggtggatagcaatgacagagaccgtgttgttgaggcaagagatgagttgcaccgcatgttgaatgaggatgaattgagggatgccgtattgcttgtctttgctaacaaacaagatcttcccaatgcaatgaacgctgctgaaataactgacaagcttggtctccactctctccgacagcgccactggtacatccagagcacttgtgcgacctccggcgagggcctgtatgaggggttggattggctctccaacaacattgcaaataaggcttgagtacggggcaggcactggatggtttttatctagtctatttgtttccttccctttctttcatgccagacaatataccatgtcgatttcgtgttgttaagtgttactgctgatcaaggatttagttgaattcatgtactattaaactcagctcctgacttgacttgcatatctatcattttagatcatttctggtgcttttgaaacagcgacctagacctatcttcttagacgaaaaggaatcttatagacggaaaaatatttt

SEQ ID NO: 12748 - DNA, 649 bp, Cyclamen graecum
tctctagatctctctgaaaacaccctccggcagggatccattgaaaaagatggggttgacattcacaaagcttttcagtcggctctttgccaagaaagagatgcgtatcctcatggtaggtcttgatgccgctggtaagaccaccatcctctacaagctcaagcttggtgagattgttactacaatccctactattggttttaatgtcgaaactgttgagtacaaaaacatcagctttaccgtgtgggatgttgggggccaggacaagatccgtccattgtggaggcactatttccagaacacccagggtctcatttttgtggtggatagcaatgacagagaccgtgttgttgaggcaagagatgagttgcaccgcatgttgaacgaggatgagttgcgagatgcagtattgctcgtctttgctaacaaacaagatcttcccaatgcaatgaatgctgctgaaataactgacaagcttggtctccactctcttcggcaacgccactggtacatccagagcacttgtgcaacttcaggcgagggtctctatgagggattggattggctctccaacaacattgcgaataaggcttgagttcggggattcatcttgtgggggattctggatgcagtttatcttatcttcttc

SEQ ID NO: 12749 - DNA, 869 bp, Epimedium sagittatum
gaatcagtgaaagatttgcatctctctccaactccccgctcttactccatctgcgatcttcctcttcagagagagcgatggggcttacgttcaccaagcttttcagccggctttttgccaagaaagagatgcgtattctgatggtgggtctcgatgcggctggtaagactaccatcttgtataagctcaagcttggagagattgtcaccactattcctaccattggatttaatgtggagactgtggaatacaagaacatcagcttcaccgtgtgggatgttgggggtcaagacaagatccggccattgtggaggcactacttccaaaacacccaaggtcttatctttgttgtggatagcaatgacagagatcgagttgttgaggctagggatgagttgcatagaatgttgaatgaggatgagttgcgagatgctgtgctgcttgtttttgctaacaaacaagatcttcccaacgcaatgaatgctgcagagatcaccgataagcttggtcttcactctctccgtcaacgccactggtacatccagagcacatgtgcaacttctggagagggtctctatgagggattggattggctatccaacaacattgcaaacaaggcttgagacagatggggggctttgcgctcttattttggggtaaaagttactatgtttggtttatgttccttgcagttgtggtgcaaatgataagtgtctttgttgtttaggaaactgttttttggttaaaaatgttttgtaagaaggattggttagatatactttgcatttaattgtatgctgcttgggcgtactaatttagctaatccttttagcttttactggaaaactactcagtgtggtattcatttg

SEQ ID NO: 12750 - DNA, 994 bp, Hevea brasiliensis
tctccatccatcgacggaaaaaggagagagtcgcatctcctcataacacgcgatttgctcctgtcgctcacccacttacgtcacatacttcttcaaaagtgctacgaatacacatacagagaatcagagatggggcttagctttacgaagctatttagccggctttttgccaagaaggagatgcgaattctgatggtgggtcttgatgctgccggaaagaccactattttgtacaagctcaagcttggagaaattgtcaccaccatccctactattggatttaatgtggagacagtggaatataagaacatcagcttcactgtttgggatgttggtggtcaagacaagattcgccctctgtggaggcattacttccagaacactcagggtcttatttttgtggtggatagtaacgacagagatcgaattgttgaggcaagggatgagttgcatagaatgttgaatgaggacgaactgagagatgctgtcttgcttgtctttgccaacaaacaagatcttcccaatgccatgaatgctgcagaaataactgacaagcttgggcttcattctctccgtcaacgccactggtacatccagagcacgtgtgcaacatctggagagggcctttatgaggggctggactggctgtcaaacaacattgctagcaaggcttgaaaacaaagctcatggattttggtggttgtctagacttacaagacttgcgactctggaaagcctatttatccccctttttgttcagagacggttgtaatagcagaatgtttgtttagatcctacttttataatatggtttgtgcaatctgtattagctagcgcttttaagaaaattataaatgacccaaacgcttttgtggttggcaagtattggttttcttctgggtgtttttatatccaatatcatattttagggaatctggaataattgggggtggggaacaggatatcaatgttttccatggaaacttgggtgttc

SEQ ID NO: 12751 - DNA, 608 bp, Ananas comosus
aaagagacatgggtttgacattcacaaagcttttcagccggctatttgccaagaaggagatgcgtatcctgatggtaggtcttgatgccgctggtaagaccaccatcctctacaagctcaagcttggtgagattgttactacaatccctactattggttttaatgtcgaaactgttgagtacaaaaacatcagctttaccgtgtgggatgttgggggtcaggacaagattcgtccattgtggaggcactatttccagaacacccagggtctcatttttgtggtggatagcaatgacagagaccgtgttgttgaggcaagagatgagttgcaccgcatgttgaatgaggatgaattgagggatgccgtattgcttgtctttgctaacaaacaagatcttcccaatgcaatgaacgctgctgaaataactgacaagcttggtctccactctcttcggcaacgccactggtacatccagagcacttgtgcaacttcaggcgagggtctctatgagggattggattggctctccaacaacattgcgaataaggcttgagttcggggattcatcttgtgggggattctggatgcagtttatcttatcttcttc

SEQ ID NO: 12752 - DNA, 658 bp, Ananas comosus
aaagagacatgggtttgacattcacaaagcttttcagccggctatttgccaagaaggagatgcgtatcctgatggtaggtcttgatgccgctggtaagaccaccatcctctacaagctgaagcttggtgagattgtgaccacaatcccaactattggctttaatgtcgaaactgttgagtacaaaaacatcagctttaccgtgtgggatgttgggggtcaggacaagatccgtccattgtggaggcactatttccagaacacccagggtctcatttttgtggtggatagcaatgacagagaccgtgttgttgaggcaagagatgagttgcaccgcatgttgaatgaggatgaattgagggatgccgtattgcttgtctttgctaacaaacaagatcttcccaatgctatgaatgctgctgaaataactgataaactcggtctccactctctccgacagcgccactggtacatccagagcacttgtgcgacctccggcgagggcctgtatgaggggttggattggctctccaacaacattgcaaataaggcttgagtacggggcaggcactggatggtttttatctagtctatttgtttccttccctttctttcatgccagacaatataccatgtcgatttcgtgttgttaagtgttac

SEQ ID NO: 12753 - DNA, 769 bp, Platanus occidentalis
agtctagttgtggtggacagctccttgagatctgctcgctcggttcgccgaacacagctttttccttcatatacgaaaatggggctgtctttcaccaagcttttcagtcgtttgtttgccaagaaagaaatgcgtattcttatggtgggtcttgatgccgctggtaagaccaccattttgtacaagcttaagttgggagagattgtcaccaccattccaacaattggatttaatgtggaaaccgtggaatataagaacattagcttcaccgtttgggatgtaggtggtcaggacaagatccggccattgtggagacattacttccaaaacacgcaaggtcttatctttgtggtcgacagcaatgaccgagaccgtgttgtcgaggctagggatgagctgcacagaatgttgaatgaggatgagttgagggatgcagtgctgcttgtttttgcaaacaagcaagatcttcctaacgcgatgaatgcggctgagatcactgataagcttggccttcactccctccgccaacgccactggtacatccagagcacatgcgccacttccggagaagggctgtatgagggattggactggctgtccaacaacattgctaacaaggcatagggtatggggtgctgacgtgttgggagtatagatattatttttattttagtctctggatgtattttctgtattccgttgaatgtgagcagaaaccgcgcttctgtattcgtttatggttatatatacattggcatttgtttcccga

SEQ ID NO: 12754 - DNA, 1621 bp, Oryza sativa
atgccgcccagaatatcgatcgcatcgaatccagtcaacttgctcggtgtgatcccacggcggcagccgcaagccgaagcatcggacggacagaaacgactgcatccgtccacgcgtgcggctcgtgacgacggtggtggggctcgcgttctctcccccagctatattatctcacacgactcgtgccacaccgcaccgcaccgcacccgcaagcgcaagcccagccgcctcgtcgtgttcgcgttcgtcgcgcggctccgacctccaaagccgccgctacccttcccgtcttcgtcgtcgccgcgcacgcagatcgcgaaccagcccgcgcgccgcgcagcagcgccgcggagaggaaaggagagctccgccgcgcaccccccgccaccatctcgtagggagagatggggctcacgttcacgaagctgttcagccgcctcttcgcgaagaaagagatgaggattctcatggtcgggctcgatgcagccggtaagaccaccatcctctacaagctcaagcttggcgagatcgtcacgaccatccccaccatcggatttaatgttgaaaccgtggaatacaagaacatcagcttcactgtttgggatgtcggtggccaggacaagatcaggcccctgtggaggcactatttccagaacacacagggactcatctttgttgtggacagcaatgatagggagcgtgttgttgaggccagagacgagcttcacaggatgctgaacgaggatgagctgcgtgatgctgtgctgcttgtatttgcaaacaaacaagatcttcctaatgccatgaatgcagctgaaatcactgacaagcttggtttgcattccctgcgccagaggcactggtacatccagagcacttgtgctacatctggtgaagggttgtatgagggtcttgactggctttccaacaacattgccagcaaggcttgagcgttttggcagctggatatctgaacaattcactagtgccggtttacatattatataacatatacaccctaccacacatagtgtgggtgcctgtgaaggaaaaaactcctttgtggaggctagtaccagattgttccttttcgtgggcactataagtgcttatattttgtttggttttacaacatttactgtgctgtccatatgtacccgtttgttctgagatggtctagtaaattgatatgctttgtcacggacttggtgtgagcattgtattttagtttttctatgatctagtgccagtgtagatattattttcctcagcttcaaacttccgtttttggttgtcgacatcgttgttgcgtcacggatgcttgcggtgaggaaagtgatgaggtatatggttttctgactgcatatgcccattggtaattgtgacattgatacgccattgctgggttgccacaaaccaacaggcccgattgcccactgggtgcgaggtttctgtgagacagaatcacaataagatgacatcagtcaagaataatttgtaggtcatgtagtatgggtatatacactatatacgttgagtacaggaaacacgcattcattgggatgttgtaggccttgtgcaaaatcttacgaaacaaatgccaaattgaatatctgtgtgt

SEQ ID NO: 12755 - DNA, 1195 bp, Panicum virgatum
cattcatattatacgactttctttccaggaaaagagctcgcgaagcgtcggttgcacgttggagcttcaaacgaggagcgcacgcccaccctctcctggacccgtcgcacgtgcaccggggactaccagcgcgccaacacccctgcagcccctcgtagaccgggtccaggccccgccccgccaaccctgccctcgcccacctcttgaagcccggaggcgccccccgcatcgggccactcgtttcattttcttcgccacgcccgaagccgaggaggagagggtaggggagcagcgggatcgcgcgcgcccgagatctcccggaagttgtggcaacatggggctcaccttcacgaagctcttcagccgcctcttctccaagaaggagatgaggatcctcatggtcggtctcgatgcagctggtaagaccaccatcctctacaagctgaagctcggggagatcgtcaccaccattcccacaatcgggttcaatgtggagactgtcgaatacaagaacattagctttactgtctgggatgtcgggggtcaggacaagatcagaccactgtggaggcactacttccagaacacacaaggtcttatctttgtcgttgatagcaatgacagagatcgtgttgttgaggcaagggatgagctccacaggatgctgaatgaggatgagttgagggatgctgtcttactcgtttttgctaacaagcaagatctgccaaatgcaatgaatgctgctgagataacagataagcttggtctccattccctgcgccaacgccactggtatatccagagcacctgtgctaccacaggagaaggtttgtacgagggtctggactggctctccaacaacattgcaaacaaggcctgattgtacaattctgcggtttcatggattacatgtcgattgcatcttccgcagaaacagacccatgggtcattttgaccttgagacttcagacttcattattatttcgttagaatgtttgtcaagtattgtatttctttgctaggcttttcagagctggttttctgttacattgtgtgattatactctctaaaatcctgttcggatatcaagacactgtaattggccattggcactagatcgtatactgagtaatgcagtttatttcaatgtatttgttattgtgcagtattgacgtacctgtacgttgtatttgcc

SEQ ID NO: 12756 - DNA, 1065 bp, Panicum virgatum
cccggaggcgcccccgcatcggcctctcgtctttttcttcgccccgcccgaagccgaggaggagacgggaggggagcagcgagatcgcgcgcgcccgagatctccaggaagttgtggcaacatggggctcaccttcacgaagctcttcagccgcctcttctccaagaaggagatgaggatcctcatggtcggtctcgatgcagctggtaagaccaccatcctctacaagctgaagctcggagagatcgtcaccaccattcccacaatcgggttcaatgtggagactgtcgaatacaagaacattagctttactgtctgggatgtcgggggtcaggacaagatcagaccactgtggaggcactactttcagaacacacaaggtcttatctttgtcgttgatagcaatgacagagatcgtgttgttgaggcaagggatgagctccacaggatgctgaatgaggatgagttgagggatgctgtcttgctcgtttttgctaacaagcaagatctgccaaatgcaatgaatgctgctgagataacagataagcttggtctccattccctgcgccaacgccactggtatatccagagcacctgtgctaccacaggagaaggtttgtacgagggtctggactggctctccaacaacattgcaaacaaggcctgattggacaattctgcgggtttgtggagtacatggcgattgcatcttccgcagaaacagacccatgggtcattttgaccttgagacttcattattatttcgttggaatgtttgtcattgtatttctttgctaggcgtttcagagagctggtttgctgttgcatcgcgtgattatactctctaaaaacctgttcggatatcaagacactgtaattggtcattggcactaggtcgtttactgagtaatgcagtttatttcaatgtatttgttattgtgcagtattgacgtacctgtacacgttgaatttgcctacaagtgtaccacttcctactctggtccgtgggtgccatactgccatacatcccaattaaactggagtggagggatgtcatcagtcaca

SEQ ID NO: 12757 - DNA, 901 bp, Raphanus sativus
ggaagcggaagctctctctctctttccttctctttcaaattccgttcgtcttcgtcgtcgtctctctatcagatatccgccgaagagtgaagaagcaaggatggggttgtcgttcgcgaagctgtttagcaggctttttgccaagaaggagatgaggattctcatggttggtcttgatgctgctggtaagaccaccattttgtacaagctcaagctcggtgagattgtcaccaccattcccactattggtttcaatgtggaaactgtggagtacaagaacattagtttcactgtgtgggatgtcgggggtcaagacaagatccgtcccttgtggaggcactacttccagaacacccaaggtctcatctttgtggtcgacagcaatgacagagaccgtgttgttgaggccagagatgaactgcacagaatgcttaatgaggatgagctgcgtgatgctgttctgctcgtgtttgctaacaaacaggatcttccaaatgccatgaacgctgctgaaatcactgataagcttggtctccactctctccgccagcgtcactggtacatccagagcacatgtgccacttcaggcgaggggctttacgaaggtcttgactggctgtccaacaacattgccggcaaggcatagagggaagatgcgtggttgagttgattttgctgggaaaatctggatgcagtagcaaacattatgtgatatttttttctatggtgttcttattgttctgtgtttttttctatggggatatgtggatttgattttgtggtcgttgttctgatttgtgtaaagagggtttctcttgtacgtagaacatagaaactaccttttactatagcttgtaatatcgaattatctacttctttcgttgtctttgttctgttgtca

SEQ ID NO: 12758 - DNA, 905 bp, Raphanus sativus
gggttcttaagctctctctctctccttctctttcaaattccattcgtcgtcgtctctctatcagatatcagccgaagagtgaagcaaggatgggtttgtctttcgcgaagctgtttagcaggctttttgccaagaaggagatgaggattctcatggttggtcttgatgctgctggtaagaccaccattttgtacaagctcaagctcggtgagattgtcaccaccattcccactattggtttcaatgtggaaactgtggagtacaagaacattagtttcaccgtgtgggatgtcgggggtcaagacaagatccgtcccttgtggaggcactacttccagaacacccaaggtctcatctttgtggtcgacagcaatgacagagaccgtgttgttgaggccagagatgaactccacagaatgcttaatgaggatgagctgcgtgatgctgttctcctcgtgtttgctaacaaacaggatcttccaaatgccatgaacgctgctgaaatcactgataagctcggtctccactctctccgtcagcgtcactggtacatccagagcacatgtgccacttcaggcgaggggctctacgaaggtcttgactggctgtccaacaacattgccggcaaggcatagagggaagatgcgtggttgagttgattttgctgggcaaatctggatgcagtggcaaacattatctgatatttttttatggtgttcttattgttctgtgttttctttggagtatgtggatttgattttgtgctcgttgttctgatttgtgtaaagagggtttctcttgtacgtagaacatagaaactgccttttactatagcttgtaatatcgaattatctactgctttcgtggtctttgttctgttgtcactttttcgagtcttaagtttg

SEQ ID NO: 12759 - DNA, 667 bp, Ambrosia trifida
tggtagtagtgatcgacagctccagatttcaaacaatatccacgtcacctttccgatagaacaatggggctgtcttttaccaagctgttcagtcgcttgtttgctaagaaggagatgcggattctgatggtcggtctcgatgcagctggtaaaaccaccatattgtacaagcttaagttgggggaaattgtcactactatccctactattggattcaatgttgaaactgttgaatacaagaacatcagctttaccgtgtgggatgttggtggtcaagacaagattcgacccttgtggaggcactacttccaaaacacacaaggtcttatctttgtggttgacagcaatgatcgtgaccgtgtagttgaggccagagatgagttacacaggatgcttaatgaggatgaactcagagatgcagtgttacttgtttttgccaacaagcaagatcttccaaatgcaatgaatgctgctgagatcactgacaaacttggcctgcattctctccgtcaacgacactggtatatccaaagcacatgtgccacctctggggaaggtctctatgagggattggactggctttccaacaacattgctaacaaggcttaaaagggactcacgtatgcatcgtataacgagtattgttagcattttatctatgttgaga

SEQ ID NO: 12760 - DNA, 976 bp, Ambrosia trifida
ccccttattttatttcacatacccccatttctcctctctctaatcgaatccatcgatcaatcgattgattgattgatccctctccaacaacaacaacctcttctcagggatcatcagtagcaaaacgatggggctaactttcaccaaactttttagccggctctttgccaagaaagagatgcgtatattgatggtcggtctcgatgcagctggtaagaccaccattttgtacaagcttaagctcggtgagattgtcaccactattcctaccataggttttaacgtggagactgttgagtacaaaaacattagcttcaccgtgtgggatgtcgggggtcaggacaagatacgtccgctatggaggcattacttccagaatacccaaggtcttatctttgtggttgatagcaatgacagggacagagttgttgaggcaagagatgaattgcacaggatgttgaacgaggatgagttaagagatgcagttctccttgtatttgctaacaaacaagatctcccgaatgcaatgaatgctgctgaaatcactgataagctcggtctccactctcttcgacagcgccactggtacatccagagcacttgtgcaacctcaggagagggactttatgagggactggactggctttccaacaacatagcaaacaaggcatgattggttatgcgggtggatgtttggcagtttctgttgtttgtttgaaaaatgtattttgctttctatataccattgttcgggttgcgagtatgtgctaggtagttggatgttatttttcaagttgtaagaggtttaagtttttgtggttgttagaagttgatgtagtttgtttacgcgtccgtttggtaaaacaattttattctaccagtttcttcaaattactcgacgccagatctgaaattgctcgttcaattttctgcttggttgtaaaggagcctttcatgcacaatggaatatcataaa

SEQ ID NO: 12761 - DNA, 999 bp, Arabidopsis lyrata
ttccgttttcgcaattatgcgttgttttgaagcttctctttcaaattctgttcgtctctcgcgatctctctctctctctcagatagctccggaactttgacgtagaggtaagtgaagcaggatgggtttgtcattcgccaagctttttagccggctttttgccaagaaggagatgcgaattctcatggttggtcttgatgctgctggtaagaccaccattttgtacaagctcaagctcggagagattgtaaccaccattcctactattgggttcaatgtggaaactgtggagtacaagaacatcagtttcacagtgtgggatgtcgggggtcaggacaagatccgtcccttgtggaggcactacttccagaacactcaaggtcttatctttgtggtggacagcaatgatagagaccgtgttgttgaggctagagatgaattgcacagaatgctgaatgaggatgagctgcgtgatgctgttctgctcgtgtttgctaacaaacaggatctcccaaatgctatgaatgcagctgaaatcactgataagcttggtctccactctctccgtcagcgtcactggtacatccagagcacatgtgccacttcaggtgaggggctttacgaaggtcttgactggttgtccaacaacattgccggcaaggcgtagagggaaagttcgtggccgagttgatttgctgagcaaatctggatgcaggggcaaacattatctgaattttttttgttggtttccgcttttgttattgttctgcttttttttttgggatatgtggatggattttgtgattgtacgtagaacttagaaaaactaccttttatatagttttggtaaaactgtaatcgaagattaatctactgctttcgtggtttctggcacattttacttttgcactttgattcatatgttggaatgcggtttcgtttacacacctgctacacgaaacttgatagttttgctagtattgtcatatgattcaagta

SEQ ID NO: 12762 - DNA, 890 bp, Arabidopsis thaliana
gtcgcgcatttagcgttgttttgaagctctctctttcaaattctgttcgtctctcgcgatctctctctctctctcagatagctccgaaactttcacgcagagttaagtgaagcaggatgggattgtcattcgccaagctttttagcaggctttttgccaagaaggagatgagaattctgatggttggtcttgatgctgctggtaagaccaccattttgtacaagctcaagctcggagagattgtaaccaccattcccactattgggttcaatgtggagactgtggagtacaagaacatcagtttcacagtgtgggatgtcggcggtcaggataagatccgtcccttgtggaggcattacttccagaacacccaaggtcttatctttgtggtggacagcaatgacagagaccgtgttgttgaggctagagatgaattgcaccgaatgttgaatgaggacgagctgcgtgatgctgttctgctcgtatttgctaacaagcaggatctcccaaatgctatgaatgcagctgagatcacggataagcttggtctccactctctccgtcagcgtcactggtacatccagagcacatgtgccacttcaggcgaggggctttacgaaggtcttgactggttgtccaacaacattgccggcaaggcgtagagggaaagttcgtggtggagttgatttgctgagcaaatctggatgcaggggcaaacattatctgaattttttttttggtttccgttttcgttattgttctgcttttttttttgggatatgtcgatggattttgtgattgtacgtagaacttagaaaaaaactaccttttatatagttttggtaaaactgtaatcgaagatttcacctactgctttcgtggttttggtc

SEQ ID NO: 12763 - DNA, 1094 bp, Aristolochia fimbriata
ggtgggaggcagctcgagatctgctcgttcggatcgcttaaaaccgtcttgttcctcccttatgcgtctatttttaaagtaaagatctactgagcatggctgcaatttaattttaacagatcgctgaagaatttacacgtagtaaactctcttcgacgacgtacaaagatggggttgtctttcacgaaactcttcagtcggctttttgccaaaaaagaaatgcgtatccttatggtgggtctcgatgcagctggtaaaacaaccattttgtacaagcttaagctgggagagatcgtgactactatccccaccattggattcaatgtggagacagttgaatacaagaacatcagtttcacagtgtgggatgttggtggtcaggacaagatccgaccattgtggagacactacttccaaaacacacaaggtcttatctttgtggtggacagcaacgatcgcgatcgtgttgttgaggcgagggatgagctgcacagaatgctgaatgaggatgagctgagggatgccgtgctgcttgtttttgctaacaagcaagatcttccaaatgcaatgaatgctgctgagatcactgataagcttggtcttcactctcttcgccaacgtcactggtacatccagagtacctgtgccacttctggggaaggtctgtacgagggattagactggctgtccaacaacattgctaacaaggcgtagaagacgtgctgattaagaggatgtttcaagttccgacgtactagtagagatattatttgggtcatctgttgagagagagctatacagtaccctcccccccacccccccaccctcttcagccgatttttactgttaattgaagaaccgtggcatttgttcttgtagactttgatgataataatttggaaatttgttctctagtgagatatggtctgttcttgttgaattttttgggcttgttcttttctagatttgtcacttaaatgtattctgtgaaattaattcttttacctaaaaggcacctctatcttttttccatgtgaagtgaggtcttaaaccgtgttataattcttaaggaaaggataaaagaaaatcaagag

SEQ ID NO: 12764 - DNA, 869 bp, Arnica chamissonis
ttgaaagcatcacacacttcggtggttcctcgaatatcgggccttcatataacaccttgtctgtttgatcgcctccacattttggtggtgctcctgatttcagacaatcttcatcatctttccggttgccggacgatcatacaaaaatggggctgtcttttaccaagctattcagtcgcttgtttgctaagagggagatgcgaattctgatggttggtcttgatgcagctggtaaaaccacaattttgtacaagctcaagttgggggaaattgtcaccactatccctactattggattcaatgttgaaaccgttgaatacaagaacatcagctttaccgtgtgggatgttggtggtcaagacaagattcgacctttgtggaggcactacttccagaacacacaaggtcttatctttgtggttgacagcaatgatcgtgatcgtgtagttgaggcccgagatgagcttcacaggatgcttaatgaggatgaattaagagatgcagtgttacttgtttttgccaacaagcaagatcttccaaatgcaatgaatgctgctgagatcactgacaagcttggcctgcattctctccgacagcgacactggtatatccagagcacatgtgccacttctggggaaggtctatatgagggactggattggctttccaacaacattgctagcaaggcttaaaagggactcgggtgtacaccgtatgacgagtatggttagcattttatctatgtttagaaggagtcggggatttcttcttgtaaaacactcgtatttcaatcaggtttcgtagacgatatacatcatcacatgtagaatctgtacgcgtttatttctgtaatatgatgttgtgtaata

SEQ ID NO: 12765 - DNA, 771 bp, Brassica juncea
gtgaattgacgtttttatcctttgcctctataaagcatcttctccattataacctcacggcgtcgcgcatttagcgttgctttgaagctctctctccttcgctttcaaactccgttcgtcgcctcgctcgtcgttacgcgatctctagagaagaagggatgggtttgtctttcgccaagctgtttagcaggctctttgccaagaaggagatgaggattctcatggttggtcttgatgctgctggtaagaccactatcttgtacaagctcaagctcggtgagattgtcaccaccattcccactattgggttcaatgtggaaactgtggagtacaagaacatcagtttcactgtgtgggatgtcgggggtcaggacaagatccgtcccttgtggaggcactacttccagaacactcaaggtctcatctttgtggtggacagcaatgacagagaccgtgttgttgaggccagagatgaactgcacaggatgcttaatgaggatgagctgcgtgatgctgttctgctcgtgtttgctaacaaacaggatcttccaaatgccatgaacgcagctgaaatcactgataagcttggtctccactctctccgtcagcgtcactggtacattcagagcacatgtgccacttcaggcgaggggctttacgaaggtcttgactggctgtccaacaacattgccggcaaggcgtagagagaaagtttgtggttgagttgattttgctgggcaaatctggatgcgggggcaaacattatctgag

SEQ ID NO: 12766 - DNA, 764 bp, Brassica oleracea
gtttctcttaagcttctctctctctctctcagagtttaaaaggacaagatggggttgagtttcgcgaagctgtttagcaggctctttgcaaagaaggagatgaggattctgatggttggtcttgatgctgctggtaagaccaccattctctacaagctcaagctcggtgagattgtcaccaccatccccactattggtttcaatgtggaaactgtggagtacaagaacatcagtttcactgtgtgggatgtcgggggtcaagacaagatccgtcccttgtggaggcactacttccagaacactcagggtctgatctttgtcgtggacagcaacgacagagacagagttgttgaggctagagatgaacttcacaggatgctcaatgaggatgagctgcgtgatgctgtgttgcttgtgtttgctaacaagcaagatcttccaaacgcgatgaatgccgctgaaatcacggataagcttggccttcactccctgcgtcagcgtcactggtacattcagagcacatgcgccacttcaggtgaaggactgtacgaaggtctggactggctgtccaacaacatcgctggcaaggcgtaatgaagtaaaacagcattgcatcgagatgattcttcctgctgtatgttggtaaagtttctggatgcaagagaaagcttataaatagtatatgaacctttttgctactggctattatatgaatgttctgattgtgcaagtatagatgtgtacctaaaaaccttatgagcccc

SEQ ID NO: 12767 - DNA, 910 bp, Vaccinium corymbosum
ccaaacacctgagaacaacatgggtttgacattcaccaagctcttcagtcggcttttcgccaagaaagagatgcgcatccttatggttggtctcgatgccgctggtaagaccaccattttgtacaagctgaagctgggggagattgtgaccaccattcccaccattggctttaatgttgagactgttgagtacaaaaatatcagcttcactgtctgggatgttggtggccaggacaagattcgcccattgtggaggcactatttccagaacacacagggtctcatttttgtggttgatagcaatgacagagaccgtgttgttgaggcaagggatgaattgcatcgcatgttgaatgaggatgagttgcgagatgcagtgttgcttgtgtttgctaacaaacaagatcttcctaatgcaatgaacgctgctgaaattactgacaagcttggtctccactctctccgacagcgtcactggtacatccagagcacctgcgcaacctctggggaggggctatacgagggattggattggctctccaacaacattgctaacaaggcttgaggtaacacggaacacattctggtggcatgatcctggatgcagggcggtttttatctatatcttttttcctgttttttgtcaaacaatctgtggttctgaattcgtttattggaaggcgtttcactttatcgagaatttcgcagttgatatgtctagtcgattgttgtgcggatataacatgttgtatttgttcttgggaatggttaggtttgattgaatatgagtatttgttcttgggaatggttaggtttgttcttgggaatggttaggtttgattgaatatgagtacttgttatagtaactgagattattttgttgctgacgttatttgagacagttttaatg

SEQ ID NO: 12768 - DNA, 1125 bp, Daucus carota
tctcgccctcatttatcgcgttggtctcaagctttcatctctgtctgtctattccacacacaaaacacgcaccagatccctctgctttcatctagggatccttacttgaaacgagaatggggctatcgttcactaagcttttcagccggctttttgccaagaaagaaatgaggattttgatggttggtcttgatgctgctggtaagacaactatattgtacaagctcaagcttggggagattgtgacaaccattcctactattggctttaatgttgagactgttgaatacaaaaacatcagctttacggtgtgggatgttggtggtcaggacaagattcgtccattgtggaggcactatttccaaaacacacaaggtcttatatttgtggttgacagcaatgatagagaccgagttgtggaggctagagatgagttgcatagaatgttgaatgaggatgagctacgagatgcagtgctactcgtatttgctaacaaacaagatcttccgaatgcaatgaatgctgctgaaataacagataagcttggtctccactctcttcgacagcgccattggtatattcagagcacctgtgcaacctcaggggagggactttatgaggggttggattggctttccaacaacattgctagcaagtcatgagcagatgcaaagttgtttgcagggagtggttatggatgcagaattattatctagttttttcttcttttggctccccacccacactatattagggtcgccaccactgtctttaaaccaaagctggacctaaacctgaccttcaagtggtcggaaagaatgccgggttatatatacgaattctggagacaataaatacttgtatgagtaatttgcaaatttgtaatataatgcttgtatgatgttgagacataattttccatcactttccgatttttggtagtttattccttattggtttctttcttattgcatgtcactgccacacattatgtcagtgaaaggaatattttgcttgttctgtgtatcacggcagctgaagtcgttcacaaatagttattatacatgcaccacatatttttggtggctttactgaaatacatacaatttgaaacttctagtctac

SEQ ID NO: 12769 - DNA, 896 bp, Catharanthus roseus
ttttgccaagggcagtccctcaagatctgcccccatttcaacgaaattcgatcaacctttgctctcttcgtccgattaatctcgatcgtctaagaaggaaggatgggtttgtcatttaccaagctcttcagcaggctctttgccaagaaggagatgcgcatattaatggtgggtcttgatgcggctggtaagactaccatattatacaagctcaagctgggagaaatagtgaccaccattccaacaattggttttaatgtggagactgtggaatacaagaacatcagctttaccgtctgggatgttgggggtcaggacaagattcgaccattgtggagacattacttccaaaatactcaaggacttatctttgtcgttgacagtaatgaccgtgaccgtgttgttgaagccagggatgaactgcacagaatgttgaatgaggatgaactaagggatgcagtcctccttgtgtttgctaacaagcaagatcttccaaatgcaatgaatgcagcagagatcaccgataagctcggtcttcattctctccgtcaacgccactggtatatccagagcacatgcgcaacatctggtgaggggctttacgagggtttggactggctctccaacaacattgccaacaaggcctagagcagcataatcaatccaatgattttgcagatgaatctttgtgaaagtggacagcgtatatttacttgtatttttcttttttgttattatcttgcttctgcaagacggaaacctcatattctgtttgattgtttgttgatgatacaatttggcattatgatcccatctagattcttcagactttactagtgtagagggagctttgttgttttggccttattcttcgttggctagtattatgaaagtta

SEQ ID NO: 12770 - DNA, 895 bp, Chrysanthemum coronarium
atttttctctctttgaaatcaaaatcaattaaaacttctcagggatcctcgctgaaaagaggatggggttaactttcaccaagctctttagccggctttttgccaagaaggagatgcgtattttgatggtgggtctcgatgcggctggtaagaccaccattttgtacaagctcaagctcggagagattgtcactaccatcccaaccattggatttaacgtggagactgtcgagtacaagaacatcagttttactgtctgggatgtcgggggtcaagacaagatccgtccactatggaggcactacttccagaacacgcagggtctaatctttgtggttgatagcaatgatagggatcgagttgttgaggcaagagatgagttgcacaggatgttgaatgaggacgagctaagagatgcagttcttcttgtgtttgccaacaaacaagatctgcctaatgcaatgaatgctgctgagattactgataagcttgggctccactctcttcgacaacgccactggtacatccagagcacctgcgctacttctggcgaaggactttatgaggggttggactggctctccaacaacattgctaacaaggcatgaggtgatgattaaattggatcatgaggttggaataccagcggcaagttttgcttttcatttggtcaggtcactttcgcgtctttcttgtggctggtgcgagcagttatggaactttgtttgttaaaaaggctttttgcatttgatatatagggggcgtgtatgatacaatgttgtgtggattgcaagtatttgcaaaggtatatgtcatgtttgtagcttttgattcatataacctaaagtgttcagagagatttaacgttgcatttttatatatgcttttcttaagc

SEQ ID NO: 12771 - DNA, 980 bp, Cirsium arvense
acgtcggtgttcctcgaatatcggccctttaataaaaccctctccgctttgatcgacggctaccgatttcaaacaatcttgcttcaccttttccggttgccggaagatcatacaattatacaaagatgggactgtcttttaccaagctattcagtcggttgttcgctaagagggagatgcgtatactgatggttggtctcgatgcggctggtaaaaccacaattttgtacaagctcaagttgggggaaattgtcaccaccatccctactattggattcaatgttgaaactgtggaatacaagaacatcagcttcactgtgtgggatgtcggtggtcaagacaagattcgacctttgtggaggcactacttccagaacacacaaggtcttatctttgtggtggacagcaatgatcgtgaccgtgtggttgaggccagagatgagctacacagaatgcttaatgaggatgaactaagagatgcagtgttgcttgtttttgccaacaaacaagatcttccaaacgctatgaatgctgctgagatcactgataagctcggcttgcattctctccgacaacgacactggtatattcagagtacatgtgccacctctggagaaggtctgtatgagggactggattggctttccaacaacattgctagcaaggcttaaaaagggatcatcaacagagagcatttgatggatgggtttgtttttggtttttatgtatgttgatctcatttctatcaagcaagcagcaggcagcttaattttttagagaatgaatgaatttgagtatgtatttctgtgacaaaaagcttctttttaaagtataattgtattcagactttggttttgtgtggtaattaatgcattgtgaaattgagattgaaagggtagtttttacattacatttgaagaatgttttatatctgtaatttttaaattctaccatgttacagttggtaataaaccatggga

SEQ ID NO: 12772 - DNA, 788 bp, Cleome gynandra
tcgcacatttagcgttacaaagattctctccttcatatttcgtctctcgctcttcctatctctctctcagatctctccgggattttcagaggatggggctgtctttcgccaagctctttagtcggctttttgccaagaaagagatgcgaattctgatggtaggtcttgatgccgctggtaagaccaccatattgtacaagctcaagcttggagagattgtgactaccattcctactattgggtttaatgttgaaactgtggagtacaagaacatcagtttcactgtgtgggatgttgggggtcaggacaagatccgtccattgtggaggcactactttcaaaacactcagggtcttatctttgttgttgatagcaatgacagagaccgagttgttgaggctagggatgaactgcatagaatgctgaatgaggatgagctgcgtgatgctgtgctgctcgtgtttgccaacaagcaggatcttccaaatgccatgaatgcagcagaaatcacagataagcttggcctccattccctccgccagcgccactggtacatccagagcacctgtgccacgtctggtgaggggttatacgaaggtctggactggctgtccaacaacattgcaaacaaggcctgaagagagcgaggctgtttttggccttatactatcttctttcttctttcttctttggctgttttgattgatcctttgtggggtttggtgcaagtgtctgtctttgtacttagaagtaccttttttaaatagttgccatattgtaattcaaaa

SEQ ID NO: 12773 - DNA, 770 bp, Cleome spinosa
acatttagcgttgccgcaaagcttctctgcctttcaaatttcgtctgctctcgctggtcattgcggggtctctcaccttctttctcccagatctctcgggaactttcttcagaggtaaagcaggatggggctgactttcgccaagctctttagtcggctttttgccaagaaggagatgcgaattctgatggtaggtcttgatgcagctggtaagaccaccattttgtacaagctcaagcttggagagattgtgaccaccattccaactattgggtttaatgttgagactgtggagtacaagaacatcagtttcaccgtgtgggatgttgggggtcaggacaagatccgtccgttgtggaggcactacttccagaatacccagggtcttatctttgttgtcgacagcaatgacagagaccgtgttgtcgaggctagggacgaactgcacagaatgctgaatgaggatgagctgcgtgatgctgtgctgcttgtctttgctaacaagcaggatcttccgaatgccatgaatgcggcagaaatcaccgataagcttggcctccattcgcttcgtcagcgtcactggtacatccaaagcacctgtgccacgtccggtgaggggctatacgaaggtctggactggctttccaacaacatagcgaacaaggcgtgaagacagagagagtgatggtgtttttggttttagtttcatcttctgtggatgtgttttggttgttggctgtgagcaagtgtacttgtacttataagtgtac

SEQ ID NO: 12774 - DNA, 1029 bp, Gossypium hirsutum
taaaataacactaaaggacggttcctttgatttcgagagtagatattcgctcgcttctctctttcgtcgaactccgcgtaataatcgctcatatttctcgcagacgtgaagaatggggctgtctttcacaaagctgttcagccggctttttgccaagaaggagatgcgtatattgatggttggacttgatgctgctggtaaaaccaccattctttacaagctcaagttgggagagattgtcaccacaattccaaccattggtttcaatgtggaaactgtggaatacaagaacatcagctttactgtctgggatgttggtggccaggacaagattcgtccattgtggaggcattacttccaaaacacacaaggactcatttttgtggttgatagcaatgatcgtgatcgtgtggtcgaagccagggatgagttgcacaggatgttgaacgaggatgagttgagggatgctgtgctgctggtatttgcaaacaagcaagatcttccaaatgctatgaatgctgccgagatcactgacaagcttggccttcattctctccgtcagcgccactggtacatacagagcacatgtgccacttccggtgaaggactgtatgagggactggattggctctcaaacaacattgcgaacaaggcttaaatgaaacaattgaaccgacggtcacactaacaatggccccattttgatgttctggatgtccatctcgttcaagtgttctggcttctttttttatatttcttattccctgcaaacattacccatttgtcacttgtagtttaaagaataatttgagtaaatttcgatttcctttgttgtattacctccatagctgcaaaaggaaagaaaaaggttttctcctagtttggggcagtttctacgttgtggcaaaattatatacataatctagtacaacttatgttgaagcagtacataaatcttgatgaatcccaaggttttgtggctttggagaatgctttggagaatggatttgatatgctccaaaatttgat

SEQ ID NO: 12775 - DNA, 932 bp, Gossypium hirsutum
aaacctaacgccttgaaggccccattctccgaaatcctcctaataaattaatcgattccaactttccactttcattttcctctttcaattctctgggcacccctctcagatcttccaatctctcaccatccagaataaaaggatggggctttcttttgctaagttgttcagtcgcctgtttgccaagaaggaaatgcgtattctgatggtgggtcttgatgctgctggtaagactaccatattatacaagttgaagctcggagagattgtcaccacgattcccactattgggtttaatgtggaaactgtggaatataagaacattagcttcaccgtttgggatgttggaggtcaggacaagattcgacctttgtggaggcactacttccaaaatactcaggggctaatctttgttgtggatagcaatgatcgtgatcgtgttgttgaggccagggatgagcttcaccgtatgctaaatgaggatgagctgagggatgctgtgctgcttgtatttgcaaacaagcaagatctaccaaatgctatgaatgctgctgagatcactgataaacttggtcttcattccctccgtcagcgccactggtatattcagagtacatgcgctacctctggtgaagggttgtatgagggtctggactggctctccaacaacatagctaacaaggcttgaggtggttggtagaaggtcggtgacatttacatttggggtagcaatctttgtggaattcggatatgtatatttctattttatgatacgttgcgttattggggttttgtttttttgtttttgctcgacaacttttaaatgaaatggatgagcttgtgtttagatatgctttgtagatggaattcattgttcagagttaattaacgaattcattgttgacatttcatagtaacatgttacatttttt

SEQ ID NO: 12776 - DNA, 895 bp, Vigna unguiculata
cctctctctttctgtcattctccgagaacaaaaatatctcgctccaactcttctcttgggaatcgagaagagcgaactggagtgagagacagagacgatggggttgtctttcacgaagctgttcagtaggttgttcgcgaagaaggaaatgaggattctgatggtaggtctcgatgctgctggtaagacaaccatcttgtacaagctcaagcttggagaaatcgtcaccactatccccactatcggatttaatgttgagactgtggagtacaagaacatcagcttcactgtgtgggatgttggtggtcaggacaagattcgtccactatggaggcattatttccagaacactcagggtctcatttttgtggttgatagcaatgatagagatcgagtggttgaggcaagggatgagttgcacaggatgctgaatgaggatgaacttagagatgctgttttgcttgtttttgccaacaagcaagatcttcctaatgcaatgaatgctgcagaaataaccgacaagcttggtcttcattcactccgtcaacgccactggtatatccagagcacttgtgcaacttctggagagggtctctatgagggtctggagtggctttccaacaacattgccagcaaggcgtgagacatttgaaaaaacttggttttgtcttgagatttcatgctagtctggcggttcttggagaaagatgcttatgttttatatggttaaggttgtaatagctgaacacttattgtaagtattgtattttgtgttaacttggttttgtatgaatgtttaaattagataatacttttagctataataattggaacttttgtttgtgttttgttagtttcatcatcgattggaatattttcattgagttttttcgaa

SEQ ID NO: 12777 - DNA, 920 bp, Vigna unguiculata
ctagatcgcgagcggcgccttttttctctctctctctactcgttcgagatccctcaagggatccgctagctgaaggagaaatggggttgacattcaccaagcttttcagtcggctttttgccaagaaggaaatgcgaattctgatggttggtcttgatgccgctggtaagaccaccatcttgtacaagctcaaacttggagagatcgttacaacaattcctaccattgggttcaatgtggagactgtggaatacaagaatattagcttcactgtttgggatgttggtggccaagacaagattcgtcccttgtggaggcactacttccaaaacacacagggtctgatatttgttgtagacagcaatgacagggacagagttgttgaggccagagatgagttgcataggatgttgaatgaggatgaactgcgagatgcagtattgcttgtatttgctaacaaacaagatcttcccaatgcaatgaatgctgctgaaattactgacaagctaggtcttcactctctcagacagcgccactggtacatccagagcacatgtgcaacctctggggagggtctttatgagggtttggactggctttccaacaacatagccaacaaggcttaggactttttgggagtcttcttgtggattggtaattctggatgcaggggtgaatattatctagtttgttttttggttctcttctgagacaaattggctttatgtttttatgttttccggtttattagggacacatcttgatggctaaaattatagtaggaatttgtttcatgggatgtctaatactttgagcttttttattgggtttggattcaatgtttataactgtaattgataccaatcaaggcgccatcccattttgagtttttatatcttaattttgataatattcctcct

SEQ ID NO: 12778 - DNA, 886 bp, Cucurbita pepo
tttttctgtctgtcgtagattctcggtggtgctcgttgaagagacagaatggggcttacgttcacaaagcttttcagtcggctttttgccaagaaagaaatgcgaattctgatggttggtcttgatgcggctggtaagacgactatcctctacaagctcaagcttggcgagatcgtgacaacaatccctaccatcgggtttaatgttgagactgtcgaatacaaaaacatcagcttcactgtctgggatgttgggggtcaagacaagattcgtcccttgtggaggcactacttccagaatacacagggtctcatatttgttgttgatagcaatgacagagatcgagttgttgaggccagggatgaattgcataggatgttgaatgaggatgagctgcgagatgcagttttgcttgtgtttgctaacaaacaagatcttcctaatgcaatgaatgctgctgagatcactgacaagcttgggctccactcgctccgtcagcgtcactggtacatccagagcacttgtgccacctctggagaggggctttatgaggggttggattggctctccaacaacattgctaacaaggcatgagcggtatcgaacagttgcttctgagactcacagttctggatgcagggtgaatattatctaattttttcatggggcaccttacaaagaggttatggtttttctgtttacgggagcttttttagcaaactatttgtcattatactgtaatatcagaatggttagccttggttattgtgtttggggctcttttttggggctttacttgcttgttattctcattcgatttctagctgaaactagttgatgtatcattccatgttggatttgtctcataaccaattcttttgttgtg

SEQ ID NO: 12779 - DNA, 839 bp, Cynodon dactylon
agtcagacagcgcgcgcccgagatctccacaaagttgcagcaacatggggctcaccttcacgaagctcttcagccgcctcttctccaaaaaggagatgaggatcctcatggtcggtctcgatgcggctggtaagacgaccatcctctacaagctcaagctcggagagattgtcactaccatccccacaatcgggttcaatgtggagactgttgagtacaaaaacattagcttcaccgtctgggatgtcgggggtcaggacaagatcagaccattgtggaggcactatttccagaacactcaaggacttattttcgttgttgatagcaatgacagagatcgtgttgttgaagcaagggatgaactccacaggatgctgaatgaggatgagttgagggatgctgtcttgctcgtttttgctaacaagcaagatctgcccaatgcaatgaatgctgctgaaatcaccgataaacttggtctgcattccctgcgccaacgccactggtatatccagagcacttgtgctacaacaggagaaggtttgtacgagggtcttgactggctctccaacaacattgcaaacaaggcctgattggacttgactgcggttttgtggaatacatgggcagttctgcagatatggagccatgggtcattttgaccaccagattataatttcgttggaatgtttgttgagtatttgtgtgtttcttgcctaggcttttaagagagctggattgttatgttgcgtaattactatctgaaaacatatattccaatattatgacactgtaattggccatatttagatcatttattactctgagtaatgcagtttatt

SEQ ID NO: 12780 - DNA, 1026 bp, Cynodon dactylon
ggggcaccgcaacgcagccacagcaatctcgtgtcgcgttcccggcgttgctcccgtctccagcgctccgcgcgcgggcgcagatcgcaagcctgaggttgcagggaggagaagggagagagagagctcgcagccgcggacagaggaggtcttcgccgccgtctcgagggtgagatggggctctcgttcaggaagctgttcagccgcctcttcgccaagaaggagatgaggatcttgatggttggtcttgatgctgctggtaagaccaccatcctctacaagctcaagctcggagagatcgttaccaccatccccactatcggattcaacgttgaaaccgtcgagtacaagaatattagcttcactgtttgggatgtcggtggccaggacaagatcagacccctgtggaggcactacttccagaacacccagggtctcatttttgttgtggacagtaatgacagggagcgtgttgttgaggctagagatgagctccataggatgctgaatgaggatgagctgcgtgatgctgtgctgcttgtgtttgcaaacaaacaagatcttcctaatgccatgaatgctgctgaaattacagacaagcttggtcttcattcacttcgccagcggcactggtacattcagagtacttgtgctacatctggtgaagggttgtacgaggggcttgactggctttccaacaacattgccagcaaggcttgaaagcatttcagcagggttcccagcaagatgtctgaacaacttactgcgccttttacatactataaactctataaacaactgatagtgcttgtgaagaaagagctccgagccctcttttcaggagctagtaccagcttattttttctttgtttgggtctattagagatttacagagtgtatgtacttgtattttcaaagatggtgtggtaaatcaaattgagatgctctgccgtacatatttgtggatttagtgctgtgcatgaaacgaattgcttattcatagaaaaaaagattacataactggca

SEQ ID NO: 12781 - DNA, 904 bp, Echinochloa colona
gactcgtctctttttcttcgccccgcccgaagccgaggagaggggagcggcgagatcgcgcgcgcgcccgagatctccaggaagttgtggcaacatggggctcaccttcacgaagctcttcagccgcctcttctccaagaaggagatgaggatcctcatggtcggtctcgatgcagctggtaagactaccatcctctacaagctgaagctcggagagatcgtcactaccatccccacaatcgggttcaatgtggagactgttgaatacaagaacattagtttcactgtctgggatgtcgggggtcaggacaagatcagaccactctggaggcactacttccagaacacgcaaggtcttatctttgttgttgatagcaatgacagagatcgtgttgttgaggcaagggatgagctccacagaatgttgaatgaggatgagttgagggatgctgtcttactcgtttttgctaacaagcaagatctgccaaatgcaatgaatgctgctgagattaccgataagcttggtctccattcgctgcgccaacgccactggtatatccagagcacctgtgctaccacaggagaaggtttgtatgagggtcttgactggctctccaacaacattgcaaacaaggcctgattggacaattctgcggtttcgtggagtatatggttgattgcatcttctgcagaaacatatccatgggtcattttgaccttgagacttgattattatttcgttggaacgtttgttaagtattgtatttctttgctaggcttttcagagagctggtttgttgttatgctgcgtgattactctctaaaaacctgttactatattaagacactgtaattggccagtggccctagatcgtttactgagtaatacagttcatttcaaggt

SEQ ID NO: 12782 - DNA, 845 bp, Eschscholzia californica
tcttccccaatcgattaatctttctgcatctttctcgcactagatcgatcacttacgaagctttctacagctaaataaacatggggttgacattcacaaagctttttagccggctttttgctaagaaagagatgcggattttaatggttggtctcgatgcagctggtaagactactattttgtacaaactcaaactcggagagattgtcacaacgattcctactataggatttaacgtcgagacagttgaatacaagaacatcagctttactgtatgggatgtcgggggtcaggacaagatccgtccattgtggagacactatttccaaaacactcaaggtttaatttttgtggtggatagcaatgatagagatcgagttgttgaggcaagggatgagctgcacaggatgttgaatgaggatgaattgcgagatgctgtgttgctcgtatttgctaacaaacaggatcttcctaatgcgatgaatgcggccgagataactgataagcttggtcttcactctcttcgtcaacgccactggtacatccagagtacatgtgcaacatctggagagggtctttacgagggtttggactggctgtctaacaacatagctaacaaggcttgaggcgattgaaaattggatctgattcatccatggatgcaggattatatgttttttagccttttatcctgagattttcgacatcattcttgcgtggagattgatttcggagaagggaacttttcatttcattttgctctggtaatagactttggagaacaaatacaataataggaaaatgactggttggtaagatgtatgtttgtaaggcatttgtttggg

SEQ ID NO: 12783 - DNA, 1012 bp, Euphorbia peplus
cgattgggacggaaagagagaaatatcagagacactacgtcatctcaccaatacctgcaatcacttctcatcgctaatccacttcagatccttcgccaatacagagctgagttggagaagtaaagatggggctgacctttacgaagctttttagccgtcttttcgctaagaaggagatgcgaattcttatggtgggtctcgatgctgctggtaagaccactatcttgtacaagctcaagcttggagaaatcgtcaccactattccaaccatcggttttaatgtggagacggtggaatacaagaacatcagcttcactgtgtgggatgttggtggtcaagacaagatccgtcctttgtggaggcattacttccagaacactcagggtcttatttttgtggtggatagtaatgacagggatcgagttgttgaggcaagggacgagttgcatagaatgttgaatgaggatgaacttcgcgatgctgtcttgctcgtgtttgccaacaaacaagatcttcctaatgcaatgaatgctgccgaaataactgacaagcttggccttcactctctccgtcaacgccactggtatatccagagtacatgtgcaacatctggagagggcctgtacgagggattggactggctgtcaaacaacattgcaaccaaggcttaaaatgaaaagctcaaggattttgcttttgagacttgcgattctggaaagcctgattccgcatttatgcagcgatttctggtacaagaatgttttgatctacttatgtcaagatatgggtttgtgctatcttagcttagtatatttatctcttgcagtttaaaatagaaatatagttgtctgacgctaatggtttgtctgggaatggcaagtactgattgtcacactggattttaaatcatagtgtattggagctcctttggcttgaatgatttatcaaatcaaagtgtgcttgatcactaaaatacactgtctttatatcaagttttgcctggtttctttgc

SEQ ID NO: 12784 - DNA, 905 bp, Festuca arundinacea
cgccgagatcaagagaggagcccgcatcggagcggagcgagctcgaggccggcgtcgccatctcggaggagagatggggctcacgttcggcaagctgttcagccgcctcttcgccaagaaggagatgaggattctcatggtcggtctcgatgccgctggtaagacaaccatcctctacaagctcaagctcggagagatcgtcaccaccatcccaaccatcggatttaatgttgagactgtcgaatacaagaacatcagcttcactgtttgggatgtggggggccaagacaagatcaggcccctgtggaggcactacttccagaatacgcagggactcatctttgttgttgacagcaatgatagggagcgtgttgttgaggccagagacgagctccacaggatgctgaatgaggatgagctgcgtgatgctgtgttgcttgtatttgcaaacaaacaagatcttcctaatgccatgaatgcggctgaaatcactgacaagcttggtctgcactcccttcgccagcggcactggtacattcagagcacttgtgctacatctggagaaggattgtacgagggacttgactggctctccaacaacattgccaacaaggcttgaagtgtctccacggctcttcaaggaacaaaggctctggttgtctgaagaactcactgctaccattttacatattgtgatatatatacatttacagcagatagtatatgtccttctgtgacaacagaagctctccttcgagtgagctagtatcagattgtttcttcgtgtgggtattatcagtgtttatgttccgttttacaaggtttactgtgtcaaccatgtgtttgtacccctatgcgtttgagatagtaaaattgaggtgcgttgactaaaaaaaaaaaaaaaa

SEQ ID NO: 12785 - DNA, 763 bp, Flaveria ramosissima
cctcatcaaaaaagccttttctctcagggatcatcatcagaaacaggatggggctcacattcaccaagctcttcagccgtctttttgccaagaaagagatgcgtatattgatggtgggtcttgatgcagctggtaagacaaccattttgtacaagctcaagctcggggagattgtgactaccatccctaccattggatttaatgtggagactgttgagtacaaaaacataagcttcactgtgtgggatgtggggggtcaggataagatccgtccactatggaggcactacttccagaacacacaaggtcttatctttgtggttgatagcaatgatagggatagagttgttgaggcaagagatgagttgcacaggatgttgaacgaggatgagctaagggatgcagttcttcttgtatttgctaacaaacaagatctgcctaatgcaatgaatgctgctgaaatcactgataagcttggccttcactctctccgacagcgccactggtacatccagagcacttgcgccacctctggggaaggactttacgagggtttggactggctctccaacaacattgctaacaaggcatgagggtgatgatcgacttgtaagaggttggaaaacctgaggcgagtttagcttttcgtttggtcaggtctctttcccgttctcatcagtgcgagcggttatgaaactttgtttgttaaacaggcttttgatttgatatatataggacatgttatggtacaatgtttgtcgtt

SEQ ID NO: 12786 - DNA, 901 bp, Flaveria ramosissima
ccccttattcatatctctctcctttcgaatcgatcgattgatccctcccgaacaagcttttctcagggatcctcactagcaagaggatggggctaactttcaccaaactcttcagccggctctttgccaagaaagagatgcgtatattgatggtgggtctcgatgcggctggtaagacaaccattttgtacaagctcaagcttggcgagattgtgaccactattcctaccataggttttaacgtggagactgttgagtacaaaaacattagcttcacagtgtgggatgtcgggggtcaggacaagattcgtccattgtggaggcactatttccagaacacccagggtcttatctttgtggtcgatagcaatgacagggacagagttgttgaggcaagagatgaattgcacaggatgttgaatgaagatgagttgagagatgcagttctgcttgtgtttgctaacaaacaagatctcccaaatgcgatgaacgctgctgaaatcactgataagcttggtctccactctctccgacagcgccactggtacatccagagcacttgtgcaacctctggagagggactttatgaaggattggactggctttccaacaacattgcaaacaaggcatgaggcgacagagggtggattgttggcagtttgtggtactggttttggaagttgttatttgaaagagtaatttgcttttgatataatacattgttttaagtttgactgaaagtatgtgttccggttggctattattctttaatctgaagttgagtttatgtggtggttagaactgttatgtagtctgtcggtatgctattattatatgatatggtaaattcagctacttaaaagaaatgttatcgaatgtaattttttctgttttgatttcg

SEQ ID NO: 12787 - DNA, 1143 bp, Setaria italica
gagcggccgcctgcaggaaaactcgtctctttttcttcaccccgcccgaagtcgaggagagggggagcaggagctgcgagatcgcgcgcgcccgagatctccaggaagttgcggcaacatggggctcaccttcacgaagctcttcagccgcctcttctccaagaaggagatgaggattctcatggttggtctcgatgcagctggtaagaccaccatcctctacaagctgaagctcggagagatcgtcaccaccatccccacaatcgggttcaatgtggagactgttgaatacaagaacattagcttcactgtctgggatgtcggcggtcaggacaagatcaggccactgtggaggcactacttccagaacacgcaagggcttatctttgttgttgatagcaatgacagagatcgtgttgttgaggcaagggatgagctccacaggatgttaaatgaggatgagttgagggatgctgtcttgctcgtttttgctaacaagcaagatctgccaaatgcaatgaatgctgctgagattaccgataagcttggtctccattcccttcgccaacgccactggtatatccagagcacctgtgctaccacaggagaaggtttgtacgagggtcttgactggctctccaacaacattgcaaacaaggcctgattggacaattctgtgggtttgtggagtacatggcggttgcattttcggcagaaacagatccatgggtcgttttgaccttgagacttgattattatttcgttggaatgcttgtcaagtattgtatttctttgctaggcttttcagagagctggtttgtccttatgtggcgtgattatactctccaaatacctgttccaatattaagacactgtaattggccattggtactagatcgtttaccagtaatgcagttcatttcaaagtattatgtcattgtgcagtatttgatattttgatgtacctgtacgtcgaatttgtcctacaagtgtacccctagccacactggtccgtgggtagcaggcattaagctgaagggatgttcagagtcacatcgtgtcattgtttatctggtgtttaagattacacctgcactgctgattcttcacttattcacgaagaaactgaattggttccggtga

SEQ ID NO: 12788 - DNA, 896 bp, Panax ginseng
aacgcagagtacatggggctctctctcacagcagaaacacagaaacgcattggatccctacctgcagactctacaaagggagggatcatttctcagaaacagaatggggctaacattcaccaagcttttcagccggctttttgccaagaaagaaatgcggattctgatggttggtcttgacgctgctgggaaaaccactatactgtacaagctcaagcttggggagattgtgacaacaatccctactattggctttaatgttgagactgttgaatacaaaaacattagcttcactgtttgggatgtcggaggtcaggacaagattcgtccattatggaggcactacttccaaaacacgcagggtcttatatttgtggttgatagcaatgatagagaccgagttgttgaggcgagggatgagcttcatagaatgttgaatgaggatgagctgcgagatgcagtgttacttgtatttgccaacaaacaagatcttccaaatgcaatgaatgctgctgaaataactgataagcttggcctccactcccttcggcagcgtcactggtacatacagagcacctgtgcaacctctggggaaggtctttatgaggggttggattggctttccaacaacattgctaacaaggcatgagctgatgtagacatttttttgatggagttgattctggatgcagggttattttatctagtctattttctttttctttccctctccaactctcagaattttctccctgtgggcaatgtttggtcatgagattcaaccaaagccaatttccttttgatttataaatagtatcttgatagaatggttcaaacgctcgtctagttttgggtgtaattttcatgactaatagcaaaagctaatttggtgttga

SEQ ID NO: 12789 - DNA, 1115 bp, Panax ginseng
ccataaaatgcctgatatgattgaagaattaattagcaggggacaacaggttgatgctgtacatttcacttatgaagttggccttgtggacaaattcccccctgttaccactgctgaaagcctttctgaaggatgctaaaaaggctgcaacttctattttggaggatccttaagcagtggtatcaacgcagagtacatggggctctctctcccagcagaaacacagaaacgcattagatccctacctgaagactctacaaagggatcatttctcagaaacagaatggggctaacattcaccaagcttttcagcaggctttttgccaagaaagaaatgcggattctgatggttggtcttgacgctgctgggaaaaccactatactgtacaaactcaagcttggggagattgtgacaacaatccctactattggctttaatgttgagactgttgaatacaaaaacattagcttcactgtctgggatgtcggaggtcaggacaagattcgtccattatggaggcactacttccaaaacacacagggtcttatatttgtggttgatagcaatgatagagaccgagttgttgaggcgagggatgagctgcatagaatgttgaatgaggatgagctgcgagatgcagtgttacttgtatttgccaacaaacaagatcttccaaatgcaatgaatgctgcagaaataactgataagcttggcctccactcccttcggcagcgtcactggtacatacagagcacctgtgcaacctccggggaaggtctttatgaggggttggattggctttccaacaacattgctaacaaggcatgagctgatgtagacgttttttgatggagttgattctggatgcagggttattttatctagtctattttctttttctttccctccaactctcagaattttctccctgtgggcaatgtttggtcatgagattcaaccaaagccgatttccttttgatttataaatagtatcttgatagaatggttctaacgctcgtctagttttgggtgtaattttcatgactaatagcaaaagctaatttggtgttgagaaaaattaaaaaaaaaaaaaaaaaaaaaaaaaaaaaaaaaa

SEQ ID NO: 12790 - DNA, 930 bp, Panax ginseng
gcttctttctcctctctctcacagcagaaacacagaaacgcattagatccctacctgaagacgctacaaagggagggatcatttctcagaaacagaatggggctaacattcaccaagcttttcagccggctttttgccaagaaagaaatgcggattctgatggttggtcttgacgctgctgggaaaaccactatactgtacaagctcaagcttggggagattgtgacaacaatccctactattggctttaatgttgagactgttgaatacaaaaacattagcttcactgtttgggatgtcggaggtcaggacaagattcgtccattatggaggcactacttccaaaacacacagggtcttatatttgtggttgatagcaatgatagagaccgagttgttgaggcgagggatgagctgcatagaatgttgaatgaggatgagctgcgagatgcagtgttacttgtatttgccaacaaacaagatcttccaaatgcaatgaatgctgctgaaataactgataagcttggcctccactcccttcggcagcgtcactggtacatacagagcacctgtgcaacctccggggaaggtctttatgaggggttggattggctttccaacaacattgctaacaaggcatgagctgatgtagacgtttttttgatggagttgattctggatgcagggttattttatctagtctattttctttttctttccctctccaactctcagaattttctccctgtggacaatgtttggtcatgagattcaaccaaagccaatttccttttgatttataaatagtatcttgatagaatggttcaaacgctcgtctagttttgggtgtaattttcatgactgtaatagcaagctaatttggtgttgagacatttgccccccctttcttatccactcacattagttcag

SEQ ID NO: 12791 - DNA, 1016 bp, Panax ginseng
gacaaattaaagctggtcagcttgtcttccttatttatccctcctcgctgacctttctcgctgccatatatacgcgttggtctcaagctttctttctcctctctctcccagcagaaacacagaaacgcattagatccctacctgaagacgctacaaagggagggatcatttctcagaaacagaatggggctaacattcaccaagcttttcagccggctttttgccaagaaagaaatgcggattctgatggttggtcttgacgctgctgggaaaaccactatactgtacaagctcaagcttggggagattgtgacaacaatccctactattggctttaatgttgagactgttgaatacaaaaacattagcttcactgtttgggatgtcggaggtcaggacaagattcgtccattatggaggcactacttccaaaacacacagggtcttatatttgtggttgatagcaatgatagagaccgagttgttgaggcgagggatgagctgcatagaatgttgaatgaggatgagctgcgagatgcagtgttacttgtatttgccaacaaacaagatcttccaaatgcaatgaatgctgctgaaataactgataagcttggcctccactcccttcggcagcgtcactggtacatacagagcacctgtgcaacctccggggaaggtctttatgaggggttggattggctttccaacaacattgctaacaaggcatgagctgatgtagacgttttttgatggagttgattctggatgcagggttattttatctagtctattttcttttctttccctccaactctcagaattttctccctgtgggcaatgtttggtcatgagattcaaccaaagccgatttccttttgatttataaatagtatcttgatagaatggttctaacgctcgtctagttttgggtgtaattttcatgactgtaatagcaaaagctaatttggtgttgagacattatcccccctttcttatccactcgcattagttcaagt

SEQ ID NO: 12792 - DNA, 901 bp, Panax ginseng
aagctttctttctcctctctctcccagcagaaacacagaaacgcattagatccctacctgaagactctacaaagggatcatttctcagaaacagaatggggctaacattcaccaagcttttcagccggctttttgccaagaaagaaatgcggattctgatggttggtcttgacgctgctgggaaaaccactatactgtacaaactcaagcttggggagattgtgacaacaatccctactattggctttaatgttgagactgttgaatacaaaaacattagcttcactgtctgggatgtcggaggtcaggacaagattcgtccattatggaggcactacttccaaaacacacagggtcttatatttgtggttgatagcaatgatagagaccgagttgttgaggcgagggatgagctgcatagaatgttgaatgaggatgagctgcgagatgcagtgttacttgtatttgccaacaaacaagatcttccaaatgcaatgaatgctgctgaaataactgataagcttggcctccactcccttcggcagcgtcactggtacatacagagcacctgtgcaacctccggggaaggtctttatgaggggttggattggctttccaacaacattgctaacaaggcatgagctgatgtagacgttttttgatggagttgattctggatgcagggttattttatctagtctattttctttttctttccctccaactctcagaattttctccctgtgggcaatgtttggtcatgagattcaaccaaagctgatttccttttgatttataaatagtatcttgatagaatggttctaacgctcgtctagttttgggtgtaattttcatgactgtaatagcaaaagctaatttggtgttgagacattatcccccc

SEQ ID NO: 12793 - DNA, 1055 bp, Gossypium raimondii
gtgtaaaataacactaaaggacggttcctttgatttcgagagtagatattcgctcgcttctctctttcgtcgaactccgcgtaataatcgctcatatttctcgcagacgtgaagaatggggctgtctttcacaaagctgttcagccggctttttgccaagaaggagatgcgtatattgatggttggacttgatgctgctggtaaaaccaccattctttacaagctcaagttgggagagattgtcaccacaattccaaccattggtttcaatgtggaaactgtggaatacaagaacatcagctttactgtctgggatgttggtggccaggacaagattcgtccattgtggaggcattacttccaaaacacacaaggactcatttttgtggttgatagcaatgatcgtgatcgtgtggtcgaagccagggatgagttgcacaggatgttgaacgaggatgagttgagggatgctgtgctgctggtatttgcaaacaagcaagatcttccaaatgctatgaatgctgccgagatcactgacaagcttggccttcattctctccgtcagcgccactggtacatacagagcacatgtgccacttccggtgaaggactgtatgagggactggattggctctcaaacaacattgcgaacaaggcttaaatgaaacgattgaaccgacggtcacactaacaatggccccattttgatgttctggatgtccatctcgttcaagtgttctggctttctttttttatatttcttattccctgcaaacattacccatttgtcacttgtagtttaaagaataatttgagtaaatttcgatttcctttgttgtattacctccatagctgcaaaaggaaagaaaaaggttttctcctagtttggggcagtttctacgttgtggcaaaattatatacataatctagtacatcttatgttgaagcagtacataaatcttgatgaatcccaaggttttgtggctttggagaatggatttgatatgctccaaaatttgatgaaaatttatatattcaattgtaagagtggtttt

SEQ ID NO: 12794 - DNA, 897 bp, Gossypium raimondii
ctttccactttcattttcctctttcaattctctgggcacccctctcagatcttccaatctctcaccatccagaataaaaggatggggctttcttttgctaagttgttcagtcgcctgtttgccaagaaggaaatgcgtattctgatggtgggtcttgatgctgctggtaagactaccatattatacaagttgaagctcggagagattgtcaccacgattcccactattgggtttaatgtggaaactgtggaatataagaacattagcttcaccgtttgggatgttggaggtcaggacaagattcgacctttgtggaggcactacttccaaaatactcaggggctaatctttgttgtggatagcaatgatcgtgatcgtgttgttgaggccagggatgagcttcaccgtatgctaaatgaggatgagctgagggatgctgtgctgcttgtatttgcaaacaagcaagatttaccaaatgctatgaatgctgctgagatcactgataaacttggtcttcattccctccgtcagcgccactggtatattcagagtacatgcgctacctctggtgaagggttgtatgagggtctggactggctctccaacaacatagctaacaaggcttgaggtggttggtagaaggtcggtgacatttacatttggggtagcaatctttgtggaattcggatatgtatatttctattttatgatatgttgcgttattggggttttgtttttttgtttttgctcgacaacttttaaatgaaatggatgagcttgtgtttagatatgctttgtagatggaattcattgttcagagttaattaacgaattcattgttgacatttcatagtaacatgttacattttttacttgttccattatcaatactatgtt

SEQ ID NO: 12795 - DNA, 963 bp, Humulus lupulus
aacttttaaaaaatcgtggccttcgtttcttattttttctttctcctgttggatccttcttctcacccagaattcagagctaaggaaagggtgaacgtacaaattcagaaatgggactgacatttacaaagctcttcagcaggctttttgccaagaaagagatgcgaattctgatggtgggtcttgatgccgctggtaagaccaccatcttgtacaagctcaaacttggagaaatcgtcaccaccatccccacaattggatttaacgtagagacagtggagtacaagaacattagcttcacagtgtgggatgttgggggtcaggacaagatccgcccactgtggaggcactatttccagaacactcaagggcttatttttgttgttgatagcaatgatagggatcgagttgttgaggcaagagatgagttgcaccggatgttgaatgaggatgaactgagagatgctgttttgctcgtattcgccaacaaacaagatcttcctaatgcaatgaatgctgcagaaataacagacaagcttggtcttcattctcttcgtcaacgccactggtacatccagagtacatgtgcaacctccggggaaggtctgtacgaagggttggagtggctatccaataacattgctagcaaggcatgagagttgagacagttgtaagattttcgtgttttgccagacgcctatgggaagaatggttttctttaattaagtgaatattgtaatagcagaccctctggctcaactttaatgtaattcaggtttcgtaagcatcatctttagctatactttttacttgtttagttgtaagcaaaagctgttatgttacaatagcattatgtatgagtcgctttcaggtacaggttcatcttgtttgctctttttgatgcctggtttactttttaaattgttataggctgtagaatggctatatatagatcatgtgtgg

SEQ ID NO: 12796 - DNA, 831 bp, Lupinus angustifolius
ctctctctacgttctctgttctcagatcccaaaagggatccttaagctgaagcagaaatggggctgacgttcactaagcttttcagtcggctttttgccaagaaggaaatgcgtattctcatggttggtctcgatgcggctggtaagaccaccattctgtacaagctcaagcttggagagattgttacaacaattcctaccattgggttcaatgttgagactgtggaatacaagaatattagcttcactgtttgggatgttgggggccaggacaagattcgtcccttgtggaggcattacttccagaacacacagggtcttatattcgtcgttgacagcaatgacagggacagagttgttgaggccagagatgagttgcataggatgttgaatgaggatgaactgagagatgcagtcttgcttgtatttgctaacaaacaagatcttcccaatgcaatgaatgctgctgaaattactgacaagctgggtctccactctctcagacagcgccactggtacatccagagcacctgtgcaacctctggtgagggtctttatgaaggcttggactggctttccaacaacatagcgaacaaggcttaaagcttttgtggagtcttgtggattggtaattctggatgcaggggtgaatattatatagtttgatttttgatcctgtcttgagacaaattggatttatgttcatgttttgtggtttaggacatattggtggccataattatagggatttgttttaatgggatgtctaatactattggttttggattcaatgtttataactaatgaataccaattaaatgcgccaccaat

SEQ ID NO: 12797 - DNA, 1232 bp, Pinus pinaster
aggacctttgccccgcaaaaggcggtttgttcacatgcaacgccatcacggtagcagactactgtaaccacagtcaaccgtccgatcgacgagcgaaggaacctatttcttcccgcaagtctctatatccagccctcctcctccccttttcggcagcagtgctaggtgttcgagaggcgtctcagatctctttgcggggagccattcttgtcccctcgaatctcagatctgacccttcaactcgggatctctaacaggtggtcaagatgggactcacttttaccaagctttttagtcggctcttcgcaaagaaggaaatgcgcattctgatggttggtctcgatgccgctggtaagacgaccatcttgtataagctgaagctgggagaaatcgttacgaccatccctaccatcggattcaatgtggaaaccgtcgagtacaagaacatcagcttcactgtgtgggatgttgggggtcaggacaagatccgtccactttggagacactacttccaaaatactcagggtctcatctttgtggttgatagcaatgatagagaccgtgttgtagaagcaagggatgaactacatagaatgctgaatgaggatgaactacgtgatgctgtattgcttgtgttcgcaaataagcaagatcttccaaatgctatgaatgctgcagagataactgacaaacttgggctgcattccctcaggcagcgccactggtatatccaaagcacttgtgccacttctggcgagggcttgtatgagggcttggattggctctctaacaacattgcaaacaaggcttgaagaaatatggtgaactgggttcctggaattttgtagggcaatgtcgtcttatttcatttttgtcagagacagtttgaagaaataagtgcagtcaaactgacttttgactactattcaatttcttctatgggtttgattgtgccaatctgctaggaatgaactaatttatatatagctcattatgcttaaatggcaaagcatgagtagttattataaatgtatttgatgattatgatattgccttttgtgtggggagcatagacattactataggaatgttccggctgatttgaaacttgtattcttatttctagctttattgtctcatattacactcaaattcattctaccagataataaatacacaggttggtttgtaattttggcatacattattgaaattcttttagctgtgtttat

SEQ ID NO: 12798 - DNA, 933 bp, Avena sativa
ctgaccgcacccgcacgacagccacaccctcccgttgcatccgtgcgagttccaagctcgccccgtctccgccgagatcaggagacgagcccagcagcggagcggagcgagctcgaagccgtcgtcgccacctcgagcaggagcagagatggggctcacgttcggcaagctgttcagccgcctcttcgccaagaaggagatgaggattctcatggttggtctcgatgcggctggtaagaccaccatcctctacaagctcaagctcggagagatcgtcaccaccatcccaaccatcggatttaacgtcgagactgtcgaatacaagaacatcagcttcactgtctgggatgtggggggtcaagacaagatcaggcccctgtggaggcactacttccagaatacgcagggcctcatctttgttgttgacagcaatgatagggagcgtgttgttgaggctagagacgagctccacaggatgctgaatgaggatgagctacgtgacgctgtgttgcttgtatttgcaaacaaacaagatcttcctaatgccatgaatgcggctgaaatcactgacaagcttggtctgcactccctgcgccagcggcactggtacattcagagcacttgtgctacatctggtgagggattgtacgagggacttgactggctctccaacaacattgccaacaaggcttgaagcgtctcagacaacgcctcaaggaacaaaggcactcgcggtctcaagaactcactgctaccattttacattttgtgatatatatatacactctacaacagatagtatgtgtccttgtgtgaggacagaagctctcctttgtgtgggggctagtatcaggttgtttcttcgtgtgggtattatcagtgtttctgttcgattttacaaggtttactgtgtcaacaatgtctatgtacccc

SEQ ID NO: 12799 - DNA, 963 bp, Avena sativa
acccgcacgacagccacaccctcccgttgcatccgtgcgagttccaagctcgccccgtctccgccgagatcaggagacgagcccgcagcggagcggagcgagctcgaagccgccgtcgccacctcgagcaggagcagagatggggctcacgttcggcaagctgttcagccgcctcttcgcaaagaaggagatgaggattctcatggttggtctcgatgcggctggtaagaccaccatcctctacaagctcaagctcggagagatcgtcaccaccatcccaaccatcggatttaacgtcgagactgtcgaatacaagaacatcagcttcactgtttgggatgtggggggtcaagacaagatcaggcccctgtggaggcactacttccagaatacgcagggcctcatctttgttgttgacagcaatgatagggagcgtgttgttgaggctagagacgagctccacaggatgctgaatgaggatgagctacgtgacgctgtgttgcttgtatttgcaaacaaacaagatcttcctaatgccatgaatgcggctgaaatcactgacaagcttggtctgcactccctgcgccagcggcactggtacattcagagcacttgtgctacatctggtgagggattgtacgagggacttgactggctctccaacaacattgccaacaaggcttgaagcgtctcagacaacgcctcaaggaacaaaggcactcgcggtctcaagaactcactgctaccattttacattttgtgatatatatatacactctacaacagatagtatgtgtccttatgtgaggacaaaagctctcctttgggtgggctagtatcagattgtttcttcgtgtgggtattatcagtgtttctgttcgattttacaaggtttactgtgtcaaccatgtgtatgtacccctatgttttcgagatatagtaaaattgcggtgtcgttgccca

SEQ ID NO: 12800 - DNA, 809 bp, Parthenium argentatum
gtggtggtgatcgacggctccagattttaaacaatatccacgtcacctttccggtgaccgacgttcattcaacaatggggctgtcttttaccaagctattcagtcgcttgtttgctaagaaggagatgcgaattctgatggtcggtcttgatgcagctggtaaaaccacaatattgtacaagctcaagttgggggaaattgtcactactattcctactattggattcaatgttgaaaccgttgaatacaagaacatcagctttactgtgtgggatgttgggggtcaagacaagattcgacctttgtggaggcactacttccaaaacacacaaggtcttatctttgtggttgacagcaatgatcgtgaccgtgtagttgaggccagagatgagttacacaggatgctaaatgaggatgaactaagagatgcagtgttacttgtttttgccaacaagcaagatcttccaaatgcaatgaatgctgctgagatcactgacaaacttggcctgcattctctccgacaacgacactggtatatccagagcacatgtgccacctctggggaaggtctctatgagggattggactggctttccaacaacattgctaacaaggcttaaaagggacccgcgtatgcatcgtataatgagtattgttagcattttatctatgttgataaggactcggggatttcttcttgtcaaacactcgtattttgatcagttttcatagacaatataatcatcacatgaatctgtacggctttgtttatgtaatatgatgtttgataataagtatcttttttctgt

SEQ ID NO: 12801 - DNA, 926 bp, Lippia dulcis
cttttcgctggttggagagatctttgcctgaagagatctctactgcgctcaatccttgccgctcatcttctatttgcagaatggggttgtcattcaccaagctgttcagcaggctctttgccaagaaagagatgcgtatactgatggtgggtctcgatgctgctggtaaaacaaccattctctacaagctcaagctaggagaaattgtcaccacaattcctactattggattcaatgtggagactgtggaatacaaaaatattagcttcactgtctgggatgttggaggccaggacaagatccgtcctttgtggaggcattatttccagaacactcaaggcctcatctttgttattgacagcaatgacagagatcgtgtcgttgaagctagggatgaacttcacaggatgttgaatgaggatgaattaagggatgctgttctcttggtgtttgcaaacaaacaagatcttccaaatgccatgaatgctgctgaaatcactgacaagctgggtcttcattccctccgccaacgtcattggtacattcagagcacatgtgcaactactggtgaagggctctatgaagggctggactggctttcaaacaatattgctaacaaggcttgaagccctcgattctgggcgacaatatattgagggtcttcattcttgtcgctttgaacttctttgaagcattatgttcccaaccttgcctccagttgagaaccctggcatctatccattgtagtttataactgtagatttttgtcaatctcgtggatttgcttattcctatgcttattcctgtttttgaaagtaggagcaacctgtgtaatgaactcgccatggataataatcatttcactttgagggtgttctttttctccatacggatgtaataatgaagtttacttgttcgaaaaagaa

SEQ ID NO: 12802 - DNA, 599 bp, Ananas comosus
ttctctctagatctctctgaaaacaccctccggcagggatccattgaaaaagatggggttgacattcacaaagcttttcagtcggctctttgccaagaaagagatgcgcatccttatggttggtctcgatgctgctggtaagaccacaattttgtacaagctcaagcttggagagatagtaaccacaattcccaccattggcttcaatgtcgagactgttgagtacaaaaacatcagcttcacagtgtgggatgtcgggggtcaggacaagatccgtccattgtggaggcactatttccagaacacccagggtctcatttttgtggtggatagcaatgacagagaccgtgttgttgaggcaagagatgagttgcaccgcatgttgaatgaggatgaattgagggatgccgtattgcttgtctttgctaacaaacaagatcttcccaatgcaatgaacgctgctgaaataactgacaagcttggtctccactctctccgacagcgccactggtacatccagagcacttgtgcaacttcaggcgagggtctctatgagggattggattggctctccaacaacattgcgaataaggcttgag

SEQ ID NO: 12803 - DNA, 817 bp, Platanus occidentalis
taccctctctctctcaaaatcgacctcctgctaagtgccttaaactttgaaggtactccacagccaaaatggggctgactttcaccaagctttttagccggctgtttgccaagaaagagatgcgtattctgatggtcggtcttgatgcagctggtaagactaccatcttgtacaagctcaagctgggtgagattgtcacaacaattcccactattggattcaatgtggagactgtggagtacaagaacatcagcttcactgtttgggatgttggtggccaagacaagatccgtccattatggaggcattatttccaaaacactcagggtcttatatttgtggttgatagcaatgacagagatcgagtcgttgaggcaagggatgagttgcataggatgttgaatgaggatgagttgcgagatgctgtattgcttgtatttgctaacaaacaagatcttcctaatgcaatgaatgctgcagagataactgataagcttggccttcactctctccgccaacgccactggtacatccagagtacttgtgcaacctcaggagagggcctttatgagggattggactggctctccaacaacattgctaacaaggcttaaggcaaaggatgatcctggatggtggggttgttctggatgtgtgggaaaatactgtcttgggctacttttctgagacaggtgaacttgtggttgtggtgatgacctaaaaacatatctttctttttgagatttttgtggtatgttgtaaaagattggatggttggatataatattactttatctagtctgtttggctgttaatg

SEQ ID NO: 12804 - DNA, 828 bp, Papaver somniferum
aattttctctttcttctctttagatcctttctcaaaagaggatcaatagtgaagcagagatgggtcttacattcacgaagcttttcagtcggctttttgccaagaaagagatgcgtattctgatggttggtctcgatgccgctggtaagactacaatattgtacaagctcaagctgggagagattgtcacaactattcctaccattggttttaatgtggagacggtggaatacaagaacatcagcttcactgtttgggatgtcggaggtcaggacaagatccgtccattgtggaggcactacttccaaaacacacaaggattaatatttgtggtggatagcaatgacagagatcgagttgtcgaggctcgtgatgagttgcacaggatgttgaatgaggatgagttgcgagatgctgtgttgctcgtattcgctaacaaacaggatcttcctaatgcaatgaatgctgccgagatcactgacaagcttggtcttcactcactccgccaacgccactggtacatccagagtacatgtgcaacctcaggagaaggtctgtatgagggtttggactggctttccaacaacattgctaacaaggcttgaggcagttgaaggttgtgtattggttggttgcttatgctgaagggacatttcttcttcttttttgccgtactgactaatgttgcaataggataaaatgaatgtctggttcggatatttgtttgtttttttgtttaaagaaggatttatattggatttaagttactatttttagctaatactttttctgtaattgagtctctatggttaatatcatctctttata

SEQ ID NO: 12805 - DNA, 932 bp, Chenopodium quinoa
aaaaaacttgataaacgggcagcttattcaagatctgcccgccgtcccttgttgaagccctagctcaattttctctctctactttatttgaaggaaaaatggggctttcattcacgaagctgttcagtaggttatttgcgaagaaagagatgagaatattgatggtgggtctcgatgcggctggtaagactaccattttgtataagctcaagctcggtgagattgttaccaccattcctaccattggattcaatgttgagacagtggaatacaaaaacattagctttacagtgtgggatgttggaggtcaggacaagattcgacctttatggagacattactttcaaaacacccaaggactcatctttgtggtggatagtaatgatcgtgatcgtgtggttgaggcaagggatgagctgcatagaatgttgaatgaggatgagttgagggatgctgtcctgttggtctttgccaacaagcaagatcttccaaatgcaatgactgctgcagaaattactgataagcttggtcttcattcccttcgtcagcgtcactggtatatccagagcacatgcgccacttctggtgaaggtctttacgagggattggactggctgtccaacaacattgccagcaaggcctagatgaaggatccgcctggctgagcttaggatatatggtggattttgaagcaccctgtttatgtgggagataatatcgagcttttggcctttgttttttgtttgctatgttaaaaaagatcacaagagtggttgtgttaatgtgattatgcttatgaaggttttgttatgatcatagaaattgctatatgatatcaatacttttgtagattcagaataactaaaatgtatctcaggaaagagtttgtttcatgttgatatatactgtgaccgcgatattctttggaacaa

SEQ ID NO: 12806 - DNA, 924 bp, Raphanus sativus
ggggttttgaagctttcttctctctctctcgcgttcaaactccgtctcgctgttacgccatctctctctcaatcgatcagatcgtctacacagagtgaagcaaggatgggattatcgttcgcgaagctatttagcaggcttttcgccaagaaggagatgaggattctcatggttggtcttgatgctgctggtaagaccaccattttgtacaagctcaagctcggtgagatcgtcaccaccatccccactattgggttcaatgttgagactgtggagtacaagaacatcagcttcactgtctgggatgtcgggggtcaagacaagattcgtccattgtggaggcactacttccagaacactcaaggtctcatctttgtggtggacagcaatgacagagaccgtgttgttgaggctagagatgaattgcacagaatgctcaatgaggatgagctgcgtgatgctgttttgctcgtgtttgctaacaagcaggatcttccaaatgctatgaacgcagctgaaatcactgataagcttggtcttcactctctccgtcagcgtcactggtacatccagagcacatgtgccacttcaggcgaggggctttacgaaggtcttgactggctgtccaacaacattgccggcaaggcgtagagagaaagtttgtggttgagttgattttgctgggcaaatctggatgcaggggcaaaacattatctgagttttttttcggttttcttatattgtttttcttttttttttcgggtatgtgaattgattttgtgatcgttgttataacttgagtaaggaggggaggggcctcttgtacgtagaacacagaaactactttattacatatatagcttgttatcgaagatttatgctactgctttcttcttcccatttttacttttgcatttcgattca

SEQ ID NO: 12807 - DNA, 915 bp, Raphanus sativus
ggggtttcgtcgtcgtctcgcatctcgcgtatctcttaagcttctctctctctcagatctctcggttagtgaaagatggggttgagtttcgcaaagctgtttagcaggctctttgcaaagaaggagatgaggattctgatggttggtcttgatgctgctggtaagactactattctctacaagctcaagctcggtgagattgtcaccaccatccccactattggtttcaatgtggaaactgtggagtacaagaacatcagtttcactgtgtgggatgttgggggtcaggacaagattcgtcccttgtggaggcactacttccagaacactcagggtctgatctttgtcgtggacagcaacgacagagacagagttgttgaggctagagatgaactgcacaggatgctcaatgaggacgagctgcgtgatgctgtgttgctagtgtttgccaacaagcaagatcttcctaacgcgatgaatgcagctgaaatcacagataagcttggtcttcactccctgcgtcagcgtcactggtacattcagagcacatgcgccacttcgggtgaaggactgtacgaaggtctggactggctgtccaacaacatcgctggcaaggcgtaatgagggtgagttgcattttgcatcgagatgattgtatctgctgtgatgcaagaaaacattataaatattatctgaacctttttgcatattgggtatgtgaatgttttgattgtgcaagtagatgtcttgtctctaaaacttactagaagaacccatttaaataagttttcctgtattttgtttgaatatgaatgttattttcctttggcgtatttatttgtaagcgtcatacgttattttgtaccatagatacatcaaaatgttattttgcttacgtctctggacccgggtgta

SEQ ID NO: 12808 - DNA, 896 bp, Raphanus sativus
ggcctcgtcgtctcgcatctcgcgtttctcttaagcttcgctctcagatctctcggttatattctacagaggtacgctttcacgatctggatctgagcttttgcattctcagtaaaagatggggttgagtttcgcaaagctgtttagcaggctctttgcaaagaaggagatgaggattctgatggttggtcttgatgctgctggtaagaccactatcttgtacaagctcaagctcggtgagattgtcaccaccatccccactattggtttcaatgtggaaactgtggagtacaagaacatcagttttactgtgtgggatgtcgggggtcaggacaagatccgtcctttgtggaggcattacttccagaacactcagggtctgatctttgtcgtggacagcaacgacagagacagagttgttgaagctagagatgaactgcacaggatgctcaatgaggacgaactgcgtgatgctgtgctgcttgtgtttgccaacaaacaagatcttcctaatgcgatgaatgcagctgaaatcactgataagcttggccttcactccctgcgtcagcgtcactggtacattcagagtacatgcgccacttcaggtgaaggactgtacgaaggtctggactggctgtccaacaacatcgctggcaaggcgtaatgagggtgatgttcatttgcatcgagatgattgtatctactgtgatgcaaagaaacgattataaatattatctggacctttttgatattgggtatgtgaatgtttttgattgtgcaagtagatgtcttgtctctaaaacttactagaagaacccatttaaataagttttcgtgtattttgaatatggatgtgttattttcctttgcaagaagcgtctaccttattttgtacc

SEQ ID NO: 12809 - DNA, 991 bp, Sarracenia psittacina
gtggtggctggtgagtcttcatctgtttctctctcacgcttcgactcaaaagccataccttcgtgtttctgtttgattttcgcgtgaatttattgcagatctcgtttgatttcatcagagacaagcccgtagacattctgaaacggaatggggttgaccttcacgaagctgttcagcaggctttttgccaagaaagagatgcgaattctcatggtaggtcttgatgctgctggtaagactaccatcttatacaaactcaagctgggagaaattgtcacaacaatccctacaattggatttaatgtggagacagtggagtacaagaacattagcttcacagtttgggatgttggtggccaggacaagatccgtccattgtggaggcattacttccaaaacacacaggggcttatatttgttgtggatagcaatgatagggatcgagttgttgaggctagagatgagttgcataggatgttgaatgaggatgagttgagagatgctgtcttgctggtgtttgctaacaaacaagatcttcctaatgcaatgaatgcagcagaaattactgacaagcttggtcttcattcactccgacaacgccattggtacattcagagcacatgtgcaacttctggagaagggctttatgaaggcctggagtggctttctaacaacattgctagcaaggcgtgaggctgttaaagattttgggtgctactggaatttttgctgatgcatggatggatactacctaggttctatataagaacttcacaattccccccctctctctctctcatccttaagtgacatttttgtgaaaagacagatcaacttgatatatttcccgaaactatcgtttgcttgtattactactgctacttttggttaatgctttttagctggaatcagtcatgccatctcttctgaagtgagcagcagctattcttttggcatttgagttgtatgaatttgaatagaatcttttggg

SEQ ID NO: 12810 - DNA, 937 bp, Silene vulgaris
aaaaaatggggcttactttcaccaagttgttcagccgtcttttcgccaagaaggaaatgagaattctgatggtgggtctcgatgccgctggtaagaccaccatcctctacaagctcaagcttggtgagatcgtcaccactattcccaccattggatttaacgtggaaactgttgaatacaagaacatcagcttcacagtgtgggatgtcgggggtcaggacaagatccgtccattgtggagacactacttccagaacacacaaggtctcatcttcgtggtggacagtaatgatagagaccgtgttgttgaggctagggatgagttgcacaggatgttgaacgaggatgagctgcgcgatgctgttttgctagtgtttgctaacaaacaggatcttccaaatgctatgaatgctgctgaaatcactgataagcttggcttgcactcccttcgacagcgtcactggtatattcagagcacttgcgctacatccggagagggtctttacgaaggattggattggctctccaacaacattgcaaacaaggcttaagaatcagcgtttgccatggattacccatctggatgcaggaatgaacctatctacttgcattcttctttggccatcctttaatagaatactccagtttggaactgtaatttttttgcgacgatgaagttgagctttctgcttagaacttcctcttatggaaatatgtcactttacaatattggttgtggttttgtttgaactcccaaaactctttgggttctttaattgtggtttagtttagtcgtagccaaaggtacttctgagcatctgctttatcggaacaatgagatcgtatgttaattgtttccacatttttctcctgcattgatccacttgtaattaaatacgtttttgaaaatttcgaagttctcgttcatttatgacag

SEQ ID NO: 12811 - DNA, 1718 bp, Glycine max
cttaattttatttaagtaaaaagaaggaaataaataattcccgtacctttgtcgctcttataaaatctattcttgttgacgcttcttcacccccatctcgcgttggtgcaaagcatccttcgcttcaatctctctctctctctttgcgctttctgcaaaccgaacatttcatctccaaagggatcaacaggtcgaaggagaaatggggctgacattcacgaagcttttcagccggcttttcgcgaagaaggaaatgcgaattctgatggttggtcttgatgctgctggtaagaccactatcctctacaagctcaagctcggagagatcgttactacaattcctaccattgggttcaatgttgagactgtggaatacaagaacattagcttcactgtttgggatgttggtggccaggacaagattcgtcccttgtggaggcactacttccagaacactcagggtcttatttttgttgtagacagcaatgatagggacagagttgttgaggccagagatgagttacataggatgttgaatgaggatgaactgagagatgccgtattgcttgtgtttgcaaacaaacaagatcttcctaatgcaatgaatgctgctgagattactgacaagttgggtctccactctctgagacagcgtcactggtacattcagagcacctgtgcaacctctggggagggcctttacgaaggtctggactggctttccaacaacattgccaataaggcttaatgcctttgggagacgggagtcttgcggattggtatttctggatgcagggttgaacattatctagcttttatttcttggtcctcttccaagacaactcgaatttgtgttcatgtaatgtggtttaggacatctcggtgctaaactgtagtaggattttactttttgggatgtgtaatactctgagctttctattgggtttggatgcaacgcccataactgtaatggagatactaattcaatgtgccaccaggttttgtctgatttttagttttattttggtcatgtatcattcatataatgaaatggagattttgtttattgtttgtaagataccaggaaaaaaaaaactatattcacttcatacctttaaaagatatgcatgcttaatttgtgttcagtgaagtctcccttgtgttttgcttcgtggatagcatgggcaatgggtaacacttcaaaggagtgggccttgaatctgaattaggttcccagcaatccgtaataatagtaagcgtgagcatacttttataacaatttttaaatattacacaatcaaaacagattcaagttattacaattttggtgtgatgtttgatgtttcctgctcatgtattttcaattcaaatgtaacaagatatccaagtccatttttgaaatttctcctagaaattttcagtttttgacagtactattttcttattcacaaaaatgtgtagctattttttcaataaaaacatgtacacaaataaacaatttaggaaataaaattatgaaaaataaattgaccaaatgctattagtattgccttttcattgttcttagtggttactattgctccgttttgcctcaatgacatatacttgaactaggggcgcaagaaaagcttaaaacagtaaagagttcaaggggctgaaatcgttttcttgaaactctaattcctcgacagggtcttcttcgaaaaggaaaggtgcgg

SEQ ID NO: 12812 - DNA, 1205 bp, Picea glauca
cctccttctcgactgcagcgctaggtgttcgagaggcaccagagatctctttgcggggagccattcttctcccctggaatctcagatctgactcttcaactcgggatctataacaggtggtcaagatggggctcacttttaccaagctttttagccggctcttcgcaaagaaggaaatgcgcattttgatggttggtcttgatgctgctggtaagactaccatcttgtataagctgaagctgggagagattgttaccaccatccctaccatcggattcaatgtcgaaactgtggagtacaagaacatcagcttcactgtgtgggatgttgggggtcaggataagatccgtccactatggagacactacttccaaaatactcaaggtctcatctttgtggttgatagcaatgacagagatcgtgttgtagaagcaagggatgaactacataggatgctgaatgaggatgaactacgtgatgctgtattacttgtgtttgcaaataagcaggatcttccaaatgctatgaatgctgcagagatcactgacaaacttgggcttcattcccttagacagcgccattggtatatccaaagcacttgtgcaacttctggcgagggattgtacgagggtttggattggctttccaacaacattgcaaacaaggcttgaagaaatatggtgaactgggtttctggaattttgtagggcaatgtcgtcttatttcatttttgtcagagacagtttgaagaaataaggttctaattgtgcagtcaaaccgacttttgactaacatttattcaatttcttctatgggtttgattgtgccaatctgctagcaatgaactaatttatatagctcactgagcttaaatggcaaagcatagtagttattattaaggtaggtgatgattatgatattgcctttgtgtggggagcatagacattactaagcatgttccagctgatttgaaacttatattcctattacaagctttattgtctcagattacactcaaattcattttgccagataataaatatacaggttggtttgtaattttttgaatttgtaatttgggaatactttaatgaaatacttgaactgtctttataatgttagttattttcaaaaatcttcatgtgagccatgaacatcttgcatgttcatattcaacaaaattcctgaagtttattctatgctac

SEQ ID NO: 12813 - DNA, 1222 bp, Picea glauca
tcatacctaaaggaagggagaccaaccatcctatttaacctctgcccgcaaaagggattttgttcacatgcaacgccataactgtagcagactcatgtaaccacagtcaaccgtccgactggcaagcgaacgaagctatttcttcccatttcttctcgatattctgccctccttctcgactgcagcgctaggtgttcgagaggcaccagagatctctttgcggggagccattcttctcccctggaatctcagatctgactcttcaactcgggatctctaacaggtggtcaagatggggctcacttttactaagctttttagccggctcttcgcaaagaaggaaatgcgcattttgatggttggtcttgatgctgctggtaagactaccatcttgtataagctgaagctgggagagattgttaccaccatccctaccatcggattcaatgtcgaaactgtggagtacaagaacatcagcttcactgtgtgggatgttgggggtcaggataagatccgtccactatggagacactacttccaaaatactcaaggtctcatctttgtggttgatagcaatgacagagatcgtgttgtagaagcaagggatgaactacataggatgctgaatgaggatgaactacgtgatgctgtattacttgtgtttgcaaataagcaggatcttccaaatgctatgaatgctgcagagatcactgacaaacttgggcttcattcccttagacagcgccattggtatatccaaagcacttgtgcaacttctggcgagggattgtacgagggtttggattggctttccaacaacattgcaaacaaggcttgaagaaatatggtgaactgggtttctggaattttgtagggcaatgtcgtcttatttcatttttgtcagacagtttgaagaaataaggttctaattgtgcagtcaaaccgacttttgactaacatttattcaatttcttctatgggtttgattgtgccaatctgctagcaatgaactaatttatatagctcactgagcttaaatggcaaagcatagtagttattattaaggtaggtgatgattatgatattgccttcgtgtggggagcatagacattactaagcatgctccagctgatttgaaacttatattcctattacaagctttattgtctcagattacactcaaattcattttgccagataataaatatacaggttggtttgt

SEQ ID NO: 12814 - DNA, 1219 bp, Picea glauca
ttcacatgcaacgccataactgtagcagactcatgtaaccacagtcaaccgtccgactggcaagcgaacgaagctatttcttcccatttcttcctcgatattctgccctccttctcgactgcagcgctaggtgttcgagaggcaccagagatctctttgcggggagccattcttctcccctggaatctcagatctgactcttcaactcgggatctctaacaggtggtcaagatggggctcacttttaccaagctttttagccggctcttcgcaaagaaggaaatgcgcattttgatggttggtcttgatgctgctggtaagactaccatcttgtataagctgaagctgggagagattgttaccaccatccctaccatcggattcaatgtcgaaactgtggagtacaagaacatcagcttcactgtgtgggatgttgggggtcaggataagatccgtccactatggagacactacttccaaaatactcaaggtctcatctttgtggttgatagcaatgacagagatcgtgttgtagaagcaagggatgaactacataggatgctgaatgaggatgaactacgtgatgctgtattacttgtgtttgcaaataagcaggatcttccaaatgctatgaatgctgcagagatcactgacaaacttgggcttcattcccttagacagcgccattggtatatccaaagcacttgtgcaacttctggcgagggattgtacgagggtttggattggctttccaacaacattgcaaacaaggcttgaagaaatatggtgaactgggtttctggaattttgtagggcaatgtcgtcttatttcatttttgtcagagacagtttgaagaaataaggttctaattgtgcagtcaaaccgacttttgactaacatttattcaatttcttctatgggtttgattgtgccaatctgctagcaatgaactaatttatatagctcactgagcttaaatggcaaagcatagtagttattattaaggtaggtgatgattatgatattgcctttgtgtggggagcatagacattactaagcatgttccagctgatttgaaacttatattcctattacaagctttattgtctcagattacactcaaattcattttgccagataataaatatacaggttggtttgtaattttttgaatttgtaatttgggaatactttaatgaaatacttgaactgtcttta

SEQ ID NO: 12815 - DNA, 1232 bp, Picea glauca
gcgggatgcaacgccataactgtagcagactcatgtaaccacagtcaaccgtccgactggcaagcgaacgaagctatttcttcccatttaccttcttcgattattctgccctccttctcgactgcagcgctaggtgttcgagaggcaccagagatctctttgcggggagccattcttctcccctggaatctcagatctgactcttcaactcgggatctctaacaggtggtcaagatggggctcacttttactaagctttttagccggctcttcgcaaagaaggaaatgcgcattttgatggttggtcttgatgctgctggtaagactaccatcttgtataagctgaagctgggagagattgttaccaccatccctaccatcggattcaatgtcgaaactgtggagtacaagaacatcagcttcactgtgtgggatgttgggggtcaggataagatccgtccactatggagacactacttccaaaatactcaaggtctcatctttgtggttgatagcaatgacagagatcgtgttgtagaagcaagggatgaactacataggatgctgaatgaggatgaactacgtgatgctgtattacttgtgtttgcaaataagcaggatcttccaaatgctatgaatgctgcagagatcactgacaaacttgggcttcattcccttagacagcgccattggtatatccaaagcacttgtgcaacttctggcgagggattgtacgagggtttggattggctttccaacaacattgcaaacaaggcttgaagaaatatggtgaactgggtttctggaattttgtagggcaatgtcgtcttatttcattttttgtcagagacagtttgaagaaataaggttctaattgtgcagtcaaaccgactttttgactaacatttattcaatttcttctatggggttttgattgtgccaatctgctagcaatgaactaattatatagctcactgagcttaaatggcaaagcatagtagttattattaaggtaggtgatgattatgatattgcctttgtgtggggagcatagacattactaagcatgttccagctgatttgaaacttatattcctattacaagactttattgtctcagattacactcaaattcattttgccagataataaatatacaggttggtttgtaattttttgaatttgtaatttgggaatactttaatgaaatacttgaactgtctttataatgt

SEQ ID NO: 12816 - DNA, 1115 bp, Saccharum officinarum
ccccccggcccgggcatcaaccactcgtctctttttcttcgccccgcccgaaagccgaagccgaggagaagaggggagcagcgagatcgcgcgcgcctccgagatctccacgaagttgtggcaacatggggctcaccttcacgaagctcttcagtcggctcttctcaaagaaagagatgaggatccttatggttggtctcgatgcagctggtaagaccaccatcctctacaagctcaagctcggagagatcgtgaccaccatccctacaatcgggtttaatgtggagactgttgaatacaagaacattagcttcactgtctgggatgtcgggggtcaggacaagatcaggccattgtggaggcactatttccagaacacccaaggccttatctttgttgttgatagcaatgacagagatcgtgttgttgaggcaagggatgagctccacaggatgctgaacgaggatgagttgagggatgctgtcttgctcgtttttgctaacaagcaagatctgccaaatgcaatgaatgctgctgagatcaccgataagcttggtctccattccctgcgccaacgccactggtatatccagagcacttgtgctaccacaggagaaggtttgtacgagggtcttgactggctctccaacaacattgcaaacaaggcctgattggacaattctgtggtttcacggagcacatggcgcggcattttctgcagaaacggagccatggtcattttgaccctgagacttgatggccctattcgtttcgctgaaatttggctgatgctgctgcttatgctgatttgttgctgagagaaaaacatttgttgtttcattggaatgttaaatattgtatttctttgctaggcttttcagagagctggtttgttatgttgcgtgattactctctaagaacctgttccgatatcaagacagtgtaattggccattggcactagtagatcgtttactgagtaatgcagtttatatgaatgtatcgcaattgtgctgtaccataacttcacattcttgtttgtgtgtgtcggactttccagttaaatctggagggatgttaacgataacgagtcgcattgtgggtatagttccatat

SEQ ID NO: 12817 - DNA, 760 bp, Helianthus annuus
gatcctcatcagaagtaggatggggcttacattcaccaaactcttcagccggcttttcgccaagaaagaaatgcgtatattgatggtgggtctcgatgctgctggtaagacaaccattttgtacaagctcaagctcggggagattgttaccaccattcctaccatcggctttaatgtggagacagttgaatacaaaaacatcagcttcactgtgtgggatgtggggggtcaggacaagatccgtcccctttggaggcactacttccagaacacacaaggtcttatctttgtggtcgatagcaatgatagggatagagttgttgaggcaagagatgagttacacaggatgttgaatgaggatgagcttagggatgcagttcttcttgtgtttgccaacaaacaagatctgcccaatgcaatgaatgctgctgaaatcaccgataagcttggccttcactctcttcgacaacgtcactggtacatccaaagcacctgtgccacctctggggaaggactttacgagggtttggactggctctccaacaacattgctaacaaggcatgaggtggagatgaattgtaatttgggggtcaagaaaccggaggcaagttttgctttttgtatggtcaggtcacttttcttactggttctcgttcttccgtgactgaggtgctagtggttatggaactttgtttgttaaaaaaggctttttgtaatttttattatatatagggtatgtatgatacgatctttggtttc

SEQ ID NO: 12818 - DNA, 804 bp, Helianthus annuus
tttttgttgttggtggtgatcgacggctcctgattcacacgctccacgtcacatctccggttaccggcgatcatacaacaatggggctgtcttttaccaagctattcagtcgcctgtttgctaagaaggagatgcgaattctgatggttggtctcgatgcagctggtaaaaccacaattttgtacaagctcaagttgggggaaattgtcaccactatccctactattggattcaatgttgaaactgttgaatacaagaacatcagctttactgtgtgggatgttgggggtcaagacaagattcgaccgttgtggaggcactacttccaaaacacacaaggtcttatctttgtggttgacagcaatgatcgtgaccgtgtagttgaggccagggatgagttacacaggatgcttaatgaggatgaactaagagatgcagtgttacttgtttttgccaacaagcaagatcttccaaatgcaatgaatgctgctgagatcactgacaaacttggtctgcattctctccgacagcgacactggtatatccagagcacatgtgccacctctggggaaggtctttatgagggattggactggctttccaacaacattgctaacaaggcttaaaagggactcacgtatgcatcgtataacgagtattgttagcattttatctatgttgaggactcgggatttcttcttgtcaaacactcgtattttgatccgctttcatagactgtatacatcatcacatttagaatctgtacgacttgatttctgtaatatgatgtttggtaataagcag

SEQ ID NO: 12819 - DNA, 802 bp, Helianthus annuus
ggctcactttttgttgttggtggtaatcgacggctcctgattcacacactccacgtcacatctccggtaaccggcgatcatacaacaatggggctgtcttttaccaagctattcagtcgcctgtttgctaagaaggagatgcgaattctgatggttggtctcgatgcagctggtaaaaccacaattttgtacaagctcaagttgggggaaattgtcactactatccctactattggattcaatgttgaaactgttgaatacaagaacatcagctttactgtgtgggatgttgggggtcaagacaagattcgaccgttgtggaggcactacttccaaaacacacaaggtcttatctttgtggttgacagcaatgatcgtgaccgtgtagttgaggccagggatgagttacacaggatgcttaatgaggatgaactaagagatgcagtgttacttgtttttgccaacaagcaagatcttccaaatgcaatgaatgctgctgagatcactgacaaacttggtctgcattctctccgacagcgacactggtatatccagagcacatgtgccacctctggggaaggtctttatgagggattggactggctttccaacaacattgctaacaaggcttaaaagggactcacgtatacgagtattgttagcattttatctatgttgaggactcgggatttcttcttgtcaaacactcgtattttgatcagctttcatagactatatacatcatcacatgtaaaatctgtacgactttatttctgtaatatgatgtttggtaataagcaga

SEQ ID NO: 12820 - DNA, 871 bp, Helianthus annuus
attatcgttccctttaattataacaaacgacccttgttcgtttaatcgtcctattttgttgttggtggtgatcgacggctcccgattcactcgctccacgtcacatctccggtaaccggcgatcatacaacaatggggctgtcttttaccaagctattcagtcgcctttttgctaagaaggagatgcgaattctgatggttggtctcgatgcagctggtaaaaccacaattttgtacaagctcaagttgggggaaattgttactactatccctactattggtttcaatgttgaaactgttgaatacaagaacatcagctttactgtgtgggatgttgggggtcaagacaagattcgaccgttgtggaggcactacttccaaaacacacaaggtcttatctttgtggttgacagcaatgatcgtgaccgtgtagttgaggccagggatgagttacacaggatgcttaatgaggatgaactaagagatgcagtgttacttgtttttgccaacaagcaagatcttccaaatgcaatgaatgctgctgagatcactgacaaacttggtctgcattctctccgacaacgacactggtatatccagagcacatgtgccacctctggggaaggtctttatgagggattggactggctttccaacaacattgctaacaaggcttaaaagggactcacgtatgcatcgtacaacgagtattgttagcattttatctatggtgaggactcgggatttcttcttgtcaaacactcgtattttgatcagctttcatagactatatacatacatcatcacatttagaatctgtacgactttatttctgtaatatgatgtttggtaataagcagatgatctcttt

SEQ ID NO: 12821 - DNA, 799 bp, Helianthus annuus
gacggctcccgattcacacgctccacgtcacatctccggttaccggcgatcatacaacaatggggctgtcttttaccaagctattcagtcgcctgtttgctaagaaggagatgcgaattctgatggttggtctcgatgcagctggtaaaaccacaattttgtacaagctcaagttgggggaaattgtcactactatccctactattggattcaatgttgaaactgttgaatacaagaacatcagctttactgtgtgggatgttgggggtcaagacaagattcgaccgttgtggaggcactacttccaaaacacacaaggtcttatctttgtggttgacagcaatgatcgtgaccgtgtagttgaggccagggatgagttacacaggatgcttaatgaggatgaactaagagatgcagtgttacttgtttttgccaacaagcaagatcttccaaatgcaatgaatgctgctgagatcactgacaaacttggtctgcattctctccgacagcgacactggtatatccagagcacatgtgccacctctggggaaggtctttatgagggattggactggctttccaacaacattgctaacaaggcttaaaagggactcacgtatgcatcgtataacgagtattgttagcattttatctatgttgaggactcgggttttcttcttgtcaaacacccgtattttaatcagctttcatagactgactatacacatcatcacatttagaatctgtacgactttatttctgtaatatgatgtttggtaataagcagatgatctttttt

SEQ ID NO: 12822 - DNA, 902 bp, Eutrema halophilum
agaatgtgaatgaggttttgacactcttctatctgcttcgttgtggttggacagtagagcaagatggggttgagtttcgccaagctatttagccggctttttgccaagaaggagatgcgaattctgatggttggtcttgatgctgctggtaagaccactattctgtacaagctcaagctcggagagatagtcaccaccatccccactattggtttcaatgtggaaactgtggagtacaagaacatcagtttcactgtgtgggatgtcgggggtcaggacaagatccgtcctttgtggaggcactacttccagaacactcagggtcttatcttcgtcgtggacagcaacgacagagacagagtagttgaggctagagatgaactccacaggatgctgaatgaggacgagctgcgtgatgctgtgttgcttgtgtttgccaacaagcaagatcttccaaatgcgatgaatgcagctgaaatcacagataagcttggccttcactccctccgtcagcgtcactggtacattcagagcacatgcgccacttctggtgaagggctctacgaaggtctggactggctgtccaacaacatcgccggcaaggcgtgatgaagtaaaaactgcattgcatcgagatgattctgcctgctgtgtgttgggaatttttctggatgcaagagaagactataaatattatctgaatgtgaatgttttgattgtgcaagtagatgtcttgtacctaaatcttactagaaagaaccccttttaaatagttttcatgtattttaaatttgaagaaacctggattgataattgtgttattgctttctttgttttttgcgtattcattatgaagaacataaattctagagttgtgttcaatatttgaaatttctcatatc

SEQ ID NO: 12823 - DNA, 971 bp, Vinca minor
atctgcccccaaattcgatcaatcctttgctctctccgtcggattattctcgattctaaggaaagatgggtttgtcatttaccaagctctttagccggctttttgccaagaaggagatgcgtatactgatggttggtctcgatgcggctggtaagactaccatattgtacaagctcaagctgggagaaattgtcaccacgattccaaccattggtttcaatgtggagacagtggaatacaagaacatcagcttcaccgtctgggatgttgggggtcaagacaagatccgaccgttgtggagacactacttccaaaatactcagggacttatatttgtcgttgatagtaatgaccgtgaccgtgttgttgaggctagggatgagctacaccgaatgttgaacgaggatgaactaagggatgctgtcctcctcgtgtttgctaacaagcaagatcttccaaatgcaatgaacgcagcagagatcaccgataagcttggtcttcattctctccgtcaacgccactggtatatccagagcacatgtgcaacatctggtgaagggctttacgagggattggactggctctccaacaacattgctaacaaggcttagatcagcataatcattccaatgattttgcagataaatctgtcaaagcggacataatatatttccttgtattttttttccttattatcttgttcctgcaagattgaacctcgtgttgtgttcgattgtttgttgttttttttatacaatttggtattttgttttagattccgactttctagtatatagagcagcgctttgttcttttggtcttatgtcactactatgttgcacttgttcttccctggctagtatgtgaaagttaatcagtgttcaccctttttcttgtacacaaaaaggtgatacccaggactcccacctcctgatccgtcagaaattgtggaggatgttaatcaaggtgac

SEQ ID NO: 12824 - DNA, 1048 bp, Citrullus lanatus
agaagccactataagaaagggaaaaggtttgcggtacgatcttgtgatcctttccccttcagatctgtctcccgaaggccccaaattcgagagtactgtgattgttgcccatagagggaagcagaaatggggttgaccttcacgaagctctttagcaggctcttttctaagaaagagatgcgcattttgatggtgggtctcgatgctgctggtaagacgacgatcttgtacaagttaaagctcggagaaattgttaccaccatccccactatcggatttaatgtggagactgtagagtacaagaacatcagctttactgtttgggacgttggtggtcaggataagatccgtccactttggaggcactatttccagaatacacagggacttatttttgttgtcgatagcaatgatagggaccgagttgtcgaggcaagagatgagttgcacaggatgttgaatgaggatgagcttagagatgctgttttgcttgtatttgctaacaagcaagatcttcctaatgccatgaatgctgcagaaataactgacaagcttggtcttcactctcttcgtcaacgccactggtacattcaaagcacatgcgcgacatctggagagggtttgtacgaaggtctagactggctttccaacaacattgctagcaaggcctgaagcgtaaatgattttgatggttcaagaatttgttcagagttttcgtcattctgggaccaatagtttcgtttgatttcagtgatagatgggaaaatttggctataccttaaaatgtactccaagacttctttaagcttgaacttcttagctcctagaagtccattattgtactgttttccatttaataccaagtccattttttatctgatcaatttgattattttgaaatgtcatattcggtgtgccacatggatcattatttggttgtctggaaagaccaaattctccctcatatagaaaggatttccatctccttttggtgagcctgaaacgtttagatcacccaataacccttgtagtagagggaatgacactg

SEQ ID NO: 12825 - DNA, 812 bp, Brassica juncea
ggtcgtctcgcatttagcgtttctcttaagcttctctctctctcagatccctcggttaagtaaaagagcaacaagatggggttgagtttcgccaagcttttcagcaggctctttgccaagaaggagatgcgtattctgatggttggtcttgatgctgctggtaagaccactatcttgtacaagctcaagctcggagagattgtcaccaccatccccactattggtttcaatgtggaaactgtggagtacaagaacatcagtttcactgtgtgggatgttgggggtcaggacaagatccgtcctttgtggaggcattacttccagaacactcagggtctgatctttgtagtggacagcaacgacagagatagagttgttgaggctagagatgaactgcacaggatgctcaatgaggacgagctgcgtgatgctgtgttgcttgtgtttgccaacaaacaagatcttcctaatgcgatgaatgcagctgaaatcacagataagcttggccttcactccctgcgtcagcgtcactggtacattcagagcacatgcgccacttcaggtgaaggactgtacgaaggtctggactggctgtccaacaacattgctggcaaggcgtaatgagggtgagttgcatttgcatcgagatggttctaccttctgtgatgcaagaaacgattataaatattatctgaacctttttgatattgggtatgtgaatgttttgattgtgcaagtagatgtcttgtctctaaaacttactagaagaacccatttaaataagttttcatgtgttttgaatatgagtatta

SEQ ID NO: 12826 - DNA, 898 bp, Brassica napus
gtcgtcgtctcgcaattagcatttctcttaagcttcgctctctctcggttacgtaaaagagcacaagatggggttgagtttcgcgaagctgtttagcaggctctttgcaaagaaggagatgaggattctgatggttggtcttgatgctgctggtaagaccactattctctacaagctcaagctcggagagattgtcaccaccatccccactattggtttcaatgtggaaactgtggagtacaagaacatcagtttcactgtgtgggatgtcgggggtcaggacaagattcgtcccttgtggaggcattacttccagaacactcagggtctgatctttgtcgtggacagcaacgacagagaccgtgttgttgaggctcgagatgaactgcacaggatgctcaatgaggacgagctgcgtgatgctgtgctgcttgtgtttgccaacaagcaagatcttccaaatgcgatgaatgcagctgaaatcacagataagcttggccttcactccctccgtcagcgtcactggtacattcagagcacatgcgccacttcaggtgaaggactttacgaaggtctggactggctgtccaacaacatcgctggcaaggcttgatgagggtgagttgcatttgcatcgagatggttctatcttctgtgatgcaagaaacaattataaatattatctgaacctttttgatattgggtatgtgaatgttttgatggtgcaagtagatgtcttgtctctaaaacttattagaagaacccatttaaataagttttcatgtgttttgaatatgagtattattttgcttttggcgtattcatttgcaagtgttattttgctttcatgtccgaacccgggttatttcaatagtggccttgtccatttatgtctaac

SEQ ID NO: 12827 - DNA, 930 bp, Brassica napus
caataggactcaacgcttcgctctctctctctctcggttacattctccagagcagttaaagagcacaagatggggttgagtttcgccaagctgtttagcaggctctttgcaaagaaggagatgagaattctgatggttggtcttgatgctgctggtaagaccactattctctacaagctcaagctcggagagattgtcaccaccatccccactattggtttcaatgtggaaactgtggagtacaagaacatcagtttcactgtgtgggatgtcgggggtcaggacaagatccgtcccttgtggaggcattacttccagaacactcagggtctgatttttgtcgtggacagcaacgacagagaccgtgttgttgaggctcgagatgaactgcacaggatgctcaatgaggacgagctgcgtgatgctgtgctgcttgtgtttgccaacaagcaagatcttccaaatgcgatgaatgcagctgagatcacagataagcttggccttcactccctgcgccagcgtcactggtacattcagagcacatgcgccacttcaggtgaaggactgtacgaaggtctggactggctgtccaacaacattgctggcaaggcgtaatgagggtgagttgcatttgcatcgagatggttctaccttctgtgatgcaagaaacgattataaatattatctgaacctttttgatattgggtatgtgaatgttttgattgtgcaagtagatgtcttgtctctaaaacttactagaagaacccatttaaataagttttcatgtgttttgaatatgagtattattttgcttttggcgtattcatttgcaagtgttattttgctttcgtgtctgaacccggcttttcaatagtggccttgtccatttatgtcttgcacagtgtataaggcagtgtaacagtcaaatca

SEQ ID NO: 12828 - DNA, 781 bp, Brassica juncea
gacgttttcatcccttgcctcctatatcaatacggcgtcggcgcgtatagcgttgttcttaagctctttctccttctctttcaaaagtccgttcgtcgtcgtcgtctcgtcttctctttctcagataatctccaaaaacttttgcgcagagtgaaagaaggatgggattgtctttcgccaagctatttagcaggcttttcgccaagaaggagatgcggattctcatggttggtcttgatgctgctggtaagaccaccatcttgtacaagctcaagctcggtgagattgtcaccaccattcccactattgggttcaatgtggaaactgtggagtacaagaacatcagtttcactgtgtgggatgtcgggggtcaagacaagatccgtcccttgtggaggcactacttccagaacactcaaggtctcatctttgtggttgacagcaatgacagagaccgtgttgttgaggccagagatgaactgcacagaatgcttaacgaggatgagctgcgtgatgctgttctgctcgtgtttgctaacaaacaggatcttccaaatgccatgaacgcagctgaaatcactgataagcttggtctccactctctccgtcagcgtcactggtacatccagagcacatgtgccacttcaggcgaggggctctacgaaggtcttgactggttgtccaacaacattgccggcaaggcgtagagggaaggttcgtggttgagttgattttgctgagcaaatctggatgcaggggcaaacattatctgaactttttt

SEQ ID NO: 12829 - DNA, 680 bp, Brassica juncea
tcgtcgtcgcgcattagcgttctcctaagcttctctctctctctcggttacgttcttcagagtaaaagcagaaaagatggggttgagtttcgccaagcttttcagcaggctctttgccaagaaggagatgcgtattctgatggttggtcttgatgctgctggtaagaccaccattctctacaagctcaagctcggtgagattgtcaccaccatccccactattggtttcaatgtggaaactgtggagtacaagaacatcagtttcactgtgtgggatgtcgggggtcaggacaagatccgtcctttgtggaggcactacttccagaacactcagggtctcatctttgtcgtggacagcaacgacagagacagagttgttgaggctagagatgaacttcacaggatgctcaatgaggatgagctgcgtgatgctgtgttgctagtgttcgctaacaaacaggatcttccaaacgcgatgaatgcagctgaaatcactgataagcttggtctccactctctccgtcagcgtcactggtacattcagagcacatgtgccacttcaggcgaggggctttacgaaggtcttgactggctgtccaacaacattgccggcaaggcgtagagggaaggttcgtggttgagttgattttgctgagcaaatctggatgcaggggcaaaca

SEQ ID NO: 12830 - DNA, 810 bp, Brassica oleracea
gtcgcgcatttagcgttgttttgaagctctctctccttcgctttcaacctccgttcgtcgtctcgctcgttgttacgcgatctctagtgaagaaggatgggtttgtctttcgccaagttgtttagcaggctttttgccaagaaggagatgaggattctcatggttggtcttgatgctgctggtaagaccaccattttgtacaagctcaagctcggtgagattgtcaccaccattcccactattgggttcaatgtggaaactgtggagtacaagaacatcagtttcactgtgtgggatgtcgggggtcaagacaagatccgtcccttgtggaggcactacttccagaacactcaaggtctcatctttgtggtcgacagcaatgacagagaccgtgttgttgaggccagagatgaactgcacaggatgcttaatgaggatgagctgcgtgatgctgttctgctcgtgtttgctaacaaacaggatcttccaaatgccatgaacgcagctgaaatcactgataagcttggtctccactctctccgtcagcgtcactggtacatccagagcacatgtgccacttcaggcgaggggctttacgaaggtcttgactggttgtccaacaacattgccggcaaggcgtagagggaaggttcgtggttgagttgattttgctgagcaaatctggatgcaggggcaaacattatctgaactttttttctttccggttttcttattgttctgtgtttttttttgggtatgtggatttgattttgtgatcgttgtttctgatttgtgtaaggagaggtctct

SEQ ID NO: 12831 - DNA, 1078 bp, Brassica rapa
cacttgacgtggtaaatctgtgaattgacgtttttatcctttgcctctataaagcatcttctccgttataacctcacggcgtcgcgcatttagcgttgctttgaagttctctctccttcgctttcaaactccgttcgtcgtctcgctcgttgttacgcgatctctagagaagaagggatggggttgtctttcgccaagctgtttagcaggctttttgccaagaaggagatgaggattctcatggttggtcttgatgctgctggtaagaccactatcttgtacaagctcaagctcggtgagattgtcaccaccattcccactattgggttcaatgtggaaactgtggagtacaagaacatcagtttcactgtgtgggatgtcgggggtcaagacaagatccggcccttgtggaggcactacttccagaacactcaaggtctcatctttgtggtggacagcaatgacagagaccgtgttgttgaggccagagatgaactgcacaggatgcttaatgaggatgagctgcgtgatgctgttctgctcgtgtttgctaacaaacaggatcttccaaatgccatgaacgcagctgagatcaccgataagcttggtctccactctctccgtcagcgtcactggtacattcagagcacatgtgccacttcaggcgaggggctctacgaaggtcttgactggttgtccaacaacattgccggcaaggcgtagagggaaggttcgtggttgagttgattttgctgagcaaatctggatgcaggggcaaacattatctgaactttttttctttccggttttcttattgttctgtgttttttttcgggtatgtggatttgattttgtgatcgttgtttctgatttgtgtaaggagaggtctcttgtacgtagaacatagaaattaccttttactatagcttgtaatattgaaagttatctactattttcgtggtcattgttctctcgttacatttagtcagaagttgcaactgcggctacgttgttaatagacttcatgggatcgtacatcgttgttaatagacttcatgggatcgtacataggttactg

SEQ ID NO: 12832 - DNA, 794 bp, Brassica napus
tgaagaaggatgggtttgtctttcgccaagttgtttagcaggctttttgccaagaaggagatgaggattctcatggttggtcttgatgctgctggtaagaccaccattttgtacaagctcaagctcggtgagattgtcaccaccattcccactattgggttcaatgtggaaactgtggagtacaagaacatcagtttcacagtgtgggatgtcggcggtcaagacaagatccgtcccttgtggaggcactacttccagaacactcaaggtctcatctttgtggtcgacagcaatgacagagaccgtgttgttgaggccagagatgaactgcacaggatgcttaatgaggatgagctgcgtgatgctgttctgctcgtgtttgctaacaaacaggatcttccaaatgccatgaacgcagctgaaatcactgataagcttggtcttcactctctccgtcagcgtcactggtacatccagagcacatgtgccacttcaggcgaggggctttacgaaggtcttgactggttgtccaacaacattgccggcaaggcgtagaggaaaggttcgtggttgagttgattttgctgagcaaatctggatgcaggggcaaacattatctgaacttttttcctttccggttttcttattattctgtgttttttttgggtatgtggatttgattttgtgatcgttgttcttatttgtgtaaggagaggtctcttgtacgtagaacatagaaattaccttttactatagcttgtaatactgaaagttatctagtgctttcgttgtcg

SEQ ID NO: 12833 - DNA, 772 bp, Brassica napus
agaagggatgggtttgtctttcgccaagctgtttagcaggctttttgccaagaaggagatgaggattctcatggttggtcttgatgctgctggtaagaccactatcttgtacaagctcaagctcggtgagattgtcaccaccatccccactattgggttcaatgttgaaactgtggagtacaagaacatcagtttcactgtgtgggatgtcgggggtcaagacaagatccgtcccttgtggaggcactacttccagaacactcaaggtctcatctttgtggtcgacagcaatgacagagaccgtgttgttgaggccagagatgaactgcacaggatgcttaatgaggatgagctgcgtgatgctgttctgctcgtgtttgctaacaaacaggatcttccaaatgccatgaacgcagctgaaatcactgataagcttggtctccactctctccgtcagcgtcactggtacattcagagcacatgtgccacttcaggcgaggggctttacgaaggtcttgactggctgtccaacaacattgccggcaaggcgtagagggaaggttcgtggttgagttgattttgctgagcaaatctggatgcaggggcaaacattatctgaacttttttctttccggttttcttattgttctgtgttttttttctggtatgtggatttgattttgtgatcgttgtttctgatttgtgtaaggagaggtctcttgtacgtagaacatagaattacctttaactatagcttgtaatattgaaagtt

SEQ ID NO: 12834 - DNA, 1892 bp, Theobroma cacao
gacggcagaaaacgaaggtgattgattggcatttgggattcagaacgggagaaaacgacggcgttagcatctaagggctgggggctgggcaacattaaacgcaaaacctaacggcgtgaaaaaggccccgtcatctgtgatctcggattccatttgcgtaaataaataaatagcatttgctattttacattgttgtctttcatttcttcctctcgttcctcgttcctgggcagcctctcaattccttcagttcctcaacatctaagaaaaaaaagatggggctgtcttttgctaagttgttcagtcggctgttcgccaagaaagagatgcgaattcttatggtgggtcttgatgctgctggtaagactaccatcttatacaagctcaagctcggagagattgtcaccaccattcccactattgggtttaatgtggagaccgtggaatataagaacattagcttcactgtttgggatgttggtggtcaggacaagattcgacctttgtggagacactacttccaaaatacgcaagggctgatctttgttgttgatagtaatgatcgtgaccgtgtggttgaggctagggatgaacttcatcgtatgctaaatgaggatgagctgagggatgctgtgctgcttgtatttgcaaacaagcaagatctgccaaatgctatgaatgctgctgagataactgataagcttggtcttcactccctccgccagcgccactggtatatccaaagtacatgtgccacatctggtgaagggttgtatgagggactggactggctctccaacaacatagctaacaaggcttgagggatggtcaagtttgggtgacatcttggagcagcaatcgataatgtcgaattggaatgtttttatatgctattttgtgttgatgggttttggtttttcttgccttgtaaacttgcaagaatgtatcagattgtggttaggatttttactgtactagaaatgggcattttgccttgtagattgatttcaaataatctttgtccacagagttaacatattcattgttatcaggttattgttacatatcatgatttttatttgttctctgcacgtctcaaaggatgatcattggtttattcttgttcatgtttggatcaggtaattttctttaactctattaggaaaaataaagccgtaattgtacctgaaacatcatttgcttgcttcacacttgagaattttttaaatatccaagtttcaagagtcggtaatctgaaaacatcattgttacaaactttgcttgaggtcgtcagcttcaatttacgttgcttttggttgagtgcaagcaaaggagactctctgtaacttgattagatgtaattattttacaatgtttggtttgggaaaaatggttggtaaagtgatttcattgtaatatcattgcagtgagagaagatgatatcattcccttctctcacggagggaaagttacattttttttttccccaacttgtctactccgatctcctcttcttctccacctttttcttattgctaattgtagaaccctagccgctcaccagcaagccccagttgttgaactctttgggaggagagaggggtgccatttgaatctggtgatgggagcaaggaagaaggggagaaaaagagaagaaaagaaaagaagaacagtccatcaacaaagagcaaggacgaagcaagaagaacagtccatcaccatagagcaacaagcaaggaagaaataagagaaaaaaatgaaagaaagaaagtgatggctaattaactaatatttttataaaataattaaaatttatttaaaatttaactaatttattaaaaataaaatatttaagaaattgagagaatttgaaaggaaaagatgtttgtcgt

SEQ ID NO: 12835 - DNA, 968 bp, Trifolium pratense
tcttctcttctctctgcgctttctgctacccaaactttttcattcatctccaaagggaggatcaacgaagtgaaggagaaatggggctaacattcacgaagctgttcagtcggttattcgcgaagaaggagatgagaattttgatggttggtctcgatgctgctggtaagacaactatcctctacaagcttaagcttggagaaatcgtcactacgatccctaccatcgggttcaatgtggagaccgttgagtacaagaacattagtttcactgtttgggatgttggaggtcaggataagatccgtcccttgtggaggcactacttccagaacactcagggtcttatatttgtcgttgacagcaatgacagggatagagttgttgaggccagagatgagttacataggatgttgaatgaggatgaattgagagatgcagtattgcttgtttttgccaacaaacaagatcttccaaatgcaatgaatgctgccgaaattactgacaagttgggtcttcactctctgagacagcgccactggtacatccagagcacctgtgcaacatctggggagggtctttatgaaggtttggactggctttccaacaacatagccaataaggcttaatgcttattgggagtatttggattggcgattctggatgcaggggtgaatattatctagctttgctttttgagtcatgtggatcggtaattctggatgcaggggcaaatattatctagcttttatttcttggtcatcttccgaaacaacttgaatttgtgttcatgtattgtggtttaggatatcttggtggctaaaattgtagtaggaatttgtttcatgggatttgtaatatttctgacttctgcgctttctattgggtttttgacactgtccataactgtaatggagatacaattaaatgtgcctcaagttctaatatatagttttattttggtcatatac

SEQ ID NO: 12836 - DNA, 1001 bp, Trifolium pratense
atacaaatcgcgattcgctcttctcttcgcaaaaatctagatcgagaagaagagttattggatcagcgatttgtgttggtgaagatggggttaacgttcacgaagctgttcagtaggttattcgcgaagaaggaaatgagaattttgatggttggtcttgatgctgctggtaagactactattttgtataaactcaagcttggagaaatcgtcactactatcccaaccattggatttaatgttgaaaccgtggagtacaagaacatcagcttcaccgtgtgggatgtcgggggtcaggacaagatccgcccattgtggaggcactacttccagaacacccagggtcttatttttgtggttgatagcaatgatagagaccgagtggttgaggcaagggatgagttgcacaggatgttgaatgaggatgaacttagagatgctgttttgcttgtttttgccaacaaacaagatcttccaaatgcaatgaatgctgccgaaattactgacaagttgggtcttcattctctgagacagcgccactggtacatccagagcacttgtgcaacatctggggagggtctttatgaaggtttggactggctttccaacaacatagccaataaggcttaatgcttattgggagtatttggattggcgattctggatgcaggggtgaatattatctagctttgctttttgagtcatgtggatcggtaattctggatgcaggggcaaatattatctagcttttatttcttggtcatcttccgaaacaacttgaatttgtgttcatgtattgtggtttaggatatcttggtggctaaaattgtagtaggaatttgtttcatgggatttgtaatatttctgacttctgcgctttctattgggtttttgacactgtccataactgtaatggagatacaattaaatgtgcctcaagttctaatatatagttttattttggtcatatacctttcatataatggagtatctgttgagta

SEQ ID NO: 12837 - DNA, 1170 bp, Cajanus cajan
agaatagcggtgcttttgggttgggtattttatttaattttagtaaaaataaaaaaaatgaaaaaataatagtggtaccttttttgctcttataaagtctattctggttgacgcttctcactcccatctcgcgttgctgcaaagcgataccatctttcgttcatctctctctccaaagggatccgcaggctgaaggagaaatggggctgacgttcacgaagcttttcagtcggcttttcgcgaagaaggaaatgcgaattctgatggttggtcttgatgctgctggtaagaccactatcctctacaagctcaagcttggagagatcgttaccacaattcctaccattgggttcaatgttgagactgtggagtacaagaacattagcttcactgtttgggatgtcggtggccaggacaagattcgtcctttgtggaggcactacttccagaacactcagggtcttatttttgttgtagatagcaatgatagggacagagttgttgaggccagagatgagttacataggatgttgaatgaggatgaactgagagatgcagtattgcttgtgtttgccaataagcaagatcttcctaatgcaatgaatgcggctgagattactgataagttgggtctccactctctcagacagcgccactggtacattcagagcacctgtgcaacctccggagaaggcctttatgaaggtttggactggctttccaacaacattgccaataaggcttaaagcctttgggagtcttgcggattggtaattctggatgcaggggtgaacattatctagcttttatttcttggtcctcttccgagacgactcaaatttgtgttcgtgtaatgtggtttaggacatcttggtggctaaaattgtagtaggactttgtttcttggggtgtgtaatactgagcttcctattgggtttatggatgcaatgtccataactgtaatggagatactaattcaatgtgccaccaggttctgatttatagttttattttggtcatgtatctttcatatattgagtattgaatggggattttgtttattgttttgtaagatacccgtaaaaaaaaactatattcactttcatacttctaaagatgcgcatgttttacttgtgttcattcaagttcctgttggggtttaggtacacg

SEQ ID NO: 12838 - DNA, 1469 bp, Glycine max
attaagaattgatagagagaggcatagacggtgctttaggttattttcttaagtaaaaagaaggaaataaataattctcgtagctttgttgctcttataaattctattctggttgacgcttctctcaccatccccatttcgcgttggtgcaaagcatccttcgtttcaatttctctctctcagcgctttctgcaatcgaacctttcatctccaaagggatccacaggccgaaggagaaatggggctgacattcacaaagcttttcagtcggcttttcgcgaagaaggaaatgcgaattctgatggttggtcttgatgctgctggtaagaccactatcctgtacaagctcaagctcggagagatcgttaccacaattcctaccatcgggttcaatgttgagactgtggaatacaagaacattagcttcactgtttgggatgttggtggccaggacaagattcgtcccttgtggaggcactacttccagaacacccagggtcttatttttgttgtagacagcaatgatagggacagagttgttgaggccagagatgagttgcataggatgttgaatgaggatgaactgagagatgcagtattgcttgtgtttgccaacaaacaagatcttcctaatgcaatgaatgctgctgagattaccgacaagttgggtctacactctctcagacagcgccactggtacattcagagcacctgtgcaacctctggggagggcctttacgaaggtctggactggctttccaacaacattgccaataaggcttaatgcctttgggagtcttgcggattggtaattctggatgcaggggtgaacattatctagcttttatttcttggtcctcttccaagacaactcgaatttgtgctcatgtaatgcggtttaggacatctcgaatttgtgctcatgtaatgcggtttaggacatctcggtgctaaattgtagtaggattttacttcttgggatgcgtaatactctgatctttctattgggtttggatgcaatgtccataactgtaatggagatactaattcaatgcgccaccgggttctgtctgatttatagttttattttggtcatgtatcattcatatattgagtatgaaatggagattttgtttattgttttgtaagattcccgaaaaaaaaaaaactatatacacttcgtaccttctatgtttgcttcgtggatagcataggcaatgggcaactcatcaaaggagtgggtcttgaatctgaattaggctcccaacaatccgtaatgattatttttttaacaattttaaatattacacataaggaatggactcaagtttttaaaattttggtgtgatgttgatgtttcttgctcatttattttcaattcaaatgcaacaggatatccaagtccctttttgaaatttctcccagaaattcagtttttgacaaaactattttcaataaaaacatgtacg

SEQ ID NO: 12839 - DNA, 1052 bp, Abies balsamea
tgttcgagaggcaccggagatctctttgcggggagccattcttctcccctcgaatctcagatcaggccatctcactcgggatctctaacaggacttcggattgatcaggcggtgaagatggggctcacttttaccaagctttttagccggctcttcgcaaagaaggaaatgcgcattttgatggtgggtcttgatgctgctggtaagactaccatcttgtataagctgaagctgggagagattgttaccaccatccctactattggattcaatgtggaaaccgtggaatacaagaacatcagcttcactgtgtgggatgttgggggtcaggacaagatccgtccactatggagacactacttccagaacactcagggtctcatctttgtggttgatagcaatgacagagaccgtgttgtagaagcaagggatgaactacacaggatgctgaatgaggatgaactacgtgatgccgtattacttgtgtttgcaaataagcaggatcttccaaatgctatgaatgctgcagagatcactgacaaacttgggctgcattcccttaggcagcgtcattggtatatccaaagcacttgtgcaacttctggggagggcttgtatgagggattggattggctctccaacaacattgcaaacaaggcttgaagaaatatggtgaattgggttcctggaattttgtagggcaatgtcgtcttatttcatttttgtcagagacagtttgaagaaacaattttctatttgtgcagtcaaactgacttttgacaacttacatttattcaatttcttctatggttttaattttgccaatctgctaggaagaactaatttatatagctcactgtgcttaaatgacaaagcatgagtagttattattatggcaggtgatgattatgatattgcctttgtgtggggagtatagacatcattaagcatgttttagctgatttgaaacttaaattcctattataggctttattgtcttagatgacgatcaaattcattctaccagataataaatatacaggttggtttgt

SEQ ID NO: 12840 - DNA, 969 bp, Amaranthus tuberculatus
ccgggggacggaccgttgatatcgttgtaacatcaaattcgggcagcttccatcttctgcccgccgtccactgttgtacccctaattttctctgtcctctatatttgaaggaaaatggggctttcgttcggaaagttgttcagtaggttatttgccaagaaagaaatgagaattttgatggtcggtcttgatgcggctggtaagaccactattttgtacaagcttaagcttggagagattgttactaccattcctactattggattcaatgtagagactgttgaatacaaaaacattagctttaccgtgtgggatgttggaggtcaagacaagattcgacctttgtggaggcattatttccaaaacacccaaggtctcatctttgtggtggatagcaatgatcgtgatcgtgttgttgaggcgagggatgaactgcataggatgttgaatgaagatgagctgagggatgctgtcctgctggtatttgccaacaagcaagatcttccaaatgcaatgactgctgctgagattaccgacaaacttggtctccactccctccgtcagcgtcactggtatatccaaagcacatgtgctacttctggtgaaggtttatatgagggattggactggctgtcaaataacattgccaacaaggcatagagtacaggttcagcctgactgaagcttaggatgaagtacatgcaattgcagcccctgctcaagtgggtgaaatcaagcttttggcctttgtttttctttgcaatattaaagatcacaagagtgatttagtgttaatgtgttaatgcttatgaaggttttgttatgcttatagaaattgctatatcaatacttttgtagattcaggataactgtagtgtatctcaggaaagtgtttgtttcatgttgatacatactgtggtctgtggctgtaatattcttttggaaccaactatggtagttccattatta

SEQ ID NO: 12841 - DNA, 676 bp, Ambrosia trifida
aaaccaaaacaactctctcactctcaggaatcctcatcagaactaggatggggcttacattcaccaagctcttcagccggctttttgccaagaaagaaatgcgtatattgatggttggtcttgatgctgctggtaagacaaccattttgtacaagcttaagcttggggagatagtgactaccatccctaccatcggctttaatgtggagactgttgaatacaaaaacatcagcttcactgtgtgggatgtggggggtcaggacaagatccgtcccctttggaggcactacttccaaaacacacagggtcttatctttgtggtcgatagcaatgatagggatagagttgttgaggcaagagatgagttgcacaggatgttgaacgaggatgagcttagggatgcagttcttcttgtctttgccaacaaacaagatctgcctaatgcaatgaatgctgctgaaatcaccgataagcttggcctccactctcttcgacagcgccactggtacatccagagcacatgcgccacctctggtgaaggactttacgaggggttggactggctctccaacaacattgctaacaaggcatgaggtggagattgaattgtaatttgggggtcaagaaaccggcggcatgttttgcttttgtattgtcgggtcacttttcttactgg

SEQ ID NO: 12842 - DNA, 836 bp, Arnica chamissonis
tccaaaaagcttctctctcagggatcctcatcagaaataggatggggcttacatttaccaaactcttcagccggctttttgccaagaaagagatgcgtatattgatggtgggtcttgatgcagctggtaagaccaccattttgtacaagctcaagctcggggagattgtgactaccatccctaccattggctttaacgtggagactgttgagtacaaaaacatcagcttcactgtgtgggatgttgggggtcaggacaagatccgtccactatggaggcattactttcagaacacacagggtcttatctttgtggttgatagcaatgatagggacagagttgttgaggcaagagatgagttgcacaggatgttgaatgaggatgagctaagagatgcagttctacttgtctttgccaacaaacaagatctgcctaatgcaatgaatgctgctgaaatcactgataagcttggccttcactccctccgacagcgccactggtacatccagagcacctgtgccacttctggggaaggactttatgaggggttggactggctctccaacaacattgctaacaaggcatgaggtgacgattaacctatccttctctgaggtgcaagcgcttatgcaactttgtttgttaaacaggaggcttttggtttgatatatataggatatgttatgatataagtgtttggttggaactttgtttgtatttcaaaggttttgaattatattatccaagggattaagactttgtagtttattactcgttaaaaaggatccttatgatgagaggtttttgggttaaagacttaaagttaattgttatga

SEQ ID NO: 12843 - DNA, 1111 bp, Persea americana
gagacagctccttcgagatctgttcgttcggatcttctgcaaatcgcctcctctcgcatcccgctgaacgaaaatggggctgtctttcaccaagcttttcagtcggctttttgccaagaaagagatgcgcattcttatggtgggtcttgatgctgcgggtaagacaaccattttgtacaagctcaagctaggggagatagtcaccaccattcctaccattggattcaatgtggagactgtggaatataaaaacattagcttcaccgtatgggatgttggtggtcaggataagatccgtcctttgtggagacattacttccaaaatacacaaggccttatttttgtcgttgacagtaatgatcgagaccgtgttgttgaggccagggatgagctgcataggatgttgaatgaggacgagttgagagatgctgtgctgcttgtttttgcaaacaagcaggatcttcccaatgcaatgaatgctgctgagattactgataagcttggcctgcactccctccgccaacgccactggtatatccaaagcacatgcgccacatccggggaagggctgtacgagggcttggactggctctctaacaacattgccaacaaggcttagtgatgcagtgattgatgaagatgattttgggtcccaaagcctgccgagtagatattattatttccatcttgttttagtgtttaaagtgtgagttgttcctttttgataccttggtttagttacggaccctggcatttgttccaatagactattgaataatccggaaatctgctctgtactgtttgggttctttccctttttttggttggagtttcgttacttgttttgaaatagatttctgatcatctctatgtattagttgaagttaattaaatattcattatatatatcgtgtgttacgatgcacaacgtgctccaaattttgagatgttgtacctcgattttgcacagcattatcctggagaagtgactcggaactgcacgtgcttgtgttgaaagcaattaaaatgtagttgcaaacagtagcagtatccttttatttgagttgtaatgtaattttgtattgtggatgttcccatctacatacgtcac

SEQ ID NO: 12844 - DNA, 721 bp, Brassica juncea
ttctctctcgttcaaactccgtctcgttgttacgccatctctctctcaatcgatcagatcatctacgcagagtgaagcaaggatgggattgtcgttcgcgaagctttttagcaggctttttgccaagaaggagatgaggattctcatggttggtcttgatgctgctggtaagaccaccattttgtacaagctcaagctcggtgagattgtcaccaccattcccaccattgggttcaatgttgaaactgtggagtacaagaacatcagcttcactgtctgggatgtcgggggtcaagacaagattcgtccattgtggaggcactacttccagaacactcaaggtctcatctttgtggtggacagcaatgacagagaccgtgttgttgaggctagagatgaattgcacaggatgcttaatgaggatgagctgcgtgatgctgttctgctcgtgtttgctaacaaacaggatcttccaaatgccatgaacgcagctgagatcaccgataagcttggtctccactctctccgtcagcgtcactggtacatccagagcacatgtgccacttcaggcgaggggctttacgaaggtcttgactggttgtccaacaacatcgccggcaaggcgtagagggaaagcttgtggttgagctgattttgctgggcaaatctggatgcaggggcaaacattatctgattttttctttattgttctgttcttttt

SEQ ID NO: 12845 - DNA, 1196 bp, Brassica oleracea
cgttcgttgttacgccatttctctctctctctcgatcagatcatatacgcagaggttattcttgatctggatctatgatactatatgcattctcaattcgaacaaattttgcaggtttcattcccatttttctagtttgggaatcgaatctcttgcattgatctaggtttcgtgctgcttgatgctctgagatttgaaaatttaacgagtcgatgtgccattgcatcgcgtctaagtctggatctgtgaaaatcatcttctcggcgatctataacatgtgatgagcattatctgattgtacttatgtttattagtaatcgctggatgcattgctttgtgatacgctactctgatctctttgtgtgttgttgtattgacacgatgagcaccggttaagagatcggttattgttggtttgatgttgattacaaccggtttaagtttataaaattaatatctttgtggtgtgattagtgaagcaggatgggactgtcgttcgccaagctttttagcaggctttttgccaagaaggagatgaggattctcatggttggtcttgatgctgctggtaagaccaccattttgtacaagctcaagctcggtgagattgtcaccaccattcccactattgggttcaatgttgaaactgtggagtacaagaacatcagcttcacagtctgggatgtcgggggtcaagacaagattcgtccattgtggaggcactacttccagaacactcaaggtctcatctttgtggtggacagcaatgacagagaccgtgttgttgaggctagagatgaattgcacagaatgcttaatgaggatgagctgcgtgatgctgttctgcttgtgtttgctaacaagcaggatcttccaaatgccatgaacgcagctgaaatcactgataagcttggtctccactctctccgtcagcgtcactggtacatccagagcacatgtgccacttcaggcgagggactttacgaaggtcttgactggttgtccaacaacatcgccggcaaggcgtagagggaaagtttgtggttgagttgattttgctgggcaaatctggatgcaggggcaaaacattatctgagtttttctattccggttatcttatattgtttttgttttttttcgggtatgtggattgattttctgatcgttgttttaacttgtgtaaggcgggatgggcc

SEQ ID NO: 12846 - DNA, 1154 bp, Brassica rapa
tgtgaacctctaattggctagattccatcgacggccaatcactcatcatcgcacgtaaaccgcgtaagctcaagccaccctccacgaaaaaacattctgcaaatgggtcttcgaagggtattccggtaatatgaccatgaattgacgttttcacccttcgcctctataaagatcttctccgttttaatattgagcgttgttttgaagctccgttcgttgttacgccatttctctctctctctctctctctccctcgatcagatcatatacacagagtgaagcaggatgggattgtcgttcgcgaagctttttagcaggctttttgccaagaaggagatgaggattctcatggttggtcttgatgctgctggtaagaccaccattttgtacaagctcaagctcggtgagattgtcaccaccattcccaccattgggttcaatgttgaaactgtggagtacaagaacatcagcttcactgtctgggatgtcgggggtcaagacaagattcgtccattgtggaggcactacttccagaacactcaaggtctcatctttgtggtggacagcaatgacagagaccgtgttgttgaggctagagatgaattgcacagaatgcttaatgaggatgagctgcgtgatgctgttctgcttgtgtttgctaacaagcaggatcttccaaatgccatgaacgcagctgaaatcactgataagcttggtctccactcactccgtcagcgtcactggtacatccagagcacatgtgccacttcaggcgagggactttacgaaggtcttgactggttgtccaacaacatcgccggcaaggcgtagagggaaagtttgtggttgaattgattttgctgggcaaatctggatgcaggggcaaaacattatctgagtttttctattccggttatcttatattgtttttgtttttttttggggtatgtggattgattttctgatcgttgttttaacttgtgtaaggcgggatgggcctcttgtacgtagaacacagaaactacctttattacatatatagcttgttattcataagttggaactgcgaatatgctattgagacatttgcttgctatattaaaactgtgtcgaactgtatgacaatgaaatataaaattatgatttccaaagat

SEQ ID NO: 12847 - DNA, 1318 bp, Theobroma cacao
aaagtccttcattttgacacatgggaagaagtcatattttttttattattattcgtatatttttttaagagataaataaaaaatttagtaaatttaactaagccgccctggactaaaaatttattcgtatctagtcaaaacaataaataattaattaatttataaaacatttcatacttgagccgattatttgtaggtgccattaatcaaataaaagagcagagaaataaacggagagagtctcaaaagaaagagatcagatcctccttccaatcacaccagaaagtgctgtgagctagaaagagcagaagagagatggggctgacatttacgaagctctttagccggctttttgccaagaaggagatgcgtattttgatggtgggtcttgatgctgctggtaaaaccactattctgtacaagctcaagctcggtgaaatcgtcaccacaatcccgaccatcgggttcaatgttgagacagtggaatacaagaatatcagcttcactgtttgggatgttgggggtcaggacaagatccgtcctctgtggaggcactatttccagaacactcagggtctcattttcgtggtggatagcaatgacagggaccgtgttgttgaggcaagggatgagttgcacaggatgttgaatgaggatgaattgagagatgctgttttgcttgtatttgccaacaaacaagatcttcccaatgcaatgaatgctgctgaaataactgataagcttggacttcattctctccgccagcgccactggtatatccagagtacatgtgcaacttctggagagggcctttatgaggggcttgagtggctttccaacaacattgctagcaaggcatgagcgaggctcagggttttggttgttagttagactcgttggaattctggcaactctggagaggatggcttcccctttgtcctgtaacttttgtaacgacagaatgtttactagatataatatgtgctttgtttaacctcggctttagcaattacttgtagttgtaaacaacactttattactccagcctttgggagtcggatttgttgcttattactgtttgggttgatttctttggttcatatctactagtatctgatttggtattcgtcagtaatctgtgctgcctccatttctttgataagctgagcaggtgaaggttttcttcacccctgtttgtatttaaactgatctttgctgttctaatagtgcatcaactagtatcaagatgctggtaagtgcacatgaaatgattatctcatgcatgcagttcacgtggttctggaatatttgaccttca

SEQ ID NO: 12848 - DNA, 845 bp, Brassica napus
ttttgaagctccgttctctttcatcgagctccgttcgttgttacgccatttctctctctctctcgatcagatcatatacgcagagtgaagcaggatgggactgtcgttcgccaagctttttagcaggctttttgccaagaaggagatgaggattctcatggttggtcttgatgctgctggtaagaccaccattttgtacaagctcaagctcggtgagatcgtcaccaccatccccactattgggttcaatgttgaaactgtggagtacaagaacatcagtttcacagtctgggatgtcgggggtcaagacaagattcgtccattgtggaggcactacttccagaacactcaaggtctcatctttgtggtggacagcaatgacagagaccgtgttgttgaggctagagatgaattgcacaggatgcttaatgaggatgagctgcgtgatgctgttctgcttgtgtttgctaacaagcaggatcttccaaatgccatgaacgcagctgaaatcactgataagcttggtctccactctctccgtcagcgtcactggtacatccagagcacatgtgccacttcaggcgagggactttacgaaggtcttgactggttgtccaacaacatcgccggcaaggcgtagagggaaagtttgtggttgagttgattttgctgggcaaatcttgatgcaggggcaaaacattatctgagttttttttattccggttatcttatattgtttttgtttttttcgggtatgtggattgattttgtgatcgttgttttaacttgtgtaaggcgggaggggcctcttgtacgtagaacacagaaactaccttattacatat

SEQ ID NO: 12849 - DNA, 812 bp, Brassica napus
tctctctctctctcgatcagatcatatacacagagtgaagcaggatgggattgtcgttcgcgaagctttttagcaggctttttgccaagaaggagatgaggattctcatggttggtcttgatgctgctggtaagaccaccattttgtacaagctcaagcttggtgagattgtcaccaccattcccaccattgggttcaatgttgaaactgtggagtacaagaacatcagcttcactgtctgggatgtcgggggtcaagacaagattcgtccattgtggaggcactacttccagaacactcaaggtctcatctttgtggtggacagcaatgacagagaccgtgttgttgaggctagagatgaattgcacagaatgcttaatgaggatgagctgcgtgatgctgttctgcttgtgtttgctaacaagcaggatcttccaaatgctatgaacgcagctgaaatcactgataagcttggtctccactcactccgtcagcgtcattggtacatccagagcacatgtgccacttcaggcgagggactttacgaaggtcttgactggttgtccaacaacatcgccggcaaggcgtagagggaaagtttgtggttgaattgattttgctgggcaaatctggatgcaggggcaaaacattatctgagtttttctattccggttatcttatattgtttttttttttttcgggtatgtggattgattttctgatcgttgttttaacttgtgtaaggcgggatgggcctcttgtacgtagaacacagaaactaccttattacatatatagcttgttattcataa

SEQ ID NO: 12850 - DNA, 1056 bp, Daucus carota
gtttgagttagagccacaggactcaaaattaaaacgaaggactctcatttctctcccaaccatttctctccctccctccaacattttcttatattaggaaaaatgggtttgtctttcaccaagctgtttagtcgattgtttgcaaagaaggagatgcgtattcttatggtcggtctcgatgctgctggtaagaccaccatattgtacaagctcaaactgggagagattgtcactaccatacctacaattgggttcaacgtggagactgtagaatacaagaacatcagctttacagtctgggatgttggtggtcaggacaagatccggccgttgtggagacactattttcaaaatacccaaggtctcatcttcgtggttgatagcaatgatagggatcgtgtggttgaggctagggatgagctacacaggatgctgaatgaggatgagctgagggatgccgtacttcttgtatttgctaacaaacaagatttaccgaatgccatgaatgctgctgagataactgataagcttggtcttcactccctcaggcagcgccactggtatatccagagcacatgtgcaacttctggagaagggctgtatgagggtctggactggctctccaataatattgctagcaagggttgatgacatgatctttcatatcttcttgagtggaagctgtcagaaaaatttgtgacccattttctttcgagtttgtgttatgttcatcttacttccgtgaatgatctgtttggttttcagcttattgttcatagtacttatctgtataagttttgaccttggcatggttaggacaagtgtggccttttagtccatgagtttctttaaactttagttgtatcaaggttcctattagtaatgaaatgaagttcatccataacatttaaattattttaatcgaggcatagaaaagtgttgaaaaccaaaattttggccatgctctgcgattactataggaagagtgatgaacgttttggccatgatctgcagttactataggaagagtgttgaaagttttggccatactccgcg

SEQ ID NO: 12851 - DNA, 1147 bp, Cenchrus ciliaris
ggagtgaagatggggctcacgttcactaagctgttcagccgcctcttcgccaagaaggagatgaggatcctcatggttggtcttgatgcggctggtaagaccaccatcctctacaagctcaagctcggcgagatcgtcaccaccatccccaccatcggatttaatgttgaaactgttgagtacaagaacattagcttcactgtttgggatgtcggtggtcaggacaagatccggcccttgtggaggcactacttccagaacacccagggcctcatttttgttgtggacagcaatgacagagatcgtgttgttgaggccagagatgagctccatcggatgctgaacgaggatgagcttcgtgatgctgtgcttctggtgtttgcaaacaagcaagatcttcccaatgccatgaacgctgctgaaatcaccgacaagcttggtctgcactccctgcgccagcggcactggtacatccagagcacatgtgccacctccggtgagggtttgtacgagggacttgactggctttccaacaacattgccaacaaggcttgaggcaccttggcagggctccaatcaaatgaaaatacgtcggatgttggagcgcatgctgcctttaccatactgctatgaactatatatagtcgtgacagtaacagtggggtgttttggggaggataaggctccttggttaaggagctagctatcagatgttttcgtgggtattgttaattgtccgtgcttctgttttggttcgtgcaaggtatactaagagccgttgtgctgtgtactagtcagtctgagactctgaggtgaggtgctgtagtatcagacttgcctcttggcatagctagcttaatggtctcgtaatttgttgtgtgcagcatatctttcctcccacatttgctttaccagtaaaagtcagaggttggttagtaccaatcaatgcattcagtaggggcctccggctgacgtcctggctataccggtgaacctgctgactttgggagtgtttggatctcctggacgtatcgaatgttggatactaattagaagtattacactagacaatctattttataactccgggctcaaaaaaaaaaaaaaaaaactcgagactagtctctctcgggggggcccggtaccc

SEQ ID NO: 12852 - DNA, 1081 bp, Coffea canephora
cggccgggggggtaaccaacgcgatatttgggctctctcttctctgctcttctcctcgtcaagggcagaccctctcaagatctgcccctcccccatcgctcaaaacattggcctctgctctctctagagtctctctcgctccacatctttctactcaattgtttgaaaagaaaacaggatgggtttgtcatttaccaagcttttcagccgcctatttgccaagaaggagatgcgcatactgatggtgggtcttgatgctgctggtaagactaccatattgtacaagctcaagctcggagaaatcgttacgaccattcccaccattggatttaatgtggaaactgtagagtacaagaacatcagctttactgtttgggatgttgggggtcaggacaagatccgaccattgtggagacattattttcaaaacacccaagggcttatatttgtggttgatagtaatgaccgagaccgtgttgttgaggctagggatgagctgcacagaatgttgaatgaggatgaactgagggatgcagtcctccttgtttttgcaaataagcaagatcttccaaacgcaatgaatgctgcagagatcaccgacaagcttggtcttcattccctccgtcaacgtcactggtacatccagagcacatgtgccacctctggtgaagggctttatgaggggctggactggctgtctaacaacattgctaacaaggcatagacgatggcagcataccccatgattttgcagatctatcattgtcaaaagtggaaaattacatattaccttgtcattttgtgtttcatccatcttgcatgtgcaagatcgaactgcttttttatgtttagttgattgttatttaacgtacggtttgacattttgatcgggttagatttgagaattgcctgtgatatatagctattgcagtccctatattcttgcaacagtatggtgtactactaaaattccattatcatgttcaatttcttcaaaagtatgcacttgtatttttatcaatgctgctgaaagggtattaaactatcccatctaaaattgcagtaaaaaaaaaaaaaaaaa

SEQ ID NO: 12853 - DNA, 1063 bp, Gossypium hirsutum
attaaaaacgatttgaagtttgagatcaatttaaaatttagattagaggttgaggatgtttaatgaaattagaccgaaaagaattccgtgaaactacaatcatattttgattttggatctgtgaattcccgaaggtctgtttgaaacgctggacgacagttcctttggttttgagagaaaagagtagatcttggcttctctccttcgttcgattccgcttaattatagcccgcgtttctctcagacgtgaaaaatggggctgtctttcacaaagctatttagccggcttttcgccaagaaggagatgcgtatactcatggttgggcttgatgctgcgggtaaaactaccattctttacaagcttaagttgggagagattgtcactaccattcccaccatcggtttcaatgttgagaccgttgaatacaagaacatcagctttactgtttgggatgttggtggccaggacaagatccgaccattgtggagacactacttccaaaacacccaaggacttatttttgtggttgatagcaacgatcgtgatcgtgtggttgaagctagagatgagttgcacaggatgttgaatgaggatgagctgagggatgctgtgctgctagtattcgcaaacaagcaagatcttccaaatgctatgaatgctgctgagattactgacaagcttggccttcattcactccgccagcgccattggtatatccagagcacatgtgctacttccggtgaaggactgtacgaggggctggactggctctcaaacaacattgcaaacaaggcataggtgtgacatgactgagttggcagtcttacaacccttttggattttatgaatgtctgcccccgttttatgtgttattttttatggtttttcacgtttgttgcaaacactgccatttgttacttatagtttaagaataattgacaaagtttgggaccgttatttcctagcgggaattgatggttagccagtttaattacccttttaatgtaaaatatacattatatatacatatattttttttccttcaattcttgaatgcttgtt

SEQ ID NO: 12854 - DNA, 841 bp, Taraxacum officinale
gatcgctctccacaaaccttctctctcaggtatcctcatcagataaaagatggggcttacattcaccaagctcttcagccggctgtttgccaagaaagagatgcgtattttgatggtgggtctcgatgcagctggtaagactaccattttgtacaagctcaagctcggtgagattgtcactacaatccctaccattggatttaacgtggagactgttgaatacaaaaacatcagcttcacagtctgggatgtcgggggtcaagacaagattcgtccactatggaggcactacttccagaacacacagggtcttatctttgtggttgatagcaatgacagggatagagttgttgaggcaagagatgagttgcacaggatgttgaatgaagatgagctaagagatgcagttctccttgtatttgctaacaaacaagatctgccaaatgcaatgaatgctgctgaaatcactgataaacttggcctccactccctccgacagcgccactggtacatccagagtacctgtgctacctctggggaaggactttatgagggattggactggctctccaacaacattgctaacaaggcatgaggtgattgtatttgagaaggggcaagttttgctttttgattggtcggtcactttagtgtacttgttatgggactatgttaaaaaaggcttttatttttgcatttgatatataggacagttttatggacttttttgtatgatacaatgtttgggttggatggattgctgcaaactattttaaagaggtatatctctactgtcttcttgtttctaggttttaacctatgattattcattactattacc

SEQ ID NO: 12855 - DNA, 1021 bp, Echinochloa colona
tcggaccgcagccacagcctcgcgtcgcattcgtctcgctcgcgtcgtcgctcccgcctccgccgatccgcgcgcgcagatcgccgaagcccgggcggcacaggggcaaaggggagggagggagctcgcgcggcggcggaggaaggcgttcgccaccgtctcgaggaagagatggggctctcgttcgggaagctgttcagccgcctcttcgccaagaaggagatgaggatcctcatggtggggcttgatgccgccggtaaaaccaccatcctctacaagctcaagctcggcgagatcgtcaccaccatccccaccatcggattcaacgttgaaactgtcgagtacaagaacattagcttcactgtttgggatgtcggtggtcaagacaagatcaggcccctgtggaggcactacttccagaacacgcagggtctcatttttgttgtggacagcaatgacagggagcgtgttgtcgaggctagggatgagctccacagaatgctgaacgaggatgagctgcgtgatgctgtgctgcttgtatttgcaaacaaacaagatcttcctaatgccatgaatgctgctgaaattactgacaagcttggcctgcattctctgcgccagcggcactggtacatccagagcacttgtgctacatctggtgaagggttgtacgaggggcttgactggctttccaacaacattgccaacaaggcttgaagcttttcggcaggtctctcaggaagaggaagacgtctgaacaccttattgctaccgttttacatattatgattattatacaatcaacaatagatagtgtggagtgcttgtgaaaaaagaaaagtcgggctctctttggaggggctagtaccagattgggttgtgtttttgttttgtggcattttgggtccttattatcgcctgctcggtttcacaaaaactgattctgtcgatcatgtgtacttaaaacttcggtgatggccggtgtggcaaattaaattaacatgctgtgccatgtggattt

SEQ ID NO: 12856 - DNA, 854 bp, Epimedium sagittatum
gacgaggaggaggatggagagtgaatctgacggtgtagattgtgagatggaggaggcgttggtggtggaaaacagctccttaagatctgctgtttcgttccgtttcaaagccttttcatcttctctctcacataggtgaagatggggctgtctttcaccaagctttttagtcggctattcgccaagaaagagatgcgtattcttatggtcggtctcgacgcagctggtaaaaccaccattttgtacaagctcaagcttggagagattgtgaccaccattccaacaattgggtttaatgttgagaccgtggaatataagaacattagcttcactgtctgggatgttggtggccaggacaagattaggcctttatggagacattacttccagaacacacaaggtcttatctttgtggttgacagcaatgatcgtgaccgtgtggttgaagctagggatgagctccacaggatgttgaacgaggatgagttgagagatgccgtgcttctagtgtttgcaaacaaacaggatcttccaaatgcaatgaatgcagcagagatcactgataaacttggtcttcactcacttcgccaacgtcactggtatatccagagcacatgtgccacatcaggtgaaggtttgtatgaggggctcgactggctctccaacaacattgctaacaaggcatagatgttcagagaataattgatgtggtccaaagttgtcaagattagagatatattttctattgtaatttgttggtatgcttttttatgttgtccttatgctgtttgtggacagaagatactgttgttatcaaaccttttgtgaaaggttttatatagtttcgaattcat

SEQ ID NO: 12857 - DNA, 1011 bp, Eschscholzia californica
ttctccttcgctgacccttctccgtttaagttgtctctctctttctctccaaaaagcgcagatctgattcagatttggaggatcaattgtgaaatagaagtatggggttgtctttcgggaagcttttcagcaggctttttgctaaaagagagatgcgtattctgatggttggtcttgatgctgctggtaagacaacaatcttgtataagctcaagcttggagagattgttaccacaattccaaccattgggtttaatgtggagacagtagaatacaagaacatcagtttcacagtttgggatgtcgggggtcaggacaagattcgtccattgtggaggcattatttccaaaatacccaaggtcttatctttgtggtcgatagcaatgacagagaccgtgttgttgaagcaagagatgagttgcataggatgttgaatgaggatgagttgagagatgctgtgttgcttgttttcgcaaacaaacaagatcttcccaatgcaatgaatgctgcggaaataactgataagcttggacttcactctcttcgtcagcgccattggtacatacagagcacttgtgctacctctggagaggggctttatgagggtttggattggctatccaacaacatcgccaacaaggcttgaagcaactgaatttcgtggtgttcttttttgggaggtcgtgttcttgatgggtgcaatggtagtagatattgacgaagctttgggtggcaaaggtgactcccacaagatgagccattctcatgagtttctgtttttttgttaaagcaagtaattactaaagttgtgacaagagaacgcccagttggatttgatgcttttatcagtcttgctctttatctttgaaagtcgaattcatacttttgctttttaacttcattcttcttctgtatgaccccatttttttcgtgaattctgttgcttttctacttcatcctgttctgtaattgaatgttaatgctagctatttgtacccgttgtacttgct

SEQ ID NO: 12858 - DNA, 976 bp, Fagopyrum esculentum
ccgaaattactggctccaccacatctcagatctacatcccgaccttcgtagtcccagagcactttcatctctttcaaaatggggctatccttcaccaagttgtttagtaggctgtttgccaagaaggagatgcgaattctcatggtgggtctcgatgctgctggtaagaccaccattttgtacaagcttaagctgggagagattgtcacaacgattccaaccatcggattcaatgttgaaactgtggaatacaagaacataagctttactgtctgggatgtcgggggtcaggacaagattcgtccattgtggagacactacttccagaatactcaagggctaatctttgtggtggatagcaacgatcgcgaccgtgttgttgaggcaagagacgaactgcatagaatgttgaatgaagatgagctaagggatgcagtgcttcttgtttttgccaacaaacaagatcttccaaatgcaatgaatgcagctgagattactgacaagcttggtcttcactcccttcgtcagcgccattggtacattcagagcacatgtgccacctccggagaagggctatatgaagggctggactggctctcaaacaacattgcaaacaaggcgtgaaagcagtagagtttccattgcgagttagctgaattttggtcacagggatttaagaaaggatttacggccttgctgtctgtgtcaagattgaacggtgcttttataattcattcccctttgttcctgccgttatgaatgattgaagaacgtgtctttaaagatgatgagactttcattgtggctgtttaagcttgtcatattctatcttattataatatgtagagattcagaagttctgtacttgctgttaatataaattgacaggttattttccttatttcttttgggatgctcgattatgaaaaattcccggtgaacttgatgagctaatctataagtggcatttgtgact

SEQ ID NO: 12859 - DNA, 963 bp, Festuca arundinacea
gcactgcacgacagccccaaagcctcctctcgcatccgtgcggttccaagctccaaactctgcccgtcttcttcgccgagatcaggaggacgagcccgctgcggagcggagcgagctcgtagccgtcgtcgccgtctcgggggagagatggggctcacgttcggcaagctgttcagccgcctcttcgccaagaaggagatgaggattctcatggtcggtctcgatgccgctggtaagaccaccatcctctacaagctcaagctcggagagatcgtcaccaccatcccaaccatcggatttaacgttgagactgtcgaatacaagaacatcagcttcactgtttgggacgtggggggccaagacaagatcaggcccctgtggaggcactacttccagaatacgcagggactcatctttgttgttgacagcaatgatagggagcgtgttgttgaggccagagatgagctccacaggatgctcaatgaggatgagctgcgtgatgctgtgttacttgtatttgcaaacaaacaagatcttcctaatgccatgaatgcggctgaaatcactgacaagcttggtctgcactccctgcgccagcggcactggtacattcagagcacctgtgctacatctggcgaaggattgtacgagggacttgactggctctccaacaacattgccaacaaggcttgaagtgtctccacaacgcttcgaggaacctctggctgtgaagaactcactgctaccatttttcatattgtgatatataaatatatacactctacaacagatagtatgtatgcttatgtgacagaagctctcctttgagtgggctagtatcaggttgtttcttcgtgtgggtattatcagcgtttctgttcggttttacaaggtttactctgtcaaccatgtgtatgtttttgagatatagtaaaattgaggtgcggtgccaaaaaaaaaaaa

SEQ ID NO: 12860 - DNA, 901 bp, Festuca arundinacea
ccccgtctccgccgagatcagaagaggagcccgcatcggagcggagcgagctcgaggccggcgtcgccatctcggaggagagatggggctctcgttcggcaagctgttcagccgcctcttcgccaagaaggagatgaggattctcatggttggtctcgacgccgctggtaagaccaccatcctctacaagctcaagctcggagagatcgtcaccaccatcccaaccatcggattcaacgttgagactgttgaatacaagaacatcagcttcactgtttgggatgtcgggggacaagacaagatcaggcccctgtggaggcactacttccagaatacgcaggggctcatctttgttgttgacagcaatgatagggagcgtgttgttgaggccagagacgagctccacaggatgctcaatgaggatgagctgcgtgatgctgtgttgcttgtatttgcaaacaaacaagatcttcctaatgccatgaatgctgctgaaatcactgacaagcttggtctgcactcccttcgccagcggcactggtacattcagagcacttgtgctacatctggcgaaggattgtacgagggacttgactggctctccaacaacattgccaacaaggcttgaagtgtctccacaacgcttcgaggaacaaaggctctggctgtctgaagaactcactgctaccattttacatattgtgatatataaatatatacactctacaacagatagtatgtatgcttatgtgacagaagctctcctttgagtgggctagtatcaggttgtttcttcgtgtgggtattatcagcgtttctattcggttttacaaggtttactgtgtcaaccatgtgtatgtacacctatgtttttgagatatagtaaaattgaggtgcgttg

SEQ ID NO: 12861 - DNA, 823 bp, Flaveria ramosissima
atcgatccctcatcaaaaaagccttttctctcagggatcatcatcagaaacaggatggggctcacattcaccaagctcttcagccgtctttttgccaagaaagagatgcgtatattgatggtgggtcttgatgcagctggtaagacaaccattttgtacaagctcaagctcggggagattgtgactaccatccctaccattggatttaatgtggaaactgttgagtacaaaaacataagcttcactgtgtgggatgtggggggtcaggacaagatccgtccactatggaggcactactttcagaacacacaaggtcttatctttgtggttgatagcaatgatagggatagagttgttgaggcaagagatgagttgcacaggatgttgaacgaggatgagctaagggatgcagttcttcttgtatttgctaacaaacaagatctgcctaatgcaatgaatgctgctgaaatcactgataagcttggccttcactctctccgacagcgccactggtacatccagagcacttgcgccacctctggggaaggactttacgagggtttggactggctctccaacaacattgctaacaaggcatgaggtgatgatcgacttgtaaaaggttggaaaacccgaggcgagtttagcttttcgtctggtcaggtctctttcccgttctcatcagtgcgagcggttatgaaactttgtttgttaaacaggcttttgatttgatatatataggacatgttatggtacaatgtttgcttggaagtttgttcggtttttttaaggttttgattcatataatctaaaggatttaaaa

SEQ ID NO: 12862 - DNA, 904 bp, Flaveria ramosissima
atgggacgctaccttattttatgaacctctatatctcctctcccacccacattttcagatcgatcgatccctcatcaaaaaagccttttctctcagggatcatcatcagaaacaggatggggctcacattcaccaagcttttcagccgtctttttgccaagaaagagatgcgtatattgatggtgggtcttgatgcagctggtaagacaaccattttgtacaagctcaagctcggggagattgtgactaccatccctaccattggatttaatgtggagactgttgagtacaaaaacataagcttcactgtgtgggatgttgggggtcaggacaagatccgtccactatggaggcactacttccagaacacacaaggtcttatctttgtggttgatagcaatgatagggatagagttgttgaggcaagagatgagttgcacaggatgttgaacgaggatgagctaagggatgcagttcttcttgtatttgctaacaaacaagatctgcctaatgcaatgaatgctgctgaaatcactgataagcttggccttcactctctccgacagcgccactggtacatccagagcacttgcgccacctctggggaaggactttacgagggtttggactggctctccaacaacattgctaacaaggcatgaggtgatgatcgacttgcaagaggttggaaaacccgaggcgagtttagcttttcgtttggtcaggtatctttcccgttctcatcagtgggagcggttatgaaactttgtttgttaaacaggcttttgattttatatatataggacatgttatggtacaatgtttgcttggaagtttgtcggtatattaaaggttttgtttgattcatataatctaaaggatttaaatagatcaggctggtttg

SEQ ID NO: 12863 - DNA, 775 bp, Flaveria ramosissima
tctcaggagcatcatcagaaacaggatggggctcacattcaccaagcttttcagccgtctttttgccaagaaagagatgcgtatattgatggtgggtcttgatgcagctggtaagacaaccattttgtacaagctcaagctcggggagattgtgactaccatccctaccattggatttaatgtggagactgttgagtacaaaaacataagcttcactgtgtgggatgttgggggtcaggacaagatccgtccactatggaggcactacttccagaacacacaaggtcttatctttgtggttgatagcaatgatagggatagagttgttgaggcaagagatgagttgcacaggatgttgaacgaggatgagctaagggatgcagttcttcttgtatttgctaacaaacaagatctgcctaatgcaatgaatgctgctgaaatcactgataagcttggccttcactctctccgacagcgccactggtacatccagagcacttgcgccacctctggggaaggactttacgagggtttggactggctctccaacaacattgctaacaaggcatgaggtgatgatcgacttgtaagaggttggaaaacccgaggcgagtttagcttttcgtttggtcaggtctctttcccgttctcatcagtgggagagcttatggaactttgtttgttaaacaggcttttgatttgatatatataggacatgttatggtacaatgtttgcttggaagtttgtcagtattttaaaggttttgttttgatt

SEQ ID NO: 12864 - DNA, 711 bp, Flaveria ramosissima
tattccacaagccccttttcctctttctctcattctcctcgatcgatccctctccaaaaggttcatttgcagggatcctcgcttgaaataaaatggggctaacattcaccaagctctttagcaggctctttgccaagaaagagatgcgaatcttgatggtgggtcttgatgcagctggtaagacaaccattttgtacaagctcaagcttggtgagatcgtgacaacaattcctacgattgggtttaatgtggagaccgttgagtacaaaaacatcagcttcactgtctgggatgttgggggtcaggacaagattcgtccattgtggaggcactacttccaaaacacacaaggtcttatctttgtggttgatagcaatgacagggatagagttgttgaggcaagagacgagttacataggatgttgaacgaggacgagcttcgagatgcagtcttgcttgtatttgctaacaaacaagatcttccaaatgcaatgaatgctgctgaaatcactgataagcttggcctccattccctccgacaacgccactggtacatccagagcacttgtgcaacctcaggagagggactttacgagggtctggattggctctccaataacattgcgaacaaggcgtaagatgagactgaatgcagatcttggatgcttttaagtgatgacgttgtttttgtgttcgtgggatttgtttgtt

SEQ ID NO: 12865 - DNA, 851 bp, Flaveria ramosissima
cccctcattcatactcttcatatatctctctcttcgaatcgatcgattgatcccttcctaacaagcttttctcagggatcctcactagcaaaaggatggggctaactttcaccaaactcttcagccggctctttgccaagaaagagatgcgtatattgatggtgggtctcgatgcggctggtaagacaaccattttgtacaagctcaagctcggcgagattgtgaccaccattcctaccataggttttaatgtggagactgttgagtacaaaaacattagcttcacagtgtgggatgtcgggggtcaggacaagattcgtccattgtggaggcactatttccagaacacccagggtcttatctttgtggttgatagcaatgacagggacagagttgttgaggcaagagatgaattgcacaggatgttgaatgaagatgagttgagagatgcagttctccttgtgtttgctaacaaacaagatcttccaaatgcgatgaatgctgctgaaatcactgataagcttggtctccactctctccgacagcgtcactggtacatccagagcacttgtgcaacctctggggagggactttatgaaggtttggattggctttccaacaacatagcaaacaaggcatgaggcaactagagggtggatgttgggagtttgtgttactggttttggaagttgttgtttgaaagggtaatttgctttcgatataatacattgtttttatgtttggactgaaagtatgtgtttggtaggttggctattattctttaatctgaagttgttgagtttatgtggtggttagaattcttatgtagtctgttggtatgctattattat

SEQ ID NO: 12866 - DNA, 783 bp, Flaveria ramosissima
tctacgttgacgcatctcttccccatattccacaagccccttttcctctttctctccttctcctcgatcgatccctctccaaaaagtctttttgcagggatccttgcttgaaataaaatggggctaacattcaccaagctctttagcaggctctttgccaagaaagagatgcgaatcttgatggtgggtcttgatgcagctggtaagacaaccattttgtacaagctcaagcttggtgagatcgtgacaacaattcctacgattgggtttaatgtggagaccgttgagtacaaaaacatcagcttcactgtctgggatgttgggggtcaggacaagattcgtccattgtggaggcactacttccagaacacacaaggtcttatctttgtggttgatagcaatgacagggatagagttgttgaggcaagagacgagttacataggatgttgaacgaggacgagcttcgagatgcagtcttgcttgtatttgctaacaaacaagatcttcctaatgcaatgaatgctgctgaaatcactgataagcttggcctccattccctccgacaacgccactggtacatccagagcacttgtgcaacctcaggagagggactttacgagggtctggattggctctccaataacattgcgaacaaggcgtaagatgagactgaatgcagatcttggatgcttttaagtgatgacgttgtttttgtgttcgtgggatttgtttgttaaacaggttttgtggtagcaaatgtgtctactcatatgatatttgtt

SEQ ID NO: 12867 - DNA, 853 bp, Flaveria ramosissima
cccctcattcatactcttcatatatctctctcttcgaatcgatcgattgatcccttcctaacaagcttttctcagggatcctcactagcaagaggatggggctaactttcaccaaactcttcagccggctctttgccaagaaagagatgcgtatattgatggtgggtctcgatgcggctggtaagacaaccattttgtacaagctcaagctcggcgagattgtgaccactattcctaccataggttttaatgtggagactgttgagtacaaaaacattagcttcacagtgtgggatgtcgggggtcaggacaagattcgtccattgtggaggcactatttccagaacacccagggtcttatctttgtggttgatagcaatgacagggacagagttgttgaggcaagagatgaattgcacaggatgttgaatgaagatgagttgagagatgcagttctccttgtgtttgctaacaaacaagatctcccaaatgcgatgaatgctgctgaaatcactgataagcttggtctccactctctccgacagcgtcactggtacatccagagcacttgtgcaacctctggggagggactttatgaaggattggattggctttccaacaacatagcaaacaaggcatgaggcaacgagagggtggatgtcggcagtttgtgttactggttttggaagttgttgtttgaaagggtaatttgcttctgatataatacattgtttttatgtttggaccgaaagtatgtgtttggtaggttggctattattctttaatctgcagttattgagtttatgtggtggttagaattctaatgtagtctgttggtatgctattattatga

SEQ ID NO: 12868 - DNA, 736 bp, Flaveria ramosissima
gatcgatccctcatcaaaaaagcttctctctcagggatcgtcatcagaaacaggatggggctcacattcaccaagctcttcagccgtctttttgccaagaaagagatgcgtatattgatggtgggtcttgatgcagctggtaagacaaccattttgtacaagctcaagctcggggagattgtgacaaccatccctaccattggatttaatgtggagactgtcgagtacaaaaacataagcttcactgtgtgggatgtggggggtcaggacaagatccgtccactatggaggcactactttcagaacacacaaggtcttatctttgtggttgatagcaatgatagggatagagttgttgaggcaagagatgagttgcacaggatgttgaacgaggatgagctaagggatgcagttcttcttgtatttgctaacaaacaagatctgcctaatgcaatgaatgctgctgaaatcactgataagcttggccttcactctcttcgacagcgccactggtacatccagagcacttgcgccacctctggggaaggactttacgagggtttggactggctctccaacaacattgctaacaaggcatgaggtgatgatcgacttgtaagaggttggaaaacccgaggcgagtttagcttttcgtttggtcaggtctctttcccgtttcatcagtgggagagcttatggaactttgtttgtaaacaggcttttgatttgatatata

SEQ ID NO: 12869 - DNA, 837 bp, Flaveria ramosissima
acgtaagacgagtggtagtcaacgacacgagtacgatggggagtcgatccctcactcgaaaagcttctctctcagggatcatcatcagaaacaggatggggctcacatttaccaagctcttcagccggctttttgccaagaaagagatgcgtatattgatggtgggtcttgatgcagctggtaagacaaccattttgtacaagctcaagctcggggagattgtgactaccatccctactattggctttaatgtggagactgttgagtacaaaaacataagcttcactgtgtgggatgtggggggtcaggacaagatccgtccactatggaggcactactttcagaacacacagggccttatctttgtggttgatagcaatgatagggatagagttgttgaggcaagagatgagttgcacagaatgttgaacgaggatgagctaagggatgcagttcttcttgtctttgctaacaaacaagatctgcctaacgcaatgaatgctgctgaaatcaccgataagcttggccttcactctctccggcagcgccactggtacatccagagcacctgtgctacctctggggaaggactttacgaggggttggactggctctccaacaacattgctaacaaggcatgaggtgatggtcgacttgtaagaggttgcaaaacccaaggcgagtttagcttttcgtttggtcaggtctctttcccgttctcatcagtgcgagcagttatgaaactttgtttgttaaacaggtctttgatttgatatatataggaccatgttatgatacaatgtttgtttggaagtttgttggtattttaaaggtttg

SEQ ID NO: 12870 - DNA, 837 bp, Flaveria ramosissima
tctctctctattcgaatcgatcgattgatcgctctcgaacaagcttttctcagggatcctcactagcaagaggatggggctaactttcaccaaactcttcagccggctctttgccaagaaagagatgcgtatattgatggtgggtctcgatgcggctggtaagacaaccattttgtacaagctcaagctcggtgagattgtgaccactattcctaccataggttttaatgtggagactgttgagtacaaaaacattagcttcacagtgtgggatgttgggggtcaggacaagattcgtccattgtggaggcactatttccagaacacccagggtcttatctttgtggttgatagcaatgacagggacagagttgttgaggcaagagatgaattgcacaggatgttgaatgaagatgagttgagagatgcagttctacttgtgtttgctaacaaacaagatctcccaaatgcgatgaatgctgctgaaatcactgataagcttggtctccactctctccgacagcgtcactggtacatccagagcacttgtgcaacctctggggagggactttatgaaggattggattggctttccaacaacatagcaaacaaggcatgaggcaaggagagggtggatgttggcagtttgtggtactggtttggaagttgttgtttgaaagggtaaattgcttctgatataatacatttgttttatgtttggactgaaagtatgtgtttggtaggttggctattattctttaatctgaagttgttgagtttatgtggtggttagaattcttatgtagtctgtggtatgctatgattatatgatatggt

SEQ ID NO: 12871 - DNA, 901 bp, Linum usitatissimum
gtttctcttttcatctctccgttcgcgtttgtcacctcgtcgccgatcccgtctgcaaagggatcagaacatcaaaggaagagaaaaatggggttgacgttcactaagctcttcagccggctgtttgccaagaaggagatgaggattctcatggttggtctcgatgcggctggtaagaccaccatcttgtacaagctcaagctcggagagatcgtcaccactattcccaccatcggattcaacgtggagactgttgaatacaagaacattagcttcacagtgtgggatgtcgggggtcaagacaagatccgtccattgtggaggcattatttccagaacactcagggtctcatcttcgttgtggacagcaatgacagagatcgtgttgttgaggccagagatgagttgcacaggatgttgaatgaggatgagctgagagatgcggtgcttcttgttttcgctaacaaacaggatctgccgaatgcaatgaacgctgctgagatcactgacaagctcggcctccactccctccgtcagcgtcactggtacatccagagcacttgtgctacttctggtgagggtctttacgaaggtctggactggctctccaacaacatcgctaataaggcttaaatctgggagagacgagcagcattttgtgggattgtcagttctggatgcaggggtgaatattatctagtttatcgctttccttctctccttcagacatttggattgtattttttgttttgcatattgtttttatctcctcctcccttctccctgccctcgtcactgtggggggagaaatgccctttctttgttctaggacctttttacccatgtcttaatatactgtaatagaatatgtatctgcgttggattatatcacttttgacca

SEQ ID NO: 12872 - DNA, 920 bp, Linum usitatissimum
gtttcttttttcatctctctgttcgcgtttttcacctcatcgccgatcccgtctgcgaagggatcagaacatcaaaggaagagaaaaatggggttgacgttcactaagctgttcagccggctgtttgccaagaaggagatgaggattctcatggttggtctcgatgcggctggtaagaccaccatcttgtataagctcaagctcggagagatcgtcaccaccattcccaccatcggattcaacgtggagactgttgaatacaagaacattagcttcacagtgtgggatgtcgggggtcaggacaagatccgtccattgtggaggcattatttccagaacactcagggtctcatctttgttgtggacagcaatgacagagatcgtgttgttgaggccagagatgagttgcacaggatgttgaatgaggatgagctgagagatgcagtgctgcttgttttcgctaacaaacaggatctgccaaatgcaatgaacgctgctgagatcaccgacaagcttggcctccactccctccgtcagcgtcactggtacattcagagcacctgtgctacttctggtgagggtctttacgaaggtctggactggctctccaacaacatcgctaacaaggcttaaatctgggagagatgagcagcagcattttgtgggggattggcagttctggatgcaggggtgaatattatctagttttatcgctttccttctctacttcagacatttggattgtattttttgttttgcatattgtttttaccttgtcccccctcccccaacctccttctccctgccctcgttactgtgggggagaatgcccttctttgttctaggaccttttttacccatgccttaatatactgtactagaatatggtactctccgttggattatatcacttttgacca

SEQ ID NO: 12873 - DNA, 852 bp, Gerbera hybrid cultivar
atctcgtcggtgattgccggttccccatttcagaagatctccgtccggtaatacaaagatggggttgtctttcaccaagcttttcagccgcctttttgctaagaaagagatgcgcattttgatggttggtctcgatgcggctggtaaaaccacaattttgtacaagctcaaattgggggagattgtaaccactattcctactattggctttaacgttgaaactgttgagtacaagaacatcagctttactgtttgggatgttggtggtcaagacaagattcgacctttgtggaggcattacttccaaaacacacaagggcttatctttgtggttgatagcaatgatcgtgaccgtgtggtggaggctagagatgaactacacaggatgcttaatgaggatgaactgagagatgcagttttgctggtgtttgccaacaaacaagatcttccaaatgctatgaatgccgctgagattactgataagcttggcttgcattctcttcgacagcgacactggtatattcagagcacatgtgccacctccggagaaggtctatacgagggattggattggctttccaacaacattgctaacaaggcttaaacatgatggatggactgcaactactgttagtgtccttttgttttgaattgttttataatttttctattgcttttcaacaaagaagatgtaatgcacatgtagaattgatggatttgtgtgccatatgttggcaaaacaacttttgcatgttcttcaaacaaccagtttcttcagactttactacttgtttgtttatgttcaatattcagatatataactgcttttcatatccaaaaaaaaaaaaaaaa

SEQ ID NO: 12874 - DNA, 889 bp, Panax ginseng
ggaacttggtattgtaagggcagtctcaaaagatctgcccctttctctctcgtcgtcgttcaaattatctgttgatcatcatacattaggaaaaatgggtttgtcgttcggcaagctctttagtcggctgtttgcgaagaaggagatgcgtatacttatggtgggtcttgatgctgctggtaagaccaccatattgtacaagctcaaactgggagagattgttaccaccattcctacgattgggtttaatgtggagactgtggaatacaagaacatcagcttcaccgtttgggacgttggtggtcaagacaagattcgacccttgtggagacactactttcagaatactcaagggcttatctttgtggttgacagcaatgacagggaacgtgtggttgaggctagggatgagttgcacaggatgttgaatgaggatgagttgagggatgctgttctgcttgtatttgctaacaaacaagatcttccaaatgccatgaacgctgctgagataactgacaagctaggtcttcactccctcaggcaacgtcactggtatatccagagcacatgtgccacctctggggaagggctgtacgaggggctggactggctctccaacaatattgctaacaaggcttgatggcatgattttccatgacattttgagcggaagttacgtctaaatggagttactattgtgtttcttggcagtttgtaatttgttcatcttacttcccgtgaatgatatttttatcgtgttcagtttattggttcttgttagttttgcacagacttttgttgatttatattcatgtttattcttcatagggttaggacaagtacagtggtgcttaatgcatgagtttgtctaagcatttgctattgtgtt

SEQ ID NO: 12875 - DNA, 1077 bp, Panax ginseng
aagcagtggtatcaacgcagagtacatggggaccttggaacttggtattgtaagggcagtctcaaaagttctgcccctttctctctcgtcgtcgtccaaattatctgttgatcatcatacattaggaaaaatgggtttgtcgttcggcaagctctttagtcggctgtttgcgaagaaggagatgcgtatacttatggtgggtcttgatgctgctggtaagaccaccatattgtacaagctcaaactgggagagattgttaccaccattcctacgattgggtttaatgtggagactgtggaatacaagaacatcagcttcaccgtttgggacgttggtggtcaagacaagattcgacccttgtggagacactactttcagaatactcaagggcttatctttgtggttgacagcaatgacagggaacgtgtggttgaggctagggatgagttgcacaggatgttgaatgaggatgagttgagggatgctgttctgcttgtatttgctaacaaacaagatcttccaaatgccatgaacgctgctgagataactgacaagctaggtcttcactccctcaggcaacgtcactggtatatccagagcacatgtgccacctctggggaagggctgtacgaggggctggactggctctccaacaatattgctaacaaggcttgatggcatgattttccatgacattttgagcggaagttacgtctaaatggagttactattgtgtttcttggcagtttgtaatttgttcatcttacttcccgtgaatgatatttttatcgtgttcagtttattggttcttgttagttttgcacagacttttgttgatttatattcatgtttattcttcatagggttaggacaagtacagtggtgcttaatgcatgagtttgtctaagcatttgctattgtgttgaggttattattagtaaatgaaatgaagctcttttgttccatttgaaccaacataatatttgatctcaagtattatgaagttatgaatttggtctttgtacacatctgaaaaacttgcaacaatgttcactctttgatggtgcatgatagaa

SEQ ID NO: 12876 - DNA, 948 bp, Panax ginseng
cagtggtatcaacgcagagtacatggggggaacttggtattgtaagggcagtctcaaaagttctgcccctttctctctcgtcgtcgtccaaattatctgttgatcatcatacattaggaaaaatgggtttgtcgttcggcaagctctttagtcggctgtttgcgaagaaggagatgcgtatacttatggtgggtcttgatgctgctggtaagaccaccatattgtacaagctcaaactgggagagattgttaccaccattcctacgattgggtttaatgtggagactgtggaatacaagaacatcagcttcaccgtttgggacgttggtggtcaagacaagattcgacccttgtggagacactactttcagaatactcaagggcttatctttgtggttgacagcaatgacagggaacgtgtggttgaggctagggatgagttgcacaggatgttgaatgaggatgagttgagggatgctgttctgcttgtatttgctaacaaacaagatcttccaaatgccatgaacgctgctgagataactgacaagctaggtcttcactccctcaggcaacgtcactggtatatccagagcacatgtgccacctctggggaagggctgtacgaggggctggactggctctccaacaatattgctaacaaggcttgatggcatgcttttccatgacattttgagctgaagttgcgtctaaatggagttactattgtgtttcttggcagtttgtaatttgttcttcccgtgaatgatatttttatcgtgttcagtttattggttcttgttagttttgcaccgacttttgttgatttatattcatgtttattcttcatagggttaggacaagtacagtggtgcttaatgcatgagtttgtgtaagcatttgctattgtattgaggttattattagtaaatgaaatgaagctcttttgtt

SEQ ID NO: 12877 - DNA, 917 bp, Gossypium raimondii
gaaggtctgtttgaaacgctggaggacagttcctttgattttgagagaaaagagtagatcttggcttctctccttcgttcgattccgcttaattatagcccgcgtttctctcagacgtgaaaaatggggctgtctttcacaaagctatttagccggcttttcgccaagaaggagatgcgtatactcatggttgggcttgatgctgcgggtaaaactaccattctttacaagcttaagttgggagagattgtcactaccattcccaccatcggtttcaatgttgagaccgttgaatacaagaacatcagctttactgtttgggatgttggtggccaggacaagatccgaccattgtggagacactacttccaaaacacccaaggacttatttttgtggttgatagcaacgatcgtgatcgtgtggttgaagctagagatgagttgcacaggatgttgaatgaggatgagctgagggatgctgtgctgctagtattcgcaaacaagcaagatcttccaaatgctatgaatgctgctgagattactgacaagcttggccttcattcactccgccagcgccattggtatatccagagcacatgtgctacttccggtgaaggactgtacgaggggctggactggctctcaaacaacattgcaaacaaggcataggtgtgacatgactgagttggcagtcttacaacccttttggattttatgaatgtctgcccccgttttatgtgttattttttatggtttttcacgtttgttgcaaacactgccatttgttacttatagtttaagaataattgacaaagtttgggaccgttatttcctagcgggaattgatggttagccagtttaattacccttttaatgtaaaatatacataatatatacatatatattttttccttcaa

SEQ ID NO: 12878 - DNA, 824 bp, Guizotia abyssinica
gaccgatccctcttcgaaaaaccatctctctcagggatcctcatcagaaataagatggggcttacatttaccaagctcttcagccggctttttgccaagaaagagatgcgtatattgatggtgggtcttgatgcagctggtaagaccaccattttgtacaagctcaagctcggggagattgtgactaccatccctaccattggcttcaatgtggagactgttgagtacaaaaacatcagcttcactgtgtgggatgtggggggtcaagacaagatccgtccactatggaggcactactttcagaacacacagggtcttatctttgtggttgatagtaatgatagggatagagttgttgaggcaagagatgagttgcaccggatgttgaatgaggatgagctaagggatgcagttcttcttgtctttgctaacaaacaagatctgcctaatgcaatgaatgctgctgaaatcactgataagcttggccttcactctctccgacagcgccactggtacatccagagcacctgtgccacctctggggaaggactttacgagggattggactggctttccaacaacattgctaacaaggcatgaggtgatgattgacttgtaagagggtgaaaaacccggagtcgagtttagcttttcgtttggtcaggttactttctgttcgcatccttctcctgaggtgcgagtggttatggaactttgtttgtaaacagggctgtcattctatatatatagaacatgttatgatacaatgtttggttggaactttgttggtttgattcttataatctaaaggtttttcatattac

SEQ ID NO: 12879 - DNA, 1321 bp, Lactuca sativa
gcttaacagcacaatatataaaaccgagagacgtgactgggaccatttgatttggttaaaaactgacggttctcaaacgtccacttttcttctctcaaaccccttcaactaataaatactacgcctactctcaactctctccgatcccttctcttctattcatcgcgaatttaatcggtgatcgccggcttcccactccgtaagatctccgtcccatcatacaaagatggggttgtctttcaccaagcttttcagtcgcctttttgctaagaaggagatgcgtattttgatggttggtctcgatgcagctggtaaaaccaccattttgtacaagctcaaattgggggagattgtaaccactattcccaccattggatttaatgtggaaaccgttgagtacaagaacatcagctttactgtatgggatgttggtggtcaggacaagattcgccctttgtggaggcactacttccaaaacacacaagggcttatctttgtggttgatagtaacgatcgtgatcgtgtggtggaagctagagatgaacttcacaggatgcttaatgaggatgagttaagagatgcagttttgcttgtgtttgccaacaaacaagatcttccaaatgccatgaatgctgctgagattactgataaacttggcttgcattctctcagacagagacactggtatattcagagcacatgtgccacctctggtgagggtctatatgaaggtctggattggctttccaacaacattgctaacaaggcttaaaagagagatagacatcatggtcttcttactgggttactgcagctactattagagtgtttgtttctaaatctttggagttgtgggtgttatatgtaaacctaaaatttgtgtcactttttacatattttcaagattgagatgtcttactcttatggatgagtagtgttttgtttttttagttggtttatgattaaaatccatattctgtggatttagttgcaataaattaatacaagcatgcttatttttagtttttaaataaaaattaatcaaaatgaatggtcatgtgttcatcgtcttcttgtattcaaatatggttttgttcaaattacataactttatgcatcatcatcatcatcaaaattgcacaaccattaagatgagtaaactattcttaacaagagaaaggaaaaatgaaacaatacgaaaaaactgaaataaaataaaataatgctatcctgcatttaaaacgttagtccctaatcaagaaaaaaagaaaacgaaaataaacagcttaggctgttagcaaagttgggcaaaggtgaacag

SEQ ID NO: 12880 - DNA, 926 bp, Lolium multiflorum
cgcactgcacgacggttccaagctccaactctgccccgtcttcgccgagatcagcaggaggacgagcccgcagcggagcggagcgagctcgaggccggcgtcgccatctcggaggagagatggggctctcgttcggcaagctgttcagccgcctcttcgccaagaaggagatgaggattctcatggtcggtctcgatgccgctggtaagaccaccatcctctacaagctcaagctcggcgagatcgtcaccaccatccccaccatcggatttaacgttgagactgtcgaatacaagaacatcagcttcactgtttgggacgtggggggtcaagacaagatcaggcccctgtggaggcactacttccagaatacgcagggactcatctttgttgttgacagcaatgatagggagcgtgttgttgaggccagagatgagctccacaggatgctcaatgaggacgagctgcgtgatgctgtgttacttgtatttgcaaacaaacaagatcttcctaatgccatgaatgcagctgaaatcactgacaagcttggtctgcactcccttcgccagcggcactggtacattcagagcacttgcgctacatctggtgaaggattgtacgagggacttgactggctctccaacaacattgccaacaaggcttgaagtgtctccacaacgcttccaggaacctctggctgtgtgaagaactcactgctaccatttttgtgatatataaatatatacactctacaacagatagtatgtatgcttatgtgacagaagctctcctttgagtgggctagtatcaggttgtttcttcgtgtgggtattatcagcgtttctgttcggttttacaaggtttactgtatcatccatgtgtatgtttttgagatatagtaaaattgaggcacggtgccaaatatt

SEQ ID NO: 12881 - DNA, 857 bp, Lupinus angustifolius
tcttctcatatcttatctttctctctcttttcagatcccaactaaagggatccataagctgaaggagaaatggggttgacattcaccaagcttttcagtcggctttttgcaaagaaggaaatgcgaattctcatggttggtctcgacgctgctggtaagaccaccatcctatacaagctcaagcttggagagatcgttactacaattcctaccattgggttcaatgtggagactgtggaatacaagaatattagcttcactgtttgggatgtcgggggtcaggacaagatccgtcccttgtggaggcactacttccagaacacacagggtctgatattcgttgtagacagcaatgacagggaccgagttgttgaggccagagatgagttgcataggatgttgaatgaggatgaactgagagatgcagtattgcttgtatttgctaacaaacaagatcttccgaatgcaatgaatgctgctgaaattactgacaagctgggtctccactctctcagacagcgccactggtacatccagagcacttgtgcaacatctggcgaaggtctttatgagggtttggactggctttccaacaacatagccaacaaggcttaaaagcttttggaggtcttgttgtggattggtattctggatgcatgggtgaatattatctagtttgaattttggtcctcttctggagacaaattgaatctgtgttcatgttttgttgtttaggacatattgatggggctataattatagtaggaatttgtttcatggtctgtctaatactactatgagttttctattggttttggattcaatgtttataaccaaatggataccaattacatgcg

SEQ ID NO: 12882 - DNA, 953 bp, Zea mays
gcctcgcgtcgtcgccccacagccacgcgagccttcgccgatccgcgagcgcagatcgccgaagccaggcggcggagagggagctcgaggcggcggaggaaggcgttcgccacagtcgctgatttccctggggaagagatgggtctctcctttgggaagctgttcagccgcctcttcgccaagaaggagatgaggattctcatggtcgggctcgatgccgccggtaagaccaccatcctctacaagctcaagctcggcgagatcgtcaccaccatccccactatcggattcaatgttgaaactgttgagtataagaacattagcttcactgtttgggatgttggtggccaggacaagatcaggcccctgtggaggcactactttcagaacacacagggacttatttttgttgtagacagcaacgacagggaacgtgttgttgaggctagagatgagctccacaggatgctgaatgaggatgagctgcgtgacgctgtgctgcttgtatttgcaaacaaacaagatcttcccaatgctatgaatgctgctgaaattactgacaagcttggtctgcattccctgcgacagcggcactggtacatccagagcacttgtgctacatctggtgaagggttgtatgaggggcttgactggctttccagcaacatctccagcaagtcttgaagcttttcggcagggctcctagcgagaggatgtctgaacaacttatggctgctttttttttacatattattactaagacacaagctacagcagatatagtacttgtgaaaaaaagaaacttctgagctcttttgagggattgatactagattggattgtgtttttgtttttgggtcgataccatcgcctgttcggttccacaaaattgactgtcaactatatttacctatgttcggagattgtatggtaaattaaattgacatgcttta

SEQ ID NO: 12883 - DNA, 998 bp, Cucumis melo
agaaggccattataagaaaggaaaaagggttgcggtaagatattgtgatctcccctttcccttcagatctgtctcctgaaggccccaaattcaagagttctgtgattgttgctcatagagggaagaagaaatggggttgaccttcacgaagctctttagcaggctcttttctaaaaaagagatgcgtattttgatggtgggtctcgatgctgctggtaaaacgacgatcctgtacaagttgaagctcggagaaattgttaccaccattccaactattggatttaatgtggagactgtggagtacaagaacatcagctttaccgtttgggatgttggtggtcaggacaagatccgtccactttggaggcactatttccagaatacacagggccttatttttgttgtggatagcaacgatagggaccgagttgttgaggcaagagatgagttgcacaggatgttgaatgaggatgagcttagagatgccgttttgcttgtatttgctaacaagcaagatcttcctaatgccatgaatgctgcagaaataactgacaagcttggtcttcactctcttcgccaacgccactggtacattcagagcacatgtgcgacatctggagagggtttatacgaaggtctagactggctttccaacaacattgctagcaaggcctgaagcgaataaatgattttggtggttgttcaagaatttgttcagagtttccttcattctgggaccaatagttttcgtttaatttcagtgatagttgggaaacatttggctagaccttaaaatgtactccaagttgtcaattgcttctttaagcttaaacttcttagctcctagaagtccattattgtactgttttccattcaataccaagttcaatttttatctgatcaatttgattaatatgaaatgcccttattttggcgtgccacatggatcattatttggttgtctagaaaagaccaaatttccctcatatagtaaggta

SEQ ID NO: 12884 - DNA, 1039 bp, Tropaeolum majus
aaaagaatcacgtctctcagtcaaaactcgcgtctcgctgattaatttttcccaactttttatagaggtaaaaaccaaacctccatttcttctaatcgatcttcacctcttctcttctaaacctgccatcttagatcttattcgattatcaacaggtgaaagctagtgtgagtcagacatggggttgtccttcacgaagctattcagccggctctttgccaagagggaaatgcgtattttgatggtgggtcttgatgctgctggtaagaccacgattctctacaaactaaagctcggagaaattgttacaactatcccaactattggatttaatgtggagacagtcgaatacaagaacattagcttcactgtttgggacgttggaggtcaagacaagattcgtccattgtggaggcactatttccaaaacactcaaggtcttatttttgtggttgatagcaatgacagggaccgagttgttgaggcaagagatgagctgcaccgtatgttaaacgaggatgagctgagagatgctgtgttgcttgtatttgccaataaacaagatcttccaaacgcaatgaatgctgcagaaatcactgacaagcttgggcttcattctctccgccaacgccactggtacattcaaagcacttgcgccacctctggagagggtctttatgaaggactggattggctctcaaacaacattgctagcaaggcatgagttagacgtttgaagagacggttttatgggagagaggtattttatcgtttgacaaacatgtttgagtgaatgttcaggtacacagtaattacgggtttgtataaatcggttgctttaatcactacttttagcctcaaaacagaattaagcatcatactctaaaactatttcctgtagtgctttgttatctctaaaaatgtttgcgtcgttttttcagttggtatattgtttcattaggtgtatttctgtaagattgattgtggctagtacgaaaacagtttggttttgtagattgtttgaaaacaaaatatattc

SEQ ID NO: 12885 - DNA, 961 bp, Olea europaea
ttctcataagggcagccttgaacaagatctgccccctctcttcttcccaaatcaatctccttctttattttctgatcacgcaaagaaaatggggttgtcttttaccaagcttttcagccgtctgttcgcaaagaaagagatgcggatacttatggtgggtcttgatgctgctggtaagaccaccatattatacaagcttaagctgggagaaatagtaacgactattcctacaattggattcaatgtggagacagtggagtacaaaaatatcagcttcacagtctgggatgttgggggtcaagataagatccgaccattgtggaggcattactttcagaacactcaggggctaatcttcgttgttgatagtaatgatcgagaccgtgtggttgaggctagggatgagctacacaggatgttgaatgaggatgaactgagggatgcagtgcttctagtttttgcgaacaaacaagatctaccaaatgctatgaatgctgctgagataactgacaagcttggacttcactctctccgtcaacgccattggtatatccagagcacatgtgccacctctggggaaggactttacgagggactggactggctgtcaaacaacattgccaacaaggcataaaagagactatattggatgattatgatagcctaattctcatcaaagaggaaattgtctttcatttttcaggcttttgtgtctcactatcttgaaaactcagtactttaatctctttattttttccgtagaaatttgtcatttctgtcgtgtagatttatattcgaaattctgtaatttcagcattcttgaataccttttggattgattaattttcaaaatgacgctcctcttctcattcattgaatgaaatggaaattactacattttgaatttcacaaatccatttggtcaaagcatatatattccaagtacattatattggccggt

SEQ ID NO: 12886 - DNA, 722 bp, Parthenium argentatum
ccgttgctgtcgctctctaaaaaaaaaaacttctctctctctctctcagggatcgtcatcagaaaaagatggggctcacattcaccaaactcttcagccggctttttgccaagaaagaaatgagaatattgatggtgggtctcgatgcagctggtaagacaaccattttgtacaagctcaagctcggggagattgtgactaccatccctaccattggctttaatgtggagactgtcgagtacaaaaacatcagcttcactgtgtgggatgtggggggtcaggacaagatccgtccactgtggaggcactacttccagaacacacagggtcttatctttgtggtcgatagcaatgatagggatagagttgttgaggcaagagatgagttgcacaggatgttgaacgaggatgagctaagggatgcagttcttcttgtcttcgccaacaaacaagatctgcctaatgcaatgaatgctgctgaaatcactgataagcttggcctccactctctccgacagcgccactggtacatccagagcacctgtgccacctctggggaaggactttacgaggggctggactggctctccaacaacattgctaacaaggcatgaggtggagattgaattgtaatttgggggtcaagaaaccggaggcaagttttgctttttgtatggtcatgtcacttttcttactggtgctcgttcttccgtccgtgattg

SEQ ID NO: 12887 - DNA, 690 bp, Parthenium argentatum
ctatcttcgtctctctcatctaatcgatcgactgatccctattcaacaacctcttctcagggatctttagtttactagcaagactagaggatggggctaactttcaccaaactgtttagccgtctctttgccaagaaagagatgcgtatattaatggtcggtctcgatgcggctggtaagaccactattttgtacaagctcaagctcggcgagattgtgactacgatccctaccataggttttaacgtggagacggttgagtacaaaaacattagcttcaccgtgtgggatgttgggggtcaggacaagatccgtccactatggaggcattacttccagaacacccaaggtcttatctttgtggttgatagcaacgacagggacagagttgttgaggcaagagatgaattgcacaggatgttgaacgaggatgagttaagagatgcagttctccttgtatttgctaacaaacaagatctcccgaatgcaatgaatgctgctgaaatcactgataagctcggtctccactctctccgacagcgccactggtacatccagagcacttgtgcaacctctggagagggactttatgaaggactggattggctttccaacaacatagcaaacaaggcatgattggtcatgagggtggatgtttggcggtttctgttactggtttgtttgaaaaag

SEQ ID NO: 12888 - DNA, 1057 bp, Petunia hybrida
atggggtatatttaggttattccatcaaacttattaatgtcagtttggtaccatctcactccttaaattaatttctccgaagttttacacctttttaataagtaaacatatttcgcgttagtttcaggcttccatctcattagatccctttttccaaacctttcttcagggatctttaagaagaaagagaaatggggctgacatttacgaagctatttagccggttatttgctaagaaggaaatgcgtattctcatggttggactcgacgcagctggtaagaccaccatattgtacaagctcaagctgggcgagattgtcaccaccattcctactattggtttcaatgtcgagactgttgagtacaagaacatcagcttcacagtttgggatgttgggggtcaggacaagatccgtccattgtggaggcactatttccagaacactcagggtctcatttttgtggtcgatagcaacgacagagaccgtgttgtggaggcaagagatgaattgcacaggatgttgaatgaggatgagcttcgggatgctgtgctgcttgtttttgctaacaaacaagatcttccgaatgcgatgaatgctgctgaaataactgataagcttggactccactccctcaggcagcgtcactggtacatccagagcacttgtgcaacttctggagagggtctttatgaggggcttgattggctttctaacaacattgctaacaaggcctagagttgttgcgggttgattccggatgcaggcgggtttttatctagctctttccttttgttttttcatttttgaaatcagtgtggttatgaacatcccttgaaagtgatttgcatcctgctaggatcttttgaaatgttttgtaaaagtggggggtatgtatttgctgtttgcttaggttggagtataatgctatagtttgtaacaaagaatagctttttctttgttacgtttcattggttatgggtggtgcttatagttccttatttgttccttcccatctgcttgtcagtggtatttcataaccagtaacatttatacta

SEQ ID NO: 12889 - DNA, 926 bp, Cajanus cajan
gtagggatcgactagctgaaggagaaatggggttgacgttcactaagcttttcagtcggctttttgccaagaaggaaatgcgaattctgatggttggtcttgatgccgctggtaagaccaccatcctgtacaagctcaaacttggagagatcgttaccacaattcccaccattgggttcaatgtggagactgtggaatacaagaatattagcttcactgtttgggatgttggtggtcaggacaagattcgtcctttgtggaggcactatttccagaacacacagggtcttatatttgttgtagacagcaatgacagggacagagttgttgaggccagagatgagttgcacaggatgttgaatgaggatgaactgagagatgcagtattgcttgtatttgctaacaaacaagatcttcccaatgcaatgaatgctgctgaaattactgacaagctgggtctccactctctcagacagcgccactggtacatccagagcacctgtgcaacctctggggagggtctttatgagggtttggactggctttccaacaacatagctaacaaggcttagtgatttttgggagtcttcttgtggattggtaattctggatgcaggggtgaatattatctagtttgttttttggtcctcttatgagacaaattggctttatgttaaatgttttctgttttaggacatcttgatggctaaaattatagtaggaattgtttcatgggatgtctaatacttttgagctattttattgagtttggattcaatgtttataactgtaatgcataccaatcaatgtgccatcccattgagtttttatatttttattttgctgatattcctctcataattattatagcgtgttacaaaaaataaaaacgatgaaaacttctcatcaatcaactgtcacatcta

SEQ ID NO: 12890 - DNA, 923 bp, Plantago ovata
tagaagaaaagtccgcgatagttgaacactagtagcgtacatttgcaacacgaaaaaataaaaataaatctgagcttttaaatatatagttgtggttcctttccatttcccaatcaactctcttccatctcattcctcaaggttttttcatcaacatagaaaaagactatggggttgtctttcaccaagcttttcagccggctatttgccaagaaggagatgagaattctcatggtgggtctcgatgctgctggtaagaccaccatattgtacaaactcaagctcggagaaattgtgaccaccattcctacaatcggtttcaatgttgagaccgtggaatacaagaacataagcttcactgtctgggatgtcgggggtcaagacaagatccgaccgctctggaggcattactttcagaatactcaaggccttatcttcgtggttgatagtaatgatcgtgatcgtgttgttgaggctagggatgagctccacaggatgttaaatgaggatgaactgagagatgcagtgcttcttgttttcgcaaacaaacaagatctaccaaatgctatgaatgctgctgagataactgacaagcttggacttcactcccttcgtcaacgtcattggtatatccagagcacatgtgccacttctggggagggcctttacgagggtctggactggctttccaacaacatagcaaacaaggcttaagaagagttgccaacatcgctgaactggagattgcggtttctgtttagtgcttttagttacagcattttaattttgtttggaactctccgtcgtagatagcctcgattgaatgtatgtgtcacaaatacaatcatgtacgtatttggtaattatgctttcttgattcatgtaatgataatcattttccctttgatgaatgagtttgatac

SEQ ID NO: 12891 - DNA, 839 bp, Plantago ovata
aggccagctccttcattttcttctccacctttttcacaatccgccagatctatagctcttaggttcaacaagcgagaaagaaaatggggctgacgttcaccaagcttttcagccggctttttgccaagaaggagatgcgtattctcatggttggtctcgatgcagctggtaagaccaccattctgtacaagctcaagctcggcgagattgtcactaccatcccaacaattggtttcaatgtggagactgttgagtacaagaacatcagcttcacagtttgggatgtcgggggtcaagacaagatccgccccttgtggaggcattacttccagaacactcagggtctgatttttgtggtggatagcaatgacagggaccgtgttgtggaggcaagagatgaattgcacaggatgttgaatgaggatgagctaagggatgcagtattacttgtattcgctaacaagcaagatctccctaatgcaatgaacgctgctgaaatcactgacaagcttggtttgcactcactcaggcagcgtcactggtacatccagagcacatgtgctacctctggtgaggggctatatgaggggcttgattggctgtctaacaacattgctaacaaggcttgaggcttgtgatgttgtttgctcgctttgatgtttgtggatgaagccgggtttctatccagtcttatactactagtatgtgtggctatatttttacttctgatgtgtttttgtacttgtttaggacctttaatggttgtcaacaatacaatgggttgttgcatatacttgcaaacatttgtttagtttctgatgtaattctcttatgagtcc

SEQ ID NO: 12892 - DNA, 944 bp, Prunus persica
ataaaaatcgcggcttgctgtgttggctcctcctctcattttgatccttcctagttcctccagataatttgataaaaatggggcttaccttcacgaagctcttcagcaggctctttgccaagaaagaaatgcgaattctcatggtgggtctcgatgccgctggtaagacgaccatattgtataagctcaagctcggagaaattgtcaccaccatccctaccattggatttaatgtggagacagtagaatataagaacatcagcttcactgtgtgggatgtggggggtcaagacaaaatccgtccattgtggaggcactacttccagaacacacaaggtcttatttttgtggttgatagcaatgatagggatcgagttgttgaggcaagggatgaattgcataggatgttgaatgaggatgaactgagggatgctgttctgcttgtatttgccaacaaacaagatcttcctaatgcaatgaatgccgcagaaataactgataagcttggtcttcattctctccgccaacgtcactggtacatccagagcacttgtgcaacctctggagagggtctgtacgaggggttagaatggctttccaacaacattgctagcaaggcatgagagtcaaggtcaaggagtttggttgcttgacttggagtttctggggaggatagttttcctttatttcaatgaatgttgtaatagcagaatgttttggcgagacgttgtcagaattcatgtgtgtatttgctactctagctataatgtttagctgtaaacgaagttgctatgttgttacaatcgttttgacgcatgagccaagtttatatttatcgcgtttgcttcaattgtctgctcttcatgtttcgaccaaaacatcaaattttgaagttaaagaataagaaaaagagaattagagatcatgcgcggctgtattttctc

SEQ ID NO: 12893 - DNA, 826 bp, Raphanus sativus
tctctctctctctctttcgatcgatcagagtgaagcaaggatgggtttgtctttcgggaagctgtttagcaagctatttgccaagaaggagatgaggattctgatggttggtcttgatgcggctggtaagaccaccattttgtacaagctcaagctcggagagattgtcaccaccattcccactattgggttcaatgttgaaactgtggagtacaagaacatcagtttcacagtgtgggatgtcgggggtcaagacaagattcgtcccttgtggaggcattacttccagaacactcaaggactcatctttgtggtggatagcaatgacagagaccgtgttgttgaggctagagatgaattgcacagaatgctcaatgaggatgagctacgtgatgctgttctgctcgtgtttgctaacaaacaggatcttccaaatgccatgaacgcagctgagatcaccgacaagcttggtctccactctctccgtcagcgtcactggtacatccagagcacatgtgccacttcaggcgaggggctttacgaaggtcttgactggttgtccaacaacatcgccggcaaggcgtagaggagaagtttgtggttgagttgattttgctgggcaaatctggatgcaggggcaaacgttatctgattttttcttctttattgttctcttctttttttttttgtttgtttcgggtatctggatttgattttgtgatcgttgttctgatttgtgcaaggaggagtctcttgcacgtaaaacatagaaactacctttttatatagtttgtaatcgaagatttatactctacttctttctgct

SEQ ID NO: 12894 - DNA, 957 bp, Raphanus sativus
ggggttataaaaaaaaaacaaccatcccgctaatcacaccccccctctattcatcgtcgtcgcgcatttagcgtttctcttaagcagagctcagtttctctccagagtttaaaaagcagaaaagggatggggttgagtttcgcgaagctgttcagcaggctctttgccaagaaagagatgaggattctgatggttggtcttgatgctgctggtaagaccaccattctctacaagctcaagctcggtgagattgtcaccaccatccccactattggtttcaatgtggaaactgtggagtacaagaacatcagtttcactgtgtgggatgtcgggggtcaggacaagatccgtcctttgtggaggcactacttccagaacactcagggtctgatctttgtcgtcgacagcaacgacagagacagagttgttgaggctagagatgaacttcacaggatgctcaatgaggatgagctgcgtgatgctgtgttgcttgtgtttgccaacaagcaagatcttccaaacgccatgaatgccgctgaaatcactgataagcttggccttcactccctgcgtcagcgtcactggtacattcagagcacatgcgccacttcaggtgaaggactctacgaaggtcttgactggctgtccaacaacatcgctggcaaggcgtaatgaagtaaaaacagcattgcatcggagatgattcttcctactgtatgttggtaaagtttctggatgcaagagagagagatttataaatattatatgaacctttttgctactggctttatgaatgttctgagattgttgcaagtagatatgtacctaaaaacttactagtatgagcccccttttaaatagctttcgtgttgttcacacctggattgatgattgaatgttattgctttcttgttatcgcctattttcatttgcaacataataagataaagtctttgg

SEQ ID NO: 12895 - DNA, 878 bp, Raphanus sativus
ggaggcgtcgcgcatctctctgtctatctctctctctctctctttcgatcgatcagagtgaagcaaggatgggtttgtctttcgggaagctgtttagcaagctatttgccaagaaggagatgaggattctgatggttggtcttgatgcggctggtaagaccaccattttgtacaagctcaagctcggagagattgtcaccaccattcccactattgggttcaatgttgaaactgtggagtacaagaacatcagcttcacagtgtgggatgtcgggggtcaagacaagattcgtcccttgtggaggcattacttccagaacactcaaggactcatctttgtggtggacagcaatgacagagaccgtgttgttgaggctagagatgaattgcacagaatgctcaatgaggatgagctgcgtgatgctgttctgctcgtgtttgctaacaaacaggatcttccaaatgccatgaacgcagctgagatcactgataagcttggtctccactctctccgtcagcgtcactggtacatccagagcacctgtgccacttcaggcgaggggctttacgaaggtcttgactggttgtccaacaacatcgccggcaaggcgtagaggagaagtttgtggttgagttgattttgctgggcagatctggatgcaggggcaaacattatctgattttttcttctttattgttctcttcttttctttttttttgtttcgggtatgtggatttgattttgtgatcgttgttctgatctgtgcaaggaggagtctcttgcacgtaaaacatagaaactacctttttatatagtttgtaatcgaagatttatactctacttctttctgcttcacgttttatttttgaatttcaat

SEQ ID NO: 12896 - DNA, 894 bp, Raphanus sativus
cgtcgtcgcgcatttagcgtttctcttaagcagagctcagtttctctccagagtttaaaaagcagaaaagagatggggttgagtttcgcgaagctgttcagcaggctctttgccaagaaggagatgaggattctgatggttggtcttgatgctgctggtaagaccaccattctctacaagctcaagctcggtgagattgtcaccaccatccccactattggtttcaatgtggaaactgtggagtacaagaacatcagtttcactgtgtgggatgtcgggggtcaggacaagatccgtcctttgtggaggcactacttccagaacactcagggtctcatctttgttgttgacagcaacgacagagacagagttgttgaggctagagatgaacttcacaggatgctcaatgaggatgagctgcgtgatgctgtgttgcttgtgtttgccaacaagcaagatcttccaaatgccatgaatgcagctgaaatcacagataagcttggccttcactctctgcgtcagcgtcactggtacattcagagcacatgtgccacctcaggtgaaggactttacgaaggtcttgactggctgtccaacaacatcgctggcaaggcgtaatgaagtaaaaacagcattgcatcgagagatgattcttcctgctgtgtgttggtaaagtttctggatgcaagagagagattataaatattatataaaccttttttgctactggctttatgaatgttctgagattgtgcaagtagatttgtacctaaaagcttactagtacgagccccttttaaatagttttcgtgttgttatcacctggattgatgattgaatgttattgttttcttgttatcgcctattttcatttgcaacataataagataaagt

SEQ ID NO: 12897 - DNA, 916 bp, Scabiosa columbaria
catagcccttcttctatttatcatatcctcacaacatcatcgagactacgcgttgctctctctttctctcactagatccctcttccaaatcctatttgcacagggatcaaagatggggcttacattcaccaagctttttagccggctctttgcaaagaaggagatgcgtattctaatggttggtcttgatgctgctggtaagacaaccatattgtacaagctcaagcttggagagatcgtcacaactattcctactattggttttaatgtggaaactgttgaatacaaaaacattagcttcactgtttgggatgttggaggtcaagataagattcgtccattgtggaggcactacttccaaaacacgcagggtcttatctttgtggttgatagcaatgacagggaccgtgttgttgaggcaagggacgagttacatagaatgttgaatgaggatgagctcagagatgcagttctcctcgtgtttgctaacaagcaagatcttccaaatgcaatgaatgctgctgaaataactgataagcttggcctccattccctcaggcagcgccactggtacatccaaagcacctgcgcaacctctggggagggactatacgaggggttggattggctctccaataacattgctagcaagtcttgagcttggtcggagtaatcctagatggatgcacgatcgtttatatgcgacgtcattcttcttacccgtggtgtgtgcttagttctctcttgtttcggaggctgtgttatcgatttcgtttaaaggtctttttggtacctttttgtttggactcgaagataataagttggtatatgtctactaatacgaccttgttatgttcttgacgtaattggttatttttattctttatttcttttctttgtctatgtcgttaggtta

SEQ ID NO: 12898 - DNA, 1020 bp, Sciadopitys verticillata
gtttgctccgttgcagccttcgccgtgcagaagcacatcagatctcgtcaagttggacagatctgagactcaaactcggtacctctaacaggtataaactaaagatggggcttacttttaccaagcttttcagcaggctttttgcaaagaaggaaatgcgcattctgatggtgggtcttgatgctgccggtaagactaccattttgtacaaactgaagctcggagagattgttactaccatccccactattggattcaatgtggaaactgttgaatacaagaacatcagcttcactgtatgggatgttgggggtcaggacaagattcgtccattatggagacactatttccagaatactcagggtcttatatttgtagtggatagcaatgacagagaccgtatagtggaagcaagggatgagttacatcggatgctgaatgaggatgaactacgagatgctgtgttacttgtgtttgcaaataagcaggatcttccaaatgcaatgaatgctgcagagatcactgacaagcttgggttgcattctcttaggcagcgccattggtatatccaaagcacctgtgcaacttctggcgagggcctgtatgaggggctggattggctttcaaacaacattgcaagcaaggcttgaaggaaatagtggactggtttctgagaattttgtagtccaagattgtctcgtgtctttattgatagagacagtttgaggagataagaatacaacatatgtagccaaacttactagggagtgtggttcactattttcacttgtattctgactgctgatatttgtttgatgtctgtcatggattttattgtgccaactgcactaatttatatagcactctgagcttgaaggagagtgttgattagttgttataacttataacattgttctaagtgcagtttttcattttgaaaatgctttctgggctttgtaaccatattgaagtagattaagaactgaatattagtacaggatttgcaattttaggttaccc

SEQ ID NO: 12899 - DNA, 854 bp, Sciadopitys verticillata
tcatttgcatctctggacgcccatttccgagaaatattactcttcctcgaatttctgggctatcaagatgggtctcacttttaccaagctttttcaacgattgtttgccaagaaagaaatgcgcattctgatggtagggcttgatgcagctggaaaaactaccattttgtacaagcttaagctgggagagattgttaccacgatcccaactattggtttcaatgtcgagacagtcgaatacaagaatattagcttcactgtttgggatgtcgggggccaggataagattcgaccactttggagacactacttccagaatactcagggtcttatctttgttgttgatagcaatgatagagatcgtgtagttgaggcaagagatgagctgcacagaatgttgaatgaggatgagctacgagatgctgtgctccttgtttttgcaaacaagcaggatcttccaaatgctatgaatgctgcagagattactgacaagcttggtttgcactctttacgtcaacgccattggtatattcagagtacctgtgctacatctggtgaaggcttatatgaaggtctcgattggctttcaaacaacattgcaagcaaggcttgagaatgcaccatgaacgatgtcaagggtcacatctttacagagctgtgttgaatatacatgatgattgtcggtgttctcattgtagtacatgtttcatagtggatcaagctccagttcaccatgaattcttttctatgcaaatttttccatctatatttgttttgcaatctactgagaatttggtggttgattttctttgtagtatcttgaagtgttgttgaaacaacttatttatatagca

SEQ ID NO: 12900 - DNA, 969 bp, Sequoia sempervirens
gttaaccgttgtcaaaaccaagctatctttcactctttatatctctgctttctgcccttcgtttttctcttgcgttggagaagatcatcaccacttttctctgtcgcctccactctgaccagatctgagactcgaaaccgagatctataccaggttacacgatggggctcacatttaccaagcttttcagcaggctttttgctaagaaggaaatgcgcattttgatggtgggtcttgatgctgctggtaagactaccattttgtacaagctgaagcttggggaaatcgttactaccatccctaccattggattcaatgtggaaactgttgaatacaagaacatcagtttcactgtatgggatgttgggggtcaggacaagattcgtccactatggagacactacttccaaaatactcagggtcttatatttgtagtggatagcaatgatagagatcgtgtcgtggaggcaagggatgagctacaccgcatgctgaatgaggatgaactacgagatgcagtgttacttgtgtttgcaaacaagcaggatcttcccaatgcaatgaatgctgcagagatcactgataaacttgggttgcattctcttaggcagcgacactggtatatccaaagcacctgtgcaacttctggcgagggcctgtatgagggcctggattggctttcaaacaacattgcaaacaaggcttgaaggatgacggtggaatgggcttcgagaattttgtattacaaaaatgtcttgtatctttattgatagagacagtttgaggagataaaaatttaacctatgcagtcaaactgactcaggagaatggctgctattttcacctgtaatttgacttattacatttgtttgattgtttttatggatttgatattgccagttgcactaatttatatagcttaccgaaattaaatgacagtgtgattagtcattatgccattttgaaaat

SEQ ID NO: 12901 - DNA, 1798 bp, Glycine max
cttgtgccttacctttcacgagaaccacgaaatcatgagaaagtgcaagaaccacgaattcaccttctcattgttggaagcaagaaatgttcctatagcgtaaagcaaaaagcttttcacaaaatcattgcccgtaacatccctaattgaattgagcctattctctagaaaactcatcaccaccttcctcttttcttttgtcgcaccatatgacttccaaattgaagaatggttcctttttcgttaacaccataggcttaccaacaactgactaaccagatattatagtcgtgtccaatagtgttatctgaatttcaccgttggagcatagcacaaacaggtgacctttatatctgcacacatctataagctttattaggaacaccttgttcaatgaatggtttagcattgagaaaatgctctcgaagtcaattgatgaaatcatggatctctaattggttgtgagcaactgcacgtgcttcgtttggtgtcaaaagaatggggttcatttgaaatggagaaagccaagtgtcaagattgagtctaaattgaaattgaaaatgaaatttgtttttcttactggttcttgaccttgcgcaaggccgatggtagagaatttggtgaattttctcatcaaagaatgggggatccactaactgaaggagcaatggggttgacatttaccaagctttttagccggcttttcgccaagaaggaaatgcgaattctaatggttggtcttgatgccgctggtaagaccaccatcctgtacaagctcaaacttggagagatcgttaccacaattcccaccattgggttcaacgtggagactgtggaatacaagaacattagtttcactgtctgggatgttggtggccaggacaagattcgtcccttgtggaggcactacttccaaaatacacagggtctcatttttgttgttgacagcaatgacagggacagagttgttgaggccagagatgagttgcacaggatgttgaatgaggatgaactgagagatgcagtattgcttgtatttgctaacaaacaagatcttcccaatgcaatgaatgctgctgaaattactgacaagctgggactccactctctcagacagcgccactggtacatccagagcacctgtgcaacctctggggagggtctctatgagggtttggactggctttccaacaacatagccaataaggcttgatgctttttgggtgtcttgtggatgcaggggtgaatattatctggttttgttttttggttctcttctgagacacattggctttatgttcatgttttctggtttaggacatcttgatggctaaaattatagcaggaatttgtttcatgggatgtctaatacttttgagtttttttattgggcttggattcaatgtttataactgtaattgataccaatcaatgtgccatcccattgagcttttatttttttattttgctaatactcctcccatgattattattgcgcgatacccaaaaaacatgagaaaacttctcttaactaaatctttaaatatttgtagtgctcgatgatacagcattatgcatccttctttgccatagtgcaactagccaagacatttttatatttttcgacaatcactaaagtacttgtccctctgttgctccactgtaggataaacccaataccttatattggtgtaatttctatctcatgctttagggtaaaggccttaatgaagttgcgcttcattttacatcctagtttataatgggtgtattcttttctttgtaagctagtaaaacg

SEQ ID NO: 12902 - DNA, 1126 bp, Saccharum officinarum
gaccgcaccgcaccgcaccgcaccgcggccaatatagcctcgcgtcgcactcgctcgctcgcgtcgtcgccccaccaccacgcgctaccgcctccgccgatccgcgcacgcagatcgccgaagcccggcggcgcagagtccaaggggagggagggagcacgcggcggcggaggaggaaggcgttcgccacagtcgcggatttccttggggaagagatggggctctcctttgggaagctgttcagccgcctcttcgccaagaaggagatgaggattctcatggtcgggctcgatgctgccggtaagaccaccatcctctacaagctcaagctcggcgagatcgtcaccaccatccccaccatcggattcaatgttgaaactgttgagtacaagaacattagcttcaccgtttgggatgttggtggccaggacaagatcaggcccctgtggaggcactactttcagaacacacagggacttatttttgttgtagacagcaatgacagggaacgtgttgttgaggctagagatgagctccacaggatgctgaatgaggatgagctgcgtgacgccgtgctgcttgtatttgcaaacaaacaagatcttcctaatgctatgaatgctgctgaaattactgacaagcttggtctgcattccctgcgccagcggcactggtacatccagagcacttgtgctacatctggtgaagggttgtacgaggggcttgactggctttccaacaacatcgccagcaagtcttgaagcttttcggctgggctcctagcaagaggaagacgtctgaacaacttatggctgctttctttacatattattactgatgagacacaatctgcagtagatagtgtgggtgcttatggggaaaaaaaaacttctgagctctcttttgaaggattgatactagattggattgtatttttgtttttgggtcggtatcatcgcctgtttggttccacaaaactgactgtcggtcatattttacctatgttcggagatggtatggtaaattaaattggcatgccttatcctaggtcttcaccgatccagtgctgtggcagatgtgacatgtgagttgctagattttgttcttagatgggtaaatgcttatt

SEQ ID NO: 12903 - DNA, 950 bp, Helianthus annuus
taataatatcatcatcaatatacatcctccggtgggttatttaacctcatacgcattatcagtattctcgcccgtttattatttcacttcacacacctcttttctcatccaatccatccattgatccctctccaacagccttttctcagggatcctcagtagcaagaggatggggctaacattcaccaaactctttagccggctctttgccaagaaagagatgcgtatattgatggtgggtctcgatgcagctggtaagacaaccattttgtacaagctcaagctcggcgagattgtgaccacgatccctaccataggttttaacgtggagactgttgagtacaagaacattagcttcaccgtgtgggatgttgggggtcaggacaagatccgtccactatggaggcattacttccagaacacccaaggtcttatctttgtggttgatagcaacgacagggaccgagttgttgaggcaagagatgaattgcacaggatgttgaacgaggatgagttaagagatgcagttctccttgtatttgctaacaaacaagatcttccgaatgcaatgaatgctgctgaaatcactgacaagctcggtctccactctcttcgacagcgtcactggtacatccagagcacttgtgcaacatctggagagggactttacgagggactggattggctttccaacaacatagctaacaaggcatgattggttatgagggtggatgtttggcggtttctgttactggtttgtttgaaaaaagatattttggattttatataccattgtttggattgcaagtatgtgttaggtaggtggttattatttctcaagttgtaagaggttaagtttttgtggttgttagaagttaatgtagtttgctttgcatttatatttggtaaaacatttttattgtatcggtttcttcaatttacaagtttct

SEQ ID NO: 12904 - DNA, 853 bp, Helianthus annuus
cacacaccttttctcatccaatcgatccattgatccctctccacaaccttctctcagggatcctcagtagcaagaggatggggctaacattcaccaaactctttagccggctctttgccaagaaagagatgcgtatattgatggtgggtctcgatgcagctggtaagacaaccattttgtacaagctcaagctcggcgagattgtgaccacgatccctaccataggttttaacgtggagactgttgagtacaagaacattagcttcaccgtgtgggatgttgggggtcaggacaagatccgtccactatggaggcattacttccagaacacccaaggtcttatctttgtggttgatagcaacgacagggaccgagttgttgaggcaagagatgaattgcacaggatgttgaacgaggatgagttaagagatgcagttctccttgtatttgctaacaaacaagatcttccgaatgcaatgaatgctgctgaaatcactgacaagctcggtctccactctcttcgacagcgtcactggtacatccagagcacttgtgcaacatctggagagggactttacgagggactggattggctttccaacaacatagctaacaaggcatgattggttatgagggtggatgtttggcggtttctgttactggtttgtttgaaaaaaagatattttggattttatatacgattgcaagtatgttttaggtaggtggttattatttctcaagttgtaagaggttaagtttttgtggttgttaaaagttaatgtagtttgctttgcatttatatttggaaaaacatttttattgtatcggtttcttcaatttacaagtttcttga

SEQ ID NO: 12905 - DNA, 858 bp, Tragopogon dubius
ggggacgacttttagatcgatcgatctctctccacaaaccttctctctcagggatcctcatcagaaaaaggatggggcttacattcaccaaactcttcagccggctctttgccaagaaagagatgcgtatattgatggtgggtctcgatgcagctggtaagaccaccattttgtacaagctcaagctcggcgagattgtgacaactatccccaccatcggcttcaatgtggagactgttgaatacaagaacattagcttcaccgtgtgggatgtcgggggtcaggacaagattcgtccactatggaggcattacttccagaacacacagggtcttatctttgtggttgacagcaatgacagggatagagttgttgaggcaagagatgagttgcacaggatgttgaatgaggatgagttaagagatgcagttcttcttgtatttgctaacaaacaagatctgcctaatgcaatgaatgctgctgaaattactgataagcttggccttcactcccttcgacagcgccactggtacatccagagcacgtgtgcgacgtctggggaaggactttacgaggggttggactggctctccaacaacattgctaacaaggcatgaggaggagaggggaagttttggttattgtttggtgcaagtggttgtttatgaggagaggagaggagagttgtggattggataaggattttaaagaggggtatatcttatgttgtcttgtttctaggatttcattattataacctaaacttttaagagattaatgtttgcttctttcttaaatgttttttaggacaaaaatcgttcaactgctaaaacctcatttaaatccgattaggacatg

SEQ ID NO: 12906 - DNA, 848 bp, Utricularia gibba
ttaagatctaacggtttggaattgattcagtagtttcctcgttttgtttccgtggaatggtcgcagcaatattgctaatgtgaatgaagtataatgattatttttattggcatggatggtgtgaaccaatactttctgtcatcgtatgcagggttctctgaaaaacgtaggaaatggggcttacgtttaccaagctttttagccggctgtttgccaagaaggagatgcgcatattgatggttggtctcgatgccgctggtaaaacaaccattctttacaagctgaagctcggagaaattgttaccaccattcccaccattggtttcaatgtggagactgttgagtacaagaacatcagcttcactgtctgggatgtcggaggtcaggacaagattcgtccattgtggaggcactacttccagaacactcagggtcttatatttgttgttgatagtaatgacagggaccgtgttgttgaagccagagatgagttgcataggatgctgaatgaggatgagctgagggatgcagtgttgcttgtttttgctaacaaacaagatcttcccaatgcaatgaacgctgctgaaattactgacaagcttggcctccactcactcagacagcgccactggtatatccagagcacatgtgctacatctggagaggggctttatgagggacttgactggctttccaacaacattgccaacaaggcatgagaatctgaggtgatcatctgggtggagctctttatctcgtggtattgtaatttgattctatagctggtattccttttgtgctagggacgttttactgtgttctttttgttgaacaacatggtgcttgtt

SEQ ID NO: 12907 - DNA, 786 bp, Salvia sclarea
aaatgggattgacattcacaaagctttttagccggctttttgccaagaaggagatgcgtattttgatggttggtcttgatgctgctggtaagaccaccatcttgtacaagctcaagctcggagagattgttactactattcctaccattggcttcaatgtggagactgttgaatacaagaacattagctttaccgtgtgggatgtcgggggtcaggacaagatccgcccattgtggaggcactacttccagaacactcagggtctcatattcgtggtggacagcaatgatagggatcgtgttgtggaggcaagggatgaattgcataggatgttgaatgaggatgagctgcgagatgctgtattacttgtattcgcaaacaaacaagatcttcctaatgcaatgaatgctgctgaaatcactgacaagcttggcctacactctctcaggcagcgccactggtacatccagagcacttgtgccacctccggggaggggctctatgagggactcgactggctctccaacaacattgctaacaaggcttagagcttttctggagctgtttatgcgagagctaatactggaaactgttgaggttttatctagttttttcttaaccatatattgctttgaaacaatgctgttttttcatttatgtttagcaccttcaaaatgtcgctatatcagacaatggtttgttttatatgttttcctacatttgcttacttttgaatgtaaaattcagacacagcctagggttttgcattattatttggttgcccac

SEQ ID NO: 12908 - DNA, 937 bp, Brassica juncea
gtcgtcgtttcggatttcgcgtttctcttaagcgtctctctctctcagatctctcggttacattcttcagagtaaaagagcacaagatggggttgagtttcgccaagctgtttagcaggctctttgcaaagaaggagatgaggattctgatggttggtcttgatgctgctggtaagaccactattctatacaagctcaagctcggagagattgtcaccaccatccccactattggtttcaatgtggaaactgtggagtacaagaacatcagtttcactgtgtgggatgtcgggggtcaggacaagatccgtcccttgtggaggcactacttccagaacactcagggtctgatctttgtcgtggacagcaacgacagagacagagttgttgaggctagagatgaactgcacaggatgctcaatgaggacgagctgcgtgatgctgtgttgcttgtgtttgctaacaagcaagatcttccaaacgcgatgaatgcagctgaaatcacagacaagcttggccttcactccctccgtcagcgtcactggtacattcagagcacatgcgccacttcaggtgaaggactgtacgaaggtctggactggctgtccaacaacatcgctggcaaggcgtaatgaggatgagttgcatttgcatcgagatgttctatctgctgtgatgcaataaacgattataaatattatctgcaactttttgttattgggtatgtgaatgttttgattgtgcaagtagatgtcttgtctctaaaacttactagaagaacccatttaaataagtttttgtgtaagttgaatatgaatgttgttttgttttggtgtattcatttacaagcgtctacattatttttacgatagatacagcaaaataacattttgctttcttacacgaaaaaataatgtattcatttacaagcgtctac

SEQ ID NO: 12909 - DNA, 734 bp, Brassica oleracea
tagcatttctcttaagcttcgctctctctcggttacgtaaaagagcacaagatggggttgagtttcgcgaagctgtttagcaggctctttgcaaagaaggagatgaggattctgatggttggtcttgatgctgctggtaagaccactattctctacaagctcaagctcggagagattgtcaccaccatccccactattggtttcaatgtggaaactgtggagtacaagaacatcagtttcactgtgtgggatgtcgggggtcaggacaagatccgtcccttgtggaggcattacttccagaacactcagggtctgatctttgtcgtggacagcaacgacagagaccgtgttgttgaggctcgagatgaacttcacaggatgctcaatgaggacgagctccgtgatgctgtgctgcttgtgtttgccaacaagcaagatcttccaaatgcgatgaatgcagctgagatcacagataagcttggccttcactccctgcgccagcgtcactggtacattcagagcacatgcgccacttcaggtgaaggactgtacgaaggtctggactggctgtccaacaacatcgctggcaaggcgtgatgagggtgagttgcatttgcatcgagatggttctatcttctgtgatgcaagaaacaattataaatattatctgaacctttttgatattgggtatgtgaatgttttgattgtgcaagtagatgtcttgtctctaaaac

SEQ ID NO: 12910 - DNA, 1134 bp, Brassica rapa
caaaccggtggtacccttctcccttataaaaatattaatttccccctctaaaccggttttgtcgtcgtttctctcaagcttcgctctctctctctctcggttacattctccagagttaaagagcacaagatggggttgagtttcgccaagctgtttagcaggctctttgccaagaaggagatgaggattctgatggttggtcttgatgctgctggtaagaccactattctctacaagctcaagctcggagagattgtcaccaccatccccactattggtttcaatgtggaaactgtggagtacaagaacatcagtttcactgtgtgggatgtcgggggtcaggacaagatccgtcccttgtggaggcattacttccagaacactcagggtctgatttttgtcgtggacagcaacgacagagaccgtgttgttgaggctcgagatgaacttcacaggatgctcaatgaggacgagctccgtgatgctgtgctgcttgtgtttgccaacaagcaagatcttccaaatgcgatgaatgcagctgagatcacagataagcttggccttcactccctgcgccagcgtcactggtacattcagagcacatgcgccacttcaggtgaaggactgtacgaaggtctggactggctgtccaacaacatcgctggcaaggcgtgatgagggtgagttgcatttgcatcgagatggttctatcttctgtgatgcaagaaacaattataaatattatctgaacctttttgatattgggtatgtgaatgttttgattgtgcaagtagaagaacccatttaaataagttttcatgtgttttgaatatgagtattattttgcttttggcgtatttcatttgcaagtgttattttgctctagtgtctgaacccgggttttcaatagtggccttgtccatttatgtcttgcacagtgtataaggcagtgtaacagtcaaatggtcatcatgtttagaaaagctcagcttgttcatcagaaacaacaacaatgaatacgagctcaagctaagggtgtgaatgtgatgtaggagagagacaggagagatgcaggagatttagacatgcagtttcatctgcatttgttgtccattcacatagaatttgcagaac

SEQ ID NO: 12911 - DNA, 926 bp, Brassica napus
gcttcgctctctctctctctcggttacattctccagagtaaaagggcacaagatggggttgagtttcgccaagctgtttagcaggctctttgcaaagaaggagatgaggattctgatggttggtcttgatgctgctggtaagaccactattctctacaagctcaagctcggagagattgtcaccaccatccccactattggtttcaatgtggaaactgtggagtacaagaacatcagtttcactgtgtgggatgtcgggggtcaggacaagatccgtcccttgtggaggcattacttccagaacactcagggtctgatttttgtcgtggacagcaacgacagagaccgtgttgttgaggctcgagatgaactgcacaggatgctcaatgaggacgagctccgtgatgctgtgctgcttgtgtttgccaacaagcaagatcttccaaatgcgatgaatgcagctgagatcacagataagcttggccttcactccctgcgccagcgtcactggtacattcagagcacatgcgccacttcaggtgaaggactgtacgaaggtctggactggctgtccaacaacatcgctggcaaggcgtgatgagggtgagttgcatttgcatcgagatggttctaccttctgtgatgcaagaaacgattataaatattatctgaacctttttgatatttgggtatgtgaatgttttgattgtgcaagtagatgtcttgtctctaaaacttactagaagaacccatttaaataagttttcatgtgttttgaatatgagtattattttgcttttggcgtattcatttgcaagtgttattttgctttcgtgtctgaacccggcttttcaatagtggccttgtccatttatgtcttgcacagtgtataaggcagtgtaacagtcaaatcaaatggtcatcat

SEQ ID NO: 12912 - DNA, 1117 bp, Cephalotaxus harringtonia
cttgcgttcgaggagctcagcagatctctcttgtatctccaatttgaccagatctgagactcgaactcgagagatttaacaggtttcaagatggggctcacttttactaagcttttcagcaggctttttgctaagaaggaaatgcgtattctgatggtgggtctcgatgctgctggtaagactaccattttgtacaagctgaagcttggggagattgttactaccatccccactattggatttaatgttgaaactgttgaatacaagaacatcagcttcactgtatgggatgttgggggtcaggacaagattcgtccactatggagacactacttccagaatactcagggtcttatatttgtagtggacagcaatgatagagaccgggttgtggaagcaagggatgagctacatcgcatgctgaatgaggatgaactacgagatgctgtattgcttgtgtttgcaaacaagcaggatcttcctaatgcaatgaatgctgcagagatcactgacaaacttgggctgcattctcttaggcagcgacattggtatattcaaagcacctgtgcaacttctggagagggcctgtatgagggcttggattggctttcaaacaacattgcaaacaaggcttgaaggatgatagtagactatgttcacagaattttgtagtctgatattgactcgtccatttattgacagagacagtttgaggagataagaatttaacctatgcagtcaaactgactcggtagtgtggttcactatttttacctgtaatttgactgctcacatttgtgtgatttctttcttggattttattgtgccaggtgtgtgctaatttaaatagctcgctgagcttaagtgacagttaatattgaaggttgctttttgggcgtaaaatattattttgttaacaatagggtaactactagaacggacatcacatttttggttaccctttcaaaaccattctactagatgaaaaatatctcttagctcatttttctcgtgtgtcaagaatctgaagtagggtagattcaaataaaacatagtctcagtattaaaacacagcctgaaacataaaatgattgaatttaatttctttcacttaatg

SEQ ID NO: 12913 - DNA, 888 bp, Arachis hypogaea
ggtgaaaggcctctcaaattgtggagttaacggtgacacagaagcagctcccatttctctcttctttgcaaagagaagagatctgcgttctcctctcccttcgcaaattttcttcaagagtagttaaaaatggggctgactttcacgaagctgttcagccggctcttcgccaagaaagagatgcgtattctcatggttggacttgacgctgctggtaagaccaccattctctacaagctcaagcttggagagatcgtcaccaccattcccaccattgggttcaatgtggaaactgtggaatacaagaacatcagcttcactgtctgggatgttggaggccaagacaagatccgtccattgtggagacattacttccaaaacacacaagggcttatttttgtggttgacagcaatgacagggaccgtgttgttgaagcaagagatgagctacataggatgttgaatgaggatgagttgagggatgccgtgcttctagtttttgctaacaaacaagatcttccaaatgctatgaatgctgctgagataactgataagcttggtcttcattctctccgtcagcgtcattggtatatccagagcacatgtgctacctctggtgaagggctttacgaaggacttgactggctctccaacaatattgcaaacaaggcatagagttctaccagttatcatgaaggactccagtcagtggttacggtctcgcatatctgattttcttgccgttcctttagattttcattgttcgagcatgtattattttgttttgataaaagaacatcattcggttacatagcccgaagaataatttgacattttttccctgtataaccaaatatatagaattgttacccattcatttatgaagcc

SEQ ID NO: 12914 - DNA, 867 bp, Raphanus sativus
gggtcgtcgtctcgcgtttctcttaagcttcttctctctctcgcatctcgcgtatctctctctctctctctcagatctctcggttacattctacagagtaagatggggttgagtttcgcaaagctgtttagcaggctctttgcaaagaaggagatgaggattctgatggttggtcttgatgctgctggtaagaccactatcttgtacaagctcaagctcggtgagattgtcaccaccatccccactattggtttcaatgtggaaactgtggagtacaagaacatcagtttcactgtgtgggatgttgggggtcaggacaagattcgtcccttgtggaggcactacttccagaacactcagggtctgatctttgtcgtggacagcaacgacagagacagagttgttgaggctagagatgaactgcacaggatgctcaatgaggacgagctgcgtgatgctgtgctgcttgtgtttgccaacaagcaagatcttccaaatgcgatgaatgcagctgaaatcacagataagcttggtcttcactccctgcgtcagcgtcactggtacattcagagcacatgcgccacttcaggtgaaggactgtacgaaggtctggactggctgtccaacaacatcgctggcaaggcgtaatgagggtgagttgcatttgcatcgagatgattgtatctgctgtgatgcaaagaaacgattataaatattatctggacctttttgcatattgggtatgtgaatgttttgattgtgcaagtagatgtcttgtctctaaaacttactagaagaacccatttaaataagttttcgtgtattttgaatatgaatatgttattttcctttgcaagaagcgtctac

SEQ ID NO: 12915 - DNA, 606 bp, Capsicum annuum
ggatcattaagaagaaagagaaatggggttgacattcacaaagcttttcagccggctatttgccaagaaggaaatgcgcatcctcatggttggactcgatgcagctggtaagaccaccatattgtacaagctcaagcttggagagatcgtcaccaccattccaactattggtttcaatgtggaaactgttgagtacaagaacatcagcttcaccgtttgggatgtcgggggtcaggacaagatccgtccattgtggaggcactatttccagaacactcagggtctcatttttgtggttgatagcaatgacagagatcgtgttgtggaggcaagagatgaattgcacaggatgttgaatgaggatgagcttcgcgatgctgtactgcttgtttttgctaacaaacaagatcttcctaatgcaatgaatgctgctgaaattaccgataagcttggactacactccctcaggcagcgtcactggtacatccagagcacttgtgcaacttctggagagggactgtacgaggggcttgattggctttccaacaacattgccaataaggcctaagctggaatagagttgcggtttgatactggatgcagggg

SEQ ID NO: 12916 - DNA, 950 bp, Helianthus annuus
gccccctttattcatactcttcattctctctctactctccctctctctctcttcgatttgatccattgatccctctccatcaagcttttctcagggatcgtcaatagcaagaggatggggctaactttcaccaagctcttcagccggctctttgccaagaaagagatgcgtatattgatggttggtctcgatgcggctggtaagacaaccattttgtacaagctcaagctcggcgagattgtgacaactattcctaccataggttttaatgtggagactgttgagtacaaaaacattagcttcacagtgtgggatgtcgggggtcaggacaagattcgtccattgtggaggcactatttccagaacacccagggtcttatctttgtggttgatagcaacgacagggacagagttgttgaggcaagagatgaattgcacaggatgttgaatgaagatgagttgagagatgcagttctccttgtgtttgctaacaaacaagatctcccaaatgcaatgaacgctgctgaaatcaccgataagcttggtctccactctctccgacagcgccactggtacatccagagcacttgtgcaacctccggagaaggactttacgaaggattggactggctttccaacaacatagcaaacaaggcatgaggcggtgatttgataacgtgaggatggatcttggcagtttgtggtggtactggttttggaacttgttatttgaaagggtaatttgcttttgatatactttgtttgtttggattgaaagtatgtttggtaggttggttattattctttaatatgaaattgttaagtttttgtgatgcttagaattaccatgtagtttgttcgtatactattatatgatatggtaaattcagctactcagcaggtgcttcatgttaaaaaataataaccaacctaccaaatatactttgttt

SEQ ID NO: 12917 - DNA, 1321 bp, Cicer arietinum
atcaaagacaccgaatcaaaaacacgttattacgaaatttggatctgtatccgcgttctataaatccgtggaggtctgactgtgagagaaactccatttcttttctctttgttacaaggagaagagatccgctttcatccaatatcgctctcttcctcaagaatacttgaaaatggggctgtcattcacgaaactatttagtcggctatttgccaagaaagagatgcgtattcttatggtaggtctcgatgcggccggtaagaccaccattctttacaagctcaagcttggagagatcgtcactaccattcctacaatcgggttcaatgtggaaacagtggaatataagaacatcagcttcactgtctgggatgtcgggggtcaggacaagattcgtcctctatggagacattacttccaaaatacacaaggacttatttttgtggttgatagcaatgacagggatcgtgttgttgaagctagagatgagctgcataggatgttgaatgaggatgaattgagagacgctgtgcttctagtttttgcaaacaagcaagatcttccaaatgctatgaatgctgctgagataactgataagcttggacttcattctcttcgtcagcgtcactggtacatccagagcacatgtgccacatctggtgaaggactttatgagggacttgactggctctcaaacaacattgcaaacaaggcatagagatttattagttaagggtacaagaagttgagtttactttagcgattacgatatccaacgtctggttttcttgccctacttagattttcattgctcgagcatgtattatttgttttaaagaaagaactacggtctactattgaagaataatttgatttttttcccatgtataaccaaatagcattgtttaatgtgtaccttttgattgtgaagtcaattgaattattaaagccacatgtttatgtgtaagtctgttagattcgtagcagcaaccgataggcagagcctcggcaaagaggagggaggttggactttattctgaaatccagctctttcttcctgatgataatagtataagatgataaacattcctaacaagtgaaatcaaccctgtaaaatcagattttgacaaactaaattgacggaaaatattgacctattaatatacggttaattttaataattacaattatttgattaaaagcaattctaactattcatgtacagttttgttgtcgttgatattcatatgtgggcattagcaagattgaaatcaaccctgtaaaatcagattttgacaaactaatattgttgtcgttcgaa

SEQ ID NO: 12918 - DNA, 760 bp, Fraxinus spp
gatctctatactcggttcaatcctcgcgattcctactttgtgaagatggggctgtctttcaccaagcttttcagtcggctgtttgccaagaaagagatgcgcatactgatggttggtcttgatgctgctggtaaaacgaccattctctataaactcaaacttggagagattgtcacaacaattcctaccattggatttaatgtggagactgtggaatacaagaacattagctttacagtctgggatgtcgggggccaggataagatccgtccactgtggagacattatttccaaaacactcaaggactaatctttgtggttgatagcaatgaccgagatcgtgttgttgaagcaagggatgagctgcacaggatgttgaatgaggacgagttaagagatgcggttctgctagtatttgcaaacaagcaagatctcccaaatgcaatgaatgctgctgaaataactgacaagcttggccttcattctctccgccaacgtcactggtacattcagagcacatgcgccacttccggtgaaggtctgtacgaggggttggactggctctctaacaacattgcaaacaaggcttagattgctatatctgaggttcagtatagtatcagtgctggaagaagctttcatttctttgttgctttgaacttttgctttttctgtcattaaaattggttccttttgcgaatgttgaaatctgattcttggtactttggaataattcgtagttttatatcgtttctttagc

SEQ ID NO: 12919 - DNA, 1365 bp, Medicago truncatula
tgtggtctatctatagactacatacatcaattaataaatttaaaaagtatatttttgtttataatactgacggaaaggtacagttgattaacaaataaatattgcaaccgtccaatccctaaaaaaaaaaaattgcaaccaattttttaattaaaacaaaaaacatcctaatattttgtataatcaagctttacacaaaaaaaaaaaatcctaattactgcaaaacagtaaagtagtcactccaatttggctttagaagaaggttcgaaagcagaatcttgatgaagggtccttctcgttattttcaaccaaggaatgaaataatcccggtgctacccttcctttttcctctaataaaaatcaattttataactttcttttcccatattacgcgttggagcaaagcttccttcatctctttacgtactccgaagctttcatctccaaaggtcggatcaaggaagtgaagagaaatggggttaacattcacaaagctgttcagtcggttattcgcgaagaaggaaatgcgaattctgatggttggtctcgatgcggctggtaagaccaccatcctttacaagctcaagcttggagagatcgtcaccaccatccctaccattgggttcaatgttgagactgtggagtacaagaacattagcttcaccgtttgggatgttggaggccaagacaagattcgtccactgtggaggcactacttccagaacactcagggtcttatatttgtcgtagacagcaatgacagggatagagttgttgaggccagagatgagttacataggatgttgaatgaggatgaactgagagatgcagttttgcttgtgttcgccaacaaacaagatcttccaaatgcaatgaatgctgccgaaattactgacaagttgggtcttcactcgctgagacagcgccactggtacatccagagcacctgtgcaacctctggggagggtctctatgaaggtttggactggctttccaacaacatagccaacaaggcttaatgcttatcgggagtattgtggattggtgattctggatgcaggggtgaatattatctagctttgcttcttgagtcttgtggatcggtaattctggatgcagaggaaaatattatctagcttttatttcttggtcgtcttctgaaacaacttgaatttgtgtttatgactttatgtattgtggtataggatggtgcctaaaatttagtagaaatttgtttcatgggctttgtaatacttctgcgccttctattggttttcgatgcaatgcccatagttgtagttgagatacaattaaatatgcctcaagttctgctttatagttttatttcggttgtatgacctttca

SEQ ID NO: 12920 - DNA, 974 bp, Elaeis guineensis
tcctcggcccccaatacaaacctacagcgatcgatattctgctgagaaaaatggggcttaccttcacgaagctcttcagccgcctctttgcgaagaaagagatgaggatcttgatggtggggcttgatgctgccggtaagacgaccattctctacaagctcaagcttggagagatcgtcaccaccatccccactattggatttaatgtggagactgtggaatacaagaatataagcttcactgtgtgggatgttggtggtcaggacaagatcagacctttgtggaggcattacttccagaacacacagggccttatttttgttgttgacagcaatgacagagatcgtgttgttgaggcaagagatgagcttcacaggatgctaaatgaggatgaattacgagatgctgtcttgcttgtgtttgcaaacaagcaagatctaccaaatgcaatgaatgctgctgaaataactgataagcttggtctgcattccctgcgtcaacgacactggtacattcagagtacctgtgctacatcaggtgaaggtttgtatgaggggcttgactggctgtccaacaacatcgccaacaaggcttgaaaatttcaaggtggttgcagaacattcttccatagacaacatgatggattcttttgggatatttagatcttcagaacttctagattgttattcacctggttttcttttttccctcagttttcacttttgaaagctttagatttagccattggagtgatggaaatttgtattgactgctgaatcacttatgttatggtttctgccccaattattgatagaatgcttcactgtctaaattgtgctttctagatgattctatattatctgtcttgtcaacgatttaggcctctgccatttattttccaaattttcatattctgattttggttttgcttgtaattggattttgatgagcatgatgaactttatccttgttca

SEQ ID NO: 12921 - DNA, 701 bp, Acacia harpophylla
ggtcctctccaaatccatcgcgcggtgtcctccatcttaagtaaagagatggggctgtctttcaccaaactgtttagtcgactctttgcaaagaaagagatgcgtattctcatggtaggtcttgatgctgctggtaagaccaccatcttgtacaagctcaagctaggagaaatcgtgacaaccattcccacgatcggatttaatgtggagactgtggaatacaaaaatattagcttcacggtctgggatgtaggaggccaagacaagattcgtcctctatggagacactacttccaaaatacccaggggcttatctttgtggttgatagcaacgatcgtgatcgtgttgttgaggccagagatgagctccaccggatgttgaatgaggatgaattgagagatgcggtgctgcttgtatttgccaacaagcaagatcttccaaatgccatgaatgctgcagaaatcacggacaaacttggtcttcattctcttcgtcaacggcactggtatatccaaagcacatgtgccacttctggggaaggactctacgagggcctggattggctttccaacaatatagccaacaaggcttgaaaacaatcacttgtggaacgctgcgttgcaatcttgcttcgaagggggtttgagcttgaattactactatgttcattgggtttttctggcaatcaactaagtcctgc

SEQ ID NO: 12922 - DNA, 781 bp, Acacia harpophylla
ggttctgaagcttcttccttctcctctcgtatccctctctggtttttgttgctagatctctttccagctttttcatcagagggatccaaaggctgaaggagaaatggggttgacattcaccaagcttttcagtcggctttttgccaagaaagaaatgcgaattctgatggtcggtcttgatgctgctggtaagactactattttgtacaagctcaagcttggtgagatcgtcactacaatccctactattgggttcaatgtggagactgtggaatacaaaaacattagcttcactgtttgggatgttgggggccaagataagattcgccctttgtggaggcattacttccagaacacacagggtctaatatttgttgtagacagcaatgacagagatagggttgttgaggccagagatgagttacataggatgttgaatgaggatgaattgagagatgcggtattgcttgtatttgccaacaaacaagatcttcctaatgcaatgaatgctgctgagatcactgacaagctggggctccactctctcaggcagcgccactggtacatccagagcacctgtgctacctctggggaaggcctttatgagggtctggactggctctctaacaacattgccaacaaggcttaatgttctttgggagttacattttggaacggttattctggatgcaggggtgaatattatctagtctttttggtcctcttctgagactaattcgatttgcgttccttgtcagcggttttaggatattttggaagc

SEQ ID NO: 12923 - DNA, 746 bp, Amaranthus tuberculatus
tcttttctttcctctctctcccctcacctcttcgtgatcgtggacgcttcagctctctgagatctttgcccttcttcctcctttctctctcatcatcgtgaaaaatggggctgtcatttaccaaattgttcagtcggttgtttgcgaaaaaggaaatgcgtattcttatggtaggtctcgatgccgctggtaaaactacaattctgtataaactcaagctcggagagattgtcaccactattcctactattggatttaatgtcgagactgtggagtacaaaaacatcagcttcactgtatgggatgttggaggtcaggataagattcgtccattgtggagacattacttccaaaacacccaaggacttatctttgtggttgacagtaatgatcgtgaccgtgttgttgaggccagggacgagctgcataggatgttaaacgaggatgaattgagggaggcagtgctgttggtgttcgctaacaagcaagatcttccaaatgcaatgaatgctgctgagatcaccgacaagcttggcctccattctttacgtcaacgtcactggtacattcagagtacatgtgccacctccggagaagggctttacgagggcctggactggctctcgaacaatattgctagcaaggcttaaatgtaacaaatcacaaatcgagttacgctagctgttctcaggatgagaagctggagttaggctgaggactatctttactgctagtattgccttttt

SEQ ID NO: 12924 - DNA, 987 bp, Amaranthus tuberculatus
ggggctttcgttcggaaagttgttcagtaggttatttgccaagaaagaaatgagaattttgatggtaggtctcgatgccgctggtaaaactacaattctgtataaactcaagctcggagagattgtcaccactattcctactattggatttaatgtcgagactgtggagtacaaaaacatcagcttcactgtatgggatgttggaggtcaggataagattcgtccattgtggagacattacttccaaaacacccaaggacttatctttgtggttgacagtaatgatcgtgaccgtgttgttgaggccagggacgagctgcataggatgttaaatgaggatgaattgagggaggcagtgctgttggtgttcgctaacaagcaagatcttccaaatgcaatgaatgctgctgagatcaccgacaagcttggcctccattctttacgtcaacgtcactggtacattcagagtacatgtgccacctccggagaagggctttacgagggcctggactggctctcgaacaatattgctagcaaggcttaaatgtaacaaatcacaaatcgagttacgctagctgttctcaggatgagaagctggagttaggctgaggactattctttactgctagtatgtaccttttaaaaaataattcattatgtgttctcatttttggtttgtaagttctactgagacagtcatattttgtgtttatgttgcttgttaatttgatattagtactattttagttaatgtaatattctgattagtgtttcagtctttctttgggtgcttcagttgaaaacttaaaatcgctgactgtattttggtaactggatttcttagtcgtttttctattggttttttagttcgttgggacggtcgtaaggctacgtacacgggggtatagggtgcgtagtgtatgtctcgtgtcgtgttaccgtagtaccgtagtacgtacgtgttaactgccgttaggcctaagtgta

SEQ ID NO: 12925 - DNA, 924 bp, Amaranthus tuberculatus
tcttttctttcctctctctcccctcacctcttcgtgatcgtggacgcttcagctctctgagatctttgcccttcttcctcctttctctctcatcatcgtgaaaaatggggctgtcatttaccaaattgttcagtcggttgtttgcgaaaaaggaaatgcgtattcttatggtaggtctcgatgccgctggtaaaactacaattctgtataaactcaagctcggagagattgtcaccactattcctactattggatttaatgtcgagactgtggagtacaaaaacatcagcttcactgtatgggatgttggaggtcaggataagattcgtccattgtggagacattacttccaaaacacccaaggacttatctttgtggttgacagtaatgatcgtgaccgtgttgttgaggccagggacgagctgcataggatgttaaatgaggatgaattgagggaggcagtgctgttggtgttcgctaacaagcaagatcttccaaatgcaatgaatgctgctgagatcaccgacaagcttggcctccattctttacgtcaacgtcactggtacattcagagtacatgtgccacctccggagaagggctttacgagggcctggactggctctcgaacaatattgctagcaaggcttaaatgtaacaaatcacaaatcgagttacgctagctgttctcaggatgagaagctggagttaggctgaggactatctttactgctagtattgcctttttttaaaaaaaataattcattatgtgttctcatttttggtttgtaatttctactgagacagtcatattttgtgtttatgttgcttgttaatttgatattagtactatttagttaatgtaatattctgattagtgtttcagtctttcttggggtgcttcagttgaaaacttaaaatcgctg

SEQ ID NO: 12926 - DNA, 1029 bp, Amorphophallus konjac
ggggtagcggtggtggcggtgggcgcaccccctctaagacctctctccctctctcctcctcctcccatcgccgccggcgctcgtcccctcactctcccctcttcccccgagacacaaagatggggttgtctttcaccaagctctttagcaggctttttgccaagaaggagatgcgtatacttatggttggtcttgatgctgctggtaagactactattttgtacaagttgaagctgggggagatcgtcaccaccattcctaccattggtttcaatgttgagacagtagagtacaagaacattagctttacagtgtgggatgttggtggtcaggacaagatccgtcctttgtggaggcattacttccagaacactcaggggcttatcttcgtggttgatagcaatgaccgagaccgtgttgttgaggctagagatgaacttcacagaatgctgaatgaggatgagctgagagacgcagtgttgcttgtatttgccaacaaacaagatctcccaaatgccatgaatgcagcggagatcactgacaagcttggcttgcattcccttcgtcaacgccactggtatatccagagcacatgcgccacatccggggaaggtctatacgagggactggactggctctcaaacaacatcgctagcaaggtctgatggcctagatgtgccgccaccagcgtcagatatctcgttttcgcaaccaggttcaaaggagtgcggctatttgggggctttgttctgtcattatataagggagggaggggggaggagaagaaagggtcgagagttgtcctttgctcgtcaactcatgcctgtgctcaagttaatacaacaaagtggccttttagtatctatctggaactataataatatggaaatctgttcctttcactcgttggattattcatgttttggaactggaatacccttgtcatttgcttttatacataagaagagctacgaatcatcgttttaattatcctgtttcttgtgtcgatgtagaactcattgttgggtt

SEQ ID NO: 12927 - DNA, 1004 bp, Malus domestica
accacattcacgcgttccttctccttccctctccctcgatcttcaaggtccctctgcgaaagctcatcgaagggatccgtagccagaaatggggcttacgttcacgaagcttttcagccggctttttgccaagaaggagatgcgaattctgatggttggtctcgatgccgctggtaagaccaccatcctctacaagctcaagcttggtgagattgtcacaaccattcccaccatcgggtttaatgtggagaccgtggagtacaagaacatcagcttcaccgtctgggatgtcgggggtcaggacaagatccgaccattgtggaggcactacttccagaacacgcagggtcttatctttgttgtggacagcaatgacagagaccgtgttgttgaggcaagggacgaattacataggatgttgaatgaggatgaactgcgtgatgctgtgttgctcgtatttgctaacaaacaagatcttcccaatgcaatgaatgctgctgaaattactgataagcttggcctccactctctgagacagcgtcactggtacatccagagcacttgtgcaacatccggggagggtctatacgaggggctggattggctctccaacaacattgctaacaaggcgtgattgtatcgaggagtctttttgtggaccggaaattctggatgcaggggtgaatattatctagttgttttttttttttttttatgctattgagacgattgaattgttgttaaatctgcttcttgtatttgttgtgggaatgctgttttcatctaggacctttttaaatcgggttgtatttcttttggttggattttggatacaattctgttctgagttgtaattcgattattggatagatgactcctggttctgtttctggttctggttatggttctggttcattatctgctcggctgctctaaccgagcttatgtgaggatcttagtttccaaggctgtgaggaagtaaactttcaaatttaatttaaaaa

SEQ ID NO: 12928 - DNA, 958 bp, Aquilegia formosa
gtgttatgtattgttgagatccggtttctgaaattctcttcagctccatttcgctcttcgctgcaaactttgcagctctctctctctttcgatctctcgatctaaacgttttcaagctttcgtaagtgaacaagaaagatggggctcacgttcacaaagctttttagccgtctttttgcaaagaaagagatgcgtattctgatggttggtctcgatgcggctggtaagactaccatcctgtacaagctcaagcttggagagattgtgacaacaattccaaccattgggtttaacgtggagacggtggaatacaagaacatcagcttcacagtctgggatgttgggggtcaggacaagatccgtccattgtggaggcactacttccaaaacactcaaggtctcatatttgtggtggatagcaatgacagagacagagttgttgaggcaagagatgaattgcatagaatgttgaatgaggatgagttgcgtgatgctgtgctgcttgtgttcgctaacaaacaagatcttccaaacgcaatgaatgctgcagagatcactgataagctcggccttcactctctccgtcagcgccactggtacatccagagcacatgtgcaacctctggagaaggtctttatgagggattagattggctatctaacaacattgctaacaaggcttgaggctgtaggcaatgacaaatgaagtatatttctgcagtaaaacttgttaatgtggtcaatggtttgcggatttgtgttgcgacatctttaagaatttcttattttttcaatagaacattttggtgataatattgtaatagaggattttgttggttggatatatgaccttgattgttggtttggaatttggttgctctagctgtaaccaggataatatgcccctatcttctacactatctgttttcacttaatataactgcatttagatacaagg

SEQ ID NO: 12929 - DNA, 951 bp, Arabidopsis lyrata
tgctagtgaaagtagaaatttcatttttcaatcacagaaaagaaatcatcatcagtcaatacacgtctttgaagcttctctctcgcctttgattttcgaaaggatcaacggttcaacggacaatggggctttcatttgcaaagcttttcagccggcttttcgccaagaaggagatgcgaatccttatggttggtcttgatgctgccggtaagaccaccattttgtacaagctcaagcttggtgagattgttaccaccattcctaccattgggtttaatgtggagacagttgagtacaaaaacatcagcttcacggtctgggatgtcgggggtcaggacaagatccgtcccttgtggaggcactacttccaaaacacacaaggtctgatattcgtggttgatagcaatgacagagaccgtgttgttgaagccagagatgaacttcacaggatgttgaatgaagatgagctacgggatgcagtattgcttgtgtttgccaacaagcaagatcttccaaacgcaatgaatgctgctgagataactgataagcttggccttcactcactccggcaacgccactggtacatacaaagcacatgcgcaactagcggtgaagggctctatgaaggtctggattggctttccaacaacattgctaacaaagcttgaggttatctcgaccagagagttttggtgttgagattgaaagcttcttctccggagtcaacttgatttcttgtggtttaagacctgatttatttgtttcatgttgaactgtcaccatttctcctttttgcttactcttcttggatgtttgaattcttctaggctctaaaagacatctttttttaatgagtaaaaaattcatatattttgttttcataaagtgaattaactttatttggtcactcatgtcgcaggcaggagctttgtgcgagacgatccttctttg

SEQ ID NO: 12930 - DNA, 842 bp, Arabidopsis thaliana
ctctcacgttcgaagaccatttcttgttctttggacgaccatcggcgacagtgttaagtctagagtcttcttcttcttcggcgtagttttttccccggcttgaaaaatgggtctatccttcggaaagttgttcagcaagctctttgcaaagaaagagatgcgtatcctcatggtgggtctcgatgcagctggtaagactacgatcttgtacaagctcaagcttggagagatcgtgactacgattccaaccattggtttcaatgtggagactgtggaatacaagaacattagctttaccgtgtgggatgtcgggggtcaagacaagattcgtccattgtggaggcactacttccagaacactcagggacttatctttgtggtggacagcaatgatcgtgaccgtgttgtggaagccagagatgagcttcacagaatgttgaacgaagatgagttgagagatgctgtgcttctcgtttttgctaacaagcaagatcttccaaatgcgatgaacgccgctgagataaccgataagcttggacttcactctctccgtcaacgacactggtacatacagagcacatgtgctacctccggagaagggctttatgagggacttgactggctctctaacaacatcgcaaacaaggcttaggagaacaacgtgtggtttggtttttaatcgaggagagtcttgtcttcttccttctatcttttgttctttcgtctcaaactcttatcatttcatactctttgttcttcgctctaataatttacaagtttttttttttgttgcttttatcctataattcagactcttataaaatggggcccaatttcggcgg

SEQ ID NO: 12931 - DNA, 866 bp, Arnica chamissonis
atcgatttattgatccctctcgaacaggcttttctcagggatcctcactagcaagaggatggggctaactttcaccaagctctttagccggctctttgccaaaaaagagatgcgtatattgatggttggtctcgatgcagctggtaagacaaccattttgtacaagctcaagcttggcgagatcgtgaccacaatccccaccataggttttaacgtggagactgttgagtacaaaaacataagctttactgtatgggatgttgggggccaggacaagattcgtccactatggaggcactacttccagaacacacagggtcttatctttgtggttgacagcaatgacagggacagagttgttgaggcaagagatgaattgcacaggatgttgaacgaggacgagttgagagacgcagttctccttgtgtttgccaacaaacaagatctcccaaatgcaatgaatgctgctgaaatcactgataagcttggtctccactccctccgacagcgccactggtacatccagagcacttgtgcaacctctggagagggactttatgagggattggattggctttccaacaacatagcaaacaaggcatgaggcaagtgattgattatgttgggcagtttctgttactggttttggaacttgtttgtttgaaaaagcaaaggtatgttgctgttgctttttatacacaattgaatacattgtttggattgcaagtatgtgttagttaggttattatttctttttatcccaagttgaagttgtaagaggttaagtctttgtgattgttagaagtcgagtacccaatgtagtttgttatccgtccatttcgtgaaacgttttcattttgattacc

SEQ ID NO: 12932 - DNA, 885 bp, Artemisia annua
agagtggtatcaacgcagtactccgacggggatccacatttgatcgacggctccgatctcaaaaaaataaaaatcttataacttttcaggtcgccggcgatcattcaaagatggggctgtcttttggcaagttattcagtcgcttgtttgctaagaaggagatgcgtattctgatggttggtctcgatgcagctggtaaaaccaccattttgtacaagctcaagttgggagaaattgtcaccactatccctactatcggattcaatgttgaaactgttgaatacaagaacatcagcttcactgtgtgggatgttgggggtcaagacaagattcgacctttgtggaggcactactttcagaacacacaaggtcttatctttgtggtcgacagcaatgaccgtgatcgtgttgtcgaagccagagatgagctacacaggatgcttaatgaggatgaattaagagatgcagtgttgcttgtttttgccaacaaacaagatcttccaaacgctatgaatgctgctgagatcactgacaagcttggcttgcaatctctccgacagcgacactggtatatccagagcacctgtgccacctctggggaaggtctatacgagggactggattggctttccaacaacattgctaacaaggcttaaaagggagagtatacatcttatgtcgagcattggtagcatttcatatctatctgttgataaggaataggtgatttccatcagctttcctagacaatatacattatcacatgtagaatttgtacgtttttatttctgtaatacaatattttgcaacatggagacaaatcttttacccttgatttgacttgagttatcatggttcttgaaagtaaacaacttgtattatttt

SEQ ID NO: 12933 - DNA, 797 bp, Brassica oleracea
aatcgcgaaacgttggaaggcgaggagcatcggcatcagatctcgtgcggcggttgtttcttcggtacgttggaatagggaaaggataggatggggctatcatttgggaagctgttcagcaagctgtttgcgaagaaagagatgcgtattctcatggttggtctcgatgctgctggtaagaccaccatcctctacaagctcaagcttggagaaatcgtcaccaccattcccaccattggtttcaatgttgaaactgtggagtacaagaacattagcttcaccgtctgggatgtcgggggtcaggacaagatccgtccgttgtggagacactacttccagaacacacagggtcttatcttcgtcgtggacagcaacgatcgtgaccgtgttgttgaagccagggacgagcttcacaggatgctcaacgaggatgaactgagggatgcagttctgcttgtttttgctaacaagcaagatctccccaacgctatgaacgctgctgagattactgacaaacttggccttcactctctccgccaacgtcactggtacattcagagcacatgtgccacctctggagaaggactctacgagggtcttgactggctctccaacaacattgctaacaaggcatagaaaaggaggtagcaagattcctccctgcttgtttcgctagtactataaaaacgaaaccaagattttattatcatatgttcgtcttctcgcatctcaaactcaaaaccatatcacattttgtactttcctttaataactcacctcttttactttcggatatt

SEQ ID NO: 12934 - DNA, 881 bp, Phaseolus vulgaris
acttccattcttttctctttgttgcaaagagaagagatctgcctccaatcgtatctctcttcctctcaaggtgatttgttgattcagaaaacttgaaaatggggctgtccttcaccaagttgttcagccggctgtttgccaagaaagagatgcgtatacttatggtgggtctcgatgctgcgggtaagaccaccattctgtacaaactcaagcttggagagattgtcaccaccattcccaccattgggtttaacgtggaaactgtggaatataagaacatcagcttcactgtttgggatgtggggggccaggacaagatccgcccattgtggagacattacttccaaaatacccaaggacttatctttgtggttgacagcaatgacagggaccgagttgttgaagctagggatgagctgcatagaatgctgaatgaggatgagttgagagatgccgtgcttctagtttttgccaacaagcaagatcttccaaatgctatgaatgctgcggagattactgataagcttggtcttcattccctccgccagcgtcactggtatatccagagcacatgcgccacatctggtgaagggctttacgaaggactggactggctctcaaacaacattgcaaacaaggcatagagacttcttagttaaaggatgcaaggaagttgagtttactacggccatctccgcgtttatgattttcttgccctacttagattttcattgttcagccatgtattatttttcttcaaaaaagaacagcggtctgttactgaagaataatttgaattttttccatgtataaccaaatagcattgtttacgatttgatttgtgaaatcaattgaattatataaagcctcgtattaggcgt

SEQ ID NO: 12935 - DNA, 985 bp, Phaseolus vulgaris
aaagagcatcattccccttccccaccagtgttggatttggagggagcttcttcttggatctaacctctcaacttctctaataatctcaattctctgcctcttcttcttctgcacctctctctctttgaagtaagatggggttgtctttcaccaagctttttagccggctctttgcgaagaaagagatgcgtattctcatggtaggtctcgacgctgctggtaagacaaccatattgtacaagctcaagctgggagagattgtgacaaccattcccactattggatttaatgtggagactgtggaatataaaaatattagctttactgtgtgggatgtgggtggccaagacaagattcgtcctttatggagacactacttccaaaacactcagggacttatctttgttgtggatagcaatgatcgtgaccgtgttgttgaggctagagatgagctccaccggatgctgaatgaggatgagttgagagatgcagttctccttgtatttgccaacaaacaagatcttccaaatgctatgaatgccgcagaaatcacagacaagcttggtcttcattctcttcgtcaacgccactggtatattcagagcacatgtgccacctctggggaagggctctatgaaggactggactggctctccaataatatagctaacaaggcttagggacatttttggggaacgctgctatcttgctcggctttacgattatattttgaagttgatcggttgatgttctcttagcattaaagtctttttttcaactctttatcaagtccttcttttgtcttatttaggtgtttgatattctattatcatagcaatcgtattcgtttctgtagaattcctaaataattaataatattaatgaattacaaactacacatgcagcgatcatggttatcttagaattctgcataagtcaataatctctataccttttcattttaagcctcgattagttgttcggg

SEQ ID NO: 12936 - DNA, 1284 bp, Phaseolus vulgaris
cgaaagaattaagcgtgagatgcattgcaatttgcagggtgcaatggttatttgatacaaaacgcgcatataattcgggtacccccgttcttgtctctgctataaaaccccctttcattccattttgcgtttttgtaaagcattcttcgcttctctctcttcttctttttttctctctctacgctctctggttcgagatccctcaagggatccgctagctgaaggagaaatggggttgacattcaccaagcttttcagtcggctttttgccaagaaggaaatgcgaattctgatggttggtcttgatgccgctggtaagaccaccatcctgtacaagctcaaacttggagagatcgttacaacaattcctactattgggttcaatgtggagactgtggaatacaagaatattagcttcactgtttgggatgttggtggccaagacaagattcgtcccttgtggaggcactacttccaaaacacacagggtctgatatttgttgtagacagcaatgacagggacagagttgttgaggccagagatgagttgcataggatgttgaatgaggatgaactgagagatgcagtattgcttgtatttgctaacaaacaagatcttcccaatgcaatgaatgctgctgaaattactgacaagctgggtcttcactctctcagacaacgccactggtacatccagagcacctgtgcaacctctggggagggtctttatgagggtttggactggctttccaacaacatagccaacaaggcttagtgctttttgggagtcttgtggattggtaattctggatgcaggggtgaatattatctagtttgttttttggtcctcttctgagacaaattggctttatgtttttatgttttctggtttattagggacacatcttgatggctaaaattatagtaggaatttgtttcgtgggatgtctaatactttgagcttttttattgggtttggattcaatgtttataactgtaattgataccaatctaggcgccatcccattttgagtttttacatcttaattttgataatattcctccaaattattgttgggtgacactgaaaaaaaggagaaaactacccatcactcgacaaaaatattttggttttgcttgccatagccaagccatttttaattttttagacaatgactacagtgcatgtccctgtgttgctccactagtgaatattgcagcctcgtaggatttcaaactggcggatacttattagctttcatgtgtgcaataacttcttaacaa

SEQ ID NO: 12937 - DNA, 959 bp, Vaccinium corymbosum
ccgtttaacggttccgggggtaaacgggaccgaacgttgggtaagttacctaaccgaccgaacgaggtaggtccgcttaacggtaccggggttcggggttgtcccggacgttccttcccccgtcctccgtctctcctctactctcctgatcctctccgcaaaagctcccgcagggatccaccgctagaaagaaaatggggttgacatttaccaagctgttcagccggctttttgccaagaaagagatgcgtatccttatggttggtctcgatgctgctggtaagaccaccattttgtacaagctcaagcttggggagattgtgacgacaatcccaaccatcggctttaacgttgaaactgttgaatataaaaatatcagcttcacagtttgggatgttggtggccaggacaagattcgtccattgtggaggcactatttccagaacacccagggtctcatttttgtggtggatagcaatgacagagaccgagttgttgaggcaagggatgaattgcatcgcatgttgaatgaggatgagctgcgagatgctgttttgcttgtattcgctaacaagcaagatctgcccaatgcaatgaacgctgctgaaattactgacaagcttggcctccactccctccgacagcgtcactggtatattcagagcacctgcgcaacatccggggaggggctctatgaggggttggattggctctccaacaacattgctaacaaggcatgaggtgctgcagcagaatgttcttgtgggttgatcctggatgcagggtggtcttatccgagtctactgtgtggttatgattttatttttccaaaaagcgtttcactttccatttaggattttgcaatggttattatgtaacagagtaattgttgggtacatgtactcgcaaacgttgtttaatacgatgcctattatgatcgcgattgatatcaagttgtc

SEQ ID NO: 12938 - DNA, 1466 bp, Theobroma cacao
cgacctcccatttaccaaacagactaggaacgacaacgcgttcaaatcaagcgtcgtcataacggcgtcgtagaggacaatgctaactaactgccaaagttttctgaaaaatcaaaaagagcagacggtgttccgtcaacctaagatcctgtttggatctataaatacccaatctccaaatctgcgcaaaacattgaaggacagctcctctgatttcgagagggggagatcttcgcttctctgcttcgttcgattacgcgtaataaccgctcgcatttctctcagacgtgaaaaatggggctgtctttcacaaagctattcagccgtcttttcgccaagaaggagatgcgtatactgatggttgggcttgatgctgctggtaaaaccaccattctttacaagcttaagttgggagagattgtcactaccattcccaccattggtttcaatgttgagaccgtggaatacaagaacatcagctttactgtttgggatgttggtggccaggacaagatccgaccattgtggagacattacttccaaaacacacaaggacttatttttgtggttgatagcaatgatcgtgatcgtgtggttgaagctagagatgagttgcacaggatgttgaatgaggatgagttgagggatgctgtgctgctagtatttgccaacaagcaagatcttccaaatgctatgaatgctgctgagattactgacaagcttggccttcattctctccgccagcgccactggtatatccagagcacatgtgccacttccggtgaagggctgtatgagggactggactggctctcaaacaacattgcaaacaaggcatagatggcataagagagttgtctcactaatgctggccctttatggagttatggatgtctacccggtttaagtgttttggtttctcatgtttctttgtttcttgcaaacattgccatttgttacttgtagtttaagaataatcgataaattttcagtttcaattatggtattatctcgatagctgcaaaagaagaaaaaaaaaattccccaagttttgtggcccttcttttcttggtggaaattaatggttagcccgttccattactgtaatgttaaatattcagtgtaagttttttctttacatcgtattcttgaatatgctggtttgagaccaagcacttgcaaatatctgatttatcaaagacctgatcaactgatgagtgttttaaagacattctttaagattaccatattaggtaatagctttttaccagtgtattgaatttattgtattaattgttaatttttgcttaatataagaatattactataaatcttaaaaacgcttttaggacacgtttaggtgatgaatgacacaagtagtgtggacgagcctttcaagatgatgaatggagcaattgggaagccacagaaaagaacaaacaggtcgcctgcgttggcccaaaaca

SEQ ID NO: 12939 - DNA, 886 bp, Brassica napus
gttggaagggtcatcggagctgagatctcgtgcggcgttgtttcttgggtttgggaaaaaagcatggggctgtcattcgggaagctgttcagcaagctgtttgcgaagaaagagatgagaattctgatggtgggactcgatgcagctggtaagacgaccatcctctacaagctcaaacttggtgagatcgtcaccactatcccaaccattggtttcaatgttgaaactgtggaatacaagaacattagctttaccgtctgggatgtcgggggtcaggacaagatccgcccattgtggagacactacttccagaacacacagggacttatctttgttgtggacagcaacgatcgtgaccgtgttgttgaagccagggacgagcttcacaggatgttgaacgaggatgagttgagggatgcagttctgcttgtctttgctaacaagcaagatcttcccaacgcaatgaacgctgctgagattactgacaagcttggccttcactctctccgccaacgacactggtacattcagagcacatgtgccacctctggagaaggactctacgagggacttgactggctctccaacaacatcgcaaacaaggcatagaaaggatgtagcaagatccctcttcacttgttttgtttataaatcaaggaaagaagggttctgtttcgctagtactatcttcatacattcttcttctcagtctcaaactcaaaaccataatcatactttgtactttcatttaataacgatgtttttttgttttaatttttttcttccgtaattgagtaaaatcacttttgtttattcttttcaaccagatctttacttttggttattagtttcgttattcaaatttgcacctcgggtgtatacaatc

SEQ ID NO: 12940 - DNA, 1031 bp, Manihot esculenta
tgtaacgcgttggtgttaagcttcttctctgtagtttcttccatctttctctacctctccagcgccctcgcttgtgattcttcctcagatccctctgcgaatctctccagaaagggatcaatagctgagaagcagaaatggggttgacattcacgaagcttttcagccggctttttgccaagaaggaaatgcgaattctgatggtgggtcttgatgctgctggtaagactacaatcctgtacaagctcaagcttggagagatcgtcactactattccaactattggttttaatgtggagactgtggaatacaaaaacatcagtttcactgtgtgggatgttggtggtcaggataagattcgtcccttgtggaggcactacttccagaacacccagggtctcatattcgtggttgacagcaatgacagggaccgtgttgtggaggcaagggatgagttgcacagaatgttgaatgaggatgagctgcgagatgcagtattgcttgtatttgctaataagcaggatcttcccaatgcaatgaatgctgctgaaatcactgacaagctagggctacactccctccgtcagcgtcactggtacatccagagcacctgtgcaacctctggtgagggactttatgagggcttggactggctctcgaataatattgctaacaaggcataaaggaaacaacgagacattttgtggaaaggcaattctggatgcagggtgaatattatctagtgatttttgtttttttcttttaattttcattttcattttcttttttgagagaactggattgtgtgtacatccctcttctttttgggatgatccttggatttaggacctgtttatggtttatattgttagaagatgagctggatatactatcgagcattaatctggagttggatgctttgaatgtatttcgtgcaccattcttttctgtattacttttctactaggtgttcttgcaacagtttggtatgttttttaacttgttgatgcttatatttattgacggggagc

SEQ ID NO: 12941 - DNA, 806 bp, Centaurea maculosa
ccggattcccgggatcgcccccttattttacgaacctctctatctctctctcttccttcctcccacgcttttagatccatccatcgatccttctccaaaaagcttctcttctcttctttctttcagggatcctcatcagaaaaaggatggggcttacattcaccaaactcttcagccggctctttgccaagaaagagatgcgcatattgatggtgggtctcgatgcagctggtaagacaaccattttgtacaagctcaagctcggcgagattgtgaccacaattcctactatcggttttaatgtggagaccgtcgaatacaaaaacatcagcttcacagtttgggatgtggggggtcaggacaagattcgtccactatggaggcactacttccagaacacccaaggtcttatctttgtggttgatagcaatgacagggacagagttgttgaggcaagagatgagttgcacaggatgttgaatgaggatgagctaagagatgcagttcttcttgtatttgccaacaaacaagatctgccaaatgcaatgaatgctgctgaaatcactgataagctcggcctccactccctccgacagcgccactggtacatccagagcacctgtgccacctctggggaaggactttacgaggggttggactggctttccaacaacattgcaaacaaggcataaggtgacaattgaatttgtattttgagggtggattctggaggcaagttttgctttatttggtgtagccactttcctgttactcgttcttcatcgtctgaggtacaagtgggtatt

SEQ ID NO: 12942 - DNA, 745 bp, Centaurea maculosa
ttacttttacgtaccctctctatctctctcttccttcctcccacgcttttagatccatccatcgatccttctccaaaaagcttctcttctcttctttctcagggatcctcatcagaaaaaggatggggcttacattcaccaaactcttcagccggctctttgccaagaaagagatgcgcatattgatggtgggtctcgatgcagctggtaagacaaccattttgtacaagctcaagctcggcgagattgtgactaccattcctaccatcggttttaatgtggagactgttgagtacaaaaacattagcttcacagtttgggatgtggggggtcaggacaagattcgtccactatggaggcactacttccagaacacccagggtcttatctttgttgttgatagcaatgacagggacagagttgttgaggcaagagatgagttgcacaggatgttgaatgaggatgagctaagagatgcagtacttcttgtatttgccaacaaacaagatctgccaaatgcaatgaatgctgctgaaatcactgataagctcggcctccactccctccgacagcgccactggtacatccagagcacctgtgccacctctggggaaggactttacgaggggttggactggctttccaacaacattgcaaacaaggcataaggtgacaattgaatttgtattttgagggtggattctggaggcaagttttgctttatttggtgtagccactttcctgt

SEQ ID NO: 12943 - DNA, 810 bp, Centaurea maculosa
tcaaatcgatccatcgatccatctcgaacaaccttttctcagggatcctcactaagaagaggaggatggggctaactttcaccaaactattcagccggctctttgccaagaaagagatgcgtatattgatggtgggtctcgatgcggctggtaagacaaccattttgtacaagctcaagctcggcgagattgtgaccacgatcccaaccataggttttaatgtggagactgttgagtacaaaaacattagcttcacagtgtgggacgttgggggtcaggacaagattcgtccactatggaggcattatttccagaacacacaggggcttatctttgtggttgatagcaatgacagggatagagtcgttgaggcaagagatgagttgcataggatgttgaacgaggatgagcttcgtgatgcagtcttgcttgtatttgctaacaaacaagatcttccaaatgcaatgaacgctgctgaaatcactgataagctcggcctccattccctccgacagcgccactggtacatccagagcacctgtgcgacatctggagagggactttatgagggtttggattggctgtctaacaacatcgctaacaaggcataagatggtaccggactgagtcttggatcaacttttccttccagtgtgggatttgttgggaaaagaaagagggtttttgtgcttttgttcttgtagtgatgttttgatataatattctggttgtattgcaagtacttttttaaaacctaaagctgtgacagagattaattttggttgtttttattatatgttgtcttagatt

SEQ ID NO: 12944 - DNA, 899 bp, Chelidonium majus
tccatttgcgaagctttccaaagtttggaggatccacagtgaaacagagatggggctcacattcaccaagctttttagccggctttttgccaagaaagagatgcgtattctgatggttggtctcgatgcagctggtaagactaccatattgtacaagctcaagctcggagagattgttacgacgattcctaccattggttttaatgtcgaaaccgttgaatacaagaacatcagtttcactgtttgggatgtcgggggtcaagacaagatccgtccattgtggaggcactacttccagaacacccaaggattaatctttgtggtggatagcaatgacagagatcgtgttgttgaggcaagggatgaattgcacaggatgttgaatgaggatgagttgcgagatgctgtgttgctcgtgtttgctaacaaacaggatcttcccaatgcaatgaacgctgctgagatcactgataagcttggtcttcactctcttcgccaacgccactggtacatccagagcacatgtgcaacctctggagagggtctttacgagggtttggattggctttccaacaacatagctaacaaggcttgaggcagttcaaggttgtgttttgattggtggctcctttggttgcggggttaatattttctaggcgtttttcctgagagatatatgggagactcatgggtgtgctgctgatttcaaagaggagccttttcttttatttttactctgctgcatcatttgataacaattgttgtaataggataattaatgaatggttggtgggatacatgtgttttttaagcatttattggagttgaaattactgcattagctaatccttttagctgtaattgagattttactatggttaatatcatttttatattaa

SEQ ID NO: 12945 - DNA, 1262 bp, Cicer arietinum
ataaaatgaaaatcccggtggtaaccctttcctttcttctcataataaaaatcaattctctttacaactttcttgcccctatttcgcgttgttgcaaagcatccttctcctctctctctctctctctctctctctctctctctctctctacgtacctcaagctttcatctccaaagggagaattaactaagtgaaggagaaatggggctgacattcacgaagctgttcagtcggctttttgcgaagaaggaaatgagaattctgatggttggtctcgatgctgctggtaagacaactatcctctataagctcaagcttggagagatcgtcaccactattcctaccattgggttcaatgtggagaccgtggagtacaagaacattagcttcactgtttgggatgtcgggggtcaagacaagattcgtcccttgtggaggcactacttccagaacacccagggtcttatatttgttgtagacagcaatgacagggatcgagttgttgaagccagagatgagttacataggatgttgaatgaggatgaacttagagatgcagtattgcttgtgtttgccaacaaacaagatcttcccaatgcaatgaatgctgctgagattactgacaagctgggtctccactctctcagacagcgccactggtacatccagagcacctgtgcaacctctggggagggtctttatgaaggtttggactggctttccaacaacatagccaataaggcttaatacttattgtgagtattgtggattggtgattctggatgccggggtgaatattatctagctttgctttttgacagtcttgtgatcaggaattctggatgcaagggcaaattttatctggcttttatttcttggtcatcttccgaaacaacttgaatttatgtccatgtattgtggtttaggatatattggtggctaaaattgtagtaggaatttgttttgtgggctttgtaacacttttaagctttctattgggtttcgatgcaatgtccataactgtaatggagatttaattaaatgtgccccatgttctgatttatagttttattttggttatgataaatgatgagtttttttatggaaaattgttgttctttatgttgtttgcattataccatgaaaaaaaactgttcgtacttttctaagttgtatatgcttgcttaatcttgttcccaatatccattcaactcaatagaaagctgagattctttcagtttgtgtaggattttattatagag

SEQ ID NO: 12946 - DNA, 865 bp, Chrysanthemum coronarium
atccacattttgctgatcgacggctccgatctcaaaaacttttcctcatttttccggttgccggcgatcatacgaagatggggctgtcttttggcaagttattcagtcgcttgtttgctaagaaggagatgcgtattctgatggttggtctcgacgcagctggtaaaactaccattttgtacaagctcaagttgggagaaattgtcaccactatccctactattggattcaacgttgagactgttgaatacaaaaacatcagcttcactgtgtgggatgttggaggtcaagacaagattcgacctttgtggaggcactactttcagaacacacaaggtcttatctttgtggtcgacagcaatgatcgtgaccgtgttgtcgaagccagagatgagctacacaggatgcttaacgaggatgaattaagagatgcagtgttgcttgtttttgccaacaaacaagatcttccaaacgctatgaatgctgctgagatcactgacaagcttggcttgcaatctctccgacagcgacactggtatatccagagcacctgtgccacctctggggaaggtctatacgagggactggattggctttccaacaacattgctaacaaggcttaaaagggactcatgcaagtgtggagtatacatcttatgacgagcattgttagtattttatatctatctgttgataaggaataggtgatctccatcagctttcctagacaatatacattatcacatgtagaatttgtacgcctttatttctgtaatacaatattttgcaatatggagacaaaaacgtttacccttgagttgacctgcgttatcgtggttttaaaagtaaaccacttttattattt

SEQ ID NO: 12947 - DNA, 828 bp, Chrysanthemum coronarium
tgatccacatttggtcgacggctccgatctcaaaatcacttttctctcaattttccggttgccggcgatcatacaacaaagatggggctgtcttttgggaagttgtttagccgattgttcgctaagaaggagatgcgtattctgatggttggtctcgacgcagctggtaaaactaccattttgtacaagctcaagttgggagaaattgtcaccactatccctactattggattcaacgttgagactgttgaatacaaaaacatcagcttcactgtgtgggatgttggaggtcaagacaagattcgacctttgtggaggcactactttcagaacacacaaggtcttatctttgtggtcgacagcaatgatcgtgaccgtgttgtcgaagccagagatgagctacacaggatgcttaacgaggatgaattaagagatgcagtgttgcttgtttttgccaacaaacaagatcttccaaacgctatgaatgctgctgagatcactgacaagcttggcttgcaatctctccgacagcgacactggtatatccagagcacctgtgccacctctggggaaggtctatacgagggactggattggctttccaacaacattgctaacaaggcttaaaagggactcatgcaagtgtggagtatacatcttatgacgagcattgttagtattttatatctatctgttgataaggaataggtgatctccatcagctttcctagacaatatacattatcacatgtagaatttgtacgcctttatttctgtaatacaatattttgcaatatggagacaaaaacgtttaccctcgagttgacc

SEQ ID NO: 12948 - DNA, 786 bp, Chrysanthemum coronarium
gcgatcattcaaagatggggctgtcttttggcaagttattcagtcgcttgtttgctaagaaggagatgcgtattctgatggttggtctcgatgcggctggtaaaacaactattttgtacaagctcaagttgggagaaattgtcaccactatccctactatcggatttaatgttgaaactgttgaatacaagaacatcagcttcactgtgtgggatgttgggggtcaagacaagattcgacctttgtggaggcactacttccagaacacacaaggtcttatctttgtggttgacagcaatgatcgtgatcgtgtggttgaagccagagatgagctacacaggatgcttaatgaggatgaactaagagacgcagtgttgcttgtttttgccaacaagcaagatcttccaaatgctatgaatgctgcggagatcaccgacaagcttggcttgcaatctctccgacaacgacactggtatatccagagcacttgtgccacctctggggaaggtctatacgagggactggattggctttccaacaacattgctaacaaggcctaaaacggactcgcatgaacatggagtatacgtcttatggcaaacattgttaccattttatctatatgttgagaaggaataggtgatttcccttggctttcttaagactgtatacattatcacttgcagtattcgtacacctttatttctgtaatactatcttttgcaatatgcaaaatgaaaactgttacccttgagttgactgagacttggttaacctagttattgc

SEQ ID NO: 12949 - DNA, 703 bp, Chrysanthemum coronarium
ctctcaattttccggttgccggcgatcatacaacaaagatggggctgtcttttgggaagttgtttagccgattgttcgctaagaaggagatgcgtattctgatggttggtctcgatgcagctggtaaaaccaccattttgtacaagctcaagttgggagaaattgtcaccactatccctactatcggattcaatgttgaaactgttgaatacaagaacatcagcttcactgtgtgggatgttgggggtcaagacaagattcgacctttgtggaggcactactttcagaacacacaaggtcttatctttgtggttgacagcaatgaccgtgatcgtgttgtcgaagccagagatgagctacacaggatgcttaatgaggatgaattaagagatgcagtgttgcttgtttttgctaacaaacaagatcttccaaatgccatgaatgctgctgagatcactgacaagcttggcttgcaatctctccgacagcgacactggtatatccagagcacctgtgccacctctggggaaggtctatacgagggactggattggctttccaacaacattgctaacaaggcctaaaacggactcacatgaacatggagtatacgtcttatgacaaacattgttagcattttatctatatgttgagaaggaataggtgatttcccttggctttcttaagactgtatacattatca

SEQ ID NO: 12950 - DNA, 869 bp, Cichorium intybus
ccactggattctcttcaggaatttgcgagagtgtccagtaaaaaggtaatctataactatcagaagcaacaacaagatgggactgactttcaccaagttgtttagccggttatttgccaagaaagagatgcgcattttgatggtaggtcttgatgctgctggtaagactactatattatacaaattaaagcttggagaaattgtgaccacaattcctaccattgggttcaatgttgagactgttgaatataagaacatcagcttcactgtttgggatgttggtggccaagacaagatccgtcccttgtggaggcactatttccaaaacacacaggggcttatctttgtggtggacagcaatgacagggatcgagttgttgaggcaagagatgaattacacaggatgttaaatgaggatgaactgagagatgctgttttgttggtctttgctaacaaacaagatctgccaaatgccatgaatgctgctgaaatcactgataaacttggtctccattcactccgtcaacgccactggtacattcagagcacatgcgcaacatctggcgaggggctctatgaagggctagattggctctcaaacaacattgctaacaaggcatgagaggaccaagtggtttcacgtggcgttttattaagatgatcagatttatacgtctttagcagtgttgtaggtaaaatggtttctaggaaatatattaaactaatgttgttttaatgtttttttgactttgactttgacttatgcttttggtggaaattatgttgtatgagctcaaaactttggagtaatttaagttgtaatagcccaattttcccaatacaaaatacaaacatcaaatttcataagg

SEQ ID NO: 12951 - DNA, 893 bp, Cirsium arvense
tcgttcccttttcgatcgatccctctccaaaaaaggctttttagcagggatcctcaccagcaataatatggggctaacattcaccaaactcttcagccggctctttgccaagaaagagatgcgcatcctgatggtgggtctcgatgcggctggtaagacaaccattttgtacaagctcaagcttggtgagatcgtgacaacaatccctaccattgggtttaatgtggagactgtcgagtacaagaacatcagcttcaccgtgtgggatgttggtggtcaagacaagattcgtccactatggaggcactacttccagaacacacagggtcttatctttgtggttgatagtaatgacagggatagagttgttgaggcaagagatgagttgcataggatgttgaacgaggatgagcttcgtgatgcagtcttgcttgtatttgctaacaaacaagatcttccaaatgcaatgaacgctgctgaaatcactgataagctcggcctccattccctccgacagcgccactggtacatccagagcacctgtgcaacatctggagagggactttatgagggtttggattggctgtctaacaacatcgctaacaaggcataagatggtaccggactgagtcttggatcaacttttccttcctgtgtgggaattgttggtaaaagaaaagagggtttttgtgcttttgttcttgtagtgatgttttgatataatatttggttgtattgcaagtactttttaaaacctaaagctgtaacagagattaattttggttgtttttattatatgttgtcttagattcaaaaaagacgattttattaacccaaaaaaactagcgagaagccagaacggaagctacatctaaacattacaagcaaaagag

SEQ ID NO: 12952 - DNA, 863 bp, Cirsium arvense
ctcagggatcctcatcagaaaaaggatggggcttacattcaccaaactcttcagccggctctttgccaagaaagagatgcgcatattgatggtgggtctcgatgcagctggtaagacaaccattttgtacaagctcaagctcggcgagattgtgactaccattcctaccatcggttttaatgtggagactgttgagtacaaaaacattagcttcacagtttgggatgtggggggtcaggacaagattcgtccactatggaggcactacttccagaacacccagggtcttatctttgttgttgatagcaatgacagggacagagttgttgaggcaagagatgagttgcacaggatgttgaatgaggatgagctaagagatgcagtacttcttgtatttgccaacaaacaagatctgccaaatgcaatgaatgctgctgaaatcactgataagctcggcctccactccctccgacagcgccactggtacatccagagcacctgtgccacctccggggaaggactttatgaggggttggactggctttccaacaacattgcaaacaaggcataaggtgacaattgaatttgtattttgagggtggattctggaggcaagttttgctttatttggtgtagccactttcctgttctcgttcttcatcgtctgaggtgcaagtgggtattaaaaactttgttgcttaaaaaaaagggtttttgcatttgataatataggacatcatgtatgatacaacgtttggttgggttgcaagtattttttaaaaggtatgatgtgtctttcttcttcttcttgtttgtaggttttgattcatgtaacctaatgttgcaagacagatttattaata

SEQ ID NO: 12953 - DNA, 927 bp, Citrus clementina
atttaccattctcctcgttttcccttaagcagcctcctccttcagatctcgtgagataacagaaaatggggctgtcatttacgaagctttttagccggctttttgccaagaaagagatgcgaattctgatggtgggtctcgacgctgctggtaagaccaccattttgtacaagctcaagctcggtgagattgtgacaaccattcctaccattggtttcaacgtggagactgtggaatataagaacattagcttcactgtttgggatgttgggggtcaggataagattcgtcctttgtggagacattacttccaaaacactcaagggcttatctttgtggttgatagcaatgatcgtgaccgtgtggttgaagctagagatgaactgcaccggatgctgaatgaggatgagttgagggatgctgtgctgcttgtttttgccaacaagcaagatcttccaaatgccatgaatgctgcagagatcactgataagcttggtcttcactcacttcgtcaacgccactggtacatccagagcacatgtgcaacatctggggaaggactctatgagggtctggactggctctccaacaacatcgctaacaaggcttaagtgattggtcaagtctgagcgactctttgcggcagcatctatgtgaatgatgttactatgcttttgtttattttgtcggggattctttttgggctttactacctacgttcagtagaatgtatttgtttgtgttagatatttgattggcaccatactataaagttttctgcattgtcattgtagagtttaaattaccctcattattcagaattcaatgattttttggctgttattcctcttagcttctctttagtctgtagcgttgcagatattctttaatcaccaataattggcttattgatttattcttaatatt

SEQ ID NO: 12954 - DNA, 874 bp, Cleome gynandra
cactctcataattggcttggctgcgttccttcccctcggcagattctcttcccaaaatccttcttagagtgaaaggctattaaaggtatagagcgaggcagatatggggctgagctttactaagctgtttagccggcttttcgccaagaaagaaatgcgaattcttatggttggtttggatgccgctggtaagaccaccattttgtacaagctgaagctaggtgaaatcgtcaccacaatccctaccatcggattcaatgttgaaacagttgagtataaaaacatcagcttcactgtatgggatgttggaggtcaggacaagatccgtccattgtggaggcactacttccagaacacccagggtctcatatttgtggtagacagtaatgacagggaccgtgttgtcgaggcaagggatgaattgcaccgtatgttgaatgaggatgaactgagagaggctgttctgctagtgtttgcaaacaagcaggatcttccaaacgcaatgaatgctgcggaaatcaccgataagcttggtcttcattctcttcgccagcgccactggtacattcagagcacctgtgccacgtccggggaaggcctttacgagggtctggattggctttccaacaacattgctagcaaggcttaagagcaagagacttttgaggtgttttaagagcttatggagagaacatcacgatgattatgatccgcataacactgtagtctgtagtggcttctcaaacacgtgataagtagtgacgttccttctttaatattcgttagcttaatacttattatagctgtaatttgtaaaaggacgatgctttactttaatttcgcatcacaatcatcattgggatgttttcacctc

SEQ ID NO: 12955 - DNA, 911 bp, Gossypium hirsutum
cagagaaataaacggggagactctgaggagaaataatatcagatcctccttctaaactctccacaaagaaaagggaaaaaaaaaaagggagatggggttgtcttttacaaagcttttcagccggcttttcgccaagaaggagatgcgtattttaatggtgggtcttgatgcagctggtaaaactactattttatacaagctcaagctcggtgaaatagtcaccactatcccaaccatcgggttcaatgtcgagacagtggaatacaagaacatcagcttcactgtttgggatgtcggtggccaagacaagatccgtcctttgtggaggcactatttccaaaacactcaaggtctcattttcgtggtggatagcaatgacagggaccgtgttgttgaagcaagggatgaactgcacaggatgttgaatgaagatgaattgagagatgccgttttgctcgtttttgccaacaaacaagatcttcccaatgcaatgaatgctgctgaaataactgataagcttggtcttcattctctccgccagcgccactggtatatccagagtgcatgtgcaacttctggagaaggcctttacgagggactcgattggctttccaacaacattgctagcaaggcatgagggaggatgggtgtttgattgttagctcaactctggccaagatagcttcctctgccatacgaaactttttcgtaacgacggaatgtttattagatatgatattgcgatatgcgctttgtttaacctcaactatactcgtgactttcggaaatgggagttcttagggagtgaaaatatttcgacttaattaagttgatattttttattttatcatcttaaactcgatttataattttttttaattaagtcgagtcaaattgaatgaaattatttg

SEQ ID NO: 12956 - DNA, 1050 bp, Gossypium hirsutum
aaaaagagtatattttcactcgcgtagcaaagcaaggtagaaaaattttgagcagtaatgcaatggaaaagaagaggggtagatcttcgttcaaccacgcctaataaccgctcggatttttctcagacgtgaaaaaaatggggctgtctttcaccaagctattcagccggctatttgccaaaaaggagatgcgcatactgatggttgggcttgatgctgctggtaaaaccaccattctttacaagctgaagttgggagagattgtcactactattcccaccatcggtttcaatgttgagaccgttgaatacaagaacatcagcttcactgtttgggatgttggcggccaggacaagatccgaccattgtggagacactatttccaaaacacgcaaggacttattttcgtggttgatagcaatgatcgtgaccgtgtggttgaagctagagatgagttgcacaggatgttgaatgaggatgagttgagggatgctgtgctgctagtatttgcaaacaagcaagatcttccaaatgctatgaatgctgctgagattaccgacaagcttggccttcattctctccgccagcgtcactggtatatccagagtacatgcgccacatctggtgaaggactgtacgagggactggactggctctcaaacaacattgcaaacaaggcatagatggcgtaattgacttgtctgtctcagaaaatgccagcccctttcggaattattgatgtttctacgtccgttaaaatgttttggtttttcatgttcttttgtttcttgcaaactttgtcatttgttgcttcttgtagtttaagaataattggtaaaattttcggtttctattgttggtcttggtagttggaaaaaaaaatgtattgttttccccaatctcgaggtcattccattcttgatggaaattaacaggttaagtcggtttctttaatctttaaatataaagataccagatttctttggatttctttaatgcttcgttttagcatgtgcagtaactgcaattctttttttttacttaaaaaaa

SEQ ID NO: 12957 - DNA, 919 bp, Vigna unguiculata
ggaccaccaccgtctggattcgctttggagggagcttcttcttggatctaccctctccatttctctaatcgtctcaattatctgcctctgcttcttctacaactcctaagtcctctctctttgaagcaggatggggttgtctttcaccaagctttttagccggctctttgcgaagaaagagatgcgtattctcatggtaggtctcgacgctgctggtaagacaaccatattgtacaagctcaagctgggagagattgtgacaaccattcccactattggatttaatgtggagactgtggaatataaaaatattagctttactgtatgggatgtgggtggccaagacaagattcgtcctttatggagacactacttccaaaacactcagggacttatctttgttgtggatagcaatgatcgtgaccgtgttgttgaagctagagatgagctccaccggatgctgaatgaggatgagttgagagatgcagttctccttgtatttgccaacaaacaagatcttccaaatgctatgaatgccgcagaaatcacagacaagcttggtcttcattctcttcgtcaacgccactggtatatccagagcacatgtgccacctctggggaagggctctatgaaggactggactggctctccaacaatatagctaacaaggcttagggacatttttggggaacgctgctatcttgttcggttttacgattatattttgaagttgatcggttgatgttctcttaaagcattaaagtcgctttcaactccttattaagttcttttttgtctttatttaggtgtttgatactatattatcatagcaatcgtatttgttcctgtagaatttctaaacaattaataatattaatgaattacaaactatacatgcagcgatcgtgctttccttag

SEQ ID NO: 12958 - DNA, 679 bp, Cucurbita pepo
ggggaccgtctctcatttctccattgtagattctcggcggtgttctttgaaggcagcgacagaaaatggggctaacgttcacaaagcttttcagtcggctttttgccaagaaggaaatgcgaattttgatggttggtcttgatgcggctggtaagacaactatcctttacaagctcaagctcggcgagatcgtcacaacaatccctaccattgggtttaatgtggagactgtagagtacaaaaacatcagcttcacagtctgggatgttgggggtcaagacaagatccgtcccttgtggaggcactacttccagaacacacagggtctcatatttgttgttgacagcaatgatagagatcgagttgttgaggccagggatgaattgcataggatgttgaatgaggatgagctgcgagatgcagttctgcttgtctttgctaacaaacaagatcttcctaatgcaatgaatgctgctgaaatcactgataagctgggtctccactctctccgccagcgtcactggtacatccagagcacttgcgccacctctggggaggggctttatgaggggttggattggctctccaacaacattgctaacaaggcataaggatatcgaacagttgcttcttctgagactcgcagttctggatgcagggtgaatattatctaattttt

SEQ ID NO: 12959 - DNA, 971 bp, Cyamopsis tetragonoloba
cctctctcgctcgctctctctttgttcgcttttcggtacccaagcctttcgacctaaggctgaaggagaaatggggctgacattcacgaagcttttcagtcggctttttgccaagaaagaaatgagaattctgatggttggtcttgatgctgctggtaagaccactatcctctacaagctcaagcttggagagatcgtcactacaattcctaccattggcttcaacgtggagactgtggaatacaagaacatcagtttcaccgtttgggatgttggtggccaggacaagattcgtcccttgtggaggcactacttccaaaatactcaaggtcttatatttgttgtggacagcaatgacagggacagagttgttgaggccagagatgagttgcataggatgttgaatgaggatgaactgagagatgctgtattgcttgtgttcgccaacaaacaagatcttcctaatgctatgaatgctgctgagatcaccgacaagttgggtctccactctctcagacagcgccactggtatatccagagcacctgtgcaacctctggggagggcctttacgaaggtttggactggctttccaacaacatagccaataaggcttagtgcttttgggagtcatgaggagcggttattctggatgcaggggtgaatattatctagctttatttcttggtcgtcttccgaaagaacttaattttgtgttcatgtattgtggtttaggacatcttggtggctaaaaattgtaggaatttgtttattgggatgtgtaatacttttgagctttgtattgggtttggatgcgattttcactactgtgatggagatcctaattcaatccaccatcagattatgatttatagttttatttttgttatataatgagtttggatggggatattttgttaattgtttgtatgataccagagagaaaaaaagcaactttgttcacttcataaaa

SEQ ID NO: 12960 - DNA, 813 bp, Cyamopsis tetragonoloba
caaagagtagttgaaaatgggcctgtgtttcacgaagctgttcagccggttgttcgccaagaaggagatgcgtatccttatggtgggtctcgacgctgccggtaaaaccaccattctctacaagctcaagcttggagaaatcgtcaccaccattccaaccattggttttaacgtggaaactgtggaatataagaacatcagcttcactgtttgggatgttggaggccaggacaagatccgtcctttgtggagacactacttccaaaacactcaaggacttatctttgtggtcgatagcaatgaccgagaccgtgtggttgaagctagagatgagctgcacaggatgttgaatgaggatgagttgagagatgctgtgcttctagttttcgctaacaagcaagatcttccaaatgccatgaatgctgctgaaataaccgataagcttggccttcattctcttcgtcagcgtcactggtatattcagagcacatgtgcaacatctggtgaaggactctatgaaggacttgactggctgtcaaacaacattgcaaacaaggcatagtgatcattagccatggattgcatgaagtccagctgagttttagcaattatgacttccgatgtttgatgtgtttagaattttatctactctaggcctgtattatttgtcttctaaaaagaacagatatctactacctaatgtcaaaataatttgttttcgtttttggcctcgtataaccagaaatccattgttttaccattttgatttgtgaagtcaatttaatcgttgaaagcttttacatttctttaaaa

SEQ ID NO: 12961 - DNA, 925 bp, Euphorbia peplus
cttatcgatcgatcgatctctcgctcgctcgattgaattttcatttccatctcagatccctcttcagaaagggatcaacagctaaggatcagatatggggttgacattcacgaaactgtttagccggctgtttgccaagaaggaaatgcgaattcttatggtaggtcttgatgcggctggtaagactacaatcttgtataagctcaagctcggagagatcgtcaccaccattcccactatcggttttaatgtggaaaccgttgaatacaaaaacatcagtttcactgtatgggatgtcgggggtcaggacaagattcgtcccttgtggaggcactacttccaaaacacccagggtctcatttttgtggttgatagcaatgacagagaccgtgttgttgaagctagggatgagttgcacaggatgttgaatgaggatgagctgcgagatgcagtgctgcttgtatttgccaacaaacaggatcttcccaacgcaatgaacgctgctgagattactgacaagcttgggttgcactcactccgccagcgccactggtacatccagagcacttgtgcaacctctggtgagggtctctatgagggtttggactggctctcaaataacattgctaacaaggcctaagatgagtgatggaactttttgtgggttggcaattctggatgcagggtgaatattatctagtgttttacttttttggttttgttttgagagaaatggattgtgtttacattgcacctgaatgatcttctttgtagaaccttttttatgctcttacttgtaatagaaatatttgctggatatgctgtcgagcacttgcctaaatttcaatgcgatactttcttctagttgtaattggaattatgggctgtattttgtccgtcctttcttttgcaggccatgttaacc

SEQ ID NO: 12962 - DNA, 885 bp, Festuca arundinacea
cgccgagatcaggagaggagcccgcatcggagcggagcgagctcgaggccggcgtcgccatctcggaggagagatggggctctcgttcggcaagctgttcagccgcctcttcgccaagaaggagatgaggattctcatggttggtctcgatgccgctggtaagaccaccatcctctacaagctcaagctcggagagatcgtcaccaccatccccaccatcggatttaacgttgagactgtcgaatacaagaacatcagcttcactgtttgggatgtggggggccaagacaagatcaggcccctgtggaggcactacttccagaatacgcagggactcatctttgttgttgacagcaatgatagggagcgtgttgttgaggccagagacgagctccacaggatgctcaatgaggatgaactgcgtgatgctgtgttacttgtatttgcaaacaaacaagatcttcctaatgccatgaatgccgctgaaatcaccgacaagcttggtctgcactcccttcgccagcggcactggtacattcagagcacttgtgctacatctggcgaaggattgtacgagggacttgactggctctccaacaacatcgccaacaaggcttgaagtgtctccacaacgcttccaggaacaaaggctctggctgtctgaagaactcactgctaccatttttcatattgtgatatataaatatatacactctacaacagatagtatgtatgcttatttgacagaagctctcctctgagtgggctagtatcaggttgtttcttcgtgtgggtattatcagcgtttctgttcagttttacaaggtttactgtgtcaactatgtgtatgtacacctacgtttttgagatatagtaaaattgagg

SEQ ID NO: 12963 - DNA, 950 bp, Flaveria ramosissima
ttattcattttacacactccattttcctcaagatctatctcttccaatcgatcgtttgatcaatctccaacaagcttttctcagggatcctcactagcaagaggatggggctaactttcaccaaactcttcagccgtctctttgccaagaaagagatgcgcatattgatggtgggtctcgatgctgctggtaagacaaccattttgtacaagctcaagcttggcgagattgtgaccacaatccctaccataggttttaatgtggagactgttgagtacaagaacataagcttcactgtgtgggatgttgggggtcaggacaagatccgtccattatggaggcactacttccagaacacacagggtcttatctttgtggttgatagcaatgatagggacagagttgttgaggcaagagatgaattgcacaggatgttgaatgaggatgagttaagagatgcagttctcctcgtgtttgctaacaaacaagatctccctaatgcaatgaatgctgctgaaatcactgataagctcggtctccactctctccgacagcgccactggtacatccagagcacttgtgcaacctctggagagggactttacgagggattggattggctttccaacaacatagcaaacaaggcatgaggcgaatgatccattatgtgggtggatgtttctgttgcgggttttgtaacttgtttgtttgaaaaggtattttgcttatgaaatacaattgaacacattgtttggattgcaagtatgtgttaggtaggttgtcgtctcaagttgtaagaggttaagtttttgtggtgattagaagttggattctcatgtagtttgttatcgtccatttgataaaacatttatattctatcgggttctttgggttgtcacaatgcaatctgctttgttgtgttcgtgagggtaattgggttatttgttgag

SEQ ID NO: 12964 - DNA, 871 bp, Flaveria ramosissima
cgtctctctcttccaatcgatcgattgatcaatctccaacaagcttttctcagggatcctcactagcaagaggatggggctaactttcaccaaactcttcagccggctgtttgcgaagaaagagatgcgtatattgatggtgggtctcgatgctgctggtaagacaaccattttgtacaagctcaagctcggcgagattgtgaccacgatccctaccataggttttaatgtggagactgttgagtacaaaaacattagcttcacggtgtgggatgttgggggtcaggacaagatccgtccactatggaggcactacttccagaacacacagggtcttatctttgtggttgatagcaacgatagggacagagttgttgaggcaagagatgaattgcacaggatgttgaatgaggatgagttaagagatgcagttctccttgtgtttgctaacaaacaagatctccctaacgcaatgaatgctgctgaaatcactgataagctcggtctccactccctccgacagcgccactggtacatccagagcacttgtgcaacctctggagaaggactttatgagggattggattggctttccaacaacatagcaaacaaggcatgaggcgaatgattgattatgtgggtgtatgtttctgttgctggttttgtaacttgtttgtttgaaaaaggtatttcgcttttgatatacaattgaatacattgtttggattgcaagtatgtgttaggtaggttgtcatctcaagttgtaagaggttaagtttttgtggtggttagaagttggatactcgatgtagtttgttatccgtccatttgataaaacatttttatttgatcgggtcaaaaaaaaaatatt

SEQ ID NO: 12965 - DNA, 875 bp, Flaveria ramosissima
tattccacaagccccttttcctctttctctccttctcctcgatcgatccctctccaaaaggttcatttgcagggatcctcgcttgacataaaatggggctaacattcaccaagctctttagcaggctctttgccaaaaaagagatgcgaatcttgatggtgggtcttgatgcagctggtaagacaaccattttgtacaagctcaagcttggtgagatcgtgacaacaattcctacgattgggtttaatgtggagactgttgagtacaaaaacatcagcttcactgtctgggatgtggggggtcaggacaagattcgtccattgtggaggcactacttccagaacacacaaggtcttatctttgtggttgatagcaatgacagggatagagttgttgaggcaagagatgagttacataggatgttgaacgaggacgagcttcgagatgcagtcttgcttgtatttgctaacaaacaagatcttccgaatgcaatgaatgctgctgaaatcactgataagcttggcctccattccctccgacaacgccactggtacatccagagcacttgtgcaacctcaggagagggactttacgagggtcttgattggctctccaataacattgcgaacaaggcgtaagatgagactgaatgcagatcttggatgcttcaagtgatgacgttgtttttgtgttcgtgggatttgtttgttaaacaagtttttgtggtagcaaatgtgtctactcatatgatatttgtttgtattgcaatttccttttataagcattgtgttttattatgtgtttcttagataatactttcgcccttatgctatcttgttgctacttatgcgaaacttatgtttagggtctatatt

SEQ ID NO: 12966 - DNA, 916 bp, Flaveria ramosissima
attccacaagccccttttcctctttctctccttctcctcgatcgatccctcaccaaaaggttcttttgcagggatcctcgcttgaaataaaatggggctaacattcaccaagctctttagcaggctctttgccaagaaagagatgcgaatcttgatggtgggtcttgatgcagctggtaagacaaccattttgtacaagctcaagcttggtgagatcgtgacaacaatacctacgattgggtttaatgtggagaccgtcgagtacaaaaacatcagcttcactgtctgggatgttgggggtcaggacaagattcgtccattgtggaggcactacttccagaatacacaaggtcttatctttgtggttgatagcaatgacagggatagagttgttgaggcaagagacgagttacataggatgttgaacgaggacgagcttcgagatgcagtcttgcttgtatttgctaacaaacaagatcttccaaatgcaatgaatgctgctgaaatcactgataagcttggcctccattccctccgacaacgccactggtacatccagagcacttgtgcaacctcgggagagggactttatgagggtctggattggctctccaataacatcgcgaacaaggcgtaagatgataccgaatgtggatcttggatgcttttaagtgatgacattgtttttgtgttcgtgggatttgtttgttaaacaggattttgtggtagcaaatgtgtctactgatatgatatttgtttgtattgcaatttcttttataagtattgtgttttattatatgtttcttagatgttacttttgctcttatgctatcttgttgctacttatgatataaagatattattttataaatttaatagttcatggtatatatacaagggtgaatttcaataaagt

SEQ ID NO: 12967 - DNA, 856 bp, Flaveria ramosissima
ttcattttacatactccattttcctctccgtctctctcttccaatcgatcgattgatcccttttcaacaagcttttctcagggatcctcactagcaagaggatggggctaactttcaccaaactcttcagccggctctttgccaagaaagagatgcgtatattgatggtgggtcttgatgcagctggtaagacaaccattttgtacaagctcaagcttggtgagattgtgactacgatccctaccataggttttaatgtggagactgttgagtacaaaaacataagcttcactgtgtgggatgttgggggtcaggacaagatccgtccactatggaggcactacttccagaacacacagggtcttatctttgtggttgatagcaatgatagggacagagttgttgaggcaagagatgaactgcacaggatgttaaatgaggatgagttgagagatgcagttctcctcgtgtttgctaacaaacaagatctccctaatgcaatgaatgctgctgaaatcactgataagctcggactccactccctccgacagcgccactggtacatccagagcacttgtgcaacctctggagagggactttatgagggattggattggctttccaacaacatagcaaacaaggcatgaggcgaatgatcgattacgtgggtggatgtttctgttgctggttttgtaacttgtttgtttgaaaaggttattttgcttttgaaatacaattgaatacattgtttggattgcaagtatgtgttaggtaggttgtcatctcaagttgtaagagcttaagttttgtggtgcctagaagttggatacttgatgtagtttgttatccgtccatt

SEQ ID NO: 12968 - DNA, 818 bp, Linum usitatissimum
cttcttcgagatccaaagctagggcaaaagccttcccccaaacaccttcatttccttctctgcctatagaacaagatgggtctatcattcaccaagctgttcagccggctctttgccaagaaagagatgcggattctgatggtgggtctcgatgcggctggtaagactaccatcttgtacaagctcaaacttggagagatcgtgactaccattcccaccattggattcaacgttgagaccgtggaatacaagaacatcagcttcactgtctgggatgttggaggtcaagacaagatccgtccattgtggagacactacttccaaaacactcaaggactgatctttgtcgttgatagcaacgatcgtgatcgtgttgttgaggctagagatgaacttcatcgcatgttgaatgaggatgagttgagggatgcagttctgcttgtcttcgccaacaaacaggatcttccaaatgccatgaacgccgctgagatcaccgacaagctcggccttcattcccttcgtcagcgccactggtacatccagagcacctgtgctacctctggcgaaggactctacgagggtctcgactggctgtcaaacaacattgccaacaaggcatagaggattgtcgtcgacatcatgaagccttaactgcttcgatactactgctagactgaacccataatataatgttttcgtgttttgtttcgagggatattgatctatcctgtaatcttgatgttggtaatttcgatctttttgtagattctcaaaataataaaattttacgatattgttaaatataattctgtaacgtg

SEQ ID NO: 12969 - DNA, 763 bp, Linum usitatissimum
gaaaggaagaggaaatggggttgacattcacgaaactgttcagccggctgtttgccaagaaggagatgagaattctgatggttggtctcgatgcggctggtaagaccaccatcttgtacaagctcaagcttggtgagatcgtcaccaccattcctactattggattcaatgttgagactgttgagtacaagaacatcagcttcacagtgtgggatgtcgggggtcaagacaagatccgtccattgtggaggcactacttccagaacactcagggtcttatcttcgttgtcgacagtaatgacagagatcgcgttgttgaggccagagatgagctgcataggatgttgaatgaggatgaactccgcgatgcagtgttgcttgttttcgccaacaagcaggatctgccgaatgcaatgaacgctgctgagatcactgacaagcttggcctccactccctccgtcagcgacactggtacatccagagcacctgtgctacatcgggcgaggggctttacgaaggtctggattggctctccaacaacatcgctaacaaggcttaaatgtgaccaggcaacaagttgtggatgcagagctgagtgttatctagtttcttcgtatttctttatcatctttgtttcttagtctgagacgtttggattttgttttttgcatatttcttaacctttctgcacatgtaacaaccttattcctagattgaaacatgtaagcccataaatcaagttcaaatcgaaaatctataccc

SEQ ID NO: 12970 - DNA, 1116 bp, Gossypium raimondii
ggggtagatcttcgttcaaccacgcctaataaccgctcggatttttctcaggcaagtttctcactttctctctcaaagccaaaaaactttcatttctcaattaattttgctgtaattttctttcaacattttctctcccgatccgccttttactttttaatattctttgaattttaacttttattttatttcgaaagtgtgttaaaatcttttgaatcttcaattcgtcgcttagtttcgtctgatctgagtgttggaactgtcacgtgaaaaaaatggggctgtctttcaccaagctattcagccggctatttgccaaaaaggagatgcgtatactgatggttgggcttgatgctgctggtaaaaccaccattctttacaagctgaagttgggagagattgtcactaccattcccaccatcggtttcaatgttgagaccgttgaatacaagaacatcagcttcactgtttgggatgttggcggccaggacaagatccgaccattgtggagacactatttccaaaacacgcaaggacttattttcgtggttgatagcaatgatcgtgaccgtgtggttgaagctagagatgagttgcacaggatgttgaatgaggatgagttgagggatgctgtgctgctagtatttgcaaacaagcaagatcttccaaatgctatgaatgctgctgagattaccgacaagcttggccttcattctctccgccagcgtcactggtatatccagagtacatgcgccacatctggtgaaggactgtacgagggactggactggctctcaaacaacattgcaaacaaggcatagatggcgtaattgacttgtctgtctcagaaaatgccagcccctttcggaattattgatgtttctacgtccgttaaaatgttttggtttttcatgttcttttgtttcttgcaaactttgtcatttgttgcttcttgtagtttaagaataattggtaaaattttcggtttctattgttggtcttggtagttggaaaaaaaaaatgtattgttttccccaatctcgaggtcattcctttcttgatggaaattaacaggttaagtcggtttctttaatctttaaatataaagataccaga

SEQ ID NO: 12971 - DNA, 1325 bp, Vitis vinifera
ccaaacttcatatacacgctatctaggaccaataatttttttttcctcctttttttaatgataataaagtaaaatatttaataaaaaataaaattttaaaaagaaaataaaaaaaggagaataaaatcatgcatcagaagtgacggttaacggcgaccacaacagaatcagcaggctaagtaaaaaaaattaacgatccgttaacgtccgttttttacgggacactataaatagagtctccgaaaatcctcggaatcaggtatcggtggtggtggtggacagctcctattctttgcttggagatctactctctccgatctctctctccgctgctggtttccatctcttctataaaaagatggggctgtctttcaccaaacttttcagtcggctatttgctaagaaggagatgcgcattctcatggttggtcttgatgctgctggtaaaactacaattttgtataagctcaagttgggggaaattgtcaccactatccctaccattggatttaatgtggagactgtggaatataagaatatcagcttcactgtctgggatgttggtggtcaggacaagattcgacctttgtggagacactacttccaaaacacgcaagggcttatctttgttgttgacagtaatgaccgagaccgtgtggttgaggctagagatgagctgcacaggatgttgaatgaggatgaactgagggatgctgtgctgcttgtgtttgcaaacaagcaagatcttccaaatgctatgaatgctgcagagataactgacaagcttggacttcactctctccgacagcgccactggtatatccagagcacatgtgccacttctggagaagggctgtacgagggactggattggctttcaaacaacattgctaacaaggcttagaggactgcagaatcagatggttttctaaggcttttcatggttgcagtccgtggcagagtataggtgttactgctattatttttatcattactggtgttttagatttaattttctttttattattgcggcgaaaaatagatgcttttctttctgttacttctgaaatcttttcatatgtactatctgtttgtggtttttaattaccatgtagatggttgacatttgtgatttgtctctctatggtcccaataagtcacattctgtttcctagttttccttttgttgttgttcatccaattttaatctaatttaatcaagattattttttcctcaaatgttttttttttttctcttttgataagtaaattttgtcccattgggacttgaaacctcacccaaactcttctcatccctttatcac

SEQ ID NO: 12972 - DNA, 1036 bp, Humulus lupulus
tcgctcggtatgctccagcatcacctggtagtatttgatgtataagcgctcaagttgacaattcttacttctcattccatttaatacgcgttggtgtgaagcttgcttcgttccttcacctcctctctttctctctcttcggtttctctcactagatccctctgcgaaatctctcctgagaagggatcaacagaccaaaaaaaatggggctgaccttcaccaagcttttcagccggctttttgccaagaaagagatgcgaattctgatggttggtcttgatgcagctggtaagacaaccatcctctacaagctcaagctcggtgagatcgtcaccacaattcctaccattggtttcaacgtggagactgtggaatacaagaacatcagcttcactgtttgggatgtggggggtcaagacaagatccgtcccttgtggaggcactacttccaaaacacgcagggtctcatatttgtggtggacagcaatgacagagatcgtgttgttgaggctagggatgaattacataggatgttgaacgaggatgagctgcgcgatgctgttcttcttgtttttgctaacaaacaagatcttccaaacgcaatgaatgcagctgagatcactgataagcttggtcttcattctctcaggcagcgccactggtacatccagagcacatgtgcaacttcaggagagggattgtacgagggtctggattggctctccaacaacattgccaacaaggcataatccctatgtggacaagcaattctggatgcaggggtgaatattatctagtttttttttcttttcttttttgtcgagacaattgaattgttgtgtctattgtcgtttgggcaatcatttaggattttctaatggttatattgtaatagaagaatggtcggttggatatatgccgttgagcttttgtttgggatttaaatacaatgctgagttgtaatcaaactaattcgacgcttaatttctttctgaattgtatctggctatatgttactatttcattttattaatta

SEQ ID NO: 12973 - DNA, 953 bp, Humulus lupulus
catttaatacgcgttggtgtgaagcttgcttcgttccttcacctcctctctttctctctcttcggtttctctcactagatccctctgcgaaatctctcctgagaagggatcaacagccaaaaaaaatggggctgaccttcaccaagcttttcagccggctttttgccaagaaagagatgcgaattctgatggttggtcttgatgcagctggtaagacaaccatcctctacaagctcaagctcggtgagatcgtcaccacaattcctaccattggtttcaacgtggagactgtggaatacaagaacatcagcttcactgtttgggatgtggggggtcaagacaagatccgtcccttgtggaggcactacttccaaaacacgcagggtctcatatttgtggtggacagcaatgacagagatcgtgttgttgaggctagggatgaattacataggatgttgaacgaggatgagctgcgcgatgctgttcttcttgtttttgctaacaaacaagatcttccaaacgcaatgaatgcagctgagatcactgataagctcggtcttcattctctcaggcagcgccactggtacatccagagcacatgtgcaacttcaggagagggattgtacgagggtctggattggctctccaacaacattgccaacaaggcataatccctatgtggacaagcaattctggatgcaggggtgaatattatcttagtttttttttctttttctttttggtcgagacaattgaattgttgtgtgtattgtcgtttgggcaatcaattaggattttctaatggttatattgtaatagaagaatggtcggttggatatatgccattgagcttttgtttgggatttaaatacaatgctgagttgtaatcaaactaattcgacgcttaatttctttctgaattgtatctggctatatgttactatttcatttta

SEQ ID NO: 12974 - DNA, 981 bp, Humulus lupulus
taatacgcgttggtgtgaagcttgcttcgttccttcacctcctctctttctctctcttcggtttctctcactagatccctctgcgaaatctctccggagaagggatcaacagccaaaaaaaatggggctgaccttcaccaagcttttcagccggctttttgccaagaaagagatgcgaattctgatggttggtcttgatgcagctggtaagacaaccatcctctacaagctcaagctcggtgagatcgtcaccacaattcctaccattggtttcaacgtggagactgtggaatacaagaacatcagcttcactgtttgggatgtggggggtcaagacaagatccgtcccttgtggaggcactacttccaaaacacgcagggtctcatatttgtggtggacagcaatgacagagatcgtgttgttgaggctagggatgaattacataggatgttgaacgaggatgagctgcgcgatgctgttcttcttgtttttgctaacaaacaagatcttccaaacgcaatgaatgcagctgagatcactgataagcttggtcttcattctctcaggcagcgccactggtacatccagagcacatgtgcaacttcaggagagggattgtacgagggtctggattggctctccaacaacattgccaacaaggcataatccctatgtggacaagcaattctggatgcaggggtgaatattatcttagtttttttttcttttcttttttgtcgagacaattgaattgttgtgtctattgtcgtttgggcaaatcatttaggattttctaatggttatattgtaatagaagaatggtcggttggatatatgccgttgagcttttgtttgggatttaaatacaatgctgagttgtaatcaaactaattcgacgcttaatttctttctgaattgtatctggctatatgttactatttcattttattaattcaaaaatgatttcaatcatctaaatg

SEQ ID NO: 12975 - DNA, 742 bp, Glycyrrhiza uralensis
tctcgctcccatttcgcgttgctgcaaagcattcttcacacacctatctctgtgtctctgcggtttctggtactcgacgaagctttcatctccaaaggttggataatatcaacaggttgaaggagaaatggggctgacattcacgaagcttttcagtcggctttttgcgaagaaggaaatgcgaattctgatggttggtcttgacgctgctggtaagaccactatcctctacaagctcaagcttggagagatcgtcactactattcctaccattgggttcaatgtggagactgtggagtacaagaacattagcttcactgtttgggatgttggtggccaggacaagattcgtcccttgtggaggcactatttccagaacactcagggtcttatatttgttgtagacagcaatgacagggatagagttgttgaggccagagatgagttacataggatgctgaatgaggatgaactgagagatgcagtattgcttgtgtttgccaacaaacaagatcttcctaatgcaatgaatgctgccgagattactgacaagctgggtcttcactctctgagacagcgccactggtacatccagagcacttgtgcaacctccggggagggcctttatgaaggtttggactggctttccaacaacatagccaataaggcttaatgctttttgggagtcttgtggattggtaattctggatgcaggggtcaatattatctagttttgcttttt

SEQ ID NO: 12976 - DNA, 820 bp, Liriodendron tulipifera
tccgcaaatcgctttctctctcttaaacatacaaagatggggctgtctttcaccaagcttttcagtcggctttttgccaagaaagagatgcgtattcttatggtgggtcttgatgctgcgggtaagaccaccattttgtacaagctcaagttgggagagatcgtcaccaccattcctaccattggatttaatgtggagactgtggaatataagaacattagcttcaccgtgtgggatgttggtggtcaggacaagatccgacctctgtggagacattacttccaaaacacacaagggcttatcttcgtggttgacagcaatgacagagatcgtgttgttgaggccagggatgaactgcataggatgttgaatgaggatgagctgagagatgcagtgcttcttgtttttgccaacaagcaagatcttcccaatgccatgaatgctgctgagattaccgataagcttggccttcactccctccgccaacgtcattggtatatccagagcacatgtgccacttctggtgaagggttgtatgagggattggactggctctccaacaacatcgccaacaaggcatagagatatgtcgctctaggtgacattgggattcaaagctggtgacagtggaattcaaagctgcccctgagtagataaatattatttcagatcatgtttttagtgttgcaaaagagatggttgttccactttgattgcttagtttaatctaaatgcaaaattcccatggtagttgttcatgtagtctctctgaataatccagaaatttgtttttttttctaggagggttgggttgctttcc

SEQ ID NO: 12977 - DNA, 911 bp, Liriodendron tulipifera
agatcgtctcatctcttcctctgctgctttggattgtaggtgaaaatggggctcacgtttacgaagctgttcagccgtctgttcgcaaagaaggagatgaggattttgatggtcggtcttgatgccgctggtaaaaccaccatcctttacaagctcaagcttggagagatcgtcaccaccatccctactattggtttcaatgttgaaacagtggagtacaagaatatcagcttcactgtttgggatgtcgggggtcaggacaagatcagaccgctatggaggcactatttccaaaacacacagggactcatatttgttgttgacagcaatgacagagaccgtgtagttgaggctagggatgaactccacaggatgctaaatgaggatgaactgcgagatgctgtattgcttgtttttgcaaacaagcaggatcttccaaatgcaatgaatgctgctgaaattactgacaagcttgggcttcattccctacgccagcgacactggtacatccaaagcacctgcgccacatctggggagggactgtatgaggggcttgattggctctcaaacaacattgccaacaaggcttgaaatatccaaagatggttggggatttgatgggtcatccctcgagtgcattggcttggctagcacagagcaaccgagattgaaaaatttggcactgcaggctttcaattgtttcagtattattgtgatgatagttcttctctccttttttttccttttattattttttgggtttgtgttatatggattttttgttcttttcttttttggccaccccctcttagcctaagaatcatttgttgccggcattataggtggttctgaagagatggttgtttgtgagttactggaaattagttccttttatatgatttcttcccccc

SEQ ID NO: 12978 - DNA, 1108 bp, Lotus japonicus
ggggtgtttttcgttattttaagcaaaccgaaggaaccaatcccggtacccttctcttctctcataaaatctattctcgtggacacttctctctcaccccccgtttcgccttgttgcaaacaaaccgctctctctctctctctgcagtttcttctacctccaatcgaagctttcatctccaaacgcaaggttgggatctacaggctggtaaggagaaatggggctgacattcacgaagctgttcagtcggcttttcgcgaagaaggaaatgcgaatcctcatggttggtctcgatgcggctggtaagaccaccatcctctacaaactcaagcttggagagatcgtcaccacaattcctaccattgggttcaatgtggagactgtggaatacaagaacattagcttcactgtttgggatgtcggaggccaggacaagattcgtcccttgtggaggcactacttccagaacactcagggtcttatattcgttgtagacagcaatgacagggacagagttgttgaggccagagatgagttacataggatgttgaatgaggatgagctgagagatgcagtactgcttgtgtttgccaacaaacaagatttaccgaatgcgatgaatgctgctgagattactgacaagctgggtctccactctctgagacagcgccactggtacatccagagcacctgtgcaacctctggggagggcctttatgaaggtttggactggctttccaacaacatagccaataaggcttaatgcttttttgggagtcttttggatcgattattctggatgcaggggtgaatattatctagcttttatttctcggtcctcttttgaaacaaacaactcaagtctttgttcatctaatgtgtggtttaggacatcttggtggctaaaattgtaataggaatttgtttcatggaacgtgtaatgcttttgagctttctattgggtttggatgcaatgtccatagctacaattcgatgaaccattttacatttattatggtcattttagctttcataaatgagtatcggatggagatttttactttgtaagataccataaagaaaaacactatattcacttctattgtct

SEQ ID NO: 12979 - DNA, 1394 bp, Lupinus angustifolius
agtagtaatataaataaaattagtaattatatttattatttgtgattggtcgatgaataacaaataatttctcatggctctcgtttatactttataaaaccattctcgttcaggattctccttcctcatttcgcgttcttacaaagcttccttcacaatttcacatccctccctctctctctctctcaaatttctttcaaatctcagatccttgagaaaactctcatctccacagggtgaaggagaaatggggctgacattcacaaagctttttagtcggctttttgcgaagaaggaaatgcgaattctgatggttggtcttgatgctgctggtaagaccactatcctctacaagctcaagcttggagagatcgtcactactattcccactatcgggttcaatgtggagactgtggaatacaagaacattagcttcactgtttgggatgttggtggccaggacaagattcgtccattgtggaggcactacttccagaacacccagggtcttatttttgtcgttgatagcaatgatagggacagagttgttgaggccagagatgagttacataggatgttgaatgaggatgaactgagagatgctgtattgcttgtgtttgccaacaaacaagatcttcctaacgcaatgaatgctgccgagattactgacaagctgggtctccactccctcagacagcgccactggtacatccagagcacttgcgcaacttctggggagggtctttatgaaggtttggactggctttccaacaacatagccaataaggcttaatgctctttttgggagtgttgtggatgggcaattctggatgcagggatgactattatctagcttttatttcttggtcctcttggaaaacaacttggatttgtgttcgtgtattgtgatttaggacatcttttgtggctaaattgccgtaggaatttgtttcatggaatgtgtaatactttaaaagctttctattattgagtataatttgtttgcatgaatattgttgtttccaacttaaatacctatagtctaagcgtatacatagtcaacgtttgattggttctaaggaatacatgcatattttttttttatcgaagtaaggtctcaggctcaaataaaaaacattcgccggaagaattagcctcttaccttgtggcttgaatgcaattgcctttgtgaagaatatttgtgtctggataaaaacctgtatatacatgtccaagttttacctacacaacaaatggtaaattataattgttgaattagtgaaattcgattaagcatcataatagtcagtacatgaaccacataacaagaagcatagtatttaaatcgaagtgttttcctctacttcccttatggtattatacattacagaacc

SEQ ID NO: 12980 - DNA, 1509 bp, Lupinus angustifolius
aagaaatgaaaggtctaatttgtacgacatttaaaattgattaatatgatttttccccctaacataacataataaattgtgtttataaaagcattctcgttaaagattcaagttcctcatttcgcgttctttcaaagcacgcttctctctcttctctctctgcatctttcattcaaatatcagatccttgaaccacttatcatttccaaagggtgaaggaaaaatgggtctaacattcacgaagcttttcagtcggctttttgcgaagaaggaaatgcgaattctgatggtgggtcttgacgctgctggtaagaccactatcctgtacaagctcaagcttggagagatcgtcactactattccaaccattgggttcaatgtggagactgtggaatacaagaacattagcttcactgtttgggatgttggaggccaggacaagattcgtcccttgtggaggcactacttccagaacactcagggtcttatatttgttgttgatagcaatgacagggacagagttgttgaggccagagatgagttacataggatgttgaatgaggatgaactgagagatgctgtattgcttgtgtttgccaacaaacaagatcttcctaacgccatgaatgctgctgagattactgacaagctaggtctccactccctcagacagcgccactggtacatccagagcacttgtgcaacttctggggaaggtctttatgaaggtttggactggctttccaacaacatagcaaataaggcttaatgctttttgggagtcttctggatgcaggggtgaatatttatctagcttttatttcttggtcttgttcagaaacaacttcgatttgtgttcatgtattgtgatttaggacatctttgtggctaaattgttgtaggagtttgtttcatgagatgtgtaaaacttttaagctttctattgggtttggatgcaatgttcgtaactgtaatggagatactaatttcaatgtgccatccctttctgatttgtagttttatcttggtcacatactttccatgtatcgtgtcactgcagggattttgtttatcaattgtaagataaaaaaagaaaacacttttcagatgtgcataccttgttcctcttctatcttgtacgggttggtacccattaccggtgggtgtggatgacatgggcgtgggcttgtacttcgtagttccttttttgcctcaatttttagtaatattgaagtacaactttgatttataacgtattggggtaacagatggaggttggcactcttctttgtttactttttcctttcctaagaaaatattttaccagtttaaaattgaaattttggatttgatttgcttcaggatatgcctaattcctggagcccaccactcatttggttgaagtggatttgaagtgagagaatatcggaagtaagaaactaaagtgaggagagtgtagtatattgtctcattttgttgttaagggaaatagagaataaggaaaaaatt

SEQ ID NO: 12981 - DNA, 869 bp, Lupinus angustifolius
ggggcacaaatttgaggaagagcagatccttctctctttcctctgcaacaagaatagatctcagagaatagttgaaaatgggtctctcattcacgaagctgtttagtcgtttgtttgcgaagaaagagatgcgtatacttatggtgggtcttgatgctgctggtaaaaccaccattctttataagctcaagcttggagaaattgtcaccaccattcccactattgggtttaatgtggaaactgtggaatacaagaacatcagcttcactgtctgggatgttggtggccaagacaagattcgtcctttgtggagacattactttcaaaatacgcaaggacttatttttgtgattgatagcaatgatcgggaccgtgttgttgaagctagagatgaactgcacaggatgttgaatgaggatgagttgagagatgcagtgcttctagtttttgcaaacaaacaagatcttcctaatgctatgaatgctgctgaaataactgataagcttggtcttcattcacttcgtcagcgtcactggtatatccagagcacctgtgccacatctggtgaaggactttacgaaggacttgactggctttcaaacaacatcgcaagcaaggcttagagattattagttggtgtatggattgcatgaagttcagtggagtttagcaattatgaattcagatgtttaatgtggggtttaccctgtttagaattttatctactctagcatgtactatttttctttggaaaaggaacacaactactgtctaatttcaaaataatctccttgtataaccaaaatccacaaagaacattatttttacatattgatttgttacaataaaagtttgactagtgacttacg

SEQ ID NO: 12982 - DNA, 837 bp, Medicago truncatula
caaaaaccaaccacgaggagagatctgatctccattttccccacaaaaataccattctcaattatcaaagaatagttgaaaatgggtctatcattcaccaagctattcagccggttgtttgcgaagaaggaaatgcgtatacttatggtcggtctcgatgccgctggtaagaccaccattctctataagctcaagcttggagaaattgtcaccaccattcccaccattgggtttaacgtggaaactgtggaatacaagaacattagcttcactgtgtgggatgttggtggccaggacaagattcgtcctttatggagacattacttccaaaatacacaagggcttatttttgtggttgatagcaatgaccgagatcgtgttgttgaagctagggacgagctgcacaggatgttaaacgaggatgagttgagagatgctgtgcttcttgtttttgcaaacaagcaagatcttccaaatgctatgaatgctgctgaaataactgataagctaggtcttcattcacttcgtcagcgtcactggtatatccagagcacatgtgctacctctggtgaaggactttatgaaggactagactggctctcaaacaacattgcaagcaagtcttagttattcatttgtcatgggctgcatgaagttcaaccgagtttagagattatgatttcagatgttcggatatggttaccctgtttagaattttaattctgtctaacatgtattgtttcatttgtattcgaaaaagaacaaatgtacctaggtttaatacaattgcatttttttccatatataataaacttaaagcattgtttcacctattga

SEQ ID NO: 12983 - DNA, 909 bp, Cucumis melo
ctttttctgtctgtcgttgattctcggtggtgcttgttgaaggctgtgacagagaatggggcttacgttcacaaagcttttcagtcggctttttgccaagaaggaaatgcgaattctgatggttggtcttgatgcggctggtaagacaactatcctctacaagctcaagcttggtgagatcgtcacaacaatccccaccattgggtttaatgttgaaactgtagagtacaaaaacatcagcttcacagtttgggatgttgggggtcaagacaagattcgtcccttgtggaggcactacttccagaacacacagggtctcatatttgttgttgatagcaatgacagagatcgagttgttgaggccagggatgagttgcacaggatgttgaatgaggatgagctgcgagatgcagttctgcttgtgtttgctaacaaacaagatcttcctaatgcaatgaatgctgctgagatcaccgacaagcttggtctccactctctccgccagcgtcactggtacatccagagcacttgcgccacctccggagagggtctttatgaggggctggattggctctccaacaacattgctaacaaggcataaggatatcgaacagtttgcttctgagactcgcagttctggatgcagggtgaatattatctaatttttttcgtggggcactttataaaagaggttatggttttttctttttttttttctttttcctttttctgtttacgggagcttttagcaaaactatttgtcattatactgtaatatcagaatggttagccttggttatcgtgttttgggctcttttacggggcttttactcgctgttcttttctttcggtttctagctcaaactagttgatgtatcattccatgttggatttgtctcataacccatt

SEQ ID NO: 12984 - DNA, 877 bp, Momordica charantia
tttctgtctgtcgtagattcttggtggtgctcggagaaggcagagacagaaatggggcttacgttcacaaagcttttcagtcggctttttgccaagaaggaaatgcgaattctgatggttggtcttgatgcggccggtaagaccactatcctctacaagctcaagcttggggagatcgtcacaacaatccctaccatcgggtttaacgtggagactgtagaatacaaaaacatcagcttcactgtttgggatgttggtggtcaagacaagatccgtcccttgtggaggcactacttccagaacacacagggtctcatatttgttgttgacagcaacgatagagatcgagttgttgaggccagggatgaattgcataggatgttgaatgaggatgagctacgagatgcagttctgcttgtgtttgctaacaaacaagatcttcctaatgcaatgaatgctgctgagatcactgataagctgggtctccactctctccgccagcgccactggtacatccagagcacttgcgccacctctggagaggggctttatgagggtttggattggctctccaacaacattgctaacaaggcataaggatatggaacagttgcttctgagactcgcagttctggatgcagggtgaatattatctaattttttcatggggcagcttataagaggttatggtttttctgtttacgggagcttttagcaaactatttgtcattatactgtaatatcagaatggttagccttggttattgtgttttgtcggctctttttggggctttacgcgctgttcctttcttttgatttctagctgaaactagttgatgtatcattccatgttggatttgtctcataacccattctt

SEQ ID NO: 12985 - DNA, 791 bp, Momordica charantia
aggagattctacgttaggaacagaaatggggctgacttttgcaaagctttttagtcggctttttgccaaaaaggagatgagaattctgatggttggtcttgatgctgctggtaagacgaccattctctataaactcaagcttggagagatcgtcacaactattcctaccatcggatttaacgtggagactgtggaatataagaacatcagcttcactgtatgggatgtcggtggtcaggacaagattcgtccattgtggaggcactacttccaaaacactcaaggtcttatatttgttgtggacagtaacgacagagaccgtgttgttgaggcaagggatgaattgcatagaatgctgaatgaggacgagcttcgagatgcagtattacttgtgtttgctaacaaacaagatctccccaatgcaatgaatgctgctgagattactgataagcttggtcttcactctcttcggcagcgccattggtatatccagagcacttgtgcaacctctggggaagggctttacgagggattggattggctctcaaacaacattgctaacaaggcataaaagcagttgagagttgtcttgtagactggcgattctggatgcaggggtgaatgttatctactttttcttgtttttcggggaatagtctctcatgccttttctttaggattgatcttccatagtatcagtctgtctatggttatatattgtaatggttgttcgtgtactccaactcacctgggcttttgtgtgtttaatgagatggtgtaattcaaactta

SEQ ID NO: 12986 - DNA, 1092 bp, Tropaeolum majus
aaaaaatatacaaatattcattctgctgcttccgatcttcttcttcttcttcttcttcctccctttataaccaatcccgttttcaccgtttctcatcaccaaatttcgccttcttcactctttctcatatattatttacagttttgttcttttctccaacagatctcctgaagtcacttcagttagagagagatcctcagggtaaggaagatgggactgacattcacaaagctttttagccggctttttgccaagaaggaaatgcgaattctaatggtgggtctcgatgcggctggtaagaccaccattttgtacaaactcaagcttggtgagatcgtgaccacaattcctaccattggttttaatgtagagactgttgaatacaagaacatcagtttcactgtgtgggatgttgggggtcaggacaagatccgtccgttatggaggcactacttccagaacacacagggtctcatttttgtggtggacagcaatgacagagaccgagttgttgaggcaagggatgaattgcataggatgttaaatgaggatgaactgcgtgacgcagtgctgcttgtatttgctaacaaacaagatcttccaaatgcaatgaatgccgcagagattactgataagcttggtctccactctctccgacagcgtcactggtacatccagagcacctgtgctacatctggtgaggggctttacgagggtttggattggctctcaaacaacattgctaacaaggcatgaaaacattgaggaaaccttatgctagatgttatgagtcttgactcgaggtgatttttatctagcgttttctttttcgcctggatgcaggaatgaattgttgttatgccatacttttattgtggagatattcgttttaccctaggaccacttaaattcttacattgtaatagagaatggattgatggttatatactttgattgagttttgaagtgttaaatggtgttttgattgtaaattataagattttaggtgccattgatttctttcaatggttatgaatgtctttctggtgtattcctgcgtcttttgaatgtacgctatgtttacagggtact

SEQ ID NO: 12987 - DNA, 962 bp, Quercus alba
accactccccatttcacgcattcctgtaaagctcatttttttctctctctctaagcgtttttttctactagatccctctgcgaagctctctctctctctctacgaagggatccatagccaggaccagaaatggggctgacattcacgaagttgttcagccggctttttgccaagaaagaaatgcgaattctgatggttggtctcgatgctgctggtaagaccaccattctctacaagctcaagcttggcgagatcgtcacaaccattcccaccattggtttcaatgtggagactgtggaatacaagaacatcagctttactgtctgggatgtcgggggccaggacaagatccgtcccttgtggaggcactactttcagaacacacagggtcttatatttgtggtggacagcaatgacagagaccgagttgttgaggcgagggatgaactgcataggatgttgaatgaggacgaactgcgagatgcagtgttgcttgtatttgctaacaaacaagatcttcccaatgcaatgaatgctgcggagattactgataagcttggcctccactctctccggcaacgtcactggtacatccagagcacctgtgcaacctcaggagaggggctttacgagggtttggaatggctctctagcaacattgcaaacaaggcataaagctcctgggggagttgttttgtgcactggcaattctggatgcaggggtgaatattatctagttctttttaaagacagttggattgtggttatggctttttttattgcgggaatttctctttttattaggaactttgtggctatattgtaatagaaaaatgtcgtgggatatatatacttgagcttttggtcttggttgtatgcaattctcttagctgcaattctcttagctgtaatcagaaccaatttgtttcaactattttaattggttttatacctatcatgtt

SEQ ID NO: 12988 - DNA, 873 bp, Allium cepa
tttccttcccaaatctcgaaagaaaaatcagaaatattatctcaaagatggggttgacattcacgaagctgtttagtcgattgttcgcaaagaaagagatgagaattttgatggttggactcgatgcggctggtaaaaccaccatcttgtataagctcaagcttggtgaaatcgtcactaccattcctacaattggatttaatgtggagacagtggaatacaagaacatcagttttactgtttgggatgtcggaggtcaagataagatcagacctttgtggaggcattacttccagaatacacagggcctcatctttgttgttgacagtaatgatagagatcgtgttgtcgaggcaagggatgagctccatagaatgctaaacgaggatgagttgcgagatgctgtactgcttgttttcgcaaacaaacaggatcttccaaatgcaatgaatgcagctgaaattactgacaagcttggcttgcattctctccgtcaaaggcactggtacatacagagcacttgtgcaacatctggagaaggattgtacgagggtctagagtggctctctagtaacattgccagcaagggttgaaaacttggaaaggatcgctgagaatataacccggggatgaatatgacatataatattttgaactttttatattaaagtggttgttacatgtttgatcaacatttgtgtttcttgtgcttatctagggttgattataaattcattttctgcagttttattatagtatttgatatattgttaccggtaaactgttgctgttgattaattttgttcgttttggattggttgtatggttgtatattgagcatggtttcattataaagtttggtgattctatatt

SEQ ID NO: 12989 - DNA, 1091 bp, Carica papaya
ataattggaggtcctaaataaaggttcctagaaaaattcccttcaacaaagaaactaaaaaggaaagaaggagaatcacgtttctaagaatctcgcggtccgctcttcccttttctcacaattttagatcctccagttttcctccgaagttttcaacagagcaagctacagggagtcagtcatggggctgacattcacgaagctatttagccggctttttgcaaagaaggaaatgcgtattctgatggttggtctggatgctgctggtaagaccaccattttgtacaagctgaagcttggtgaaattgtcaccacgatccctaccataggatttaatgtggagacagttgaatacaagaatatcagcttcactgtttgggatgtgggtggtcaagataagatccgcccattgtggaggcactattttcagaacactcaaggtcttatttttgtggtggacagcaatgatagggaccgtattgttgaggcgagggatgagttgcatcgtatgttgaacgaggatgaactaagggatgctgttcttcttgtatttgccaataagcaagatcttcccaatgcaatgaacgctgcagaaataactgacaagcttggtcttcattctctccgccaacgccactggtacatccagagcacttgtgcaacttcaggagaaggtctttatgaggggttggattggctttccaacaacatcgctagcaaggcatgaagtttttgaggattttggttcttagacagagactctgataatcgtggagaaaatagttgtgcttttatttgatcgagtttgtaatggcagaatggttatgtaattgttggtttagctaatacttttagctataaatataactattatgatgatactatgttttggtaaattgcatcatatcctggatatggtttggtttgcttcatatagtgcttctcttaccctctagatttcaatttatatttttcaaataatcgtggagaaaatagttgtgcttttgtttgatcgggtttgtaatggcagaatggttatgtaattgttggtttagctaatacttttagctataaatataactattatgatg

SEQ ID NO: 12990 - DNA, 953 bp, Carica papaya
attcaaggacagcaccttttgttctcgagcgaggggggcgcagatctcttttctctccatccacacaaaaccttctcatttctctctgacgcgtaaagatggggctgtctttcaccaaactgttcagcaggctgtttgcaaagaaggagatgcgtatactgatggtgggtcttgatgctgctggtaagaccaccattctttacaagctcaagctgggagagattgtcaccaccattccgaccatcggatttaatgtggagactgtcgaatataagaacatcagctttacagtctgggatgtcggtggccaggacaagatccgtcccttgtggagacactatttccaaaacacacaaggacttatctttgtggttgatagcaatgaccgagaccgtgtggttgaagctagagatgagctgcaccgaatgttgaatgaggatgaactgagggatgctgtgctgctagtatttgcaaacaagcaggatcttcctaatgcaatgaatgctgctgagataactgacaagcttggcctccactcactccgtcaacgacactggtacatccagagcacatgtgctacatctggagaagggctctacgagggtctggactggctctccaacaatatcgcaaacaaggcatagatgagatgagatgattggttcaaagtcttgggtggctactggattacatagtttaagaagggttctgttgtgttctgggttttttttttttttttttttttttttttttttttcttgttaaattgttaagcgttgtgacctgtttttgccgtgtttgttattgaccttgcaaaacattacaatttgttttcgtgtagtttcagaataattcataaatttttgtccttcccgtatgatgatggcattgggtggataaaaatttcccttgtttcttctttttaccttgcgatatattctttgttcattatg

SEQ ID NO: 12991 - DNA, 1136 bp, Petroselinum crispum
atctcttatgtatatgcatcctctatatatcatcccaatgattcagtgaatctctgtgctttccattgcttttgaatcatctaacaaacactgtttctaattgaggagtgttaaagatggggttgtcctttaccaaactcttcagtcggctttttgccaagaaagagatgcgcatacttatggtgggtctcgatgcagctggtaaaacaactattctttacaagcttaagctgggagagatagttacaacgattcctactattggatttaacgtggaaactgtggaatacaagaacatcagctttaccgtctgggatgttggaggccaggacaagatccgccctttgtggagacattacttccaaaatactcagggcctcatatttgtggttgatagcaatgatcgagatcgtgtagttgaagcaagggatgagctgcacagaatgcttaatgaggatgaattaagggatgctgtcctacttgtattcgcaaacaaacaagatcttcctaatgcaatgaatgctgctgagattactgataagcttggccttcattctcttcgtcagcgccactggtacattcagagcacatgtgccacttcaggtgaaggtttatatgaaggtttggactggctctcgaataacattgcaaacaaggcatagacatcttgattagagttggaatcttctctggaaccagatagagttcatcaaattacttggctcggagatctgtcacgacagtcggatagtgttattcacatttctttttcccttccaagttgtgtaccatgtctttatgtttgacctctttactatattggaggtctgttaaaaatgttcattttgtttcttgtaggtttgttatggttctgtatcatatattattcccatatatgataattgacctttttacagtttaatatgcaatcatggttgtgcaaatgtgcaaatttttctttcataaattaatgagcaatacattttttatatggtggtaatttacttttttgcgagtaggaggattgattgaagtggtttgctagtacttatgtatattatgtaccacatgaagttgaacaagatttagaccgcttcttagattcaggagacagttgcgcatgcaactattctggg

SEQ ID NO: 12992 - DNA, 935 bp, Arachis hypogaea
ttctctctctctctctgtttatcctctctcatcgtttctctcccttcctttttctggttccagatcccttaagggatccacacgctgaaggagaaatggggctcacattcactaagcttttcagtcggctttttgccaagaaggaaatgcgaattctgatggttggtcttgatgcagctggtaagaccaccatcctctacaagctcaagcttggagagatcgttaccacaattcctaccattgggttcaatgtggagactgtggagtacaagaacattagcttcactgtttgggatgtaggtggccaagacaagattcgtcccttgtggaggcactacttccagaacacacagggtcttatatttgttgttgacagcaatgacagagacagagttgttgaggccagagatgagttgcacaggatgttgaatgaggatgaactgagagatgcagtattgcttgtatttgctaacaagcaagatcttccgaatgcaatgaatgctgccgaaattactgacaagctgggtctccactctctcagacagcgccactggtacatccagagcacctgtgcaacctctggggagggtctttatgagggtttggactggctttccaacaacatagccaacaaggcttaatgcttgttgggagtcttcttctgaaccggtgattctggatgcaggggtgaatattatctagtttgcgtttttggtcgtcttccgagacaaattggatttgtgttcatgtttttgtggtttaggacatcttgatcgctaaaattatagtaggaatttgtttcatgggatgtcgaatacttttgacctttctattgggtttggattcaatgtttataaatgtaatggataacaaagcaattcaatgcgccatcccattctgagttttatagtttatttgtttgttatataccccat

SEQ ID NO: 12993 - DNA, 889 bp, Arachis hypogaea
tctctctctccctctctctctctctctccgaacgttctgtttccagatcactcaaggctctcatttcccaacggttgaaggagaaatggggctgacattcacaaagcttttcagtaggctctttgccaagaaggaaatgaggattctcatggtgggtcttgatgctgctggtaagaccactatcctctacaagctcaagcttggagagatcgtcactacaattcccactattgggttcaatgtggagactgttgaatacaagaacattagcttcactgtttgggatgttggtggccaggacaagatccgtccattgtggaggcactatttccagaacacccaaggtcttatatttgttgtggacagcaatgacagggacagagttgttgaggccagagatgagttacatcggatgttgaatgaggatgaactgagagatgctgtattgcttgtgtttgccaacaaacaagatcttcctaatgcaatgaatgctgctgagattactgacaagctgggactccactctctcagacaacgccactggtacatccagagcacttgtgcaacatctggggaaggcctttatgaaggtttggactggctttcgaacaacattgccaataaggcttaatgcttttggggagtcctgtggatcggtgattctggatgcaggggtgaatattatctagcttttatttcttggtcctcgttggaaaccacctagatttgtgttcatgtaatgtgtttttggacttggtggcgaaaattgtgttaggaatttgtttcatggatgtgtaatacttgtgagcaatgttgggcattgttgcaatgttcataactgtaatggagacactaattcaatgtgccaccccgttttgatttattcagt

SEQ ID NO: 12994 - DNA, 789 bp, Petunia hybrida
caaaggtattcccattttcttgtcatttccaaaagggcagaatatagatctgcccctctttctctctatctctcttgattcatcactgcattgaaaaaagatggggttgtcattcgggaagcttttcagtcggctttttgccaagaaggagatgcgtatcctcatggttggtctcgatgcagctggtaaaaccaccatattgtacaagctcaagcttggagagatcgttaccaccattcctaccattggattcaacgtggagactgttgaatacaagaacataagcttcactgtctgggatgttggaggtcaggacaagatccgaccattgtggaggcattacttccaaaacacacaaggacttatctttgtggttgacagtaatgatcgggatcgtgttgttgaggctagagatgagttgcacaggatgttgaatgaggatgaacttagggatgctgtgctgcttgtgtttgctaacaagcaagatcttccaaatgctatgaatgctgccgagatcactgacaagcttggtctccactccctccgtcaacgtcactggtacatccagagcacatgtgctacctctggagaagggctgtatgaggggcttgactggctctcaaacaacattgccaacaagggttagagagcaagatccatgatttttgcagctatatttttgtcaatatagacttcaacaatgtttagagcacttatgtacctgcttgaattttcttttcggagacagatcaccttatttctatagttatcagtacattttccatttct

SEQ ID NO: 12995 - DNA, 895 bp, Plantago ovata
cggccgggggcacaatagctggtctctgctgcgattcaacctctctcgatagatttcatttcatcacgtaggcatttgtaaggaaaatggggttgtcttttaccaagcttttcagccggctgtttgccaagaaggagatgagaattcttatggttggtctcgatgcagctggtaagactactatattgtacaaactgaagctgggagaaatagtgaccaccatcccaactattggattcaatgtggagacggtggagtacaagaacataagcttcactgtctgggatgttgggggtcaagacaagattcgcccactgtggaggcattacttccagaacactcaagggctcatcttcgtggttgatagcaacgatcgtgaccgtgttgttgaggctagagatgagctgcacaggatgttgaatgaggatgagctgagggatgctgtgcttcttgtttttgcaaacaaacaagatcttcctaatgcgatgaatgctgctgagataactgacaaacttgggcttcactcacttcgccaacgccattggtatattcagagcacatgtgccacatctggggaagggctgtatgagggtctcgattggctctccaataacattgcaaacaaggcttgatcagagatccagtgcatgaattttgttatcgcgatccttgttgaagtggtggctgcatttagctttctgctcgggcaaacttagcacttgatcactgcattctttatcatgtggtcacctcttgttatgtataatttgagttttacattttgttactcgcagtttactatatacgcagcgtgctgtattgggcttgggctgcttattctctagaatgattgttgggtttgttctttcttttattcttttgggcaaagcaagtg

SEQ ID NO: 12996 - DNA, 892 bp, Platanus occidentalis
tcagttcgactcctcctcgaggaaaggaccccacatccacaaaagaaaaatggggttgactttcactaagcttttcagccggctttttgccaagaaagagatgcgtattttgatggttggtcttgatgcagcgggtaagaccaccatcttgtacaagctcaagcttggtgagattgtcacgacaattccaaccattggattcaatgtggaaacagtggaatacaagaacatcagcttcaccgtttgggatgttggtggccaggacaagatccgtccattgtggaggcattacttccaaaacacacagggtcttatatttgtggtggatagcaatgacagagatcgagttgttgaggcaagggatgagttgcataggatgttaaatgaggatgagttgcgagatgctgtgttgcttgtatttgctaacaaacaagatcttcctaatgcaatgaatgctgcggagataactgataaacttggccttcactctctccgccaacgtcactggtacatccaaagtacttgtgcaacctcaggagagggcctttacgaggggttggattggctctccaacaacattgctaacaaggcctgagccaaataagggttgtgcttcgttgcgtggggttgttctggattcggagtatatattgtgtagggctttttctttatctttgataagtgggcttttggttgtggtgactggtgccaactggataggacggatattgctctgtgaaacttctggtgacatattgtgatagaaagcttggatggttggacatttagtttacgagcttgtctgtggttgaatgtaatgctttacccaatccttagtttgtaattgaagccgtatgtatggtgtttacaacctctttctgaaatgggcttt

SEQ ID NO: 12997 - DNA, 848 bp, Platanus occidentalis
tcggatcaccgataactgcctttcccttcatatacaaagatggggctgtctttcaccaagcttttcagtcggctgtttgccaagaaagaaatgcgaattcttatggtgggtcttgatgctgcgggtaagaccaccattttgtacaagctgaagctgggagagattgttactaccattcctaccattggttttaatgtggaaactgtggaatataagaacattagctttaccgtctgggatgtaggtggtcaggacaagatccggcctttgtggagacattacttccaaaacacgcaaggtcttatctttgtggtagatagcaatgaccgggaccgtgttgttgaggctagggacgagctgcacagaatgttgaatgaggatgagttgagggatgctgtgctgcttgtgtttgctaacaagcaagatcttcctaacgccatgaatgccgctgagatcactgataagcttggtcttcactccctccgccaacgccactggtacatccagagcacatgtgccacttccggagaagggctgtatgagggactggattggctgtcgaacaacattgctaacaaggcatagaagatgggtgtaattctaatgaattttgggctgcagttggacgtgtcagagtagaatgttattattattattttggtgtcttggattttctttttccatggtttgtttaacgtgagttgttatccccttttatatccctctgtttatggttatatacattggcatttgttttgctatatccagaaaattctcatttcagcctctatgccatgagttcttattgatgttttgagaaacaaatagaaatgggaagaccgaatgat

SEQ ID NO: 12998 - DNA, 1014 bp, Populus trichocarpa
ttaaaatagaaaagggccaaaagggcaaggatccacgttaagtcctataaatacaaacaattagtctcttggatcgtgtgaatatttgccgtgaaggacagctcctcctcctcattttaatttccctgtactctctgctgaggtagatctctctctctctcacccctcttggctccttgtcagacgtgagaaaatggggctgtctttcaccaagttgtttagcagactgtttgctaagaaggaaatgcgtattctgatggtgggtcttgatgctgctggtaagacaaccattctctacaagctcaagctcggtgagattgtcaccaccattcctactattggattcaatgtggagactgtggagtataagaacattagctttactgtttgggatgtcgggggtcaggacaagatccgccccttgtggagacattacttccagaacacacaaggacttatctttgtggttgatagcaatgacagggatcgtgtggttgaagctagggatgagctacacaggatgttgaatgaggatgagttgagggatgctgtgcttctagtgtttgcaaacaagcaagatcttccaaatgcaatgaatgctgctgagataactgataagcttggtcttcactctcttcgtcagcgccactggtatatccagagcacatgtgccacttctggtgaagggttgtatgagggattggactggctctcaaacaacattgcaaacaaggcttagatggcataactcccaagttctcgattgcaatgagtgctggaatacagagtctatatttgttttgtattctggattttccaccagctcattttgtctttacctgtcttaacatgtttgtggttgcttttgcaaacttttccgtttgttttctgtagcttcagaatttttcattaattttcgttttgttcatgatgttatctaaatagcatgttttgtttttcagataattttttaaggtaatgaatcttgagactttttccttttatcctaattgt

SEQ ID NO: 12999 - DNA, 993 bp, Papaver somniferum
gaagatctctgtctttctctccatccccccgtatacacctctttccctgcaaacatggggctgtcattcaccaagttatttagtaggctatttgccaagaaggagatgagaattcttatggtaggtctagatgcggctggtaagactacaatattgtataagctcaagttgggagagattgttaccaccattcctactattggttttaatgtggagactgtagagtacaagaacatcagtttcactgtgtgggatgttggaggtcaagacaagatccgacccttgtggagacattacttccaaaacacccaaggtcttatctttgtggttgacagcaacgatcgtgatcgtgtggttgaagctagagatgaactgcataggatgttgaatgaggatgagttgagagatgctgtgcttctagtgttcgctaacaaacaggatcttccaaatgcaatgaatgctgctgagatcactgataagcttggtcttcattctcttcgtcaacgacactggtacatccagagtacatgtgcaacttcaggagaagggttgtatgaaggtcttgactggctctccaacaacattgctaacaaggcatagaagtctcaacattgatattttggcctatgttggttggatgttgaattatttagtattttcatcatcataattgttgttactgtatgtgtcttcttgttcgtatatttctctcccccctgttaattgttgagaaaggaattgttcttaaaacctttcttatgtgaatgatttctatgttacagactacatttgtttctttttagatccataataattgcagagcatattaatcttctaattctcttgtgccatttttccttctatgttatccaaatagagatattgtggcaccaaatacgagatgggttgattgattacctttcgatgaacaatttttactatcattatctatgtaaagttatagttgggtttggcaatattaagaggaaatac

SEQ ID NO: 13000 - DNA, 905 bp, Papaver somniferum
tctctgtctttctctccatccccaagtatacacctctttccctacaaagatggggctgtcattcaccaagttatttagtaggctatttgccaagaaggagatgagaattcttatggtaggtctagatgcggctggtaagactacaattttgtataagctcaagttgggagagattgttaccaccattcctactatcggatttaatgtggagactgtagagtacaagaacatcagtttcactgtgtgggatgttggaggtcaagacaagatccgacccttgtggagacattacttccagaacacccaaggtcttatcttcgtggttgacagcaatgatcgtgatcgtgtggttgaagctagagatgaactgcataggatgttgaatgaggatgaattgagagatgctgtgcttctagtgttcgctaacaaacaggatcttccaaatgcaatgaatgccgctgagatcactgataagcttggtcttcactctcttcgtcaacgacactggtacatccagagtacgtgtgcaacttcaggagaagggttgtatgaaggtcttgactggctctccaacaacattgctaacaaggcatagaagtctcaacattgatattttggtcttatgttggttgaatgttgaattatttagtattttcgtcatcataattgtcggtactgtatgtgtcttcttgttcgtatatttctctccccctgttaattgttgagaaaggaattgttcttaaaacctttcttatgtgaatgatttctatgttacagactacatttgtttctctttagatccataataattgcagatcatattaatcttctaattctcttgtaccattttcccttgatggtatgttatccaaacagagatagtggtatgttatcaggaaagggag

SEQ ID NO: 13001 - DNA, 1153 bp, Prunus mume
ctccacattcacgcgttgatttaaagcttctctcccctccgctctctccctccctcgatctccatctttaactaagatccctccgcgaaagctcatcgaagggatccacagccagaatggggcttacattcacgaagcttttcagtcggctttttgccaagaaagagatgcgaattctgatggttggtcttgatgctgctggtaagaccaccatcctctacaagctcaagctcggtgagatcgtcacaacaattcccaccattgggtttaatgtggagaccgtggagtacaagaacatcagcttcacagtctgggatgtcgggggtcaggacaagatccgacctttgtggaggcattacttccagaacacacagggtcttatctttgttgtggatagcaatgacagagaccgtgttgttgaggcaagggatgaattgcataggatgttgaatgaggatgagctgcgagatgctgtgttgcttgtatttgctaacaaacaagatcttcccaatgcaatgaatgctgctgaaattactgataagcttggcctccactctctcagacagcgtcactggtacatccagagcacttgtgcaacctctggagagggtctatatgaggggctggattggctctccaacaacattgctaacaaggcgtgatcctattggggagtcattttgtggactggaaattctggatgcaggggtgaatattatctagttctttttttttctgagacaagacgatcgaattgttgttaaatcatctatttcttccttcttctgggagtggtctttttcatttaggacgttttaatggttatattgtgatagaaagaatggttggtcaaatgtatacatttgagcttttggttggattttggatacagttcggagttgtaattggatttcaatagatgcctccttcctttttttattttttattttttcaaaactgctctgagttgtaattggttttggttggattttggatacatgtttcaaatgtatacatattgccgagtaatgcagaaccacacttgaattgaaggagttgcttattaattgaggtcccatgttttggttcgtttggtttgggaccctccagaggagaagggagacctcacactcataataaaaatcccattttt

SEQ ID NO: 13002 - DNA, 910 bp, Prunus persica
atgacaatatctctcaagcttgttatgtgtctcgcaaatttcttattagagttaggcaaattgtaccacgaatcttgtaaatttcttataaataagctagtctcccaaccctggagcccatttctcatcgtacctcttctctctctagggcagcgtctcagatctgccccctctaagcttttcaaaatggggttatctttcaccaagttgttcagtcgtctttttgctaaaaaagaaatgcgaattcttatggtcggtctcgatgctgctggtaaaactaccatattgtacaagcttaagctcggagagatcgtgaccaccattccaacaattggattcaatgttgaaactgtggaatataaaaacattagctttacggtttgggatgttggaggccaggacaagattcgacctttatggagacactacttccaaaatacacaagggctgatttttgtggttgatagcaatgatcgtgatcgtgttgttgaggctagggatgagctgcataggatgttgaatgaggatgagttgagggatgcagtgctgcttgtattcgctaacaagcaagatctcccaaatgcaatgaatgctgctgagatcactgacaaactcggtctccattctcttcgtcaacgccactggtacatccaaagtacatgtgccacctctggggaagggctctatgagggtcttgactggctgtccaacaatatagcaaacaaggcttaaaacgatgacaaaaacttcggcagcctcttgttttgaatgtgtcaaagtggaatgtccattatcttctgtttatgaatttcttagtgttactattctaagaatgtattttgtttagataattactacaaagtgattgatgccgtctggccctgtagatttaaataattcaagattttta

SEQ ID NO: 13003 - DNA, 879 bp, Pteridium aquilinum
cttctgcacgcggtgttctcctcacacactatacaaaaccgcagtgtgaagaagaccagaaaccctcgctcgcaggaaaatcgccatagccagaggtccatttcaggctttccagcatgggcctctccttcaccaagctcttccaacgcctcttcgccaagaaggagatgcgcatccttatggtcggtctcgatgcagccggtaaaaccaccattctctacaagctcaagctcggcgagattgtcaccaccattccaactataggatttaatgtggaaacagtggaatataagaacatcagctttacagtgtgggatgttggaggtcaagacaagattcgcccgctatggaggcattactttcaaaacacacaagggcttatatttgtggttgatagtaacgatagagatcgtgtagtggaagcacgagatgaacttcataggatgctcaatgaggatgagcttagggatgccgtgctgcttgtttttgctaacaagcaggatcttccaaatgctatgaatgcagcggaaattacggataagttgggcttgcattctcttcgccagcgccactggtatattcagagcacatgtgctacctctggggaaggtctttacgaaggattagattggctctctaacaacattgcaagcaaggcttaaggctgtttctgttacactgtgaagctgaagaagactagaagagacgtatgattggatagtttatttcatttagagactgtttctggtctaaggtgaccaataaactgtggtaatatgtttggtgcttgtttgacaattcttgtgcttgtgtttgggcctctctttagagagcagtcgtgataagagccctttttgtagctggtttccgtacggtttt

SEQ ID NO: 13004 - DNA, 825 bp, Pteridium aquilinum
aaggacagctcctctgatttcgagagggggagatcttcgcttctctgcttcgttcgattacgcgtaataaccgctcgcatttctctcagacgtgaaaaatggggctgtctttcacaaagctattcagccgtcttttcgccaagaaggagatgcgtatactgatggttgggcttgatgctgctggtaaaaccaccattctttacaagcttaagttgggagagattgtcactaccattcccaccattggtttcaatgttgagaccgtggaatacaagaacatcagctttactgtttgggatgttggtggccaggacaagatccgaccattgtggagacattacttccaaaacacacaaggacttatttttgtggttgatagcaatgatcgtgatcgtgtggttgaagctagagatgagttgcacaggatgttgaatgaggatgagttgagggatgctgtgctgctagtatttgccaacaagcaagatcttccaaatgctatgaatgctgctgagattactgacaagcttggccttcattctctccgccagcgccactggtatatccagagcacatgtgccacttccggtgaagggctgtatgagggactggactggctctcaaacaacattgcaaacaaggcatagatggcataagagagttgtctcactaatgctggccccttatggagttatggatgtctacccggtttaagtgttttggtttctcatgttctttgtttcttgcaaacattgccatttgttacttgtagtttaagaataatcgataaattttcagtttcacttatggtattatctcgatagctgc

SEQ ID NO: 13005 - DNA, 964 bp, Raphanus sativus
gggatttatttctgtgtccctttaaaaaaaaaaaaatcgtgaaggagcgttcgcaggccattggcatcagagagacagagagagcttagatctcgcgcggcgttggcttttcggtttgtgattaaaaaaaaaaaggaaggatgggggtatcattcgggaagctgttcagcaggctttttgccaagaaggagatgcgtattctcatggttggtctcgatgctgctggtaagaccaccatcctctacaagctcaaacttggtgagatcgtcactaccattcctaccattggtttcaatgttgagactgtggaatacaagaacattagctttaccgtctgggatgtcgggggtcaggacaagatccgtccattgtggaggcactacttccagaacacgcagggacttatctttgttgttgacagcaacgatcgtgaccgtgttgttgaagccagggacgagcttcacaggatgctcaacgaggatgaattgagggatgcagttctgcttgtttttgctaacaagcaagatcttcccaacgcaatgaacgctgctgagatcactgacaagcttggccttcactctctccgccagcgacactggtacattcagagcacatgtgccacctctggagaaggactctacgagggacttgactggctctccaacaacattgcaaacaaggcgtagaaagccggtagcaggactcatctttgcttgttttgttttatacaccactgttgaggggtctgtttctctagctctacaaaacgaaaccgagtttttattatgtcatacattcttcttctgtatgttgttcttcaacaattagtactttccttcaataaatcataagttctttcttttgcttttcgagtttttgttatgtcatacattcttcttctgtatgttgttcttcaacaattagtactttccttcaataaatcataagttctttcttttgctta

SEQ ID NO: 13006 - DNA, 933 bp, Salvia sclarea
ctagtggatccccgggctgcaggaattcggcacgaggctcgcgttgttctcaggcagctccacatttctctctctcgcgccagcaggaacacactttctctctctagcgcctccgccaaatctatcgttccaagagatcaaaagcaagaaagagaaatggggttgacattcacaaagctttttagccggctttttgccaagaaggagatgcgcatattgatggttggtcttgatgctgctggtaagaccaccatcctgtacaagctcaagctcggagagattgttactactattcctaccattggcttcaatgtggagactgtcgaatacaagaacatcagcttcaccgtttgggatgtcgggggtcaggacaagatccgcccattgtggaggcactacttccagaacactcagggtctcatattcgtggtagatagcaacgatagggaccgtgttgtggaggcaagggatgaattgcataggatgttgaacgaggatgagctgagagatgctgtattacttgtatttgcaaacaaacaagatcttcctaatgcaatgaacgctgctgaaatcactgacaagcttggcctacactcgctcaggcagcgccactggtacatccagagcacttgtgccacctccggtgaggggctctacgagggactcgactggctctccaacaacattgctaacaaggcttagagcttttctggagttgtttacgcgagagctaatactggacactgtcgaggttttatctagttttttcttaaccatatattgctttgaaacaatgttgttttttcatttatgtttaggaccttcgaaatgtcgctatatcagacaatggtttgttttatatgtcttcctacgtttgcttagttttgaatgtaatattcagactcacagactagggttttggattattatttg

SEQ ID NO: 13007 - DNA, 878 bp, Sarracenia psittacina
aggctttctattgtctctcgctctcgcccgctagatccctctgcaaaatctgcacgccgggatccacctcctgaaagaaaaatggggctgacattcaccaagcttttcagccggctttttgccaagaaagaaatgcgtatccttatggttggtcttgatgctgctggtaagacgaccattttgtacaagctcaagcttggtgagattgtcaccacaattcctaccatcggctttaacgttgaaactgttgagtacaaaaatatcagcttcaccgtgtgggatgtcggtggccaggacaagattcgcccactgtggaggcactatttccagaacacgcagggtctcatttttgtggtggatagcaacgacagagaccgtgttgttgaggccagggatgaattgcatcgcatgctgaatgaggatgagttgcgagatgcagtgttacttgtctttgctaacaaacaagatcttccaaatgcaatgaatgctgctgaaattactgacaagcttggcctccactctctccgacagcgtcactggtacatccagagcacctgtgcaacgtctggagagggactgtatgaggggttggattggctctccaacaacattgctaacaaggcatgaggtaccgcagaacattcttgttgagtgatcctggatgcagggtggtttttatctagtctctttttccctgtttctttcttccatctgtcaaacaatgttgtgtggtcatgaattttatctccttaaaggcatttcacttttcatgtaggattttcgcaatggacatgtctcgtagattgttggcctggtttattatatgtgcttgaaaacaaacattctttaggtttgaatataatgctcattaagcgtac

SEQ ID NO: 13008 - DNA, 1441 bp, Glycine max
atgcattgcagggtgcaaatggtatttgatccaaaacgcgcatataaatcgggtacccccgttcttgtctctccctcctatataaaaccctttctttccattttgcgttattgtaaagcattcttcgcctttctctctcttctttttactctctctctgtctctctctacgctttctcgttcgagatccctcaagggatccactaactgaaggagaaatggggttgacattcaccaagcttttcagccggcttttcgccaagaaggaaatgcgaattctgatggtgggtctcgatgcagctggtaagaccaccatcctgtacaagctcaaacttggagagatcgttaccacaattcccaccattgggttcaatgtggagactgtggaatacaagaacattagtttcactgtctgggatgttggtggccaggacaagattcgtcccttgtggaggcactacttccaaaacacacagggtctcatttttgtggttgacagcaacgacagggacagagttgttgaggccagagatgagttgcacaggatgttgaatgaggatgaactgagagatgcagtattgctcgtatttgctaacaaacaagatcttcccaatgcaatgaatgctgctgaaattaccgacaagctgggtctccactctctcagacagcgccactggtacatccagagcacctgcgcaacctctggggagggtctttatgagggtttggactggctttccaacaacatagccaacaaggcttgatgctttttgggagtcttcttgtggattggtgattctggatgcaggggtgaatattatctagtttgtttttttggttctctcatgagacaaattggctttatgttaatgttttatggcttaggacatcttgatggctaaaattatagtaggaatttgtttcatgggatgtctaaatacttttgagttttttttttttttaattgagtttggattcaatgtttataactgtaattgataccaatcaatgcgccatcccattgagttatgattttattttgctaatattcctcatgattattattgcatgatacccaaaaaatgagaaatctttgaatatttgtagtgctcggtgatactgcaatattcatccttcgttgcatagtgcaactatgcaactagccaggccatttttatatttttcgacaatcatgttcctctgttgctccactataggataaaatcgaacaccatagaacagagtaatgtttcccagttgtcacgccaagcagaatttcaacaatggcgtagatctgtagttagcttcaatgggtgtaacttctatctcaccttttagggtaaagggttaaaggccttaataaggtcttcacatatgaagttgctcttcattttaactaagtttgtaatgggtgtatttttttctttgaaagctcaaaaacg

SEQ ID NO: 13009 - DNA, 1237 bp, Glycine max
aaacgagagaaatggaaaatctgaggatgtaagtcatgtagaagaaaaaagaaaagaaaagaagcgaatatcttagttaatagaaagttaacgagcgtaaagtggtaaaccgaaattataagtagagggaataaacgacgttatgacggggaaacacgaattttggatcttataaatccggcaaggcctgcctgcaggaaaatctcaatttcttttctctttgtcgcaaagagaagagatctgcctcctttttccttcccaaatcaaatctatctcttcttcaagttgaaaatggggctgtcgttcaccaagttgttcagccggctgtttgccaagaaagagatgcgtatactaatggtgggtctcgatgctgcgggtaagaccaccattctgtacaagctcaagcttggagagattgtcaccaccattcccaccattgggtttaatgtggaaactgtggaatacaagaacatcagcttcactgtctgggatgttggaggtcaggacaagatccgtcctttgtggagacattacttccaaaatacacaaggactcatttttgtggttgatagcaatgacagggaccgagttgttgaagctagagatgagttgcatagaatgttgaatgaggatgagttgagagatgccgtgcttctagtttttgccaacaagcaagatcttcctaatgctatgaatgctgcagagataactgataagcttggtcttcattccctccgtcagcgccactggtatatccagagcacatgtgccacatctggtgaagggctctatgaaggacttgactggctctcaaacaacattgcaaacaaggcgtagagatttgttagttaaacgcaaggaagttgagtttacttcggccattatgatctccagtctctaattttcttgccctacttagattttcattacttgagcatgtatttttcttgaaaaagaacagcggtttgttactgaagaacaatttgaattttttttccatgtataaccaaatagcattgtttactatttgatttgttaagtcaattgaattatataaagcctcgtattatgtctatgattcttgccacaatttgtattcgactgtgtcccggcaaattgaagggaagacatggtttttattttggaacccatctctctttcctttgaaggaaagatattatactatgtaaaatcaaattctaaagcatattaaatttaaattattattatggagcca

SEQ ID NO: 13010 - DNA, 760 bp, Euphorbia esula
atctcccgcctctcgatcgctcgatcgatcctcgctcgattgaattttcatttccatctcagatccctctccagaaagggatcaacagctaaggatcagatatggggttgacattcacgaaactgtttagccggctgtttgccaagaaggaaatgcgaattcttatggtaggtctcgatgctgctggtaagactacaatcttgtataagctcaagctcggagagatcgtcaccaccattcccactatcggttttaatgtggaaactgttgaatacaaaaacatcagtttcactgtatgggatgtcgggggtcaggacaagattcgtcccttgtggaggcactacttccaaaacactcagggtctcatttttgtggtggatagcaatgacagagaccgtgttgttgaagctagggatgagttgcacaggatgttgaatgaggatgagcttcgagatgcagtgctgctagtatttgctaacaaacaggatcttcccaatgcaatgaatgctgctgagattactgacaagcttgggttgcactctcttcgccagcgccactggtacatccagagcacttgtgcaacctctggtgagggtctctacgagggtttggactggctctcaaataacattgctaacaaggcataagtcaaatgatggaatgaatattttctgggttggcaattctggatgcagggtgaatattatctagtgttttacttttttggtttttgttttttttttgagagaaattgattgtg

SEQ ID NO: 13011 - DNA, 865 bp, Thalictrum flavum
ctctctctctctcgatctaaaattttcaagctttcttaagtgaacaagaaagatggggctcacgttcacaaagcttttcagccgtctttttgcaaagaaagagatgcgtattctgatggttggtctcgatgcggctggtaagactaccatcctgtacaagctcaagcttggcgagattgtgacaacaattccaaccattggttttaatgtggaaacggtggaatacaaaaacatcagcttcacggtctgggatgttgggggtcaggacaagatccgtccactgtggaggcactatttccaaaacacacaaggtctcatatttgttgtggatagcaatgacagagacagagttgttgaggcaagagatgaattacacagaatgttgaatgaggatgaattgcgtgatgctgtgctgcttgtgtttgctaacaaacaagatcttccaaatgcaatgaatgctgcagagattactgataagctcggccttcattctctccgtcagcgccactggtacatccagagcacttgtgctacctctggagaaggtctttacgagggtttggactggctatctaacaacattgctaacaaggcctgaggcagtaagcaatagctgctgatgtatcttctgcagtaaaacttgttaatgtggccagtggtttgccctttgtggtgcaacttaagaattgttttttttttaaaatcctatagaacattttggtgacaatattgtaatagaggattttttttcctttggatatatttacgagttcagctacaccttgattgttggtttggatttgttgtactgctctagctgtaaccaggatctatgcccctatcttcaatatacttgatctgtttc

SEQ ID NO: 13012 - DNA, 921 bp, Tragopogon dubius
actcaaaccccttcaagcaataactactacgcctactctctctgcatcctccccttcctatccatcccaaatttcttcggtgatcgccggccggctctctaatccttaagatctccgtcccatcatacaaagatggggttgtctttcaccaagcttttcagtcggctttttgccaagaaagagatgcgaattctgatggtcggtctcgatgcagctggtaaaaccaccattttgtacaagctcaagttgggagagattgtaaccactattcctaccatcggatttaatgtggaaactgttgagtacaagaacatcagctttaccgtgtgggatgttggtggtcaggacaagattcgacctttgtggaggcactactttcaaaacacacaagggctaatctttgtggttgatagcaatgatcgtgatcgtgtggtggaggctagagatgaactacacaggatgcttaatgaggatgagttaagagatgcagttttgcttgtgtttgccaacaaacaagatcttccaaacgcgatgaatgctgctgagattactgataagcttgggttgcattctctccgacaacgacactggtacattcagagcacatgtgccacatctggtgaaggtctgtatgaaggtctggattggctttccaacaacattgctaacaaggcttaaagggatgtggatcatcatcatcctcattatcttactgcaactattgttagtgtttgtttctaaatcttttaagttgtgggtgttatatgtaaacctaacttgttggcagagagaaaacgacagtctggacgctttttacgtattttaaacattgagatgtcttatggataaacagtgtggtttactattttttttctccacaataaattaaataagtgttgcgaccaaaaaaaaaaaaaaaaa

SEQ ID NO: 13013 - DNA, 1049 bp, Trigonella foenum-graecum
tttcaaccaagggaatgaaataatcccggtgctaccctttcctttttcctctcataaaaatcgattctctgacaattttattgcccatattacgcgttgcagcaaagcttccttcatctctctctacgaacccgaagcttgcatctccaaaggtcggatcaaggaagtgaaggagaaatggggctgacattcacgaagctgttcagtcgtttgttcgcgaagaaggaaatgagaattctgatggttggtctcgatgcggctggtaagaccaccatcctctacaagctcaagcttggagagattgtcactactattcccaccattgggttcaatgtggagactgtggagtacaagaacattagcttcaccgtttgggatgttggaggccaggacaagattcgtcccttgtggaggcactacttccagaacactcagggtcttatatttgttgtagacagcaatgacagggatagagttgttgaggccagagatgagttacataggatgttgaatgaggatgaactgagagatgcagtattgcttgtctttgccaacaaacaagatcttccaaatgcaatgaatgctgcagaaatcactgacaagttgggtcttcactctctgagacagcgccactggtacatccagagcacctgtgcaacctctggggagggtctttatgaaggtttggactggctttccaacaacatagccaataaggcttaagcttatcgggggtattgtggattggtgattctggatgcaggggtgaatattatctagctttgcttttgagtctcgtggagcggtaattctggatgcagaggaaaatattatctagcttttatttcttggtcatcttctgaaacaacttgaatttgtgtttatgtattgtggtttaggatatcttggtccctaaaattgtagtagaaatttgtttcgtgggctttgtaatacttctgagctttctattgggtttcgatgcaatgcccataactgtagtggagatacaattaaatgtgcctcaagttctacttcatagttttattttg

SEQ ID NO: 13014 - DNA, 1102 bp, Triphysaria pusilla
ggttcttaccggcgattgcacgatggtgttgtcaggaaatcagtgacttcactgcctgttgaagtagacggcgctccctccgaggctgaaaaccttattggacccgcattcgaagtgggatgataaaggcagtgtcatcgagaattacaggtcgttcggcgtcgtttcgaatcccaatttcctcgccgtaagggcgcgtatagatcatatggtggagatcgatgctctccagatgtcgccggccggagatgatgccgtatcggagtttgagccgattgacagcggcagcgagctcgaagaagatggtataaacaacgatggggttgacttttaccaagcttttcagtcggctttttgccaagaaggagatgcgtattctgatggtaggtcttgatgcagctggtaagacgacaatcttgtacaagctcaagctaggagagattgtcactaccattcctactattggcttcaatgtggagactgttgagtacaagaacatcagcttcactgtttgggatgttgggggtcaagacaagatccgtccattgtggaggcactactttcagaacacccagggtctcatattcgtggtggatagcaatgacagggaccgtgtcgttgaagccagggatgaattacataggatgttgaacgaggatgagctgagagatgcagtattacttgtgtttgcaaacaaacaagatcttcctaatgcgatgaatgctgctgaaataactgataagctcggcctgcactcactcaggcagcgccactggtacatccagagcacctgtgctacctccggtgaggggctctacgagggactggattggctctccaacaacattgctaacaaggcttaaagtgcccctcatggagctgatgcaaaatgcaggcgagtttttatctagtattacacctcttttctggcttatatatacataagaatttgttggcgttgtgcttttacgtttaggacctttgtattggctgtatagcagacaattgtttgtttcctatatttgcaatcatttgcttatttttttatactttttcttattgtaatacacagtgattaagactatggtgggtattgaatttt

SEQ ID NO: 13015 - DNA, 939 bp, Tripterygium wilfordii
cgttggtgctaagcttcctctcttttgcgcttcttctctctcgcaaattctctgagaagctcttgaaagaggcgccaatagtggttaggagaaatggggctgacatttactaagctcttcagccggctttttgccaagaaagagatgcgtattctgatggtgggtcttgatgctgctggtaagacaaccatattgtacaagctaaagcttggtgagatcgtcaccactatcccaactattgggttcaatgtggaaacggtggaatacaaaaacatcagtttcactgtgtgggatgttgggggtcaggacaagatccgtcccttgtggaggcactacttccaaaacacacagggtctcatttttgtcgtagacagcaatgacagagaccgagttgttgaggctagggatgaattgcacaggatgttgaatgaggatgagctgcgagatgcagttttgctcgtatttgccaacaaacaggatcttcctaatgcaatgaatgctgctgagatcactgataagcttggtctccactccctccgtcagcgtcactggtacatccagagcacttgtgcaacctctggggaggggctttacgagggtttggattggctctccaataacattgctaacaaggcgtaaatctattggagagagaattctggatggcaattctggatgcaggggtgaatattatctagtgttttctctctcttacatttttttatctcgtttctcattttgacacagttggattttgttatgtgctattttttcgatcctttatttagaagatggatttaatgtgtttttgtgcttatagttggtgtttgaatgcgaaattgctagcttaatcaacacctttggtgcgtcaatccttcttggactgatggattttctgtgttttttggcattgaacaagtttttacacctttggtgttt

SEQ ID NO: 13016 - DNA, 862 bp, Juglans hindsii x Juglans regia
tgatttctgaatctgaatctgaatctgaattcgatttagcgtgtgacgccagttcctctgtaggatccaactcttcccccccttcccttctctctcctcgttttcgtaaaagatacaaaaatggggcttactttcaccaagctcttcagccggctatttgccaagaaagagatgcgtattcttatggttggtctggatgctgctggtaaaaccacaattctgtataagctcaagcttggggaaatcgttaccaccattcctaccattggatttaatgttgaaaccgtggaatataaaaatattagcttcacggtttgggatgttggtggtcaggataagattcgacctttatggagacactacttccaaaacacacagggacttatctttgtggttgatagcaatgaccgagaccgtgttgttgaggctagggatgagctacacagaatgttgaatgaggatgaattaagggatgccgtcttgctcgtgtttgcaaacaagcaagatcttcctaatgcaatgaatgctgctgagatcactgacaaactcggcctgcattctctccggcaacgccattggtatatccagagcacatgtgccacttccggagaaggattgtacgagggactggattggctctcaaacaacattgcgaacaaggcttagaggacggcaggcttggtctttacttttctatttttttcctacttttgtcgaaattgttgcggcaacaaaacaggggttcacttgctggtttaattattctgttatcctttaatatgtactctagaagttaaaattaatctgttggcgtttgctttgcacgatgcatggtaactaatcaaatattcaaattctggag

SEQ ID NO: 13017 - DNA, 1378 bp, Citrullus lanatus
caatctataacgtatatgcttcgttttctaatacgaattaggcttttcttttgattagtatcatgattattgttccgatctgcttctttggcgaatttttgtggtttatttttcaattggatgcatgaatttattggatgagcttcatatatggtcaatttcctggtcttaaggcgatctgaagttgcgatgtgatctaccttcagatcccttcgagtgagcgtgagggatgtgatttcgttaaattgacgatccacagctacttctttttttgcgttccatttgatcgtttggtacttcgaataatcttgatttctttgtttactattttgttgattttcatttccggcgtcgctattttctctcgatctttgtcgctatggttatcgatctcatattcgaaatcacgtaggggtttctaggtagagacggagaatggggcttacgttcacaaagcttttcagtcggctttttgcaaagaaggaaatgcgaattctgatggttggtcttgatgcagctggtaagacaactatcctctacaagctcaagcttggcgagatcgtcacaacaatccctaccatcgggtttaatgttgagactgtagagtacaaaaacatcagcttcacggtctgggatgttgggggtcaagacaagattcgtcccttgtggaggcactacttccagaacacacagggtctcatatttgttgttgatagcaatgacagagatcgagttgttgaggccagggatgaattgcataggatgttgaatgaggatgagctgcgagatgcagttcttcttgtgtttgctaacaaacaagatcttcctaatgcaatgaatgctgctgagatcaccgacaagcttggtctccactctctccgccagcgtcactggtacatccagagcacatgcgccacctctggagagggactttatgaggggttggattggctctccaacaacattgctaacaaggcataaggatatggaacatttgattctaagactcgcagttctggatgcagggtgaatattatctaattttttcatggggcaccttataaaagaggttttttttttttttttttttttttttttttttttttatttcttctttttttcttttttctgtttacgggagcttttagcaaactatttgtcattatactgtaatatcagaatggttagccttggttattgtgtttcgggctcttttttggggcccttactcgctgttcttttctttcgatttctagctcaaactagttgatgtatcattccatgttggatttgtctcataacccattcttttgttgctaccgtttgttttcttcgttgcatgagtaataagtaacaatgccgcctaaataagtgtcaa

SEQ ID NO: 13018 - DNA, 946 bp, Arabidopsis lyrata
cgtcgtcgtcgcgtttctcttaagcttctctctctctctctttcaaatttcgtcgagtctctctcgctctctccgtttcttcgcggtctcgctctcagatctctctcggttactttcttcgtagtgaagcaaaaatggggttgagtttcgccaagctgtttagccggctttttgccaagaaggagatgcgaattctgatggttggtcttgatgctgctggtaagacaactattttgtacaagctcaagctcggagagattgtcaccaccatccctactattggtttcaatgtggaaactgtggaatacaagaacatcagtttcaccgtgtgggatgtcgggggtcaggacaagatccgtcccttgtggagacactacttccagaacactcagggtcttatctttgtcgtggatagcaacgacagagacagagttgttgaggctagggatgaactccacaggatgctgaatgaggacgagctgcgtgatgctgtgttgcttgtgtttgccaacaagcaagatcttccaaatgcgatgaacgctgctgaaatcacagataagcttggccttcactccctccgtcagcgtcattggtacatccagagcacatgtgccacatcaggtgaagggctttatgaaggtctggactggctctccaacaacatcgccggcaaggcatgatgagggagaaatggcgttgcatcgagatgattctgtctactgtgttgggatttctctgtttggatgcaagagagattataaatattatctgaacctttttgctattgggtatgtgaatgtttctgattgattgtgcaagtagatttcttgtacttaaaattctactagaagaaccctttttaaatagttgtattgtacctggattaatatgattgattgttttgctttcttgtttttgcatttgcatattttcacgcctgcatttg

SEQ ID NO: 13019 - DNA, 1007 bp, Arabidopsis thaliana
tcatcgcgtttctcttaagcttctctcacatttctctttcaaatttcttcgagtctctctcgctctctccgtttcttcgcggtctctctctctcagatctctccgaaacattcttcgtagcttctgagatgttgaagatctgtatcagagagattatgatatctcgggacgtttgattctctgtttggatcggcctgatctcgttgaaatttgatgttttgaagcaaaatggggttgagtttcgccaagctgtttagcaggctttttgccaagaaggagatgcgaattctgatggttggtcttgatgctgctggtaagaccacaatcttgtacaagctcaagctcggagagattgtcaccaccatccctactattggtttcaatgtggaaactgtggaatacaagaacattagtttcaccgtgtgggatgtcgggggtcaggacaagatccgtcccttgtggagacactacttccagaacactcaaggtctaatctttgttgttgatagcaatgacagagacagagttgttgaggctcgagatgaactccacaggatgctgaatgaggacgagctgcgtgatgctgtgttgcttgtgtttgccaacaagcaagatcttccaaatgctatgaacgctgctgaaatcacagataagcttggccttcactccctccgtcagcgtcattggtatatccagagcacatgtgccacttcaggtgaagggctttatgaaggtctggactggctctccaacaacatcgctggcaaggcatgatgagggagaaattgcgttgcatcgagatgattctgtctgctgtgttgggatctctctctgtcttgatgcaagagagattataaatattatctgaacctttttgcttttttgggtatgtgaatgtttcttattgtgcaagtagatggtcttgtacctaaaaatttactagaagaacccttttaaatagctttcgtgtattgtgcctggattaatatgattgattgttttgcttt

SEQ ID NO: 13020 - DNA, 898 bp, Silene vulgaris
tgtccatcgcaggggttttcttacttagcctaggaaaatggggcttacattcaccaagttgtttagccgactgtttgcaaagaaggaaatgcgaattttgatggtgggtctcgatgcagctggtaagaccacaatcctctataagctcaagcttggcgagatcgtcaccactattcccaccattggattcaatgtggaaactgttgaatacaagaacatcagctttacagtctgggatgtcgggggccaggacaagatccgtccattgtggaggcactatttccaaaacacacaaggtctcattttcgtggtggacagtaatgatagggatcgtgttgttgaagctagggatgagttgcacaggatgttgaacgaggatgagttacgtgatgcagttttgctcgtctttgctaacaagcaggatcttcctaatgcaatgaatgctgctgaaatcactgacaagcttggcttgcactctctccgacagcgtcactggtatatccagagcacttgcgctacctctggagaaggtctgtatgaaggattggactggctctccaacaacattgcaaacaaggcttaagaattggagtttgtcgtggattagtgatcctggatgcagggatggagtttatctagttgcattcttttctttaatcatctttacttagagaactcagtttgcgcttgtgatttttgtggcgatggagttgagcttctgcgtacaacttctcatatggatatatgtcgcacaatagagaacgtggtcggtttatgctcccaagattctttgggttaccatttgtgtagtaatctagttgtatactttctcagtttcttgtgacttctgatagtgtttgcttataatagagagatcataatcacctaatcacaattt

SEQ ID NO: 13021 - DNA, 1079 bp, Ocimum basilicum
cccttccaaagttggttattagtctctcgcgttgttctcaggcagctccacatttctctctctcgcgctacgcggaaaccatagtttctctctctagcgcctcgccgaatctagcgttctcaggaatcaatagcaagaaagggaaatggggttgacattcacaaagctttttagccggctttttgccaagaaggagatgcgtattttgatggttggtcttgatgctgctggtaagaccaccatcttgtacaagctcaagcttggagagattgttacaaccattcctactattggcttcaatgtggagactgttgaatacaagaacatcagcttcactgtgtgggatgtcgggggtcaggacaagatccgcccattgtggaggcactacttccagaacacccagggtctcatattcgtggttgatagtaatgatagggaccgtgttgttgaggcgagggatgaattgcataggatgttgaatgaggatgagctgagagatgctgtattacttgtatttgcaaacaaacaagatcttcctaatgcaatgaacgcggccgaaatcactgataagcttggcctgcactcactcaggcagcgccactggtacatccagagtacttgtgccacatctggtgagggactctatgaggggctcgactggctctccaacaacattgctaacaaggcttaaggctttcgtggagttgtttacgcaagcttatactggaagcagtcgggtttttatctagttttctttaaccatattgctttgaaaacaatgttttttcatttatgtttaggacttttgaaatttcgccatatcagacaatggtttgttttatatgtttccctacatttgcttagttttgaatgtaatattcagattcggactagggtattggattttactttgtctgcccgtatgcttctttctctacctgtaaaactgcctgatctgaatccgttatgagttaaaattttgggtatgatctttttgttaatcgtaaaataattctagttaagtacattttgtgtgatttttatatttttagaatgaattgttgtatgtttttcaaaac

SEQ ID NO: 13022 - DNA, 724 bp, Cyclamen graecum
cccaatctctctctctagatcccacccacagttagggatcaattgacaaaaaacagagatggggctgacattcaccaagcttttcagtcggctgtttgccaagaaagaaatgcgtatcctcatggttggtctcgatgctgctggtaagaccacaattttgtacaagctcaagcttggagagatagtaaccacaattcccaccattggcttcaatgtcgagactgttgagtacaaaaacatcagcttcacagtgtgggatgtcgggggtcaggacaagattcgcccattgtggaggcactatttccagaacacacaaggtctcatatttgtggtggatagcaatgatagggatcgtgttgttgaggctagagatgagctgcatcgcatgctgaatgaggatgagctgcgtgatgcggtgctgctcgtgtttgctaacaaacaagatcttcccaatgctatgaatgctgctgaaataactgacaagctcggtctccactcactcagacaacgtcattggtacatccagagcacctgtgctacatcaggcgaggggctctacgagggtctggattggctctccaacaacattgctaacaaggcatgaaatagtttggaaaattcaaggggatgatcctgaatgtaagcccggttttacatcagcagattctttttccctttattttttcgccgtgtctatcagatggtgtgtggctgtgacttgcga

SEQ ID NO: 13023 - DNA, 772 bp, Arnica chamissonis
attcatactcatttctctctttagtttctctccatctctcccttcgaatcgatcgattgacccctcccgaacaaggttttctcagggatcctcactagcaagaggatggggctaactttcaccaaactcttcagccggctcttcgccaagaaggagatgcgtatattgatggtgggtctcgatgcagctggtaagacaaccattttgtataagctcaagctcggagagattgtgaccactattcctaccataggttttaatgtggagactgttgagtacaaaaacataagcttcacagtgtgggatgttgggggtcaggacaagatccgtccattgtggaggcactatttccagaacacccagggtcttatctttgtggtcgatagcaatgacagggacagagttgttgaggcaagagatgaattgcacaggatgctgaatgaagatgagttgagagatgcagttctccttgtgtttgctaacaagcaagatctccctaatgcaatgaatgctgctgagatcactgataagcttggtctccactctctccgacagcgccactggtacatccagagcacttgtgcaacctctggagagggactttatgaaggattggattggctttccaacaacatagcaaacaaggcatgaggaggcaacgattgaggcggatgttggcagtttgtggtactggttttgcaagttgttatatgaggggcaatttggttttaatacaatagattgtttgtttgtttggactgaaagtatgtgt

SEQ ID NO: 13024 - DNA, 747 bp, Cleome gynandra
gagatcccttcgcatcaatttcgaaaggatcaccagctgaaggaaaatggggctttcatttgcgaagcttttcagccggctttttgccaagaaggagatgcgcatccttatggtaggtcttgacgctgctggtaagactaccattttatacaagctcaagcttggtgagatcgtaaccaccattcccaccatcgggttcaatgtggagacggttgaatacaaaaacatcagcttcactgtttgggatgtcgggggtcaagacaagatccgtcctttgtggaggcactactttcaaaacacacaaggtttgatatttgtggtggatagcaatgacagagaccgtgtcgttgaagcaagggatgaacttcacaggatgttgaatgaggatgagctacgtgatgcagtactgcttgtgttcgccaacaagcaggatctgccaaacgcaatgaacgctgctgagataactgataaactcggcctccactctctgcggcagcgtcattggtacatacagagcacatgtgccacaaccggtgagggactgtacgagggtctcgactggctttccaacaacatcgctaacaaatcctgagggatacaaggatggagcagagatttgttttgagggatggaggaattttctgacgcaaagggtggagtattattattattgttatcccttttcgttttctttgttaagaggtaaaaaagaaaaagatattatgtttgctgctaaagaagtgttat

SEQ ID NO: 13025 - DNA, 942 bp, Lotus japonicus
ggatttcgcgttgtagggaagcagcattgttcgcctctctctctttcttctcgtacctctctctacgcgttctggttctagatccctcaagggatccacaagctgaaggagaaatggggctgacattcaccaagcttttcagtcggcttttcgccaagaaggaaatgcgaattctgatggttggtcttgatgccgctggtaagaccaccatcctttacaagctcaagcttggagagatcgttaccacaattcctaccatagggttcaatgtggagactgtggaatacaagaacattagcttcactgtttgggatgttgggggtcaggacaagattcgtcccttgtggaggcactacttccagaacacacagggtcttatattcgttgtagacagcaatgacagggaccgagttgttgaggccagagatgagttgcacaggatgttgaatgaggatgaactgagagatgcagtactacttgtatttgctaacaaacaagatcttcccaatgcaatgaatgctgctgaaattactgacaaactaggtctccactctctcagacagcgtcactggtacatccagagcacttgtgcaacctctggggaggggctttatgagggtttggactggctttccaacaacatagccaacaaggcctaatgctttttggagtcttgtggattggtgattctggatgcaggggtgaatattatctagtttgttttttggtctttttctgagacaaattggatttctgtccatgttttgtggcgtagaacctcttgatggctgaaattatagcaggaatttgtttcatgggatgtcagctactgtttttattgggtttggattcaatgtttataactgtattagatgccaattcaacgtaccatcttattgagtttattattgaatgataccaaaaaaggaactactttgtgtt

SEQ ID NO: 13026 - DNA, 899 bp, Lupinus angustifolius
tatcaacgcagagtacatggggacaaattgaaggaatatcagtttcttctttttcttccaaaccaaacaacaacagatctcagaatagttgaaaatgggtctatcattcacgaagctgttcagtcgtctatttgcgaagaaagagatgcgtatacttatggtaggtcttgatgctgctggtaagaccaccattctttataagcttaagcttggagaaattgtcactaccattcccaccattgggtttaatgtggaaactgtggaatacaagaacatcagcttcactgtctgggatgtgggtggccaggacaagattcgtcctttgtggaggcattacttccaaaatacacaaggacttatttttgtgattgatagcaatgacagagatcgtgttgttgaagctagagatgagctacacaggatgttgaatgaggatgagttaagagatgccgtgcttctagtttttgcaaacaaacaagatcttccaaatgccatgaatgctgctgaaataactgataagcttggtcttcattcacttcgtcagcgtcactggtatatccagagcacctgtgccacatctggtgaaggactttatgaaggacttgactggctttcaaacaacatagcaagcaaggcatagaaattattagttggtggcagaccttattagtgttatggattacatgaagttcagtctgagtttagtgattatgaattccgatgtttaatgtggggtgtaccctgtttagaattttatctactcttacatgtattagttttctcctgaaaaggaatagacatccactgcttaatttcgaaataatctccatgtataaccgaaaaaccacaatgagcattatttttacacattgatttgtccagtgacacaatttttaaag

SEQ ID NO: 13027 - DNA, 941 bp, Ambrosia trifida
tagcgggagttctcgtccctactatttcatttcttacattcactaacccctccttttcttctcttttctcctttttaaagctttttctcagggatcttgtccagcaacgatatggggctaacattcaccaaactctttagccggctcttcgccaagaaagagatgcgtattttgatggtgggtcttgatgcggctggtaagactaccattttgtacaagctcaagcttggtgagatcgtgacaactattcctactattgggtttaatgtggagactgtcgagtacaaaaacattagctttaccgtctgggacgttgggggtcaggacaagattcgtccactatggaggcactactttcaaaacacacaaggtcttatctttgtggttgatagcaatgacagggatagagttgttgaggcaagagatgagttacataggatgttgaacgaggacgagcttcgcgatgcagtcttgcttgtatttgccaacaaacaagatcttccaaatgcgatgaatgctgctgaaatcactgataagcttggcctccattccctccgacagcgccactggtacatccagagcacctgtgcaacctcaggagagggactctacgagggtctggattggctttctaataacatcgctaacaaggcttaagactgaatgtggatcttggatgtgagctgtgtgtgtctttattgttggtttagcagctttttgtggtagcaaaacgcgtcttataatatagtatccgggtttgggttgcattgcattgcaagtacttttcaaataggtttcctttgataaacctgaagttataatagaggttgagattttgactctatgcttttacctttcagtaaatcatttcatcttatcttgtggtttcctttctttttctatagtcgcctatgtatgtcaatttaataatcagaaaccag

SEQ ID NO: 13028 - DNA, 1235 bp, Malus domestica
atggcgggcactgattggacacacaatgtcacccgcaggcttagcgttgtaggggcattttcgtacttcaagccaattacgaaaaaaatagtcgagtttataaacccccagttgacaatcctcacccctacacattcacgcgttggttcaaagcttccgtctccttctctctctctctctccctcgatctccatcttcaagatccctctgcgaaagctcatcgaagggatccgtagccagaaatggggcttacattcacgaagcttttcagccggctttttgccaagaaggagatgcgaattctgatggtcggtcttgatgccgccggtaagaccaccatcctctacaagctcaagcttggtgagatcgtcacaaccattcccaccattgggtttaatgtggagactgtggagtacaagaacatcagcttcactgtctgggatgtcgggggtcaggacaagatccgaccattgtggaggcactacttccaaaacacacagggtcttatctttgttgtggacagcaatgacagagaccgtgttgttgaggcaagggatgaattgcataggatgttgaatgaggatgaactgcgtgatgctgtgttgctcgtatttgctaataaacaagatcttcccaatgcaatgaatgctgccgaaatcactgataagcttggcctgcactctctgagacagcgtcactggtacattcagagcacctgtgcaacctctggggagggtctatatgaggggctcgattggctctccaacaacattgctaacaaggcgtgatcgtattgaggagtcattttgtggaccggaaattctggatgcaggggtgaacattatcttgttctttttgttttttcttgagacaattgaattgttgttaaatcttgtatttcttctgggaattctcatttcgtgtaggaggaagacctttaatattatgttatgatagaaagaacgaatgagtgggagtgggagtggggttggtcaaatcaaatgtatacatttgagctcttggttggattttggatacagtttctgaattgtaattgctatgtctactgttgtgttgtgccttgctttgtttcttgccatgcaagaattccaagtgatgcaggtggaggtaccacgtcactcatccgtccaagacccaaaaacatcccactaggtccatctcctgtatttcaacctcacacaccccagttggatcccaacgcagcgggtctttaa

SEQ ID NO: 13029 - DNA, 718 bp, Persea americana
ggcacgctctctctctatctctgcttcttttctctccgctctttcttcgcccgaaacttgcaacctactcttctttttctccatctccaggcgccaatctcccgttttcaacgcttcagatatccgatcgcctctctctctctctctccaactggtttaattggaggagaaaatgggtcttacgttcacgaagctgttcagtcgcctctttgcgaagaaggagatgaggattcttatggtaggtctcgatgcggctggtaaaaccaccatcctttacaagctcaagctcggagagatcgtcaccactatccccactatcggcttcaacgtggaaactgtggaatataagaacatcagcttcactgtttgggatgttgggggtcaggataagatcagaccactatggaggcactatttccagaacacacagggcctcatttttgttgttgacagcaatgacagagaccgtgtggttgaagcaagggatgaacttcacaggatgctgaatgaggatgaactaagagatgcagtgttgcttgtttttgcaaacaagcaggacctcccaaatgctatgaatgcagcggaaattactgataaactgggtctccattccctgcgccagcgtcactggtatatccagagcacatgtgccacctctggagaaggattgtatgaagggcttgattggctctccaacaacattgccaacaaggcttga

SEQ ID NO: 13030 - DNA, 841 bp, Brassica juncea
gctctttactcgttcgaagaccattagcttgttctttggacgacccatcggcgacagtgaaagtctgagttcttcttcggcgtacctctttttctccgggatttgaaaaaaagatggggctatcattcgggaagctgttcagcagactgtttgcaaagaaagagatgcgtatcctcatggttggtctcgatgctgctggtaagaccaccatcctgtacaggctcaagcttggcgagatcgtcaccaccattccaaccattggtttcaatgtggagactgtggaatacaagaacatcagcttcaccgtctgggatgtcgggggtcaggacaagattcgtccattgtggaggcactacttccagaacacgcaagggctgatcttcgtggtggacagcaacgaccgtgaccgtgttgtggaagctagagacgagcttcacagaatgctcaacgaagatgagttgagagatgccgtgcttcttgtctttgctaacaagcaagatcttccaaacgccatgaacgccgctgagataactgacaaacttgggcttcactctctccgtcaacgacactggtacatacagagtacatgtgctacctcaggagaagggctctacgagggacttgactggctctccaacaacatcgcaaacaaggcttaggagagagcagtttgtgggtttggtctcatcgaagaatcttcgactctgttttgttctttcgtctcagactttttatcatttcacactttgttcttcgctccctaataactcttttaaagttgtttttcttctatactaaattctgaatattatgaaatgaacccacgtttcggcggattttc

SEQ ID NO: 13031 - DNA, 821 bp, Brassica juncea
gctctacagtagatccttctttggagcttcttcgaaagggataggtaaaggaagatggggcttaacttcacgaagctgttcagcaggctgtttgccaagaaagaaatgaggattttgatggtgggtcttgatgctgctggtaagaccactatcttgtacaagctcaagcttggcgaaattgtcaccaccatccccaccatcggattcaatgtggagactgttgagtacaagaacatcagcttcactgtctgggatgtggggggtcaggacaagattcgtcccctgtggaggcactacttccagaacactcaaggtcttatattcgtggttgatagcaacgacagggaccgagtggttgaggccagggatgagttacatcgcatgttgaacgaggatgaactgagggatgctgtccttcttgtgtttgcaaacaaacaagatcttcccaacgcaatgaatgctgcagaaataaccgacaagcttggccttcactctcttcgccagcgccattggtacattcaaagcacatgtgccacatctggggaaggtctttatgaaggccttgattggctctccaacaacatcgctaacaaggcatgatgaagctggtggaacacggttttgcaacttgaaagagaccaccattagtgattgtggagaagagaatgaagatgaaagaagtactgtgtgtgatgttgtttcaactgtccgttgatctctctgaccttatctgtgtagcctctaaaactcacctctactctttttacccgtttaatggagagggaaatcattgaagcatttaaagtactaaaaggtagtaa

SEQ ID NO: 13032 - DNA, 1102 bp, Brassica oleracea
tttgtgtatagaaatcacaaacttataataaaaaaccgtttaaacgcgtacaataatataagtagagaaagtaaaaaaaaaaaaaaaaaaaaaagaaaaaaggttgcgtcacacgatcctcctcttgctcgtacgaagaccatcatttgcctttggacgacccatcggcgacagtgaaagtctatatcttcttccgggtttgaaagaagaagatggggctgtctttcgggaagctgttcagcaagctgtttgcgaagaaagagatgcgtatcctcatggttggtctcgatgctgctggtaagaccaccatcctgtacaagctcaagcttggcgagatcgtcaccaccattccaaccattggtttcaatgtggagactgtggaatacaagaacatcagcttcaccgtctgggatgtcgggggtcaggacaagattcgtccattgtggaggcactacttccagaacacgcaagggctgatcttcgtggtggacagcaacgaccgtgaccgtgttgtggaagctagagacgagcttcacagaatgctcaacgaagatgagttgagagatgccgtgcttcttgtctttgctaacaagcaagatcttccaaacgccatgaacgccgctgagattactgacaaacttggccttcactctctccgtcaacgacactggtacatacagagtacatgtgctacctcaggagaagggctctacgagggacttgactggctctccaacaacatcgcaaacaaggcttaggagagcagtttgtcggtttggtctcgtcttcttcgactctgttttgttctttcgtctcagacttttatcatttcatactttgttcttcgctccctaataactcttttaaagttgtttttcttatatactaaattctgaatattatgaaatgaacccacgtttcggcggattttccaatatcttcacacatttattaaatttatttatataaaactaaactaaaacgggatctaaaataatcgtatacaaagcttaccaaacgagaaacgactaagctattacaacaaccaagtgacccacgttgcatttgtcttgatgggctttaatttttttttatctaatca

SEQ ID NO: 13033 - DNA, 791 bp, Brassica oleracea
atcgtgaaacgttctcgcaggccatttgcttagacgaaccatcggcatcagagagaggttagatctcgcgcggcgttgtttcttcgatggggctgtcatttgggaagctgttcagcaagctgtttgcgaagaaagagatgcggattctgatggtgggtctcgacgctgctggtaagaccaccatcctctacaagctcaagcttggtgagatcgtcacaaccattcccaccattggtttcaatgttgagactgttgaatacaagaacattagcttcaccgtctgggatgtcgggggtcaggacaagatccgtccattgtggaggcactacttccagaacacgcaggggcttatctttgttgtggacagcaacgatcgtgaccgtgttgttgaagccagggacgagcttcacaggatgctcaacgaggatgaactgagggatgcagttctgcttgtttttgctaacaagcaagatctacccaacgcaatgaatgctgctgagattactgacaagcttggccttcactctctccgccaacgtcactggtacattcagagcacatgtgccacctctggagaaggactctacgagggacttgactggctctccaacaacatcgcaaacaaggcgtagaagggagatagcgggattcatctttctttgcttgttttgttatatacatcagagtaaggggtctgtttctctagcactacaaaacgaaaccaagtttttattatgttatacattcttcttcgtctgttctttaaccattagtactttccttgaataaat

SEQ ID NO: 13034 - DNA, 743 bp, Brassica oleracea
cttgctctacagtaagatccttctttggagcttcttcgaaagggataggtaaaggaagatggggcttaacttcaccaagctgttcagcaggctgtttgccaagaaagaaatgaggattctgatggtgggtcttgatgctgctggtaagaccactatcttgtacaagctcaagcttggcgaaatcgtcaccaccatccccaccattggattcaatgtggagactgttgagtacaagaacatcagtttcactgtttgggatgtggggggtcaggacaagattcgtcccctgtggaggcactacttccagaacactcaaggtcttatattcgtggttgatagcaacgacagggaccgagttgtggaagctagggatgagttacatcgcatgttgaacgaggatgaactgagggatgctgtccttctcgtgtttgctaacaaacaagatcttcccaacgcaatgaatgctgcagaaataaccgacaagcttggccttcactctcttcgccagcgccactggtacattcaaagcacttgtgccacatctggggaaggtctttatgaaggccttgattggctctccaacaacatcgctaacaaggcatgatgaaactgctggaacacgtttttgcaacttgaaagagaccattagtgattgtggagaagagaatgaagaagaaacaagtattgtgtatgatgttgtttcaactgtccgttgatctctctgaccttatctgtgtagcctc

SEQ ID NO: 13035 - DNA, 862 bp, Brassica rapa
aagtagagaaaggtagcgtaacacacgatcctcctcttaatcgttcgaagaccatcggcgagctcttcttcggcgtagcctttcttcccccgggtttgaaagaagaagatggggctgtctttcgggaagctgttcagcaagctgtttgcgaagaaagagatgcgtatcctcatggttggtctcgatgctgctggtaagaccaccatcctgtacaagctcaagcttggcgagatcgtcaccaccattccaaccattggtttcaatgtggagactgtggaatacaagaacatcagcttcaccgtctgggatgtcgggggtcaggacaagattcgtccattgtggaggcactacttccagaacacgcaagggctgatcttcgtggtggacagcaacgaccgtgaccgtgttgtggaagctagagacgagcttcacagaatgctcaacgaagatgagttgagagatgccgtgcttcttgtctttgctaacaagcaagatcttccaaacgccatgaacgccgctgagattactgacaaacttggccttcactctctccgtcaacgacactggtacatacagagtacatgtgctacctcaggagaagggctctacgagggacttgactggctctccaacaacatcgcaaacaaggcttaggatagcagtttgtgggtttggtctcatcgaagaatcttcgactctgttttgttctttcgtctcagactttttatcatttcacactttgttcttcgctccctaataactcttttaaagttgtttttcttatatactaaattctgaatattatgaaatgaacccacgtttcggcggattttccaatatcttcacacatttattaaattta

SEQ ID NO: 13036 - DNA, 1439 bp, Brassica rapa
agattcgacgtatttttaacgctcagtgggttggattatatataagtcgagattagattatttttctctgtccgttaaaaaaaaaaaaaaaatcaaatcgtgaaacgttctcgcaggccatttgcgtagacgaaccatcggcatcagagagaggttagatctcgcgcggcgttgtttcttcgatggggctgtcatttgggaagctgttcagcaagctgtttgcgaagaaagagatgcggattctgatggttggtctcgacgctgctggtaagaccaccatcctctacaagctcaagcttggtgagatcgtcacaaccattcccaccattggtttcaatgttgagactgttgaatacaagaacattagctttaccgtctgggatgtcgggggtcaggacaagatccgtccattgtggaggcactacttccagaacacgcaggggcttatctttgttgtggacagcaacgatcgtgaccgtgttgttgaagccagggacgagcttcacaggatgctcaacgaggatgaactgagggatgccgttcttcttgtttttgctaacaagcaagatctacccaacgcaatgaatgctgctgagattactgacaagcttggccttcactctctccgccaacgtcactggtacattcagagcacatgtgccacctctggagaaggactctacgagggacttgactggctctccaacaacatcgcaaacaaggcgtagaaagaggaggttgcaggattcatctttgcttgttttgttatatacatcaaagtaaggggtctgtttctctagcactacaaaacgaaaccaagtttttattatgttatacattcttcttcgtctgttctttaaccattagtactttccttgaataaatcataagccttttctttttgcattttcttcctgaagtgagtacgttcttttcttttaatcagttttatccttgtatccagttccttctttgagcttcagagtaaacagatctttactgttcgataatcaatatcgttattaaaatttgaactaaatatacagcttacattacacaaaaaatcataaaaacacactcagaaattaagggaacaaaaaacacgcgtcaaccacaaatcacacatgaaaccagagagcgtgtggttgtcgtaacaacacaacaactcataatccacctgctgctccacaaaaaccgaatctacttcaccgacaattttgacattcaagcagcggacggtgcagtcacgtacttgacccgtccagcttcagtaagagcgttgatgaacggcttcagattcactagatccgactcagcttcagatttcttgtaatccaaggaaccgtccttgtagatgtcccaccacttgttcactaacattttgatgtcttctctctccatattcgcctccttccctgtgtatctccatggcttcgaac

SEQ ID NO: 13037 - DNA, 1396 bp, Brassica rapa
ggagagtcatttcctcttcgaaactcgcggcttgctctacagtaagatccttctttggagcttcttcgaaaggggataggtaaaggaagatggggcttaacttcacgaagctgttcagcaggctgtttgccaagaaagaaatgaggattttgatggtgggtcttgatgctgctggtaagaccactatcttgtacaagctcaagcttggcgaaatcgtcaccaccatccccaccattggattcaatgtggagactgttgagtacaagaacatcagcttcactgtctgggatgtggggggtcaggacaagattcgtcccctgtggaggcactacttccagaacactcaaggtcttatattcgtggttgatagcaacgacagggaccgagttgtggaagctagggatgagttacatcgcatgttgaacgaggatgaactgagggatgctgtccttctcgtgtttgctaacaaacaagatcttcccaacgcaatgaatgctgcagaaataaccgacaagcttggccttcactctcttcgccagcgccactggtacattcaaagcacttgtgccacatctggggaaggtctttatgaaggccttgattggctctccaacaacatcgctaacaaggcatgatgaaactgctggaacacgtttttgcaacttgaaagagaccattagtgattgtggagaagagaatgaagaagaaacaagtattgtgtatgatgttgtttcaactgtccgttgatctctctgaccttatctgtgtagcctctaaaactcacctctactctttttacccgtttaatggatttgtgttttaagttttttttatttttacaatttcgtttgtgtttccaaatatattgaagctgggtaagcaatagagatgttacgttttttatataaaccatatatttaagacagaagagtcgaaagattacacaccgaataatagaacttctgtttggatgttttagagaatgaaagacgaaggcattgaccacacaaatatatatcatgtgaatcgagtttctacaacaactagagacgcaccacatactagataattcaaaagagttctgtttatcctttttccctgtctctcagagacaaaagaacaccgcatggattgtcttgcttttggaatttagtcatcagctggatcttgtggactctcttcagcactgcgtttgattatgatgactgggcactctgcatgcttcacacaaaactcactaaccgttccaacaaataccctgtccatatagcaacaagtgtgagctgattacacaatagcctgaggtttcaaactctattaacatacttaatgcaagtacagggccctactcctcaacttctgtcaagcataagttagttaaagcatatgattatcg

SEQ ID NO: 13038 - DNA, 1092 bp, Phaseolus vulgaris
aagtaatgaattttttttattagagaatttgagaccatccaaacgccaaaacacaacaacaacatcagatcatttactaaacgctgccccgaaacatcaacacaacaacaaccaccacctcagatctcatctcaatttcctcaacacaactttctttgtcatatctccaaggcaagtccttcttttctctctcacatttttcattatcgttttaattctcaaacggtcaccttctcgatccgtgtagcaattaacggttccgcctccatctgcgacaatagttgaaaatggggctctcattcaccaagcttttcagtcggttgtttgcgaagaaggagatgcgtatacttatggtcggtctcgacgccgccggtaagaccaccattctctacaaactcaagctcggagagatcgtcaccaccattcccaccattgggtttaatgtggaaactgtggaatataagaacatcagcttcactgtctgggatgttggtggccaggacaagatccgtcctttgtggagacattacttccaaaatacccaaggtcttatatttgtggttgatagcaatgaccgagatcgtgttgtggaagcgagagacgagctgcacaggatgttgaatgaggatgagttgagagatgctgtgcttcttgtttttgcaaacaagcaagatcttccaaatgctatgaatgctgccgaaataactgataaacttggtcttcattctctccgtcagcgtcactggtatatccagagcacatgtgccacatctggtgaaggactttacgaaggacttgactggctctcaaacaacattgccaacaaggcatagtgatttatcatttgtggattgcttcaagtttggttgagtttatagcgattgtgacttccgatgtttgatgcggttaccttgtttagaatctttcatctgatctagcatgtattaatttgtctttgataaagaacaatatatttacaacctaatatcaaaataatttgcatttttttccagtatatccaaaagacactgttcttttcttacccattgtttttagaagtcaatttttcctatggtgcctggatactaccac

SEQ ID NO: 13039 - DNA, 1707 bp, Theobroma cacao
gatcgcacgcattttgtgaacaacagtgactgtgacgtggcgatgactgattggaacctaacggctatactttatggggggcaatttggttattttctgtgaaaggatcgggaaaagtttctggtgtggtacaccacgcggcccgctccttgcatccttcccactataaatcatccaaattggcatttctcaccccatgttccgcgttggtctcaagctttcatttctcgaaattctctctgactctcttcccccttttggttcaaaatcaaaatctctcgcgttttcctctcacagatccctctgcgattatctccaaagggatcaacagcgagggaagagaaatggggctgacattcacgaagcttttcagccggctttttgccaagaaagagatgcgaattttgatggtgggccttgatgcagctggtaagactaccatcttatacaagctcaagctaggagagattgtcaccacaattcctaccattgggtttaatgtggagactgtggaatataagaacatcagtttcactgtgtgggatgttggtggtcaggacaagattcgtcccttgtggaggcattacttccagaatacgcagggtctcatctttgtggttgacagcaacgacagagaccgtgttgttgaggctagggatgaattgcatagaatgttgaatgaggatgagctgcgagatgcagtcttgcttgtatttgcaaacaagcaggatcttccaaatgcaatgaatgctgcagaaattactgataagcttggcctccattcccttcgacagcgtcactggtacatccagagcacctgtgcaacctctggtgaggggctttatgagggtctggactggctttcaaacaacatagctaacaaggcctgaagccattgagaagatttttgcaatatgggaaaatctggatgcaggggtgaatattatctagtttctttttcttttcttttcttttttttataatatcgttctccttttcccccaattttcatctgagacagttggattgttgttatgcccttttttcttttggtgatgcgcattgtagttaggaccttaaggctatattgtaacaaaaaacagtcggttggatttacaccttttggatgcaatgtttctggctgtaatcaaatctcattgtgcatttttgcaattgatccatttacatttttgggtttttacgattcaaatttgcattttctgctttgacgctcacgttcacttgataccctcccgattcataggttaaaatgcttgtgcttatgatgtttctgtgatagagctttgtaatttcagtctcctgtcgttctttcaagatcgagatcgagtagaagctttttatatgaggtggtgccttccttaacctaaatgcaagaatgcgtgttttgtttggatcaattgaggctgatatggtggtgtgaatataagctcaaccattgccttttacaactaaaaccagcagagattggggaagctgttctctgcaagacagatttgcctattcctcaacagattgagagagactggattattgagaattacggcgccccgcctcccttgacctggttatctttccgcttagcttcattaggatcacgggcggagcctggcccccccaaatttaaaaatttttttgtatactatataaactttttaaatttttttataaattttcttaataaccccc

SEQ ID NO: 13040 - DNA, 1372 bp, Cannabis sativa
aaaaaataataacaaaagccacgacttaggtggcgcccttgcgatgacgtggcaatcactggttggaaaggtagtgtaagatgtcgcttagaacgtaagctgacttgggggtatttcggtaatttcattgggcataatgctcatacaatacctcacctggtagtattttttccgatataaaagcgctcaagttgacaattctttcttctcattccatttccatttattacgcgttggtctgaagcttgctttgttccttctctttctctctcttcgctttctctcactagatccctctgcgaaatctctacagagaagggatcaacagccaaaacaaatggggctgacattcaccaagcttttcagccggctttttgccaagaaagagatgcgaattctgatggttggtctcgatgcagctggtaagacaaccatcctctacaagctcaagctcggggagatcgtcaccactattcctacaattggtttcaatgtggagactgtggaatacaagaacattagcttcacagtttgggatgtggggggtcaagacaagatccgtcccttgtggaggcactacttccaaaacacacagggtctcatatttgtggtggacagcaatgacagagatcgtgttgttgaagcaagggatgaattacataggatgttgaatgaggatgagctgcgcgatgctgttcttcttgtttttgctaacaaacaggatcttccaaacgcaatgaatgcagctgagatcactgataagcttggtcttcattctctcaggcagcgccactggtacatccagagcacatgtgcaacctcaggagaaggattgtacgagggtctggattggctctccaacaacattgccaacaaggcataatccctatgtggagcctttttgtggacaatcaattctggatgcaggggtgaatattatctagttcttttttttctctttttttgtcgagacaattgaattgttgtgtctattgtcatttggtgacaatcatttaggattttgtttctaatggttatattgtaatagaagaagaatggtcggttggatatatgcccattgagcttttgtttggggtttaaatacaatgctgagttgtaatcaaaaactaattcgacttttaatttctttctgaattgtatctctgtctggctatatgttactatttcattttattcattcaaaaatgattttaatcagattaaaagcattttttttgtttgtgtaccctatgaaagtttacttttatttaaattagtctcaacaactttgatttcctttataaaccaaggttcaaaatggtgatgaggtaatgattttgtactagttttgaaaagggaaagcacactcgca

SEQ ID NO: 13041 - DNA, 825 bp, Brassica napus
gaagtagagaaaggtagcgtaacacacgatcctcctcttaatcgttcgaagaccatcggcgagctcttcttcggcgtagcctttcttcccccgggtttgaaagaagaagatggggctgtctttcgggaagctgttcagcaagctgtttgcgaagaaagagatgcgtatcctcatggttggtctcgatgctgctggtaagaccaccatcctgtacaagctcaagcttggcgagatcgtcaccaccattccaaccattggtttcaatgtggagactgtggaatacaagaacatcagcttcaccgtctgggatgtcgggggtcaggacaagattcgtccattgtggaggcactacttccagaacacgcaagggctgatcttcgtggtggacagcaacgaccgtgaccgtgttgtggaagctagagacgagcttcacagaatgctcaacgaagatgagttgagagatgccgtgcttcttgtctttgctaacaagcaagatcttccaaacgccatgaacgccgctgagattactgacaaacttggccttcactctctccgtcaacgacactggtacatacagagtacatgtgctacctcaggagaagggctctacgagggacttgactggctctccaacaacatcgcaaacaaggcttaggatagcagtttgtgggtttggtctcatcgaagaatcttcgactctgttttgttctttcgtctcagactttttatcatttcacactttgttcttcgctccctaataactcttttaaagttgtttttcttctatactaaattctgaatattatgaaatgaacccacgtttcg

SEQ ID NO: 13042 - DNA, 938 bp, Brassica napus
cgcgaaacgttggaaggcgaggagcatcggcatcagatctcgtgcggcggttgtttcttcggtctaacaatcgatcgatgattggaaattaatatcatcctgattcgatcaagttctgaggcaagattgatcaaattgcgtttttgtaatcatataataatctgttagtttagtttgaataaagaaaggagatggggctatcatttgggaagctgttcagcaagctgtttgcgaagaaagagatgcgtattctcatggttggtctcgatgctgctggtaagaccaccatcctctacaagctcaagcttggtgagatcgtcaccaccattcccaccattggtttcaatgttgaaactgtggagtacaagaacattagcttcaccgtctgggatgtcgggggtcaggacaagatccgtccgttgtggagacactacttccagaacacacagggtcttatcttcgtcgtggacagcaacgatcgtgaccgtgttgttgaagccagggacgagcttcacaggatgctcaacgaggatgaactgagggatgcagttctacttgtttttgctaacaagcaagatctccccaacgctatgaacgctgctgagattactgacaagcttggccttcactctctccgccaacgtcactggtacattcagagcacatgtgccacctctggagaaggactctacgagggacttgactggctctccaacaacattgctaacaaggcatagaaaggaggtagcaagattcctccctgcttgtttggtttgtttataaaatcaaggaaaggggtctgtttcgctagtactataaaaacgaaaccaagattttatcatcacatgttcttcttcttcttcttctcgcatctcaaactcaatatcatatcacattttgtactttcctttaataactcagctctatttactttcgga

SEQ ID NO: 13043 - DNA, 840 bp, Brassica napus
ggcttgctctacagtaagatccttctttggagcttcttcgaaagggataggtaaaggaagatggggcttaacttcacgaagctgttcagcaggctgtttgccaagaaagaaatgaggattttgatggtgggtcttgatgctgctggtaagaccactatcttgtacaagctcaagcttggcgaaatcgtcaccaccatccccaccattggattcaatgtggagactgttgagtacaagaacatcagtttcactgtttgggatgtggggggtcaggacaagatccgtcccctgtggaggcactacttccagaacactcaaggtcttatattcgtggttgatagcaacgacagggaccgagttgtggaggctagggatgagttacatcgcatgttgaacgaggatgaactgagggatgctgtccttctcgtgtttgctaacaaacaagatcttcccaacgcaatgaatgctgcagaaataaccgacaagcttggccttcactctcttcgccagcgccactggtacattcaaagcacttgtgccacatctggggaaggtctttatgaaggccttgattggctctccaacaacatcgctaacaaggcatgatgaaactgctggaacacgtttttgcaacttgaaagagaccattagtgattgtggagaagagaatgaagaagaaacaagtattgtgtatgatgttgtttcaactgtccgttgatctctctgaccttaactttgtagcctctaaaactcacctctactctttttacccgtttaatggatttgtgttttaagttttttatttttacaatttcgtttgtgtttccaaatacgtatatt

SEQ ID NO: 13044 - DNA, 896 bp, Daucus carota
aaacgctgtactgcctgcctgtatataaaatcaaaaaataaagctgtgtttggctgtgcgattttcttctgctcggatcttcaacctcatcatataaagatggggctctctttcaccaagcttttcagccgtctctttgctaagaaagaaatgcgcattctcatggttggtctcgatgctgctggtaaaaccacaattttgtacaagctcaagttaggtgaaattgtcaccactattccaacaattggctttaatgtggagactgttgaatacaagaacattagctttactgtgtgggatgttggtggtcaggacaagatccgtcctttatggaggcattatttccaaaacacacaagggcttatctttgtggtggacagtaacgatcgggaccgtgtggtggaggcaagagatgaactccacaggatgctgaatgaggatgaactgagagatgcagtgctcctagtgtttgctaacaagcaagatcttccaaatgctatgaatgcagctgagatcactgacaaactcggcttgcattcacttcgacagagacactggtacattcaaagcacctgtgctacatctggagagggcctatacgagggactggattggctttccaacaatatcgctaacaaggcttagggaatttcttgatggttttatcgggtacccaagtcaatctatcggctcactcgtcacctgggtgtcggtgttactgatattatagtttttaaaattacctattgtgggtgttgttctgatgatgtgagaatgtaaaatggtgatgtaatatgtcgtgctgatggtttacattcatgttgctaataatatacattgctacagagcaattagatgttggtttcctgtttcatctatgctggtttatatggggc

SEQ ID NO: 13045 - DNA, 1082 bp, Cenchrus ciliaris
ccgcaccgcaccgcagccacagagcctcgcgtcgcattcgttcgctcgcgtcgtcgctcccgacctgtgctccatcccacctccgcggatccgcgcgcacgcagatcgccaaagcccagcgttgcaagggcgaagggggtgagggagggagagggagctcgcgcggcggcggaggaaggcgttcgccaccgtctcgaggaagagatggggctctcgttcgggaagctgttcagccgcctcttcgccaagaaggagatgaggatcctcatggtcgggcttgatgccgccggtaagaccaccatcctctacaagctcaagctcggcgagatcgtcaccaccatccccaccatcggattcaacgttgaaactgttgagtacaagaacattagcttcactgtctgggatgtcgggggccaggacaagatcaggcccctgtggaggcactacttccagaacacgcagggtctcatttttgttgtggacagcaatgatagggagcgtgttgttgaggctagggatgagctccacaggatgctgaatgaggatgagctgcgtgatgctgtgctgcttgtatttgcaaacaaacaagatcttcctaatgctatgaatgctgctgaaattactgacaagcttggcctgcattccctgcgccagcggcactggtacatccagagcacttgtgctacatctggtgaagggttgtacgaggggcttgattggctttccaacaacatcgccaacaaggcttgaagctttttggcagggctccctggaagaggatgatgtctcaacaacatattgctgcctttttacatattataagattattatacaatctacaatagatagtgtgggtgtttgtgaacaaaaagaaaccccctctcttttgaggggcagtaccagatttggttgtgtttatgttttcggctcggtattgtcgcctgttctgttccataactgactgtcgatcatgtgtacctatatgttctcagatgtttggtaaattaaagttgacatgctttgccataggccagaccaatgatttgaccgatataagttgttaatttttgtttgttatagat

SEQ ID NO: 13046 - DNA, 912 bp, Centaurea maculosa
cccatattctacaatccccccttcgttcccttttcgatcgatccctctccaaaaaaggctttttagcagggatcctcaccagcaataatatggggctaacattcaccaaactcttcagccggctctttgccaagaaagagatgcgcatactgatggtgggtctcgatgcggctggtaagacaaccattttgtacaagctcaagcttggtgagatcgtgacaacaatccctaccattgggtttaatgtggagactgtcgagtacaaaaacatcagcttcaccgtgtgggatgttggtggtcaagacaagattcgtccactatggaggcactacttccagaacacacagggtcttatctttgtggttgatagcaatgacagggatagagtcgttgaggcaagagatgagttgcataggatgttgaacgaggatgagcttcgtgatgcagtcttgcttgtatttgctaacaaacaagatcttccaaatgcaatgaacgctgctgaaatcactgataagctcggcctccattccctccgacagcgccactggtacatccagagcacctgtgcgacatctggagagggactttatgagggtttggattggctttctaacaacatcgctaacaaggcataagatggtaccggactgagtcttggatcaacttttccttccagtgtgggatttgttggtaaaagaaagagggtttttgtgcttttgttcttgtagtgatgttttgatataatattctggttgtattgcaagtactttttaaaacctaaagctgtaacagagattaattttggttgtttttattatatgttgtcttagattacaaaaagaaaatgaaataataagctttaatatatgttttacatcaataaaaggcttagaaccaaaagaagtacagaaa

SEQ ID NO: 13047 - DNA, 968 bp, Centaurea maculosa
cgcggggaccgatcccccttctcgatctgaattttttcgcccactggatcctctttcgagatcgatctgcgagagtgtccagtaaaaaagtaatttataaccatttgaagcaacaccaagatggggctgacttttaccaagttgtttagccggttatttgccaagaaagagatgcgaattctgatggtaggtcttgatgctgctggtaagactactatattatacaaattaaagctcggagaaatcgtgacgacaattccaactatcggattcaatgttgagactgttgaatataagaatatcagcttcactgtttgggatgttggtggccaagacaagattcgtcctttgtggaggcactacttccaaaacactcaggggcttatctttgtggtcgatagcaatgacagggatcgagttgttgaggcaagggatgaattgcataggatgttgaatgaggatgaactcagagatgctgttctgctggtgtttgctaacaaacaagatctgcctaatgccatgaatgctgcagaaattaccgataaacttggtcttcattcactccgtcaacgccactggtacattcagagcacatgtgcaacatctggcgaaggtctttatgaagggctcgattggctctccaacaacattgctaacaaggcgtaagaatacaacggttttggttgccgatggagggtagacatcatcacttgccattttattaaaaatatcggaatttatacatttttcttaccgatccttagaaacatattaaaactaatgtcttaattgttttacttttgttgttctttcggcttaaaaatatgactttagatggatattatgttgtatgtgtgaccgaaagttgattatgctcaaaacgaacgaattcgagttgttcttataagagattgatcgtgtgaaagatccatttggttcgatgatcgttaagatgaaaaagaacaatg

SEQ ID NO: 13048 - DNA, 843 bp, Chrysanthemum coronarium
acatttggtcgacggctccgatctcaaaatcacttttctctcaattttccggttgccggcgatcatacaacaaagatggggctgtcttttgggaagttgtttagccgattgtttgctaagaaggagatgcgtattctgatggttggtctcgatgcagctggtaaaaccaccattttgtacaagctcaagttgggagaaattgtcaccactatccctactattggattcaatgttgagactgttgaatacaaaaacatcagttttactgtgtgggatgttggaggtcaagacaagattcgtcctttgtggaggcactactttcagaacacacaaggtcttatctttgtggtcgacagcaatgatcgtgatcgtgttgttgaagccagagatgagctacacaggatgcttaatgaggatgaattaagagatgcagtgctgcttgtgtttgccaacaaacaagatcttccaaacgctatgaatgctgctgagatcactgacaagcttggcttgcaatctctccgacagcgacactggtatatccagagcacctgtgccacctctggggaaggtctatatgagggactggattggctttcaaacaacattgctaacaaggcttaaaagggactcatgcaagtgtggagtatattttataaagagcattgttagtattttatatctatctgttgataaggaataggtgatctccatcagctttcctagacaatatacattatcacatgtagaatttgtacgcttttattcctgtaatacagtattttgcaatatggagacaaaaacgtttacccttgagttgacctgagttatcgtggttttttaagt

SEQ ID NO: 13049 - DNA, 969 bp, Chrysanthemum coronarium
atatcgtccctttataaaatccatttttccactttgatcgcatccacatttggtcgacggctccgatctcaaaatcacttttctctcaattttccggttgccggcgatcatacaacaaagatggggctgtcttttgggaagttgtttagccgattgtttgctaagaaggagatgcgtattctgatggttggtctcgatgcagctggtaaaaccaccattttgtacaagctcaagttgggagaaattgtcaccactatccctactattggattcaatgttgaaactgttgaatacaaaaacatcagcttcactgtgtgggatgttgggggtcaagacaagattcgtcctttgtggaggcactacttccagaacacacaaggtcttatctttgtggttgacagcaatgatcgtgatcgtgtggttgaagcgagagatgagctacacaggatgcttaatgaggatgaactgagagatgcagtgttgcttgtttttgctaacaaacaagatcttccaaatgccatgaatgctgcggagatcactgacaagcttggcttgcaatctctccgacaacgacactggtatatccagagcacttgtgccacctctggggaaggtctgtatgagggactggattggctctcgaacaacattgctaacaaggcctaaaacggactcgcatgaacatggggcatacagcttatgacaaacattgttagcattttatctatatgtcgagaaggaatagtgttttccctcagatttctatacttttattacttgcagtatttgtatgcctttatttctgtaatactatcttttgcaatatgcaaaatgaaaacttttacccttgagttgactgagactttgttaacctagttattccagtcagttaacttgtattctctttccgtgaaacttgcgttcatgctttttgcatgcatgtagttgggacattgtgcgtttccagaa

SEQ ID NO: 13050 - DNA, 816 bp, Chrysanthemum coronarium
gatccacattttgctgatcgacggctccgatctcaaaaacttttcctcatttttccggttgccggcgatcatacgaagatggggctgtcttttggcaagttattcagtcgcttgtttgctaagaaggagatgcgtattctgatggttggtctcgacgcagctggtaaaactaccattttgtacaagctcaagttgggagaaattgtcaccactatccctactattggattcaatgttgaaactgttgaatacaaaaacatcagcttcactgtgtgggatgttgggggtcaagacaagattcgtcctttgtggaggcactacttccagaacacacaaggtcttatctttgtggttgacagcaatgatcgtgatcgtgtggttgaagcgagagatgagctacacaggatgcttaatgaggatgaactgagagacgcagtgttgcttgtttttgctaacaaacaagatcttccaaatgccatgaatgctgcggagatcactgacaagcttggcttgcaatctctccgacaacgacactggtatatccagagcacttgtgccacctctggggaaggtctgtatgagggactggattggctctcgaacaacattgctaacaaggcctaaaacggactcgcatgaacatggggcatacagcttatgacaaacattgttagcattttatctatatgtcgagaaggaatagtgtttttccctcagatttctatacttttattacttgcagtatttgtatgcctttatttctgtaatactatcttttgcaatatgcaaaatgaaaacttttacccttgagttgac

SEQ ID NO: 13051 - DNA, 892 bp, Cirsium arvense
ccctaaaaaaacccgctattcccatcgatctgaattttgcccactggattctctttccagatctgcgagagtgtccagtaaagaagtaatttatagccatctgaagcaacaccaagatggggctgactttcaccaagttgtttagccggttatttgccaagaaagagatgcgaattctaatggtaggtcttgatgctgccggtaagactactatattatacaaattaaagctcggagaaattgtgacgacaattcctaccattggattcaatgttgagactgttgaatataagaatatcagcttcactgtttgggatgttggtggtcaagacaagattcgtccgttgtggaggcactacttccaaaacacacaagggcttatctttgtggtggatagcaatgatagggatcgagttgttgaggcaagagatgaattgcataggatgttgaatgaggatgaacttagagatgctgttttgctggtgtttgctaacaaacaagatctgcctaatgccatgaatgctgcggaaattaccgacaaacttggtcttcattcactccgtcaacgccactggtacattcagagcacatgtgcaacgtctggcgaaggtctttatgaagggctcgattggctctccaacaacattgctaacaaggcgtaaaaatacaacggttttggttgccggtggagggtagacatcatcgcttgccgttttattaaaaatatcggaatttatacatttttttctaccgatccttagaaacatattaaaactaatgtcttaattgcttttcttttgttgttctttctgcttaaacatacgactttagatggatattatgttgtatgcgtgacggaaagttgattatgctcaaaacgaacgaattcgag

SEQ ID NO: 13052 - DNA, 902 bp, Citrus clementina
gacgccgtgaaaacagttaaacagctgtgtggagttggttctataaatactcgctgctttctagccgtgtgaaaattgaaggacagctcttatttttatagagagagagaggggcagtagatctgcaccaaggcaaaaaccgctctcttcctcagttgtgaaaaatggggctgtctttcaccaagcttttcagcaggctttttgctaagaaagagatgagaattctcatggtaggtctcgatgcagctggtaagactactatcctgtacaagcttaagctcggagagatcgtcaccaccattcctaccattggatttaatgtagagaccgttgagtataagaacatcagctttactgtctgggatgtcgggggtcaagacaagatccgacctttgtggagacattatttccaaaacacccaaggactcatctttgtggttgacagtaatgatcgcgaccgtgtggtagaagctagggatgagttgcacagaatgttgaatgaggatgaattgagagatgctgtgctgcttgtatttgctaacaagcaagatcttccaaatgcaatgaatgctgctgagataactgacaagcttggccttcactctcttcgccagcgccactggtatatccagagcacatgtgccacttctggtgaagggctgtatgagggacttgactggctctcaaacaacattgcaaacaaggcatagacaactaaattttgagttttgggttgccgcaactgctgaaatacagagttaacaacacatctcaagtgttcttgctttccttcctgtaatagcttcgttgcccgttttactgtgtttgttgtttcccttgcaaacgttgagatttgtttcttgtagcttcagaataattcttgaatgtttatctttcctcat

SEQ ID NO: 13053 - DNA, 928 bp, Trifolium pratense
ttgtttagcgttctataaatccgcaaaggtctgacggtgagagaagctccacttcttttcttttctctttgttacaattacatccgccttcatcttcttcttcttctccaagaaaacttgaaaatgggattgtctttcacgaaactgttcagtcggctatttgccaagaaagagatgcgtatacttatggtaggtctcgatgcggctggtaagaccacaattctttataagctcaagcttggagagatcgtcaccaccattcctacaatcgggttcaatgtggaaactgtggaatacaagaacattagtttcactgtgtgggatgttggaggtcaggacaagatccgtcctctgtggagacattacttccaaaatacacaagggcttatctttgtggttgatagcaatgatagggatcgtgttgttgaagctagagatgagctgcataggatgttgaatgaggatgaattgagagatgccgtgcttctagttttcgcaaacaagcaagatcttccaaatgctatgaatgctgctgagataactgataaacttggtcttcattctctccgtcagcgtcactggtacatccagagcacatgtgccacatctggtgagggactttatgaaggacttgactggctctcaaacaacattgcaaacaaggcatagagatttattagttaaagggtgcaagaagttgagcttactatagcgattatgatctccggagtctggttttcttgccctgcttagattttcattgctcgagcatgtattatttgtctttaaaagaactgcagtctattactgaagaataatttgattttttttccccatgtataaccaaatagcattgtttaatgtttacccttttgattgtgaagtcaattgaattatttaaagccgcaaaaaagaagaaagtaccgac

SEQ ID NO: 13054 - DNA, 856 bp, Gossypium hirsutum
ctcgtttctcaaatttctctctcattcgcttttcttccgtttggctcaaattcaaaattctctcgcggatccctctgcgattatctccaaagggatcaacaggtagagaagataaatggggctgtcattcgctaagcttttcagccggctttttgccaagaaggagatgcgaattttgatggtgggccttgatgcagccggtaagactaccattttgtacaagctcaagcttggagagattgtcaccactattcccaccatcggatttaatgtggaaactgttgaatataagaacatcagtttcactgtctgggatgttggtggtcaggacaagattcgtcctttgtggaggcattacttccaaaatacacagggtctcatcttcgtggttgacagcaatgacagagaccgtgttgttgaggccagggatgaattgcatagaatgttgaatgaggatgaactgcgagatgctgtgttgcttgtatttgcaaacaagcaggatcttccaaatgcaatgaatgctgctgaaataactgacaagcttggcctccattcccttcgacagcgtcactggtatatccagagtacatgtgcaacatctggtgaggggctttatgagggcctagattggctttccaacaacatagctaacaaggcctgaagctattaagaagatttttgcaatgtgggaagttctggaagcaggggggagcattatctcgtcttattattattatttttcaatcattctcctttccccctcatttttcatctgagacagtcggattgttgttatgcctttatttgcattttgtgatgatcattaatttagttgggaacttatggctaaattgta

SEQ ID NO: 13055 - DNA, 926 bp, Gossypium hirsutum
gagagaggaggagatcttcgcttctctccgtcgttctgctccatttgataaccgcttgcagttctctcagacgtgaaaaatggggttgtctttcacaaagctattcagccggcttttcgccaagaaggagatgcgtatactgatggttgggcttgatgctgctggtaaaaccaccattctttacaagcttaagttgggagagattgtcactaccattcctaccatcggtttcaatgttgagaccgtggaatacaagaacatcagcttcacggtttgggatgttggtggccaggacaagatccgaccattgtggagacattacttccaaaacacacaaggacttatttttgtggttgatagcaacgatcgtgatcgtgtggttgaagctagagatgagttgcacaggatgttgaatgaggatgagttgagggatgctgtcctgctagtatttgcaaacaagcaagatcttccaaatgctatgaatgctgctgagattactgacaagcttggccttcattctctccgccaacgccactggtacatccagagcacatgtgccacttctggtgaaggtctgtatgagggactggactggctttcgaacaacattgcaaacaaggcatagatggcatcattgagttgttagtctcaccaatgctggccccttttagagttccggatgttcatcccgttcaagtgtttttggtttttcgtgttcatttgtttcttgcaaacattgccatttgttacttgtagtttaacaataattaataaattgtttgtttcctttgtggtattatcccgatagctgaaaaaaaaacatccccgagtttcggcagttcttttcttggtggaaatttaaggatagcaagcttcttgaatgcttcttttaactcggcaataaatgagagcctttcttctttagt

SEQ ID NO: 13056 - DNA, 898 bp, Gossypium hirsutum
ggtctcaatctaagctctcgtttctcaaaattctctcattcgcttttcttccgtttggctcaaattcaaatttctctcgcggatccctctgcgattatctccaaagggatcaaaaggtagagaagataaatggggctgtcattcgccaagcttttcagccggctttttgccaagaaggagatgcgaattttgatggtgggccttgatgcagccggtaagactaccattttgtacaagctcaagcttggagagattgtcaccactattcccaccatcggatttaatgtggaaactgtcgaatataagaacatcagtttcactgtctgggatgttggtggtcaggacaagattcgtcctttgtggaggcattacttccaaaatacacagggtctcatcttcgtggttgacagcaatgacagagaccgtgttgttgaggccagggatgaattgcatagaatgttgaatgaagatgaactgcgagatgctgtgttgcttgtttttgcaaacaagcaggatcttccaaatgcaatgaatgctgctgaaataactgacaagcttggcctccattcccttcgacagcgtcactggtatatccagagtacgtgtgcaacatctggtgaggggctttatgagggcctagattggctttccaacaacatagctaacaaggcctgaagctattaagaagatttttgcaatgtgggaagttctggaagcaggggggagcattatatcgtcttattattattatttttcattctcctttccccctcatttttcatctgagacagtcggattgttgttatgcctttatttgcattttgtgatgatcattaatttagttgggaacttatggctatattgtaactaaaaaactggctggttggatatataatac

SEQ ID NO: 13057 - DNA, 1531 bp, Gossypium hirsutum
ggcacgagcatcaattagcaaagacaagagtaagatctgaaggagctctttgtcaaaaaacatgtagatgttttatttcaccttcttagcgtcaatttgaagaaggtacaaatccagcttgacgttggagaaaaaattctgcagtgtcggcttcactgcaataattgtaaccaaacacaaacatgattcactgtcatgtatcaagaaacgattagaaaataaagtactggagggagagagggagacctgatgaagggagctgaggtgaatgaaaccagaggatttgtctaagtcaccgccaaaaacagatccattcttttgcaatgcttcccattcctcagcagtgctaattctgtagacgaattcttccccttgacctgcggccattgtttacgctcagcaatagataattgtgataactgtgttgtagcgactaggcttaatagtattattaattagcttggacgtgtatccttatgggctttttatctaaatcaagctccgcagtccatatatataaataaaaggctcttaactccaggctttaccttctagcgttagttcgttcagcgccttcgattccaatagagatagagagagaggaggagatcttcgcttctctccgtcgttctgctccatttgataaccgcttgcagttctctcagacgtgaaaaatggggttgtctttcacaaagctattcagccggcttttcgccaagaaggagatgcgtatactgatggttgggcttgatgctgctggtaaaaccaccattctttacaagcttaagttgggagagattgtcactaccattcctaccatcggtttcaatgttgagaccgtggaatacaagaacatcagcttcacggtttgggatgttggtggccaggacaagatccgaccattgtggagacattacttccaaaacacacaaggacttatttttgtggttgatagcaacgatcgtgatcgtgtggttgaagctagagatgagttgcacaggatgttgaatgaggatgagttgagggatgctgtcctgctagtatttgcaaacaagcaagatcttccaaatgctatgaatgctgctgagattactgacaagcttggccttcattctctccgccaacggcactggtacatccagagcacatgtgccacttctggtgaaggcttgtatgagggactggactggctttcgaacaacattgcaaacaaggcatagatggcatcattgagttgtcagtctcaccaatgctggccccttttagagttccggatgtttatcccgttcaagtgtttttggttgttcgtggtcatttgtttcttgcaaacattgccatttgttacttatagtttaacaataattgataaattgcttgtttcctttgtggtattatcccgatagctgaaaaaaaaaaaaaacttccattaggcagttattttcttggttgggtaaagttttaaggtaagttaaggtcaagacttcttgtaatgcttcttttaacttcggtcaataatgagagaccttcttac

SEQ ID NO: 13058 - DNA, 996 bp, Gossypium hirsutum
ttctattatagctctacttcgtaagtctattctattacagttatccaaagttacccttagcgttgctatgaagccctttctttcaaaatcaaagtctgatgtggtcgtgcccaaagggatcaacaactagggaagagaaatggggctgactttcaccaagctttttagccggctttttgccaagaaggagatgcgaattttaatggtgggtcttgatgcagccggtaaaactaccatcttgtacaagctgaagcttggagagattgtcaccactattcccaccatcggatttaatgtggagactgttgaatataagaacatcagtttcaccgtgtgggatgttggtggtcaggacaagattcgtccattgtggaggcattacttccagaatacacagggtctcatctttgttgttgatagcaatgacagagatcgtgttgttgaggcgagggatgaattgcatagaatgctgaatgaggatgagctgcgagatgcagtgttgcttgtatttgcaaacaagcaagatcttccaaatgcaatgaatgctgctgaaataactgataagcttggcctccattcccttcgacaacgtcactggtacatccagagcacctgcgcaacctctggtgaggggctttatgagggtttggattggctttccaacaacatagctaacaaggcctaaagccattaagaggattattgcaatatggggaaattctggatgcaggagtgaatattgtttcaagtgtttttcctttttatatatagctgtaattattctttttctcatcatttttcatctgagacagttggcttcttgttgttatgcgtttttcttctgatgattagcattgtagtgtaggatcttatagctgcattggaactagaaactattgacttcgtttttaatatgctgcctatagagtttttaactccaccagtgagaaattaaggatgagataatttctcggaatataatttcatttggatgca

SEQ ID NO: 13059 - DNA, 876 bp, Vigna unguiculata
acttccattcttttctctttgttgcaaagagaagagatctgcctcctccttctttccagcatatctctcttccgctcaagaatcgttgaaaatggggctgtccttcaccaagttgttcagccggctgtttgccaagaaagagatgcgtatacttatggtcggtctcgatgctgcgggtaagaccaccattctgtacaagctcaagcttggagagattgtcaccaccattcccaccattgggtttaatgtggaaactgtggaatataagaacatcagcttcaccgtttgggatgttggaggccaggacaagatccgcccattgtggagacattacttccaaaatacccaaggacttatctttgtggttgatagtaatgacagggaccgagttgttgaagctagggatgagctgcatagaatgctgaatgaggatgagttgagagatgccgtgcttctggtttttgccaacaagcaagatcttccaaatgctatgaatgctgcagagatcactgataagcttggtcttcattccctccgccagcgtcactggtatatccagagcacatgcgccacatctggtgaagggctctatgaaggacttgactggctctcaaacaacattgcaaacaaggcatagagatttattagttgaaggatgcaaggaagttgagtttacttcggccatctctgcgtttatattttcttgtccttcttacattttcattgttcagccatgtattatttttcttcaaaaagaacagcggtctgttactgaggaataatttgaattttttttttccatgtaaccaaatagcattgtttacgatttgatttgtgaaatcaattgaatttatataaagcctcgtattatgcgta

SEQ ID NO: 13060 - DNA, 901 bp, Vigna unguiculata
caccaaatcatctactaaacgctctccgctcccaaacaccccacgcagatctcatcgcaagttccccaatacaacttcctctttctcatatctctaagaatagttgaaaatggggctctcgttcaccaagcttttcagtcgcttgtttgcgaagaaggagatgcgtatacttatggtcggtctcgacgccgccggtaagacaaccattctctacaaactcaagctcggagagatcgtcaccaccattcccaccattgggtttaatgtggaaactgtggaatataagaacatcagcttcactgtttgggatgtcggtggccaggacaagatccgtcctttgtggagacattacttccaaaatacccaaggtcttatatttgtggttgatagcaatgaccgagatcgtgttgtggaagctagagacgagctgcacaggatgttgaatgaggatgagttgagagatgctgtgcttcttgtttttgctaacaagcaagatcttccaaatgctatgaatgctgccgaaataactgacaaacttggtcttcattctctccgtcagcgccactggtatatccagagcacatgtgccacatctggtgaaggactttacgaaggacttgactggctctcaaacaacattgcaaacaaggcatagtgatcatcatttgtggattgcttggattttggttgagtttatagcgattgtgacttccgatgtttgatgcggttaccttgtttagaatcttttatctcatctagcatgtattatttgtctttgataaagaacaatatatttacaacctaatatcaaaataatttgaattcttttccgtgtataatcagaagacactgtttacccattgattttagaagtcaattttgcctatggtgcgttgatact

SEQ ID NO: 13061 - DNA, 906 bp, Taraxacum officinale
cggcgggggccccatatttccaagcccctctctctcgttcccttttcgatcgatccctctccaaagctcttctcagggatcctcaccagcaatagaatggggctaacattcaccaaactctttagccggctttttgccaagaaagagatgcgtatactgatggtgggtctcgatgcagctggtaagacaaccattttgtacaagctcaagcttggtgagatcgtgacaacaatccctaccattgggtttaatgtggagactgtcgagtacaaaaacatcagcttcactgtgtgggatgttgggggtcaggacaagattcgtccattatggaggcactacttccagaacactcaaggtcttatctttgtggttgatagcaatgacagagatagagttgttgaggcaagagatgagttgcataggatgttgaatgaggatgagctccgagatgcagtgttgcttgtatttgccaacaaacaagatcttccaaatgcaatgaatgctgctgaaatcactgataaacttggcctccattccctccgacagcgccactggtacatccagagcacttgtgcaacttcaggtgaaggactttacgagggtctggattggctttctaacaacattgctaacaaggcatgatgtgagaattgaatgcggaggtattctcattgtggttggtgactgaggtgggatttattggtgaaaggaacatgtttttgtggtagcagtgtgtctatctgtctgatataatatttgcttgtattgcaacttgttattcttgtctagattttgcttcataaacctaaacttgtaacagaggttaattttcttccttttatattatagtttgctactattcccatactttgcctagtatgtcatcaaataaaaaagtttttttgt

SEQ ID NO: 13062 - DNA, 894 bp, Taraxacum officinale
cgggggccctcttattttaagcctccctttctcgatttctctctcctcttctcaatctctctcacttcaaaacgatcgattgatccttctcgaacaacttttctcagggaccttcactagcaagcaaatggggctaacattcaccaaactttttagccggctctttgccaagaaagagatgcgaatattgatggtaggtctcgatgcagctggtaagaccaccattttatacaagctcaagctcggtgagattgtcaccaccattcccaccataggtttcaatgtggagactgtcgagtacaaaaacattagcttcacagtgtgggacgtcgggggtcaggacaagattcgtccactatggaggcattatttccagaacacacaaggtcttatctttgtggttgacagcaatgacagggacagagttgttgaggcaagagatgaattgcacaggatgttgaatgaggatgagttaagagatgcagttcttcttgtatttgctaacaaacaagatctcccaaatgcaatgaatgctgctgaaatcactgataagcttggcctccactcccttcgacagcgccactggtacatccagagcacttgtgcaacatctggagagggactttatgagggattggattggctctctaacaacatagcaaacaaggcgtgaggatcttggaagaagcgagtattggcgaatttcccagttttaaaaaagaaaaaaaaagtgttattgcttttgatataggagtgatgtgatgtggaattgaatttgaaagtatgtggtaggtttgattgatattctttgatatggagttgtaagaggtttttaagtttttgtatgtagtttgctgctctctctattttttgtcaaaactatatatgctaaat

SEQ ID NO: 13063 - DNA, 1103 bp, Solanum melongena
atagaatagggctgacattaaaatacgtaggctggatatttccgacatcaaaacaagaagagaacttccaaagcttccccatttccttgtcaattacaaagggcagtcttttctagatctactgccccctccatctctctccttctctttcattccttcttcatcactgcattgaaaaaagatgggtttatcattcgggaagcttttcagtcggctgtttgccaagaaggagatgcgtattctgatggttggtcttgatgcagctggtaaaaccaccatattgtacaagctcaagctgggagagattgttaccactattcctaccattggattcaatgtggagactgttgaatacaagaacattagcttcactgtctgggacgttgggggtcaggacaagatcagaccattgtggaggcattacttccaaaacacccaaggacttatctttgtggtcgatagtaatgatcgtgatcgtgttgttgaggctagagatgagctgcatcggatgttgaatgaggatgaactgagagatgctgtgctgcttgtgtttgctaacaagcaagatcttccaaatgctatgaatgctgcagagattactgacaagcttggtttgcactccctccgtcaacgtcactggtacattcagagcacatgtgctacctctggagaagggttgtatgaagggcttgactggctctcaaacaacattgcaaacaagggttgaacatgagatccatgatttttgcagctatgtttttgtcaatatagacttcaacaatatctagagcacttatgcacgtgctgatctttctttcccgagatagatccacttatcgctattatttttcagtacatttcccttgttttaaaagtatggtactttacagtaactttagttgaattgatgtaatattttgcaatctgggtttacatattctcaatgactcttgtttcgacattttgtttcaattaaagctcgagtttctctctaggtgcctgttggttttagttagtgctgcttttctgttcagctgatgagcaggtctttactatttttgttgtgctatctgttgacagctaaacaatattcagttggaact

SEQ ID NO: 13064 - DNA, 976 bp, Euonymus alatus
tcccactcgtcctgaacggtctaaaagaccccaacgttactcgaatctggccaaagctttaacgccgtcaaagtgtctgtctctcccggagtctccccgtctatataatcaacgtctccttcctctccttctcctcgttctccgtctcctgaggcaacttcacaagatctccccttctatctaccctgtctaagttgaaaagatggggctgtcttttgccaagcttttcagccggctttttgccaagaaagagatgcgaattctgatggtaggtcttgatgctgcgggtaagaccaccatcttgtacaagctcaagttgggagagattgtcaccacaattcctacaatcggattcaacgtggagaccgtggaatataaaaacataagcttcacagtttgggacgttggtggtcaggataagattcgtcccttgtggaggcactatttccaaaatactcaaggtcttatttttgtcgttgatagcaatgatcgtgatcgtgtagttgaggccagggatgaacttcatcgaatgttgaatgaggatgagttgagagatgctgtgctgcttgtatttgcaaacaaacaagatcttccaaatgctatgaatgctgcagaaattacggacaagcttggccttcattcactccgtcaacgccactggtatatacagagcacctgtgccacatctggtgagggactttacgagggactggattggctctccaacaatattgctaacaaggcatgattgaccttgtcaatttgactttctgggcagcaatctgctgcaaaatgtgattctactttaggatataggctatgtgctggtcttgattttcttcattttaaccctgtaattgtggtgcgagttgtatcttgtctttagatatcggtaccttctattattattattattattagttgggtgtttgtccttgtagatcttgtcatcttgaatagtagttgtttcatggtt

SEQ ID NO: 13065 - DNA, 821 bp, Euphorbia peplus
cgcatttttaattttcctcatttggtggtgaggaggtagatctcaatatttgctctggctcttctctcaggtgtgaaaagatggggctgtctttcaccaagttgttcagccggctctttgctaagaaagagatgcgtatactgatggtgggtcttgatgctgctggtaagaccaccatcctctacaagctcaagcttggagagattgtcaccactatccctaccattggttttaatgtggagaccgtggaatacaagaacattagcttcaccgtttgggatgttggtggccaagacaagattcgaccattgtggagacattacttccaaaacacacaaggtcttatctttgtggttgatagcaatgacagagaccgtgtggttgaagctagggatgagctacacagaatgttgaatgaggatgagttaagggatgcagttctgcttgtattcgcaaacaaacaagatcttccaaacgcaatgaatgctgctgaaataactgataagcttggtcttcactccctccgccaacgccactggtatatccagagcacatgtgccacttctggggaagggctgtacgagggactggactggctctctaacaatattgcaaacaaggcatagaagccgtaacccggagtcttggattgcgaaaaagtactcgaaatatacagttgatagtgctcctttgtttctgattttcgtcctttttttacagcctttagcggttctgcctgttttaactgtgtttgtcctttctcttgcaaacattgcaatttatttctgtagtttcagaataattcataaatttgcgttatt

SEQ ID NO: 13066 - DNA, 967 bp, Flaveria ramosissima
gggggttatataacctcacattcatcatcagttttctcgcccctttattcattttacacactccattttcctcaagatctctctcttccaatcgatcgtttgatcaatctccaacaagcttttctcagggatcctcactagcaagaggatggggctaactttcaccaaactcttcagccgtctctttgccaagaaagagatgcgcatattgatggtgggtctcgatgctgctggtaagacaaccattttgtacaagctcaagctcggcgagattgtgaccacgatccctaccataggttttaatgtggagactgttgagtacaagaacataagcttcactgtgtgggatgttgggggtcaggacaagatccgtccattatggaggcactacttccagaacacgcagggtcttatctttgtggttgatagcaatgatagggacagagttgttgaggcaagagatgaattgcacaggatgttgaatgaggatgagttaagagatgcagttctcctcgtgtttgctaacaaacaagatctccctaatgcaatgaatgctgctgaaatcactgataagctcggtctccactctctccgacagcgccactggtacatccagagcacatgtgcaacctctggagaggggctttacgagggattggattggctttcgaacaacatagcaaacaaggcatgaggcgaatgatccattatgtgggtggatgtttctgttgcgggttttgtaacttgtttgtttgaaaaaagtattttgcttatgaaatacaattgaatacattgtttggattgcaagtatgtgttaggtaggttgtcatctcaagttgtaagaggttaagtttttgtggtgattagaagttggattctcatgtagtttgttatcgtccatttgataaaaacatttatattctatcgggttctttgggttctcacaatgcaatctgctttgttgtga

SEQ ID NO: 13067 - DNA, 984 bp, Setaria italica
ccgcagccacagagcctcgcgtcgcatccgctcgctcgcgtcgtcgctcccgaccggtgctcccgcctccgccgatccgcgcgcacgcagatcgccgaagcccggcggcgcaggggtgagggagggagggagctcgcgcggcggtggaggaaggcgttcgccaccgtctcgaggaagagatggggctctcgttcgggaagctgttcagccgcctcttcgccaagaaggagatgaggatcctcatggtcgggcttgatgccgccggtaagaccaccatcctctacaagctcaagctcggcgagatcgtcaccaccatccccaccatcggattcaacgttgaaactgttgagtacaagaacattagcttcactgtttgggatgtcggtggccaggacaagatcaggcccctgtggaggcactacttccagaacacgcagggtctcatttttgttgtggacagcaatgatagggagcgtgttgttgaggctagggatgagctccacaggatgctgaatgaggatgagctgcgtgatgctgtgctgcttgtatttgcaaacaaacaagatcttcctaatgccatgaatgctgctgaaattactgacaagcttggcctgcattccctgcgtcagcggcactggtacatccagagcacttgtgctacatctggtgaagggttgtacgaggggcttgattggctttccaacaacatcgccaacaaggcttgaagctttttggcagggctcccaggaagaggaatatgcctgaacaacttattgctgcctttttacatgttataaagataatacaatctacgaatagatagtgtgggtgtttgtgaagaaaaagaaactcgctctcttttgaggggctagtaccagattcggttgtgtttttgtttttggcttggtattatcgcctgttcggttccacaaaactgactgaaacaatcatgtgtacctatacgttcagagatgtggtaattta

SEQ ID NO: 13068 - DNA, 785 bp, Fraxinus spp
acgacggggccgaaaaaattattaatctctcgcgctaatctcaggcagctcactcactgcctctctcatcagatccatctctcagggatcaaaagctagaaagagaaatggggctgacattcacaaagctgttcagccggctttttgccaagaaggaaatgcgtattctgatggttggtcttgatgctgctggtaagactaccatcctgtacaagcttaagctcggagagatcgtaactaccattcctaccataggttttaacgtggagactgttgagtacaaaaacatcagcttcacggtttgggatgttggaggtcaggacaagatccgtccattgtggaggcactacttccaaaacacccaggggctcatatttgtggtggacagcaatgacagggatcgagttgtggaggcaagggatgaattgcacaggatgttgaatgaggatgagctgagagatgctgtattacttgtatttgcgaacaaacaagatcttcccaatgcaatgaatgctgctgagataactgacaaactcggcctgcactcactgaggcagcgtcactggtacatccagagcacctgcgctacatcaggagaggggctttatgaaggtcttgagtggctctctaacaacattgctagcaaggcataaattgtgagttgatgcattgccggatgtgagctggatcttatctagtcttatacctatagtttgtgtgtttatgagttttatagctggatcttatctagtcttatacctatagtttgtgtatttaggagtttt

SEQ ID NO: 13069 - DNA, 1002 bp, Fraxinus spp
agcctttctctcgcgtaatatctcatctttcagatacgtatattacttgtttatgtatgcatctatattacatacgcgtatgaaaatttcatatctggagttagaattagatttcacaaattgcaaattatttaattacgatacagttgtgtgtgtatttgtctgaatttattgatctttcggtttgatatgcgtatttggatcgtacagataaaaaaacagaaatggggttatcatttaccaaacttttcagccggctgttcgctaagaaggaaatgcgaattcttatggtgggtcttgatgctgctggtaagaccaccatactttacaagctcaagctgggagaaattgttactaccattcctacaattggattcaatgtggagactgtggaatacaagaacatcagctttactgtctgggatgtcggtggtcaagataagattcgaccattgtggagacattactttcaaaacactcaaggactcatctttgtggttgatagcaatgatcgagatcgtgtagtcgaggctagggatgagctgcataggatgttgaatgaggatgaactgagggatgccgtgctgcttgtatttgcaaacaaacaagatcttccaaatgctatgaatgctgctgagataactgacaagcttggacttcactccctccgtcaacgtcattggtatatccagagcacatgtgcaacttcaggggaggggctttatgagggtctagactggctctccaacaacattgctaacaaggcctaaacaaggattttcttcaatgattttgatagccgaatccttgttgaagtggaaattctttcccgttctgagggctttgtatcaagttcatcttgctttactagagcaatctgttttctgtgcttaattttgtttttcatagagatcgcctttatcgtgaggtagatttgtatggacagtggactcctgtaattgctgcattcctgtttatgctataataccagcacgtttcttt

SEQ ID NO: 13070 - DNA, 849 bp, Fraxinus spp
aaaattattaatctctcgcgctaatctcaggcagttcactcactgcctctctcatcagatccatctctcagggatcaaaagctagaaagagaaatggggctgacattcacaaagctgttcagccggctttttgccaagaaggaaatgcgcattctgatggttggtcttgatgctgctggtaagactaccatcctgtacaagcttaagctcggagagatcgtaactaccattcctaccataggttttaacgtggagactgttgagtacaaaaacatcagcttcacggtttgggatgttggtggtcaggacaagatccgtccattgtggaggcactacttccaaaacacccaggggctcatatttgtggtggacagcaatgacagggatcgagttgtggaggcaagggatgaattgcacaggatgttgaatgaggatgagctgagagatgctgtattacttgtatttgcgaacaaacaagatcttcccaatgcaatgaatgccgctgagataactgacaaactcggcctgcactccctgaggcagcgtcactggtacatccagagcacctgtgctacatcaggagaggggctttacgaaggtcttgagtggctctctaacaacattgctagcaaggcataaattgtgagttgatgcattgccggatgtgagctggatcttatctagtcttatacctatagtttgtgtgtttatgagttttacttttcaagttcttttggttttcgtttaggacttcttgtgctatatcacagagctttgctttatatgattgcaaacatatgttttagttatataatggtattaaaactttgattaaaattgtttcttgac

SEQ ID NO: 13071 - DNA, 1149 bp, Panax ginseng
ctctccgaaggctcatatagtcatataggtttatcacatcttcaatttcaagttttagtttgctttcttctttgaggatcctcaatcagaaagaaaatgggattaagtttcaccaagctttttagcaggctattcgccaagaaagaaatgcggattctgatggtcggtcttgatgctgctggtaagaccactatattgtacaagctcaagctcggggagattgtgacaacaattcctactattggctttaatgttgagactgttgaatataaaaatatcagcttcactgtctgggatgttggtggtcaggacaagatccgtccattatggaggcactatttccaaaacacacagggtcttatatttgttgttgatagcaatgacagggaccgagttgttgaggctagggatgagttgcatagaatgttgaatgaggatgagttgcgagatgcagtgttactcgtatttgcaaacaaacaagatcttccgaatgcaatgaatgctgctgaaataactgataagcttggcctccactccctccggcagcgtcactggtacatacagagcacctgtgcaacctctggggaaggactttatgaggggttggattggctctccaacaacattgctaacaaagcatgagttgttgcagatggagtgattctggatgcagggatattttatccaagtctattttctttttctttccctcccctgccctagtattttcctcctataggcaatgtttgaccttgaattttaattaaagttgatctgcttttcgtttagaacctgtagtattgttgtccaattagaatggttttggtatagttactctgcaatcatttttgtagctttgggcgtaagagcaagctattttggtgttttgacactatttcgattcttttctcacattagttcgtatgggatgttccagtgaaaataatttagtggtgtactctaatattccggcttgtattgaaggcttattagcaaatgatgttgaagggacttggccgtccaaattaaccaaaaaaaaaaaaaaaaacaaaaaaaaaaaacaaaaaaaaaaacaaaaaaaataagtacgtaggagacaagacacacgaggagtagcaccaccaccaccccccccccccccccccaccc

SEQ ID NO: 13072 - DNA, 915 bp, Gossypium raimondii
tctcaatctaagctctcgtttctcaaatttctctctcattcgcttttcttccgtttggctcaaattcaaaattctctcgcggatccctctgcgattatctccaaagggatcaacaggtagagaagataaatggggctgtcattcgctaagcttttcagccggctttttgccaagaaggagatgcgaattttgatggtgggccttgatgcagccggtaagactaccattttgtacaagctcaagcttggagagattgtcaccactattcccaccatcggatttaatgtggaaactgttgaatataagaacatcagtttcactgtctgggatgttggtggtcaggacaagattcgtcctttgtggaggcattacttccaaaatacacagggtctcatcttcgtggttgacagcaatgacagagaccgtgttgttgaggccagggatgaattgcatagaatgttgaatgaggatgaactgcgagatgctgtgttgcttgtatttgcaaacaagcaggatcttccaaatgcaatgaatgctgctgaaataactgacaagcttggcctccattcccttcgacagcgtcactggtatatccagagtacatgtgcaacatctggtgaggggctttatgagggcctagattggctttccaacaacatagctaacaaggcctgaagctattaagaagatttttgcaatgtgggaagttctggaagcaggggggagcattatctcgtcttattattattatttttcatcattctcctttccccctcatttttcatctgagacagtcggattgttgttatgcctttatttgcattttgtgatgatcattaatttagttgggaacttatggctatattgtaactaaaaaactggctggttggatatataatacctttggataatttt

SEQ ID NO: 13073 - DNA, 969 bp, Gossypium raimondii
cgttagttcgttcagcgccttcgattccaatagagatagagagagagaggaggagatcttcgcttctctccgtcgttctgctccatttgataaccgcttgcagttctctcagacgtgaaaaatggggttgtctttcacaaagctattcagccggcttttcgccaagaaggagatgcgtatactgatggttgggcttgatgctgctggtaaaaccaccattctttacaagcttaagttgggagagattgtcactaccattcctaccatcggtttcaatgttgagaccgtggaatacaagaacatcagcttcacggtttgggatgttggtggccaggacaagatccgaccattgtggagacattacttccaaaacacacaaggacttatttttgtggttgatagcaacgatcgtgatcgtgtggttgaagctagagatgagttgcacaggatgttgaatgaggatgagttgagggatgctgtcctgctagtatttgcaaacaagcaagatcttccaaatgctatgaatgctgctgagattactgacaagcttggccttcattctctccgccaacgccactggtacatccagagcacatgtgccacttctggtgaaggtctgtatgagggactggactggctttcgaacaacattgcaaacaaggcatagatggcatcattgagttgtcagtctcaccaatgctggccccttttagagttccggatgttcatcccgttcaagtgtttttggtttttcgtgttcatttgtttcttgcaaacattgccatttgttacttgtagtttaacaataattgataaattgtttgtttcctttgaggtattagcccgatagctgaaaaaaaaaacatccccgagtttgggcagttcttttcttggtggaaatttaaggatagcaagcttcttgaatgcttcttttaactcggcaataaatgagagcctttcttctttagt

SEQ ID NO: 13074 - DNA, 1031 bp, Gossypium raimondii
accaaagcataattagcgttggtctcaagccctttctttcaaaatcaaagtctgatgtggtctctgcaattgtcttcaaaggtatagtaattcgattctctattttgatatttatttttgatctagcattccgataaatggatcaacaactagggaagagaaatggggctgactttcaccaagctttttagccggctttttgccaagaaggagatgcgaattttaatggtgggtcttgatgcagccggtaaaactaccatcttgtacaagctgaagcttggagagattgtcaccactattcccaccatcggatttaatgtggagactgttgaatataagaacatcagtttcaccgtgtgggatgttggtggtcaggacaagattcgtccattgtggaggcattacttccagaatacacagggtctcatctttgttgttgatagcaatgacagagatcgtgttgttgaggcgagggatgaattgcatagaatgctgaatgaggatgagctgcgagatgcagtgttgcttgtatttgcaaacaagcaagatcttccaaatgcaatgaatgctgctgaaataactgataagcttggcctccattcccttcgacaacgtcactggtacatccagagcacctgcgcaacctctggtgaggggctttatgagggtttggattggctttccaacaacatagctaacaaggcctaaagccattaagaggattattgcaatatggggaaattctggatgcaggagtgaatattgtttcaagtgtttttcctttttatatatagctgtaattatcctttttctcatcatttttcatctgagacagttggcttcttgttgttatgcgtttttcttctgatgatgagcattgtagtgtaggatcttatagctgcattggaactagaaactattgacttcgtttttaatatgctgcctatagagtttttaactccaccagtgagaaattaaggatgagataatttctcggaatataatttcatttggatgcaaatacttctgtt

SEQ ID NO: 13075 - DNA, 791 bp, Guizotia abyssinica
tctcagggatcctcgctagcaagaggatggggctaactttcaccaaactcttcagccggctctttgcgaagaaagagatgcgtatattgatggtgggtcttgatgctgctggtaagacaaccattttgtacaagctcaagcttggcgagattgtgaccactattcctaccataggttttaatgtggagactgttgagtacaaaaacattagcttcacagtgtgggatgtcgggggtcaggacaagattcgtccattgtggaggcactatttccagaacacccagggtcttatctttgtggtcgatagcaatgacagggacagagttgttgaggcaagagatgaattgcacaggatgttgaatgaagatgagttgagagatgcagttctccttgtgtttgctaacaaacaagatctcccaaatgcaatgaatgctgctgaaatcactgataagcttggtctccactctctccgacagcgccactggtacatccagagcacttgtgcaacctctggagagggactttatgaaggattggattggctttccaacaacatagcaaacaaggcatgagggaactattgagggctgagggtggaccttggcagtttgtggtactggtttgggagttgtttgaagggtaaattgcttttaatatacattgtttgtttgtttgtttggattggaaagtatgttaggttggttattattctttcatctgaagttaagtttttgtggtgggtagattatcatgtagtttgttggtatgctattatatgatatggtaaattc

SEQ ID NO: 13076 - DNA, 860 bp, Carpinus betulus
accctcatatgatatatttcgttggtttgaagcttcacctctcttttcctcagcgttcttagatccctctgcgaagctctccgaagggatcaacagccagaaaagagaaatggggctgacattcacgaaacttttcagccggcttttcgccaagaaagaaatgcgaattcttatggttggtcttgatgctgctggtaagactaccatcctctacaagctcaagcttggtgagatcgtcacaaccattcctaccattgggttcaatgtggagactgtggaatataagaacatcagctttaccgtctgggatgttgggggtcaggacaagatccgtcccttgtggaggcactactttcagaacacccagggtcttatatttgtggtggacagcaatgatagagaccgtgttgttgaggcaagggatgaattgcataggatgctgaacgaggacgaattgcgtgatgcagtgttgcttgtatttgctaacaaacaagatcttcctaatgcaatgaatgctgctgagattactgataagctcggcctccactctctccgccaacgccactggtacatccagagcacctgtgcaacctcaggagaggggctttatgaggggttggattggctctctaacaacattgcaaacaaggcgtgaagctcctggggagtcttttgtgcacggcaaattctggatgcaggggtgaatattatctagtttttttctttccgttcttttgaagacaatttgattgtggctatgccttttttttcccgggaaatgatcttttaattaggaacttttgtggcctataatttgtaacagaaaagtggtatgttggatatatatacttgaggttttt

SEQ ID NO: 13077 - DNA, 997 bp, Humulus lupulus
ccgttgaattcggtcttcggctacccctgtaccctcgttacgacgtaactctactggcgcttgaaagacagctcctttttcttcttcgtttatagagagaggaaatcaaggacaaaagacgatctccattgccacaaacctctctctatcttctctcttctcagaatggggctgtctttcaccaagctcttcagccggctttttgccaagaaagagatgcgtatacttatggtgggtctcgatgctgctggtaagacgactattttatacaagctcaagctcggcgagattgtcaccaccattccaaccatcggatttaacgtggagactgtggagtacaaaaacattagctttaccgtctgggatgttgggggccaagacaagatccgacctttgtggagacattatttccagaacacacagggattaatctttgttgttgatagcaatgacagagaccgtgtggttgaagccagggatgagttgcacagaatgttgaatgaggatgagctcagggatgcagtgctgctagtatttgcaaacaaacaagatcttcctaatgccatgaatgcagctgagattactgataagcttggtctccattcgcttcgtcaacgtcactggtatatccagagcacatgtgcaacctcaggtgaagggttgtacgagggacttgactggctttcaaacaacattgccaacaaggcttaggtggttgtttaattcgcaattttgtgttggctgaagaacaagaaaggatgatgatacagtttgttgtgtttgttattgttttagatttggtatgttgttaaattgttttgttgtaccgtgtttctgcgttctcttgcaaacgctgacgttttgttactaaatagtgttccacaataattcataaatttcctcctcgaaagattccttccattataataacattttacttggttgatatcttttaaactatagtttgaagagattaatagaagaaactcatcccatt

SEQ ID NO: 13078 - DNA, 949 bp, Humulus lupulus
ctggcgcttgaaagacagctcctttttcttcttcgtttatagagagaggaaatcaaggacaaaagacgatctccattgccacaaacctctctctatcttctctcttctcagaatggggctgtctttcaccaagctcttcagccggctttttgccaagaaagagatgcgtatacttatggtgggtctcgatgctgctggtaagacgactattttatacaagctcaagctcggcgagattgtcaccaccattccaaccatcggatttaacgtggagactgtggagtacaaaaacattagctttaccgtctgggatgttgggggccaagacaagatccgacctttgtggagacattatttccagaacacacagggattaatctttgttgttgatagcaatgacagagaccgtgtggttgaagccagggatgagttgcacagaatgttgaatgaggatgagctcagggatgcagtgctgctagtatttgcaaacaaacaagatcttcctaatgccatgaatgcagctgagattactgataagcttggtctccattcgcttcgtcaacgtcactggtatatccagagcacatgtgcaacctcaggtgaagggttgtacgagggacttgactggctttcaaacaacattgccaacaaggcttaggtggttgtttaattcgcaattttgtgttggctgaagaacaagaaaggatgatgatacagtttgttgtgtttgttattgttttagatttggtatgttgttaaattgttttgttgtaccgtgtttctgcgttctcttgcaaacgccgacgttttgttactaaatagtgttccacaataattcataaatttcctcctcgaaagattccttccattataataacattttacttggttgatatcttttaaactagtttgaagagattaatagaagaaactcaccccattcaattcg

SEQ ID NO: 13079 - DNA, 972 bp, Ipomoea batatas
ccggggactgcgagaccacataaccgcgagtcatcaaggacagggcagattgtcttctgctagatctgcttctctctccccttctcgcttttcaccctgtcacttcgtaagacatttagaatatggggttgtcctttacaaagcttttcagccggctctttgccaagaaggagatgcgtatccttatggtgggtctagatgcagctggtaagaccactatattgtataaacttaagctgggagagattgttactaccattcctactattggatttaatgtggagactgtggagtacaaaaacataagctttacagtgtgggatgttggtggccaggacaagattcgtccactatggagacactatttccagaatacacaggggcttatctttgttgttgacagtaatgatcgagatcgtgttgttgaggctagggatgagcttcaccgtatgctgaatgaggatgaattgagggatgctgtgttgcttgtgtttgcaaacaagcaagatcttcctaatgctatgaatgctgctgagattactgataagcttggtcttcactcactccgtcaacgtcactggtatatccagagtacttgtgccacatctggagaagggctttatgagggactggactggctctcaaacaacattgcaaacaaggcatagaaggtaaagtgagtgccattatctttttgaacatttatgtatatcttggttttactggccggatcaggttggctctaagtttgcgttttattctcctctaaattgttgtgaacaaacttgcgggtatgcactttttggttatttcatgtaatttctgctacttttaggttatttcatgtaatttctgctactctccatgaaatcttctttaaaataggccgttatcatggctaaattagttactttttctcactgccttgggatcttcaattgaaatttatcatttgagtgtttcgatttgtcg

SEQ ID NO: 13080 - DNA, 928 bp, Ipomoea nil
tcttctgctagatctgcttctctctcccctcctcgcttttcaccctgtcacttcctaagacatttaaaatatggggttgtcctttacaaagcttttcagccggctgtttgccaagaaggagatgcgtatccttatggtgggtctagatgcagctggtaagaccactatattgtataaacttaagctgggagagattgttactaccattcctactattgggtttaatgtggagactgtggagtacaaaaacataagctttacagtgtgggatgttggtggccaggacaagattcgtccactatggagacactatttccagaatacacaggggcttatctttgttgttgacagtaatgatcgagatcgtgttgttgaggctagggatgagcttcaccgtatgctgaatgaggatgaattgagggatgctgtgttgcttgtgtttgcaaacaagcaagatcttcctaatgctatgaatgctgctgagattactgataagcttggtcttcattcactccgtcaacgtcactggtatatccagagtacttgtgccacatctggagaagggctttatgagggactggactggctctcaaacaacattgcaaacaaggcatagaaggtaaagtgagtggcatcatctttttgaacatttatgtatatcttggttttactggccagatcaggttggctctaagtttgcattttattctcctctatattgttgtgaacaaacttgccgctatgcactttttggttatttcatgtaatttctgctactctccatggaattagttactttttctcaatgccctgggaccttcaaatgagatttatcatttgagcacatttcgatttgtcatattttactttaagccaattttcagtgacttccaattggcatgtttactgtctgtatatccatccatat

SEQ ID NO: 13081 - DNA, 930 bp, Actinidia deliciosa
taataacagagagaagacacttttcatcgcctcgaaaaccgcattcacctctctctctctctctctcttctctgcgcgctctctgatccttgttcgaagctttccatcggtgtcagttccaagtgataagccaatagcctgagcggaggagtagagatggggctcaccttcacaaagctgttcagcagacttttcgccaagaaagagatgcggattcttatggttggtcttgatgctgctggtaagactaccatcttgtacaaactcaagcttggagaaattgtcaccacaatccctaccatcggattcaacgtggagacggtggagtacaagaacattagtttcactgtttgggatgttggtggtcaggacaagattcgtccattgtggaggcactacttccagaatacacagggcctaatatttgtggtggatagcaatgacagggatcgggttgttgaggcaagggatgagttacataggatgttgaatgaggatgagttgagagatgctattctgcttgtgtttgctaacaaacaagatcttcctaatgcaatgaatgctgcggaaataactgacaagctcggccttcattcactccgacaacgtcactggtacatccagagcacatgtgcaacctctggagaagggctttatgaagggctcgattggctatctaacaacattgctagcaaggcttaaggccatcgcggattttgggggagcggttgggatttttgctgatgcattgttagatatcaagggttaccatatgaacttggccattcatggagacagaatatttgagtgtcgttataacaagattgtttgcttgatacattttctgaaactattgtttggtttgtacaactgttaacttttcttcgataatttaggtgcaatggtactgttatggtctaaaaaaaaaaa

SEQ ID NO: 13082 - DNA, 715 bp, Actinidia deliciosa
gcaatattccatacgcccacgaaaaccgcattcacctctctctcttctctgcgcgctctctgatccttgttcgaagctttccatcggtgtataagccaatagcctgagcggaggagtagagatggggctcaccttcacaaagctgttcagcaggctttttgccaagaaagagatgcggattcttatggttggtcttgatgctgctggtaagactaccatcttgtacaaactcaagcttggagaaattgtcaccacaatccctaccatcggattcaacgtggagacagtggagtacaagaacattagtttcactgtttgggatgttggtggtcaggacaagattcgtccattgtggaggcactacttccagaatacacagggcctaatatttgtggtggatagcaatgacagggatagggttgttgaggcaagggatgagttacataggatgttgaatgaggatgagttgagagatgctattctgcttgtgtttgctaacaaacaagatcttcctaatgcaatgaatgctgcggaaataactgacaagctcggccttcattcactccgacaacgtcactggtacatccagagcacatgtgcaacctctggagaagggctttatgaagggctcgattggctatctaacaacattgctagcaaggcttaaggccatcgcggattttgggggagcgggtgggatttttgctgatgcatt

SEQ ID NO: 13083 - DNA, 1141 bp, Actinidia deliciosa
ccatccaaaagtgaagtagaggattacccaaatcgggggataaaaactagaagacactggcaggacgcgtcggtaaaacgagcgattgaaaaccgtgtaattctcgcacgataaaatattatatttatattccatgagaaaagtaatcatttcacaatcctccgcctttgtttgttgagaaccggagaagaggatagagagaaacagagatctgtttcgctcttatctcccaattcgcttccttcctcagcttgtagacacaaagatggggctgtctttcaccaagctttttagtcgtctgtttgcgaagaaagagatgcgcatattgatggtgggtcttgatgcggctggtaagactaccattctttacaagctcaaactgggagagatagtcaccactattcctactattggatttaatgtggaaactgtggagtacaagaacattagctttactgtttgggatgtcggtggccaggacaagatccgacctttgtggagacattacttccaaaatactcagggtctgatcttcgtggttgatagcaatgaccgagatcgtgtggttgaagcaagggatgaacttcacagaatgttaaatgaggatgagttgagggatgctgtgctgttggtgtttgcaaacaagcaagatcttccaaatgcaatgaatgctgctgagataactgataagcttggccttcactccctccgccaacgccactggtacatccagagcacttgtgccacttctggggaagggctgtatgaaggacttgactggctctcaaacaacattgcaaataaggcatagacagacattggatgctcagtttgatttgctactgctgctgaatagagagttaacatttctttggtgttcctactttagcccttgttattccgttacctcctttactatttgaggcttctgttgatgatttttatagacttatagtttgtttcctgtagtttcaggtgtaattcataaatttttgttcttccccatttttgtcccattttctccatgtattaggatggatgcccaaacgagtgccctgctgttgttttgtctggtgatggttgcacaatttggtgtgacaatatgcattcaatacaagagttgctagagcacaggacaatt

SEQ ID NO: 13084 - DNA, 766 bp, Medicago truncatula
ctcttattctctttgttacaaggagaagagctcttcttcttctcaaatcatttctctcttcttcaagaaaacttgaaaaatgggattgtcattcacgaagctgtttagccggctatttgccaagaaagagatgcgtatacttatggtaggtctcgatgcagctggtaagaccactattctttataagctcaagcttggagagatcgttacaaccattcctacgatcgggttcaatgtggaaacagtggaatacaagaacatcagcttcactgtctgggatgttggaggtcaggacaagatccgtcctctgtggagacattacttccaaaatacacaaggactcatttttgtggttgatagcaatgacagggaccgtgttgttgaggctagagatgagctgcacaggatgttgaatgaggatgaattgagagatgcagtgcttctagtttttgctaacaaacaagatcttccaaatgctatgaatgctgctgagataactgataagcttggtcttcactctctccgtcagcgtcactggtacatccagagcacatgtgccacatctggtgaaggactttatgaaggacttgactggctctcaaacaacattgcaaacaaggcatagagatttattagttaaaggtgcaagaacttgagtttacttctgcgattaagatctccagcatctggttttcttgcctgcatagattttcattgctcgagtgtattatttgttttaaaaaagaactgcagtctattactgagg

SEQ ID NO: 13085 - DNA, 1006 bp, Pennisetum glaucum
cgctcggaccgcaccgcaccgctgccacagagcctcgcgtcgcgtcgtcgctcccgcctccgccgatccgtgcgcacgcagatcgccgaagcccggcggcgcaggggcgaaggggtgagggagggagggagcccgcgcggcggcggaggaaggcgttcgccaccgtctcgaggaagagatggggctctcgttcgggaagctgttcagccgcctcttcgccaagaaggagatgaggatcctcatggtcgggcttgatgccgccggtaagaccaccatcctctacaagctcaagctcggcgagatcgtcaccaccatccccaccatcggattcaatgttgaaactgtggagtacaagaacattagcttcactgtctgggatgttggtggccaggacaagatcaggcccctgtggaggcactacttccagaacacgcagggtctcatttttgttgtggacagcaatgatagggagcgtgttgttgaggctagggatgagctccacaggatgctgaatgaggatgagctgcgtgatgctgtgctgcttgtatttgcaaacaaacaagatcttcctaatgctatgaatgctgctgaaattactgacaagcttggcctgcattccctgcgccagcggcactggtacatccagagcacttgtgctacatctggtgaagggttgtacgaggggcttgattggctttccaacaacatcgccaacaaggcttgaagctttttggcagggctccctggaagaggatgatgtctcaacaacatattgctgcctttttacatattataagattattatacaatctacaatagatagtgtgggtgtttgtgaacaaaaagaaaccccctctcttttgaggggcagtaccagatttggttgtgtttatgttttcggctcggtattgtcgcctgttctgttccataactgactgtcgatcatgtgtacctatatgttctcagatgtttggtaaattaaagttgacatgctttgccataggcc

SEQ ID NO: 13086 - DNA, 966 bp, Nicotiana benthamiana
cgacaatcctcgaggcatccgctaaaagaagaacagaacatccatagctttcgcattttattgtcatttctaaagggcagagtcttttctagatctgcccctctttctcgctctctcctgattcgttgttcatcactgcattgagaaaagatgggtttatcatttgggaagctttttagtcggctgtttgccaagaaggagatgcgtattctgatggtcggtcttgatgcagctggtaaaaccaccatattgtacaagctcaagctgggagagattgttaccactatccctaccattggattcaatgtggagactgttgaatacaagaacataagcttcactgtctgggatgttggtggtcaggacaagatccgaccattgtggaggcattacttccaaaacacacaaggactgatctttgtggtcgatagtaatgatcgtgatcgtgttgttgaggctagagatgagctgcaccgaatgttgaatgaggatgaactgagggatgctgtgctgcttgtgtttgctaacaagcaagatcttccaaatgctatgaatgctgctgagattactgacaagcttggtcttcattctctccgtcaacgtcactggtacattcagagcacttgcgctacctctggagaagggttgtatgaggggcttgactggctctcaaacaacattgcaaacaagggttgaacgggggatccatgatttttgcagctatatttttgtcaatatagacttcaacaatgtttagagcacttatgtacttactgatctttctttcgcgagatagatctgcttatccatattgttatcagtacatttgcccttttcttttaaagaatggtactctgcagtaactttaggttaaattcatgtaatattttgccctttggctgacatatgctcaacgactttgccctcaacattttattttaattgagattaaggttctctccctgt

SEQ ID NO: 13087 - DNA, 1110 bp, Nicotiana benthamiana
gcggcacaattataaatgagtggtggtaaagaatctaaaaaatttctattactactatttgtcacccaaaaagtttaaaagaatccaattccacatctgacgagacttattaatttgaaaattcaaattgttaaatttaataggaacatccatagctttcgcattttattgtcatttctatctaaagggcagagtcttttctagatctgcccctctctctcgctctctccagattcgttgttcatcacagcattgaaaaaagatgggtttatcattcgggaagcttttcagtcggctgtttgccaagaaggagatgcgtattctgatggtcggtcttgatgcagctggtaaaaccaccatattgtacaagctcaagctgggagagatagttaccactattcctaccattggattcaatgtggagactgttgaatacaagaacataagcttcacggtctgggatgttggtggtcaggacaagatccgaccattgtggaggcattacttccaaaacacacaaggacttatctttgtggtcgatagtaatgatcgtgatcgtgttgttgaggctagagatgagctgcaccggatgttgaatgaggatgaactgagggatgctgtactgcttgtgtttgctaacaagcaagatcttccaaatgctatgaatgctgctgagattactgacaagcttggtcttcattctctccgtcaacgtcactggtacattcagagcacttgcgctacctctggagaagggttgtatgaggggcttgactggctctcaaacaacattgcaaacaagggttgaatgcgagatccatgatttttgcagctatgtttttgtcaatatagacttcaacaatgtctagagcacttatgtacttactgatctttctttcgcgggatagatctgcttatccctattgttatcagtacgtttgccctttcttttaaagaatggtactctgcagtaactttaggttaaattcatgtaatattttgcactttggctgacatatgttcagcgactttggcttcaacattttattttaattgagattaaggttctctcgccgtaatgatttggttgaagttggtgatgtttctctg

SEQ ID NO: 13088 - DNA, 1010 bp, Quercus alba
tagtatcagcccgggatcgatttataaaagcccaaacctttagttgacgatcttcaccactccccatttcacgcattcctgtaaagctcatttttttttctctctctctaagcgttttttttcactagatccctctgcgaagctctctctctctctctctacgaagggatccatagccaggaccagaaatggggctgacattcacgaagttgttcagccggctttttgccaagaaagaaatgcgaattctgatggttggtctcgatgctgctggtaagaccaccattctctacaagctcaagcttggcgagatcgtcacaaccattcccaccattggtttcaatgtggagactgtggaatacaagaacatcagctttactgtctgggatgtcgggggtcaggacaagatccgtcccttgtggaggcactactttcagaacacacagggtcttatatttgtggtggacagcaatgacagagaccgagttgttgaggcgagggatgaactgcataggatgttgaatgaggacgaactgcgagatgcagtgttgcttgtatttgctaacaaacaagatcttcccaatgcaatgaatgctgcggagattactgataagcttggcctccactctctccggcaacgtcactggtacatccagagcacctgtgcaacctcaggagaggggctttacgagggtttggaatggctctctagcaacattgcaaacaaggcataaagctcctggggagttgttttgtgcactggcaattctggatgcaggggtgaatattatctagttctttttaaagacagttggattgtggttatggctttttttattgcgggaatttctctttttattaggaactttgtggctatattgtaatagaaaaatgtcgtgggatatatatacttgagcttttggtcttggttgtatgcaattctcttagctgtaatcagaaccaatttgtttcaacattttaattggttttatacctatcatgttgattct

SEQ ID NO: 13089 - DNA, 951 bp, Quercus alba
actccccatttcacgcattcctgtaaagctcattttttttctctctctctaagcgttttttttcactagatccctctgcgaagctctctctctctctctctctacgaagggatccatagccaggaccagaaatggggctgacattcacgaagttgttcagccggctttttgccaagaaagaaatgcgaattctgatggttggtctcgatgctgctggtaagaccaccattctctacaagctcaagcttggcgagatcgtcacaaccattcccaccattggtttcaatgtggagactgtggaatacaagaacatcagctttactgtctgggatgtcgggggccaggacaagatccgtcccttgtggaggcactactttcagaacacacagggtcttatatttgtggtggacagcaatgacagagaccgagttgttgaggcgagggatgaactgcataggatgttgaatgaggacgaactgcgagatgcagtgttgcttgtatttgctaacaaacaagatcttcccaatgcaatgaatgctgcggagattactgataagcttggcctccactctctccggcaacgtcactggtacatccagagcacctgtgcaacctcaggagaggggctttacgagggtttggaatggctctctagcaacattgcaaacaaggcataaagctcctggggagttgttttgtgcactggcaattctggatgcaggggtgaatattatctagttctttttaaagacagttggattgtggttatggctttttttattgcgggaatttctctttttattaggaactttgtggctatattgtaatagaaaaatgtcgtgggatatatatacttgagcttttggtcttggttgtatgcaattctcttagctgtaatcagaaccaatttgtttcaacattttaattggttttatacctatcatgttgatt

SEQ ID NO: 13090 - DNA, 1008 bp, Quercus alba
gggaccactccccatttcacgcattcctgtaaagctctatttttttcttctctctctaagtcgtttttttctactagatccctctgcgaagctctctctctctctctacgaagggatccatagccaggaccagaaatggggctgacattcacgaagttgttcagccggctttttgccaagaaagaaatgcgaattctgatggttggtctcgatgctgctggtaagaccaccattctctacaagctcaagcttggcgagatcgtcacaaccattcccaccattggtttcaatgtggagactgtggaatacaagaacatcagctttactgtctgggatgtcgggggtcaggacaagatccgtcccttgtggaggcactactttcagaacacacagggtcttatatttgtggtggacagcaatgacagagaccgagttgttgaggcgagggatgaactgcataggatgttgaatgaggacgaactgcgagatgcagtgttgcttgtatttgctaacaaacaagatcttcccaatgcaatgaatgctgcggagattactgataagcttggcctccactctctccggcaacgtcactggtacatccagagcacctgtgcaacctcaggagaggggctttatgagggtttggaatggctctctagcaacattgcaaacaaggcataaagctcctggggagttgttttgtgcactggcaattctggatgcaggggtgaatattatctagttctttttaaagacagttggattgtggttatggctttttttattgcgggaatttctctttttattaggaactttgtggctatattgtaatagaaaaatgtcgtgggatatatatacttgagcttttggtcttggttgtatgcaattctcttagctgtaatcagaaccaatttgtttcaacattttaattggttttatacctatcatgttgattcttgaggtaaaaaaaaaaaaaaagttaattaatcgcgatctagtagagacacg

SEQ ID NO: 13091 - DNA, 1270 bp, Olea europaea
aatgccattggtacgctaacacgatatttaactgcaattaacaatcgaagcgactttggatttcccagggctgtgtgtgttcgaagaagatctgccgtctcccttcaatttagccttctcgcgcataaaaaatcgaaatggggttatcatttaccaaacttttcagccggctgttcgctaagaaggaaatgagaattcttatggtgggtcttgatgctgctggtaagaccaccatactttacaagctcaagctgggagaaatcgttactactattcctacaattggattcaatgtggaaacggtggaatacaagaatatcagctttactgtctgggatgtcggtggtcaagacaagattcgaccattgtggagacattactttcaaaacactcaaggacttatctttgtggttgatagtaatgatcgagatcgtgtagttgaggctagggacgagctgcataggatgttgaatgaggatgaattgagagatgcagtgctgcttgtatttgcaaacaaacaagatctgccgaatgcgatgaatgctgctgagataactgacaagcttggacttcactcgctccgtcaacgtcattggtatatccaaagcacatgtgcaacttccggggaggggctttacgagggtcttgactggctctccaacaacattgctaacaaggcctaaacaaggcattttcttcagtgcttttgatagccgaaagcttgttgaagaggaaattatttcccattataagggctttttattatgtacaccttgctttactagagcaatctgccttctcttaattttgtttctcgtagggactcgagattactgtgaagtagattcgaaaggccttatgtactttctgcattcctctaaagtttttacgctatattagcagcgtgtttattttgttcaatataattatacttttttgaagataaattttttgttcctttcttgcaaattgaaaaattcttcatggctgactactgtttaaattaaaaaacaaaggaaggaacttgtacctaaccttatccatgtactcagtatacctttctccaaaggtctctagcatcaaggcctctctaattttgccttttgcccataatacatagcacaaaccgcaatgataaatagtgtcactcattggtgctctgagtgcagtgaagtatagtaacaaacgaggagctaagttgttagacgctatacttaagttccgtgggttgggtaggaactagtggtgggttattggtctttagattacg

SEQ ID NO: 13092 - DNA, 878 bp, Olea europaea
taaaccgctccgtacaattttcatcctcctgaaaaggttattaatctctcgcgctaatctcaggcagctcactcactgcctctctcaccagatccatctctcagggatcaaaagctagaaaaagaaatggggctgacattcacaaagctattcagccgtctttttgccaagaaggaaatgcgcattctgatggttggtcttgatgctgctggtaagactacaatactgtacaagcttaagctcggagagatcgtaactactattcctaccattggttttaacgtggagactgttgagtacaagaacatcagcttcacggtttgggatgtcggtggtcaagacaagatccgtccattgtggaggcactacttccaaaacacccaggggctcatatttgtggtggacagcaatgacagggatcgtgttgtggaggcaagggatgaattgcacaggatgttgaatgaggatgagctgagagatgctgtattacttgtatttgcgaacaaacaagatcttcccaatgcaatgaatgcagctgagataactgacaagctcggcctgcactcactgaggcagcgtcactggtacatccagagcacttgtgctacatcaggagaggggctttatgagggtcttgactggctctctaacaacattgctaacaaggcataaattgtgagttgatgcattgccggatgcgagctggatcgtatctagtcttatacctatagtttgtgtgtttatgagttttacttttcgagtcttttcgtttttgtttaggactacttgtgctatatgacagagcttcgttttacatgattgcaaacatatgttgtagttatataatgctatgaaaaccttttgtgattttaattaaa

SEQ ID NO: 13093 - DNA, 902 bp, Citrus sinensis
gacgccgtgaaaacagttaaacagctgtgtggagttggttctataaatactcgctgctttctagccgtgtgaaaattgaaggacagctcgtatttttatagagagagagaggggcagtagatctgcaccaaggcaaaaaccgctctcttcctcagttgtgaaaaatggggctgtctttcaccaagcttttcagcaggctttttgctaagaaagagatgagaattctcatggtaggtctcgatgcagctggtaagactactatcctgtacaagcttaagctcggagagatcgtcaccaccattcctaccattggatttaatgtagagaccgttgagtataagaacatcagctttactgtctgggatgtcgggggtcaagacaagatccgacctttgtggagacattatttccaaaacacccaaggactcatctttgtggttgacagtaatgatcgcgaccgtgtggtagaagctagggatgagttgcacagaatgttgaatgaggatgaattgagagatgctgtgctgcttgtatttgctaacaagcaagatcttccaaatgcaatgaatgctgctgagataactgacaagcttggccttcactctcttcgccagcgccactggtatatccagagcacatgtgccacttctggtgaagggctgtatgagggacttgactggctctcaaacaacattgcaaacaaggcatagacaactaaattttgagttttgggttgccgcaactgctgaaatacagagttaacaacacatctcaagtgttcttgctttccttcctgtaatagcttcgttgcccgttttactgtgtttgttgtttcccttgcaaacgttgagatttgtttcttgtagcttcagaataattcttgaatgtttatctttcctcat

SEQ ID NO: 13094 - DNA, 654 bp, Parthenium argentatum
atggggctaacattcaccaaactctttagtcggctgtttgccaagaaagagatgcggatcttgatggtgggtcttgatgcagctggtaagacaaccattttgtacaagctcaagcttggtgagatcgtgacgacaattcctaccattgggtttaacgtggagactgtggagtacaaaaacatcagcttcactgtctgggatgtcgggggtcaggacaagatccgtccattgtggaggcactacttccagaacacacaaggtcttatctttgtggttgatagcaatgacagggatagagttgttgaggcaagagatgagttacataggatgttgaatgaggacgagcttcgagatgcagtcttgcttgtatttgctaacaaacaagatcttccaaatgcaatgaatgctgccgaaatcactgataagcttggcctccattcccttcgacaacgccactggtacatccagagcacctgcgcaacctcaggagagggactttatgagggtctggattggctttccaataacatcgctaacaaggcataagatgaaaccaaatcaaacctaatgtggatcttggatgctgggagcttttgctcaactttgtgtgtttgttaactggtagcaaatgtgtgtagctatatcatatttggg

SEQ ID NO: 13095 - DNA, 921 bp, Arachis hypogaea
aggaaatagcaaggggtagggtcctgtttctccatcctgcatctttgcaaaggcaccaaaatccaaacaaaagaacagatctcagctcagctcatacgaattgctctctttctcggctctccaagatgggtctgtcattcacgaagctattcagcaggctgttcgccaagaaggagatgcgtatacttatggtcggtctcgacgctgccggtaagaccaccattctctataagctcaagctcggagagatcgttaccaccattcccaccattgggtttaatgtggaaaccgtcgaatataagaacattagcttcactgtctgggatgttggtggccaggacaagatccgtcctttgtggagacattacttccaaaatacacaaggacttatttttgtggtagatagcaatgatcgtgatcgtgttgtcgaggctagggatgagctccataggatgttgaatgaggatgagttgagagatgctgtgcttctagtttttgcaaacaaacaagatcttccaaatgctatgaatgctgctgaaataactgataagcttggtcttcattcactccgtcaacgtcactggtatatccagagcacctgcgctacatctggtgaaggactttatgaagggcttgattggctctcaaacaacattgcaaacaaggcttagagatttgattagttaatggttccttggagtgttgttgagtgttagcgactatggctcttgattattgatattgttaccctgttcagaatattatctactcttacatgtattgttgcttcgagaaagaacagagacgtctactactagtttcagaataatttgctatatattttatttttcatgtataatcgaattaattttgcccgcagatttgtttaggcaatccttattgaaagcttacacttataca

SEQ ID NO: 13096 - DNA, 878 bp, Pisum sativum
ccttcacctctctgtctctctgcggtttctgctacatcaacttttcttcttcaaagggaggatcaaggtagcgaaggaaaaatggggttaacattcacgaagcttttcagtcggttatttgcgaagaaggaaatgagaattttgatggtgggtctcgatgctgctggtaagaccactatcctctacaagctcaagctgggagagattgtcactactatccctaccattgggttcaatgttgagactgtggaatacaagaacattagcttcactgtttgggatgtcggaggccaggacaagattcgtcccttgtggaggcactacttccagaacactcagggtcttatatttgttgttgacagcaatgacagggacagagttgttgaggccagagacgagctacatagaatgttgaatgaggatgaactgagagatgcagtattgcttgtgtttgccaacaaacaagatcttcccaatgcaatgaatgctgctgagattactgacaagctgggtctccactctctcagacagcgccactggtacattcagagcacttgtgcaacctctggggagggtctttatgaaggtttggactggctttccaacaatattgccaataaggcataatgctcttttgggagtctattggatcagtatttttggatgcaggggtgaatattatctagcttttatgagtcctcttccgaaacaacttgaatttatgttcatgtattatgatttaggacatattggtggctacaatgtagtaggaatttgtttcatgggatgtttaatattttgagctttctaatatgggtttggatgcaaagccttcaactgtaatggagatactaattctatgcgccatcaggttctgg

SEQ ID NO: 13097 - DNA, 1106 bp, Cajanus cajan
aacgagcgtatggtgatgaaccgaaattataagtaaagcgaataaacgacgttatgacgcgcaaacacgaattttggatcttagtccgcgttctataaatctgcgaaccccttcctgtaagaccacctctatttcttttctctttgttgcaaagagaagagatcttgtttacttctctctctctctctctcttcttcaagaatatttgaaaatggggctgtctttcaccaagttattcagccggctgtttgccaagaaggagatgcgtattcttatggtgggtctcgacgctgctggtaagaccaccattctgtataagctcaagctcggagagattgtcaccaccattcccactattgggtttaatgtggaaactgtggaatataagaacatcagcttcactgtctgggatgttggaggtcaggacaagatccgtcctttgtggagacattacttccaaaatacacaaggacttatttttgtggttgatagcaatgacagagaccgagttgttgaggctagagatgagctgcatagaatgttgaatgaggatgagttgagagatgctgtgcttctagtttttgcgaacaagcaagatcttccaaatgctatgaatgctgcggagataactgataagcttggtcttcattccctccgtcagcgtcactggtatatccagagcacatgtgccacatctggtgaagggctctatgaaggacttgactggctctcaaacaacattgcaaacaaggcatagagatttattagttaaggatgcaaggaagttgagtttacttcggctgttatgatgtccagtttctggttttcttgccctacttagattttcattgctcgagcatgtattatttttcttgaaaaaaagaacagtggcctgttactgaagaataatttgaaatttttttccatgtataacctaatagcattgtttaccctttgatttgtgaagtcaattgaattatattaagcctcgtattatgtgtacgaaacataatatttctgagattcttattcttacgacgatacagtggtgttactgaagaataatttgaaattatttacatgcataaccgaatagcattgtttac

SEQ ID NO: 13098 - DNA, 1101 bp, Cajanus cajan
gagagttgagaccactaaaatttgaacaggaagttctgaaaacgcatctagttgtctgtgatttaaaaaactagaatgcgtaaaaggaacggttagcgcgacacccctcaatcctcatcaaatcttgcccttacctcaccgctgctctctgcagactgcaaactgcaaactgcaaactgcaaactgcaaactgcaaactgcaaacagagacaccaaagcagatctcatctttctcatcaagaatgggtctgtctttcacgaagctcttcagtcgcttatttgccaagaaggagatgcgtatactcatggtcggtctcgacgccgccggtaagaccaccattctctacaagctcaagctcggcgagatcgtcaccaccattccaaccattgggtttaatgtggaaactgtggagtacaagaacatcagcttcactgtctgggatgttggtggccaggacaagatccgtcctttgtggagacattacttccaaaatacccaaggacttatatttgtggttgatagcaatgaccgagatcgtgttgtggaagctagagacgagctgcacaggatgttaaatgaggatgagttgagagatgctgtgcttcttgtttttgcaaacaagcaagatcttccaaatgctatgaatgctgctgaaataactgataagcttggtcttcattctcttcgtcagcgtcactggtatatccagagcacatgtgccacatctggtgaaggactttatgaaggacttgactggctctcaaacaacattgcaaacaaggcatagtgattatcggtcgtgggttgcatgaagttcagttgagtttcgattctgacttccgatgtttgatgtggttaccgtttaccctgtttagaatcttatctgctctagcatgtattatttgtcttcgataaagaacagatgtctactacctaatatcaaaataatttgcgtttttttttttttttcgtgtatgaccaaaattgaaggcattgtttcacccattgaattgtgaagtcaattttataattgaaagtttttgcatttatacatgatatgttaaacacaattaacaacagtgtatctcagacatcgatta

SEQ ID NO: 13099 - DNA, 810 bp, Platanus occidentalis
gctttctctccttctcctcaattcgatccctttgcgtagcgttcgaaagggatcccacagccacaaataagcatggggctcactttcacgaagcttttcagccggctttttgccaagaaagagatgcgaattctaatggttggtcttgatgctgctggtaagactactattttgtataagctcaagcttggcgagattgtcacaacaattcctaccataggattcaatgtggaaacagtggaatacaagaatatcagctttactgtttgggatgttggtggtcaggacaagatccgtccactttggaggcattacttccagaacacacagggtcttatatttgtggtggatagcaatgatagagatagagttgttgaagcaagggatgagttgcataggatgttgaatgaggatgagttgcgagatgctgtgttgcttgtatttgctaacaaacaagatcttccgaatgcaatgaatgccgcagagataactgataaacttggtcttcactctctccgccaacgccactggtacatacagagtacttgcgccacctctggagagggcctttacgaggggttagattggctctccaacaatattgctacaaaggcctgaggcataagaagattgtggttcttcaggtgagtagtggagttgggataaatattgtcttccttttttgtttcttctgaaacaagtgggcttgtgattttgacgctttaagagcaaggatcttgctctttaggactttctggtgatatgtaataggtgaatgaatggttggatataatactattacgggttttg

SEQ ID NO: 13100 - DNA, 1139 bp, Populus trichocarpa
accctaacatataagtctctaacgctgttaactcactacacccatatttaagcacaggttgatagattgagcctccctctttcccatttccttgatctctctctgggcagcttctgtgtgctctgccctctctctatctctcgctcgctatctgtgagatttaggaaagatggggctttcattcaccaagctttttagccgtctttttgccaagaaagaaatgagaattctcatggtgggtcttgatgctgctggtaagaccaccatcttgtacaagctcaagcttggggagattgtcaccactatccctacaattgggttcaatgtggagactgtagaatacaagaacataagcttcactgtctgggatgttggtggtcaggacaagattcgaccattgtggagacattatttccaaaacactcaagggctcatctttgtggttgatagcaatgatcgtgaccgtgtggttgaagctagggatgagctgcatcggatgttgaatgaggatgaattgagggatgctgtgctacttgtgtttgctaacaagcaagatcttccaaatgctatgaatgctgctgaaattacggataaacttggtcttcattcgcttcgtcaacgccactggtatatccagagcacctgtgccacttctggtgaaggcctctatgagggacttgactggctatctaacaacattgctaacaaggcttaagagatgggttttctgaagctttttggtagcattctgcttcagtttgggaatattatttggttgtttgatgttcgaggattccaatttgttgtaatattggcaagagaagaatgtatttgtttggttttgtaagataatgttactgtaatagaaattggcaaattatccatatatacaccaaaataattaatgattcacagtttcttaagtaattgtgcctttgcttcaaagtttatgatggaggagcttttgcagattttttcattgaccagccaatgcttgatgtctgtagtagctattttgccctgtagtattggttatcgtaggctgtactttctgttatgcagaaccgtgcacttttctagtgattgttgaatcttgcctttgagggttgatttatcagttagtgctcttgaagaatcaa

SEQ ID NO: 13101 - DNA, 1083 bp, Prunus mume
cgttgctcaaatccttcccggcccccaaacgtcgttagaaagatcgttatctcccacatatttaaatgcccaaatagtctcccaatcctggagcccatttctcatcgtacctcctctctctctagggcagcttctcagatctgccccttctaagcttttcaaaatggggttgtctttcaccaagttgttcagtcgtctttttgctaaaaaggaaatgcgaattcttatggtcggtctcgatgctgctggtaaaactaccatcttgtacaagcttaagctcggagagatcgtgaccaccattccaacaattggattcaatgttgaaactgtggaatataaaaacattagctttacggtttgggatgttggaggccaggacaagattcgacctttatggagacactacttccaaaatacacaagggctgattttcgtggttgatagcaatgatcgtgatcgtgttgttgaggctagggatgagctgcataggatgttgaatgaggatgagttgagggatgcagtgctgcttgttttcgctaacaagcaagatcttccgaatgcaatgaatgctgctgagatcactgacaaacttggtcttcactctcttcgtcaacgccactggtacatccaaagtacatgtgccacctctggggaagggctctatgagggtcttgactggctctccaacaatatagcaaacaaggcttaaaacgatgacaaaaacttcagcagcctcttgttttgaatgtgtcaaaagtggaatgtcattatcttgtgtttatgaatttcttagtgttactattctaagaatgtattttgtttagataattactacaaagtgattgatgccgtttggccctgtagatttaaataattcaagatttttagagtctccctgccattccatacattctgttgtgtttagatttccaatcaatggatggatgttgaatcggtaccatttctgtcatattcgaatgattggcgtttttatctttcatcatgagacaaaaaatattagacttcatttgtaaactatacaaatacaacaaacccgtgacaataaatttccatggtatttta

SEQ ID NO: 13102 - DNA, 934 bp, Raphanus sativus
ggaaaatacaaatttctaaaattagattggagctggagagtcattttctctgcgaaactcgcggcttgctctacagtagatccttcttcgaaagggatagataggtaaaggaagatggggcttaacttcacgaagctgttcagcaggcttttcgccaagaaagaaatgaggattctgatggtaggtcttgatgctgctggtaagaccactatcttgtacaagctcaagcttggcgaaattgtcaccaccatccccaccatcggattcaatgtggagactgttgagtacaagaacatcagtttcactgtttgggatgtgggaggtcaggacaagattcgccccctgtggaggcactacttccagaacactcaaggtcttatattcgtggttgatagcaacgacagggaccgagttgtggaggctagggatgagttacatcgcatgttgaacgaggatgaactgagggatgctgtccttctagtgtttgctaacaaacaagatcttcccaacgcaatgaatgctgcagaaataaccgacaagcttggccttcactctcttcgccagcgccactggtacattcaaagcacatgtgccacatctggggaaggtctttatgaaggccttgattggctctccaacaacatcgctaacaaggcatgatggagctgctggaacacgtttttgcaacttgaaagagatcattagtgattgcggagaagagaaataagaaacgagtattgtgtctgatgttgtttcaactgtctgttgatttctctgacctttatctgtgtagcctctaaaactcacctctactctttttacccttttaatggatttgtgttttaagtttttatttttacttttacaatttcgtttgtgtttccaaatatattgaagcttagtaagcagtagagatgttgccactttttttgga

SEQ ID NO: 13103 - DNA, 869 bp, Raphanus sativus
gggtgtccctttaaaaaaaaaaaatcaaatcgtgaaggagcgttcgcaggccatcggcatcagagagagagagagagagagagagagaggttagatctcgcgcggcgttggctcttcggtttgtgattgaaagaaaaaggatgggggtatcattcgggaagctgttcagcaggctttttgccaagaaggagatgcgtattctcatggttggtctcgatgctgctggtaagaccaccatcctctacaagctcaaacttggtgagatcgtcactaccattcctaccattggtttcaatgttgagactgtggaatacaagaacattagctttactgtctgggatgtcgggggtcaggacaagatccgtccattgtggaggcactacttccagaacacgcagggacttatctttgttgttgacagcaacgatcgtgaccgtgttgttgaagccagggacgagcttcacaggatgctcaacgaggatgaattgagggatgcagttctgcttgtttttgctaacaagcaagatcttcccaacgcaatgaacgctgctgagattactgacaagcttggccttcactctctccgccaacgtcactggtacattcagagcacatgtgccacctctggagaaggactctatgagggacttgactggctctccaacaacatcgcaaacaaggcgtagaaagcaggtagcaggattcctcttttcttgttctttgttttaaacatcaaggtgaggtttctctaagcactacaaaacgaaaccaagtttttattatgtcatacattcttcttctgtctgttgttcttcgacaattagcactttccttcaataaatcaaaaagtttttctttttgcattttca

SEQ ID NO: 13104 - DNA, 797 bp, Scabiosa columbaria
aaggcttctcttctccctcattcttcgctattgtttcttgtttgcttgtggtggacagctcctgttccttttatcgttttctctctcaatctcctttcacagatctgctactttcaacattcatttgaggggagatctttgcttcgctctcatcgcttccttcttcaggagaaacaaagatggggctgtctttcaccaagctcttcagtaggctctttgccaagaaagagatgcgcatactcatggtgggtctcgacgctgctggtaaaactactattttgtacaagctcaagctgggagagatagtcactacaattcctacaattggatttaatgtggagactgtggaatacaagaacatcagctttactgtttgggatgttggtggtcaggacaagattcgccctttgtggagacattacttccaaaacactcagggactcatttttgtggttgatagcaacgatcgagatcgtgtggttgaagcaagggatgagctccacagaatgttgaatgaggatgaattgagggatgctgtgttgctggtatttgcaaacaaacaagatcttcccaatgcaatgaatgctgctgagataaccgacaagcttggtcttcactccctgcgtcagcgccactggtacattcagagcacatgtgcaacatctggtgaaggtttgtacgaggggcttgattggctctctaacaatattgcaaacaaggcttaataactgggctcgtattgatgaggaactgcaccagatagagttataagttttattgttttgaaatatgtatct

SEQ ID NO: 13105 - DNA, 959 bp, Senecio madagascariensis
tggatcccccgggctgcaggtttacatttacacatattctctctctccatttcttaatacgcaaatcgatcaatcgatcgatccctaccaaacaactttttctcagggatcctcagtagcaagaggatggggctaactttcaccaagctcttcagccggctctttgccaagaaagagatgcgtattttgatggtgggtctcgatgcggctggtaagaccaccattttgtataagctcaagctcggagagattgtcaccactattcctaccataggttttaatgtggagactgttgagtacaagaacatcagtttcacagtgtgggatgtcgggggtcaagacaagattcgtccactatggaggcattatttccagaacacacaaggtcttatctttgtggtcgacagcaatgacagggacagagttgttgaggcaagagatgaattgcacaggatgttgaatgaggacgagttaagagatgcagttctccttgtattcgctaacaaacaagatcttccaaatgcaatgaatgctgctgaaattaccgacaagcttggcctccactccctccgacagcgccactggtacatccagagcacttgtgcaacctctggtgagggactttatgagggattggattggctttccaacaacatcgcaaacaaggcatgaggcagtgattgatctttgtttttatgagggtggatcttgggcagttggtgtttctgtgtttttgttttcgatatagaagtgatggattgttgtttggttatttgtttggattgcaagtatgtgttaggtgttttgattcttttttatctgaagaagttgtaagaggataagttttgtggttattagaagttgagtaccctagtatgctctccgtctattattgtttgtaataccatttggtaaaacacattattatatgcttaattcaactaaaatgcttgctatcc

SEQ ID NO: 13106 - DNA, 960 bp, Solanum phureja
aatattagaggttttgctaaaacaagaagagaacatccaaaggttctcatttcttgtcaattatacaaagggcagtccttttctagatcaactcccccactatctctctctctgtgattccttcttcatcaccgcattgaaaaaagatgggtttatcattcgggaagcttttcagtcggctgtttgccaagaaggagatgcgtattctgatggtgggtcttgatgcagctggtaaaaccaccatattgtacaagctcaagctgggagagattgttaccactattcctaccattggattcaatgtggagactgttgaatacaagaacataagcttcactgtctgggatgtcgggggtcaggacaagatcagaccattgtggaggcattacttccaaaacacacaaggacttatctttgtggttgatagtaatgatcgtgatcgtgttgttgaggctagagatgagctgcatcgtatgttgaatgaggatgaactgagagatgctgtgttgcttgtgtttgctaacaagcaagatcttccaaatgctatgaatgctgctgagattaccgacaagcttggtttgcactccctccgtcaacgccactggtacattcagagcacatgtgctacctctggagaagggttgtatgaggggcttgactggctctcaaacaacattgcaaacaagagttgaacatgagatccatgatttttgcagctatatttttgtcaatatagacttcaacaatgtctagagcacttgtgcacctgcttatctttcttatgcgagatagatccacttatcactatatttttttcagtacattttcctttctttaaaagaatgttactttacagtaactttagttgaattcatgtaatattttacactctgggtttacatattctcaattactccgctttcagcattttgtttaaattaagacttgaggttctctccc

SEQ ID NO: 13107 - DNA, 1165 bp, Glycine max
tatgcagaagaaaaaaaaaaaaagcgaaaaacctcgttaaaaaaaaagaagaagttaacgagcgtaaagtggtaaaccgaaattataaggagagggaataaacgacgttatgacggggaaacacgaattttggatcttagtccgcgttctataaatccggcaaggcctgcctgcaggaaaatctcaatttcttttctctttgtcgcaaagagaagagatctgcctcctttttatcaaatctatctcttcttcaagaatagttgaaaatggggctgtctttcaccaagttgttcagccgactgtttgccaagaaagagatgcgtatactgatggtgggtctcgatgctgcgggtaagaccaccattctgtacaagctcaagcttggagagattgtcaccaccattcccaccattgggtttaatgtggaaactgtggaatataagaacatcagcttcactgtctgggatgttggaggtcaggacaagatccgtcctttgtggagacattacttccaaaatacacaaggacttatttttgtggttgatagcaatgacagggaccgagttgttgaagctagagatgagttgcatagaatgttgaatgaggatgagttgagagatgctgtgcttctagtttttgccaacaagcaagatcttccaaatgctatgaatgctgctgagataactgataagcttggtcttcattccctccggcagcgtcactggtatatccagagcacatgtgccacatctggtgaagggctctatgaaggacttgactggctctcaaacaacattgcaaacaaggcatagagatttgttagttaaatgcaaggaagttgagcttacttcggccattatgatctccagtttctaattttcttgccctacttagattttcattacttgagcatgtatttttcttgaaaaagaacaacggtttgctactgaagaataatttgaatttttttccatgtataaccaaatagcattgtttactatttgatttgtgaagtcaattgaattatatgaaacctcgtattatgtctatgattcttacgatcatttgtattcgactgtgtcccggcaaattgaagaaaagaagacattgtttttattttggaaatgcttaataaatttaaattactattattattattattcag

SEQ ID NO: 13108 - DNA, 1413 bp, Glycine max
aaaagaaaaaaagaatttaatttccacatcgacgcaatataatttgttgtttagaatattaaaaatccctgtgaatagagttataagaagaagaagaaaaaaaaataggggccacccaaaattgaacaagaagtcctgagaaggcatctagaacaaagctctgaatctgattttgaaaactggaacgcgtaaaatgaacggtacccctccctcataaataaaatctactactaaacgctcttctcttctgcaatcaatttgcaaaccaaacacaacacaaggagaagaaccagatctctctttctcaaatcaccaagaatagttgaaaatggggctgtctttcacgaagctgttcagccggctctttgcgaagaaggagatgcgtattcttatggtgggtctcgacgccgccggtaagaccaccattctctacaaactcaagctaggagagatcgtcacaaccattcccaccattgggtttaatgttgaaactgtggaatacaagaacatcagcttcactgtctgggatgttggtggccaggacaagatccgtcctctgtggagacactacttccaaaatacccaagggcttatctttgtggttgatagcaatgaccgggatcgtgtggttgaagctagggatgagctgcacaggatgttgaatgaggatgagttgagagatgctgtgcttctagtttttgcaaacaagcaagatcttccaaatgctatgaatgctgctgaaataactgataagcttggtcttcattctcttcgtcagcgtcactggtatatccagagcacatgtgccacatctggtgaagggctttatgaagggcttgactggctctcaaacaacattgcaaacaaggcatagtgattatcggtcatgggttgcatcaaagttcatttgagtttagcggttgtgacttccaatgtttgatgtgcttaccctgtttagaatcttattttctctagcatgtattatttgtcttcgataaagaacagattgtctactacctaatatcaaaataatttgcattttttctccgtgtataaccaaaaggcatttgtcttacccatcgatttgtgaagtcaatttatcattgaaatttttacatttattcataaatattaaacataaaattaacctttgttttctaaagcctaccaattttgttcattctcaattagcctttgttttctaaagcctaccaatttgaattcctctattgatgataaacccaacaatgccaagaaggacaaacttcaatgcacaaactatggaggggagttacttggtgcacccagcattggtgcatccaacacgtaggatgaaatgacaaaaatgtccttcaccttaatgatataaataaagctagtgtccgtatggccttcttcttcctcctatccctg

SEQ ID NO: 13109 - DNA, 885 bp, Helianthus annuus
atctcctctcacacccaccattttcagatcgatcgatcccccctctccaacaagcttctctctctctcagggatcgtcatcagaaaaaggatggggctcacatttaccaaactcttcagccggctttttgccaagaaagagatgcgcatattgatggtgggtctcgatgcagctggtaagacaactatattgtacaagctcaagctcggggagattgtgactaccattcctaccattggttttaacgtggagactgtcgaatacaaaaacatcagcttcaccgtgtgggatgtagggggtcaagacaagatccgtccactatggaggcactactttcagaacacacagggtcttatctttgtggttgatagcaatgatagggatcgagttgttgaggcaagagatgagttgcacaggatgttgaacgaggatgagctaagggatgcggttcttcttgtctttgctaacaaacaagatctgcctaatgcaatgaatgctgctgaaatcactgataagcttggccttcactctctccgacagcgccactggtacatccagagcacctgtgccacctctggggaaggactttacgaggggctcgactggctctccaacaacatcgctaacaaggcatgaagtgatgattgacttgctcttctctgaggttatggaattaagtttgtttgttaaacaggcatttgatttgatatatataggacatcgtgtgatacagtgtttggttggaactttgttggtattttaaagattttgattcatataatctaaaggattaagagatactagtgctctgcttgtttatattgtgtttttggtaatatgttttttctgttcatattatctaaaccgaataagacccgttaaacc

SEQ ID NO: 13110 - DNA, 953 bp, Helianthus annuus
attctcgccctatattcacaaatcccctttttctcagggatcttctctagcgacggaatggggctaacattcaccaagctctttagccggctctttgccaagaaggagatgcgtattttgatggtgggtcttgatgcagctggtaagacaaccattttgtacaagctcaagcttggtgagatcgtgacaacaatccctaccattgggtttaacgtggagactgttgagtacaaaaacatcagcttcactgtctgggatgttgggggtcaggacaagatccgtccactatggaggcactactttcagaacacacaaggtcttatctttgtggttgatagcaatgacagggatagagttgttgaggcaagagatgagttacataggatgttgaacgaggacgagcttcgcgatgcagtgttgcttgtatttgctaacaaacaagatcttccaaatgcaatgaatgctgctgaaatcactgacaagcttggcctccattccctccgacaacgccactggtacatccagagcacctgtgcaacctcaggagagggtctctatgagggtctggattggctttctaataacattgctaacaaggcataagactgaatgtggatcttggatgtgagctgtgtgcctttggtgttggtttatagcagctttttgcggtagcaaaatgtgtcttatatagtattcgggtctgggttgtattgcaagtacttttttaaatagagtttccttcataagcctgaagttgtaatagaggttaattttgactctatgctttaccttcatcaaatcatttcacctattcttgtgttattctttcttcttccatcgtcgtttgtgttggtggcaatgttttgaaaaccggaccaaatcatgaaccgatctgcttgctaagagaagcacgcattgttgatggtttttgactcactgatttatttgtgtcc

SEQ ID NO: 13111 - DNA, 872 bp, Helianthus annuus
gctgacccgctctgccgatctggaatttgtacgcggggatctctctcgcccccaattcacaactcacaacccccctttctctctttctttctccttcgatccctctccacatccacagggatcctacgcggcaaaaaaatggggctaacgttcacgaaactctttagtcggctgtttgccaagaaggagatgcggatcttgatggtgggtcttgatgcagctggtaagacgaccattttgtacaagctcaagcttggtgagatcgtgacaacgattcctaccattgggtttaacgtggagaccgtggagtacaaaaacatcagcttcaccgtctgggatgtcgggggtcaggacaagatccgtccattatggaggcactacttccagaacacacaaggtcttatctttgtggttgatagcaatgacagggatagagttgttgaggcaagagatgaattacataggatgttgaatgaggacgagcttcgagatgcagtcttgcttgtatttgctaacaaacaagatcttccaaatgcaatgaatgctgccgaaatcactgataagcttggcctccattcccttcgccaacgccactggtacatccagagcacctgtgcaacctcaggagagggactttacgagggtctcgattggctttccaataacatcgctaacaaggcataagatgaaacaagaccaaacctaatgtcgatcttggatgctgggagcttttgctttgctctgtgtgtttgttaatcggtagcaaatgtgtctacttatataatatttggctgtattgcagttactttttaaaagcattgtctaaagtttgtaacagaggttaattttgattgttttattatatgatgatg

SEQ ID NO: 13112 - DNA, 1104 bp, Nicotiana tabacum
cggggcggcacaattccaatgagtggtggtaaagaatctagtagaaattttctactatttgtcacccaaaaagtttaaaagaatccaattccacatctgacgagacttattaatttgaaaattcaaattgttaaatttaataggaacatccattgctttcgcattttattgtcatttctaaagggcagagtcttttctagatctgcccctttctcgctctctcctgattcgttgttcatcactgcattgagaaaagatgggtttatcattcgggaagcttttcagtcggctgtttgccaagaaggagatgcgtattctgatggtcggtcttgatgcagctggtaaaaccaccatattgtacaagctcaagttgggagagattgttaccactattcctaccattggattcaatgtggagactgttgaatacaagaacataagcttcactgtctgggatgttggtggtcaggacaagatccgaccattgtggaggcattacttccaaaacacacaaggacttatctttgtggtcgatagtaatgatcgcgatcgtgttgttgaggctagagatgagctgcaccggatgttgaatgaggatgaactgagggatgctgtgctgcttgtatttgctaacaagcaagatcttccaaatgctatgaatgctgctgagattactgacaagcttggtcttcattctctccgtcaacgtcactggtacattcagagcacttgcgctacctctggagaagggttgtatgaggggcttgactggctctcaaacaacattgcaaacaagggttgaatgcgagatccatgatttttgcagctatgtttttgtcaatatagacttcaacaatgtctagagcacttatgtacttactgatctttctttcacgggatagatctgcttatccctattgttatcagtacgtttgccctttcttttaaagaatggtactctgcagtaactttaggttaaattcatgtaatattttgcactttggctgacatatgctcagcgactttggcttcaacattttattttaattgagattaaggttctctccccgtaatgatttggttaaagttggtgatgtttctctg

SEQ ID NO: 13113 - DNA, 966 bp, Nicotiana tabacum
ggccattacggccggggaggcatcccctaaaagaagaaaagaacatccatagctttcgcaatttattgtcatttctaaagggcagtcttttctagatctgcccctctctcgctctctcctgattcgttgttcatcactgcattgaaaaaagatgggtttatcattcgggaagcttttcagtcggctgtttgccaagaaggagatgcgtattctgatggtcggtcttgatgcagctggtaaaaccaccatattgtacaagctcaagctgggagagatcgttaccactattcctaccattggattcaatgtggagactgttgaatacaagaacataagcttcactgtctgggatgttggtggtcaggacaagatccgaccattgtggaggcattacttccaaaacacacaaggacttatctttgtggttgatagtaatgatcgtgatcgtgttgttgaggctagagatgagctgcaccggatgttgaatgaggatgaactgagggatgctgtgctgcttgtgtttgctaacaagcaagatcttccaaatgctatgaatgctgctgagattactgacaagcttggtcttcactctctccgccaacgtcactggtacattcagagcacttgcgctacctctggagaagggttgtatgaggggcttgactggctctcaaacaacattgcaaacaagggttgaactcgggatccatgatttttgcagctatatttttgtcaatatagacttcaacaatgtttagagcacttatgtacttactgatctttctttcgcgagatagatctgcttatccctattgttatcagtacatttgcccttttcttttaaagaatggtactctgcagtaactttagggtaaattaatgtaatattttgccctttggctgacatatgctcaactactttgccttcaacattttattttaattgagattaaggttctctccccg

SEQ ID NO: 13114 - DNA, 1088 bp, Solanum lycopersicum
atcgtgacaatttattaggagtgacattaaaatacgtgaggctttcgctaaaacaagaagagaacctccaaaattgcccatttcttgtcaattgtacaaagggcagtctttttctagatctactgccccctctctctctctgtgattccttcttcatcaccgcattgaagaaagatgggtttatcattcgggaagcttttcagccggctgtttgccaagaaggagatgcgtattctgatggttggtcttgatgcagctggtaaaaccaccatattgtacaagctcaagctgggagagattgttaccaccattcctaccattggattcaatgtggagactgttgaatacaagaacataagcttcaccgtctgggatgtcgggggtcaggacaagatcagaccattgtggaggcattacttccaaaacacacaaggacttatctttgtggttgatagtaatgatcgtgatcgtgttgttgaggccagagacgagctgcatcggatgttgaatgaggatgaactgagagatgctgtgctgcttgtgtttgctaacaagcaagatcttccaaatgctatgaatgctgctgagatcactgacaagcttggtttgcactccctccgtcaacgtcactggtacattcagagcacatgtgctacctctggagaagggttgtatgaggggcttgactggctctcaaacaacattgcaaacaagggttgaacacgagatccatgatttttgcagctatatttttgtcaatatagacttcaaacaatgtctagagcacttgtgcacctgctgaatggatccacttatcactattttttatttcagtacattttcatttctttaaaagaatgttactttacagtaactttagttgaattcatgtaatattttacattctgggtttacatattctcaatgactctgctttcgatattttgttttagttaagactcgagattccctcccagtcttcgttggttttagttaatgctgcttttcgatactgctggagtttgaactattttgtttggttaagaagtttaggcctccacaactttataacaaaatcttaaagggtt

SEQ ID NO: 13115 - DNA, 1621 bp, Solanum lycopersicum
catttggggtcacaatgtgtttacaacaattttaacctatacaatttataatataacaccaactttattatttacgttagtaaaagaatcctaaatagagtatttgaaaattcaaaattgtgacaatttaataatagggttgacattaaaatattagaggcttctaaaacaacaagagaacatccaaaggttcccatttcttgtcaattatatacaaagggcagttttttctagatctactgccccccctctctctctctgtgattccttcttcatcattgcattgaaaaaaagatgggtttatcattcgggaagcttttcagccggttgtttgccaagaaggagatgcgtattctgatggttggtcttgatgcagctggtaaaaccacaatattgtacaagctcaagctgggagagattgttaccactattcctaccattggattcaatgtggagactgttgaatacaagaacataagcttcactgtctgggatgtcgggggtcaggacaagatcagaccattgtggaggcattacttccaaaacacacaaggacttatctttgtggttgatagtaatgatcgtgatcgtgttgttgaggctagggatgagctgcatcgcatgttgaatgaggatgaactgagggatgctgtgctgcttgtgtttgccaacaagcaagatcttccaaatgctatgaatgctgctgagattaccgacaagcttggtttgcactccctccgtcagcgtcactggtacattcagagcacatgtgctacctctggagaagggttgtatgaggggcttgactggctctcaaacaacattgcaaacaagggttgaacatgagatccatgatttttgcagctatatttttgtcaatatagacttcaacaatgtctagaacacttgtgcaccatgcgagatggatccacttatcagtattatttttttttcagtacattttcctttctttaaaagaatgttgctttatagtaactttagttgaattcatgtaatattttatactctgggtttacatattctcaatgactctgcttttggcattttgttttaattaagacttgatgttctcgcagtgttcgtatgttttagttagtgaagcttttctatactgctggtgagcaggtctttactatatctgtgctatctctactaaacaaattttcagttgaaactatttgtttggttgagaagtatccttgcaaagtctaaccctataacaattgaagttcaataatttctaagcttccagagcagacttgtgataattttaatctgatataactttaacaaacacgaaactgctagcgtctgatctgccgtcaacctgaattagttccgactctgagtaatcgtatgacattacttgtgcacttgcccatcaaatcatccagtgtaacctcattttttgttgttgtcgtactcttgattgtgtgtatatgttggccatcaaagacctaatgtttaccctcatatatcaatagcatataaagcttgtcttccactttggtaggatactagcaatagcacaacaccttcctaaaacttcccattgttagcatttagactctataattcaatctaatcccccgcttacttc

SEQ ID NO: 13116 - DNA, 999 bp, Trigonella foenum-graecum
ggaaggtactaagtaaaaaataacaaagacaccgaccgaataaaacaacgttaactagaatttaggatctgaatttagcgttgttctataaatccgcgtaggcttgacgttgagagaaactcccatttcttttctctttgttacaaggagaagagatccatccatccatccatccgcgttcgttcatcttcaagaaaagttgaaaatgggactgtcattcacgaagctattcagccggctttttgccaagaaagagatgcgtatacttatggtaggtctcgatgcggctggtaagaccaccattctttacaaactcaagcttggggagatcgtcacaactattcctactatcgggttcaatgtggaaacagtggagtacaagaatatcagcttcaccgtgtgggatgtcggaggtcaggacaagatccgtcctctgtggagacattacttccaaaatacacaaggacttattttcgtggttgacagcaatgacagggatcgtgttgttgaagctagagatgagctgcataggatgttgaatgaggatgaattgagagatgctgtgcttctagtttttgcaaacaaacaagatcttccaaatgctatgaatgctgctgagataactgataagcttggtcttcactctctccgtcagcgtcactggtacatccagagcacatgtgccacatctggtgaaggactttacgaaggacttgactggctctcaaacaacattgcaaacaaggcatagagattttatagttaagggtgcaagaagttgagtttacttttgcgtttatgatctccagcttctggttttcttgccctgggtagattttcattgttcgagtatgtattatttgtcttaaaaaaagaactgcggtctattattgaagaataatttgattttttcccccatgtataaccaaatagaattgtttaaagtttacccttttgattgtgaagtcaaatgattattttaagccacatgtttgtgtt

SEQ ID NO: 13117 - DNA, 925 bp, Tripterygium wilfordii
tcttgcgcttcttctctctcgaaaattctctgaggaactcttgaaagaggggccaacagtggtaaggagaaatggggctgacgtttactaagctcttcagccggctttttgccaagaaagagatgcgtattctgatggtgggtcttgatgctgctggtaagacaaccatattgtacaagctaaagcttggtgagatcgtcaccactatcccaactatagggttcaatgtggaaacagtggaatataaaaacatcagtttcactgtgtgggatgttgggggtcaggacaagatccgtcccttgtggaggcactacttccaaaacacacagggtctcatttttgtcgtagacagcaatgacagagatcgagttgttgaggctagggatgaattgcacaggatgttgaatgaggatgagctgcgagatgcagttttgctcgtatttgctaacaaacaggatcttcctaatgcaatgaatgctgctgagatcactgataagcttggtcttcactccctccgtcagcgtcactggtacatccagagcacttgtgcaacctcaggggaggggctttatgagggtttggattggctctcaaataacattgctaataaggcgtaaattcccctaatggtggactggcaattctggatgcaggggtgaatgttatctagttttttttctcttatttttatcttgtttctctctttttgagacagtcggattttgttatgtgcttttttttggatgaatctttatttagggcctgttggttgatattgtaatagaagattgattgattgtgtttttgcgcttatatttgattttttgaatgtgaagttgttagcttaatcaacaccttttggtgtgtcaatccttcttggattgataaattttctgtgttttttggcattgaaccagtatacgcc

SEQ ID NO: 13118 - DNA, 834 bp, Utricularia gibba
ttatttgtatgactggtatctgataacgaatatttccgtcatggtaagcagggtctcaaaaaacattggagatgggacttacgtttactaagctttttagccggctctttgccaagaaggagatgcgcatattgatggtcggtctagatgctgctggtaaaacaactattctgtacaagctgaagctcggagaaattgtcaccaccattcctaccattggatttaatgtggagaccgttgagtacaagaacattagcttcacagtctgggatgtcggtggtcaggacaagattcgtccattatggaggcactacttccagaacactcagggtcttatatttgttgttgatagtaatgacagggatcgtgttgttgaggcaagggatgagttgcataggatgttgaatgaggatgagctgagagatgcagtattgcttgttttcgcgaacaagcaagatctcccaaatgcaatgaacgctgctgaaatcactgacaagcttggtctccactcactcaggcagcgccactggtatatccagagcacatgtgctacatctggagaggggctttacgagggactggactggctctcaaacaacattgccaacaaagcatgaatctgaagtgattcgggggcggtcgcttctgcttctttacctagtggtattgcgattcctttaaattttacggtcttctttttgttacacgaacctggtggcgcttcattcgtcgaacatgtgcttcgctttcattgtgaaagacaataccgttcatcatcatccatattggatcccttgccctttagttttttaaaaaaaaaaaaaaacacgctgt

SEQ ID NO: 13119 - DNA, 934 bp, Vicia sativa
tctctctctgctacatcaacttttcttcttcaaagggaaggaaaaatggggttaacattcacgaagctgttcagtcggttatttgccaagaaggaaatgagaattttgatggtgggtctcgatgcggctgggaagaccactatcctgtataagctcaagcttggagagattgttactaccatccctaccattgggttcaatgttgagactgtggagtacaagaacattagcttcactgtttgggatgtcggaggtcaagacaagattcgtcccttgtggaggcactacttccagaacactcagggtcttatttttgttgttgacagcaatgacagggacagagttgttgaggccagagatgagctacatagaatgttgaatgaggatgaactgagagatgcagtattgcttgtgtttgctaacaaacaagatcttcccaatgcaatgaatgctgctgagattactgacaagctgggtctccattctctcagacagcgccactggtacattcagagcacttgtgcaacctctggggagggtctttatgaaggtttggactggctctccaacaatatagccaataaggcataatgatattttgggagtcttttggatcggtcattctggatgcaggggtgaatattatctagcttttatttccgagtcctcttccgaaacaacttgaatttgtgttcatgtattatgatttaggacatattggtggctacaattgtagtaggaatttgtttcatgggatgtttaatacttttgagctttctaatgggtttggatgcaaagccttcaactgtaatggagatactaattctatgcgccatcaggttctgatttatacctttgttttggtcatttataccttttcatatttagtattggatggagattttcatttttgtaagatactaccaaggaaagt

SEQ ID NO: 13120 - DNA, 856 bp, Vicia sativa
ctctttgttacaaggagaagagatccgctttcatcttcctcttctcaaatcgctcttttcatcaagaatagttgaaaatgggattgtctttcacgaagctgttcagccggctatttgccaagaaagagatgcgtatacttatggtaggtctcgatgcggctggtaagaccaccattctttataagctcaagcttggagagatcgtcaccaccattcctactatcgggttcaatgtggaaacagtggaatataagaatatcagcttcactgtctgggatgtcggaggtcaggacaagatccgtcctctgtggagacattacttccaaaatacacaaggccttatttttgtggttgacagcaacgacagggatcgtgttgttgaagctagggatgagctgcataggatgttgaatgaggatgaattgagagatgccgtgcttctagtttttgcaaacaagcaagatcttccaaatgctatgaatgctgctgagataactgataagcttggtcttcattctcttcgtcagcgtcactggtacatccagagcacatgtgccacatctggtgaaggactttatgaagggcttgactggctctcaaacaacattgcaaacaaggcatagagatttattagttaaaggtgcaagaagctgagttaacttttgcgatcatgatttccagcatctgttctctccctgcgtagattttcattgctcaagcatgtattatttgtcttaaaaaaagaacttcggtctattactgaagaataatttgatttttttacccatgtataatcaaatagtattgtttaatgttcaccattttgattgtgaagtcaattgaattatttaaagcc

SEQ ID NO: 13121 - DNA, 874 bp, Vinca minor
tctctcgaaggccaatctcaggtatcatccataagaaagcaatatgggattgacgttcaccaagctctttagccggctctttgccaagaaggagatgcgaattctgatggtaggtcttgatgcagctggtaagactaccatattgtacaagctcaagctcggagaaattgtcaccacgattcccactattggttttaatgttgagactgtcgagtacaagaacattagcttcactgtttgggatgttgggggtcaggacaagatccgtcccttgtggaggcactactttcaaaacacacaaggtcttatttttgtggtggatagcaatgacagagaccgtgttgtggaagccagggatgagttgcataggatgttgaatgaggatgagcttcgtgatgcagtgttgcttgtatttgccaacaaacaagatcttcctaatgcaatgaatgcagctgaaataaccgataagcttggtctgcactccctccggcagcgccactggtatatccagagcacttgcgcaacttctggagaaggactatacgagggactggattggctttctaacaacattgctaataaggcataaagcaagacaggaaatattttgatggattgacactggatgcaggctcctttttatctagaattttcctgttatggtattatggatttaaattttagtcactattatatatattttaacctgctagaagtactcggttttatgtaattgcaatgtgtttgtctaggttttttaatataatgccagaaggttggattttattgctggtagtattattttaaacagagattttaagctgttatgcacctttgtttctcaatggcttgtattctttttaatacttgtatg

SEQ ID NO: 13122 - DNA, 964 bp, Artemisia annua
tctctcttgaaatccgatcaaatcaaatcaaatcaatcgtaacttcttcttctttcagcgatcctcaccaataataggatggggctaactttcaccaaactctttagccggctcttcgccaagaaggagatgcgtatattgatggtgggtctcgatgcggctggtaagaccaccattttgtacaagctcaagctcggagagattgtcaccaccatccctaccattggatttaacgtggagactgttgagtacaagaacatcagcttcacagtgtgggatgtcgggggtcaagacaagatccgtccactatggaggcattacttccagaacacacagggtcttatctttgtggttgatagcaacgacagggacagagttgttgaggcaagagatgaactgcacaggatgttgaacgaggatgagctaagagatgcagttctccttgtatttgctaacaaacaagatcttccaaatgccatgaatgctgctgagataactgataagctgggcctccactcccttcgacagcgccactggtacatccagagcacttgtgcaacctctggagagggactttatgagggattggactggctttccaacaacatagcaaacaaggcttagggcatgaatgatctttgtttttatgagggtggatcttggccagtttgtggttctgtgctgcctttggttttggaacttggttctttcaaaaggtgttttgtttttaatatagaagttatggattgtgtcgaattgaatacattgttgttttgtttgtttggattgcaagtatcttatgttagatcatcatgattcttttatctgaagttgtaagaggtcaagtattttgtggtttttagaaatcgagtacctatgtagtttgctggtatgctcttatcttcattgtttgtattcggtaaacgttatatgctatattcaaatgttcgagaaatggttcatg

SEQ ID NO: 13123 - DNA, 1054 bp, Chrysanthemum coronarium
atctcttttcttcattctctctcttgaaatccgatcaaatcaaatcaaatcaaccgaaacttcttctctcagggatcctcaccaacaagaggatgggtctaactttcaccaaactattcagccggctctttgccaagaaggagatgcgtatattgatggtgggtctcgatgcggctggtaagaccaccattttgtacaagctcaagcttggtgagatcgtcacaacaatccctaccattggatttaatgtggagactgtagagtacaagaacatcagcttcacagtgtgggatgtcgggggtcaagacaagatccgtccactatggaggcattacttccagaacacacaaggtcttatctttgtggttgatagcaacgacagggacagagttgttgaggcaagagatgaactgcacaggatgttgaacgaggatgagctaagagatgcagttctccttgtatttgctaacaaacaagatcttccaaatgccatgaatgctgctgagatcactgataagctcggtctccactcccttcgacagcgccactggtacatccagagcacttgtgcaacctctggagagggactttatgagggattggactggctttccaacaacatagcaaacaaggcttaggggatgaatgatctttgtttttatgagggtggatctttttccagtttgtggttctgtgctgcctttggttttggaacttggttctttcaaagggtgttttgtttttaatatagaagttatggattgtgtcgaattgaatacattgtcgtttgttttttttggattgcaagtatcttctgttagatcgtcatgattcttttatcgtaagttgtaagaggttaactattttgtggcttttagaaatctgagtacctatgtagtttgctggtatgctctatcttcattgtttgtataccattcggtgaaacattatatgttcaactgttcgagaaatggttcatgttatcccaatattatcaatctcttgtacggtgtgacatgatacttcatgtcgcatttgtaattttgtacccccg

SEQ ID NO: 13124 - DNA, 1100 bp, Chrysanthemum coronarium
ttccgatctcttgtgtttattctctctcttgaaatccgatcaaatcttcaaatcaatcgtaacttcttattctctcagggatcctcaccaacaagaggatgggtctaactttcaccaaactattcagccggctctttgccaagaaggagatgcgtatattgatggtgggtctcgatgcggctggtaagaccaccattttgtacaagctcaagctcggagagattgtcaccaccatccctaccattggatttaacgtggagactgttgagtacaagaacatcagcttcacagtgtgggatgtcgggggtcaagacaagatccgtccactatggaggcattacttccagaacacacaaggtcttatctttgtggttgatagcaacgacagggacagagttgttgaggcaagagatgaactgcacaggatgttgaacgaggatgagctaagagatgcagttctccttgtatttgctaacaaacaagatcttccaaatgccatgaatgctgctgagatcactgataagcttggtctccactcccttcgacagcgccactggtacatccagagcacttgtgcaacctctggagagggactttatgagggattggactggctttccaacaacatagcaaacaaggcttaggggatgaatgatctttgtttttatgagggtggatctttttccagtttgtggttctgtgctgcctttggttttggaacttggttctttcaaagggtgttttgttttggaacttggttatggattgtgtcgaattgaatacattgtcgtttgttttgtttggattgcaagtatcttctgttagatcatcatgattcttttatctgaagttgtaagaggttaactattttgtggcttttagaaatctgagtacctatgtagtttgctggtatgctctatcttcattgtttgtataccattcggtgaaacattatatgttcaactgttcgagaaatggttcatgttataccaatattatcaatctcttgcacggtgtaacgtagatacttcatgtcgcggttgtaatttttgtacctcgggagctttatttgctgtatcattaatgaaaaaacaaactta

SEQ ID NO: 13125 - DNA, 1021 bp, Chrysanthemum coronarium
atgcgtattttgatggtgaacaggaagatccgggtgtttatataaaatcctcttcctcctcctcatattcattatcatcgtttcatttttctctctttgaaatcaaaatcaattaaaactcatcagggatcctcaccaaaaagaggatgggtttaactttcaccaagctctttagccggctttttgccaagaaggagatgcgtattttgatggtgggtctcgatgcagctggtaagaccactattttgtacaagctcaagctcggagagatcgtcaccaccatccctaccattggatttaacgttgagactgttgagtacaaaaacatcagttttaccgtgtgggatgtcgggggtcaagacaagatccgtcctctatggaggcattacttccagaacacacagggtcttatctttgtggttgatagcaacgacagggacagagttgttgaggcaagggatgaactgcacaggatgttgaacgaggatgagctaagagatgcagttctccttgtatttgctaacaaacaagatcttccaaatgccatgaatgctgctgagatcactgataagcttggcctccactcccttcgacagcgccactggtacattcagagcacttgtgcaacctctggagagggactttatgaaggattggactggctctccaacaacatagcaaacaaggcttaggcaatgaatgatctttgtgtttatgagggtggatcttggccagtttgtggttctgcgctgcctgtggttttggaacttggtgttttgtttttaatatagaagttatggattgtgtcgaattgaatacattgttgtttgtttgtttggattgcaagtatcttatgttagatgattatgatgattcttttatctcaagttgtaagaggtttgtggtttttagaaatcgagtacttatgtagtttgctggtatgctctacctccattgtttgtataccatttggtactcattatatgctaaattcaactgttcggagaaatgtttatgttac

SEQ ID NO: 13126 - DNA, 1093 bp, Chrysanthemum coronarium
tctctctcttgaaatccgatcaaatcaaatcaatcgtaacttcttcattcagggatcctcacaaacaataggatggggttaactttcaccaaactctttagccggctctttgccaagaaggagatgcgtatattgatggtgggtctcgatgcggctggtaagaccaccattttgtacaagctcaagcttggagagattgtcaccaccatccctaccattggatttaacgtggagactgttgagtacaagaacatcagcttcacagtgtgggatgtcgggggtcaagacaagatccgtccactatggaggcattacttccagaacacacaaggtcttatctttgttgttgatagcaacgacagggacagagttgttgaggcaagagatgaactgcacaggatgttgaacgaggatgagctaagagatgcagttctccttgtatttgctaacaaacaagatcttccaaatgccatgaatgctgctgagatcactgataagctcggtctccactcccttcgacagcgccactggtacatccagagcacttgtgcaacctctggagagggactttatgagggattggactggctttccaacaacatagcaaacaaggcttaggggatgaatgatctttgtttttatgagggtggatctttttccagtttgtggttctgtgctgcctttggttttggaacttggttctttcaaagggtgttttgtttttaatatagaagttatggattgtgtcgaattgaatacattgtcgtttgttttgtttggattgcaagtatcttctgttagatcatcatgattcttttatctgaagttgtaagaggttaactattttgtggttttagaaatcgagtacctatgtagtttgctggtatgctcaatcttcattgtttgtataccattcggtaaaacattatatgttcaactgttcgagaaatggttcatgttatcccaatattatcaatctcttgtacggtgtgacatgatacttcatgtcgcatttgtaattttgtacctccggagctttattcgctgtatcattaatgaaaaaacaaacttagggggtgcttgtttaagctta

SEQ ID NO: 13127 - DNA, 891 bp, Arnica chamissonis
tctcccacccacatttccagatcccctctccatctctcagtgatcctcatcagaagtaggatggggcttacatttaccaaactctttagccggctttttgccaagaaagaaatgcgtatattgatggtgggtcttgatgcagctggtaagacaactattttatacaagctcaagctcggggagattgtgaccaccatccctaccatcggatttaatgtggagaccgttgagtacaaaaacatcagcttcactgtgtgggatgtggggggtcaggacaagatccgtccactatggaggcactacttccagaacacacaaggccttatctttgtggttgatagcaatgatagggatagagttgttgaggcaagagatgagctgcacaggatgttgaatgaggatgagctaagggatgcagttcttcttgtgtttgccaacaaacaagatctgcctaatgcaatgaatgctgctgaaatcaccgataagcttggccttcactctcttcgacagcgccactggtacatccagagcacctgtgccacttctggggaaggactttacgagggtctggactggctctccaacaacattgctaacaaggcatgaggtgatgattgaattgtatttgagggtggaaaaaccagagacaggttttgctttttgtttggttgggttagtttcggtttctcgtctttggggctgaggtacgaatggttatggaactttgtttgttaagaaaggctttttgcatttatatatatttataggacatgtatgatacaatctttggttggaactttgttggtactttaaaggttctatttctcataacctaaagaattaagagagatttatgtttattgtttatatatgcctttctttaaaaaaaaa

SEQ ID NO: 13128 - DNA, 936 bp, Flaveria ramosissima
catttccagatcgctcgatccctctcctaaaaactcatctctcagggatcctcatcagagacaggatggggctcacattcaccaaactcttcagccggctttttgccaagaaagaaatgcgtatattgatggtgggtcttgatgcagctggtaagacaaccattctgtacaagctcaagctcggggagattgtgactaccatccctaccattggatttaatgtggagactgttgagtacaaaaacatcagcttcactgtgtgggatgtggggggtcaggacaagatccgtccactatggaggcactacttccaaaacacacagggtcttatctttgtggttgatagcaatgatagggatagagttgttgaagcaagagatgagctgcacaggatgttgaacgaggatgagctaagggatgcagttcttctggtatttgccaacaaacaagatctgcctaatgcaatgaatgccgctgaaatcaccgataagcttggccttcactctcttcgacaacgccattggtacatccagagcacctgtgccacctctggggaaggactttacgagggtttggactggctttccaacaacattgctaacaaggcatgatatgttgattgaactgtatttgagggtggaaaaaccggaggcaggttttgctttttgtgcggtcgggtcactttcttgtactagttctcgttcttctgtgactgaggtgcggttggttatgaactatgttaaaaaaggtgttttgcattttacatatagtccttgtatgataaaatctttggttggaactttgtcgtcgtattttaaaggtttatttcacataaccaagagattaattttgcttgttacaaaaaaaaaagaaaaaatactcggtgtagactacacgtgtactatagagacgcgacgagacacacggaggtagagg

SEQ ID NO: 13129 - DNA, 838 bp, Flaveria ramosissima
cacatttccagatcgctcgatccatctccaaaaaactcatctctcaggtatcctcatcagagacaggatggggctcacattcaccaaactcttcagcaggctttttgccaagaaagaaatgcgtatattgatggtgggtcttgatgcagctggtaagacaaccattttgtacaagctcaagctcggggagattgtgactaccatccctaccattggatttaacgtggaaactgttgagtacaaaaacatcagcttcactgtgtgggatgtggggggtcaggacaagatccgtccactatggaggcactacttccaaaacacacagggtcttatctttgtggttgatagcaatgatagggatagagttgttgaggcaagagatgagttgcacaggatgttgaacgaggatgagctaagggatgcagttcttcttgtatttgctaacaaacaagatctgcctaatgcaatgaatgctgctgaaatcactgataagcttggccttcactctcttcgacagcgccactggtacatccagagcacctgcgccacctctggggaaggactttacgagggtttggactggctttccaacaacattgctaacaaggcatgaggcgttgattgaactgtattcgagggtggaaaaaccggaggcaggttttgcttttgttcggtcggtcactttcttgtactagttctcgttcttctgtgacggaggtgcgagtggttatgaaactttgttaaaaaaggctttttgcattttatatatagtccttgtatgataaaatctttggttggaactttgtcgtcgtactttaaaggtttatttcacataacc

SEQ ID NO: 13130 - DNA, 940 bp, Gerbera hybrid cultivar
gctccctttctctctcctctctttttctctctctaacttcaagtcgagcgattcaatttgatctctctccggaaagcttctctcagggatcctcagttgcaagaggatggggctaactttcaccaagctctttagccggctctttgccaagaaagagatgcgtatattgatggtgggtctcgatgcggctggtaagacaaccattttgtacaagctcaagctcggcgaaatcgtcaccacaatccctaccattggttttaatgtggagactgtcgagtacaaaaacattagcttcactgtgtgggatgttgggggtcaggacaagattcgtccactatggaggcactatttccagaacacacagggtcttatctttgtggttgatagcaatgacagggacagggttgttgaggcaagagatgaattgcacaggatgttgaatgaggatgagttaagagatgcagttctgcttgtatttgctaacaaacaagatcttcctaatgcaatgaatgctgctgaaatcactgataagctcggcctccactccctccgacagcgccactggtacatccagagcacctgtgcaacctccggagaaggactttacgagggattggattggctctccaacaacatagcaaacaaggcatgaggtgatgattgagcttttatatgagggtggatcttgatgagttttttgtcctcatgctgcgtgtggttttggaacttgttcgttaaaaaggccttttgcttatctttcattataggagttattatgtctcgttaaatatattgtttgtttgtttgtttgaattgaaactactttaaaagtatgtgttaggttttgattcatatatctaaagttgtaagagattaagtttggtgggtgtagaagttgagtatcacttgtataccatttgataaaactttttatgcttga

SEQ ID NO: 13131 - DNA, 1664 bp, Medicago truncatula
ttgttattgaagttttgattggactgtgtaattaggtcggatcaaggaagtgaagagaaatggggttaacattcacgaagctgttcagtcggttatttgcgaagaaggaaatgcgaattctgatggttggtctcgatgcagctggtaagaccaccatcctttacaagctcaagcttggagagatcgtcaccaccatccctaccattgggttcaatgttgagactgtggagtacaagaacattagcttcaccgtttgggatgttggaggccaagacaagattcgtccactgtggaggcactacttccagaacactcagggtcttatatttgtcgtagacagcaatgacagggatagagttgttgaggccagagatgagttacataggatgttgaatgaggatgaactgagagatgcagtgttgcttgtgttcgccaacaaacaagatcttccaaatgcaatgaatgctgccgaaattactgacaagttgggtcttcactcgctgagacagcgccactggtacatccagagcacctgtgcaacctctggggagggtctctatgaaggtttggactggctttccaacaacatagccaacaaggcttaatgcttatcgggagtattgtggattggtgattctggatgcagggaggaaaatattatctagcttttatttcttggtcgtcttctgaaacaacttgaatttgtgtttatgactttatgtattgtggtataggatggtgcctaaaatttagtagaaatttgtttcatgggctttgtaatacttctgcgccttctattggttttcgatgcaatgcccatagttgtagttgagatacaattaaatatgcctcaagttctgctttatagttttatttcggttcattcttcacccttctctctctctgtctctgtctctgcgatttctgctacatcaacttttcttcttccaagatttgatcaagaagtgaaggagaaatggggttaacattcacgaagctgttcagtcggttatttgcgaagaaggaaatgcgaattctgatggttggtctcgatgcagctggtaagaccaccattctctacaagctcaagcttggagaaattgtcaccactatccctactatcgggttcaatgtggagactgtggaatacaagaacattagcttcactgtttgggatgtcggaggccaggacaagattcgtcccttgtggaggcactacttccagaacactcagggtcttatatttgttgttgacagcaatgacagggatagagttgttgaggccagagatgagctacataggatgttgaatgaggatgaactgagagatgcagtgttgcttgtgtttgccaacaaacaagatcttcccaatgcaatgaatgcagctgagattactgacaagctgggtctccactctctcagacagcgccactggtacatacagagcacttgtgccacctctggggagggtctttatgaaggtctggactggctttccaacaacattgccaataaggcataatactttttgggagtattttgttttgggtcggtatttttggatgcaggggtgaatattatctagcttttatttctgggtcctcttccgaaacaacttaaatctgtgtttcatgtattgtggtttaggacgtaatggtggctac

SEQ ID NO: 13132 - DNA, 1395 bp, Medicago truncatula
actcaattcctattccgcgttgctgcaaagcattcttcacccttctctctctctgtctctgtctctgcgatttctgctacatcaacttttcttcttccaagatttgatcaagaagtgaaggagaaatggggttaacattcacgaagctgttcagtcggttatttgcgaagaaggaaatgcgaattctgatggttggtctcgatgcagctggtaagaccaccattctctacaagctcaagcttggagaaattgtcaccactatccctactatcgggttcaatgtggagactgtggaatacaagaacattagcttcactgtttgggatgtcggaggccaggacaagattcgtcccttgtggaggcactacttccagaacactcagggtcttatatttgttgttgacagcaatgacagggatagagttgttgaggccagagatgagctacataggatgttgaatgaggatgaactgagagatgcagtgttgcttgtgtttgccaacaaacaagatcttcccaatgcaatgaatgcagctgagattactgacaagctgggtctccactctctcagacagcgccactggtacatacagagcacttgtgccacctctggggagggtctttatgaaggtctggactggctttccaacaacattgccaataaggcataatactttttgggagtattttgttttgggtcggtatttttggatgcaggggtgaatattatctagcttttatttctgggtcctcttccgaaacaacttaaatctgtgtttcatgtattgtggtttaggacgtaatggtggctaccattgtagtaggaatttatttcatgggatgtttaatactttttgagctttctattgtgtttggatgcgttgccctaattgtaatggagatactaattctatgcgccatcagtttcagcttctgatttatacctttgttatgctcatatataccgttcctattatgtgctggatggagattttgttttttttaaggtaccaaggataatacgatattcatatggtttttggtgctcatgttttcaactttgtgcgtcacgtgaatccggattttatggttaatttgactggttggtaatacataaatatttttttcaggattgacattttcttgtttagttgattcaccttgaattgtaaaaatggtaccttgttgtatgcaagaatgcttctcttaattttcagtattttgtcttgttgaggttgacaccaccatacacttacataccaacatagttgcttcttaaaattaatatattaatttatcactctaaatttagattttgccaaaaatgtaacatctcaagattcaacctaatgagtactacccatttatcataatcccccctcactttagaattct

SEQ ID NO: 13133 - DNA, 963 bp, Vicia sativa
gttctctctctctttcctctcaagaacaaatcgcgattcgctcttctccaaaaaatctctagatcgaaaagaagagcgatttgtgtgttggtgaagatggggttaacgttcacgaagctgttcaataggttattcgcgaagaaggaaatgaggattttgatggttggtctcgatgcggctggtaagacaactattttgtataaactcaagcttggagaaatcgtcaccaccatcccaaccattgggtttaatgttgaaaccgtggagtacaagaacatcagcttcaccgtgtgggatgtcgggggtcaggacaagatccgcccattgtggaggcactacttccagaacactcagggtcttatttttgtggttgatagcaatgatagagaccgagtggttgaggcaagggatgagttgcacaggatgttgaatgaggacgaacttagagatgctgttttgcttgttttcgccaacaaacaagatcttcccaatgcaatgaatgctgcagaaataacagacaagcttggtcttcattcactccgccaacgccactggtatattcagagcacctgtgcaacttctggagagggtctatacgagggtttggactggctttctaacaacattgcaagcaaggcataaagagacatttgaatttttgggtgtatctgatcatttcctgtcagtctggtggttcttgaagaaggatgcttttcctttcaagtgcatgttgtaatagaggaatgattgttaggaatattatcctcttgagtgttacttgggtttgtatgattgcttaaatgagctaatacttttagctacaattggaactcttgcaatcactttttgtgtgccttcatgtttatttttttagtttcattatcagttgaatatttctgtggcttctgttcttaagagttttaccagtaataattttgtctaatgattggtgaagcagaattg

SEQ ID NO: 13134 - DNA, 796 bp, Brassica juncea
ctctctctctctcggttacattctccagagtaaaagggcacaagatggggttgagtttcgccaagctgtttagcaggctctttgcaaagaaggagatgaggattctgatggttggtcttgatgctgctggtaagaccactattctctacaagctcaagctcggagagattgtcaccaccatccccactattggtttcaatgtggaaactgtggagtacaagaacatcagtttcactgtgtgggatgtcgggggtcaggacaagatccgtcccttgtggaggcattacttccagaacactcagggtctgatttttgtcgtggacagcaacgacagagaccgtgttgttgaggctcgagatgaacttcacaggatgctcaatgaggacgagctccgtgatgctgtgctgcttgtgtttgccaacaagcaagatcttccaaatgcgatgaatgcagctgagatcacagataagcttggccttcactccctgcgccagcgtcactggtacattcagagcacatgcgccacttcaggtgaagggctctatgagggacttgactggctctccaacaacatcgctggcaaggcgtgatgagggtgagttgcatttgcatcgagatggttctaccttctgtgatgcaagaaacgattataaatattatctgaacctttttgatattgggtatgtgaatgttttgattgtgcaagtagatgtcttgtctctaaaacttactagaagaacccatttaaataagttttcatgtgttttgaatatgagtattattttgcttttggcgt

SEQ ID NO: 13135 - DNA, 888 bp, Liriodendron tulipifera
gtggaaagtagctctctccacttctctggtttccgagactttctccctcgaaagccagacatggggctgactttcacaaagctttttagccggctttttgccaagaaagagatgcgtattctgatggttggtcttgatgccgctggtaagactaccatcttatacaagctcaagctgggggagattgttaccacaattccaactattggatttaatgtggagactgtggaatataagaacataagcttcactgtatgggatgttggtggtcaggacaagatccgtccattgtggaggcactacttccaaaatactcagggtcttatatttgtggttgatagcaatgacagggaccgtgttgttgaggctagagatgagttgcatagaatgttgaatgaggatgaactgcgtgatgctgtgttgcttgtattcgcaaacaagcaagatcttccaaatgcaatgaatgcagcggagattactgataagcttggacttcactccctccgccagcgccattggtacatccagagcacgtgcgcgacttctggggagggcctgtacgaagggttggattggctatccaacaacattgctaacaaggcctgagatattggggttgcggttcctttgagattttctggatgcaggggtgaatgttatctaagcttttttcctgaggtaaggtggctgtgatgaaattagaggacctcttcattttccttttatttttatttttatttttgtaactgctcgtggcatattgtaatagaagactcactgcttactacattagcatctttacctgccatatggtgtttgatctttgttcaactaaacctttactgcaaatgaaactggtatttctctttatggatagtctgatcatac

SEQ ID NO: 13136 - DNA, 899 bp, Cucumis sativus
ttcccaccgtctctcttttctgtctgtcgtagattctcggcggtgcttgttcaaggctgtgacagagaatggggctcacgttcacaaagcttttcagtcggctttttgccaagaaggaaatgcgaattctgatggttggtcttgatgcggctggtaagacaactattctctacaagctcaagcttggtgagatcgtcacaacaatccccaccattgggtttaatgttgaaactgtagagtacaaaaacatcagcttcacagtttgggatgttgggggtcaagacaagattcgtcccttgtggaggcattacttccagaacacacagggtctcatatttgttgttgatagcaatgacagagatcgagttgttgaggccagggatgagttgcataggatgttgaatgaggatgagctgcgagatgcagttctgcttgtgtttgctaacaaacaagatcttcctaatgcaatgaatgctgctgagatcaccgacaagcttggtctccactctctccgccagcgtcactggtacatccagagcacttgcgccacctccggagagggtctttatgaggggttggattggctctccaacaacattgctaacaaggcataaggatatccaacagtttgcttctgagactcgcagttctggatgcagggtgaatattatctaatttttttcaaggggcactttataaaagaggttatggttttttttttcctttttcctttttctgtttacgggagcttttagcaaactatttgtcattatactgtaatatcagaatggttagccttggtttatgtgttttgggctctttttcagggcttttactcgctgttcttttcttttcgatttctagctcaaactagttgatgtatcattccatgttggatt

SEQ ID NO: 13137 - DNA, 875 bp, Eschscholzia californica
agacagcttctttcttctcgctcggattcctctgaaattccattttccccgtcaataaagatggggctgtctttcaccaagctttttagtcggctttttgccaagaaagagatgcgtattcttatggtgggtctcgatgcagctggtaagactactattttatacaagctcaagctgggagagattgtcaccactattcctactattggattcaatgtggaaactgtcgaatacaagaacatcagtttcactgtctgggatgttggtggccaggacaagatcagacccttgtggagacactacttccagaacacacaaggtcttatctttgtggttgacagcaatgaccgtgaccgtgtggttgaggccagagatgaactccacaggatgttgaacgaggatgagttgagagatgcagtacttcttgtgtttgctaacaaacaagatcttccaaatgcaatgaatgctgccgaaattactgataagctaggtcttcactctctccgccaacgtcactggtacattcagagcacttgtgccacttcaggagaaggtctttacgaaggacttgattggctctccaacaacatcgctaacaaggcatagaagaagctacaatgattttgagctactgctgaattgttggattagagatgttattagtattattgtaagacaactaatattgtttttttatttggtggttgaggtattcgtctattacatttctctcttgtttcctgtaagttgtcacaagagggtgaaaagtattttcttttagctgcaatattctgaatggtttctttattaaatagacagatctaaatgcattttttgtcctaaaaaaaagtacgtacgggtagggcgaaggacga

SEQ ID NO: 13138 - DNA, 853 bp, Humulus lupulus
tgcctcatttctctctgggcagcttctcagatctgccccttttctcagcttctctcgtaatcgtctttttcgcttgagccatccgagattaagaaatggggttgtctttcaccaagctcttcagtcggctttttgccaaaaaggagatgagaattctaatggttggtctcgatgccgctggtaagaccaccatcttgtataagctcaagctgggagagattgtgacgaccattcctacaatcggattcaatgtggagactgttgaatataagaacattagctttaccgtctgggatgtcgggggtcaggacaagattcgacctctgtggagacactacttccagaatactcaaggactcatctttgtggttgacagcaatgatcgtgaccgtgttgtcgaggctagggatgagttgcatcgtatgttgaatgaggatgagttgagggatgctgtgctgcttgtatttgccaacaaacaggatctcccaaatgccatgaatgcagctgagatcacagacaaacttggtcttcactctcttcgccaacgtcactggtacatccagagcacatgtgccacatctggggaaggactctacgagggtctggattggctctccaacaatattgctaacaaggcttaaagagacctgatctctgttgaaggatttcacgcagcaattggtgtcatcatggcatgctgctccccttatatttggtgttgatggattcttttttatctttttttttttactgtcattaattaatgtatctgttcagattttgtttccacaaaatagaaattgccattttatcctgtagatgctaaataattcatggttcttagaatatataa

SEQ ID NO: 13139 - DNA, 966 bp, Humulus lupulus
atttctctctgggcagcttctcagatctgccccttttctcagcttctctcgtaatcgtctttttcgcttgagccatccgagattaagaaatggggttgtctttcaccaagctcttcagtcggctttttgccaaaaaggagatgagaattctaatggttggtctcgatgccgctggtaagaccaccatcttgtataagctcaagctgggagagattgtgacgaccattcctacaatcggattcaatgtggagactgttgaatataagaacattagctttaccgtctgggatgtcgggggtcaggacaagattcgacctctgtggagacactacttccagaatactcaaggactcatctttgtggttgacagcaatgatcgtgaccgtgttgtcgaggctagggatgagttgcatcgtatgttgaatgaggatgagttgagggatgctgtgctgcttgtatttgccaacaaacaggatctcccaaatgccatgaatgcagctgagatcacagacaaacttggtcttcactctcttcgccaacgtcactggtacatccagagcacatgtgccacatctggggaaggactctacgagggtctggattggctctccaacaatattgctaacaaggcttaaagagacctgatctctgttgaaggatttcacgcagcaattggtgtcatcatggcatgctgccttccccttattagtttggttgttggtgtatttctttttatttttttttttttactgtcattaattaatgtatctgttcagattttgtttccacaaaatagaaattgccattttatcctgtagatgctaaataattcatggttcttagaatatataaacgattcattcttttattgtttagagtatactaattttttcttttttcggttacgtattatccccactgttatttttatattctcaaattccataaagattctcgccaacttaa

SEQ ID NO: 13140 - DNA, 1142 bp, Coffea canephora
gagatggcaatccagtaaatccaagaacatcctcaacttggggcctgtgggcgtcgctctttatttaggacctcaagttgaaattcccattcccccataattacgcgttggtctcaagctttcgtttttattttcgagtctctctcatcacctcacctcagatccctctcttccctctgtcaaatccttcctcagggatcttacataagaaagcataatggggctaacgttcacgaagctgttcagccggctttttgccaagaaggagatgcgcattctgatggtgggtcttgatgcagctggtaagaccaccatcttgtacaagctcaagctcggagagatcgttaccacaattcccaccattggttttaatgttgagactgttgagtataagaatattagctttactgtttgggatgttgggggtcaggacaagattcgtcctttgtggaggcactacttccaaaatactcagggtcttatatttgtggtagatagcaatgatagggaccgtgttgtggaggcaagggatgaattacacaggatgttgaatgaggatgagctacgtgatgcagtattacttgtatttgctaacaaacaagatcttcctaatgcaatgaatgctgctgaaataactgataagcttggcctccactccctcaggcagcgccactggtatatccaaagcacctgtgcaacttctggagaggggctctacgaaggcctggattggctctctaacaatattgctaataaggcataaagtgatgtggtaacattttgatgggttgatcctggatgcaggcggctttttatctagttgtttctgttgtcatggtcgtggatttcagttttgagtccttttgtatctttcaagtcactatttgcaatgcaatacttggttttttagcaaatgctagtgtttgtctaggtttgggtactgctatggaagtatgagcctgtaaacagagattaacttggtatctacttcgggttttgccaatgccgtcatagttatattctttatattgtttgtcattattattattgtttcttttcattgtgaaaagcttgccaatattaattacttgagtgtaaggctttttttttttcccgaagtttgtgtgaagtatttctagaac

SEQ ID NO: 13141 - DNA, 986 bp, Cucurbita pepo
tataaaaatagagtcctcatgatttgcgaatgcgcttttgatcgtgaaggacagcttctctcttgcacaagagagatctatcattctatttggggccgatcgctcaaatccgctctctttaattcttttccgtgaaaaatggggctgtctttcaccaagcttttcagccggctctttgccaagaaggagatgcgtattctcatggtgggtctcgacgcagctggtaagacgacgatcctttacaaactcaagctgggagagattgtcaccaccattcccaccattggtttcaatgttgagaccgtcgaatacaagaacattagcttcactgtctgggatgttgggggtcaagataagatccgaccattgtggaggcattatttccaaaacactcaaggacttatttttgtggtggatagcaatgacagagaccgtgttgttgaagctagggatgagctgcacagaatgttgaatgaggacgagctgagggatgctgtgcttttggtatttgccaacaagcaagatcttcccaatgccatgaatgctgctgagatcaccgataagctcggtcttcactccctccgacaacgtcactggtacattcaaagcacatgtgccacatctggtgaagggctgtacgaaggactcgactggctctcaaacaacattgccaacaaggcgtagatggcttgctttgagcttggattgcttctggaaattcaaattcatgtcatttatcccttggtttttgggcatttttgttgcattacctgatgatctatacgatgttcgttttgtttctagtcgtttctagtcgacatgattcctaggttgcctttggattctgaataattgaagaaattttgcaagtgttttctcatgttatcgacttaatagcattgtttttatgtaacgaattaatgatgttcttaaatagatatatttgtacgaataccattttcattatttggaatggattgctgaaa

SEQ ID NO: 13142 - DNA, 667 bp, Acacia harpophylla
ggttcacccctcgcatatcatatctctctccttccctgcgtaactagatccctccttcaagcgcacatctctcaaggggccccgctgtttgaaggagaaatgggtttgacattcacgaaacttttcagtcggctctttgccaaaagagaaatgcgaattctcatggtgggtcttgatgctgccggtaagaccaccatcttgtataagcttaagcttggagagatcgtaactacaattcctaccattggctttaatgtggagactgttgaatacaagaatattagcttcactgtctgggacgtcggtggtcaggacaagattcgtccgttgtggaggcattacttccagaatacccaaggccttatatttgttgtggacagcaatgacagggacagagttgttgaagcaagagacgagttgcacagaatgttgaatgaggatgaactcagagatgcagtattgcttgtatttgctaacaaacaagatcttcccaatgcaatgaatgctgctgagatcactgataagctgggtctccactctctcaggcagcgccactggtatatccagagcacctgtgcaacttctggtgaaggcctttatgagggtttggattggctttccaacaatatagccaacaaggcttgatgctcttcctgagtcttatagt

SEQ ID NO: 13143 - DNA, 1145 bp, Amaranthus tuberculatus
tgaaactccaaacaaacaaacaaacaaactaccgtcacatttctttctctcttgaaaatttctccctttccagattgttgaacttaagaggaagcaaaaatggggctttctttcacaaagctgtttagcagactgttttcgaagaaggagatgcgtatactgatggtgggtctcgatgcggctggtaagaccaccatcttgtataagctcaagttgggagaaattgttaccaccattccaaccattggattcaatgtggagactgttgagtacaagaacattagcttcactgtgtgggatgttggaggtcaagacaagatccgtcccttgtggagacactacttccagaacacacaaggactcatctttgtggttgacagtaacgatcgtgaccgtgtggttgaagcgagggatgagctgcacaggatgctgaatgaggatgaattgagggatgcggttctgctagtgtttgctaacaagcaggatcttcccaatgcaatgaacgctgcagaaattaccgacaagcttggtctccactccctccgtcaacgacactggtatatccagagtacatgtgcgacatcaggtgaaggactgtacgagggtctcgactggctctcaaacaacatagcaagcaagggttaaataactgagttctgagtttacatctagaacaaagatgattggatattcattttcgttgatgacttcgattattacatttatttcagagttcttcatagcacatattgttcagtcgcaggttatgtcatttgttttttgtagtctgattttaagacatgagattgattgcaaccatttatctagtaatgtgattttgttcattatttttagtgtttttcttttgttgctcaagttctcttctcaaaccatgctttcggttctcacaatgtgaagaaatgtttaagcaaatttggcaccagacacgagaataatgagttggtctaatggtgatctgatctcgattgattgattgtagtaattaaagtgttatagttgtggtatgaacatactcagcagtgagttgtcggaccttggtgtgccttgggcaattaattagctcccaaaagtccaagctttgtagtcctaaaaacatgctataaaaatttactatatactttctt

SEQ ID NO: 13144 - DNA, 910 bp, Amsonia hubrichtii
tcactcactcactcaatcactcatacatccctctcctctcgaagccttctccgggatcactaataacaaagaaaaatggggttaaccttcacaaagctgttcagccggcttttcgctaagaaggaaatgcgcattctgatggtcggtcttgatgcagctggtaagaccaccatcttgtacaagctcaagcttggagagatcgtgaccacaattcccaccattggttttaacgtggagactgttgagtataagaacatcagcttcactgtttgggatgttggtggtcaggacaagattcgcccattatggaggcactacttccagaatacacagggtcttatctttgtggtggatagcaatgacagagaccgtattgtggaggcaagggatgagttgcataggatgttgaatgaggatgagctgcgagatgcagtgttacttgtatttgctaacaagcaagatcttcctaatgcaatgaatgctgctgaaataactgataagcttggcctccactctctccggcagcgccactggtacatccaaagcacctgtgcaacttctggagagggactctatgagggtctcgattggctttccaacaacattgctaataaggcataagtgataaggagttattttgatgggttgatcctggatgctggcagctttttatctagtcttttacccttctgttatgaattgatgttttaagtcactatatctttataaatagctccttgtaatagagtgcttggtttaatgtaattgcaattattcgtctaggtatcaaatataagcgcaatgagatgtgaacttgtcaactggtatttaagttaatatgaaccttggttttgtaatggcttctacctgcaccctttttggacatttagttcttttgttgcttgatcaa

SEQ ID NO: 13145 - DNA, 1027 bp, Malus domestica
atatagcgtcggtatcggtattgctgccaaggacagcccttccccttcttcttagagacgctcatacgccctagagagagaaaccaccgcagatctactctctttctctctctctcctcaaattctccatcttcctcaggttcgaaaatggggctgtcattcacgaagctgttcagccgtctgtttgcgaagaaggagatgcgcattctgatggtgggtctcgatgcggctggtaagaccaccattctctataagctcaagctcggcgagatcgtcaccaccattcccaccattggattcaatgtggagactgtggaatacaagaacatcagctttactgtgtgggatgtcgggggtcaggacaagatccgacctttgtggaggcattacttccagaacacacaaggacttatctttgtggttgatagcaacgatcgtgaccgtgtggttgaagccagagatgagcttcacagaatgttgaatgaggatgagttgagggaggctgtgcttcttgtatttgcaaacaagcaagatcttccaaatgccatgaatgctgctgaaataactgataagcttggtcttcactctctccgtcaacgccactggtatatccagagcacgtgcgccacttctggtgaaggactgtacgagggtcttgactggctctcaaacaatattgcaaacaaggcatagatggcttgacttgaattttgtgtatcgccgattctgctgtaatatgaagttgacattgatcggtccttggtattctgcatttctctgctcttaagtacctgtttttaccatttttgtgtttacttttgcaaacagttccttttcttcgacatgtagatgtagttaagaataattcctaaattctcaatttttcgcccagtattagcgtaatagctttgtttcccctccattgttttgtgaaatgaaatagctgtcatctatctgttaatattttctctcgcatcatccaaattcaaatcaaatggatttgggaagtattgtttggcctgtgaaa

SEQ ID NO: 13146 - DNA, 895 bp, Brassica juncea
cgaaaatctgaattatccggaccgaaaccgaacgatccaccgaacgcccaggcctacttattactgggtttatatacgtagagatcttctgtgtgtccacaaaaaagaatcatcgggaaacgttggaagggtcatcggagctgagatctctcgtgcggcgttgtttcttgggtttggaagaaaacatgggggtgtcattcgggaagctgttcagcaagctgtttgcgaagaaagagatgagaattctgatggtgggactggatgcagctggtaagacgaccatcctctacaagctcaaacttggtgagatcgtcaccactatcccaaccattggtttcaatgttgaaactgtggaatacaagaacattagctttaccgtctgggatgtcgggggtcaggacaagatccgtccattgtggagacactacttccagaacacacagggacttatctttgttgtggacagcaacgatcgtgaccgtgttgttgaagccagggacgagcttcacaggatgttgaacgaggatgagttgagggatgcagttctgcttgtctttgctaacaagcaagatcttcccaacgcaatgaacgctgctgagattactgacaagcttggccttcactctctccgccaacgacactggtacattcagagcacatgtgccacctctggagaaggactctacgagggacttgactggctctccaacaacatcgcaaacaaggcatagaaaggaggtagcaagattcctcttcacttgttttgtttataaatcaaggaaagaagggttctgtttcgctagtactatcttcatacattcttcttcttcttcttcgactcagtctcaaactcaaaaccctaatcatactttgtaactttcctttaataacgatg

SEQ ID NO: 13147 - DNA, 1108 bp, Musa acuminata
ccgcttttgaactccgccatagtcccgtgcctctttctttcttttccccggctcgtggtgaaagaggaagaggaagaagaggcggaaacctcgcgtcttaagagatctcagatcggaaagaatggggctcacgttcgctaagctcttcagccgcctctttgcgaagaaggagatgcggatcctcatggttgggcttgatgcggccggtaagacgaccatcctgtacaagctgaagctcggggagatcgtcaccaccatacccaccatcggatttaatgtggagactgtagagtataaaaatattagcttcactgtctgggatgttggtggtcaggataagattagacctttatggaggcattatttccagaacacacagggccttatttttgttgtcgacagcaatgacagagatcgtgtcattgaggcaagggatgaacttcacaggatgcttaatgaggatgaattgcgtgatgcagtcttgcttgtttttgctaacaaacaagacctgccaaatgctatgaatgctgctgaaattactgataagcttggtctgcattccctgcgtcaacgccattggtacatacaaagcacctgtgctacctctggtgagggtttatatgaagggcttgattggctatctaacaacatagctaataaggcttaaattatgacttgtggaagatgaagcaacaggaactcccatatctacgaagcagtcgtgttcccttctctcctggacgcttttggtactcttttgacccataaaacttttatctcgacttgtgcgaatgatttcaggtatctgttggctacctgtgctttctatatatgcatatgtatggttttctagtccatttcttggcagaattttgttatggcttatgagtttacttgttagatttctatgttcctatcgcagttgctttggttctcggatccgcatgcctcatctgcatgtacacaaatgaattcatttaaccccaaactctattgttgcacgatattaaccctaaactctaggcatctccttgggaattgatggcaatatgaattgtagcatctgcataatatattatatggtgaaaaatttaagacaaagcaaccc

SEQ ID NO: 13148 - DNA, 862 bp, Fagus grandifolia
ctctctttctctctgtctgattcaatatctcagggcagcttctctcagatctgcccaatcccatttcacatcttcaccatcttgagataaaagatggggctgtctttcaccaagcttttcagccggctttttgccaaaaaggagatgcgtattctaatggtgggtctcgatgcagctggtaagaccaccattttgtacaagctcaagctgggagagattgtcacaaccattccgaccattggtttcaatgtggagactgtggaatataagaacattagcttcactgtctgggatgttgggggccaggacaagattcgacctttgtggagacattacttccaaaacactcaggggcttatctttgtggttgatagcaatgaccgtgaccgtgtggttgaggctagggatgagctgcatcggatgttgaatgaggatgaattgagggaagccgtgctgcttgtatttgcaaacaagcaagatctaccaaatgccatgaatgctgctgaaataactgataagcttggtcttcactccctccgtcaacgccactggtatatccagagcacatgtgccacttctggggaagggctgtatgagggattagactggctttccaacaatattgctaacaaggcttaggggatcagtaaatcttcagtaaactgttttgggctgcaatctccgtcgaaggagattttactgttgttatgtggtgtttatgctttttacattgatactgtcttgagaatgtatctgtttgtttagatcattgttacaatatgatagaaaatgaaatttgccttgtagattctaaataattcatgattcacagttcatagatgatttaagtccttttttattt

SEQ ID NO: 13149 - DNA, 846 bp, Fagus grandifolia
tctatatatactgagagagagagaattataaaatagcactaagcatttgctccttaatttgaatctgaatctgatttggctctgaaagccatttccgttcaatatacaaaatggggttgtctttcaccaagcttttcagccggctttttgctaagaaagagatgcgtattcttatggtgggtcttgatgctgctggtaaaaccacgattttgtataagctcaagttgggggaaatagttaccaccatccctaccattggatttaatgtggaaactgtggaatataaaaatattagcttcactgtctgggatgttgggggtcaggataagattcgacctttgtggagacactacttccaaaacacccaagggcttatctttgtggttgatagcaatgatcgagaccgtgttgttgaggctagagatgagctgcacaggatgttgaatgaggatgaattaagagaggctgtgttgcttgtgttcgcaaataagcaagatcttcctaatgcaatgaatgctgctgagatcactgataagctcggcctccattctctccggcaacgccattggtacatccagagcacatgtgcaacttctggagaaggattgtatgagggactggattggctctcaaacaacattgccaacaaggcttagaggattgcaggctggtctctattatcttgattgcagcaagaaaagaggattttatttttagtttaattcttttgtaccctttaatgtgtacttttggatgtggtcaaaaactaatattgtgtaagctgttggcatttgttttaaacacagtaactcatgaaatatttgactttatgcttagctttcggag

SEQ ID NO: 13150 - DNA, 829 bp, Manihot esculenta
gtaaatattgccgtggaggacagctcttcgttctaatttgttctcattttgtttgtgcggaggtagatcccgcatttgctcttggctcttttctcagcagacgtgaaacaatggggctgtctttcactaagctgttcagccgactctttgctaagaaagagatgcgtattctgatggtgggtcttgatgctgctggtaagaccaccatcctctataaactcaagctcggagaaattgtcacaaccatccctaccattggatttaatgtggagactgtggagtacaagaatattagcttcactgtgtgggatgttggtggtcaggacaagattcggcctttgtggagacattacttccaaaacacacaagggcttatctttgtggttgatagcaatgacagagatcgtgtggttgaagctagggatgagctgcacaggatgttgaatgaggatgagctgagagatgctgtactgcttgtatttgcaaacaagcaagatcttccaaatgcaatgaatgctgctgaaataactgataagcttggccttaactctctccgacaacgccactggtacatccagagcacatgtgccacctctggtgaagggctatacgagggtctggactggctctcgaacaatattgcaaataaggcataaatggctcaattcttgagttttggattgcaacaattgctcgaatacacatttggtagtgccccttttgttccggtttcttttttccttagtaccacctttagcggttgtacctgtttaaccgtgtttgttatcccttctgcagacattgtaatttgtttcttgtagcttcagaa

SEQ ID NO: 13151 - DNA, 757 bp, Castanea mollissima
ctgcccaatcccacctcacacattcaccatcttgagataaaagatggggctgtctttcaccaagctttttagccggctctttgccaagaaggagatgcgaattctaatggtgggtctcgatgcggctggtaagaccaccattttgtacaagctcaagcttggagagattgtgaccaccattcctacaattggtttcaatgtggagactgtggaatacaagaacatcagcttcactgtctgggatgtcgggggccaggataagattcgacctttgtggagacattacttccaaaacactcaagggcttatcttcgtggttgatagcaatgaccgtgaccgtgtggttgaggctagggatgagctgcatcggatgttgaatgaggatgaattgagggaggctgtgctgcttgtatttgcaaacaagcaggatcttccaaatgccatgaatgccgctgaaataactgataagcttggtcttcattccctccgtcaacgccactggtatatccagagcacatgtgccacttcaggggaagggctgtatgagggactagactggctttccaacaatattgctaacaaggcttaggagatccgtaaatcatcatttacttttttgggctgcaatctctgtcaaaagggattttgtcgttatgtggtgtttatgcattttacatttgatattgtcttgagaatgtatctgcttgtttagatcattgttacaatatgatagaaattgacatttgccttgtagatt

SEQ ID NO: 13152 - DNA, 840 bp, Castanea mollissima
ctctctctctcagggcagcttctctcagatctgcccaatcccacctcacatattcaccatcttgagataaaagatggggctgtctttcaccaagctttttagccggctctttgccaagaaggagatgcgaattctaatggtgggtctcgatgcggctggtaagaccaccattttgtacaagctcaagcttggagagattgtgaccaccattcctacaattggtttcaatgtggagactgtggaatacaagaacatcagcttcactgtctgggatgtcgggggccaggataagattcggcctttgtggagacattacttccaaaacactcaagggcttatcttcgtggttgatagcaatgaccgtgaccgtgtggttgaggctagggatgagctgcatcggatgttgaatgaggatgaattgagggaggctgtgctgcttgtatttgcaaacaagcaggatcttccaaatgccatgaatgccgctgaaataactgataagcttggtcttcattcccttcgtcaacgccactggtatatccagagcacatgtgccacttcaggggaaggactgtacgagggactagactggctctccaacaatattgctaacaaggcttaggagatccgtaaatcatcatttacttttttgggccgcaatctatgtcaaaggggattttgtcgttatgtggtgtttatgcattttacatttgatattgtcatgagaatgtatctgtttgtttagatcattgttacaatatgatagaaattgacatttgccttgtagattctaaataattcatgattcacagttcatagatatgattaaaccttgcttatttt

SEQ ID NO: 13153 - DNA, 1235 bp, Cicer arietinum
taaaaatgaagcttttaaggcaagatctcaaaataaaatcgcatgttattttatgcaaacaccaaaaccaaccacaacacgaatagaagaagagatctcctctcatttcaccacaaaaataatttctttctcaaatctgaaagaatagttgaaaatgggtctatctttcacgaagctgttcagccgattgtttgcgaagaaggagatgcgtatacttatggtgggtctcgatgccgctggtaagacaaccattctctataagctcaagcttggagaaattgtcaccaccattcccaccattggtttcaatgtggaaactgtggaatacaagaacatcagctttactgtctgggatgttggtggtcaggacaagattcgtcctttgtggagacattacttccaaaatacacaaggacttatttttgtggttgatagcaatgaccgagatcgtgttgttgaagctagggatgagctgcacaggatgttaaatgaggatgagttgagagatgctgtgcttctagtttttgcaaacaaacaagatcttccaaatgctatgaatgctgcggaaataactgataagcttggtcttcattcacttcgtcagcgtcactggtatatccagagcacatgtgccacctctggtgaaggactttatgaaggacttgactggctctcaaacaacattgctaacaagggttagttactgttagtcatgagctgcatgaagctcagttgagtttagagattatgatttcctatgtttggatatggttgccctgtttagaattttacttggctttagtatgtattgtttcatttgtcttcgaaaaaaacgaacgtaggttcaatacatttgcaatttatttttttcccgtgtataaccagaaagctttgtttcatccattgatctgtgtggtcaattaaaccattggaaagcttttatgcataatatgttagttataaaatgagcaatcgtattttcagcagagtcgtgtcaatatggctagtttgatgactggaaaaatccattgttccaaaaccaaaccatgattattattacatttgctgcttttattcctcgatgtgcattttttttttgtaatgaagttgtggagtaatttactccatgtttggtggctactattacgagtaaacaaataaatcagggactaataccgttttggtggagtaataaggtttaaatggattttcatgtttaaacacatgaaattgtg

SEQ ID NO: 13154 - DNA, 1038 bp, Citrus clementina
cccatatacatatttctgcgttgttgttaagctaataagcttcgtcctccacaccccccccccctcccctctctctctcgcgttctctgaagtgatccccagctggaagaatggggctgactttcacaaagctgttcagccggctctttgccaagaaagagatgcgaattctaatggttggtcttgatgctgctggtaagaccactatcttgtacaagctcaagcttggagagattgtcaccacaattcctaccattgggtttaatgtggagaccgttgaatataaaaacatcagtttcactgtgtgggatgttggtggccaggacaagattcgtcccttgtggaggcattatttccagaacactcaaggtctcatttttgttgtggacagcaatgacagagaccgtattgtagaagcaagggatgaattgcataggatgttgaatgaggatgagctgcgagatgcagtgttgcttgtatttgctaacaaacaggatcttccaaatgcaatgaatgctgctgagattactgataagcttggcctccactccctcaggcagcgccactggtacatccagagcacctgtgcaacctctggtgagggtctttatgaaggtctggattggctctccaacaacatcgctaacaaggcctgaagctgttaagatctttttgcggactggcaattctggatgcaggggtgaatattatctatttttttttctttttaaccctttttgtttgagacgtttgggttgttgtgttgttttggtcctaggatctttacaactatattgtaatagaagaattgttggttggatacatgtactccaaggtttttggctcggtttagatatctgtaattgaaactaatttggtgcaccactcatatttgaaattgtttttttcgcattgcgtttctgtgatggcgtctgcactttaagttctcgcctcttttgacaagtgctttcatatctccgtgtctgttgggtggaaaatacttttgctagaaagtaaattcttccttagcaaaatctt

SEQ ID NO: 13155 - DNA, 928 bp, Conyza canadensis
actcattcggggcctgggggtttattttattctaaaatatcagcctcttaaatattcctattgtctgtccactttgatcgcctttcacattttgctgatccaatcaaaactttcccgtccggctatcatggggttgtcatttacgaagttattcagtcggttgttcgctaagagggagatgcgaatattgatggtcggtctcgatgcagctggtaaaactacgattttgtacaagcttaagttgggagaaattgtcaccactattcctactattggatttaatgttgaaaccgttgaatacaagaacatcagcttcactgtgtgggatgttgggggtcaagacaagattcgacctttgtggaggcactacttccagaacacacagggtctaatcttcgtggttgacagcaacgatcgtgatcgtgtggttgaggccagagatgagctacacaggatgcttaatgaggacgagttgagagatgcagtgctactcgtttttgccaacaagcaagatcttccaaacgctatgaatgctgctgagatcactgacaagcttggtctgcaatctctccgacaacgacattggtatatccagagcacatgtgccacctctggggaaggtctatatgaggggcttgattggctttccagcaacattgccaacaaggcttaagaagggactcatatgaatatggggtatacagcttaaaacaagtattgttggcctttcatttatgttgagaaggaatatgtgaaacctatcagctttcctagacaatatacttcatcacatgtagaatttgtatgtctttatttctgtaatacactgctttgtaatatgcagaccggaacatttgcctttgagttgacggagactgttttaacctatagttcttgcaagtatgagaactaatatttttattttatt

SEQ ID NO: 13156 - DNA, 989 bp, Gossypium hirsutum
gcttcgagcggccgcccgggcaggcacgcgggggcgttggtctcaagctctctctgcctctctttctaccatttgcttcaaaatcaaatccaaaatctctctgcgattttctccaaagggatcagcaattagggaagagaaatggggctgacattcacgaagctttttagccggctttttgctaagaaggagatgcggattttgatggtgggtcttgatgcagccggtaagactaccatcttgtacaagctcaagcttggagaaattgttaccaccattccaaccatcggatttaatgtggagactgtggaatataagaacatcagtttcactgtgtgggatgttggtggtcaggacaagattcgtccgttgtggaggcattacttccagaatacacagggtctcatcttcgtggttgacagcaacgacagagaccgtgttgttgaggctagggatgaattgcatagaatgttgaatgaggatgagctgcgagatgcagtattgcttgtatttgcaaacaagcaggatcttccaaacgcaatgaatgctgctgaaataactgataagcttggtcttaattcccttcgacagcgtcactggtacatccagagcacctgtgcaacatctggtgaagggctttatgagggtctggattggctttcaaacaacatagctaacaaggcctgaagccattaaagaaggggtatttgcaatatcaaaaattctggatgcagggtgaacattatctagtcttattttcttcaattattattatgccctcatttttcgactgtgacagctggattgttgttatgcgtttctgtttttggagatgaccatattagtttggaccttgtggttatatattgaaaactaaaaattggtttgattggatgtatatctctttctgtaaccaaaacttatttgcaattgcatgaattgcatttctatgaaaaaaaaaaaaactaagcgactgccaacggacgacc

SEQ ID NO: 13157 - DNA, 947 bp, Gossypium hirsutum
taaaaatatttggtattcgtgtttaatttgcgttggtctcaagctctctctacctctctttctaccatttgcttcaaaatcaaatccaaaatctctctgcgattttctccaaagggatcagcaattagggaagagaaatggggctgacattcacgaagctttttagccggctttttgctaagaaggagatgcggattttgatggtgggtctcgatgcagccggtaagacaaccatcttgtacaagctcaagcttggagaaattgttaccaccattcctaccatcggatttaatgtggagactgtggaatataagaacatcagtttcactgtgtgggatgttggtggtcaggacaagattcgtccgttgtggaggcattacttccagaatacacagggtctcatcttcgtggttgacagcaacgacagagaccgtgttgttgaggctagggatgaattgcatagaatgttgaatgaggatgagctgcgagatgcagtattgcttgtatttgcaaacaagcaggatcttccaaacgcaatgaatgctgctgaaataactgataagcttggtcttaattcccttcgacagcgtcactggtacattcagagcacctgtgcaacatctggtgaagggctttatgagggtctggattggctttcaaacaacatagctaacaaggcctgaagccattaaagaaggggtatttgcaatatcaaaaattctggatgcagggtgaacattatctagtcttattttcttcaattattattatgccctcatttttcgactgtgacagctggattgttgttatgcgtttctgtttttggagatgaccatattagtttggaccttgtggttatatattgaaaactaaaaattggtttgattggatgtatatctctttccagtaaccaaaacttatttgcaattgctgaattgcatttctat

SEQ ID NO: 13158 - DNA, 783 bp, Gossypium hirsutum
cctctctttctaccatttgcttcaaaatcaaattcaaaatctctctgcgattttctccaaagggatcagcaattagggaagagaaatggggctgacattcacgaagctttttagccggctttttgctaagaaggagatgcggattttgatggtgggtctcgatgcagccggtaagacaaccatcttgtacaagctcaagcttggagaaattgttaccaccattcctaccatcggatttaatgtggagactgtggaatataagaacatcagtttcactgtgtgggatgttggtggtcaggacaagattcgtccgttgtggaggcattacttccagaatacacagggtctcatcttcgtggttgacagcaacgacagagaccgtgttgttgaggctagggatgaattgcatagaatgttgaatgaggatgagctgcgagatgcagtattgcttgtatttgcaaacaagcaggatcttccaaacgcaatgaatgctgctgaaataactgataagcttggtcttaattcccttcgacagcgtcactggtacattcagagcacctgtgcaacatctggtgaagggctctatgagggtctggattggctttcaaacaacatagctaacaaggcctgaagccattaaagaaggggtatttgcaatatcaaaaaattctggatgcagggtgaacattatctagtcttattttcttcaattattattatgccctcattttccgactgtgacagctggattgttgttatgcgttcttatttggagatgaccat

SEQ ID NO: 13159 - DNA, 804 bp, Cyamopsis tetragonoloba
gcgttttgctcttctcctggaaaacttcagaaacgggaagagcgattggtgtgagcgaagatggggttgacgttcacgaagctgtttagcaggcttttcgcgaagaaggaaatgagaattctgatggtaggtcttgatgctgctggtaagacaaccatcttatacaagctcaagttgggagaaatcgtcaccactatccctaccatcggatttaatgttgagactgttgagtacaagaacatcagctttactgtgtgggatgttgggggccaagacaagattcgtccattatggaggcactacttccagaacactcagggtcttatttttgtggttgatagcaatgatagagatcgagtggttgaggcaagggatgagctgcacaggatgttgaatgaggatgaacttagagaagctgttttgcttgtttttgccaacaaacaagatcttcccaatgcaatgaatgctgcagaaataactgacaagcttggacttcattcactccgccaacgccactggtatatccagagcacttgtgcaacttctggagagggtctctacgagggtttagattggctttctaacaacattgccaacaaggcatgaatcagttgaaaatttttgctgtagtccgttgatttcaagcgagtcaagtagttcttggaggaggatgctttcccctttaactgaatgtcttaatagcagaatgttgctagagattttatcattttacattgtaacttgagtttgtttgattacttaaattagctaatacttttagctataattggaactcttgcaaaa

SEQ ID NO: 13160 - DNA, 1337 bp, Cycas rumphii
attttcctttggccaaatgcgcgctcgggcatgttacatgacttagatctcaacagcaaccggttcgacgttcacaaggagcgtaggaagtaaccgctatatctcgacgcggtcattgtaggttggttatagttaacccgagttaaagttctctactataaaagtatacgatagaggatgaccagacttgcatctcagtagattttgctgcatctgtgggagaagaagatatctgaggcatctgccctgtgttctgcgatctgcgagctataaacatggggctgactttcaccaagcttttccagcggttgtttgcgaagaaggagatgcgcattcttatggttggtcttgatgcagctggaaagaccaccattttgtataagctcaagctgggagagattgttacaacaattccaaccattggcttcaatgtggagaccgtggaatacaagaatattagcttcactgtttgggatgttggaggtcaagacaagatccgaccactgtggagacactacttccagaatacccagggtcttatctttgtggtggacagcaatgatagagaccgtgtagttgaggcaagagatgagttgcacaggatgctgaatgaggatgaattacgagacgcagtcctgctcgtgtttgcaaataaacaggatcttccaaatgcaatgaatgctgcagagattactgacaagcttgggttgcactctttgcgccaacgtcattggtacatccagagcacatgtgctacatctggtgaaggcttgtatgagggcttggactggctttcaaacaacattgcaaataaggcttgaggatgaactgtggacctagattgtggtttagatatggggcaaattcatacagggcagtgatgataggttcaacaaccctcgtgatttatcttgaggatttacaatgagaacgagttttgcagtgacccaagagccccacttaacttatcaattattttgttcttattgatttgcctacttattttaattctgtaatcaaccaagaatccagggattttgaattgtgtttttgtattgtcaggtttgaagaggcaacttattcatatagtgcttattctgggcttttgcattctgtttttgagtgtgttcacatttgaagaagcaaactgttaatgtagagagctattcatggattttgcattctgttttagtattttgagaacattaatgtactgcatattaatgtgttgtgtagagttttaagtattgtaaggtttgaagcaaaaatttgtcagtgtagtaatggcacatgtttaagtgcttcaggaatttcacattttgatttccagatttgaa

SEQ ID NO: 13161 - DNA, 859 bp, Cynara scolymus
actttggtggtagcgaccgacggctcccgatttcgaacactcttcgtcaccttttccggttgccggctgatcatacaaagatgggactgtcttttaccaagctattcagtcgcttgttcgctaagagggagatgcgtattctgatggttggtctcgatgcagctggtaaaaccacgattttgtacaagctcaagttgggggaaattgtcaccaccatccctactattggattcaatgttgaaactgtagagtacaagaacatcagcttcactgtgtgggatgtcggtggtcaagacaagattcgacctttgtggaggcactacttccagaacacacaaggtcttatctttgtggtggacagcaatgatcgtgaccgtgtggttgaggccagagatgagctacacagaatgcttaatgaggacgaactaagagatgcagtgttgcttgtttttgctaacaaacaagatcttccaaatgctatgaatgctgctgagatcactgacaagctcggcctgcattctctccgacaacgacactggtatatccagagcacgtgtgccacctctggagaaggtctatatgagggactggattggctttccaacaacattgctaacaaggcttaaaagggagtgatacaaaggtggggtatacatgttagcagcagcatcaacagagcattttatggggttgttttttgttttatgtatgttgagagggaataggtgattgattcttctcatttctatcaagcagcaggcagcttaattcctagagatgaatgatgaatgaatatacagcacgtagacttgagtatgtattctgtgacaaagcttttattcagtataatgtattgaaa

SEQ ID NO: 13162 - DNA, 1069 bp, Cynodon dactylon
ccgggggtcaggcttcccttcctcctatatatccggttgccgtgcgcggcggcctgcctctctcctccctcccccattttgctttccccgcgatccgagcccgcgcccgcagggacgaagagaagcgatcacccgatcaccagggcgaggcatatctcgcgcgggagcggagatggggctcacgttcacgaagctgttcagccgcctcttcgccaagaaggagatgcggatcctcatggtcggtctcgacgcggccggtaagaccaccatcctatacaagctcaagctcggcgagatcgtcaccaccatccccaccatcggtttcaatgttgaaactgttgagtacaagaacattagcttcactgtgtgggatgtcgggggtcaggacaagatcaggcccctgtggaggcactacttccagaacacccagggcctcatttttgttgtggacagcaatgacagagagcgtgttgttgaggccagagatgagctccaccggatgctgaatgaggatgagctgcgtgatgctgtgctgctggtattcgcaaacaaacaagatcttcctaatgccatgaatgctgctgagatcactgacaagcttggcctgcattccttgcgccagcggcactggtacatccagagcacatgtgctacctctggtgagggtttgtatgaaggccttgactggctttccaacaacattgccaacaaggcttgaagcatcttggcaggggcttcaatcaaccaagatattcgagcgagcgcatggtgtctctaccatactatagtcatgacagtgacagatactgtggggtgtttttgggggaggataaagctcctttggtcaaggagctagctatcagattgttttcgtgtggtattgttaattgtctgagtttggtttctgagtgaaagttataccatgacggaatttgtgctgtgtacccgcgccagtcttgaggcgttgtagcatcgactgtctcttggcatagcttaatggtcgcgtaatttgttgtgtgcagcatcattatctcccgtctgctattccattttttaatctttgttctgt

SEQ ID NO: 13163 - DNA, 907 bp, Euonymus alatus
cggccgggggaagaacggacagatatttttctccctgtttgagagaagacgagaagaggtagatctctcttgttcgcattcctcgcctaaggcactctcctctcgggcttgaagaaaatggggctttcattcaccaagctttttagtcggctctttgccaagaaagagatgcgcatcctcatggtgggtcttgatgcggctggtaagaccaccattctctacaaactcaagttgggagagatagtgaccaccattcccactattgggtttaatgtggagactgtagaatacaagaacattagcttcacagtctgggatgttgggggccaggacaagatccgacctttgtggagacattacttccaaaatactcaagggcttatctttgtggttgatagcaatgaccgagaccgtgcggttgaggccagggatgagctacacaggatgttgaatgaggatgaattgagagaggcagtgttgctagtgtttgctaacaagcaagatctgccaaatgctatgaatgctgctgagataactgataagctcggtcttcactctctccgtcagcgccactggtatatccagagtacatgcgccacttctggtgaggggctgtacgaaggacttgactggctctcaaataatattgcaagcaaggcatagactgccaaaatctaagttttgtattgcagcaagttctggaacacagctggtcgttccgtatttcattttaccttatcattacttactaaatagaatcattgttacctttgttacttaattcatagaatatttgagtttttctcatacaaacgttgctattgtttacccggagttgcagaataattcaaattttgcatctttgcctattttacccgttcaagtctttgaatgaaactcatttgag

SEQ ID NO: 13164 - DNA, 953 bp, Fagopyrum esculentum
tccatataaatatcacctgatcgctagagaaagaagtcttctgaaatcacgagctgagccagtttacgggcagtttcccagatctgccttggtctccgaatcgatctcttcttgttctagcagtacacctctccaagatggggctctccttcaccaagcttttcagtaggctatttgccaagaaggagatgcgaattctcatggtaggtctcgatgcagctggtaagactaccattttgtacaagcttaagctgggagagattgtcacaaccattcctaccatcggattcaatgttgaaactgtggagtacaaaaacattagcttcactgtttgggatgttggaggtcaagacaagatccgtccattgtggagacactatttccagaatacccaagggctaatctttgttgtggatagcaatgatcgtgaccgtgttgttgaagctagagatgaactgcatagaatgctgaatgaagatgaattgagggatgcagttcttcttgtgtttgccaacaaacaagatcttccaaatgcaatgaatgcagcagagattactgacaagctcggtctccactctcttcgtcagcgccattggtatatccagagcacctgtgcaacttccggggaaggactatacgaagggctcgattggctctcgaacaacatcgccaataagtcttaaaggagaagcggcttgcagcttgcagcttgcagcgttagcgaacggttgacaaaaaattgaagcaaagagtgaatggtgcgtttgatttctttccatgtgtaaacgttttgaaaacttgtttttgagatcacaatagtagtgtttgaagatattgttatcttgttgtagatccaggtacttttccaacattatttcgatatacggaataattttacattattcatataatcttctccaaaagagttatagatccacggtgattatttgctt

SEQ ID NO: 13165 - DNA, 813 bp, Fagopyrum esculentum
aatcacgagctgaaccggtttgcgggcagtttcccagatctgcctcggcctccgaattcgatctctccttccgagttctagcagtacaccaatatggggctctccttcaccaagctcttcagtaggctttttgccaagaaggagatgcgaattctcatggtaggtctcgatgcggctggtaagactaccattttgtacaagcttaagctgggagaaattgtcacaaccattcctaccattggattcaacgttgaaactgtggagtacaaaaacattagcttcactgtttgggatgttgggggtcaagacaagatccgtccattgtggagacactatttccagaacacccaagggctaatttttgtggttgatagcaatgatcgtgatcgtgttgttgaagctagagatgaacttcacagaatgctgaatgaagatgaattgagggatgcagtgctccttgtgtttgccaacaaacaagatcttccaaatgcaatgaatgcagctgagattactgacaagcttggcctccactctcttcgtcagcgccattggtatattcagagcacctgtgcaacttccggagaaggactatatgaagggctcgattggctatcgaacaacattgcaaataagtcttaaagatgatgcagcttgaaatttgcagcgctagctaatggttgacagaagtttgagttaaagatcgaatggtgcgtttgattcctttccgtatggaaacgtttttaaaacttgtttttgagatcacagatagtagtgtgtgaagaaattgtcatcttgttgtagatccaggtactt

SEQ ID NO: 13166 - DNA, 860 bp, Fagopyrum esculentum
acgagctgaaccggtttacgggcagtttcccagatctgcctcggcctccaaattcgatctctctttctgagttctagcagtacaccacgcattgtagcaagatggggctctccttcaccaagcttttcagtaggctatttgccaagaaggagatgcgaattctcatggtaggtctcgatgcggctggtaagactaccattttgtacaagcttaagctgggagaaattgtcacaaccattcctaccattggattcaacgttgaaactgtggagtacaaaaacattagcttcactgtttgggatgttgggggtcaagacaagatccgtccattgtggagacactatttccagaacacccaagggctaatttttgtggtggatagcaacgatcgtgatcgtgttgttgaagctagagatgaacttcatagaatgctgaatgaagatgaattgagggatgcagtgctccttgtgtttgccaacaaacaagatcttccaaatgcaatgaatgcagctgagattactgacaagcttggcctccactctcttcgccagcgccattggtatattcagagcacctgtgcaacctctggggaaggactatatgaagggctcgattggctatcaaacaacattgccaataagtcttaaagatgatgcagcttgaaatctgcagcgttagcggatgttgacagaagtttgaattaaagattgaatggtgcgtttgatttctttctatatgtaaacgttttaaaaacttgtttttgagatcacagatagtagtgtgtgaagaaattgtcatcttgttgtagatccagatactttgaaacaaaatttctatatggggaataacattatgttatt

SEQ ID NO: 13167 - DNA, 889 bp, Fraxinus spp
aaataattataaatccctagcgttaatctcaagcagctccatatttctctctaacttcgcttccgaactaatttttcaggggtcaaaagcaagaaagagaaatggggttgacattcacgaagttgttcagccggctttttgccaagagggagatgcggattctgatggttggtctcgatgcagctggtaagaccaccatcctgtacaagctcaagcttggagagatagtcactaccattcccaccattggtttcaatgtggaaactgttgagtacaagaacatcagcttcaccgtttgggatgttgggggtcaggacaagatccgtccattgtggaggcactacttccaaaacacacagggtctcatatttgtggtggatagcaatgatagagaccgtgtggtggaggcaagagatgaattgcataggatgttgaatgaggacgagctaagagatgcagtattacttgtatttgccaacaaacaagatcttcctaatgcaatgaatgctgctgaaataactgataagctcggcctgcactcgttgaggcagcgtcactggtacatccagagcacctgtgctacatctggagaggggctttacgaggggcttgattggctctctaataacattgctaacaaggcatagaactttatgcagttacttatgctgagttgatgatgggtgaggtggttttatctagtcttatatctctagtctgcgtggttatggatttttcacttttcatgtcttttttcgttaggaccttatataatggttggctgtgatgtgctggtttgttttatatgataaaaatatgtttgtttagatttgaatgtaatgctgttaaacccgcatatgaatcgatcgaagatcacccgttttgatgg

SEQ ID NO: 13168 - DNA, 827 bp, Zingiber officinale
gcacgaggcctttctggtgcgttcagatcttcttagaatcatgggactcacgtttgcgaagctttttagccgcttatttgcgaagaaggagatgaggattctgatggtggggcttgatgctgctggaaagacaaccatcctttacaagctcaagcttggggagattgtcaccaccattcctaccatcggcttcaatgtagagactgttgaatacaagaacattagcttcactgtatgggatgttggtggtcaagataagatcagacctctctggaggcattatttccaaaatacacaaggccttatttttgttgttgatagcaatgaccgagatcgtgttgttgaggcaagggatgaactccacaggatgctcaatgaggatgagttaagggatgctgtcttacttgtctttgctaacaaacaagaccttccaaatgcaatgaatgctgctgaaatcactgataagcttggtctgcattctctgcgtcagcgacactggtatatacagagtacttgtgctacatctggggagggtttgtacgaggggcttgattggctctccaacaacatagccaataagtaatagatgttgcttgatggacaaagtagcactcggcatttgccacacggtttgatgttttgtgtatgatatggatgaagatagctctaataagttgcttgttatctttcgtattgtgtatttgtaccctggatttcttccacgtgctgcatttttgctgttaggatatattgtttagtagaaacatgtcttttaattcatttgccaccttgtactactcggttggttaggctgtttcgtgttaatc

SEQ ID NO: 13169 - DNA, 933 bp, Panax ginseng
aagcagtggtatcaacgcagagtacatggggatctctgctccgtatctgataggtgttcggtggtggacgacagctccattcgagatctctgattcttttgctcgtatcgctcacctcattatacaaagatggggttgtctttcaccaagcttttcagtcgcctgtttgctaagaaagaaatgcgtattctaatggttggtctcgatgctgctggtaaaaccacaattttgtacaagctcaagttgggagaaatcgtcaccactatccctacaattggctttaatgttgagactgttgagtacaagaacattagtttcactgtgtgggatgttggtggtcaggacaagatccgaccgttgtggaggcactacttccaaaacacacaggggcttatctttgtggttgacagcaatgatcgagaccgtgtggttgaggctaaagatgaactgcacaggatgttgaatgaggatgaattgagagatgctgtgctccttgtgtttgcaaacaagcaggatcttccaaatgccatgaatgctgctgagatcaccgacaagcttggtttgcattctcttcgacagcggcactggtatattcagagcacatgtgccacatctggagaaggtctatacgagggactggattggctttcaaacaatattgctaacaaagcttgatggactactctgctggttcagttggtactttatgaagtgtatgggtgcagttatcgtctgggtataggtgttgctacaattattatttctataattgcttttgatgttttggattctctttttccatgttgtgctgcaattacatataggatttattgttcctttttgagttgtaaagctttatgccagggctctggtggattgctattaaagtagttatacaagctactgggtttatatcagttttttatcctattt

SEQ ID NO: 13170 - DNA, 728 bp, Panax ginseng
aagcagtggtatcaacgcagagtacatggggctcctcctccgcatctgatagacagagcggttttttggaacgacagctacatttagagatctctgcattctaacgctcccatcgcgcacctcatcctcaatatagagatggggctgtcttttaccaagcttttcagtcgcctatttgctaagagagaaatgcgcattctaatggttggtctcgatgccgctggtaaaaccacaattttgtacaagctcaagttgggtgaaattgtcaccactatccctacaattggctttaatgtggagactgttgaatacaagaacattagcttcactgtgtgggatgttggtggtcaggacaagatccgacctttgtggaggcactatttccaaaacacacaagggctcatctttgttgttgacagcaatgatcgagaccgtgtggtcgaggctagagatgaactgcacaggatgttgaatgaggatgaactgagagatgctgtactccttgtgtttgcaaacaagcaagatcttccaaatgccatgaatgctgctgagattactgacaagcttggcttgcattctcttcgacaacgacattggtatattcagagcacatgcgccacatctggagaaggtctatacgagggactggattggctttcaaacaatattgctaacaaggcttagtgggctactctaccggctcagttggtactcaaagaaatacattg

SEQ ID NO: 13171 - DNA, 987 bp, Panax ginseng
aagcagtggtatcaacgcagagtacatggggctcctcctccgcatctgatagacagagcggttttttggaacgacagctacatttagagatctctgcattctaacgctcccatcgcgcacctcatcctcaatatagagatggggctgtcttttaccaagcttttcagtcgcctatttgctaagagagaaatgcgcattctaatggttggtctcgatgccgctggtaaaaccacaattttgtacaagctcaagttgggtgaaattgtcaccactatccctacaattggctttaatgtggagactgttgaatacaagaacattagcttcactgtgtgggatgttggtggtcaggacaagatccgacctttgtggaggcactatttccaaaacacacaagggctcatctttgttgttgacagcaatgatcgagaccgtgtggtcgaggctagagatgaactgcacaggatgttgaatgaggatgaactgagagatgctgtactccttgtgtttgcaaacaagcaagatcttccaaatgccatgaatgctgctgagattactgacaagcttggcttgcattctcttcgacaacgacattggtatattcagagcacatgcgccacatctggagaaggtctatacgagggactggattggctttcaaacaatattgctaacaaggcttagtgggctactctaccggctcagttggtactcaaagaaatacattggtgcagtcaatctggttataagtgttgttgcaatgactctttgtataattgcttttggtggtttggatttcaatttcttgtcgtggtgagaggaaaaagatgatgtattatgactctgttaaatttccctttgacttatctgcttaataatatacatagtattacaaataggatttattgctcctttttgagttgtaaagcttttcatgccagtgctcttgtggaatgctactatgaactaattatagcttggtttata

SEQ ID NO: 13172 - DNA, 829 bp, Panax ginseng
tatattgtttgtcgcggaggaagatagagagagaaacaaaagagagaaaaagagaggaagatatctctgtttctttctcgtcgtatttccaattcattcgcttccttctgtaggagtagctaagatggggctgtctttcaccaagctcttcagtcggctgtttgcgaagaaagagatgcgcatactgatggtgggtctcgatgcagctggtaaaacaaccattctttacaagctcaagttgggagagatagttacaacaattcctaccattggatttaatgtggagaccgtggaatataagaacattagcttcaccgtttgggatgttggtggccaggacaagatccgtcctttgtggagacattacttccaaaacactcagggtctcatctttgtggttgatagcaatgatcgagatcgtgtggttgaagccagggatgaacttcacagaatgctgaatgaggatgagttaagggatgccgtgctacttgtatttgcaaacaagcaagatcttcccaatgcaatgaatgctgctgagattactgataaacttagccttcactctctccgtcagcgccactggtatatccagagcacatgtgccacttctggtgaagggttgtatgaggggctggactggctctcaaacaacattgcaaacaaggcatagaggctgctgaatctgtgtttggatcgtgattatagccagataaaggagtttgtcgtatttctttgtgtttctgaaatcttgtaacatagagtttttcatttttgtttgttttgaaatctgtaccatgttgatgtttacctatttacaatctcttctcaa

SEQ ID NO: 13173 - DNA, 1028 bp, Panax ginseng
gagattctcgtctctcaaaacctctgactccatcttgaaatcaatcctcagtgaagctttgaaaagtgttgagtgaagatggggctatctttcacgaaactgttcagcaggctctttgcgaagaaagagatgcgcattctgatggtaggtcttgatgctgctggtaagactaccatcttgtataagctcaaacttggagaaattgtcacaacaatccctacaattggatttaatgttgagactgtggaatacaaaaacattagcttcactgtttgggatgttggaggccaggacaagatccgtccattgtggaggcactacttccagaacacacaaggtcttatctttgtggtggatagcaatgacagagatagagttgttgaggcgagggatgagttgcataggatgttgaatgaggatgaacttagggatgctgttttgcttgtctttgccaacaaacaagatatgcccaatgcaatgaatgctgcggagataacagacaagcttggtcttcattctctccgtcaacgtcactggtacattcagagcacatgtgccacctcaggtgagggactttatgaagggctggattggctttctaacaacattgctaacaaggcatgagctgaatgagttcagttgccaatgggattttccatgaatccattggatagatactattaggccttgtatgagatgtatgaagacgatgcttgtccctgtattttcaagagatgtagcaatctgggtgcttttgaagttattgtctgcttgataccgttgctggtttggttattactcgactgcaaaagatgctcttattatgctatagtaattttatgtccaatgaactacacgatagtatgtgttaagacttgtggaagtgttaaatgatctacacttcagtaaatgttaagaagtatggaactggttaataccttttcaatggactagatttattgcccaaccttgtattgagtaatggaacttgtaggctacagtcaagccattcagtctgtctttatttt

SEQ ID NO: 13174 - DNA, 912 bp, Panax ginseng
cgacagctccatttagagatctctgcattctaacgctcccatcgcgcacctcatcctcaatatagagatggggctgtcttttaccaagcttttcagtcgcctatttgctaagagagaaatgcgcattctaatggttggtctcgatgccgctggtaaaaccacaattttgtacaagctcaagttgggtgaaattgtcaccactatccctacaattggctttaatgtggagactgttgaatacaagaacattagcttcactgtgtgggatgttggtggtcaagacaagatccgacctttgtggaggcactatttccaaaacacacaagggctcatctttgttgttgacagcaatgatcgagaccgtgtggtcgaggctagagatgaactgcacaggatgttgaatgaggatgaactgagagatgctgtactccttgtgtttgcaaacaagcaagatcttccaaatgccatgaatgctgctgagattactgacaagcttggtttgcattctcttcgacaacgacattggtatattcagagcacatgcgccacatctggagaaggtctatacgagggactggattggctttcaaacaatattgctaacaaggcttagtgggctactctaccggctcagttggtactcaaagaaatacattggtgcagtcaatctggttataagtgttgttgcaatgactctttgtataattgcttttggtggtttggatttcaatttcttgtcgtggtgagagaggaaaaagatgatgttaaatttccctttggcttatctgcttaataatatacatagtattacaaataggatttattgctcctttttgagttgtaaagcttttcatgccagtgctcttgtggaatgctactatgaactaattatagcttggtttatatcatttt

SEQ ID NO: 13175 - DNA, 833 bp, Panax ginseng
gcatctgatagacagagcggttttttggaacgacagctccatttagagatctctgcattctaacgctcccatcgcgcacctcatcctcaatatagagatggggctgtcttttaccaagcttttcagtcgcctatttgctaagagagaaatgcgcattctaatggttggtctcgatgccgctggtaaaaccacaattttgtacaagctcaagttgggtgaaattgtcaccactatccctacaattggctttaatgtggagactgttgaatacaagaacattagcttcactgtgtgggatgttggtggtcaagacaagatccgacctttgtggaggcactatttccaaaacacacaagggctcatctttgttgttgacagcaatgatcgagaccgtgtggtcgaggctagagatgaactgcacaggatgttgaatgaggatgaactgagagatgctgtactccttgtgtttgcaaacaagcaagatcttccaaatgccatgaatgctgctgagattactgacaagcttggtttgcattctcttcgacaacgacattggtatattcagagcacatgcgccacatctggagaaggtctatacgagggactggattggctttcaaacaatattgctaacaaggcttagtgggctactctaccggctcagttggtactcaaagaaatacattggtgcagtcaatctggttataagtgttgttgcaatgactctttgtataattgtcttttggtggtttggatttctaatttcttgtcgtggtgagagaggaaaagctagtatagttaatttcctttgtacttatctgtcttaatataac

SEQ ID NO: 13176 - DNA, 1012 bp, Panax ginseng
aagcagtggtatcaacgcagagtacatggggcctcctccgcatctgatagacagcggttttttggaacgacaactccatttagagatctctgcattccaacgctcccatcgcccacctcatactcaatatagagatggggctgtcttttaccaagcttttcagtcgcctatttgctaagagagaaatgcgcattctaatggttggtctcgatgccgctggtaaaaccacaattttgtacaagctcaagttgggtgaaattgtcaccactatccctacaattggctttaatgtggagactgttgaatacaagaacattagcttcactgtgtgggatgttggtggtcaggacaagatccgacctttgtggaggcactatttccaaaacacacaagggctcatctttgttgttgacagcaatgatcgagaccgtgtggttgaggctagagatgaactgcacaggatgttgaatgaggatgaactgagagatgctgtactccttgtgtttgcaaacaagcaagatcttccaaatgccatgaatgctgctgagattactgacaagcttggtttgcattctcttcgacaacgccattggtatattcagagcacatgcgccacatctggagaaggtctatacgagggactggattggctttcaaacaacattgctaacaaggcttaatgggctactctaccggctcacttggtactcaaagaaatacattggtgcagtcaatctggttacaagtgttgttgcaattactctttgtataattgcttttggtggtttggatttcagtttcttgtcgtggtgagagaggaaaaagatgatgtattatgactgtgttaaatttccctttgaattatctgcttaataatatacatagtattacaaataggatttattgctcctttttgagttgtaaagcttttcatgccagtgctctggtggaatgctactatgaactaattatagcttggttttatatcatttttccctcagtgcagtaccaa

SEQ ID NO: 13177 - DNA, 898 bp, Panax ginseng
ggactgaaagagagtataaataaagaattcatattcctcggtacctgggaacttgtataagggcagtctccaaagatctgccccccttctctcttcgtccaaattcgcatagctatttgttgatcatcatacttgaaagatgggtttgtcttttaccaagctctttagtcggttgtttgcgaagaaggagatgcgtatacttatggtgggtcttgatgctgctggtaagaccaccatattgtacaagcttaaactgggagagattgttaccaccattcctacaattggatttaatgtggagactgtggaatataagaacattagcttcaccgtttgggatgttggtggtcaagacaagattcgacccttgtggagacactacttccagaatactcaggggcttatatttgtggttgatagcaatgatagggaacgtgtggttgaggctagggatgagcttcacaggatgttgaatgaggatgagttgagggatgctgtgctgcttgtttttgctaacaaacaagatcttccaaatgctatgaatgctgctgagataactgacaagctaggtcttcactccctcaggcaacgccactggtatattcagagcacatgtgccacctctggggaagggctgtacgaggggctggactggctctccaacaatattgctaacaaggcttgatggtatgatttttgagctgaagtatctatatggagatgctaatgtatttcttggcattttgtaatttgttcatcttattacttcctgtgaatgatttgtttgtcttggtaagtttattattatgacagttactggcatttctcacttatccatgtagcttcagataaattcttgttagttttgcacggacttctgttgatgtgattatatttt

SEQ ID NO: 13178 - DNA, 890 bp, Panax ginseng
ccgattctccggtatattgtttgtcgcggaggaagatagagagagaaacaaaagagagaaaaagagaggaagatatctctgtttctttctcgtcgtatttccaattcattcgcttccttctgtaggagtagctaagatggggctgtctttcaccaagctcttcagtcggctgtttgcgaagaaagagatgcgcatactgatggtgggtctcgatgcagctggtaaaacaaccattctttacaagctcaagttgggagagatagttacaacaattcctaccattggatttaatgtggagaccgtggaatataagaacattagcttcaccgtttgggatgttggtggccaggacaagatccgtcctttgtggagacattacttccaaaacactcagggtctcatctttgtggttgatagcaatgatcgagatcgtgtggttgaagccagggatgaacttcacagaatgctgaatgaggatgagttaagggatgccgtgctacttgtatttgcaaacaagcaagatcttcccaatgcaatgaatgctgctgagattactgataaacttagccttcactctctccgtcagcgccactggtatatccagagcacatgtgccacttccggtgaagggctgtacgaggggctggactggctctcaaacaacattgcaaacaaggcataggctgctgaatgtgagtttggatcgtgattatagccagatggagtttgtttgtgtttctgaaatagagtttttcatttttgtttgttttgaaatctgtaccatgttataatgtttacctatttacaatctcttctcaagatatcgtcatttgctcctttgcatatttaaatcaatttgctgctatgcctttctcgggcaaattgatacg

SEQ ID NO: 13179 - DNA, 1015 bp, Panax ginseng
aagcagtggtatcaacgcagagtacatggggctcctccgcatctgatagacagagcggttttttggaacgacagctacatttagagatctctgcattctaacgctcccatcgcgcacctcatcctcaatatagagatggggctgtcttttaccaagcttttcagtcgcctatttgctaagagagaaatgcgcattctaatggttggtctcgatgccgctggtaaaaccacaattttgtacaagctcaagttgggtgaaattgtcaccactatccctacaattggctttaatgtggagactgttgaatacaagaacattagcttcactgtgtgggatgttggtggtcaggacaagatccgacctttgtggaggcactatttccaaaacacacaagggctcatctttgttgttgacagcaatgatcgagaccgtgtggttgaggctagagatgaactgcacaggatgttgaatgaggatgaactgagagatgctgtactccttgtgtttgcaaacaagcaagatcttccaaatgccatgaatgctgctgagattactgacaagcttggtttgcattctcttcgacaacgccattggtatattcagagcacatgcgccacatctggagaaggtctatacgagggactggattggctttcaaacaacattgctaacaaggcttaatgggctactctaccggctcacttggtactcaaagaaatacattggtgcagtcaatctggttacaagtgttgttgcaattactctttgtataattgcttttggtggtttggatttcagtttcttgtcgtggtgagagaggaaaaagatgatgtattatgactgtctgttaaatttccctttgaattatctgcttaataatatacatagtattacaaataggatttattgctcctttttgagttgtaaagcttttcatgccagtgctctggtggaatgctactatgaactaattatagcttggttttatatcatttttccctcagtgcagtaccaa

SEQ ID NO: 13180 - DNA, 1292 bp, Panax ginseng
aagcagtggtatcaacgcagagtacatggggactacgtactcatctgataggtgttcggtggtggacgacagctccattcgagatctctgatactcttactcgtgtcgctcacctcatcatacaaagatggggttgtctttcaccaagcttttcagtcgcctgtttgctaagaaagaaatgcgtattctaatggttggtctcgatgctgctggtaaaaccacaattttgtacaagctcaagttgggagaaattgtcaccactatccctacaattggctttaatgttgagactgttgagtacaagaacattagtttcactgtgtgggatgttggtggtcaggacaagatccgaccgttgtggaggcactacttccaaaacacacaggggcttatctttgtggttgacagcaatgatagagaccgtgtggttgaggctaaagatgaactgcacaggatgttgaatgaggatgaattgagagatgctgtgctccttgtgtttgcaaacaagcaggatcttccaaatgccatgaatgctgctgagatcactgacaagcttggtttgcattctcttcgacagcggcactggtatattcagagcacatgtgccacatctggagaaggtctatacgagggactggattggctttcaaacaatattgctaacaaagcttagtggactactctgatggttcagttggtactttatgaagtgtatgtgtgtgggtataggtgttgctacaattattatttctataattggttttgatgttttggattctctttttccatgttgtgctgcaattacaatttacatataggatttattgttcctttttgagttgtaaagctttatgccagattgccagggctctggtggattgctattaaagtagttatacaacaagctactgggtttatatacaaaaaaaaaaaaaaaaaaaaaaaaaaaaaaaaaaaaaaaaaaaaaaaaaaaaaaaaaaaaaaaaaaaaaaacaaaaaaaaacaaaaaaaaacaaaaaaacaaaaaacaaaaacaaactaactaatactactactactactactactactactactacgtaacgacgaacgtactacacacatagtagtagacgtacgtactacgtactacgtactaactaactactactactaactactactactactacttactacgtacgtacgtacgtacgtacgtacgtacgtacgttacgtacgttacgttacgttacgttacgtacgtacgtacgacgtacgacgtaccgtaccgtacgacgacgacgacagcg

SEQ ID NO: 13181 - DNA, 872 bp, Panax ginseng
ataggtgttcggtggtggacgacagctccattcgagatctctgatactcttactcgtgtcgctcacctcatcatacaaagatggggttgtctttcaccaagcttttcagtcgcctgtttgctaagaaagaaatgcgtattctaatggttggtctcgatgctgctggtaaaaccacaattttgtacaagctcaagttgggagaaattgtcaccactatccctacaattggctttaatgttgagactgttgagtacaagaacattagtttcactgtgtgggatgttggtggtcaggacaagatccgaccgttgtggaggcactacttccaaaacacacaggggcttatctttgtggttgacagcaatgatagagaccgtgtggttgaggctaaagatgaactgcacaggatgttgaatgaggatgaattgagagatgctgtgctccttgtgtttgcaaacaagcaggatcttccaaatgccatgaatgctgctgagatcactgacaagcttggtttgcattctcttcgacagcggcactggtatattcagagcacatgtgccacatctggagaaggtctatacgagggactggattggctttcaaacaatattgctaacaaagcttagtggactactctgatggttcagttggtactttatgaagtgtatgggtgtggttgtgtgtgggtataggtgttgctacaattattatttctataattggttttgatgttttggattctctttttccatgttgtgctgcaattacaatttacatataggatttattgttcctttttgagttgtaaagctttatgccagattgccagggctctggtggattgctattaaagtagttatacaacaagctac

SEQ ID NO: 13182 - DNA, 1048 bp, Panax ginseng
tatattctatctagtggaaagcagtggtatcaacgcagagtacatggggctcctccgcatctgatagacagagcggttttttggaacgacagctacatttagagatctctgcattctaacgctcccatcgcgcacctcatcctcaatatagagatggggctgtcttttaccaagcttttcagtcgcctatttgctaagagagaaatgcgcattctaatggttggtctcgatgccgctggtaaaaccacaattttgtacaagctcaagttgggtgaaattgtcaccactatccctacaattggctttaatgtggagactgttgaatacaagaacattagcttcactgtgtgggatgttggtggtcaggacaagatccgacctttgtggaggcactatttccaaaacacacaagggctcatctttgttgttgacagcaatgatcgagaccgtgtggttgaggctagagatgaactgcacaggatgttgaatgaggatgaactgagagatgctgtactccttgtgtttgcaaacaagcaagatcttccaaatgccatgaatgctgctgagattactgacaagcttggtttgcattctcttcgacaacgccattggtatattcagagcacatgcgccacatctggagaaggtctatacgagggactggattggctttcaaacaacattgctaacaaggcttaatgggctactctaccggctcacttggtactcaaagaaatacattggtgcagtcaatctggttacaagtgttgttgcaattactctttgtataattgcttttggtggtttggatttcagtttcttgtcgtggtgagagaggaaaaagatgatgtattatgactgtgttaaatttccctttgaattatctgcttaataatatacatagtattacaaataggatttattgctcctttttgagttgtaaagcttttcatgccagtgctcttgtggaatgctactatgaactaattatagcttggtttatatcatttttccctcagtgcagtaccaattttaccggcttcattaa

SEQ ID NO: 13183 - DNA, 852 bp, Panax ginseng
aacttgtataagggcagtctccaaagatctgccccccttctctcttcgtccaaattcgcatagctatttgttgatcatcatacttgaaagatgggtttgtcttttaccaagctctttagtcggttgtttgcgaagaaggagatgcgtatacttatggtgggtcttgatgctgctggtaagaccaccatattgtacaagcttaaactgggagagattgttaccaccattcctacaattggatttaatgtggagactgtggaatataagaacattagcttcaccgtttgggatgttggtggtcaagacaagattcgacccttgtggagacactacttccagaatactcaggggcttatatttgtggttgatagcaatgatagggaacgtgtggttgaggctagggatgagcttcacaggatgttgaatgaggatgagttgagggatgctgtgctgcttgtttttgctaacaaacaagatcttccaaatgctatgaatgctgctgagataacggacaagctaggtcttcactccctcaggcaacgccactggtatattcagagcacatgtgccacctctggggaagggctgtacgaggggctggactggctctccaacaatattgctaacaaggcttgatggtatgatttttgagctgaagtatctatatggagatattaatgtatttcttgacattttgtaatttgttcatcttacttcctgtgaatgatttgtttgtctgggtaagtttattattatgacagttactggcatttctcacttatccatgtagcttcagataaattcttgttagttttgcacggacttctgttgatgtgattatattttctgaaa

SEQ ID NO: 13184 - DNA, 703 bp, Panax ginseng
catctgatagacagagcggttttttggaacgacaactccatttagagatctctgcattccaacgttcccatcgcccacctcatcctcaatatagagatggggctgtcttttaccaagcttttcagtcgcctatttgctaagagagaaatgcgcattctaatggttggtctcgatgccgctggtaaaaccacaattttgtacaagctcaagttgggtgaaattgtcaccactatccctacaattggctttaatgtggagactgttgaatacaagaacattagcttcactgtgtgggatgttggtggtcaggacaagatccgacctttgtggaggcactatttccaaaacacacaagggctcatctttgttgttgacagcaatgatcgagaccgtgtggttgaggctagagatgaactgcacaggatgttgaatgaggatgaactgagagatgctgtactccttgtgtttgcaaacaagcaagatcttccaaatgccatgaatgctgctgagattactgacaagcttggtttgcattctcttcgacaacgccattggtatattcagagcacatgcgccacatctggagaaggtctatacgagggactggattggctttcaaacaacattgctaacaaggcttaatgggctactctaccggctcacttggtactcaaagaaatacattggtgcagtcaatctggtt

SEQ ID NO: 13185 - DNA, 765 bp, Panax ginseng
gtcgtattaccaattcattcgcttccttctgtaggagtagctaagatggggctgtctttcaccaagctcttcagtcggctgtttgccaagaaagaaatgcgcatactgatggtgggtctcgatgcagctggtaaaacaaccattctttacaagctcaagttgggagagatagttacaacaattcctaccattggatttaatgtggagaccgtggaatataagaacattagcttcaccgtttgggatgttggtggccaggacaagatccgtcctttgtggagacattacttccaaaacactcagggtctcatctttgtggttgatagcaatgatcgagatcgtgtggttgaagccagggatgaacttcacagaatgctgaatgaggatgagttaagggatgccgtgctacttgtatttgcaaacaagcaagatcttcccaatgcaatgaatgctgctgagattactgataaacttagccttcactctctccgtcagcgccactggtatatccagagcacatgtgccacttctggtgaagggttgtatgaggggctggactggctctcaaacaacattgcaaacaaggcatagaggctgctgaatctgtgtttggatcgtgattatagccagataaaggagtttgtcgtatttctttgtgtttctgaaatcttgtaacatagagtttttcatttttgtttgttttgaaatctgtaccatgttgatgtttacctatttacaatctcttctcaagatattgtcatttgc

SEQ ID NO: 13186 - DNA, 1121 bp, Panax ginseng
ggaaggagagaagagattctcgtctctcaaaacctctgactccatcttgaaatcaatcctcagtgaagctttgaaaagtgttgagtgaagatggggctatctttcacgaaactgttcagcaggctctttgcgaagaaagagatgcgcattctgatggtaggtcttgatgctgctggtaagactaccatcttgtataagctcaaacttggagaaattgtcacaacaatccctacaattggatttaatgttgagactgtggaatacaaaaacattagcttcactgtttgggatgttggaggccaggacaagatccgtccattgtggaggcactacttccagaacacacaaggtcttatctttgtggtggatagcaatgacagagatagagttgttgaggcgagggatgagttgcataggatgttgaatgaggatgaacttagggatgctgttttgcttgtctttgccaacaaacaagatatgcccaatgcaatgaatgctgcggagataacagacaagcttggtcttcattctctccgtcaacgtcactggtacattcagagcacatgtgccacctcaggtgagggactttatgaagggctggattggctttctaacaacattgctaacaaggcatgagctgaatgagttcagttgccaatgggattttccatgaatccattggatagatactattaggccttgtatgagatgtatgaagacgatgcttgtccctgtattttcaagagatgtagcaatctgggtgcttttgaagttattgtctgcttgataccgttgctggtttggttattactcgactgcaaaagatgctcttattatgctatagtaattttatgtccaatgaactacacgatagtatgtgttaagacttgtggaagtgttaaatgatctacacttcagtaaatgttaagaagtatggaactggttaataccttttcaatggactagatttattgcccaaccttgtattgagtaatggaacttgtaggctacagtcaagccattcagtctgtctttatttttcgtttggagtatgtttatttgcaatgattatacttaggatatgattattaattttaagtgtctcgtttgtttttaaattt

SEQ ID NO: 13187 - DNA, 890 bp, Panax ginseng
aggtgttcggtggtggacgacagctccattcgagatctctgatactcttactcgtgtcgctcacctcatcatacaaagatggggttgtctttcaccaagcttttcagtcgcctgtttgctaagaaagaaatgcgtattctaatggttggtctcgatgctgctggtaaaaccacaattttgtacaagctcaagttgggagaaattgtcaccactatccctacaattggctttaatgttgagactgttgagtacaagaacattagtttcactgtgtgggatgttggtggtcaggacaagatccgaccgttgtggaggcactacttccaaaacacacaggggcttatctttgtggttgacagcaatgatagagaccgtgtggttgaggctaaagatgaactgcacaggatgttgaatgaggatgaattgagagatgctgtgctccttgtgtttgcaaacaagcaggatcttccaaatgccatgaatgctgctgagatcactgacaagcttggtttgcattctcttcgacagcggcactggtatattcagagcacatgtgccacatctggagaaggtctatacgagggactggattggctttcaaacaatattgctaacaaagcttagtggactactctgatggttcagttggtactttatgaagtgtatgggtgtggttgtgtgtgggtataggtgttgctacaattattatttctataattggttttgatgttttggattctctttttccatgttgtgctgcaattacaatttacatataggatttattgttcctttttgagttgtaaagctttatgccagattgccagggctctggtggattgctattaaagtagttatacaacaagctactgggtttatatcagtttttt

SEQ ID NO: 13188 - DNA, 869 bp, Panax ginseng
atctgatagacagagcggttttttggaacgacaactccatttagagatctctgcattccaacgttcccatcgcccacctcatcctcaatatagagatggggctgtcttttaccaagcttttcagtcgcctatttgctaagagagaaatgcgcattctaatggttggtctcgatgccgctggtaaaaccacaattttgtacaagctcaagttgggtgaaattgtcaccactatccctacaattggctttaatgtggagactgttgaatacaagaacattagcttcactgtgtgggatgttggtggtcaggacaagatccgacctttgtggaggcactatttccaaaacacacaagggctcatctttgttgttgacagcaatgatcgagaccgtgtggttgaggctagagatgaactgcacaggatgttgaatgaggatgaactgagagatgctgtactccttgtgtttgcaaacaagcaagatcttccaaatgccatgaatgctgctgagattactgacaagcttggtttgcattctcttcgacaacgccattggtatattcagagcacatgcgccacatctggagaaggtctatacgagggactggattggctttcaaacaacattgctaacaaggcttaatgggctactctaccggctcacttggtactcaaagaaatacattggtgcagtcaatctggttacaagtgttgttgcaattactctttgtataattgcttttggtggtttggatttcagtttcttgtcgtggtgagagaggaaaaagatgatgtattatgactgtctgttaaatttaccctttgaattatctgcttaataatatacatagtattacaaataggatttatt

SEQ ID NO: 13189 - DNA, 792 bp, Panax ginseng
ctcctccgcatctgatagacagcggttttttggaacgacaactccatttagagatctctgcattccaacgttcccatcgcccacctcatcctcaatatagagatggggctgtcttttaccaagcttttcagtcgcctatttgctaagagagaaatgcgcattctaatggttggtctcgatgccgctggtaaaaccacaattttgtacaagctcaagttgggtgaaattgtcaccactatccctacaattggctttaatgtggagactgttgaatacaagaacattagcttcactgtgtgggatgttggtggtcaggacaagatccgacctttgtggaggcactatttccaaaacacacaagggctcatctttgttgttgacagcaatgatcgagaccgtgtggttgaggctagagatgaactgcacaggatgttgaatgaggatgaactgagagatgctgtactccttgtgtttgcaaacaagcaagatcttccaaatgccatgaatgctgctgagattactgacaagcttggtttgcattctcttcgacaacgccattggtatattcagagcacatgcgccacatctggagaaggtctatacgagggactggattggctttcaaacaatattgctaacaaggcttagtgggctactctaccggctcagttggtactcaaagaaatacattggtgcagtcaatctggttataagtgttgttgcaatgactctttgtataattgcttttggtggtttggatttcaatttcttgtcgtggtgagagaggaaaaa

SEQ ID NO: 13190 - DNA, 869 bp, Panax ginseng
ggttttttggaacgacaactccatttagagatctctgcattccaacgttcccatcgcccacctcatcctcaatatagagatggggctgtcttttaccaagcttttcagtcgcctatttgctaagagagaaatgcgcattctaatggttggtctcgatgccgctggtaaaaccacaattttgtacaagctcaagttgggtgaaattgtcaccactatccctacaattggctttaatgtggagactgttgaatacaagaacattagcttcactgtgtgggatgttggtggtcaggacaagatccgacctttgtggaggcactatttccaaaacacacaagggctcatctttgttgttgacagcaatgatcgagaccgtgtggttgaggctagagatgaactgcacaggatgttgaatgaggatgaactgagagatgctgtactccttgtgtttgcaaacaagcaagatcttccaaatgccatgaatgctgctgagattactgacaagcttggtttgcattctcttcgacaacgccattggtatattcagagcacatgcgccacatctggagaaggtctatacgagggactggattggctttcaaacaacattgctaacaaggcttaatgggctactctaccggctcacttggtactcaaagaaatacattggtgcagtcaatctggttacaagtgttgttgcaattactctttgtataattgcttttggtggtttggatttcagtttcttgtcgtggtgagagaggaaaaagatgatgtattatgactgtctgttaaatttccctttgaattatctgcttaataatatacatagtattacaaataggatttattgctcctttttgagttgt

SEQ ID NO: 13191 - DNA, 945 bp, Panax ginseng
cagccgtcccccatcccgattctccggtatattgtttgtcgcggaggaagatagagagagaaacaaaagagagaaaaagagaggaagatatctctgtttctttctcgtcgtatttccaattcattcgcttccttctgagtagctaagatggggctgtctttcaccaagctcttcagtcggctgtttgcgaagaaagagatgcgcatactgatggtgggtctcgatgcagctggtaaaacaaccattctttacaagctcaagttgggagagatagttacaacaattcctaccattggatttaatgtggagaccgtggaatataagaacattagcttcaccgtttgggatgttggtggccaggacaagatccgtcctttgtggagacattacttccaaaacactcagggtctcatctttgtggttgatagcaatgatcgagatcgtgtggttgaagccagggatgaacttcacagaatgctgaatgaggatgagttaagggatgccgtgctacttgtatttgcaaacaagcaagatcttcccaatgcaatgaatgctgctgagattactgataaacttagccttcactctctccgtcagcgccactggtatatccagagcacatgtgccacttctggtgaagggttgtatgaggggctggactggctctcaaacaacattgcaaacaaggcatagaggctgctgaatctgtgtttggatcgtgattatagccagataaaggagtttgtcgtatttctttgtgtttctgaaatcttgtaacatagagtttttcatttttgtttgttttgaaatctgtaccatgttgatgtttacctatttacaatctcttctcaagatatcgtcatttgctcctttgcatatttaaatcaatttgctatgcatttcttgagaaattgatacggtattaggttaattcttcactttcac

SEQ ID NO: 13192 - DNA, 1141 bp, Panax ginseng
aagcagtggtatcaacgcagagtacgcggggatccccaaatatggcatttactctctctctcgacacatcgattcctgcgaccttcgatcagatttccgccggaagataccactgaggaaggcggaataggaagaacacagccaccgcctgaggcggcacccatatcctcttccttttcctctcgattcacgtcgctcaaaaccggcggatctcttttctctgtgttgaaatcaattctcagtggattcttcaggcgaaggtttccagagaaaaattctcagcacagtatttctgtctcagtgtcgagcaagttataagcagctgaggtacaagaaagatggggttgtctttcacaaagctgttcagcaggctttttgcgaagaaagagatgcgcattctgatggtaggtcttgatgctgctggtaagactaccattttgtacaaactcaagcttggagaaattgtcacaacaatccctactataggatttaatgttgagactgtggaatacaagaacattagcttcactgtttgggatgttggtggtcaggataagatccgtccactgtggaggcactacttccagaatacacaaggtcttatctttgtggtggatagcaatgacagagagagagttgttgaggcaagggatgagttgcataggatgttgaatgaggatgaactcagagatgctgttttgctcgtctttgctaacaaacaagatttgcccaatgcaatgaatgctgcggagataacagacaagcttggtcttcattctctccgtcaacgtcactggtacattcagagcacatgtgccacctcaggtgagggactttatgaagggctggattggctttctaacaacatcgctaacaaggcatgagctgaatgagttcagttactaatgggattttccatgaatccattggatagatactattaggccttgtatgagatgtatgaagacgatgcttgtccctgtattttcaagagatgtagcaatatgggtgcttttgaagttactgtctgcttgataccgttgctggtttggttattacccgactgcaaaagatgcttattatgctatagtaattttatgtccaatgaactacacgatagtacgtgttaagacttatggaa

SEQ ID NO: 13193 - DNA, 862 bp, Panax ginseng
ggtgttcggtggtggacgacagctccattcgagatctctgatttcttttgctcgttatcgctcacctcattatacaaagatggggttgtctttcaccaagcttttcagtcgcctgtttgctaagaaagaaatgcgtattctaatggttggtctcgatgctgctggtaaaaccacaattttgtacaagctcaagttgggagaaatcgtcaccactatccctacaattggctttaatgttgagactgttgagtacaagaacattagtttcactgtgtgggatgttggtggtcaggacaagatccgaccgttgtggaggcactacttccaaaacacacaggggcttatctttgtggttgacagcaatgatcgagaccgtgtggttgaggctaaagatgaactgcacaggatgttgaatgaggatgaattgagagatgctgtgctccttgtgtttgcaaacaagcaggatcttccaaatgccatgaatgctgctgagatcaccgacaagcttggtttgcattctcttcgacagcggcactggtatattcagagcacatgtgccacatctggagaaggtctatacgagggactggattggctttcaaacaatattgctaacaaagcttagtggactactctgatggttcagttggtactttatgaagtgtatgtgtgtgggtataggtgttgctacaattattatttctataattggttttgatattttggattctctttttccatgttgtgctgcaattacaatttacatataggatttattgttcctttttgagttgtaaagctttatgccagattgccagggctctggtggattgctattaaagtagttatacaacaagctact

SEQ ID NO: 13194 - DNA, 934 bp, Gossypium raimondii
gctttggtctcaagctctctctgcctctctttctaccatttgcttcaaaatcaaatccaaaatctctctgcgattttctccaaagggatcagcaattagggaagagaaatggggctgacattcacgaagctttttagccggctttttgctaagaaggagatgcggattttgatggtgggtctcgatgcagccggtaagactaccatcttgtacaagctcaagcttggagaaattgttaccaccattccaaccatcggatttaatgtggagactgtggaatataagaacatcagtttcactgtgtgggatgttggtggtcaggacaagattcgtccgttgtggaggcattacttccagaatacacagggtctcatcttcgtggttgacagcaacgacagagaccgtgttgttgaggctagggatgaattgcatagaatgttgaatgaggatgagctgcgagatgcagtattgcttgtatttgcaaacaagcaggatcttccaaacgcaatgaatgctgctgaaataactgataagcttggtcttaattcccttcgacagcgtcactggtacatccagagcacctgtgcaacatctggtgaagggctctatgagggtctggattggctttcaaacaacatagctaacaaggcctgaagccattaagaagtggtatttgcagtatcaaaaattctggatgcaggggtgaacattatctagtcttattttcttcaattattattatgccctcatttttcgactgtgacagctggattgttgttatgcgtttctatttttggagatgaccatattagtttggaccttgtggttatatattgcaaactaaaaattggtttgattggatgtataactctttctgtaaccaaaacttatttgcaattgcatgaattgcatttctatgaaacccgggatttgg

SEQ ID NO: 13195 - DNA, 961 bp, Carpinus betulus
attggggattgttccgaaggacacctcctttcctttacagcaagaggggtagatctctgttatcgtccacagaatagcgtgagaaaaaaaatggggctgtctttcaccaagcttttcagtcgtctctttgctaagaaagagatgcgtatactcatggtgggtcttgatgccgctggtaagaccaccattctctacaagctcaagttgggagagatagtcaccacaattcctaccattggatttaatgtggagactgtggaatataagaatatcagtttcactgtctgggatgttggtggccaggacaagatccgtcctttgtggagacattacttccaaaatacccaaggactcatatttgtggttgatagcaatgaccgagaccgtgtagctgaagctagagatgagctgcacagaatgttaaatgaggatgagttgagggatgccgtgctgctagtgtttgcaaacaagcaagatcttccaaatgccatgaatgctgctgagataactgataagcttggccttcactccctccgtcaacgccactggtatatccagagcacatgtgccacttctggtgaagggctctatgagggacttgactggctctcaaacaatattgccaacaaggcatagatggcttgattcttgagtttcaggttgcagcaactgcagaaacatttttctgatgttctggatcttgcttccctgtttagtataaacctattctaccatgtttatggtttcccttgcagactttgtcgttgttacctgtagtttcagaataattcttaaaaaaattctttctcatggtattacccccatagaattcttaaacaaatttcctttcgatcctgcatatctaactaagctatctattcataccatttagctttagttgttatttttcgtttgtgaactgagaaattataattatcctatggataaagtttttctctaa

SEQ ID NO: 13196 - DNA, 807 bp, Humulus lupulus
cagcttctttcgtaatcgtctttttcgcttgagccatccgagattaagaaatggggttgtctttcaccaagctcttcagtcggctttttgccaaaaaggagatgagaattctaatggttggtctcgatgccgctggtaagaccaccatcttgtataagctcaagctgggagagattgtgacgaccattcctacaatcggattcaatgtggagactgttgaatataagaacattagctttaccgtctgggatgtcgggggtcaggacaagattcgacctctgtggagacactacttccagaatactcaaggactcatctttgtggttgacagcaatgatcgtgaccgtgttgtcgaggctagggatgagttgcatcgtatgttgaatgaggatgagttgagggatgctgtgctgcttgtatttgctaacaaacaggatctcccaaatgccatgaatgcagctgagatcacagacaaacttggtcttcactctcttcgccaacgtcactggtacatccagagcacatgtgccacatctggggaaggactctacgagggtctggattggctctccaacaatattgctaacaagtcttaaaaagacctgatctctgttgaaggatttcacgcagcaattggtgtcatcatgatgctgctccccttatatttggtgttgatggattcttttttatctttttttttactgtcattaattaatgtatctgttcagattttgttaccacaaaatagaaattgccattttatcctgtagatgctaaataattcatggttctcagaatatataaacg

SEQ ID NO: 13197 - DNA, 1083 bp, Mesembryanthemum crystallinum
ccgccgcgtccctctctctcttcctccatctgtgttgaagatggggctctctttcaccaagctgttcagtaggctttttgccaagaaagagatgaggattcttatggtgggtctcgatgcggctggtaagaccaccatattgtataagctcaagctgggagagatcgttaccaccattcctaccattggattcaatgttgagaccgttgaatacaaaaacatcagcttcactgtgtgggatgttggaggtcaggacaagattcggcctttgtggagacattacttccagaacactcaagggcttatctttgtggtggatagcaatgatcgtgatcgtgctgtcgaggcaagggatgagctccaccggatgttgaatgaagatgagttgagggatgctgtgctcctggttttcgccaacaagcaagatcttccaaatgcaatgactgctgctgagatcactgacaagcttggtcttcactcccttcgtcaacgtcactggtatatccaaagcacatgtgctacttccggtgaaggtctttacgagggactggactggctgtccaacaacattgccagcaaggcttagatgatgggacctggctgagcttaggatgagtatattttggatttgctgcccacacctttgctgaaatggaatatgattttgagatttggccccttttttttgccttgctttgctatcttaccaatacaagagtgatgtgttctgtgatacgcactatgcagctttgctattatcatacgaaatgcttttgtcacaccttgtagattcccataactcaaatgtccccggaacagattgtgcatgctattcatttttatgtgacgtactatctcgggtaataaaaaaaaataacttaggggggcccgtacaaatttgctataacggtcgatatcgcgctcactggcgccgtacacaactcgactggaaaacctgcgtttcacactaacgctgtgacaattccttttgactgtgctatattaaaggcctcacttctcttcacaattcctactaatgcatgtgcaccctctcgtcttaagatgtgtgtgaggctctccttc

SEQ ID NO: 13198 - DNA, 915 bp, Ipomoea batatas
cattacggcggggagcgttaatctcaggcttcagcttcacccctctcttgctctctctctcatcagatccctcttccaaaaagttttctcaggggtcatcagcaaggagaaatggggctcaccttcaccaagctcttcagccggctttttgccaagaaggagatgcgtattctaatggttggtcttgatgcagctggtaagaccactattttgtacaagctcaaacttggagagatcgtgactaccatccctacaattggtttcaatgtggagactgttgagtacaagaatatcagcttcacagtttgggatgtcgggggccaggacaagatccgcccattgtggaggcactatttccagaacactcagggacttatctttgttgttgatagcaatgacagagaccgtattgtggaggcaagggacgagttgcataggatgttgaatgaggatgaacttcgtgatgctgtgctacttgtatttgctaacaaacaagatcttccgaatgcaatgaatgctgctgagataaccgataagcttggtctccactctctcaggcagcgccattggtacatccaaagcacctgtgcaacctctggagagggtctttatgaagggcttgattggctttccaacaacattgctaacaaggcataaagcaatacagagctcatgtgggttgatatcctggatgcaggcaggtttttatctagtctctttctttcttttcccctaaaagttggtgtggctatggacaccgttttaaaaggcactttgcatgttagggacttctgaaatggctttgtaatacactagttggatatatatatatatatataaacaatggctagcttcttattaacattgttggattaatggttaaagacttgaaatagacgcctcgccctgttctcg

SEQ ID NO: 13199 - DNA, 1028 bp, Ipomoea nil
attacgcgttaatctcaggcttcagcttcccccctctcttgctctctctctcatcagatccctcttccaaaaagttttctcaggggtcatcagcaaggagaaatggggctcaccttcaccaagctcttcagccggctttttgccaagaaggagatgcgtattctaatggttggtcttgatgcagctggtaagaccactattttgtacaagctcaagcttggagagatcgtgactaccatccctacaattggttttaatgtggagactgttgagtacaagaacatcagcttcacagtttgggatgtcgggggccaggacaagatccgcccattgtggaggcactatttccagaacactcagggacttatctttgtcgttgatagcaatgacagagaccgtattgtggaggcaagggacgagttgcataggatgttgaatgaggatgaacttcgtgatgctgtgctacttgtatttgctaacaaacaagatcttccgaatgcaatgaatgctgctgagataaccgataagcttggtctccactctctcaggcagcgccattggtacatccagagcacctgtgcaacctctggagagggtctttatgaagggcttgattggctttccaacaacattgctaacaaggcataaagcaattcagagctcatgtgtgttgatatcctggatgcaggcaggtttttatctagtctctttcttttcccctaaaagttggtgtggctatgaacaccgttttaaaaggcactttgcctgttagggacttctgaaatggctttgtaatacactggttggatatatataaacaatggctagcttcttattaacattgttggattaatggttaaagacttgaattagacccctcgccctgttcttgttgtcattggttatcaatgttgtgctattctcaagtgttttgggatttttaagtcttttgttagacaatgtgatttaattatcattgttaatttaagggcaaagtacaattttggtccgtcaattatttgttatgt

SEQ ID NO: 13200 - DNA, 776 bp, Ipomoea nil
catttctcccagctccctctctctctccgccgtgcgcgcgctttctctctctagacccatctcacaggaacacctttcaggtatctcagcaagaaagagaaatgggactcagttttaccaagctcttcagccggctttttgccaagaaggagatgcgcattctgatggttggtcttgatgcagctggtaagaccaccatcttgtacaagctcaagcttggagagattgtcactacaattcctaccattggtttcaacgtggagactgttgagtacaaaaacatcagcttcactgtttgggatgttggtggtcaggacaagatccgtccattgtggaggcactatttccagaatacacagggcctcatctttgttgttgatagcaatgatagggaccgtatcgtggaggcaagagatgagttgcataggatgctgaatgaggatgagctccgggatgctgtcctactggtgtttgccaacaaacaagatcttcctaatgcaatgaatgctgcggagataacagataagcttggtctccactctctgaggcaacgtcactggtacatccagagcacctgtgcaacttctggagaggggctttatgaaggtcttgattggctctctaacaacattgctaacaaggcctaaagcggtatagcgttggtttgtcgtcgtggattgatcctggatgcagtagttttttatctaaaaaaattgggttatgaacttcagatatatgtaactgtttttttttctctagacttgagtaccatgttt

SEQ ID NO: 13201 - DNA, 872 bp, Actinidia deliciosa
gtctcatcctaactaagatctgcgatcgacatcgtcgaaactagctctctgtttttgatactgaggcacaaaaatgggtttgtcttttaccaaacttttcagtcggctctttgctaagaaagagatgcgaatacttatggtgggtctcgatgctgcgggtaagaccacaatattgtacaagctcaagctgggagagattgtcacaaccattcccacgattggatttaatgtggagaccgtggaatacaaaaacattagctttactgtttgggatgttggtggtcaagacaagatccgacccttgtggagacactacttccaaaatactcaagggctgatctttgtagttgatagcaatgatcgggaccgtgtcattgaggctagggatgagctgcataggatgttgaatgaggatgagttgagggatgctgtgctgctggtgtttgcaaataagcaagatcttccaaatgccatgaatgctgctgagatcactgacaagcttggtcttcactccctccgtcaacgccattggtatatccagagcacttgtgccacctctggggagggactgtatgaggggctggactggctctccaacaacattgctaccaaggcttagaagattggcatatgatggttcaaagagttttggggctgaatgtcgaataagtagagagacctgatgtgtttcttggggtcttgggcttcaattcaccttcaattgtgcattgttgcacttgtttatcttcatatctaatagttgttttatactagagagttatttgtttctgtggattttgatgaataattttatgtaattttctggtacccctttgtaaacaggtatgctcttcggttaataaaaaatattg

SEQ ID NO: 13202 - DNA, 1018 bp, Leymus cinereus x Leymus triticoides
gcacgaggatttctctcctcctcctcctgccaccgatcccgaaccagggaggaacccggcgcgaggagggcaaaggaagagaagaggagatcaccgagccgagcgcccgaccgcacgcacaggacagcaggctccgcgatctcgcgcaggagcggagatggggctcacgttcacgaagctgttcagccggctcttcgccaagaaggagatgaggatcctcatggtcggtctcgatgcggccggtaagaccaccatcctctacaagctcaagctcggagagatcgtcaccaccatccccacaatcgggtttaatgttgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggccagagatgagcttcatcggatgctgaatgaggatgagctgcgtgatgctgtgctgctggtgtttgcaaacaagcaagatcttcctaatgccatgaacgctgctgaaatcactgacaagcttggcctgcattccctgcgccagcgacactggtacatccagagcacatgtgctacctctggggaggggttgtacgaggggcttgactggctgtccaacaacattgccaacaaggcttgaagcatctcggcaggggcttccatggatctggataagctggatattcggactaatactgcctttacgtattataaactatatagtcttgacagataatgtgggtgttttggaaagataacgctctctgtcaaagagctagctatcagattgttttcgtgggtgttaattgtccgtggcgctgtttgtttgcccatcatggttttactatgtccgctctgtactctgtactcgccactccgaccgactcgagacattgtagtattgacttgtcttgccatagtttgtcagcgtgagggcttaccatgtttcttctga

SEQ ID NO: 13203 - DNA, 1088 bp, Liriodendron tulipifera
atcccccgggctgcagaatcggcgtctggatttcttctctgcaagccggaaggaaacatggggctcactttcacgaagctttttagccggctttttgccaagaaggagatgcgtatcctgatggttggtcttgatgcggctggtaagaccaccatattgtacaagctcaagctgggagagatcgtaaccacaattccaacaattggatttaatgtggagacagtggaatacaagaacatcagcttcactgtctgggatgttggtggtcaggacaagatccgtccattatggaggcactacttccagaatacccagggtcttatctttgtggtagatagcaatgacagggatcgtgttgttgaggcgagagatgagttgcacagaatgttgaacgaggatgaactgcgagatgctgtgttgcttgtatttgcaaacaaacaagatcttccaaatgccatgaatgccgcagagataactgataagctcggccttcactctctccgccaacgccactggtacatccaaagcgcgtgtgcaacttctggtgagggtctttatgaagggctggagtggctctccaacaacatcgctagcaaggcatgagcggttacgacttctgttagggttttatttggattgcaggtataaaatgtcatctgagctttttttgaggtaagggaattgtggttgtgatgaaattagaggaccccttttctcccccttccctcacttgggttgtgttgtaatagaaggatgattgcatgctgctacattagtgcaattcatcaggtggagttggatctttgtgtagctaatccttttagctgtaacagagaatactagtttggttttccttttctttccaggcggcactctgctgctacctgagtttatagcattttttttttaggctttttaaagcgaggaatcacctccaactgggttgcatgctcagcctgttcttttacgccttcttaaatcttgtttccaattttacccttggaaatatcatgttcaaaggcaaaatggtttggaggtgatctcccccctccactctctgaaaatgcatttggagtttccatgtcttc

SEQ ID NO: 13204 - DNA, 1611 bp, Zea mays
gatctcgtaggatttcattgaggaagagatggggctctcctttgggaagctgttcagccgcctcttcgccaagaaggagatgaggattctcatggtcgggctcgatgccgccggtaagaccaccatcctctataagctcaagctcggcgagatcgtcaccaccatccccaccattggattcaatgttgaaactgttgagtacaagaacattagcttcaccgtttgggatgttggtggccaggacaagatcaggcccctgtggaggcactactttcagaacacgcagggacttatttttgttgtagacagcaatgatagggaacgtgttgttgaggctagagatgagctccacaggatgctgaatgaggatgagctgcgtgatgccgtgctgcttgtatttgcaaacaaacaagatcttcccaatgctatgaatgctgctgaaattactgacaagcttggtctgcattctcttcgccagcggcactggtacatccagagcacttgtgctacatctggtgaagggttgtatgaggggcttgattggctttccaacaacatcgccaacaagtcttgaagcttttcagcagggctcctagcaagaggaagacgtctgaacaacttatggatgcttttttacattttattacaaagatactccctctgtctcgatttactattccttttgggatagtggttgattcatataatatttgatgtatgtgtttaatagatgtgtctagattcaccatcatctattttaatatggacatagatataaagagctaaaacaaatactattttgaaatggagtgagtacaatctatagtagatagtgtgggtgctgtggagagaaaaaaatctgagctttcttttgagtgtttgctagtgtttaccttcggagatgatatggtaaattatattgacatgctttcgcgtaggtcttcaccgatccagtgctgtggcagctacatttcgttcttagatggttaacgtgtgccaacataaatccaatatgttgcttgtggtacgcaccgttttaaaatagctatggacagaccataattgacatcatcttctgtcgaactagcgttgggcttagttaggacttgggatgtcaatgctagatagctagagctgtatagcatctctaaggggtatttggtttgatgttcgatgaatcatctacatattctttatttatttttatttgggttatgatgtggaataggttgatgcatcaccatctcatatctcatatattagaagataactagcaaagtgtccgttgctacagtttttatttatacttgaggataaagtataaaatataaaaatatgtttgttttattggttatttgagtgtgaatgtaagtttaaagcgaataattgtggttcaaatccaaatttatcataattttagttttttaccgtttaaatgtggggagcatgcatggaaacagttgcttatatagtagagataattagtgttagtataaaaaaattatctcaccaattttgagaaacggttgctttatattgtatagacaattagtattagtataaaaaataaaattatcctaccaattttgagaaagactctaatataccacc

SEQ ID NO: 13205 - DNA, 921 bp, Zea mays
cgccacgcgacaaccgacaatccttcgcagtcccgcaccgcaccgccgcaccgcaccaccgcaccgcggccaaggccaatagcctcgcctagcgctcactcgctcgccccactaccaccgcaccacgcgctcccgtttccgccgatccgagcgcgcagatcgcggaagcccagcggctcagagtccagggggagggagctcgcggcggctgaggaaggcgttcaccaccgtcgcggtgagtgctcccagtcaagcgcctcttccttcgtagtgtcaacaattccgccccgcgcccgcgcggatctgattgtctcgatcgtccaatcgagcggatttcattgaggaagagatggggctctcctttgggaagctgttcagccgcctcttcgccaagaaggagatgaggattctcatggtcgggctcgatgccgccggtaagaccaccatcctctataagctcaagctcggcgagatcgtcaccaccatccccaccattggattcaatgttgaaactgttgagtacaagaacattagcttcaccgtttgggatgttggtggccaggacaagatcaggcccctgtggaggcactactttcagaacacgcagggacttatttttgttgtagacagcaatgatagggaacgtgttgttgaggctagagatgagctccacaggatgctgaatgaggatgagctgcgtgatgccgtgctgcttgtatttgcaaacaaacaagatcttcccaatgctatgaatgctgctgaaattactgacaagcttggtctgcattctcttcgccagcggcactggtacatccagagcacttgtgctacatctggtgaagggttgtatgaggggcttgattggctttccaacaacatcgccaacaagtcttgaagcttttcagcagggctcctagcaag

SEQ ID NO: 13206 - DNA, 826 bp, Tropaeolum majus
tgtttccatctataaataggcatcctaaataagtgtatgaaatgaagctgctccatttgtttaaggggagagagttatagtaaagatttgaaaaatggggttgtctttcaccaagcttttcagccggcttttcgccaagaaagagatgcggatattgatggtgggtctcgatgcggctggtaagaccaccattctttataagctcaagttgggagaaatcgtcaccaccattcctaccattggattcaatgtcgagactgtggaatacaagaacattagctttactgtctgggatgttggaggtcaggacaagatccgtcctttgtggagacactacttccagaacacacaaggacttatcttcgtggttgatagcaatgacagagaccgtgttgttgaagcaagggatgagttacacagaatgttgaatgaggacgagctgagggaggctgtgctgctagtgtttgccaacaaacaagatcttcctaatgcaatgaatgctgcggagataaccgacaagcttggcctccactctctgcgccaacgacactggtacattcaaagcacatgcgccacttctggtgaaggattatacgagggtctcgattggctctcgaacaatatcgcaaacaaggcttagataacataatttccgaggtttggatctctactggattggattgtagttaaaaaaaaagtttttttttattgatattacggattttgtttgttaagcatttattcagttttttttaaatatttttttattttgtaaaccggtgttatatgtttctctttagattcagaattatttgacatttttttt

SEQ ID NO: 13207 - DNA, 1001 bp, Nicotiana benthamiana
gtgccatagcagagagaaacgcggctaacgacagctccatttctagatctacgtactcaattctccgatcgctgatctccggtatccagagatggggctgtctttcggtaaacttttcagtcgcctctttgctaagaaagaaatgcgtattcttatggttggtcttgatgctgctggtaaaaccacaattctttacaagctcaagttgggggaaattgttaccactatccctactattggcttcaacgtggagactgttgaatacaagaacatcagctttactgtgtgggatgttggaggtcaagacaagattcgaccactatggaggcattatttccagaacacacaaggcctcatctttgtggttgatagcaatgaccgagaccgtgtagttgaggctagggatgagcttcataggatgttaaatgaggatgaattgagagaggctgtgctgcttgtttttgcaaacaaacaagatcttccaaatgcaatgaatgcagctgaaatcaccgataagcttggccttcattctcttcgacaacgacactggtatatccaaagtacgtgtgccacttctggagaaggattgtacgaaggactagattggctttcgaacaatatttcaaacaaggcataggtcatcccatgaggttgcactccagcccacgttccttaatttggagtacaaatgttaaacaccatagcttttatcattatctcttagtttggtggtttagacttctgtttcatatcttctgtggtcatagaagtgattaaactctgaaaatcacccgcctttctttcatttttggttttcttattaatgaaatctcattgtcaacaatacttgtgggtcagctaccacattgctggatgtgcacatttgtaatgtgaacacactttagtacaatactggctttcgtatcctagtggagctactttaaccatcttgatgtctttgttatatttgatactgcgactgttacacaatgaaagcaaag

SEQ ID NO: 13208 - DNA, 958 bp, Nicotiana benthamiana
aaggagtccctctcaccctaatttatctctctttccgtgccagagcagagggaaacgcggctaacgacagctccattcctagatctacatactcaattttccgatcgtcgatctccgttatacagagatggggctgtctttcggcaaacttttcagtcgcctctttgctaagaaagaaatgcgtattcttatggttggtcttgatgctgctggtaaaaccacaattctctacaagctcaagttgggggaaattgttaccactatccctactattggcttcaacgtggagactgttgaatacaagaacatcagctttactgtgtgggatgttggaggtcaagacaagattcgaccactatggaggcattatttccagaacacacaaggcctcatctttgtggttgatagcaatgaccgagaccgtgtagttgaggcaagggatgagcttcataggatgttaaatgaggatgaattgagagaggctgtgctacttgtttttgcaaacaaacaagatcttcccaatgcaatgaacgcagctgaaatcaccgataagcttggccttcattctcttcgacaacgtcactggtatatccaaagtacgtgtgccacttctggagaagggttgtacgaaggactagattggctttcgaacaatatttcaaacaaggcatagggcatccatgaggttgcactccagcccacgttgttaaacaccatagcttttatcattatctcttagtttggtggtttagacttctgtttcaaatctgtggtcatagaagtgatcaaactctgaaaatccccgcttttctttcatttttggttttcttattaatgaaatctcattgtcaacaatacttgtgggtcagctaccacatcgctggatgtgcacatttgttatgtgaacacactttagtacaatactggcttttgtatcctagtggagctactttaacca

SEQ ID NO: 13209 - DNA, 786 bp, Nicotiana benthamiana
gcggcacaattccaaatgagtggtggtaaagaatttagaaattttctactatttgtcacccaaaaagtttaaagaatccaattccacatctgacgagacttttaagttgaaaattaaaattgtcaaatttaataggaacatccatagcttttgcattttattttcatttctaaagggcagagtcttttctagatctgcccctctctctcgctctctcctgattccactgcattgaaaaaagatgggtttatcattcgggaagcttttcagtcggctgtttgccaagaaggagatgcgtattctgatggtcggtcttgatgcagctggtaaaaccaccatattgtacaagctcaagctgggagagattgttaccactatccctaccattggattcaatgtggagactgttgaatacaagaacataagcttcactgtctgggatgttggtggtcaggacaagatccgaccattgtggaggcattacttccaaaacacgcaaggacttatctttgtggtcgatagtaatgatcgtgatcgtgttgttgaggctagagatgagctgcaccggatgttgaatgaggatgaactgagggatgctgtactgcttgtgtttgctaacaagcaagatcttccaaatgctatgaatgctgctgagattactgacaagcttggtcttcattctctccgtcaacgtcactggtacattcagagcacttgcgctacctctggagaagggttgtatgaggggcttgactggctctcaaacaacattgcaaattttgttct

SEQ ID NO: 13210 - DNA, 933 bp, Nicotiana benthamiana
acccctctcagtatttggcgttaatctcaggcttccatttctctcattctctctctacattttctccttctctcttcgttagatccctctttcaaaagcttctttcagggatcatcaacaagaaggggaaatggggctaacattcaccaagcttttcagccggcttttcgccaagaaggaaatgcgaattctcatggttggacttgacgcagctggtaagaccaccatattgtacaagctcaagctgggggagatcgtcactactattcctaccattggtttcaatgtggaaactgttgagtacaagaatatcagcttcactgtttgggatgttgggggtcaggacaagattcgtccattgtggaggcactatttccagaacactcagggtctcattttcgtggttgatagcaatgacagagaccgtgttgttgaggcaagagatgagttgcacaggatgttgaatgaggatgagcttcgggatgctgtgctgcttgtttttgctaacaaacaagatcttcctaatgcaatgaacgctgctgaaataactgataagcttggactgcattccctcaggcagcgtcactggtacattcagagcacgtgtgcaacatctggagaggggctttacgagggtcttgattggctttctaacaacattgccaacaagtcctaaggcgacggagagtttttgcgggttgatcctggatgcaggcgtatttttatctagtttcttttcccaagtctggctatgaaccattgtcttgacaggcattttgcatcttgttagggcttaatgaaatggctctgtaatactacagttcggaaatatgtaatgatgtttgtctaggttcaagttaatttcataaatttgtaaacaaagactagttctttatgagaattttgttaatggttaatgattgtactttctat

SEQ ID NO: 13211 - DNA, 861 bp, Nuphar advena
ccgtccttcttgcttcatttctgcttgaaaaaggagagggagatggggttgacgttcacgaagctctttagccggctttttgccaagagggaaatgcgtattcttatggttggtctcgacgcggccggtaaaaccacgatcttgtacaagctcaagctgggtgagatcgtcaccacgatcccgacaatcggttttaatgtagagactgtggaatacaagaacatcagcttcactgtttgggatgttggtggtcaagacaagattcgtccattgtggaggcactacttccaaaacacacagggcctcatctttgttgttgatagcaatgacagagatcgtgttattgaggcaagggatgagttgcacaggatgttgaatgaggatgaactgcgtgatgctgttttgcttgtatttgcaaacaaacaagatctaccaaatgcaatgaatgcagctgagataactgataagcttggccttcactccctgcgtcaacgccactggtatatccagagcacttgtgcaacttccggagagggcctgtacgaggggctggattggctctccaacaacattgctagcaaggcctgagttcttggcttcatgatttcatacaagatccacgtagccttgctctttctgtgtttaagatggttgatggctatgaaacctaggaaacctttatgcaactgctagtgttttgtaatagtgaaaaatgatttacatcaacatttgttatgtttcactttttcttgcttgtttgatcagtctgctgttctataacaatatgataagattgattaggcgtattttttgttgttttcaggacagaatatgtgattgaaagtgatttaagttctaact

SEQ ID NO: 13212 - DNA, 863 bp, Nuphar advena
ctctctcggaaagctccgtcgttcttgcttcatttctgcttgaaaaaggagagggagatggggttgacgttcacgaagctctttagccggctttttgccaagaaggaaatgcgtattctgatggttggtctcgacgcggccggtaaaaccacgatcttgtacaagctcaaactgggtgagatcgtcaccacgatcccgacaatcgggtttaatgtagagactgtggaatacaagaacatcagcttcactgtttgggatgttggtggtcaagacaagattcgcccattgtggaggcactacttccaaaacacacagggcctcatctttgttgttgatagtaatgacagggatcgtgttattgaggcaagggatgagttgcataggatgttgaatgaggatgaactgcgtgatgctgttttgcttgtatttgcgaacaaacaagatctaccaaatgcaatgaatgcagctgagataactgataagcttggccttcaatcccttcgtcaacgccactggtatatccagagcacttgtgcaacttccggagagggcctgtacgaggggctggattggctctccaacaacattgctagcaaggcctgagtcattggcttcatgatttcatacaagatccatgtggccttgctctctttctgtgtttaagatggttgatggctatgatacttaggaaacctttatgtaactgctagtgtttttgtaatagtgaaaaatgatttacatcaacgcttgttatgtttcactttttcttgcttgtttgatcacagtctgctgttctataacaatatgataagattggttaggcgtattttttgttgttttcaggacagaatatgtgattgaaa

SEQ ID NO: 13213 - DNA, 908 bp, Quercus alba
ccgttcccatttctctctctctctctctctctctctcagggcagcttctctcagatctgcccaaacccacctcacatattcaccatcttgagataaaagatggggctgtctttcaccaagcttttcagccggctctttgccaagaaggagatgcgaattctaatggtgggtctcgatgcggctggtaagaccaccattttgtacaagctcaagcttggagagatcgtgaccaccattcctacaattggtttcaatgtggagactgtggaatacaagaacatcagcttcactgtctgggatgtcgggggccaggacaagattcgacctttgtggagacattacttccaaaatactcaagggcttatcttcgtggttgatagcaatgaccgtgaccgtgtggttgaggctagggatgagctgcatcggatgttgaatgaggatgaattgagggaggctgtgctgcttgtatttgcaaacaagcaggatcttccaaatgccatgaatgctgctgaaataactgataagcttggtcttcattccctccgtcaacgccactggtatatccagagcacatgtgccacttcaggggaagggctgtacgagggactagactggctttccaacaatattgctaacaaggcttaggagatccgtaaatcttcatttacttttttgggctgcaatctctgtcaaaggggattttgtcgttatgtggtgtttatgcattttacatttgatattgtcttgagaatgtatctgtttgtttagatcattgttacaatatgatagaaattgacatttgccttgtagattctaaataattcatgattcacagttgatagatatgattaaaccttgcttattttgggatacccttgcttctggttctccttcaatggatatggttg

SEQ ID NO: 13214 - DNA, 948 bp, Elaeis guineensis
ggtggtggacagctcctcctgtgatctccttgctcggatcggctctcattcctttccctctcacgtgaagatggggctgtctttcaccaagctcttcagtcggctttttgccaagaaagagatgcgtattcttatggtgggtcttgatgctgctggcaagaccaccatcttgtacaagctgaagctgggagagattgtgaccaccattcctaccattggatttaatgtggagacggtggaatacaagaacattagctttaccgtgtgggatgttggtggtcaggacaagatccggcctctgtggagacattacttccagaacacccagggccttatctttgttgtcgacagcaatgacagagatcgtattgttgaggctagagatgaattgcacaggatgcttaatgaggatgaattgagggatgcagtgctgctggtctttgcgaacaagcaagatcttcctaatgccatgaatgctgcggaaatcactgataagctcgggttacactccctccgccaacgtcactggtacatccagagcacgtgtgccacatctggggagggtctttatgagggattggactggctctcaaacaacattgctaacaaggcatagatattgctggttgggtaccttgttggagctgaaaacattagtacacttccgagtatgcgagagagctgtcccgaggatcaatttgcttatgtttctaacttcatagactcgagcctctgttgtcatttagataaagaatgatctggaaatttgttcttcttatctacaagctaaatttttgcccttttttttttggctgccaattgcgttgtttgaagaccttgcttgggtgatataatagttttatttctacaaaaagcttggttcttaggagacctatctgccatcacatgatgtttttgtatttctgtactgatatcttatataatgtt

SEQ ID NO: 13215 - DNA, 981 bp, Olea europaea
tgaacgttcctgagatcttcaaccgggagatctctatactcggctcaatcttgcctttccttctagcttaattcattggagttggtagttgcaaagatgggactgtctttcaccaagcttttcagtaggctgtttgctaagagagagatgcgcatactgatggtgggtcttgatgctgctggtaaaacgaccattctctataaactcaaacttggagagatcgtcactacaattcctaccattggatttaatgtggagactgtggaatacaaaaacattagctttacagtttgggatgtcgggggccaggataagatccgtccactgtggagacattacttccaaaacacacaaggtctaatctttgtggttgatagcaatgaccgagaccgtgttgttgaagcaagggatgagctgcacaggatgttgaatgaggatgagttgagagatgcagtcctcctagtatttgcaaacaagcaagatctcccaaatgcaatgaatgctgctgaaataactgacaagcttggccttcattctctccgccaacgtcactggtacattcagagcacatgtgccacttctggtgaaggcctgtacgaggggttggactggctttcaaacaacattgcaaacaaggcttagattgctgtgtatctaaggtgcagtgttgtatcagtgctggaagaagctttcatttctctgttgctttggacttctgctttttctgtcattaaacttggttgcttttgggaaggttgaaatctgattctcgtactttggaataattcataaatttttgtcggttctttagcatcatcccctgttacatattcacacctaagatctttttccatattcggttgttctataaggaatcacttccttttctgcacataaagcaggacgagtgttacttccaacatcggctcatgcaccaatacccgtatacggatcgatttaagatccgaaggcatttttgat

SEQ ID NO: 13216 - DNA, 1052 bp, Allium cepa
gcaggacagctcctctctcagatctgccctctcatctttgattctcattttcctctcctaacctcacttgaagatggggttatctttcaccaaactcttcagtcggctatttgccaagagagaaatgagaattctcatggtgggtctcgatgctgctggtaaaacaaccattctctacaagctcaaactaggagagattgtcaccactattcctaccatcggcttcaacgtagagactgtggaatataagaacatcagcttcactgtgtgggatgttggtggtcaggacaagattcgaccattgtggaggcactatttccaaaacacacagggccttatttttgtggttgacagcaatgaccgagatcgtgttgttgaggctagagatgaactccacaggatgcttaatgaggatgagttgagggatgcagtgctgcttgtattcgcgaacaaacaagatcttcccaatgctatgaatgctgctgaaataactgacaagcttggccttcattctcttcgccagcgtcactggtatatccagagcacatgtgcgacatctggagaaggtctgtacgagggattagattggctctcaaacaacattgctaacaaggcatagatgctacatttggtgatggtttggcattggagcttgagattatcaacagtctatattttggttgaagggtctcttccaataaccacatgttgcttatgttcttaaataccttaaaaaaatcatggcatattttcttattgtctagaccttaataatgtgtgacaatatattattatattcagtttgttatatgattttaatatttgtattgtaatgtgtttttgtgaggttcacttgcttatcaatcagattgatgtagggcttgcatatttgttgctgaaatgatacggggtcaagttctggtaatatcagatggcatcagtaagctattcagttgaataacacttatttgaatattagaaattcagacgagtgatgtgtttaattgtccatacctatttgtttaagaattaagttatagtaaaacacacac

SEQ ID NO: 13217 - DNA, 878 bp, Allium cepa
gcatttcagtacttggatatctagaatttcggtggtgcaggacagctcctctctcagatctgccctctcatctttgattctcattttcctctcttaacctcacttgaagatggggttatctttcaccaaactcttcagtcggctatttgccaagagagagatgagaattctcatggtgggtctcgatgctgctggtaaaacaaccattctctacaagctcaaactaggagagattgtcaccaccattcccaccatcggcttcaacgtggagactgtggaatacaagaacatcagcttcactgtatgggatgttggtggtcaggacaagattcggccattgtggaggcactatttccaaaatacacagggccttatttttgtggttgacagcaatgaccgagatcgtgttgttgaggctagagatgaactccacaggatgcttaatgaggatgagttgagggatgcagtgctgcttgtatttgcgaacaaacaagatcttcctaatgctatgaatgctgctgaaataactgacaagcttggccttcattcccttcgtcagcgtcactggtatattcagagcacatgtgccacatctggagaaggtctgtacgaggggttagactggctctcaaacaacattgctaacaaggcatagatgctacatttggtgatgggttggcattggagcttgagattatcaacagtctatattttggttgaagggtctcttccaatggcacatgttgcttgtgtttttaattaccttaagaaaaatcatggcgtattttcttattgtctagaccttaataatgtgtgatgatatattattatatatagtttgttatatgactttaatctagatagttttagtttgttaa

SEQ ID NO: 13218 - DNA, 1029 bp, Allium cepa
gtttacatatctagaatttcggtggtgcaggacagctcctctctcagatctgccctctcatctttgattctcattttcctctcctaacctcacttgaagatggggttatctttcaccaaactcttcagtcggctatttgccaagagagaaatgagaattctcatggtgggtctcgatgctgctggtaaaacaaccattctctacaagctcaaactaggagagattgtcaccactattcctaccatcggcttcaacgtagagactgtggaatataagaacatcagcttcactgtgtgggatgttggtggtcaggacaagattcgaccattgtggaggcactatttccaaaacacgcagggccttatttttgtggttgacagcaatgaccgagatcgtgttgttgaggctagagatgaactccacaggatgcttaatgaggatgagttgagggatgcagtgctgcttgtattcgcgaacaaacaagatcttcccaatgctatgaatgctgctgaaataactgacaagcttggccttcattctcttcgccagcgtcactggtatatccagagcacatgtgcgacatctggagaaggtctgtacgagggattagattggctctcaaacaacattgctaacaaggcatagatgctacatttggtgatggtttggcattggagcttgagattatcaacagtctatattttggttgaagggtctcttccaataaccacatgttgcttatgttcttaaataccataaaaaaaaatcatggcatattttcttattgtctagaccttaaataatgtgtgacaatatattattatattcagtttgttatatgattttaatatttgtattgtaatgtgttttgtgaggttcacttgcttatcggtcagattgatgtaggcttgcatatttgttgctgaaatgatacggggtcaagttctggtaatatcagatggcatcagtaagctattcagttgaataacacttatttgaatattagaaattcagacgagtgatgtgttt

SEQ ID NO: 13219 - DNA, 908 bp, Carica papaya
ggggaccctctcagccgctgggttctgattgttctttatttctcagatcgtctccttctcttccatttcctctagcgtccgtatccaggcgctgtaagcctgtaaaggatcggggtaaacaaagatattaagtgcggtaaaaaaagatggggttgtcgtttgcgaagctcttcagtcggctatttgccaaaaaagagatgcgaattcttatggtgggtcttgacgctgcaggtaagaccaccattttgtacaaacttaagctgggagagattgtgactactattcccacaattggttttaatgtagagactgtggagtataagaacataagcttcactgtgtgggatgttgggggtcaagacaagatccgtcccttgtggagacattactttcaaaacactcaggggctcatattcgtggttgacagtaatgatcgcgaccgtgtagttgaagctagggatgaactgcaccgtatgctaaacgaggatgaattgagggatgctgtattgcttgtttttgcgaacaagcaagatcttccaaatgctatgaatgctgcagagatcactgataagcttggtcttcactcccttagacagcgccactggtatatccagagtacttgtgccacatctggtgaagggctttatgagggacttgagtggctctccaacaacattgctaacaaggcataaaggtcatgaacaataggagttttccttcaaattttagcgagcagtctttcttagtacaaaagtttcccagtgatatcgaggttgtcattaattttcatgtcagtgagaaagcatttgttagatattgtcatacagaaatctgacatttatatatgggtttgtagatttgcaataattcttgattaacatttgtatgagatatgattgtccttaact

SEQ ID NO: 13220 - DNA, 918 bp, Petunia hybrida
tatggatccccgggctgcaggattcggcacgagggaaaaaggcagctgagatctactcattttatccaccgatctccgattcacaaagatggggctgtctttcactaaactcttcagccgcctctttgcgaagaaggaaatgcgtattcttatggttggtctcgatgctgctggtaaaaccacaattctctacaagctcaagttgggagaaattgtcacaaccatcccaaccattggcttcaatgtggagactgttgaatacaagaacatcagctttactgtgtgggatgtcgggggtcaggacaagattagacctctatggaggcattatttccagaacacacaaggtcttatctttgtggttgacagcaatgaccgagaccgtgtggttgaggcaagggatgagcttcacaggatgttaaatgaggatgaattaagagaagctgtgttgcttgtttttgcaaacaaacaagatcttccaaatgcaatgaatgctgctgaaatcaccgacaagcttggccttcattctctcagacagcgacactggtatatccagagtacatgtgctacttctggagaagggctatacgagggactagattggctttccaacaacattgccagcaagtcctagagcaatgatgtggtcgggtgctaccaacgttgctatatctggagaaataaacaccactgcgttgtctcaatctcttagtttggaggtctaggtctctatttcagatccgtggtgatagaagtcaatacaattctgaacatcccctgcccttctttccctcttttatggtttattattaatgagcaacaatgatatagctaccacattgctggggtgcacattggcaatgtaaagatatttttgtatgaaatctggttttgtatcttagtgagttgtttgacacc

SEQ ID NO: 13221 - DNA, 897 bp, Phalaenopsis aphrodite
gcacgaatgctccctctcgtcatttcttctgaaggataagatgccggccttcatcccagaagaatttggtggtcgacggtagctcctcggtcttctggtgccgcatcatcttccgcagtttcgttcttctttcgtatccctcctgtgtgaagatggggctgtcattcacaaaactgttcagtcggctttttgccaagaaagaaatgcgtattcttatggtgggtcttgatgcggctggtaagactaccattctgtataagctgaagctgggagagatagttacgaccatccccaccattggattcaatgtggagacagtggagtacaagaacataagctttactgtttgggatgttggcggtcaagacaagatccgcccgctatggaggcattacttccagaacacacaggggctcatttttgtggtggacagcaacgatcgtgaccgtgttgttgaagccagagacgagctccacagaatgttgaatgaggatgagttgagagatgccgtcctgcttgtgtttgccaacaaacaagaccttcccaacgccatgaatgcggctgaaattaccgacaaacttggcctccactctcttcgtcagcgacattggtatatccagagcacatgtgccacttctggagaagggctgtatgaaggacttgattggctctctaacaacatagctaataagtcttaaaaacaatatgctgctgctgctgctgctgctgagaaataggaagaagtttgttctgacgattattgtgttggatattataagacattgtggcttaagactatgatattgtgattgttatgctaaccagacctgttgtatttttgttggtaatattgcggaatttggtgtttgatagcattgttgtgttgtctatttaata

SEQ ID NO: 13222 - DNA, 810 bp, Phalaenopsis aphrodite
ccgcatcatcttccgcagtttcgtttttctttcgtatccctcctgtgtgaagatgggactgtcattcacaaaactgttcagtcggctttttgccaagaaagaaatgcgtattcttatggtgggtcttgatgcggctggtaagactaccattctgtataagctgaagctgggagagatagttacgaccatccccaccattggattcaatgtggagacagtggagtacaagaacataagctttactgtttgggatgttggcggtcaagacaagatccgcccgctatggaggcattacttccagaacacacaggggctcatttttgtggtggacagcaacgatcgtgaccgtgttgttgaagccagagacgagctccacagaatgttgaatgaggatgagttgagagatgccgtcctacttgtgtttgccaacaaacaagaccttcccaacgccatgaatgcggctgaaattaccgataaacttggtctccactctcttcgtcagcgacactggtatatccagagcacatgtgccacttccggagaagggctgtatgaaggacttgattggctctctaacaacatagctaataagtcttaaaaacaatatgctgctgctgctgctgctgagaattaggaagaagtttgttccgacgattgttgtgttggatattataatatattgtggcttaagactatgatattttgattgttatgctaaccagacctgtgtatttttgttggtaatgttgtggaatttggtgtttgatagcattgttgtgttgtttatttaatataatgatgtgggtgaga

SEQ ID NO: 13223 - DNA, 899 bp, Pinus taeda
cctctgcagaaacgaactcttcatcaccggggtctgtgattttacaggatatctggttttctctcgagttttgcaagatggggctcacgttcaccaagctttttcaacgtctgtttgccaaaaaggaaatgcgtattctgatggtgggtcttgatgctgctggtaagactaccattctgtacaagctgaagcttggagaaattgtcacaacaattcccactattggtttcaatgttgagactgtggagtacaagaatattagctttactgtttgggatgtcggaggtcaggacaagatccgaccactatggagacattactttcagaatacccagggtcttatatttgtggttgatagtaatgacagggaccgtgttgttgaagcaagagacgaattgcataggatgctgaatgaggatgagttgcgagatgctgttctcctcgtatttgcaaacaagcaggatcttcccaatgcaatgaatgctgctgagataactgataagcttggcctgcattctttgcgtcagcgtcattggtatatccagagtacctgtgctacttctggtgaaggactgtatgaaggtttggattggctttctaacaacatcgcaaacaaggcataatgttgaagcatcgtaatgacgctatgaagcctttgagaatgggctggtttccatgtcttttgaatattggttggattaggatactttctgcagtgtagtggacgtgtttcatgcttctcctagtaaattgaagtagataaatagttaaggggggttgaggatctattcttgtggtgtactgatccttagtttagttaatttgtttgaaattttgcatgtctacaattgttacataatcaactatgaattcttccagtgggttcctcaggatttcgg

SEQ ID NO: 13224 - DNA, 1001 bp, Plantago ovata
gagatatattgtagctagcgtaacaactgagcaagatctcgtcccttttcccttcttttccaaaatcgctctcgtctcctctgaaacgtagagaaaatggggttgtccttcaccaagcttttcagtcggttgtttgccaagaaggagatgcgaattcttatggtaggtctcgatgcggctggtaagacaaccatattgtataagctcaagctgggagagattgtcacaaccatccccacaattggattcaatgtggagacggtggaatacaagaacattagcttcactgtctgggatgttgggggtcaagacaagatccgaccattgtggaggcattacttccagaacactcaaggactcatctttgttgttgatagtaatgatcgagaccgtgttgttgaagctagggacgagctgcacaggatgctgaatgaggatgaactgagagatgcggtgcttcttgtttttgctaacaagcaagatctgccaaatgctatgaatgctgctgagataactgacaagcttggccttcactctcttcgtcagcgtcattggtatatccagagcacttgtgccacttctggagaaggtttatatgaggggctcgactggctctctaacaatattgcaaacaagtcttaaaagctagagctgttgagttaattcggtggttatcatcgttgaattggagaagaaaattcttagcacgctcttgtttctgaatccttgttgaagtgaaggtctttatttttattttcgagcagcctagtgtctgaaccggttccctactgtggtcaccactactgttgatagatagtcacctgttggctgtagccttttttggttgcgactctcgtttatgttactggatggttaatgttgttagcattgtgataacacacccttctgtttgggtggctgaattaaatgttatcagtatttttcctgtgttataaaaccatgtttgcttactccactctctagtcaatgatctcttctta

SEQ ID NO: 13225 - DNA, 1161 bp, Prunus mume
cgctctccctgatctataaatacagatagtgtgaatcgtagcgagcgtatcggtgtgaaggacagctcctcttcctcttcctcttcttagacacacacatatacacagacagaaagagaaagagaagcgtagatctatttgttgcttcacggtcgcgctcttcctcaggtgaaaaatggggctgtctttcacgaagcttttcagtcggctctttgccaagaaggagatgcgtattctgatggtgggtctcgatgcggctggtaagaccaccattctctacaagctcaagctcggcgagatcgtcaccaccattcccaccattggattcaatgtggagactgtggaatacaagaacatcagctttactgtctgggatgttgggggtcaggacaagatccgacctttgtggaggcattacttccaaaacacacaaggacttatctttgtggttgatagtaatgatcgtgaccgtgttgttgaagccagggatgagctgcacaggatgttgaatgaggatgagttgagggaggctgtcctgcttgtatttgcaaataagcaagatcttccaaatgccatgaatgctgctgaaattactgataagcttggccttcactccctccgtcaacgccactggtatatccagagtacatgtgccacatctggtgaaggactgtacgagggacttgactggctttcaaacaatattgcaaacaaggcatagatggcttggcttgaattttgtgcggtgacgaagttggacattgatccttggtgctctgcatttgctaccgttttaagtaccctattttaccgtctttgtgttttcttttgcaaacagtgcctttttttacctgtagtcttaagaataattcgtaagttgtcaatttttctcacggtattaactcaatagcattgttcccccgattgtttgtgtaatgaaatagctgccatttattttactaccatttcttcgtttattctttactttgctggagattatagaagatgatcctgccctcattctctcactcgttcaaaattcaaatctcaattgttttcaatttactctcatctcagattgaagaaaaaaatgtaatatggaaatagatagctgggcaagtgataaactgaaaatagaaatccagactcgcttcataaaaa

SEQ ID NO: 13226 - DNA, 956 bp, Prunus persica
cgctctctctgatctataaatacagatagtgtgaatcgtagcgggcgtatcggtgtgaaggacagctcctcttcctcttcttcttcttagacacacacatacacagacagaaagagaaagagaagcgtagatctatttgttgcttcaaggtcgcgctcttcctcaggtgaaaaatggggctgtctttcacgaagcttttcagtcggctctttgccaagaaagagatgcgtattctgatggtgggtctcgatgcggctggtaagaccaccattctctacaagctcaagctcggcgagatcgtcaccaccattcccaccattggattcaatgtggagactgtggaatacaagaacatcagctttaccgtctgggatgttgggggtcaggacaagatccgacctttgtggaggcattacttccaaaacacacaaggacttatctttgtggttgatagtaatgatcgtgaccgtgtcgttgaagccagggatgagctgcacaggatgttgaatgaggatgagttgagggaggctgtcctccttgtatttgcaaataagcaagatcttccaaatgccatgaatgctgctgaaattactgataagcttggccttcactccctccgtcaacgccactggtatatccagagtacatgtgccacatctggtgaaggactgtacgagggacttgactggctctcaaacaatattgcaaacaaggcatagatggtgttgaattttgtgcggtgacgaagttggacattgatcctcggtgctctgcatttgctaccgttttaagtaccttattttaccgtgtttgtgttttcttttgcaaacagtgcctttttttacctgtagtctataagaataattcgtaagttgtcaatttttctcacggtattaactcaatagcattgtttccccgattgtttgtgtaatgaaatagctgccatttctttgttt

SEQ ID NO: 13227 - DNA, 743 bp, Raphanus sativus
cgacccatcccatcggcgagcgactgtgaaagggaaagatggggctgtcattcgggaagttgttcagtaagctgtttgcaaagaaagagatgaggatccttatggttggtctcgatgctgctggtaagactaccatcctctacaagctcaagcttggcgagatcgtcaccaccattcccaccattggtttcaatgtggagactgtggagtacaagaacatcagcttcaccgtctgggatgtcgggggtcaggacaagattcgtccattgtggaggcactacttccagaacacccaagggctgatcttcgtggtggacagcaatgaccgtgaccgtgttgtcgaagctagggacgagcttcacagaatgctcaacgaagatgagttgagagatgcagtgcttcttgtctttgctaacaagcaagatcttccaaacgccatgaacgccgctgagattactgacaaactcggccttcactctctccgtcaacgacactggtacatacagagcacatgtactacctcaggagaagggctctatgagggtcttgattggctctccaacaacatcgcaaacaaggcttaggagagcagtttgtgggagagtgtcttgtcttcttggactctgttttgttctttcagtctcaacacttttttttttatcatttcatactttgttcttcgctctttttttcttctatcctaaatgcagaatattatgaaatgggacctacgtttcgacgga

SEQ ID NO: 13228 - DNA, 1051 bp, Oryza sativa
tctctctccccatctatctcctctccctctccgcccatttctcctctccacctgcgatccatccgcgcccgcgaggaggagggagccggacgccgccgcggggagagcaggggagagaaggagaggaggagatcgccgtcgccgtcgccgtcgccgtcgccgatctcgagcgggagcggagatggggctcacgttcacgaagctgttcagccgcctcttcgccaagaaggagatgaggatcctcatggtcggtctcgatgcggccggtaaaaccaccatcctctacaagctcaagctcggcgagatcgtcaccactatccccaccatcggttttaatgtcgaaactgttgagtacaagaacattagcttcaccgtttgggatgttggtggtcaggacaagatcaggcccctgtggaggcactatttccagaacacccagggcctcatttttgttgtggacagcaatgacagagagcgtgttgttgaggccagggatgagctccaccgtatgctgaatgaggatgagctacgtgatgctgtgctgctggtgtttgcaaacaaacaagatcttcctaatgccatgaacgctgctgagatcaccgacaagcttggtctgcactccttgcgccagcggcactggtacatccagagcacatgtgctacctctggtgaggggttgtatgaggggcttgactggctttccaacaacattgccaacaaggcttgaagcatcttggccgggcttaaatgaaaggaagacatggcggatatccctgagtgaacgctgcctttttacgtatcgaaactatatagtcatgacagataatgatgtggatgttttgggaagataaagctctttaggttccaccaccaaaggagctagctatcagattgtttttcgtggggtgttaaaaaatcgtgcgtgtttcagtttggtttttaatcgaaaggcttacggtgcctgacttttgtacctctgtactcgccacagatgttgtagtattgacttgtcttgggcatagcgtattgttacgtaatcctgttctgtgca

SEQ ID NO: 13229 - DNA, 971 bp, Rosa hybrid cultivar
ggaacgtgtttttctagttcgctgactcttcctccctctgtgtctgtggctctataaatacagggatactcataaagcgtacgtatcggtgtcaaggacagctctcttctcttcttagacacacacacacagagcggaagaggcgtagatctcaaattcctctcttcctcaggtgaaaaatggggctgtctttcaccaagcttttcagtcgtctctttgccaagaaagagatgcgtatactcatggtgggtctcgatgccgctggtaagaccaccattctctacaagctcaagctcggcgagatcgtcaccaccattcccaccattggattcaatgtggagactgtggaatataagaacatcagctttactgtctgggatgttgggggtcaggacaagattcgacccttgtggaggcactacttccaaaacacacaaggacttatctttgtggttgatagcaacgatcgtgaccgtgtagttgaagctagggatgagctgcacagaatgttgaatgaggatgagttgagggaagctgtgctgcttgtatttgctaacaagcaagatcttccaaatgcaatgaatgctgctgaaataactgataagcttggccttcactccctccgtcaacgccactggtatatccagagcacatgtgctacttctggtgaaggactgtatgagggactagactggctctcaaacaacattgcaaacaaggcttagatggcttacttgaattttgtgttttgaaagtgctgcaacacaaagttgacgtttgattcttggtgttctgccttggctaccatcttaaagtgcttgttccttgtttgtgttttccttttgcaactgtgcccgtcttttacctgtagtttaacaataattcatagattctcaatcttttgtcatggtattaactcaatagctttgtttctgccaatttattttgcgaaaggaaatatctatcattta

SEQ ID NO: 13230 - DNA, 750 bp, Rosmarinus officinalis
cggccgggggacataccattgatttgaatttgcccgagggcagtctctcaagatctgcccccatttcaccgaaattcgatcaatctttgctctctccgccggattattatcgattgtataagaaggaaggatgggtttgtcatttaccaagctctttagcaggctttttgccaagaaggagatgcgcatactaatggtgggtcttgatgcggctggtaagactaccatattgtacaaactcaagctgggagaaatagtgaccaccattccaacaattggtttcaatgtggagactgtggaatacaagaacatcagctttacagtctgggatgtggggggtcaggacaagattcgaccattgtggagacattacttccaaaatactcaaggacttatctttgtcgttgacagtaatgaccgtgaccgtgttgttgaagccagggatgaactgcacagaatgttgaatgaggatgaactgagggaagctgtcctcctcgtgtttgctaacaagcaagatcttccaaatgcaatgaatgcggcagagattaccgataagcttggtcttcattctctccgccaacgccactggtatatccagagcacatgtgctacatctggtgaaggactctatgagggtttggactggctctccaacaacattgccaacaaggcctagagcagcataatcaatccaatgattttgcagatgaatctttgtgaaattcgatattatatatttcttgtcttgta

SEQ ID NO: 13231 - DNA, 1012 bp, Rosmarinus officinalis
agcacacgactcatctttccgtggagagatctctaaaccctggtccatcctcgctgctcctctaccatttaaaagatggggctgtctttcacgaagcttttcagccggctgtttgccaagaaagagatgcgtatactcatggtaggtcttgatgctgctggtaaaacaaccattctctacaagcttaaactaggagaaattgtcaccacaattcctaccattgggttcaatgtggagactgttgagtataagaacattagcttcactgtttgggatgttggtggccaggacaagatccggccattatggaggcattatttccagaacacccaaggccttatctttgttgttgacagcaatgaccgtgatcgtgttgttgaagcaagggatgaattgcacaggatgctgaatgaggacgagttgagggatgctgttctgcttgtttttgccaacaagcaggatcttccaaatgcaatgaatgccgcagagataactgacaagctgggccttcattccctccgccaacgccattggtacatccagagcacatgtgcaacttccggtgaaggactctatgagggattggactggctgtcgaataacattgccaacaagagttaagctcttcaagtcgagatgaccttgcactatgacctgtgggggcttccattctttatcactcggatcgtctagcattattatgccgacagccttggaccagtcgaggacaataccatctttcgtatctcctatgtagttaataataatttctagattttcttgtcaaccgtgtggttcttcctactactgttttgtggtataggatcgagtcatgttatagataccacccactgatatcgatttcacttttgatgagacttatgttaataaattacattctcctgagaatcgctggatctgttttgctgaatatatatgagtaccgaatgggtcaatgtttattttggtagtttcctattttcagttgcactaatagaaaaaatttaatctg

SEQ ID NO: 13232 - DNA, 1006 bp, Secale cereale
caccgcactgcacgacagccatcctccgtgcggttccaagctccaactcccacgcccgtctcccccgagatcaggaggagcacgccccggagcgccgagacctcgaagccttcgtctccacccccggaggagagatggggctcacgttcaccaagctgttcagccgcctcttcgccaagaaggagatgaggattctcatggttggtctcgatgccgctggtaagaccaccatcctctacaagctcaagctcggagagatcgtcaccaccatcccaaccatcggatttaacgtcgaaactgtcgaatacaagaacatcagcttcactgtttgggatgtggggggccaagacaagatcaggcccctgtggaggcactacttccagaatacgcaagggctcatttttgttgttgacagcaatgatagggagcgtgttgttgaggctagagacgagcttcacaggatgctgaatgaggatgagctgcgtgatgctgtgttgcttgtatttgcaaacaaacaagatcttcctaatgccatgaatgctgctgaaatcactgacaagcttggtctgcactccctgcgccagcggcactggtacattcagagcacctgcgcgacatctggagaagggttgtacgagggacttgactggctctccaacaacattgccaacaaggcttgaagcatgtcgacaagtgcttcatcaagaaacaaacgtgctggatgtctcaacaactcactgctaccatttttacatattgtgatatatatatacactgtacaagagatagtatgtgtgcgtatgtgacagacagaagctctcttctttaagtgagctagtatcaggtcaggttgtttttttgtatggatattatcagtattcccgcgtcgtggttttacaaggtttactttgtcgaccatgtgtgcatgaacccctatcttttttgagttgtagtaagattgaattgtggttgccgatgttggttggttcagttgagtgatgtggat

SEQ ID NO: 13233 - DNA, 699 bp, Scabiosa columbaria
gcgttgctctcaaacgctctccttctctctttctctcactagatccctcctccatttgcacagggatcaaagatggggctaacattcactaagctttttagccggctctttgcaaagaaagagatgcgaattctgatggttggtctcgatgctgctggtaagacgaccatattgtacaagcttaagcttggagagattgtcaccactatacctactatcggttttaatgtggaaactgttgaatacaaaaacattagctttactgtgtgggatgttggaggtcaagacaagattcgtccattgtggaggcactacttccaaaatacacagggtcttatctttgtggttgatagcaatgacagggaccgtgttgttgaggcaagggatgagttacatagaatgttgaatgaggatgaactcagagatgcagtgctacttgtgtttgctaacaagcaagatcttccaaatgcaatgaatgctgcagaaattaccgataagcttggactccattccctcaggcaacgccactggtacatccaaagcacctgcgcaacctctggagaaggactatatgaggggttggattggctctccaataacatcgctaacaagtcttgagctcggtcggtgcaatctgaagtcctcttacccatggtgcgtgcttattcttcttttagaggctgtgttatcgatttattt

SEQ ID NO: 13234 - DNA, 856 bp, Solanum phureja
accatatttcgcgttattctcaagctctctctctctctatctgtcctctcgtgctttctctcactagatccctctttcccaaactgttcttcagggatcattaagaagaaagagaaatggggctgacattcaccaagcttttcagccggctatttgccaagaaggaaatgcgcatcctcatggttggactcgatgcagctggtaagaccaccatattgtacaagctcaagctgggagaaattgtcaccaccattccaactattggtttcaatgtggaaactgttgaatacaagaacatcagcttcaccgtttgggatgtcgggggtcaggacaagatccgtccattgtggaggcactatttccagaacactcagggtctcatttttgtggttgatagcaatgacagagaccgtgtagtggaggcaagagatgaattgcacaggatgttgaatgaggatgagcttcgggatgctgtgctgcttgtttttgctaacaaacaagatcttcctaatgcaatgaatgctgctgaaataaccgataagcttggactccactccctcaggcagcgtcactggtacatccagagcgcttgtgcaacttctggcgagggactctacgaggggcttgattggctttctaacaacattgccaataaggcctaagtcgaagtagagttgttgcggattgatcctggatgcaggcgggtttttatctaattccatttacttttattacgtcgtttttcttcttcttttttcagacattctctgaatctgtgtggttatggcatttgcttcttaggaggtcacttttgaaatgtttttgtaatacaatggttgaatgtatgtaatttgct

SEQ ID NO: 13235 - DNA, 727 bp, Glycine max
ttgaattaagagatggggttgtctttcaccaagctttttagccggctctttgccaagaaagagatgcgtattctcatggtaggtcttgatgctgctggtaagactaccatcttgtacaagctcaagctgggagaaattgtcacaaccattcccacaattggatttaatgtggagactgtggaatataagaatattagctttactgtatgggatgtgggtggccaagataagattcgtcctttatggagacactacttccaaaacactcaggggcttatctttgttgtggatagcaatgatcgtgaccgtgttgttgaggctagagatgagctccaccggatgttgaatgaggatgagttgagagatgctgttctcctggtatttgccaacaaacaagatcttccaaatgctatgaatgctgcagaaatcacagacaagcttggtcttcattctcttcgccaacgccactggtatatccagagcacatgtgctacctctggggaaggactatatgaaggactggagtggctctccaacaatatagctaacaaggcttagggacattttgtggaatgccgctatttcttgcttattatattatgaggttgatgggttgctgcttctcttatatagcattataatatatatatatattttactcttttaagtcttttctttttctttatttaggtgtttgatactatatcatagcaatcgtattgaatcc

SEQ ID NO: 13236 - DNA, 1086 bp, Spinacia oleracea
tctcctctttctctctctagtctctacgcgcttcacagaagttagtgacttatttaagggggaaatatggggcttacattcacaaagctgtttagccgcctcttcgcgaagaaggagatgagaattcttatggtgggtctcgatgcagctggtaagaccaccattctttataagctcaagcttggtgagatcgtcacgaccatccccactattggattcaatgtggaaactgttgaatacaaaaacatcagcttcactgtatgggatgtcgggggtcaagacaagatccgtccattgtggaggcattatttccaaaatacacaggggctcatcttcgtggttgacagtaatgatagagatcgtgttgttgaggcaagggatgagttgcacaggatgttgaatgaggatgagctacgcgaagcagtgttgcttgtcttcgctaacaaacaggatcttcctaatgcgatgaatgctgctgaaattactgataagctcggccttcactctctccgacagcgtcactggtatattcagagcacttgtgcaacctctggggagggactttatgaaggtttggattggctttctaacaacattgcaaacaaggcttaaggatttggaattttgtcatggcctgttggtcctggatgcaggtgtgaagattatctaagtcgcgtttgtttttgttaaccatttttaccgtagaaaactcagtttgtggttgtaattttgtggaccggagcgataagtttttggcttagagctttgcatatggatatatgttactaaatagcggttgagcgttgtttgtaaacacaagattctttgggttcccatttgtgtaattgcaatagatgtaactgaaagttaaatactagccgtctttgtgaggctcctgatagtggtgattcagtttagtgattttgtattactatccttaagttactttcacattattcgtttaccagtagtttatatggccttgtgagcttggataatgcaatctgtattagctgcaggacatccaagaccagttagccaatggttaagaatttgcaagaactttttagttattcatttgtttca

SEQ ID NO: 13237 - DNA, 1458 bp, Picea glauca
tcttccagcctcatccgtaactgtcaactgcggatgctctggtgattacatagcagtgaaggggcgtaaacgaagagctccaaagtaaagagagtgatccctccctctctttaatcgggaagccttcggggattcttctgcgcagtccctcaacagctctgctcgcattttcaatttcccttcgggagttgtttaactcaaagctgaaaagatggggctcactttcaccaagcttttccagcggctttttgcaaagaaggagatgcgcattcttatggtgggtctcgatgcagccggtaagaccaccattttgtacaagctcaagctgggagagatcgtcactactatcccaaccattggtttcaatgtggagactgtagagtacaagaatatcagcttcactgtttgggatgttggaggtcaggacaagatccgaccgctctggagacattacttccagaatactcagggtctaatatttgtggttgacagcaatgatagagaccgtgtagttgaggctagagatgaattgcaccggatgctgaatgaggatgaactacgtgatgctgtcttacttgtattcgcaaacaagcaagatcttccaaatgctatgaatgccgcagagatcactgataagcttggtctgcattctctgcgacagcgccattggtatattcagagcacttgtgcaacttctggtgaaggcctttatgaaggcttggattggctttcaaacaacattgccaacaaggcataatttggaatgcgtctaatttctatattgggcacgaagtttattagccatgaagtagattccttcagaattacaatgatcgacagccactggcatggattttttaaagaagaccttgactcgattcattttcttgatagcttgattgctatgtattttacaacttgtcattattgtgcgagaatctgggatttttctgtctgccagttgtgctatattgactatattagctctgctacacatctaactattatcttttgattgagaagacttgtataattagattttagtggattgaaaggcttttctatgttcaataggaacaaatataatgctgctttccaaatttattagttgggaaaaacagaaagtagttcagtatttacattagtatctgaagcttctataagatatttatatctgtattcttttcctgtccagttgaggttgcctgattgtgaagtttatagtgataatgctgtatgctgcatcatcgtgaaagctatagcagtataaagtgtatgtcattgttatgctggttattagtagtctgtttgttttggaataaacataaaaggtgcacgggagttaatagtctaggttgagttgacctctttcttcttctttgaagagatagatgcacatgttttaaaaagaacgctggtcatgtatgctttgaaactatcaaaattgctttgaagtcc

SEQ ID NO: 13238 - DNA, 1039 bp, Picea glauca
tattcgttcatctcaggcctctgcagaaacgaactcttcatcagcggggtctgcgattttacaggatatttgattttctctcaagtttggcaagatggggctcacgttcaccaagctctttcagcgtctgtttgccaagaaggaaatgcgtattctgatggtgggtcttgatgctgccggtaagaccaccattctgtacaagctgaagcttggagaaattgtcaccacaattcccactattggtttcaatgtggagactgtcgagtacaagaatattagcttcactgtttgggatgtcggaggtcaggacaagatccgaccactatggagacattactttcagaatacccagggtcttatatttgtcgtggatagtaatgacagggaccgtgttgttgaagcaagagatgaattgcatagaatgttgaatgaggatgagctacgagatgctgttcttcttgtatttgcaaacaagcaggatcttcccaatgcaatgaatgctgctgagataactgataagcttggcctgcattctttacgtcagcgccattggtatatccagagtacttgtgctacttctggtgaaggactgtatgaaggcttggattggctttctaacaacattgcaaacaaggcataatgttgaagcatagtaatgatgctgtgatgcctttcagaatgggttggattctgtgcattttgagtattggttggatactttctgcgatgtagtggacgtgtttcatgcttctcctagtaaattgaagtagataaatagttaaggggggttgaggatctattctgtggtgtactgatccttagtttacttgttttgttgtttgaaattttgcatgtctacaattgtttcataatcaactatgaattcttccagtgggttcctcaggatttcagtgtgcaatttattgccctgtgccccctctttttgccttgtttgtggattcaaaagtactgttactgaaattccaaagttacatattcttttgaatttatatatattgcatgttatgcatgtaccaga

SEQ ID NO: 13239 - DNA, 1223 bp, Picea glauca
attcaaatataaatatatcctagaatcaatcccgattacctcttccagcctcatccgtaactgtcaactgcggatgctctggtgattacatagcagtgaaggggcgtaaacgaagagctccaaagtaaagagagtgatccctccctctctttaatcgggaagccttcggggattcttctgcgcagtccctcaacagctctgctcgcattttcaatttcccttcgggagttgtttaactcaaagctgaaaagatggggctcactttcaccaagcttttccagcggctttttgcaaagaaggagatgcgcattcttatggtgggtctcgatgcagccggtaagaccaccattttgtacaagctcaagctgggagagatcgtcactactatcccaaccattggtttcaatgtggagactgtagagtacaagaatatcagcttcactgtttgggatgttggaggtcaggacaagatccgaccgctctggagacattacttccagaatactcagggtctaatatttgtggttgacagcaatgatagagaccgtgtagttgaggctagagatgaattgcaccggatgctgaatgaggatgaactacgtgatgctgtcttacttgtattcgcaaacaagcaagatcttccaaatgctatgaatgccgcagagatcactgataagcttggtctgcattctctgcgacagcgccattggtatattcagagcacttgtgcaacttctggtgaaggcctttatgaaggcttggattggctttcaaacaacattgccaacaaggcataatttggaatgcgtctaatatctatattgggcacgaagtttattatccatgaagtagattccttcagaattacaatgatcgacagccactggcatggattttttaaagaagaccttgactcgattcattttcttgatagcttgattgctatgtattttacaacttgtcattattgtgcgagaatctgggatttttctgtctgccagttgtgctatattgactatattagctctgctacacatctaactattatcttttgattgagaagacttgtataattaaattttagaggattgaaaggcttttctatgttcaataggaacaaatataatgctgctttccaaatttattagttgggaaaaacagaaagtagttcagtatttacattagtatctgaagcttctataagatatttatatctgtattct

SEQ ID NO: 13240 - DNA, 1150 bp, Picea glauca
ttaattaaattaatccccccccccccccggttcatctcaggcctctgcagaaacgaactcttcatcagcggggtctgcgattttacaggatatttgattttctctcaagtttggcaagatggggctcacgttcaccaagctctttcagcgtctgtttgccaagaaggaaatgcgtattctgatggtgggtcttgatgctgccggtaagaccaccattctgtacaagctgaagcttggagaaattgtcaccacaattcccactattggtttcaatgtggagactgtcgagtacaagaatattagcttcactgtttgggatgtcggaggtcaggacaagatccgaccactatggagacattactttcagaatacccagggtcttatatttgtcgtggatagtaatgacagggaccgtgttgttgaagcaagagatgaattgcatagaatgctgaatgaggatgagctgcgagatgctgttcttcttgtatttgcaaacaagcaggatcttcccaatgcaatgaatgctgctgagataactgataagcttggcctgcattctttacgtcagcgccattggtatatccagagtacttgtgctacttctggtgaaggactgtatgaaggcttggattggctttctaacaacattgcaaacaaggcataatgttgaagcatagtaatgatgctgtgatgcctttcagaatgggttggattctgtgcattttgagtattggttggatactttctgcgatgtagtggacgtgtttcatgcttctcctagtaaattgaagtagataaatagttaaggggggttgaggatctattctgtggtgtactgatccttagtttacttgttttgttgtttgaaattttgcatgtctacaattgtttcataatcaactatgaattcttccagtgggttcctcaggatttcagtgtgcaatttattgccctgtgccccctctttttgccttgtttgtggattcaaaagtactgttactgaaattccaaagttacatattcttttgaatttatatatattgcatgttatgcatgtaccaggtgcctgtatatgatgttgcttgtagtgccttttgaattttcccaaattatggatatacataagaaaaaaaaaaaaaaaagagctctt

SEQ ID NO: 13241 - DNA, 960 bp, Picea glauca
atattcgttcatctcaggcctctgcagaaacgaactcttcatcagcggggtctgcgattttacaggatatttgattttctctcaagtttggcaagatggggctcacgttcaccaagctctttcagcgtctgtttgccaagaaggaaatgcgtattctgatggtgggtcttgatgctgccggtaagaccaccattctgtacaagctgaagcttggagaaattgtcaccacaattcccactattggtttcaatgtggagactgtcgagtacaagaatattagcttcactgtttgggatgtcggaggtcaggacaagatccgaccactatggagacattactttcagaatacccagggtcttatatttgtcgtggatagtaatgacagggaccgtgttgttgaagcaagagatgaattgcatagaatgctgaatgaggatgagctacgagatgctgttcttcttgtatttgcaaacaagcaggatcttcccaatgcaatgaatgctgctgagataactgataagcttggcctgcattctttacgtcagcgccattggtatatccagagtacttgtgctacttctggtgaaggactgtatgaaggcttggattggctttctaacaacattgcaaacaaggcataatgttgaagcatagtaatgatgctgtgatgcctttcagaatgggttggattctgtgcattttgagtattggttggatactttctgcgatgtagtggacgtgtttcatgcttctcctagtaaattgaagtagataaatagttaaggggggttgaggatctattctgtggtgtactgatccttagtttacttgttttgttgtttgaaattttgcatgtctacaattgtttcataatcaactatgaattcttccagtggggttcctcaggatttcagtgtgcaatttattgccctgtgccccctctttttgccttgtttgtgg

SEQ ID NO: 13242 - DNA, 879 bp, Picea glauca
tctcaagtttggcaagatggggctcacgttcaccaagctctttcagcgtctgtttgccaagaaggaaatgcgtattctgatggtgggtcttgatgctgccggtaagaccaccattctgtacaagctgaagcttggagaaattgtcaccacaattcccactattggtttcaatgtggagactgtcgagtacaagaatattagcttcactgtttgggatgtcggaggtcaggacaagatccgaccactatggagacattactttcagaatacccagggtcttatatttgtcgtggatagtaatgacagggaccgtgttgttgaagcaagagatgaattgcatagaatgctgaatgaggatgagctgcgagatgctgttcttcttgtatttgcaaacaagcaggatcttcccaatgcaatgaatgctgctgagataactgataagcttggcctgcattctttacgtcagcgccattggtatatccagagtacttgtgctacttctggtgaaggactgtatgaaggcttggattggctttctaacaacattgcaaacaaggcataatgttgaagcatagtaatgatgctgtgatgcctttcagaatgggttggattctgtgcattttgagtattggttggatactttctgcgatgtagtggacgtgtttcatgcttctcctagtaaattgaagtagataaatagttaaggggggttgaggatctattctgtggtgtactgatccttagtttacttgttttgttgtttgaaattttgcatgtctacaattgtttcataatcaactatgaattcttccagtgggttcctcaggatttcagtgtgcaatttattgccctgtgccccctcttttttgccttgtttgt

SEQ ID NO: 13243 - DNA, 1228 bp, Picea glauca
ttccagcctcatccgtaactgtcaactgcggatgctctggtgattacatagcagtgaaggggcgtaaacgaagagctcaaaagtaaagagagtgatccctccctctctttaatcgggaagcctttgaggattcttctgcgcagtccctcaacagctctgcttgcattttcaatttcccttcgggagttgttcaactcaaagctgaaaagatggggctcactttcaccaagcttttccagcggctttttgcaaagaaggagatgcgcattcttatggtgggtctcgatgcagccggtaagaccaccattttgtacaagctcaagctgggagagatcgtcactactatcccaaccattggtttcaatgtggagactgtagagtacaagaatatcagcttcactgtttgggatgttggaggtcaggacaagatccgaccgctctggagacattacttccagaatactcagggtctaatatttgtggttgacagcaatgatagagaccgtgtagttgaggctagagatgaattgcaccggatgctgaatgaggatgaactacgtgatgctgtcttacttgtattcgcaaacaagcaagatcttccaaatgctatgaatgccgcagagatcactgataagcttggtctgcattctctgcgacagcgccattggtatattcagagcacttgtgcaacttctggtgaaggcctttatgaaggcttggattggctttcaaacaacattgccaacaaggcataatttggaatgcgtctaatatctatattgggcacgaagtttattagccatgaagtagattccttcagaattacaatgatcgacagccactggcatggattttttaaagaagaccttgactcgattcattttcttgatagcttgattgctatgtattttacaacttgtcattattgtgcgagaatctgggatttttctgtctgccagttgtgctatattgactatattagctctgctacacatctaactattatcttttgattgagaagacttgtataattagattttagtggattgaaaggcttttctatgttcaataggaacaaatataatgctgctttccaaatttattagttgggaaaacagaaagtagttcagtatttacattagtatctgaagcttctataagatatttatatctgtattcttttcctgtgaaccagttggggttgcctgattgtggagtttatagtgaa

SEQ ID NO: 13244 - DNA, 1482 bp, Picea glauca
ggtattcaaattgaatagagcaatcaaagtttatgcaaccacgggtctcctgaatggaatatattcaaatataaatatatcctagaatcaatcccgattacctcttccagcctcatccgtaactgtcagctgcggatgctctggtgattacatagcagtgaaagggcgtaaacgaagagctccaaagtaaagagagtgatccctccctctctttaatcgggaagccttcggggattcttctgcgcagtccctcaacagctctgctcgcattttcaatttcccttcgggagttgtttaactcaaagctgaaaagatggggctcactttcaccaagcttttccagcgactttttgcaaagaaggagatgcgcattcttatggtgggtctcgatgcagccggtaagaccaccattttgtacaagctcaagctgggagagatcgtcactactatcccaaccattggtttcaatgtggagactgtagagtacaagaatatcagcttcactgtttgggatgttggaggtcaggacaagatccgaccgctctggagacattacttccagaatactcagggtctaatatttgtggttgacagcaatgatagagaccgtgtagttgaggctagagatgaattgcaccggatgctgaatgaggatgaactacgtgatgctgtcttacttgtattcgcaaacaagcaagatcttccaaatgctatgaatgccgcagagatcactgataagcttggtctgcattctctgcgacagcgccattggtatatccagagtacttgtgctacttctggtgaaggactgtatgaaggcttggattggctttctaacaacattgcaaacaaggcataatgttgaagcatagtaatgatgctgtgatgcctttcagaatgggttggattctgtgcattttgagtattggttggatactttctgcgatgtagtggacgtgtttcatgcttctcctagtaaattgaagtagataaatagttaaggggggttgaggatctattctgtggtgtactgatccttagtttacttgttttgttgtttgaaattttgcatgtctacaattgtttcataatcaactatgaattcttccagtgggttcctcaggatttcagtgtgcaatttattgccctgtgccccctctttttgccttgtttgtggattcaaaagtactgttactgaaattccaaagttacatattcttttgaatttatatatattgcattttatccatgtaccagatgcctgtatatgatgttgcttgtagtgccttttgaatttcccaaattaagcttagagaatttattgaattttcattgagagcagagctacagagactaattccatttattaaaagtgtgtaactgaagaattgaaatattgcatcatacgtataggttacataaatgcttcaaatatgcatacattctaaattaaaaaataaaaaaatggtatggcgatttctc

SEQ ID NO: 13245 - DNA, 1029 bp, Fragaria vesca
gtatatattttcctgattggggctcttctcctctatctctggtgctctataaatacagagatcctcagaaaggcgtacgtatcgggttgaaggacagctcctctcctctcctctcctctcttcttagacacacaccgagagcggaagagccgtagatctctcctccttccatttccctcaggtgaaaacaatatggggctgtctttcaccaagcttttcagccgtctctttgcgaagaaggagatgcgtatactgatggtgggtctcgatgccgctggtaagaccaccattctctacaagctaaagctcggcgagatcgtcaccaccattcccaccattggattcaatgtggagactgtggaatacaagaacatcagcttcactgtctgggatgttgggggtcaggacaagattcgacccttgtggaggcactacttccaaaacacacaaggacttatatttgtggttgatagcaacgatcgtgaccgtgtagttgaagctagggatgagctgcacagaatgttgaacgaggatgagttgagggaagctgttctgcttgtatttgctaacaagcaagatcttccaaatgccatgaatgctgccgaaataactgataagctcggccttcactccctccgtcaacgccactggtatatccagagcacatgtgctacttctggtgaaggactgtatgagggactggactggctctcaaacaacattgcaaacaaggcatagattggcttaatttgaattgtgttccaagtgtgctgtaacaccaagttgacatttgatccttggtgttcagcttttgctactgtttgaagtacctgtttaccatgtttgtgttttctttttgcacactgtccatctttacctgtagcttaacaataattcatagattctcactcttttttcatggtatcaactcgataggtttgtttattgataacttgctttgtggaaggaaatagcatcatttatttatttttctagtttaaccctattattcccccatctcgttttaca

SEQ ID NO: 13246 - DNA, 928 bp, Tabernaemontana elegans
aattctcgcttcctcacattgcgcgtttgtcaccttcgttctctcttcgctacgattcctcgcctctcctgtcccgaaggccatctcagggatcttccataagaaagcaaaatgggattaacgtttacaaagctgttcagccggctctttgccaagaaggaaatgcgcattttgatggtgggtcttgatgcagctggtaagaccaccatattgtacaagctcaagctcggagagatagtgaccacaattcccactatcggttttaatgttgagactgttgagtataagaacattagcttcactgtttgggatgttggtggtcaggacaagatccgtcccttgtggaggcactacttccaaaacacacaaggtcttatctttgtggtggatagcaatgatagagaccgtattgtggaggcgagggatgagttgcatagaatgttgaatgaggatgagctgcgagaggcagtgttgcttgtctttgccaacaaacaagatcttcctaatgcaatgaatgctgctgaaataactgataagcttggtctgcactccctccggcagcgccactggtacatccaaagcacctgcgcaacttctggagagggactttatgagggactggattggctttctaacaacattgctagtaaggcataaagcaacataggaaacatattcatgggttgatactggatgcaggcggctttttatctagtctttttctgttatggtgttatgaatttcaattttaagtcacttttatcttttagctgtctactggtaatagagtgctcggtcttatgtaattgcaagtgtttgtctaggttttgaatataatgcaagaggtatgagcctgtgaacgcatagtttttttaatggtagaactgtaaacgttgatccaagttgttattcaccttggttttttaat

SEQ ID NO: 13247 - DNA, 938 bp, Nicotiana tabacum
gcctctggtctttttattattcttacccctctcagtatttggcgttaatctcaggcttccatttctcgttctctctctcattttctccttctctcttcattggatccctctttcaaaagcttctttcagggatcatcaacaagaaggggaaatggggttaacattcaccaagcttttcagccggcttttcgccaagaaggaaatgcgaattctcatggttggacttgacgcagctggtaagaccaccatattgtacaagctcaagctgggggagatcgtcactactattcctaccattggtttcaatgtggaaactgttgagtacaagaatatcagcttcactgtttgggatgttgggggtcaggacaagattcgtccattgtggaggcactatttccagaacactcagggtctcattttcgtggttgatagcaatgacagagaccgtgttgttgaggcaagagatgagttgcacaggatgttgaatgaggatgagcttcgggatgctgtgctgcttgtttttgctaacaaacaagatcttcctaatgcaatgaacgctgctgaaataactgataagcttggacttcactctctcaggcagcgtcactggtacattcagagcacttgtgcaacatctggagaggggctctatgagggtcttgattggctttctaacaacattgccaacaagtcctaaggtgacacagagtttttgcgggttgatcctggatgcaggcgtgtttttatctagtttcttttcccaagtctgtggctatgaacattgtcttgacaggcattttgcatcttgttagggcaatgaaatggctctgtaatactacagtttggaaaatatgcaatgatgtttgtctaggttcaagttaatttcataaatttgtaaacaaagactagttctttatgagaattttgttaatggttaa

SEQ ID NO: 13248 - DNA, 973 bp, Nicotiana tabacum
gggtgccagagcagagggaaacgcggctaaggacagctccatttctagatctacgcactcaattctccgatcgccgatctccgttatacagagatggggctgtctttcggcaaacttttcagtcgcctttttgctaagaaagaaatgcgtattcttatggttggtcttgatgctgctggtaaaaccacaattctctacaagctcaagttgggggaaattgttaccactatccctactattggtttcaacgtggagactgttgaatacaagaacatcagctttactgtgtgggatgttggaggtcaagacaagattcgaccactatggaggcattatttccagaacacacaaggcctcatctttgtggttgatagcaatgaccgagaccgtgtagttgaggcaagggatgagcttcataggatgttaaatgaggatgaattgagagaggctgtgctgcttgtttttgcaaacaaacaagatcttccaaatgcaatgaatgcagctgaaatcaccgataagcttggccttcattctcttcgacaacgacactggtatatccaaagtacgtgtgccacttctggagaagggttgtatgaaggactagattggctttcgaacaatatttcaaacaaggcatagggcatcccatgaggttgcactccagcccacgttccttaatttggagtacagatgttaaacaccatagcttttatcattatctcttagtttggtggtttagacttctgtttcatatctgtggtcatagaagtgattaaactctgaaaatcacccacctttctttcattttttgttttcttattaatgaaatttcattgtcaacaatacttgtgggtcagctaccacattgctggatgtgctcatttgtaatgtgaaaacactagtacaatattggcttttgtatcctagtggagctactttaaccagcggccgcatgaggggtacctgtcctctc

SEQ ID NO: 13249 - DNA, 943 bp, Nicotiana tabacum
cggggtgccagagcagagggaaacgcggctaaaggacagctccatttctagatctacgcactcaattctccgatctccgatctccgttatacagagatggggctgtctttcggcaaacttttcagtcgcctctttgctaagaaagaaatgcgtattcttatggttggtcttgatgctgctggtaaaaccacaattctctacaagctcaagttgggggaaattgttaccactatccctactattggcttcaacgtggagactgttgaatacaagaacatcagctttaccgtgtgggatgttggaggtcaagacaagattcgaccactatggaggcattatttccagaatactcaaggtctcatctttgtcgttgacagcaatgaccgagaccgtgtagttgaggcaagggatgagcttcataggatgttaaatgaggatgaattaagagaggctgtgctgcttgtttttgcaaacaaacaagatcttccaaatgcaatgaatgcagctgaaatcaccgataagcttggccttcattctcttcgacaacgacactggtatatccaaagtacgtgtgccacttctggagaagggttgtacgaaggactagattggctttcgaacaatatttcaaacaaggcatagggcatcccacgaggttgcactccagcccacgttccttaatttggagtacagacgttaaacaccatagcttttatcattatctcttagtttggtggtttagacttctgtttcatatctgtggtcatagaagtgattaaactctgaaaatcacccgcctttctttcatttttggttttcttattaatgacatctcattgtcaacaatacttgtgggtcagctaccacattgctggatgtgcacatttgtgatgtaaacatatttagtacaatattggcttttgtatcctattggagctacttt

SEQ ID NO: 13250 - DNA, 1227 bp, Solanum lycopersicum
agtttggtgtcctttacttatttatcgcctgtgctttccccgaaatattaccatatatcgcgttattctcaagctctctctctctctctctctctctcaattctcgtgctttctctcactagatccctctttgcccaagctgttcttcagggatcgttaagaagaaagagaaatggggttgacattcaccaagcttttcagccggctatttgccaagaaggaaatgcgcatcctcatggttggactcgatgcagctggtaagaccaccatattgtacaagctcaagctgggagaaatcgtcaccaccattccaactattggtttcaatgtggaaactgttgaatacaagaacatcagcttcaccgtttgggatgtcgggggtcaagacaagatccgtccattgtggaggcactatttccagaacactcagggtctcatttttgtggttgatagcaatgacagagaccgtgtaggggaggcaagagatgaattgcacaggatgttgaatgaggatgagcttcgggatgctgtgttgcttgtttttgctaacaaacaagatcttcctaatgcaatgaatgctgctgaaataaccgacaagcttggactccactccctcaggcagcgtcactggtacatccaaagcacttgtgcaacttctggagagggactctatgagggtcttgattggctttctaacaacatcgccaataaggcctaagtcgaaatagagttgttgcggattcatcctggatgcaggcgggtttttatctagttccatttacttttatttcgtcttttttctttcagacattctctgaatctgtgtggttatggcatttgcttcttaggaggtcacttttgaaacgtttttgtaatacaatggttgaatgtatgtaatttgctgattaaactttattaacttgtaacaaatactagctcttttctggttattttgcagtcaatttaaaatgcatatcaaataccataatataaaaactactgtggtattaaaaatttcatttcaactcattgccagactcttctttgtgaactgagtaagaacagggtatatgttgtcaaatgcagcatataggtcatctctaaccttggctccagtgataacaattttcccagaagcaaaaaccagcagcacaattttcggtttcttcatacgatacaccaaaccaggaaatatttctggttcataacttgagaaactactgtgag

SEQ ID NO: 13251 - DNA, 882 bp, Solanum lycopersicum
atgaaatggcaatttagtgcatcacattccctttatttatttcctgtcatctttttcttattattactctctcagaatttggcgttaatctcaggcttcactctctcctattcttagatccctcttccataatcttctttcagggatcaccaacaagaaggagaaatggggctgtcattcaccaagcttttcagccggcttttcgccaagaaagaaatgcgaattctcatggttggacttgatgcagctggtaagaccacaatattgtacaagctcaagctgggcgagatcgttactactattcctaccattggtttcaatgtggagactgttgagtacaagaacatcagcttcactgtttgggatgtcgggggtcaggacaagattcgtccattatggaggcactatttccagaacactcagggtctcattttcgtggttgatagcaatgacagagatcgtgttgtggaggcaagagatgagttgcataggatgttaaatgaggacgagcttcgggatgctgtgcttcttgtttttgctaacaaacaagatcttcccaatgcaatgaatgctgccgaaataactgataagcttggactgcactctcttaggcagcgtcactggtacattcagagcacctgtgcaacatctggagagggactttatgagggtcttgattggctttctaacaatatagctaacaagtcctaaggcaatggaagagttcttgcgggttgatactggatgcaggcaggtttttatctagtttctttcccaagtcaatgtggttatgaacattgtcttgaaagtcattttgcattttgttagaacttaatgaaggctttgtaatacaagggtgggatatgtatgtaatgttgtttg

SEQ ID NO: 13252 - DNA, 820 bp, Triphysaria pusilla
taaaaatccctctctttcattgtagcgtacaacatcagcatttcgtttggtgtctccagggcagcctcacaccaagatctgcccttcaaatcttcattcttctcaaatttcgtataccaatcgcccaaaaaaatgggtttgtctttcaccaagctttttagccggctgtttgccaagaaagaaatgcgtattcttatggtaggtctcgatgctgctggtaagacaacgatattatacaaactcaagcttggagagattgtgacaaccattcctacaattggatttaatgtggaaacagttgaatacaagaacattagcttcactgtctgggatgttgggggtcaagacaagatccgaccattgtggaggcattactttcagaacactcaagggttgatatttgtggttgatagtaatgatcgggatcgtgttgttgaggctagggatgaactccacaggatgttgaatgaggatgaactgagggatgcagtgcttcttgtttttgcaaacaaacaagatctcccaaatgccatgaatgccgctgagataaccgacaagcttggacttcactctctccgtcaacgccattggtatatccagagcacatgtgctacatctggggaagggctgtacgaggggctcgactggctctccaacaacattgctaacaagggataagaagtgatgttcgaataatttagatttcccgatccttgttgaaatcgaggttgtctttctatgttgtggtttttgctcagatttaaactcatggtaattagtttaactatcatcatatagtcatctccatctgtggagattg

SEQ ID NO: 13253 - DNA, 851 bp, Triphysaria pusilla
tgaagagatcttgagctcacagatctctacacctctcatcctcctcaatttgaaagatggggttgtctttcaccaagcttttcagccggctgtttgccaagagagagatgcgtatactaatggtcggtctcgatgctgctggtaaaaccaccatcctctacaaactcaagctcggcgaaatcgtcaccacaatccctactattggattcaatgtggagactgtggaatataagaatatcagcttcactgtttgggatgttgggggtcaagacaagatccgtccattgtggaggcactactttcagaacacccagggtctcatattcgtggtggatagcaatgacagggaccgtgttgttgaagccagggatgaattacataggatgttgaacgaggatgagctgagagatgcagtattacttgtgtttgcaaacaaacaagatcttcctaatgcgatgaatgctgctgaaataactgataagctcggcctacactcactcaggcagcgccactggtacatccagagcacctgtgctacctctggtgagggtctctacgagggactggattggctctccaacaacattgctaacaaggcttaaaatgcttcatggagctgttgaagtgagctgatgcaaaatgcaggcgagtttttatctagtattatacctcttttctggcttatatatacataagaatttgttggcgttgtgcttttacgtttaggacctttgtattggctgtatagcagacaattgtttgtttcctatatttgcagttatttgcttattttttatactttttcttattgtaatacacagtgattaagactatggtgggtattgaatttt

SEQ ID NO: 13254 - DNA, 752 bp, Triphysaria pusilla
tcacaccaagatctgcccttcaaatcttcattcttctcaaatttcgtataccaatcgcccaaaaaatgggtttgtctttcaccaagcttttcagccggctgtttgccaagaaagaaatgcgtattcttatggtaggtctcgatgctgctggtaagacaacgatattatacaaactcaagcttggagagattgtgacaaccattcctacaattggatttaatgtcgaaacagttgaatacaagaacattagcttcactgtctgggatgttgggggtcaagacaagatccgaccattgtggaggcattactttcagaacactcaagggctgatcttcgtggttgatagtaatgatcgggatcgtgttgttgaggctagggatgaactccacaggatgttgaatgaggatgaactgagggatgccgtgcttcttgtttttgcaaacaaacaagatctcccaaatgctatgaatgccgctgagataaccgacaagcttggacttcactctctccgtcaacgccattggtatatccagagcacatgtgctacatctggggaagggctgtacgaggggctagactggctctccaacaacattgctaacaagggataagaagtgatgttcgaataatatagatttctcgatccttgttgaaatcgaggttgtctttcgatgttgtggtttttgctcagattaaactcatgttaattagtttaactatcatcatatagttatctccatctgtggagattg

SEQ ID NO: 13255 - DNA, 932 bp, Triphysaria pusilla
caacagcatttggtctgtcacagccacagggcagcctctcagcaagatctgccctttttattcttcttctcaaatctctgatatcaatcacccaaggcaaaagaaatgggtttgtctttcaccaagcttttcagccggctgtttgccaagaaagaaatgagaattcttatggtaggtctcgatgcagctggtaagaccacgatattatacaaactcaagcttggagaaattgtgacaaccattcctacaattggatttaatgtggagacggtggaatacaagaacattagcttcactgtctgggatgtcgggggtcaagacaagatccgaccattgtggaggcattactttcagaacactcaggggttgatcttcgtggttgatagtaatgatcgggatcgtgttgttgaggctagggatgagctccacaggatgttaaatgaggatgaactgagggatgcagtgcttcttgtttttgcaaacaaacaagatcttccaaatgccatgaatgctgccgagataactgacaaacttggcctccactctctccgtcaacgccattggtatatccagagcacatgtgctacatctggagaagggctgtacgaggggctcgattggctctccaacaacattgctaacaagggataagaagcgatgttcgaataatttaggtatctcgatccttgttgaaatcgagcatgtcttttcgacattctgattttttaattagttgtactgttaacagatagtcattttcatctctggagactgagatttgcttaatttctgcacttatacttgtctcattgtgtttatttggctgcgtgcttaatatctatgatgtgtcatttagcatgtttggaaacacttttcagatctacttttagacttgaaagagttttaatgtttttgaaggtaaaaaaaaaaaa

SEQ ID NO: 13256 - DNA, 802 bp, Tripterygium wilfordii
ggacgtagatttctcttgctccctttcctcgcttaagccactctcatctctcgggcttgaagaaaatggggctttcattcaccaagctttttagtcggctctttgccaagaaagagatgcgtatcctcatggtgggtcttgatgctgctggtaagacgaccattctctacaaactcaaactgggagagattgtgaccaccattcccacaattgggtttaatgtggagactgtagaatacaagaacattagctttacagtctgggatgttgggggccaggacaagatccgtcctttgtggagacattactttcaaaatactcaagggcttatctttgtggttgatagcaatgaccgagaccgtgtggttgaggccagggatgagctacacaggatgttgaatgaggatgaattgagagaggcagtgttgctagtgtttgctaacaagcaagatctgccaaatgctatgaatgctgcagagataactgataagcttggtcttcattctctccgtcagcgccactggtatatccagagtacatgcgccacttctggtgaggggctgtatgaaggacttgactggctctcaaataatattgcaaacaaggcatagacagcggaattctgagttttggattgcagcaagttgtggaacacaaagctggttgttccttattttgttttagcgtaccatttcttcatagaatctctgttacttgagtcatagattatttgtgttttctcatgcaaacgtttgctatttagcctgtagttgcagaaataattcatacgtttcaaattttc

SEQ ID NO: 13257 - DNA, 874 bp, Tripterygium wilfordii
aaaaaccgtgtgaagaacggacagggagatttctcttgctcgctttcctcgcccaacccactctcctctcgggcttgaaaaaaatggggctttcattcaccaagctttttagtcggctctttgccaagaaggagatgcgtatcctcatggtgggtcttgatgctgctggtaagaccaccattctctacaaacttaagctgggagagattgtgaccaccattcccactattgggtttaatgtggagactgtagaatacaagaacattagctttacagtctgggatgtcgggggccaggacaagatccgacctttgtggagacattactttcaaaacactcaagggctcatctttgttgttgatagcaatgaccgagaccgtgtggttgaggccagggatgagctacacaggatgttgaatgaggatgaattgagagaggcagtgttgctagtgtttgctaacaagcaagatctgccaaatgctatgaatgctgctgagataactgataagcttggtcttcactctctccgtcagcgccactggtatatccagagtacatgcgccacttctggtgaggggctgtatgaaggacttgactggctctcaaataatattgcaaacaaggcatagacagcagaattctgagttttggattgtggcaagttctggaacacacggctggttatttcttattttgttttacggtaccattactttatagaatctttgttacttgagtcagattatttgtgtttttctcatgcaaacattgctattgtttacccagtagttgcagaataattctcacatgtcaaaatttacgtctttctgcctattttctctgctgttgtcttgtttttcttgctatcaaccat

SEQ ID NO: 13258 - DNA, 839 bp, Utricularia gibba
tccccgtgcgtttctctactgcctgatagctgatagctagcgcgcagcgaaaagagaggaagatgggtcttacgttcacaaagctttttagtcggctctttgccaagagggagatgcgtattttaatggttggtcttgatgctgctggtaaaacaaccatcctgtataagttgaagcttggagaaattgttaccaccattcctaccattggttttaatgttgagactgttgagtacaagaacataagcttcactgtatgggatgttggcggccaggacaaaatccgtccattatggaggcactacttccaaaatacgcaaggtctcatatttgtggttgatagcaatgacagggaccgtgttgtggaggctagggatgaactacataggatgttaaatgaggatgagcttagagatgcagtgctgcttgtttttgctaacaagcaagatcttcccaacgcaatgaatgcggctgagattactgacaagttaggcctgcattcgctcaggcagcgacattggtacatacagagcacctgcgctacatctggggaggggctctatgaaggactggattggctctctaacaacattgcaaacaaggcataaatgctgaagcggtctctccactgcaccaagttttatgttgccttagaatccttttagtatatggttcttcaacagctgcttgcctcctctctgtctatcttcttctcgaagatttgtgttggtatgtaatcctgttgaatgtgaaacggtctatggaatccaaggagttgagacaaacggtgtaataatcacttcaaattgtcatttggcggggtttgtggcaacccacct

SEQ ID NO: 13259 - DNA, 907 bp, Valeriana officinalis
gtcctcataattacgcgttgctctcagacgctcctcccttttctatctttctctcactagatccctcatccgaaggccattcgcacagggatcaaagatggggttaacattcaccaagcttttcagccggctttttgcaaagaaggagatgcgcattctgatggttggtctcgatgcagctggtaagactaccattttgtacaagcttaagcttggagagattgtaacaacaattcctaccattggttttaatgttgaaactgtcgaatacaagaacattagcttcacagtttgggatgttggaggtcaagacaagattcgtccattgtggaggcactacttccaaaacacacaaggtctcatctttgtggttgacagcaatgacagggatcgagttgtcgaggcaagggatgagttacatagaatgttgaacgaggatgagctgagagatgcagtactacttgtgtttgctaacaagcaagatcttccaaatgcaatgaatgctgctgaaataacagataagcttggcctccattctctcaggcagcgccactggtacattcagagcacctgtgcaacatctggagagggactatacgaggggttggattggctttccaataatattgctaacaagtcttaagctgaggcggaaatgtttcttgtttggcggagtgtttctgggcggatgcagttgattcttttacatctgaagtcatttttcttagccgtggtgcactctactttcccctctttatgaggctgtgttatcaatttcatttcaaattttctcctgttttttgttattttctttttggacttgattttaaattggtacgtgcctagtagaattgttggttgatgtatctacttgcatgttggaaatgtctaggcttaaatataattc

SEQ ID NO: 13260 - DNA, 1095 bp, Vinca minor
agacgcagccctcctctctgtggcaggaatttgttcacactcgattgttcatcaacggaagctttcgagagtgttgagtggtgcatagtagagacaaagcacagatggggctaacgttcaccaagctgttcagtaggctctttgccaagaaagagatgcggattctgatggtaggtcttgatgctgctggtaagactaccatcttgtacaagttgaagctcggagagatcgttaccaccattcccactataggtttcaatgttgagactgtagaatataagaatattagcttcactgtatgggatgttggtggtcaggacaagattcgtcctttgtggaggcattacttccaaaacactcagggtcttatctttgtggtggatagtaatgatagggatcgagttgttgaagcaagggatgagctccataggatgttgaacgaggacgaactgcgagaagctgttttgcttgtatttgccaacaagcaagatctgccaaatgcaatgaatgctgcagaaattactgacaagcttggactccattctctccgccagcgccattggtatattcagagcacctgtgcaacctccggggagggcctatatgaagggctggattggctttctaacaatattgctaacaaggcatgaagcagggaaggatttttgtgggcacatggatactgttttgctttatgtcattggcaatttctagacatgatagcttattgttttgcttttaatatggaattggaaaagcttgacatatcacaagttgcttttggaactctatgttggcttgatatttttttattgtttagtttatcttttgaactatgagccttagaaattccgtgatagaattgaattgggcgcttttggcatttaactgatgaactcattctccctgatagctgtggtataatcttttccttgggtaaagttggtcattgagaaggctgtcattaaagagaacatccttctgtttaatataccaaaagaaagaaaaagaaaaagactacaatagttagaacatgatcaacaattgagtacttgtaactaagttgattgtttgttattccaaaaaatagaaagg

SEQ ID NO: 13261 - DNA, 975 bp, Juglans hindsii x Juglans regia
attgtgttggatccggggatcggccattacggccggggcccacccccacgatccatattgcgcgttggtgtgaagctcgcattagatcgatccctctgcgaagctctccgaagggatccacagccagaaagagcaatggggctgacattcacaaagcttttcagccggcttttcgccaagaaagaaatgcgaattctaatggttggtcttgatgctgctggtaagacaaccatcctctacaagctcaagcttggcgagatcgtcacaaccattcctactatcgggttcaatgtggagacggtggaatataaaaacatcagcttcactgtctgggatgtcggtggtcaggacaagatccgtcccctgtggaggcactacttccagaacactcagggtcttatttttgtggtggacagcaatgacagagaccgagttgttgaggcacgagatgaattgcataggatgttgaatgaggatgaactgcgagatgcagttttgcttgtctttgctaacaagcaagatcttcctaatgcaatgaacgctgctgagattactgataagcttggcctccactcacttcgccaacgtcactggtacattcagagcacctgtgcaacttcaggggaggggctttatgagggtttggaatggctctctaacaacatagcgaacaaggcataaagctcctgtggagtccttttgtgcactggaaattctggatgcaggggtgaatattatctagttttgttttttcttttccatcccgaagacaattggattgtggttgtgcctttttactccgggaaatgatcttttttatcaggaacttcatgctatattgtaatagaaattgggtatgttggatatgttatatacctgagctttttgtctgggttgcatgcaattctcctagttgtaatcaaaactaatttgttgcaacttcttaattgattttatacgtattatgtgattcgg

SEQ ID NO: 13262 - DNA, 794 bp, Pennisetum glaucum
tcgttcgggaagctgttcagccgcctcttcgccaagaaggagatgaggatcctcatggtcgggcttgatgccgccggtaagaccaccatcctctacaagctcaagctcggcgagatcgtcaccaccatccccaccatcggattcaatgttgaaactgtggagtacaagaacatcagcttcactgtctgggatgtcgggggtcaggacaagatcaggccgctgtggaggcattacttccagaacacacagggtctcatctttgttgtggacagcaacgatagggaccgtgttgttgaagccagggatgagctccaccggatgctgaatgaggatgaactacgtgatgctgtgctgcttgtatttgcaaacaaacaagatcttccgaatgctatgaacgctgctgaaattactgacaagcttggcctgcattccctgcgccagcggcactggtacatccagagcacttgtgctacatctggtgaaggattgtacgaaggcctggactggctgtccagcaacattgccagcaagtcttaatttttcaagaggtttggatcatctaggagctttttggatgatgatattgctggatatttagggttgggttgatattcccgtatgtaaggtgtatgccctgagctcaatagttattgagcttggttaagatttcacagttaaaattgttttgtgtaatttgggcccttgagatgtttccgaaccaaactgctaaatagtgttccgttgagttaattggttggggaaatcgtgccggtatgcatcatcgcaatgcttcg

SEQ ID NO: 13263 - DNA, 1095 bp, Hordeum vulgare
gggccgcccggtctctccaccgcaccgcactgcacgacagccatcttcatcttccgtgcggttcccaggctccaactcccacgcccgtctcccccgagatcaggcggagcacgcccgggagcgccgagaccccgagagcctccgtctccaccaccccggagcagagatggggctcacgttcaccaagctgttcagccgcctcttcgccaagaaggagatgaggattctcatggttggtctcgatgccgctggtaagaccaccatcctctacaagctcaagctcggagagatcgtcaccaccatcccaaccatcggttttaatgtcgaaactgttgaatacaagaacatcagcttcactgtttgggatgtggggggccaagacaagatcaggcccctgtggaggcactacttccagaatacgcagggcctcatttttgtcgtcgacagcaatgatagggaacgtgttgttgaggctagagacgagctccacaggatgctgaatgaggatgagctgcgtgacgctgtgttgcttgtatttgcgaacaaacaagatcttcctaatgcgatgaatgcggctgaaatcactgacaagcttggcctgcactctctgcgccagcggcactggtacattcagagcacttgcgcgacatctggtgaagggttgtacgagggacttgactggctctccaacaacattgccaacaaggcttgaagcgtatcgaggactgcttcgaggaatgaacgatgctggatgtctcgacaactcactactaccattttacatattgtgatatatatacactgtacaacagatagtatgtgtgcgtatgtgacaggcagaagctcccttctttaagtgagctagtatcaggtcaggtttttttttttgtatggatattatcagtatttctgtgccgtggttttacaaggtttactttgtcaacattgtgtgtatgaacccctgtctttttgaattttagtaagattgaggtgcggttgccaatgttggttggttcaattgagtgatgtggatggtaacattatttttactagttctgtatacgatctagtactggttcggatttgttctgccct

SEQ ID NO: 13264 - DNA, 986 bp, Cephalotaxus harringtonia
gcggtcagaagcctcccaaatatcgcaataaaggcactctcacatctcatttgcatctccctggatatttaacttgtggagcttcccagctgtcaagatgggcctgacctttaccaagctttttcaacggttgtttgccaagaaggagatgcgcattctaatggtaggtcttgacgcagctggtaagactaccatattgtacaagctcaagctgggagagatcgttaccaccatcccaactattggattcaatgtagagacagtggaatacaagaatattagcttcactgtttgggatgttgggggccaggacaagattcggccactttggagacactacttccagaatactcagggtcttatctttgtggtagacagcaatgatagagaccgtgtagttgaggcaagagatgagcttcacaggatgttgaatgaggatgagttacgagatgcagtgctccttgtgtttgcaaacaagcaggatctgccaaatgctatgaatgctgcagaaatcactgacaagcttggtttgcactctttacgacagcgccattggtatatccaaagcacttgtgctacatctggtgaaggcttatacgaaggcttggactggctttcaaacaacattgcaaacaaggcttgaggatgaagcgtaaacaaaggaaaggtatacctttttacagggctgtgttgaatatattatgatctttgctgttattcacattctattacacgttttgtagtgggtttacagtatgtcccacaaattatcttctatgcaaacttttccatctatctttgtttctcgctctattgagaagatggtggtttatatgctttgtttagggttttcaagtttaaagaagcaacctatttgtatagaaccccgagtctgtggttctatttgctcttgtacttatgatatttcaaatctgctatgttaatgttttcatagatttttgtgtttttgcaatttctcatttgaa

SEQ ID NO: 13265 - DNA, 1015 bp, Cycas rumphii
gatctgtgggagaagaagatatctgaggcatctgccctgtgttctgcgatccgcgagctataaacatggggctgactttcaccaagcttttccagcggttgtttgcgaagaaggagatgcgcattcttatggttggtcttgatgcagctggaaagaccaccattttgtataagctcaagctgggagagattgttacaacaattccaaccattggcttcaatgtggagaccgtggaatacaagaatattagcttcactgtttgggatgttggaggtcaagacaagatccgaccactgtggagacactacttccagaatacccagggtcttatctttgtggtggacagcaatgatagagaccgtgtagttgaggcaagagatgagttgcacaggatgctgaatgaggatgaattacgagacgcagtcctgctcgtgtttgcaaataaacaggatcttccaaatgcaatgaatgctgcagagattactgacaagcttgggttgcactctttgcgccaacgtcattggtacatccagagcacatgtgctacatctggtgaaggcttgtatgagggcttggactggctttcaaacaacattgcaaataaggcttgaggatgaactgtggacctagattgtggtttagatatggggcaaattcatacagggcagtgatgataggttcaacaaccctcgtgatttatcttgaggatttacaatgagaacgagttttgcagtgacccaagagccccacttaacttatcaattattttgttcttattgatttgcctacttattttaattctgtaatcaaccaagaatccagggattttgaattgtgtttttgtattgtcaggtttgaagaggcaacttattcatatagtgcttattctgggcttttgcattctgtttttgagtgtgttcacattttaattctgtaatcaaccaagaatccagggattttgaattgtgtttttgtattgtcaggtttgaagaggcaatttattcatatagtgctt

SEQ ID NO: 13266 - DNA, 1038 bp, Mimulus guttatus
cgcggaaactgaaaataaataaaaaataaataaaaaaatactcttgctaactaagatatttacgccaatagacgtctcatctcatcccctatttggtagctgattggagagagatctttggctgagagatctctgcgtcgctcaaccctcaccgatcctcgtcaaatttaagcgatggggttgtctttcaccaaactcttcagccggctgtttgccaagagagagatgcgtatactaatggttggtcttgatgctgctggtaaaacaaccattctctacaagctcaaactcggtgaaattgtcaccaccattcctactattggattcaatgtggagactgtggaatataagaacattagcttcacagtttgggatgttgggggccaggacaagattcgtccattgtggaggcactatttccagaacactcagggcctaatctttgttgttgacagcaacgatcgagatcgtgttgtcgaagcaagggatgaactgcacaggatgttgaatgaggatgaattgagggacgctgttcttttggtgtttgccaacaagcaagatcttccaaatgctatgaacgctgctgaaataactgacaagttgggccttcattcccttcgccaacgtcattggtatattcagagcacatgtgcaacttctggtgaagggttgtacgagggattagactggctgtcaaacaacattgctaacaaggcttgaatacgtcagtcggaggttacaatgtaccctatggctttgttttttttgttgcttttagtttctttaaaacattatgtcctaaaaccttggttttcagccaagaaaatcgctgtattttcaatgaatttatgatatatttttgtttttgtcaatcttgtggatctctgcctgttcctattatggtgaaactaggaatacgtatttttacgaacttatgtggattatgatcatattcaggacaatttgtactcttcagacatctatgccaataatcacaaggagtcagtagctatgctatttactttgttcgtttgccta

SEQ ID NO: 13267 - DNA, 844 bp, Lippia dulcis
ttttgctttgcttcccaaatcactcatttttctctgggtttcttcagcattagaaaatgggtttgtctttcaccaagcttttcagtcggctatttgccaagaaggagatgcgaattcttatggtaggtctagatgctgctggtaagactaccatattgtacaaactgaagttgggagaaatagtgacaaccattcctacgattggtttcaatgtggagactgtggagtacaagaatataagcttcactgtctgggatgttggtggtcaagacaagattcggccattgtggaggcattactttcagaacactcaaggtctgatcttcgtggttgatagtaatgatcgagatcgtgctgttgaggctagggatgagctgcataggatgttaaatgaggatgagttgagggatgctgtgctgttagtttttgcgaacaaacaggatcttccaaatgctatgaatgctgctgaaataactgacaagcttggacttcattctctccgtcaacgtcattggtacattcagagcacatgtgcaacctctggtgaaggactatacgaggggctggactggctctccaacaacattgctaacaaggcttgagagagagagagagagagatgttggattggattttggtatctgtatggttgttttgactcaatattgcattttttgtttttcgggcatttagtggcctcatatgatgtatgattgtgattcactacataatttctgcttctatactatacctcattggctgagattcatttctggaatgatatgctggcactagtttgtagaatgtgtatttgaagtacttaattaaaagattgtgaggaaat

SEQ ID NO: 13268 - DNA, 718 bp, Ananas comosus
caagcttccaatctctctctcttgctagatcccttttaccccaagggatcaatcaccagcaaagagacatgggtttgacattcaccaagcttttcagccggctttttgccaagagggagatgcgtattcttatggtaggtcttgatgccgctggtaagaccaccatactctacaagctcaagctcggtgagattgtgaccacaatccctactattggctttaacgtcgaaactgttgagtacaaaaacatcagctttaccgtgtgggatgttgggggtcaggacaagatccgtccattgtggaggcactatttccagaacacccagggtctcatttttgtggtggatagcaatgacagagaccgtgttgttgaggcaagagatgagttgcaccgcatgttgaatgaggatgaattgagggatgccgtattgcttgtctttgctaacaaacaagatcttccgaatgcaatgaacgcagctgaaataaccgataagcttggtctccactctctccgacagcgccactggtacatccagagcacttgtgcgacctccggcgagggcctgtatgaggggttggattggctctccaacaacattgcaaataaggcttgagtacggggcaggcactggatggtttttatctagtctatttgtttccttccctttctttcatgccagacaatataccatgtcgatttcgtgttgttaagtgttac

SEQ ID NO: 13269 - DNA, 1021 bp, Taxus baccata
tcgggggagtcaaatacattttttaacggacaaaatgcttggcgtaacctcgatcttgtaacccacagcgatcttattaactctatttaaatcgtggtaagaagctccaatccttcgcattaaagacattcccagcattttatttgctcctctctggatatttttctctgcggagcttctgagttgtcaagatgggtctgacatttaccaagctttttcaacggctgtttgccaagaaggagatgcgaattctaatggtaggtcttgatgcagctggtaagactaccattttgtacaagctcaagctgggagagatcgttaccactattccaactataggattcaatgtagagactgtggaatacaagaatattagtttcactgtttgggatgttggtggccaggacaagattcgaccgctttggagacactacttccagaatactcagggtcttatctttgtggtagacagcaatgatagagaccgtgtggttgaggcaagagacgagcttcacaggatgttgaatgaggatgaattacgagatgcagtgctccttgtgtttgcgaacaagcaggatctaccaaatgctatgaatgctgcagaaatcactgacaagcttggtttgcactccttacggcagcggcattggtatatccagagcacttgtgctacatctggtgaaggattatacgaaggcttggactggctttcaaacaacattgcaaacaaggcttgaggatgcagcataaacaaagtaaaggcgcacctttttatagggctgtgttgaatatgctttgatctttgctgttatcacattttattacacgttttgtggtgaattcaagtagatccacggattctcttccatgttaattttccatctttgtttctcagtatattgagagatgttggtgatttttacttttgtagtattttaaagtttaaagaagcagtctattgatatagaagcccaagtatgtgtctctatttgctatttaacttcaagatatttcaaacccg

SEQ ID NO: 13270 - DNA, 1696 bp, Triticum aestivum
ataagtggagttatgatgaggttgtgatccctgatatgacactcagagattacctcgccattgctcaaaaagaaaaggaaaagtttcatcaataccttccacatacagcaggccgttacaacgtcaagcgtttccgtaaggcccaatgtcctattgttgaacgattaacaaactctctcatgatgcacggcagaaacaacggaaagaagcttcttgccgttcgtatcgtcaaacatgcatttgaagttattcacttgttgagtggtgaaaatcctctccaagttttagtcaacgccatcataaatggtgctcctcgtgaagattcaactcgtgttgggaatgcaggaactgcaagacgtcaagctgttgatgtttccccacttcgtagagtaaatcaagccatctacttaatctgtgctggcgctcgaactgctgcatttagaaatgtaaaaacaatctcagagtgtttagctgatgagcttatcaattgttcaaaagaatcccctaacagctatgctttcaaaaagaaggacgagatcgaaagagtagctaaatccaatcgttaaacgaatattattcttaattttgttgttgtggacgtaaataaagcctgccttctccctttaaaaaaatttctctcctcctcctcctgccaccgatcccgaaccagggaggaacccggcgcgaggagggcaaaggaagagaagaggagatcaccgagcccagcgcgcgcacaggacagcaggcgccgcgatctcgcgcaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgtttgcaaacaagcaagatcttcctaatgccatgaacgctgctgaaatcactgacaagcttggcctgcattctctgcgccagcgacactggtacatccagagcacatgtgctacctctggagaggggttgtacgagggccttgactggctgtccaacaacattgccaacaaggcttgaagcatctcggcaggggcttctatggatctggataagctggatattcggactaatactgcctttacgtattataaactatatagtcttgacagataatgtgggtgttttggaaagataaagctctctgtcaaagagctagctatcagattgttttcgtgggtgttaaattgtccgtggcgctgtttgtttgcccatcatggttttactatgtccgctctgtactctgtactcgccactccgacagacttgatacattgtagtattgacttgtcttggcatagtttgtcagcgtgtcttctgaattgctatctcttgtgttgatttcatgtgcaaagtacattttccatcccgaaacaacgtgatcaactggaaatgctg

SEQ ID NO: 13271 - DNA, 917 bp, Amorphophallus konjac
cgtccttatctgctccgctttgatcggaattgttgatctaggtgagcgaacatggggctaacgttcacgaagctcttcagccggctcttcgccaagaaggagatgaggatccttatggtggggcttgatgccgccggtaagacgaccatcctgtacaagctcaagctgggggaaatcgtcaccaccatccccaccatcggctttaatgtagagaccgtggagtataaaaacattagcttcactgtttgggatgttggtggtcaggacaagatcaggccactgtggagacactacttccaaaacacacagggccttatctttgtcgtggatagcaatgatagggatcgtatcgttgaggcaagggatgagctccataggatgttgaatgaggatgaattgcgtgatgctgtgttgctcgtttttgcaaacaaacaagatcttccaaatgcaatgaatgctgctgagattactgataagcttggcctgcactccctacgtcagcgacactggtatatccagagcacgtgtgccacctcaggtgaaggactttatgaggggctggattggctctccaacaacattgccaacaaggcttgaagatctcgtggtaccaggagtttgagggaaatattgactacgacactgctacaccattaaaggcgggcgctggaatgctgctgtatttctttatcgtcgtatgttctttcatttcatcgctacccaacaatatctaagaatgtctttgtagacagtcgagatccgtctggtctgtgtagttaagtagataagatgatgcgtcgttgaatttcttaaaagagtgtgatgttttgtaccatatctatagatggatatgtacgagtggtatgtgtcatatggtaagggcaagttcagatagacatttaacgacatgaagagtt

SEQ ID NO: 13272 - DNA, 2085 bp, Brassica rapa
aaccctttccccttattaaaaagaaaaaaaatcaatcttcccactaataatcctttgattcatcatcgtcgtcgcgtctctcttaagcttctctagcagatcctccggtgcagagtttaaaaggacaaaaaaatggggttgagtttcgcgaagctgtttagcaagctctttgcaaagaaggagatgaggattctgatggttggtcttgatgctgctggtaagaccactattctctacaagctcaagctcggtgagattgtcaccaccatccccactattggtttcaatgtggaaactgtggagtacaagaacatcagtttcactgtgtgggatgtcgggggtcaagacaagatccgtcccttgtggaggcactacttccagaacacgcagggtctgatctttgtcgtggacagcaacgacagagacagagttgttgaggctagagatgaacttcacaggatgcttaatgaggatgagctgcgtgatgctgtgttgcttgtgtttgctaacaaacaagatcttccaaatgctatgaatgccgctgaaatcacggataagcttggccttcactccctgcgtcagcgtcactggtacattcagagcacatgcgccacttcaggtgaaggactgtacgaaggtctggactggctgtccaacaacatcgctggcaaggcgtaatgaagtaaaacagcattgcatcgagatgattcttcctgctgtatgttggtaaagtttctggatgcaagagaaagcttataaatattatatgaacctttttgctactggctattgtatgaatgttctgattgtgcaagtagatgtgtacctaaaaaacttactagtatgagccccttttgaatagttttcgtgcattttgatttgttcaaaccttggattgatgaatgaatgttattgctttcttgtcatttgtaattcgtagagccatggctgtagaaaaaattcaacattctccattagtgatgaattgtatcttaggacagcaagcgtatacgtatctgatcccaaaagtcatgaacatttctatgaccaaccaaaatcatggactgggttacagttttcctcaagaactgaatcagcacaaatcttttcgacgtctccttgatgttctcctgtgtgctgcccatctctcctttatatctccgggattcacaatccgctgctcatccagcgagggactatcatccgtttcgccggttgccaaacgtttgcggatcttagcggtctcagccaacaagtcatggatgagcatctctgttgtcttggctgtgatgcctctcagataccaagaaatgggaggcggtggaacaatcgccggctgtattagctggtcaagcgttacctttgatccgaccctccctttaccaccagtgcactgctcatactcctccagtgttttcggtttcagacgatcgcacatatgctcgtccacaaacaagggctttactttccagtttcctgggcgggggaacaatcgccggctgtattagctggtcaagcgttacctttgatccgaccctccctttaccaccagtgcactgctcatactcctccagtgttttcggtttcagacgatcgcacatatgctcgtccacaaacaagggctttactttccagtttccttcgaatctcttcatgaacccgctcttcacttgcttgaatctcatctacaaaacacatttccttttcacaaaccactaaagaaaaagactcaaaagactttttgtttagtggtcttacagagtgatctgctcggttttgatccaccaagacatgaactgagattgttccagaccaccagagaaatctccacaaagcagcttgttctacttccaccacttgcctcaatccttcatccaccactactttccgcgacagaacctcctataaatgtgatcacaggtcaggctggagcttaacctctaatggaggaagaaggtaagatagaagtaccttgatattcttgaagacccttctgttgtcagggtcaatcacaatgttataaactgcatcagggggtaaaccaacattcacctcagctttgagattgcaaagcgaccctttcgg

SEQ ID NO: 13273 - DNA, 1295 bp, Hordeum vulgare
tctcggtctctctctctctctctcctccattcctctcctcctcctcctcctgccaccgatcccaaaccagggaggaacccggcgcgaggagggcaaaggaagagaagaggagaccacccagccgaccgcgcgaccgcacgcacagggcagcagccgtcgcgatcccgcgcaggagcggacatggggctcacgttcactaagctgttcagtcggctcttcgccaagaaggagatgaggatcctcatggtcggtctcgatgcggctggtaagaccaccatcctctacaagctcaagctcggagagatcgtcaccaccatccccacaatcgggtttaatgttgaaactgtagagtacaagaacattagtttcaccgtttgggatgttgggggtcaggacaagatcaggcccctgtggaggcactactttcagaacacccagggtctcatttttgtcgtggacagcaacgacagagagcgtgttgttgaggccagagatgagctccaccggatgctgaatgaggatgagctgcgtgatgctgtcctgctggtgtttgcaaacaagcaagatcttcctaatgccatgaatgctgctgaaatcactgacaagcttggcctgcattccctgcgtcagcgacactggtacatccagagcacatgtgctacctctggggaggggttgtatgaggggcttgactggctgtccaacaacattgccaacaaggcttgaagcatctcggcaggggcttctatggatctggataagctggatattcggactaatgctgcctttacgtattataaactatatagtcttgacagataatgtgggtgttttggaaggataaagctctttgtgaaagagctagctatcagattgttttcgtgggtgtttaattgtctggtgctgtttgttttccccatcgtggtctttactatgtcagctctgtattcgccactccgacagacttgagacattgtagtattgacctgtcttggcatagtttgtcactgtgagggctgtcatgtctcttctgaattgctatcgctggtgttgatttcatgtgcaacggacattttcgaagtctctttaggctttgtttggtagaggtggatttgggaggtttggggaggagtgtatttcagtggatttgatgaatcccttccttccaccctaccaatcctcattgcatatccgtacttattcgatacacatggattatttgatacacatgcattggtacacaaggtttataaaattactatattataattaaaaatgcaatttttgcaacttca

SEQ ID NO: 13274 - DNA, 1084 bp, Cephalotaxus harringtonia
acacaaaccgtgttgtcttttcattaaccgggcctctgatatcttaaaacttaaccagtttggcaagatgggtcttacattcacgaagcttttccaacgattatttgccaagaaggagatgcgtattctgatggtgggtcttgatgccgctggtaagaccaccatattgtataagttgaagcttggcgaaattgtaaccaccattcccactatcggtttcaatgttgagactgtggagtacaagaatattagcttcactgtttgggatgttgggggccaagacaagatccgaccactatggagacattacttccagaatactcagggtcttatttttgtggtcgacagtaatgacagagaccgtgttgttgaagcgagagatgagctgcataggatgctgaatgaggatgagttgcgagatgctgttcttcttgtctttgcaaacaaacaggatcttcccaatgcaatgaatgctgccgagataactgacaagcttggcttgcactctttgcgtcagcgccattggtacatccagagcacttgtgctacttctggtgaaggcttgtatgaaggcttggattggctgtctaacaacattgcaaataaggcttgaccaagatgcatttttctaaggccatatatgcgtttgagaatgtgttgcagtcttttagagatgtagcagatatgtttaacaagtctcctagtgaattcaaatagataatagcttggataattggggatcaactctattgtgaaccgatccttagtttacttattgttttgtttgaaattttgcactacgattgtttttgtaatctctactatgatttttggcaactatctcttcaaatatcagtccatctttcctttgtccaatgttgttattgctccctctttgtcatagaaatgctattgcaattatttttaaagctttccatcagtgcttattattttgttgcatgctatgcactattgggtagcttcattggcatgtaatttaaaatggagcattggtttccaaaaatttgagaaatccgtggatgagtgggatgcaatttatttattatgctttcttttgagattc

SEQ ID NO: 13275 - DNA, 1015 bp, Chelidonium majus
gacctttattaccccgtttcacgcgtctccactctctctctctctactaaacgaaggaagtcttttgaagatctcaaagcgcagatctgatttagaggattcatagtgagacagagtcatggggttgtctttcactaagcttttcagccggctgtttgccaagagagagatgcgtattctgatggttggtctcgatgctgctggtaagactaccatcttgtacaagctcaagctcggagagattgtcactacaattcctaccattgggtttaatgtggagactgtggaatacaagaacattagcttcacagtttgggatgtcgggggtcaggacaagattcgtccactgtggaggcactacttccaaaacactcaaggacttatctttgtggtggatagcaatgaccgagaccgagttgtcgaagcaagggatgaattgcaccggatgttgaatgaggatgagttacgagacgctgtgttgcttgtttttgctaacaaacaagatctccctaatgcaatgaacgctgcagagataactgataagcttggccttcactctcttcgccaacgccattggtacatccagagcacatgcgcaacctctggagagggactttatgagggtttggattggttatccaacaacattgccaacaaggcttgaggcagcaatggaaatcagcagtagaggtttgtcggggggttttggttttctggatggcggggtaaatttaaatccaagcttttgctgagatgggcttttggatgtggaatggcttcctttaggagtcatttcataggacttttatattttctctctttttttgttaacaaatactgttgtaacaggagaatactcagtttgatgatatgatgctttataagcttgcttgttttttttgtatttgtggtcgaattctttactggctttttagctaatccttttagctgttacatacattacagtgggtggtggtgtttaccatttcgtagtagaatttatgcttgttagttt

SEQ ID NO: 13276 - DNA, 1311 bp, Chrysanthemum coronarium
aataaaaacaaataccaaccaccccttcctttcataaaccataatcatcataaaagtgtttcacaggggcttcggaatcttaaggtgattattgtatccccatcaatacagtcaattaaccaggttataagtggagatagatgcgtagaagtaaagtaggtataaaggcaataaaatttcactcagcaacatggccttcactcagcaggatggaaatgaaggaacaacctttcaagtatcgatctttacaggaatggacccatcatacagtctccctaataatgtagcattgctaacactccagatagcaaaccaaacgacgctgaatgccttagttaaggaggacaagaaaaaggataaagagatgaaggagcaagatgataaagagcaggaggaggaaaataacaaagatgaaaagattcttcaggcggaggtatcctcttcagacacattatggggcttacattcaccaaacttttcagccggctttttgccaagagagagatgcgtattttgatggtgggtctcgatgcagctggtaagaccaccattttgtacaagctcaagctcggcgagatcgtcactaccattcctacaattgggtttaacgtggagactgtcgagtacaagaacatcagcttcactgtctgggatgtcgggggtcaagacaagatccgtccactatggaggcactacttccagaacacacagggtctgatctttgtggttgatagcaacgatagggatagagttgttgaggcaagagatgagttgcacaggatgttgaatgaggacgagctaagagatgcagttcttcttgtgtttgccaacaaacaagatctgcctaatgcaatgaatgctgctgagattactgataagcttgggctccactctcttcgacaacgccactggtacatccagagcacctgcgctacttctggcgaaggactttatgaggggttggactggctctccaacaacattgctaacaaggcatgaggtgatgattaaattggatcatgaggttggaataccagcggcaagttttgcttttcatttggtcaggtcactttcgcgtcttgtcgttcttgtggctggtgcgagcagttatggaactttgtttgttaaaaaggctttttgcatttgatatatagggggcgtgtatgatacaatgttgtgtggattgcaagtatttgcaaaggtatatgtcatgtttgtagcttttgattcatataacctaaagtgttcagagagatttaacgttgcagttttatatatgcttttcttaagctagtacatcttatataaaaa

SEQ ID NO: 13277 - DNA, 1287 bp, Cocos nucifera
acgtgcgcgcggcgacatcaacgacggggaagggtcctttcccctcccgtcctctcagtccctcctatataaccgcgtcgccccactttccaattcccccaattggtcttcctctccgtctttctcacgagtagaagaagaagaggagactcccgttctcctcggcccccatccaaagcttccggagatcgatcttctgctgagaaagaaagatggggcttaccttcacgaagctcttcagccgcctctttgcgaagaaggagatgaggatcttgatggtggggcttgatgccgctggtaagaccaccattctctacaagcttaagcttggagagatcgtcaccactatccccactattggatttaatgtggaaactgtggaatacaagaatattagcttcactgtgtgggatgttggtggtcaggacaagatcagacctttgtggaggcattacttccagaacacacagggccttatttttgttgttgacagcaatgacagagatcgtattgttgaggcaagagatgagcttcacaggatgctaaatgaggatgaattacgggatgctgttttgcttgtctttgcaaacaaacaagatctgccgaatgcaatgaatgctgctgaaataacagataagcttggtctgcattccctgcgtcagcggcactggtacattcagagcacctgtgctacatctggtgaaggtttgtatgaggggcttgactggctgtccaacaacattgccaacaaggcttgaaatttcaaggtgcttgagagtactagagaatcgttattggaatattccttcatagactacatatggattcttttgggatatttagatcttcagaacttctagattgttattcacgtgatttgctctttttcctcagttttcacgtttgaaaaactgtggatttaacaattaaagtgatggaaatttgtattgaccactgaatgacttctattatgtttttctgtcccaattatcgatagaatgcttcatcatcaaatttgtgatatatagatggttctgtactatctgttttgtcattcgttgggcctttgccattgtcctccaatttgatgtcccgacgttggttttgcctgtatttaattgctctgaagttgattcatccataaaggttcttgtgagcttgctagtcgggttatatgttgatgatgcaattactagtcagttggctggatcaacggttttgattccctggttgggcccagagcatttttcctgtccttttttccattctttatggaagtgaattctt

SEQ ID NO: 13278 - DNA, 888 bp, Cryptomeria japonica
gattcttcgaggcctacgcgcaatcttgtgaagtcttttcagtaacagggcctctgatttctggaaacctcatcagctgggcaggatgggtcttacatttacgaagctttttcaacggttatttgccaagaaggagatgcgcattctgatggttggtcttgatgccgctggtaagaccaccatattgtacaagttgaaactcggtgaaattgtcactaccattcctactatcggtttcaacgttgagactgtggagtacaagaatattagcttcacagtgtgggatgttgggggccaagacaagatccgtccactatggagacactacttccagaatactcagggtcttattttcgtggttgatagtaatgacagagaccgtgttgttgaagccagagatgaactgcacaggatgctgaatgaggatgagttgcgagatgctgttcttctagtttttgcaaacaaacaggatcttcccaatgcaatgaatgcggcagagataactgacaagcttggtctgcattccttgcgtcagcgccattggtacattcagagcacttgcgctacttctggtgaaggcctgtatgaaggcttggattggctgtccaacaacattgcaaataaggcttgatttggtacaattttatgaaggccatatgcatttcagaatgtattgaaggcttttagagatgtaacagatatttttaacaagctctcctagtgaagtagatattagcttggacgagtcggatcaatttctttgtgaactgatccttcgtttactttattgttttgtttgaaattttgcactattatgattgttttgtaatcaagtactatgatttttttaacagcctctgttgattaaagtccacatttcctttgttc

SEQ ID NO: 13279 - DNA, 939 bp, Cryptomeria japonica
gggaaataaagcaattcaaacaatttcatttggatccctgaagattttgcgtacctgtggagtttctgagctgtcaagatgggtttgacttttaccaagctttttcaacggctctttgccaaaaaggagatgcgcatcctaatggtagggcttgatgcagctggtaagactaccattttgtacaagctcaagctgggagagatcgtcaccacaattccaactattggattcaatgtagagacagttgaatacaagaatatcagcttcactgtttgggatgtggggggccaggacaagattcgaccactttggagacactacttccagaatactcagggtcttatctttgtggtagacagcaatgatagggaccgtgtagttgaggcaagggatgagcttcacaggatgttgaatgaggatgagttgcgagatgctgtgctccttgtgtttgcaaacaagcaggatcttccaaatgctatgaatgctgcagagatcactgacaagcttggtttgcactctctacgtcagcgccattggtatattcagagcacttgtgctacatctggtgaaggcttatatgaaggcctggattggctttcaaacaacattgcaaacaaggcttgaggatgaaacgtggacaagtaaaggggtgcatttttacaggactgcattggaattatgatagctgcagttattctattctattacacattttgtagtgggtctggctataatatatctatgaattcttttctattctattttttctggccaactttgtgttcgtctgtactgggaagttggtttattgtggagtattttcaagtctaaagaagtaacctattatatagagccccagttttgtggttttatttgcttgtggtatgttcaactttgaagagcgatttatatatatagaacctccatttttgtgttttc

SEQ ID NO: 13280 - DNA, 933 bp, Eschscholzia californica
cgcgtctctctctctctctcctttccccaacgaagctttaggaaaacctaaaactgagatctgggcttcagaatttggaggatatagttgtgaggtagaaatatggggttatctttcacgaagctttttagtcggctttttgccaaaagagagatgcgtattctgatggttggtcttgatgcggctggtaagacaaccatcttgtataagctcaagcttggagagattgtcaccacaattcccaccattgggttcaacgtggagacagtagaatacaagaacattagcttcacagtctgggatgttgggggtcaggacaagatccgaccattatggaggcattacttccagaacacacaaggtcttatttttgtggtggatagcaatgaccgagaccgagttgtagaagcacgggatgaattgcatagaatgttgaacgaggatgagttgcgagacgctgtgttgcttgtttttgcaaacaaacaagatcttcctaatgcgatgaatgctgccgaaataactgataaacttggccttcactctcttcgccaacgtcattggtacatccagagcacttgtgcaacctcgggagaggggctttatgagggtttggactggctatccaacaatattgcaaacaaggcttgaggcgattcaatggtgtgattttcttgttcatggggttgatttttagatgggagaagtggtaataggtgtttacaaagtatttgatgttatgggacaacggtattgactttcattagacgagacgttctcacaggattttcttatatcttcggaggaaaaaacgagttgggttatgacaggagaatgctaagatgggattatgataagcttttaatttagtcttttgctttgcttgtttttatattcgagataaatacttcccttgctttttttagctaatccttt

SEQ ID NO: 13281 - DNA, 1020 bp, Festuca arundinacea
ggaagcccggcgtgaggagggcgaggaagagaggaggagatcaccgaggcgtcacgcacagggcaggaggcgtcgcgatctcgcgcaggagccgagatggggctcacgttcacgaagctgttcagccgcctcttcgccaagaaggagatgaggatcctcatggtcggtctcgatgccgctggtaagaccaccatcctctacaagctcaagctcggcgagatcgtcaccaccatccccacgatcggatttaatgttgaaactgttgagtacaagaacattagtttcacagtttgggatgttgggggtcaggacaagatcaggcccctgtggaggcactacttccagaacacccagggccttatttttgtggtggacagcaacgacagagagcgtgttgttgaggccagagatgagcttcaccggatgctcaatgaggatgagttgcgtgatgctgtgcttctggtgtttgcaaacaagcaagatcttcctaatgccatgaatgctgctgaaatcactgataagcttggcctgcattcccttcgccagcgacactggtacatccagagcacatgtgctacctctggtgagggtttgtacgaggggcttgactggctgtccaacaacattgccaacaaggcttgaagcatcttggcaggagcttcttctattatctggataagctggatgatattcggattaatgctgcctttacgtattataaactatagtcttgacagataatgtgggtgtttcgggaaagatcagctctttgtgagagagctaactatcagaatgttttcatgggtgttaattgtcagtggcgctgtttgtttgcccatcaaagttcttactatgtcctctgtacccgccaactctgagagacttgagacgttgtagtattgacttgtcttgccatagattgttgtgaatgtttcttccaatgacgtcgatttcatgttagacaaataagcattccgttgagatccctgttcaaaaaaaagaaaaaaaaaaaaaaaaaaa

SEQ ID NO: 13282 - DNA, 779 bp, Heritiera littoralis
gaagagaagggaaacaggtcagatcagatcctcttttcaaagctctccacaaagtgttgcgagctacaaagagaataagaggatggggttgacctttacaaagctctttagctggctttttgccaagaaggagatgcgtattttgatggtgggtcttgatgcagctggtaaaaccactatcttatacaagctcaagctcggcgaaatcgtcaccacaatcccaactattggattcaatgttgagactgttgaatacaagaatattagcttcactgtttgggatgttggtggtcaggacaagatccgtcctttgtggaggcattatttccagaatactcagggtctcattttcgtggtggatagcaatgacagggaccgtattgttgaggcaagggatgagttgcacaggatgttgaatgaggatgaattgagagatgctgtattgcttgtatttgccaacaaacaagatcttcccaacgcaatgaatgctgctgaaataactgataaacttggtcttcattctctccgccagcgccactggtatatccagagtacatgtgcaacttctggagagggcctttatgaggggcttgattggctttccaacaacattgctagcaaggcatgagagaattgatgttttgattgttggttaggcttgttggaattctggcaactctggagacactgaaagatagcttcttctccatccaggaacttttgtaaggacagaatgtttattagatataatatgcgctttgtttagcctgtgtgttagc

SEQ ID NO: 13283 - DNA, 1289 bp, Lolium multiflorum
ctcctccatttctctcctcttcctcctggcctgccacccgatccccaaccgaggaggaagccccggcgcgaggagggcgaggaagagaggaggagatcaccgcggcctcacgcacagggcagcggccgtcgcgatcccgcgcaggagccgagatggggctcacgttcaccaagctgttcagccgcctcttcgccaagaaggagatgaggatcctcatggtcggtctcgatgcggccggtaagaccaccatcctctacaagctcaagctcggcgagatcgtcaccaccatccccaccatcggatttaatgttgaaactgtcgagtacaagaacatcagtttcacagtttgggatgtcgggggtcaggacaagatcaggcccctgtggaggcactacttccagaacacccagggccttatttttgtggtggacagcaacgacagagagcgtgttgttgaggccagagatgagcttcaccggatgctcaatgaggatgagttgcgtgatgctgtgcttctggtgtttgcaaacaagcaagatcttcctaatgccatgaatgctgctgaaatcactgataagcttggcctgcattcccttcgccagcgacactggtacatccagagcacatgtgctacctctggtgagggtttgtacgaggggcttgactggctgtccaacaacattgccaacaaggcttgaagtatcttggcaggagcttcttctattatctggataagctggatgatattcggattaatgctgcctttacgtattataaactatagtcttgacagataatgtgggtgtttcgggaaagatcagctctttgtgagagagctaactatcagaatgttttcatgggtgttaattgtcagtggcgctgtttgtttgcccatcaaagttcttactatgtcctctgtacccgccaactctgagagacgtgagacgttgtagtattgacttgtcttgccatagattgttgtgaatgtttcttccaatgacgtcgatttcatgttagacaaataagcattccgttgagatccctgttcaatccgcgtgggcagagaaatctcgtgtcgtttgtcaatcccacactgttgagcgaaccatcttgcatggaattttcaatgtggtccgacctcatgttatttttactataaactgacaatacgattcttataagggtatgattctaagtactccatctgtttggaaatgtaagatattgaagcgatttgtttggttcatctactttagttcggtttgtatctaatctattttcatatgtag

SEQ ID NO: 13284 - DNA, 1022 bp, Lolium multiflorum
agatggggctcacgttcaccaagctgttcagccgcctcttcgccaagaaggagatgaggatcctcatggtcggtctcgacgcggccggtaagaccaccatcctctacaagctcaagctcggcgagatcgtcaccaccatccccaccatcggatttaatgttgaaactgtcgagtacaagaacatcagtttcacagtttgggatgtcgggggtcaggacaagatcaggcccctgtggaggcactacttccagaatacgcagggactcatctttgttgttgacagcaatgatagggagcgcgttgttgaggccagagatgagctccacaggatgctcaatgaggatgagctgcgtgatgctgtgttgcttgtatttgcaaacaaacaagatcttcctaatgccatgaatgctgctgaaatcactgataagcttggcctgcattcccttcgccagcgacactggtacatccagagcacatgtgctacctctggtgagggtttgtacgaggggcttgactggctgtccaacaacattgccaacaaggcttgaagcatcttggcaggagcttcttctattatctggataagctggatgatattcggattaatgctgcctttacgtattataaactatagtcttgacagataatgtgggtgtttcgggaaagatcagctctttgtgagagagctaactatcagaatgttttcatgggtgttaattgtcagtggcgctgtttgtttgcccatcaaagttcttactatgtcctctgtacccgccaactctgagagacgtgagacgttgtagtattgacttgtcttgccatagattgttgtgaatgtttcttccaatgacgtcgatttcatgttagacaaataagcattccgttgagatccctgttcaatccgcgtgggcagagaaatctcgtgtcgtttgtcaatcccacactgttgagcgaaccatcttgcatggaattttcaatgtggtccgacctcatgttatttttactataaactgacaatacga

SEQ ID NO: 13285 - DNA, 1023 bp, Avena sativa
gccacccgatcccgaaccgaggaggacccggcgcgaggagggcgaggaagagaggaggagatcacccagccgagcgagcgcgcgtcaagcacaaggcaggaagcgtcgcgatctcgcgcaggagcggagatggggctcacgttcacgaagctgttcagccgcctcttcgccaagaaggagatgaggatcctcatggtcggtctcgatgcggccggtaagaccaccatcctctacaagctcaagctcggcgagatcgtcaccaccatccccacgatcggattcaatgttgaaactgtcgagtacaagaacattagcttcaccgtgtgggatgtcggaggtcaggacaagatcaggcccctgtggaggcactacttccagaacacccagggcctcatttttgttgtggacagcaatgacagagagcgtgttgttgaggccagagatgagcttcaccggatgctcaacgaggatgagctgcgtgatgctgtgcttctggtgtttgcgaacaaacaagatcttcctaatgccatgaacgctgctgaaatcactgataagcttggcctgcattccctccgccagcgacactggtacatccagagcacttgtgctacctctggtgagggtttgtatgaggggcttgactggctgtccaacaacattgccaacaaggcttgaagcatctcggcaggggcttctgtatatctggataagctggatattcggactaataccgcctttacgtattataaactacatagtcttgacagatactttggggttgttctgggaaaagataaagctctttgtcaaagagctagctatcagattgttttcgtgggtgttaattgtccttggcgctctttgttttccctgcccatcaatgtctcgttatgtccactctgtactctgtacttgcaactcccagagagacttgagacattgtagtattgacttgtcatggcatagcttgttgtcagtgtggtctatcatgtttcttttgaattgttctggctgatgttgatt

SEQ ID NO: 13286 - DNA, 1090 bp, Avena sativa
cctgccacccgatcccgaaccgaggaggacccggcgcgaggagggcgaggaagagaggaggagatcacccagccgagcgagcgcgcgtcaagcacaaggcaggaagcgtcgcgatctcgcgcaggagcggagatggggctcacgttcacgaagctgttcagccgcctcttcgccaagaaggagatgaggatcctcatggtcggtctcgatgcggccggtaagaccaccatcctctacaagctcaagctcggcgagatcgtcaccaccatccccacgatcggattcaatgttgaaactgtcgagtacaagaacattagcttcaccgtgtgggatgtcggaggtcaggacaagatcaggcccctgtggaggcactacttccagaacacccagggcctcatttttgttgtggacagcaatgacagagagcgtgttgttgaggccagagatgagcttcaccggatgctcaacgaggatgagctgcgtgatgctgtgcttctggtgtttgcaaacaaacaagatcttcctaatgccatgaacgctgctgaaatcactgataagcttggcctgcattccctccgccagcgacactggtacatccagagcacttgtgctacctctggtgagggtttgtatgaggggcttgactggctgtccaacaacattgccaacaaggcttgaagcatctcggcaggggcttctgtatatctggataagctggatattcggactaatgccgcctttacgtattataaactacatagtcttgacagatactttggggttgttctgggaaaagataaagctctttgtcaaagagctagctatcagattgttttcgtgggtgttaattgtccttggcgctctttgttttccctgcccatcaatgtctcgttatgtccactctgtactctgtacttgcaactcccagagagacttgagacattgtagtattgacttgtcatggcatagcttgttgtcagtgtggtctatcatgtttcttttgaattgttatggctgatgttgatctcatgttgaatgggaatatctttgaaatccacaaatcgttttgatgtcttgatcattagacaga

SEQ ID NO: 13287 - DNA, 953 bp, Avena sativa
ggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcggaggtcaggacaagatcaggcccctgtggaggcactacttccagaacacccagggcctcatttttgttgtggacagcaatgacagagagcgtgttgttgaggccagagatgagcttcaccggatgctcaacgaggatgagctgcgtgatgctgtgcttctggtgtttgcgaacaaacaagatcttcctaatgccatgaacgctgctgaaatcactgataagcttggcctgcattccctccgccagcgacactggtacatccagagcacttgtgctacctctggtgagggtttgtatgaggggcttgactggctgtccaacaacattgccaacaaggcttgaagcatctcggcaggggcttctgtatatctggataagctggatattcggactaataccgcctttacgtattataaactacatagtcttgacagatactttggggttgttctgggaaaagataaagctctttgtcaaagagctagctatcagattgttttcgtgggtgttaattgtccttggcgctctttgttttccctgcccatcaatgtctcgttatgtgcactctgtactctgtacttgcaactcccagagagacttgagacattgtagtattgacttgtcatggcatagcttgttgtcagtgtggtctatcatgtttcttttgaattgttatggctgatgttgatctcatgttgaatgggaatattcttttgaaatccacaaatcgttttgtatgt

SEQ ID NO: 13288 - DNA, 1019 bp, Avena sativa
cgcgaggagggcgaggaagagaggaggagatcacccagccgagcgagcgcgcgtcaagcacaaggcaggaagcgtcgcgatctcgcgcaggagcggagatggggctcacgttcacgaagctgttcagccgcctcttcgccaagaaggagatgaggatcctcatggtcggtctcgatgcggccggtaagaccaccatcctctacaagctcaagctcggcgagatcgtcaccaccatccccacgatcggattcaatgttgaaactgtcgagtacaagaacattagcttcaccgtgtgggatgtcggaggtcaggacaagatcaggcccctgtggaggcactacttccagaacacccagggcctcatttttgttgtggacagcaatgacagagagcgtgttgttgaggccagagatgagcttcaccggatgctcaacgaggatgagctgcgtgatgctgtgcttctggtgtttgcgaacaaacaagatcttcctaatgccatgaacgctgctgaaatcactgataagcttggcctgcattccctccgccagcgacactggtacatccagagcacttgtgctacctctggtgagggtttgtatgaggggcttgactggctgtccaacaacattgccaacaaggcttgaagcatctcggcaggggcttctgtatatctggataagctggatattcggactaataccgcctttacgtattataaactacatagtcttgacagatactttggggttgttctgggaaaagataaagctctttgtcaaagagctagctatcagattgttttcgtgggtgttaattgtccttggcgctctttgttttccctgcccatcaatgtctcgttatgtgcactctgtactctgtacttgcaactcccagagagacttgagacattgtagtattgacttgtcatggcatagcttgttgtcagtgtggtctatcatgtttcttttgaattgttatggctgatgttgatctcatgttgaatgggaatatctttgaaa

SEQ ID NO: 13289 - DNA, 1132 bp, Podocarpus macrophillus
gcaactgccagcttgcgtcgcagggtataatattaaccctggtcaagcttcgtaaaatcaaagctgtctgtatcttctcattcctcctctctctcccaatctatatcgttgcagcagaggagttctccatagtatcacagccctcttcatcttgatcagatctgagagatctctaataggatggggctcactttcaccaagcttttcagcaggctttttgccaagaaggaaatgcgcattctgatggtgggtcttgatgcagctggtaagactaccattttgtacaagctgaagcttggagagatagttactacgatccccacgattggattcaatgtggaaactgttgaatacaagaacatcagctttaccgtatgggatgtggggggtcaggacaagattcgcccactttggaggcactacttccagaatacacagggtctcatatttgttgtggatagtaatgatagagaccgtatagtggaggcaagagatgagttacatcgtatgttgaatgaggatgaactacgagatgctgtgctgcttgtcttcgcaaacaagcaagatcttccaaatgcaatgaatgctgcagagattactgacaagcttgggttgcattcccttaggcaacgccattggtatattcaaagcacctgtgcaacttctggtgagggcttgtatgagggtttggactggctttcaaacaacattgcaaacaaggcttgaaggagtgtagtggactgggttttctggaattttgtaggccgagctgagattgtcttatggctttattgatagagacagtttgaggagataagaatttaacctatgcagtcaaactgactcaggagtgtggttcagtattttagcctttacttttgactgcttcaatttgtttggtttcgactatggatttttttgtgccaactgcactaatttatatagctggctcagctagtatgataatgtgtggcattaattgttcattattctcaatgcagtattcattttcaaaattggttttgggcattgtacaatcttactcttaaacatagcgaagtagattctaaacacaattcctttggatataaggagacatccttaaatctaatcttttctctatttgaatcag

SEQ ID NO: 13290 - DNA, 1046 bp, Pseudoroegneria spicata
caattctctcctcctcctcctgccaccgatcccgaaccagggaggaacccggcgcgaggagggcaaaggaagagaggaggagatcaccgagccgagcgcgccaccgcacgcacaggacagcaggcgctgcgatctcgcgcaggagccgagatggggctcacgttcacgaagctgttcagccggctcttcgccaagaaggagatgaggatcctcatggtcggtctcgatgcggccggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggccagagatgagcttcaccggatgctgaatgaggatgagctgcgtgatgctgtgctgctggtgtttgcaaacaagcaagatcttcccaatgccatgaatgctgctgaaatcactgacaagcttggcctgcattccctgcgccagcgacactggtacatccagagcacatgtgctacctctggggaggggttgtacgaggggcttgactggctgtccaacaacattgccaacaaggcttgaagcatctcggcaggggcttctatggatctggataagctggatattcggactaatactgcctttacgtattataaactatatagtcttgacagataatgttggtgttttggaaagataaagctctctgaaagagctagctatcagattgttttcgtgggtgttaattgtccgtggcgctgtttgtttgcccatcatggttttactatgtccgctctgtactctgtactctgtactcgccactccgacagacttgagacattgtagtattgacttgtcttggcatagtttgtcagcgtgagggctaccatgtctcttctgaattgctatcgcttgtgttgatttcatgtgca

SEQ ID NO: 13291 - DNA, 1016 bp, Secale cereale
tcctcctgccaccgatcccgaaccagggaggaacccggcgcgaggagggcaaaggaagagaagagaagaggagaccgccgagccgagcgcgcgaccgcacgcacaggacagcacgcgccgcgatcccgcgcaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgtttgcaaacaagcaagatcttcctaatgccatgaacgctgctgaaattactgacaagcttggcctgcattctctgcgccagcgacactggtacatccagagcacatgtgctacctctggagaggggttgtacgaggggcttgactggctgtccaacaacattgccaacaaggcttgaagcatctcggcaggggcttctatggatctggataagctggatattcggactaatactgcctttacgtattataaactatatagtcttgacagataatgtgggtgttttggaaagataaagctctctgtcaaagagctagctatcagattgttttcgtgggtgttaaattgtccgtggcgctgtttgtttgcccatcatggttttactatgtccgctctgtgtactctgtactcgccactccgacagacttgagacattgtagtattgacttgtcttggcatagtttgtcagcgtgagggtaccatgtctcttctgaattgctatggctt

SEQ ID NO: 13292 - DNA, 1022 bp, Secale cereale
ctcctcctcctgccaccgatcccgaaccagggaggaacccggcgcgaggagggcaaaggaagagaagagaagaggagaccgccgagccgagcgcgcgaccgcacgcacaggacagcacgcgccgcgatcccgcgcaggagcggagatggggctcacgttcactaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgttgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgtttgcaaacaagcaagatcttcctaatgccatgaacgctgctgaaatcactgacaagcttggcctgcattctctgcgccagcgacactggtacatccagagcacatgtgctacctctggagaggggttgtacgaggggcttgactggctgtccaacaacattgccaacaaggcttgaagcatctcggcaggggcttctatggatctggataagctggatattcggactaatactgcctttacgtattataaactatatagtcttgacagataatgtgggtgttttggaaagataaagctctctgtcaaagagctagctatcagattgttttcgtgggtgttaaattgtccgtggcgctgtttgtttgcccatcatggctttactatgtccgctctgtgtactctgtactcgccactccgacagacttgagacattgtagtattgacttgtcttggcatagtttgtcagcgtgagggtaccatgtctcttctgaattgctatggcttgt

SEQ ID NO: 13293 - DNA, 1052 bp, Secale cereale
ccactttctctcctcctcctcctgccaccgatcccgaaccagggaggaacccggcgcgaggagggcaaaggaagagaagagaagaggagaccgccgagccgagcgcgcgaccgcacgcacaggacagcacgcgccgcgatcccgcgcaggagcggagatggggctcacgttcactaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgttgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgtttgcaaacaagcaagatcttcctaatgccatgaacgctgctgaaatcactgacaagcttggcctgcattctctgcgccagcgacactggtacatccagagcacatgtgctacctctggagaggggttgtacgaggggcttgactggctgtccaacaacattgccaacaaggcttgaagcatctcggcaggggcttctatggatctggataagctggatattcggactaatactgcctttacgtattataaactatatagtcttgacagataatgtgggtgttttggaaagataaagctctctgtcaaagagctagctatcagattgttttcgtgggtgttaaattgtccgtggcgctgtttgtttgcccatcatggttttactatgtccgctgtgtgtactctgtactcgccactccgacagacttgagacattgtagtattgacttgtcttggcatagtttgtcagcgtgagggtaccgtgtctcttctgaattgctatggcttgtgttgatttcatgtgcaaa

SEQ ID NO: 13294 - DNA, 1041 bp, Secale cereale
ctctcctcctcctcctgccaccgatcccgaaccagggaggaacccggcgcgaggagggcaaaggaagagaagagaagaggagaccgccgagccgagcgcgcgaccgcacgcacaggacagcacgcgccgcgatcccgcgcaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgttgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgtttgcaaacaagcaagatcttcctaatgccatgaacgctgctgaaattactgacaagcttggcctgcattctctgcgccagcgacactggtacatccagagcacatgtgctacctctggagaggggttgtacgaggggcttgactggctgtccaacaacattgccaacaaggcttgaagcatctcggcaggggcttctatggatctggataagctggatattcggactaatactgcctttacgtattataaactatatagtcttgactgataatgtgggtgttttggaaagataaagctctctgtcaaagagctagctatcagattgttttcgtgggtgttaaattgtccgtggcgctgtttgtttgtccatcatggttttactatgtccgctgtgtgtactctgtactcgccactccgacagacttgagacattgtagtattgacttgtcttggcatagtttgtcagcgtgagggtaccatgtctcttctgaattgctatggcttgtgttgatttcatgcg

SEQ ID NO: 13295 - DNA, 1027 bp, Secale cereale
gactctcctcctcctcctgccaccgatcccgaaccagggaggaacccggcgcgaggagggcaaaggaagagaagagaagaggagaccgccgagccgagcgcgcgaccgcacgcacaggacagcacgcgccgcgatcccgcgcaggagcggagatggggctcacgttcactaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgttgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgtttgcaaacaagcaagatcttcctaatgccatgaacgctgctgaaatcactgacaagcttggcctgcattctctgcgccagcgacactggtacatccagagcacatgtgctacctctggagaggggttgtacgaggggcttgactggctgtccaacaacattgccaacaaggcttgaagcatctcggcaggggcttctatggatctggataagctggatattcggactaatactgcctttacgtattataaactatatagtcttgacagataatgtgggtgttttggaaagataaagctctctgtcaaagagctagctatcagattgttttcgtgggtgttacattgtccgtggcgctgtttgtttgtccatcatggttttactatgtccgctgtgtgtactctgtactcgccactccgacagacttgagacattgtagtattgacttgtcttggcatagtttgtcagcgtgagggtaccatgtctcttctgaattgctatggctt

SEQ ID NO: 13296 - DNA, 991 bp, Sequoia sempervirens
gggcattcgaatcgaaagaaagcaactcatattttcatttgcatccctgaagattttaggtacttgtggatcttctgagctgtcaagatgggtctgacttttaccaagctttttcaacgactctttgccaagaaggagatgcgcattctaatggtaggccttgatgcagctggtaagactaccattttgtacaagctcaagctgggagagatcgtcaccacaattccaactattggattcaatgtagagacagttgaatacaagaatatcagcttcactgtttgggatgtggggggccaggacaagattcgaccactttggagacactacttccagaatactcagggtcttatctttgtggtagacagcaatgatagagaccgtgtagttgaggcaagggacgagcttcacaggatgttgaatgaggatgagttgcgagatgcagtgctccttgtgtttgcaaacaagcaggatcttccaaatgctatgaatgctgcggagatcactgacaagcttggtttgcactctctacgtcagcgccattggtatattcagagcacttgtgctacatctggtgaaggcttatatgaaggcctggattggctttcaaacaacattgcaaacaaggcttgaggattgaaacgcaaacaaaaggggcatgtttttacaggaccgcattgaaattatgatagctgcagttattcacattctattacacattttgtagtgggtcaagctacaatacatctatgaattcttttctattctaatttttctggccaactttgttagtctactgcgaagttggtttatttgctttgtggagtattttcaagtctatagaattaacctattatatagagccccagttttgtggttttatttgcttgtgtggaatcttcaactttgaagagcaacctatttatatagaacctccatttctgtggttttatttgctattgcatttcagatatttcaaatctaccagttc

SEQ ID NO: 13297 - DNA, 851 bp, Sequoia sempervirens
cacaaacttgttggtcttttcagtaacagggcctgtgatttctgaaaacctgaccagttgggcaagatgggtcttacattcacgaagctttttcaacgattatttgccaagaaggaaatgcggattctgatggtgggtcttgatgcagctggtaagaccaccatattgtacaagttgaaactcggtgaaattgttaccaccattcccactatcggtttcaatgttgagactgtggagtacaagaatattagcttcacagtttgggatgttgggggccaggacaagatccgaccactatggagacattacttccagaatactcagggtcttatttttgtggttgatagtaatgacagagaccgtgttgttgaagcaagagatgaactgcacaggatgctgaatgaggatgagttgcgagatgctgttcttctagtctttgcaaacaaacaggatcttcccaatgcaatgaatgcagcggagataactgacaagcttggtctgcattccttgcgtcagcgccattggtacattcagagcacttgtgctacttctggtgaaggcctgtacgaaggtttggattggctgtccaacaacattgcaaataaggcttgacttgggagaattttatgaagccatatgcatttcagaatgtgttgcaggcttttagggatgtaacagatatttttaacaagctctcttagtaaagtagatattagcttggacgagtggggatcaattccgttgtgagctgatccttcgtttactttattgttttgtttgaaattttgcactattatgattgtttttgtaatcaactactatgattttttaactgcccccgttgattaaag

SEQ ID NO: 13298 - DNA, 1057 bp, Eutrema halophilum
ccattacggccgggggcgcatttagcgttgttttgaagcttcttcttctctctctctctctttcaaattccgttcgtgtctagctcgttgttacgcgatctctctcagatatcttcgaaagtttttcgcagagtgaagcaggatgggtttgtctttcgctaagctttttagccggctttttgcaaagaaggagatgcgaattctgatggttggtcttgatgctgctggtaagaccaccattttgtacaagctcaagctcggagagatcgtaaccaccattcccactattgggttcaacgttgaaactgtggagtacaagaacatcagtttcacagtgtgggatgttgggggtcaggacaagatccgtcccttgtggaggcactacttccagaacactcaaggtcttatctttgtggtggacagcaatgacagagaccgtgttagtgaggctagagatgaattgcacagaatgctgaatgaggatgagctgcgtgatgctgttctgctcgtgtttgctaacaagcaggatcttccaaatgccatgaacgcagctgaaatcactgataagcttggtctccactctctccgtcagcgtcactggtacattcagagcacatgtgccacttcaggtgaagggctttacgaaggtcttgactggttgtccaacaacattgccggcaaggcgtagagggaaagttcgttgttgagttgattttgctggtcaaatctggatgcaggggcaaacatcatctgaattgtttctttctttctttccggttttcttattgttctgttttgtttttttggggtaagtggattgattttgtgattgttgttctgatttgtgtaaggtgggggtctcttgtatgtagaacatagaaactatcttttatatagtctggtaaaactgtaatcgaagatttaatctactactttcgtggcttttttgttgttgtcacgttttacttttgcactttgattccataagttgcaactgcggctacgttgattatagacatcatggagcgtacctatgttatctaagaccttcttcact

SEQ ID NO: 13299 - DNA, 932 bp, Eutrema parvulum
ttttgtgtttcttatggtttgacagtgaagcaggatgggtttgtctttcgctaagctttttagccggctttttgcaaagaaggagatgcgaattctgatggttggtcttgatgctgctggtaagaccaccattttgtacaagctcaagctcggagagatcgtaaccaccattcccactattgggttcaacgttgaaactgtggagtacaagaacatcagtttcacagtgtgggatgttgggggtcaggacaagatccgtcccttgtggaggcactacttccagaacactcaaggtcttatctttgtggtggacagcaatgacagagaccgtgttagtgaggctagagatgaattgcacagaatgctgaatgaggatgagctgcgtgatgctgttctgctcgtgtttgctaacaagcaggatcttccaaatgccatgaacgcagctgaaatcactgataagcttggtctccactctctccgtcagcgtcactggtacattcagagcacatgtgccacttcaggtgaagggctttacgaaggtcttgactggttgtccaacaacattgccggcaaggcgtagagggaaagttcgttgttgagttgattttgctggtcaaatctggatgcaggggcaaacatcatctgaattgtttttccggttttcttattgttctgttttgtttttttgggtaagtggattgattttgtgattgttgttctgatttgtgtaaggtgggggtctcttgtatgtagaacatagaaactatcttttatatagtctggtaaaactgtaatcgaagatttaatctactactttcgtgctctttctctgtcgcattttacatttgcaatccgattcattagttgaaattgccgctacgttaataatagacatcatgtgatcagacacaaacatcatgtgatcggacata

SEQ ID NO: 13300 - DNA, 1043 bp, Amborella trichopoda
ctccttcatctctggccctataaaaatagctcttcagatttgtttagtgcctccttgttacccacccatctggcggagctttcatctcgttgctcctccaaattcgggaaaaatggggctcactttcacaaagcttttcagccggttgtttgcgaagaaagaaatgcgtattctaatggttggtcttgatgcggctggtaagaccaccatattgtacaagctcaagcttggcgagattgtcaccactatccccactattggatttaatgtggagacagtcgagtataagaacattagcttcactgtttgggatgttggtggtcaggacaagatccggcctttgtggaggcattatttccagaatactcagggtcttatctttgttgtcgatagcaatgatagagatcgtattgtggaggccagagatgagcttcacaggatgctgaacgaggatgagctgagagatgctgttctgcttgtgtttgccaacaaacaagatcttccaaatgcaatgaacgctgctgagatcactgataagctgggtcttcactcccttcgacaacgccattggtacattcagagtacttgtgctacatctggggaggggctttacgaggggttggactggctctcaaacaacattgctaacaaggcctgaaaagttaagactgtaggttttggtttcttgtgattttgcggcaacaggcttatagttttcgaatggttggggtgacaatgatgtagctgttactatctcgtaatggcgtgcgtcgggaaagctatcatactaatacaccccaatctacttgtccgactgttatgagttgttttcttgatccaaatacatgacaaacatattgtgttgttctcttatccctgactagtgatatgcatgttagcctgtggattttgaattctaatttgttggaatggatatctgggatttgaagaagtgaatttacttaaagagaacagagatgtcaaattaggaatatactttctggtatgattaagctgctctgatggttgttacttctgtatta

SEQ ID NO: 13301 - DNA, 933 bp, Amborella trichopoda
tcttatattgatacgcaatttttgtttgtacgtggcatggaaatctgctagagatatggggctgactttcacaaagctattcagccggctttttgccaagaaagagatgcgaattctgatggttggtcttgatgcagctggtaagaccaccatattgtacaagctcaagttaggtgagattgtgaccacaatccccaccattggctttaacgttgagactgtggaatataaaaacatcagcttcactgtttgggatgttggtggccaggacaagatccgacctttgtggaggcactacttccaaaacactcagggtcttatatttgttgtggatagcaatgacagagatcgtattgttgaggcaagggatgagttgcataggatgttgaatgaggatgaattgcgagatgctgttttacttgtgtttgcaaacaaacaagatcttcccaatgcaatgaatgctgctgagattactgataagcttggacttcactcccttcgtcaacgccactggtatatacagagcacgtgtgccacttcgggagagggtctctatgaggggttggactggctctcgaacaacatcgctaataaggcttaatcagccaggaactgtgttttgggagacgggcggtaaatagtatctacttttgctttgttaggaagctgtgtattttttttgttttgttttttttgttgttgttcttgtatggagtgattggagatagttttggatttcattttgttttggttgctctgattcactgcttttgtacaatgctactgcttggatttgcattcctatttaatgaatcactgaacacatctgttttccagatttttgggttgaccattgacgttttatgttttttgggttgaccattaactttttatgatcagaaatctttatttactcgaattagattattgtta

SEQ ID NO: 13302 - DNA, 1198 bp, Amorphophallus konjac
agtttcgtctcgttcgcaggttctgcgtcgtacgtggagaaagcgagcaccgacttgaaagctttttcccatttcgtcgtcggaacccccggtagctggtcgctgctgcggtgctctcctctcctccctttatctcgaggtttcagatacctgtgccggcgtccttatctgctccgctttgatcggaattgttgatctaggtgagcgaacatggggctaacgttcacgaagctcttcagccggctcttcgccaagaaggagatgaggatccttatggtggggcttgatgccgccggtaagacgaccatcctgtacaagctcaagctgggggaaatcgtcaccaccatccccactatcggctttaatgtagagaccgtggagtataaaaacattagcttcactgtttgggatgttggtggtcaggacaagatcaggccactgtggagacactacttccaaaacacacagggccttatctttgtcgtggatagcaatgatagggatcgtatcgttgaggcaagggatgagctccataggatgttgaatgaggatgaattgcgtgatgctgtgttgctcgtttttgcaaacaaacaagatcttccaaatgcaatgaatgctgctgagattactgataagcttggcctgcactccctacgtcagcgacactggtatatccagagcacgtgtgccacctcaggtgaaggactttatgaggggctggattggctctccaacaacattgccaacaaggcttgaagatctcgtggaaccaggagtttgagggaaatattgacttacgacactgctacaccattaaaggcgggcgcatggagcttttctggaatgctgctgtatttctttatcgtcgtctgttctttcatttcatcgctacccaacaatatctaagaatgtctttgtagacagtcgagatccgtctggtctgtgtagttaagtagataagatgatgcgtctgttgaatttcttaaaagagtgtgatgttttgtaccatatctatagatggatatgtacgagtggtatgtgtcatatggtaagggcaagttcagatagacatttaacgacatgaagagttgagaacattttagccattccttctcagttttggttctttcaaagaatcatgattgttgactatttgattaacccatcaaatgtttgtagtaaaaaagcgcccttgaac

SEQ ID NO: 13303 - DNA, 1155 bp, Amorphophallus konjac
ccttattaattcccagtttcgtctcgttcgcaggttatgcgtcgtacgtggggaaagcgagcaccgacttgaaagctttttcccatttcgtcgttggaacccccggttgctggtcgctgctgcggtatctcgaggtttcagatacctgtgccggcgtccttatctgctccgctttgatcggaattgttgatctaggtgagcgaacatggggctaacgttcacgaagctcttcagccggctcttcgccaagaaggagatgaggatccttatggtggggcttgatgccgccggtaagacgaccatcctgtacaagctcaagctgggggaaatcgtcaccaccatccccactatcggctttaatgtagagaccgtggagtataaaaacattagcttcactgtttgggatgttggtggtcaggacaagatcaggccactgtggagacactacttccaaaacacacagggccttatctttgtcgtggatagcaatgatagggatcgtatcgttgaggcaagggatgagctccataggatgttgaatgaggatgaattgcgtgatgctgtgttgctcgtttttgcaaacaaacaagatcttccaaatgcaatgaatgctgctgagattactgataagcttggcctgcactccctacgtcagcgacactggtatatccagagcacgtgtgccacctcaggtgaaggactttatgaggggctggattggctctccaacaacattgccaacaaggcttgaagatctcgtggaaccaggagtttgagggaaatattgacttacgacactgctacaccattaaaggcgggcgcatggagcttttctggaatgctgctgtatttctttatcgtcgtctgttctttcatttcatcgctacccaacaatatctaagaatgtctttgtagacagtcgagatccgtctggtctgtgtagttaagtagataagatgatgcgtctgttgaatttcttaaaagagtgtgatgttttgtaccatatctatagatggatatgtacgagtggtatgtgtcatatggtaagggcaagttcagatagacatttaacgacatgaagagttgagaacattttagccattccttctcagttttggtttctttcaaagaatcatgattgttgactatttgaac

SEQ ID NO: 13304 - DNA, 830 bp, Daucus carota
ctctctcgatctctctcgatttttcatttaaggaaaaatggggttgtctttcaccaagctgttcagtcggttgtttgcaaaaaaggagatgcgtatacttatggtcggtctcgatgctgcgggtaagaccaccatattgtacaagctcaaattgggagagattgttactaccattccaacaattgggttcaatgtggagactgtggaatacaagaacatcagcttcactgtctgggacgttggtggtcaggacaagattcggcccctgtggcgtcactatttccaaaatacccaaggcctcatctttgtcgttgatagcaatgacagggatcgtgtggttgaagcgagggatgagttgcacaggatgctgaacgaggatgagctgagagatgcagtgctgcttgtttttgctaacaaacaagatctacccaatgccatgaatgccgctgagataactgataagcttggtcttcactctctcaggcagcgccactggtacatccagagcacatgtgcaacatctggggaagggctgtacgagggcctggactggctttccaacaatattgctaacaagggttgatgacatgatttaccatggccttttgagctggatccagaacggagatgcccgtttttctttaggactatgttatgttcatcttattttgtgtgattggcctgtttggtgttcagtttattgtctatagcacttatactagttttatcctttggcgtggttaggagctctctgcctttcagtcactgaggttctttgaactagttgtatcaaggttattatttagtaatggagtaaaaactacctggca

SEQ ID NO: 13305 - DNA, 679 bp, Ricinus communis
caatattcagaagagagaaaaggaaggtgagagatttttttacatccttcttcaaatcagtagccaaaaaatggggcttagctttacaaaactgtttagccggctctttgccaaaaaggaaatgagaattctgatggtaggtctcgacgctgctggtaaaactactattctgtacaagctcaagcttggtgaaattgtcactactatccctaccatcggatttaatgtggagaccgtggaatataagaacataagcttcactgtttgggatgttggtggtcaagacaagatccgccctttgtggaggcattacttccaaaacactcagggtcttatatttgtggtggatagtaatgacagggatcgtgttgttgaggccagggatgagttgcatagaatgttgaatgaggatgaactgagggatgctgtcttgcttgtgttcgcaaacaaacaagatcttcccaatgcaatgaatgctgcagaaataactgacaagcttgggcttaattctctccgtcaacgccactggtacattcagagcacatgtgcaacatctggagagggtctctatgaggggctggaatggctgtcgaacaacattgctagcaaggcttgaaaaataaactcttcttaaggaattttggtcgttgtctagacttgtaatacttgcaattctggg

SEQ ID NO: 13306 - DNA, 1063 bp, Cedrus atlantica
ctccaaccacatccgtaactgttaattgcagatgctccggtgattacataggagagaaggggcgtaaccgaagagctccaaagtaaagagagtggtctcgccctctctcttctcgggaagccatcggaggattcttctgtgcagtccctcaacagctctgctcgcattttcaattttccttcgggagttgttcgactaaaagctcaaaagatggggctcactttcaccaagcttttccagcgactttttgcaaagaaggagatgcgcattctcatggtgggtcttgatgcagccggtaagaccaccattttgtacaagctcaagctgggagagattgtcactactatcccgaccattggtttcaatgtggagactgtagaatacaagaatatcagcttcactgtttgggatgtcggaggtcaggacaagatccgaccactttggagacattacttccagaatacccagggtctaatatttgtggttgacagcaatgatagagaccgtgtagttgaagctagagatgaattgcaccggatgctgaatgaggatgaactgcgtgatgctgtcttactggtatttgcaaacaagcaagatcttccaaatgccatgaatgccgcagagatcactgataagcttggtctgcattctctacgtcagcgccattggtatatccagagcacttgtgcaacttctggtgaaggcctctatgagggcttggattggctttcaaacaacattgctaacaaggcataaatccaaatgaatctaatttcgatattgggtatgaagtatatttgccatgaagtagttacaatgactcagccactggcatggattttctaaagaagagactacttgatagcttgattgctatgaatttctgagtacctacaactttgtcattactgtgcaagaatctgggatttttctttccgccagttgtgctatattttctatattagctctgttatacaattgactattatcttttgattgagaaggcttgtataattagattttaaaggactgaaaaggcttttctatgttcaatatggacaaa

SEQ ID NO: 13307 - DNA, 814 bp, Cocos nucifera
ttttagtatatctggcgagagaagagaagagatttaccttcctcgagccctcaccggtcgccctttctttctcgcttgctcgcaaatctccttcgaagacggttctctgaagcggagaacaatggggcttaccttcacgaagctcttcagccgtctttttgcgaagaaggagatgaggatcttgatggtcgggcttgatgcggcaggtaaaacgaccatcctgtacaagcttaagcttggagagatcgtcaccacaatacccacaatcggattcaatgtggagactgtggagtacaagaacattagcttcactgtttgggatgttggtggtcaggataagatccgacctttatggaggcactacttccagaacactcagggccttatctttgttgttgatagcaatgacagggatcgtattgttgaggcaagggatgagctccatcggatgctaaatgaggatgagttacgtgatgctgtgttgcttgtgtttgcaaacaaacaagaccttcctaatgcaatgaatgctgctgaaattactgataagcttggccttcattctctgcgtcagcgacactggtacatccagagcacttgtgcgacctctggtgaggggttgtatgaggggctggattggctctccaacaacattgccaacaaggcttaaaattttcagcatagatgggcaaagcgtttgaaatataattctgggttatatatgcctcttgcggttgtggtgatgtttgatgtatgacagtcttttagccatcagtttgttggccaaggatccaaggatcatttaccatcctttttt

SEQ ID NO: 13308 - DNA, 1091 bp, Gossypium hirsutum
catccgtacttactttgaccataattgattaatttaaagaataaaaaaatctgtgaaaaagacgaaggtgattgggatttccaaaacggcagcgtttggatctaatcaaagggcatcgcaacgttttaagaaaacctaatctgaaatcactcacccccgcctccagctcctccaattgcgtaataaatagccccaaagcccaaccccttcccccatcgaatttgatatttgtaagtgttaaacattgtttgcctttcatttctttctctattccttgttgcttcttcggcagcctctcggtttctgagtaatataaaaaaggatggggctgtcttttgctaagctgtttagtcggctgtttgccaagaaagagatgcgaattcttatggtgggtcttgatgctgctggtaagactaccattttgtataagctcaagctcggtgagattgtcactaccattcccaccattggctttaacgtggagaccgtagaatataagaacattagcttcactgtttgggatgttggtggtcaggacaagattcgacctttgtggaggcactacttccaaaacactcagggtctaatctttgttgttgatagcaatgaccgtgaccgtgtggttgaggccagggatgagcttcatcgtatgctaaatgaggacgagctgagggatgctgtgcttcttgtgtttgcaaacaagcaagatctgccgaatgctatgaatgctgctgagattactgataagcttggccttcactcccttcgtcagcgccactggtatatccagagtacttgtgccacctctggcgaagggctgtatgagggactggactggctttccaacaacattgctaacaagggttgagggttggttgaattccagtcatatcttcaggcagctatccttattattttctggttccttttttaagttttacaggaaatgtatcagattgtgttatataattaatatatattcgccgtactactgaaattagaggcctttggccttctttgtagattgatttctcaaataatattcttatcaaatacttagttgacgtctaaatctcatcttacgttttttt

SEQ ID NO: 13309 - DNA, 1069 bp, Echinochloa colona
ctactgaagcccttgatccctctctctccgcctccacatttctcttcgccctgcgatcccgtgccccgcaccccgcagggaggagagaagcgatcacctgatcaccagggcgcgtcgcctcgcgatctcgcgcaggagcggagatggggctcacgttcacgaagctgttcagccgcctcttcgccaagaaggagatgaggatcctcatggttggtctcgacgcggctggtaagaccaccatcctctacaagctcaagctcggcgagatcgtcaccaccatccccaccatcggatttaatgtcgaaactgttgagtacaagaacatcagcttcactgtttgggatgtcggtggtcaggacaagatccggcccctgtggaggcactacttccagaacacccagggcctcatttttgttgtggacagcaatgacagagagcgtgttgttgaggctagagatgagctccatcggatgctcaatgaggacgagctccgtgatgctgtgcttctggtgtttgcaaacaaacaagatcttcccaatgccatgaatgcagctgaaatcactgacaagcttggccttcactccctgcgccagcggcactggtacatccagagcacatgtgcgacctctggtgagggtttgtacgaggggcttgactggctttccaacaacattgcaaacaaggcttgaggcatcttggcagggctccgatcaatgcaaatactttggatatcggagcgcatactgcctttaccatactgctatgaactatatagtcgtgacagtgacagataatgtggggtgttttggggagtataaggctccttccttggtgaaggagctagctatcagatgtttctgtgggtattgttaattgtccgtgcatctgttttggtttgtgcaaggtatatgctatgcccgtctttgatctgtgtactcgtcagtctgaggcgttgtagtatggatttgcctcttggcattgctagcttaatggttgcctaattgtcctgtgcagcatatctttcctcgcgtttgctgtgccgtttttgaggtttgttgtcgtagtacca

SEQ ID NO: 13310 - DNA, 1039 bp, Eschscholzia californica
attcaacttcggtatacgcgtctctctctctctttccccaacgaagctttggaaaacctaaaactgagatctgggcttcagaatttggaggatatagttgtgaggtagaaatatggggttatctttcacgaagctttttagtcggctttttgccaaaagagagatgcgtattctgatggttggtcttgatgcggctggtaagacaaccatcttgtataagctcaagcttggagagattgtcaccacaattcccaccattgggttcaacgtggagacagtagaatacaagaacattagcttcacagtctgggatgttggtggtcaggacaagatccgtccattatggaggcattacttccagaacacacaaggtcttatctttgtggtggacagcaatgaccgagaccgagttgtagaagcacgggatgaattgcatagaatgttaaacgaggatgagttgcgagacgctgtgttgcttgtttttgccaacaaacaagatcttcctaatgcgatgaatgctgccgaaataactgacaaacttggccttcactctcttcgccaacgccattggtacatccagagcacttgtgcaacctctggagaggggctttatgagggtttggactggctatccaacaatatcgcaaacaaggcttgaggcgattcaatggtgtgattttcttgttcatggggttgatttttagatgggagaagtggtaatagatgtttacagagtatttgatgttatgggacaacggtattgactttcattagacgagacgttttcacaggattttcttatatcttcagaggaaaaaacgagttgggttatgacaggagaatgctaagatgggattatgataagcttttaatttagtctttgctttgcttgtttttatattctgagataaatactttccttgctttttcttagctaatccttttagctgttaaaaaacaatatatagtttgttatgactattccatatatgaaatgtgactttcttttaattttgagttcgtggggtaggctaaggca

SEQ ID NO: 13311 - DNA, 1014 bp, Eschscholzia californica
cctgatattacttggccgcctcctccgatttacatattattctcctcctcgctcgctgaccttctttaatctttaccaccaccaccaccacctcgatcctctctctctttctttctctagaagattttgaagatcagtagatctgatttggaggatctattgtgagatagaagaagtatggggttgtctttcacaaagcttttcagtcggctttttgccaaaagagagatgcgtattctgatggttggtcttgatgcggctggtaagactaccatcttgtataagctcaagcttggagaaattgtcaccacaattcccaccattggattcaatgtggagacagtagaatacaagaacatcagtttcacagtttgggatgttggtggtcaggacaagattcgtccattgtggaggcattacttccagaacacacaaggtcttatctttgtggtggatagtaatgatcgagaccgagttgttgaagcaagggatgaactgcacaggatgttgaatgaggatgagcttcgggatgctgtgttgcttgttttcgctaacaaacaggatcttccaaatgcaatgaatgctgcagagataactgataaacttggactccactctcttcgccaacgccattggtacatccagagcacttgcgcaacctccggagagggtctttatgaaggtttggattggctatccaacaatattgccaacaaggcttgaggaaactgaactgcgaggttggtttctggattgacgcattgatgatagtagatactaaccaagcggagtgacaatgaagcggcttccattggaggagccattttcttaggatttactattttgtctgaaacaaatactgcttgttgtaacaggataatactcagttgggtttgatgctttatcgttttattttaataggtttgatctttatatttgaagttcaaattcatgacattgcgttttagccttattagatatatagtttgtatgaaacctatatcttaacgctgc

SEQ ID NO: 13312 - DNA, 905 bp, Flaveria ramosissima
atgggggccccttattcatactcttcatatatctctctctcttcgaatcgatcgattgatccctttctaacaagcttttctcagggatcctcactagcaagaggatggggctaactttcaccaaactcttcagccggctctttgccaagaaagagatgcgtatattgatggtgggtctcgatgcggctggtaagacaaccattttgtacaagctcaagctcggcgagattgtgaccactattcctaccataggttttaatgtggagactgttgagtacaaaaacattagcttcacagtgtgggatgttgggggtcaggacaagattcgtccattgtggaggcactatttccagaacacccagggtcttatctttgtggttgatagcaatgacagggacagagttgttgaggcaagagatgaattgcacaggatgttgaatgaagatgagttgagagatgcagttctccttgtgtttgctaacaaacaagatctcccaaatgcgatgaatgctgctgaaatcactgataagcttggtctccactctctccgacagcgtcactggtacatccagagcacttgtgcaacctctggggagggactttatgaaggattggagtggctttccaacaacatagcaaacaaggcatgaggcaaggagagggtggatgttggcagtttgtgttactggttttggaagttgttgtttgaaagggtaatttgcttctgatataatacattgttttatgtttggactgaaagtatgtgtttgttaggttggctgttattctttaatctgaaattgttgagtttatctggtgtttagaattcttatgtagtctgttggtatgctattattatgacatctaatgaactctaacaatgtctggtaaagaaaaaaaaaaaa

SEQ ID NO: 13313 - DNA, 974 bp, Setaria italica
ccccctcccccctccattcctcttcccctgcgatccgagcccgcaccccgcagggaggagaggcgatcacctgatcaccagggcgaggcctcgcgatctcgcgcaggagcggagatggggctcacgttcactaagctgttcagccgcctcttcgccaagaaggagatgaggatcctcatggttggtctcgacgcggccggtaagaccaccatcctctacaagctcaagcttggcgagatcgtcaccaccatccccaccataggatttaatgtcgaaactgttgagtacaagaacattagcttcactgtttgggatgtcggtggtcaggacaagatccggcccttgtggaggcactacttccagaacacccagggcctcatttttgtcgtggacagcaatgacagagagcgtgttgttgaggccagagatgagctccataggatgctgaacgaggacgagcttcgtgatgctgtgcttctggtgtttgcaaacaaacaagatcttcccaatgccatgaatgctgctgaaatcaccgacaagcttggccttcactccctgcgccagcggcattggtacatccagagcacatgtgctacctctggtgagggtttgtacgaggggcttgactggctttccaacaacattgccaacaaggcttgaggcatcttggcagagctctgatcaatgaaaatacttcggatgttggagcgcgtactgcctttaccatactgctatgaactatatatagtcgtgacagtgacagataatgtggggtgtttttgggagtactaaagctctttggtcaaggagctagctatcagatgttttcgtgggtattgctaattgtccgttttggttcgttcaaggtatactatgaagcgccgttgcgctgtgtactggacagtgaggtgaggtgttgtagtatcagacttgcctcttggcattatggcatagctagcttaatggtcgcgtaa

SEQ ID NO: 13314 - DNA, 864 bp, Panax ginseng
gcgagatccatccctagagagagagataaaacatcccctctcgttcattcgctctctcctttaggatcaaagatggggctgtctttcaccaagctcttcagtcggctgtttgccaagaaagagatgcgcatactgatggtgggtctcgatgcagctggtaaaactaccattctttacaagctcaagctcggagagatagtcacaacaattcctaccattggttttaacgtggagactgtggaatataagaacattagcttcaccgtttgggatgttggtggccaagacaagatccgtcctttgtggagacattacttccaaaacactcagggcctcatctttgtggttgacagcaatgatcgagatcgtgtgattgaagccagggatgagctgcacagaatgctgaatgaggatgagttgagggatgctgtgctacttgtatttgcaaacaagcaagatcttcccaacgcaatgaatgctgctgagattactgataaacttggccttcactctcttcgtcagcgccactggtatatccagagcacttgtgccacttctggtgaagggttgtatgaggggttggactggctctcaaacaacattgcgaacaaggcgtagacggcttatctgagtttggatcgtcaccacaaccaaattagagtttttcgtgcttcttttttgttcagaaatctgtaccatgttgatgtttacctcattactattttgaggtcccatttccagatattgatatttgtttcctttagtttcagaataattcacattatttttgttttattcaccatgtttctccatatctttgatattctatgcaagtacaatcctaaccttagagaaactattccc

SEQ ID NO: 13315 - DNA, 910 bp, Panax ginseng
attgtaagtgcagtctcaaaatatctgcccctttctctctcgtcgtccaaattatctgttgatcatcatacattaggaaaaatgggtttgtcattcaccaagctctttagtcggctgtttgcgaagaaggagatgcgtatacttatggtgggtcttgatgctgctggtaagaccaccatattgtacaagctcaaactgggagagattgttaccaccattcctacgattgggtttaatgtggagactgtggaatacaagaacatcagcttcactgtttgggacgttggtggtcaagacaagattcgacccttgtggagacactactttcagaatactcaagggcttatctttgtggttgacagcaatgacagggaacgtgtggttgaggctagggatgagttgcacaggatgttgaatgaggatgagttgagggatgctgttctgcttgtatttgctaacaaacaagatcttccaaatgccatgaacgctgctgagataactgacaagctaggtcttcactccctcaggcaacgtcactggtatatccagagcacatgtgccacctctggggaagggctgtacgaggggctggactggctctccaacaatattgctaacaaggcttgatggcatgcttttccatgacattttgagctgaagttgcgtctaaatggagttactattgtgtttcttggcagtttgtaatttgttcttcccgtgaatgatatttttatcgtgttcagtttattggttcttgttagttttgcaccgacttttgttgatttatattcatgtttattcttcatagggttaggacaagtacagtggtgcttaatgcatgagtttgtgtaagcatttgctattgtattgaggttattattagtaaatgaaatgaagctcttttgttcca

SEQ ID NO: 13316 - DNA, 746 bp, Panax ginseng
atgggtttgtctttcaccaagctctttagtcggctgtttgcgaagaaggagatgcgtatacttatggtgggtcttgatgctgctggtaagaccaccatattgtacaagctcaaactgggagagattgttaccaccattcctacgattgggtttaatgtggagactgtggaatacaagaacatcagcttcactgtttgggacgttggtggtcaagacaagattcgacccttgtggagacactactttcagaatactcaagggcttatctttgtggttgacagcaatgacagggaacgtgtggttgaggctagggatgagttgcacaggatgttgaatgaggatgagttgagggatgctgttctgcttgtatttgctaacaaacaagatcttccaaatgccatgaacgctgctgagataactgacaagctaggtcttcactccctcaggcaacgtcactggtatatccagagcacatgtgccacctctggggaagggctgtacgaggggctggactggctctccaacaatattgctaacaaggcttgatggcatgattttccatgacattttgagcggaagttacgtctaaatggagttactattgttgtttcttggtcagtttgtaatttgttcatcttacttcccgtgaatgatatttttatcgtgttcagtttattggttcttgttagttttgcacagacttttgttgatttatattcatgtttattcttcatagggttaggaca

SEQ ID NO: 13317 - DNA, 982 bp, Panax ginseng
ttgtaagtgcagtctcaaaatatctgcccctttctctctcgtcgtccaaattatctgttgatcatcatacattaggaaaaatgggtttgtcattcaccaagctctttagtcggctgtttgcgaagaaggagatgcgtatacttatggtgggtcttgatgctgctggtaagaccaccatattgtacaagctcaaactgggagagattgttaccaccattcctacgattgggtttaatgtggagactgtggaatacaagaacatcagcttcactgtttgggacgttggtggtcaagacaagattcgacccttgtggagacactactttcagaatactcaagggcttatctttgtggttgacagcaatgacagggaacgtgtggttgaggctagggatgagttgcacaggatgttgaatgaggatgagttgagggatgctgttctgcttgtatttgctaacaaacaagatcttccaaatgccatgaacgctgctgagataactgacaagctaggtcttcactccctcaggcaacgtcactggtatatccagagcacatgtgccacctctggggaagggctgtacgaggggctggactggctctccaacaatattgctaacaaggcttgatggcatgcttttccatgacattttgagctgaagttacgtctaaatggagttactattgtgtttcttggcagtttgtaatttgttcttcccgtgaataatatttttatcgtgttcagtttattggttcttgttagttttgcaccgacttttgttgatttatattcatgtttattcttcatagggttaggacaagtacagtggtgcttaatgcatgagtttgtgtaagcatttgctattgtattgaggttattattagtaaatgaaatgaagctcttttgttaaccaaaaaaaaaaaaaaaaaaaaaaaaaaaaaaaaaaaaaaaaaaaaaaaaaaaaaaaaaaaaaaaaaaaaaaaa

SEQ ID NO: 13318 - DNA, 868 bp, Panax ginseng
atccctagggagagagataaaacatccactctggttttcctctcgttcattcgctctcttctttaggatcaaagatggggctgtctttcaccaagctcttcagtcggctgtttgccaagaaagagatgcgcatactgatggtgggtctcgatgcagctggtaaaactaccattctttacaagctcaagctcggagagatagtcacaacaattcctactattggatttaacgtggagactgtggaatataagaacattagcttcaccgtttgggatgttggtggccaagacaagatccgtcctttgtggagacattacttccaaaacactcagggcctcatctttgtggttgacagcaatgatcgagatcgtgtgattgaagccagggatgagctgcacagaatgctgaatgaggatgagttgagggatgctgtgctacttgtatttgcaaacaagcaagatcttcccaatgcaatgaatgctgctgagattactgataaacttggccttcactctcttcgtcagcgccactggtatatccagagcacttgtgccacttctggtgaagggttgtacgaggggctggactggctctcaaataacattgcgaacaaggcgtagacggcttatctgagtttggatcgtcaccacagccaaattagagtttttcgtgctttatttggttcagaaatctgtaccatgttgatgtttacctcttttactatttttgaggtcccatttccagatattgatatttgtttccttcagtttcagaataattcacattatttttgttttattcgccatatttctccatatctttgatattctatgcaagtacaatcctaaccttagagaaactattcccc

SEQ ID NO: 13319 - DNA, 989 bp, Gnetum gnemon
ggcatttgctttctctctctctattgctccttcctcccaagggttccttcctcaacacagctgctgcgtagatcggatcttgttggaatatctctgctcaggtgggaagatggggctcacatttaccaagctttttagcagactctttgccaagaaggagatgcgtattcttatggttggtcttgatgcagctggtaagactacaattctgtacaagctgaagttgggagagattgtcacaaccattccaaccattggatttaacgtggagactgttgaatacaagaacattagtttcactgtatgggatgttgggggccaagacaagatccgacctttgtggaggcactacttccaaaacacgcaaggtcttatcttcgttgttgatagcaatgatagagatcgtattgttgaggcaagagatgagcttcacagaatgttgaatgaggatgagctgcgtgatgctgtgttgcttgtctttgcaaacaagcaagatctgccaaatgctatgaatgctgcggaaatcactgacaaacttggattgcattctctgaggcagcgccactggtacatccagagcacttgtgctacttctggtgagggtctgtacgagggattagattggctctcgaacaacattgccaacaaggcttgaactctggcgtacgcgttgcttctctcagttggcggcatagtgtcgttttgttttagtgtctctaggattaaagctgatttgtgtccgcgtttaactatagagggatgatgaatttaagttcatttggtaacgtcgatggaactgcttttgttagtcctttatgcttctgatgctattaaaagcataattcagatggtagaattatgagagaatgtcctctgccttttgcttttttggtttatagttatgatggtattgtattcattttttgcttgaggataatacctgataaagttgaattctcacatttgctttcaatcgttatgtccgttat

SEQ ID NO: 13320 - DNA, 906 bp, Gossypium raimondii
ctccaattgcgtaataaatagccccgaagcccaaccccttcccccattgaatttgatatttgtaagtgttaaacattgtttgcctttcatttctttctctattccttgttgcttcctcggcagcctctcggtttctgagtaatataaaaaaggatggggctgtcttttgctaagctgtttagtcgactgtttgccaagaaagagatgcgaattcttatggtgggtcttgatgctgctggtaagactaccattttgtacaagctcaagctcggtgagattgtcactaccattcccaccattggctttaacgtggagaccgtagaatataagaacattagcttcactgtttgggatgttggtggtcaggacaagattcgacctttgtggaggcactacttccaaaacactcaggggctaatctttgttgttgatagcaatgaccgtgaccgtgtggttgaggccagggatgagcttcatcgtatgctaaatgaggacgagctgagggatgctgtgcttcttgtgtttgcaaacaagcaagatctgccgaatgctatgaatgctgctgagattactgataagcttggccttcactcccttcgtcagcgccactggtatatccagagtacttgtgccacctctggcgaagggctgtatgagggactggactggctttccaacaacattgctaacaagggttgagggttggttgaattccagtcatatcttcaggcagctatcctattattttctggttccttttttaagttttacaggaaatgtatcagattgtgttatataattaatatatattcaccgtactactgaaattaggcatttgcctgctttgtagattgatttctcaaataatttttttctatatgatcacctgaactctaattccagaaa

SEQ ID NO: 13321 - DNA, 637 bp, Hevea brasiliensis
cagaaagggatcaatagctgagaagcagaaatggggttgacattcacgaagcttttcagccggctttttgccaagaaggaaatgcgaattctgatggtgggtcttgatgctgctggtaagaccacaatcctgtacaagctcaagcttggagagattgtcaccactattcccactattggatttaatgtggagactgtggaatacaaaaacatcagtttcactgtgtgggatgttggtggtcaggacaagattcgtcccttgtggaggcactacttccaaaacacccagggtctcatatttgtggtggacagcaatgacagagaccgtattgtggaggcaagggatgagttgcacagaatgttgaatgaggatgagctgcgagatgcagtgttgcttgtatttgctaataagcaggatcttcccaatgcaatgaatgctgctgaaatcactgacaagcttgggctgcactccctccgtcagcgtcactggtacatccagagtacctgtgcaacctccggtgagggactttatgagggcttggactggctctccaataatattgctaacaaggcataaagcaaacaatgagacattgtggaatggcaattctggatgcagggtgaatattatctagtca

SEQ ID NO: 13322 - DNA, 900 bp, Carpinus betulus
cacagccttgctctccgtcccctcccatcagatcccctcctccatagagctgagtgatcgataggcagctagctagggctagagcaaaagcagggatggggctaacattcacgaagctattcagcaaactttttgcgaagaaagaaatgcgaattctgatggttggtctcgatgccgccggtaagaccaccatcttgtacaagctcaagctcggtgaaatcgtcaccacgatcccgactatcggatttaatgtggagacagtggaatataaaaacatcagcttcactgtttgggatgtcggtggtcaggataagatccgtccattgtggaggcactacttccaaaacactcagggtcttatatttgtggttgatagcaatgacagggatcgagttgtggaggcaagggatgagttgcataggatgttgaatgaggatgagctgagggaggctgttttgcttgtatttgccaacaaacaagatcttcccaatgcaatgaatgctgcagagatcactgacaagcttggtcttcattctctccgccaacgtcactggtacatccagagcacatgcgcaacttctggagagggtctgtatgagggtttggactggctttccaacaacattgctagcaaggcatgaggctttaaagaattttggtttctggcgatttgggagatgacagcttcccccccatttcagtgaatgttgtaatagaagaatgtttggctagacctttttatatatatcggtttgtatggttgctactttagctaaatgcttttagctgtaaaccagacttttttttatgttgctacattctcttttgggcatggccgcatttaactagctatttttgtttgcctttatatttactggtggaggcacttaactagtttct

SEQ ID NO: 13323 - DNA, 1184 bp, Elaeis guineensis
ccatatttccccttccagacagtcacgtgagattggctgtctcgcacgtgcgcgcggcgacctcaacgacggggaaggatcctttcccccccgttctcccagtccctcctatataaccgcgtcgccccactttccaatcccccaattcgtcttcctctccgtctttctctcaaggagaagaagaagaggagactcccgttctcctcgccccccatccaaagcttccggagatcgatcttctgctgcgaaagaaagatggggcttaccttcacgaagctcttcagccgcctctttgcgaagaaggagatgaggatcttgatggtggggcttgatgccgctggtaagaccaccattctctacaagctcaagcttggagagatcgtcaccactatccccactattggatttaatgtggagacagtagaatacaagaatattagcttcactgtgtgggatgttggtggtcaggacaagatcagacctttgtggaggcattacttccagaacacgcagggccttatttttgttgttgacagcaatgacagagatcgtgttgttgaggcaagagacgagcttcataggatgcttaatgaggatgaattacgggatgctgttttacttgtctttgcaaacaaacaagatctgccgaatgcaatgaatgctgctgaaataacagataagcttggtctgcattccctgcgtcagcgacactggtacattcagagcacctgtgctacatctggtgaaggattgtatgaggggcttgactggctgtccaacaacattgccaacaaggtttgaaatttcaaggtgcttgagagaactacagaatctttattggaatattcctccatagactacatatggattcttttgggatatttagatcttcagaacttctagattgttattcacgtggtttgctctttctcagttttcacgtttgaaaaactgtggatttaacaattataagtgatggaaatttgtattgaccactgaatgacttctattatgtttttctgtcccaattattgatagaatgcttcatcgtcaaatttgtgatttatagatggttctgtactatctgttttgtcattcattaggccttttttgccatttgtcttccaattcgatgtcctgatgtttgttttgcctgtatttaattgatctgaagttgattcacc

SEQ ID NO: 13324 - DNA, 1076 bp, Ananas comosus
ggagaggaaagatggggctcaccttcacgaagctctttagccgcctctttgcgaagaaggagatgaggatattgatggttgggcttgatgcggctggtaagacgaccatcctctacaagctcaagctcggagagatcgtcaccaccattcccacgatcggattcaatgtggaaactgtggagtataagaacattagcttcaccgtatgggatgttggtggccaggacaagatccgcccattgtggaggcattacttccagaacacgcagggccttatcttcgtcgtcgacagcaatgacagggatcgtattgtcgaggctagagatgagctccacaggatgctcaatgaggatgagttgcgcgatgccgtgttgctcgtctttgcgaacaagcaagatctccctaatgctatgaatgctgctgagatcaccgataagcttggccttcactccctacgtcagaggcactggtacattcagagcacgtgtgctacatctggtgaggggttgtatgaggggcttgactggctctccaacaacatcgccagcaagggttgaagatgtgaaaagcatattttgaaatggctgaagatcttggtgttattaagtattatagtactactttgttacgttaactagtttgggttgctttcgttgttttgatgaattggtcatattttggtttgttttttcctaatattttgtgtttcggctgttaatgtacttgcctatcaatcagtacatgtctgcatgtctttctttgtagtagtaatttgactctgtgatgtcgctgttttagtgcacaacccttttcttcctcgtgttgtgtaatttcttcagggtgaaacattcttttctagattttgataagcacggtttttatttattcattaaaataaaatacatctcgtcagtacggtgaaagtttatcaacacgtctaccgcacaataggaccgagtaatttgagtaaatgttgaacaaagtataaactagtgtggggagcgcctcacgtgtaaacgtataaaccgaaggtctggagggttttcgttgaagttctcgcaagttttcagcatact

SEQ ID NO: 13325 - DNA, 1190 bp, Ananas comosus
ttgtcgagatggggctgtccttcaccaagttattcagccggctttttgccaagaaggagatgaggattcttatggtgggtcttgatgccgctggtaagaccactattctgtacaaattgaagctgggggaaattgtgaccacgattccaaccattggattcaatgttgaaactgtggaatacaagaacattagcttcactgtttgggatgttggtggccaagacaagattcgacctttgtggaggcattacttccagaacactcaaggcctgatctttgtggtcgacagcaatgacagggaccgtattgttgaagctagagatgaactccataggatgcttaatgaggatgagttgagagatgctgtgctgcttgtgtttgcgaacaaacaagacctcccaaatgccatgaatgctgctgaaatcactgataagcttggccttcattccctccgccaacgccattggtacattcagagcacatgtgctacatctggagaaggtctgtatgaggggttggactggctctccaacaacattgctaacaaggcttagatgttactcaaaaggattcttcttgcttgtcatgtttcttttgctaatgaaatccattatctttggagagagtgagagagctgtatcaatatcgagcattagatcctcttgtactttttacttttatagactcaaaaaattgccgctggttagaacatgaataagctggaacttgttctgctagatgatggtattatttgtgttgtattgaaatttatttgaagaccatatttagttgccttaaaatgttaatgctggtgcctaaattatcaacctcaaaggtggattgtccgatgtgctttaattaactgtgaactggaagtttaagtaccttggtggccgattcaatgctggtccttgcgaaaaattacaaggctgtataacttgtttgaatgaacgatatatatggccttgatctgatgccaaaatttacaaagaaaaactatcttatgtaaggaccagtttcttgttgaggattatatcatctgtggagaagtcagcttccttccggtacgttccccggccaaagtcgaggttgtatgaatccgcaaggccatcgatcaacccaaattctggggtccaacctaattcctttgtagctttctcaatcgatgcaaagaaatgctgatctcggaa

SEQ ID NO: 13326 - DNA, 1244 bp, Ananas comosus
acccaccgttcgttttcctctgttctctctctccgatccttccttttctcgcgaagagagagagagagagagagagagagagagagggaggaggaagcgaggaagaagaagcggagactccgatcccaagcgcgcgacgagagcgagagatcgtccgggagaggaaagatggggctcaccttcacgaagctctttagccgcctctttgcgaagaaggagatgaggatattgatggttgggcttgatgcggctggtaagacgaccatcctctacaagctcaagctcggagagatcgtcaccaccattcccacgatcggattcaatgtggaaactgtggagtataagaacattagcttcaccgtatgggatgttggtggccaggacaagatccgcccattgtggaggcattacttccagaacacgcagggccttatcttcgtcgtcgacagcaatgacagggatcgtattgtcgaggctagagatgagctccacaggatgctcaatgaggatgagttgcgcgatgccgtgttgctcgtctttgcgaacaagcaagatctccctaatgctatgaatgctgctgagatcaccgataagcttggccttcactccctacgtcagaggcactggtacattcagagcacgtgtgctacatctggtgaggggttgtatgaggggcttgactggctctccaacaacatcgccagcaagggttgaagatgtgaaaagcatattttgaaatggctgaagatcttggtgttattaagtattatagtactactttgttacgttaactagtttgggttgctttcgttgttttgatgaattggtcatattttggtttgttttttcctaatattttgtgtttcggctgttaatgtacttgcctatcaatcagtacatgtctgcatgtctttctttgtagtagtaatttgactctgtgatgtcgctgttttagtgcacaacccttttcttcctcgtgttgtgtaatttcttcagggtgaaacattcttttctagattttgataagcacggtttttatttattcattaaaataaaatacatctcgtcagtacggtgaaagtttatcaacacgtctgccgcacaataggaccgagtaatttgagtaaatgttgaacaaagtataaactagtgtggggagcgcctcacgtgtaaacgtataaaccgaaggtctggagggttttcgttgaagttctcgcaagttttcagcatacttgtgagaagca

SEQ ID NO: 13327 - DNA, 1127 bp, Ananas comosus
tctctctctcgcgggcaaagatggggctatcattcacaaagctcttcagtcggcttttcgccaagaaggagatgagaattcttatggtgggtctcgatgctgctggtaagaccaccatcctgtacaagctgaagctgggcgagattgtgaccaccattccaacaattggatttaacgttgagacagttgaatacaagaacatcagctttactgtttgggatgttggtggccaagacaagatccgccccctctggaggcattacttccagaacacacaaggtctgatctttgtggtcgacagcaacgatagggaccgtatcgttgaagcaagagatgaactccacaggatgcttaacgaggatgagctgagagatgcagtgcttctcgtctttgccaacaagcaagatcttcccaatgcaatgaatgccgcggagatcactgataagcttggccttcattccctccgccagcgccactggtacatccagagcacgtgtgctacgtccggagaaggtttgtacgaaggtttggactggctctccaacaacattgctaacaaggcttaaaagtttgctggtgttgttgttacatcttctcggagccgagcaggaaattccggtgcgctttcctaatcaaatatattatgttttagtcttcgagagagctcttcccccaacagttagttaccttttacagaccgatgaatttatcgctatctagtcccaaaagacttaacaatctcgaatttgttttcttatttggatgttctctgtttacatcaaatactatttcaattctaagctcctatttttattcatctcatttctctcgtattattactttcgtcagttttgggtagagcccgtataaggttttccaaggacttgcatgcaaacaccaacttagttgtttaatcatcatatgggcaatgtctgtgattgcttaatggtttcggtgctaattagatggctattatgtgctcaatatgcgaaagcgtcgcaccgtagccgcctcaaatagatctgcattattacttagggtaagaggagtaggggtggaactaaggcttcgtttggatttgcgcagagattgtgttacgtgcggtgaaaaagtacgatgaaaaaata

SEQ ID NO: 13328 - DNA, 805 bp, Platanus occidentalis
agatctgctcgcttggattctccaaaatcgccatctccttacatatacgaaaatggggctgtctttcaccaaacttttcagtcggttgtttgccaagaaagaaatgcgaattcttatggtgggtctcgatgccgcgggtaagaccaccattttgtacaagctgaagctgggagagattgtcaccacgattcctaccataggatttaatgtggaaactgtggaatataagaacattagcttcaccgtttgggatgtgggtggtcaggacaagatccggccattgtggagacattacttccaaaacacacaaggtctcatctttgtcgttgacagcaatgaccgggatcgtgttgttgaggctagggatgagctgcataggatgttgaatgaggacgagttgagggaggctgtgctccttgtgtttgcaaacaagcaagatcttcctaatgcaatgaatgctgctgagatcactgataaacttggccttcactctctccgccaacgccactggtacattcagagcacatgtgccacttctggagaaggcctgtatgagggattggactggctgtccaacaacattgctaacaaggcgtagaagattggtgtaatttcaatgtgttttgggctgcagtcaggcgtgttggaatagaaatgttactattattattgttctgtctctggataaattttcccctttttttttccctgtgttcatggttgtaaacattggcatttgtttcccgtaggtccagaataatcctgaaatattgtcattacagcctctatgcaatgagtcttcaca

SEQ ID NO: 13329 - DNA, 956 bp, Primula obconica
tcccacattcttgcgcgtcggtctcaagcttacattctctctctttctctctagagatccctccgctcgcagggatcaactaaaaggaaagagacatgggtttgacattcaccaagcttttcagtcggctttttgccaagaaggagatgcgtatccttatggtaggtctcgatgccgctggtaagaccaccatcctgtacaagctcaagctcggtgagattgtgaccacaatccctaccattgggtttaacgtggaaactgtcgagtacaaaaacatcagctttaccgtgtgggatgttgggggtcaagacaagattcgtccattgtggaggcattatttccagaacacccagggtctcattttcgtggtggatagcaatgacagagaccgtgttgttgaggcgagagatgagttgcaccgcatgttgaatgaggatgagttgcgggatgcagtattacttgtttttgccaacaaacaagatcttcctaatgcaatgaacgctgctgaaataactgacaaacttggtctgaactctctccgacagcgccactggtatatccagagcacttgtgcaacctccggtgagggcctgtatgaggggttggattggctctccaacaacattgcaaataaggcttgagtatgggggcttgatacttggatgcaggatggtctttttatctagtctaattttttttactttcctttttttcttgtgagacaatatattgtcatcgacttcaattttaagtgtttatgttgattaaggattttgcaatgtctattgatctttatcagaaaggtttgttgaattcgtgcactatcagaattgtgctccagattttactgggtgcatacaattaatagccacttggcttttattcactatcatcttatttgttcctgtttgtgttatacggtagcgaaaatgataaatctgtctttagactgacta

SEQ ID NO: 13330 - DNA, 878 bp, Primula obconica
acattcttgcgcgtcggtctcaagcttacattctctctctttctctctagagatccctccgctcgcagggatcaactaaaaggaaagagacatgggtttgacattcaccaagcttttcagtcggctttttgccaagaaggagatgcgtatccttatggtaggtctcgatgccgctggtaagaccaccatcctgtacaagctcaagctcggtgagattgtgaccacaatccctaccattgggtttaacgtggaaactgtcgagtacaaaaacatcagctttaccgtgtgggatgttgggggtcaagacaagattcgtccattgtggaggcattatttccagaacacccagggtctcattttcgtggtggatagcaatgacagagaccgtgttgttgaggcgagagatgagttgcaccgcatgttgaatgaggatgagttgcgggatgcagtattacttgtctttgccaacaaacaagatcttcctaatgcaatgaacgctgctgaaataactgacaaacttggtctgaactctctccgacagcgccactggtatatccagagcacttgtgcaacctccggtgagggcctgtatgaggggttggattggctctccaacaacattgcaaataaggcttgagtatgggggcttgatacttggatgcaggatggtctttttatctagtctaattttttttactttcctttttttcttgtgagacaatatattgtcatcgacttcaattttaagtgtttatgttgattaaggattttgcaatgtctattgatctttatcagaaaggtttgttgaattcgtgcactatcagaattgtgctccagattttactgggtgcatacaattaatagccacttggctttta

SEQ ID NO: 13331 - DNA, 957 bp, Primula obconica
cgaacatacacacaattattcgacacaaccacaattactatagagacgattggacgccatcgaacacaagctttatttattttgtcttagtgactgccacaagtgcagttcgtgcaagagcagctcgagccacacttgcacttgccatcattctcagcagctggagcctccatgacaacacccattacggccgaaactcctcccacattcttgcgcgtcggtctcaagcttacattctctctctttctctctagagatccctccgctcgcagggatcaactaaaaggaaagagacatgggtttgacattcaccaagcttttcagtcggctttttgccaagaaggagatgcgtatccttatggtaggtctcgatgccgctggtaagaccaccatcctgtacaagctcaagctcggtgagattgtgaccacaatccctaccattgggtttaacgtggaaactgtcgagtacaaaaacatcagctttaccgtgtgggatgttgggggtcaagacaagattcgtccattgtggaggcattatttccagaacacccagggtctcattttcgtggtggatagcaatgacagagaccgtgttgttgaggcgagagatgagttgcaccgcatgttgaatgaggatgagttgcgggatgcagtattacttgtctttgccaacaaacaagatcttcctaatgcaatgaacgctgctgaaataactgacaaacttggtctgaactctctccgacagcgccactggtatatccagagcacttgtgcaacctccggtgagggcctgtatgaggggttggattggctctccaacaacattgcaaataaggcttgagtatgggggcttgatacttggatgcaggatggtctttttatctagtctaattttttttacttcttttttcttgtgagacaatatattgtcatcgacttctaattttaagttgttta

SEQ ID NO: 13332 - DNA, 945 bp, Pseudoroegneria spicata
tgcggttccaagctccaactcccacgcccgtctcccccgagatcaggaggagcacgccgcaccggagcgccgagacctcgaagccttcgtctccacctcggagcagagatggggctcacgttcaccaagctgttcagccgcctcttcgcgaagaaggagatgaggattctcatggttggtctcgatgccgctggtaagaccaccatcctctacaagctcaagctcggagagatcgtcaccaccatcccaaccattggatttaacgtcgaaactgtcgaatacaagaacatcagcttcactgtttgggatgtggggggccaagacaagatcaggcccctgtggaggcactacttccagaatacgcaagggctcatttttgttgttgacagcaatgatagggaacgtgttgttgaggctagagacgagctccacaggatgctgaatgaggatgagctgcgtgatgctgtgttgcttgtatttgcaaacaaacaagatcttcctaatgccatgaatgctgctgaaatcaccgacaagcttggtctgcactccctgcgccagcggcactggtacattcagagcacttgcgcgacatctggcgaagggttgtacgagggacttgactggctctccaacaacattgccaacaaggcttgaagcgtctcgacaagtgcttcatcgagaaacaaacgtgctggatgtctcaacaactcactgctaccattttacatatttgtgatatatatacactgtacaacagatagtatgtgtgcgtatgtgacagacagaagctctcttctttaagtgagctagtatcaggtcaggttttttttggtatggatattatcagtattcccgtgtcgtggttttacaaggtttactttgtcgaccatttgtgcatgaacccctatcgtttcgagttttagtaagattgaattgtggttgcca

SEQ ID NO: 13333 - DNA, 1027 bp, Secale cereale
tcaggccatcctccgtgcggttccaagctccaactcccacgcccgtctcccccgagatcaggaggagcacgccccggagcgccgagacctcgaagccttcgtctccacccccggaggagagatggggctcacgttcaccaagctgttcagccgcctcttcgccaagaaggagatgaggattctcatggttggtctcgatgccgctggtaagaccaccatcctctacaagctcaagctcggagagatcgtcaccaccatcccaaccatcggatttaacgtcgaaactgtcgaatacaagaacatcagcttcactgtttgggatgtggggggccaagacaagatcaggcccctgtggaggcactacttccagaatacgcaagggctcatttttgttgttgacagcaatgatagggagcgtgttgttgaggctagagacgagcttcacaggatgctgaatgaggatgagctgcgtgatgctgtgttgcttgtatttgcaaacaaacaagatcttcctaatgccatgaatgctgctgaaatcaccgacaagcttggtctgcactcccttcgccagcggcactggtacattcagagcacttgcgcgacatctggagaagggttgtacgagggacttgactggctctccaacaacattgccaacaaggcttgaagcgtctcgacaagtgcttcatcaagaaacaaacgtgctggatgtctcaacaactcactgctaccatttttacatattgtgatatatatatacactgtacaagagatagtatgtgtgcgtatgtgacagacagaagctctcttctttaagtgagctagtatcaggtcaggttgtttttttgtatggatattatcagtattcccgcgtcgtggttttacaaggtttactttgtcgaccatgtgtgcatgaacccctatctttttgagttgtagtaagattgaattgtggttgccaatgttggttggttcagttgagtgatgtggatggggtacatgttgataacatacttatgtgagcgat

SEQ ID NO: 13334 - DNA, 1025 bp, Secale cereale
gactggtgcagaccgagcggcccgatggtctgcaccgcactgcacgacagccatcctccgtgcggttccaagctccaactcccacgcccgtctccccagagatcaggaggagcacgccccggagcgccgagacctcgaagccttcgtctccacccccggagcagagatggggctcacgttcaccaagctgttcagccgcctctttgccaagaaggagatgaggattcttatggttggtctcgatgcggctggtaagaccaccatcctctacaagctcaagctcggagagatcgtcaccaccatcccaaccatcggatttaacgtcgaaactgtcgaatacaagaacatcagcttcactgtttgggatgtggggggccaagacaagatcaggcccctctggaggcactacttccagaatacgcaagggctcatttttgttgttgacagcaatgatagggagcgtgttgttgaggctagagacgagcttcacaggatgctgaatgaggatgagctgcgtgatgctgtgttgcttgtatttgcaaacaaacaagatcttcctaatgccatgaatgctgctgaaatcactgacaagcttggtctgcactccctgcgccagcggcactggtacattcagagcacttgcgcgacatctggagaaggattgtacgagggacttgactggctctccaacaacattgccaacaaggcttgaagcgtctcgacaagtgcttcatcaagaaacaaacgtgctggatgtctcaacaactcactgctaccattttttacatattgtgatatatatacactgtacaagagatagtatgtgtgcgtatgtgacagacagaagctctcttctttaagtgagctatatcaggtcaggtttgtttttttgtatggatattatcagtattcccgtgtcgtggttttacaaggtttactttgtcgaccatgtgtgcatgaacccctatctttttgagttgtagtaagattgaattgtggttgccaatgttggttggttcagttga

SEQ ID NO: 13335 - DNA, 978 bp, Secale cereale
cagccatcctccgtgcggttccaagctccaactcccacgcccgtctcccccgagatcaggaggagcacgccccggagcgccgagacctcgaagccttcgtctccacccccggaggagagatggggctcacgttcaccaagctgttcagccgcctcttcgcgaagaaggagatgaggattctcatggttggtctcgatgccgctggtaagaccaccatcctctacaagctcaagctcggagagatcgtcactaccatcccaaccatcggatttaacgttgaaaccgtcgaatacaagaacatcagcttcactgtttgggatgtggggggccaagacaagatcaggcccctgtggaggcactacttccagaatacgcaggggctcatttttgttgttgacagcaatgatagggagcgtgttgttgaggctagagacgagcttcacaggatgctgaatgaggatgagctgcgtgatgctgtgttgcttgtatttgcaaacaaacaagatcttcctaatgccatgaatgctgctgaaatcaccgacaagcttggtctgcactcccttcgccagcggcactggtacattcagagcacttgcgcgacatctggagaagggttgtacgagggacttgactggctctccaacaacattgccaacaaggcttgaagcgtctcgacaagtgcttcatcaagaaacaaacgtgctggatgtctcaacaactcactgctaccatttttacatattgtgatatatatatacactgtacaagagatagtatgtgtgcgtatgtgacagacagaagctctcttctttaagtgagctagtatcaggtcaggtttgtttttttgtacggatattatcagtattcccgcgtcgtggttttacaaggtttactttgtcgaccatgtgtgcatgaacccctatccttttgagttgtagtaagattgaattgtggttgccaatgttggttggttcagtt

SEQ ID NO: 13336 - DNA, 1046 bp, Silene vulgaris
atcccggatttgtaatcaactctcttccccgatattctacgctaccatctcctctcctctctctcaactttcttcgctgttcgcagggttttagcgaagaggaaaaatgggtcttacattcaccaagctgtttagccgcttgtttgccaagaaggaaatgagaattctgatggtgggtctcgatgcggctggtaagaccaccatcctttacaagctcaagctcggtgagattgtcactactattcctaccattggattcaacgtggaaactgttgaatacaagaacattagcttcacagtctgggatgtcgggggtcaagacaagatccgtcctttgtggaggcattacttccaaaacacacaaggtctcatctttgtggtggacagtaatgacagagatcgtgctgttgaggcgagggatgagctccacaggatgttgaacgaggatgaactccgcgatgcagttttgcttgtgtttgctaacaagcaagatcttcctaatgcgatgaatgcggctgaaatcactgataagcttggcttgcactctctccgacagcgccactggtatatccagagcacctgtgctacctctggcgagggtctgtatgaaggattggattggctctccaacaacatcgcaaacaaggcttaggactcgagaaatttctagagacgaaggtggaacttgagtttgccgtgaatttatgatcctggatgaggggtgagcgttatctagtcgcatttgttttagccataattacctaaaaacactctggttgtaatttttgcagtgaagaagttaaagcatgttgcttagaacttctcattttgtaatgtcgcaaaatagtggtggtgctttcgtttgtacttccgagattcttttgattccttgcctaaaaacaaaaagattcttttcgttcttatatgtgtatgactctatttgtaactaaagcagctacttccaagtttcaatccttgtgtggtttgaaagttatgatagtgctgattggaatagtgatgatattgtcgtcatttctcgaaaatag

SEQ ID NO: 13337 - DNA, 980 bp, Taxus baccata
atccttccaggcctatgcacaaccggtgttgttttttctttcattaacaggtttgcgaattcagaaaacttcaccagtttggcaagatgggtcttacattcacgaagctttttcaacgattatttgccaagaaggagatgcgcattctcatggtgggtcttgacgccgctggtaagactaccatattgtacaagctgaaacttggtgaaattgttaccaccattcctactatcggtttcaatgttgaaactgtggagtacaagaatatcagcttcactgtttgggatgttgggggccaagacaagatccgaccactatggagacattactttcagaatactcagggtcttatttttgtggtcgatagtaatgacagagaccgtgttgttgaagcaagagatgagctgcataggatgctgaatgaggatgagttgcgagatgctgttcttctagtctttgcaaacaaacaggatcttcccaatgcaatgaatgctgctgagataactgacaagcttggcctgcactccttgcgtcagcgccattggtacatccagagtacttgtgctacatctggtgaaggcctatacgaaggtttggattggctgtctaacaacattgcaaacaaggcttgatcagagagcatttttctaaagccatatatgcattcgagaatgtgttgcagtcttttagggatgtaacagatatgtttaacaagtcacttagtgaattcaagtagataatagcttttggatgattggggatcaattccattgtgaactgatccatagtttacttattgttttgtttgatttttgcactacaattgtttttgtaatcaactactaagatttatttttttcacaactgtcccttttgttcctttgcctaatgctgatgctattgcaaatgttttataagtttttatctgtgtttgttattatttcattgcatgctatgcactactcgtagcgctattggca

SEQ ID NO: 13338 - DNA, 971 bp, Thalictrum flavum
ctactttttttttaaagatcgttaggttttcataattgtaggttttcgcaatttggatttgaatttcaatttcgtgagctgaagacttatgatttgttgagttctgattctatttgatttcaagggaaattcagacatggggcttacattcactaagctttttagccggctttttgccaagaaagagatgcgtattttgatggttggtctcgatgcagctggtaaaactactattttgtacaagcttaagcttggggagattgtcacaacaattcctaccattgggtttaatgtggagactgttgaatacaagaacatcagctttactgtttgggatgttggtggccaggacaagattcgtccattgtggaggcactatttccagaacacacaaggtcttatctttgtggtggatagtaatgacagagatcgtgttgttgaagcgagggatgaattgcataggatgttgaatgaggatgagttgcgagatgctgtgttactggtattcgctaacaaacaagatcttcctaatgcaatgaatgcagctgagattactgataggctgggccttcattctcttcgccaacgtcactggtacatccagagcacatgtgcaacctctggggagggcctgtatgaggggttggactggctctccaacaacattgctaataaggcttgagaggtagctgggtttgcatcatattggtggtatccggatgcaggggtgaatgttatctaggcttttttacaagtcatctagttcatctttttggtgaagagtaggctaaagattttttttcccattagactaatggtaattgtgctgtaataggagaatgtgtttttatatattcttaaaaacctctggtcgagaacttgtttctcaagctaatccttttagctgtgactaaaattatttcattatatcagattatcatccatatatgaaacatgttaatagacttggg

SEQ ID NO: 13339 - DNA, 758 bp, Vinca minor
gcgtaagaaggaaagatggggttgtcatttaccaagctctttagccggctttttgccaagaaggagatgcgtatactgatggttggtctcgatgcggctggtaagactaccatattgtacaagctcaagctgggagaaattgtcaccactattccaaccattggtttcaatgtggagacagtggaatacaagaacatcagcttcactgtctgggatgttgggggtcaagacaagatccgaccattgtggagacattacttccaaaatactcaaggacttatctttgtcgttgatagtaatgaccgtgaccgtgttgttgaggctagggatgagctacacagaatgttgaatgaggatgaactaagggatgctgtcctccttgtgtttgctaacaagcaagatcttccaaatgcaatgaatgcggcagagatcaccgataagcttggtcttcattctctccgtcaacgccactggtatatccagagcacatgtgcaacatctggtgaagggctttacgagggtttggactggctctccaacaacattgctaacaagtcctagagcagcataatcagtccaatgattttgcagataaatctttgtgaaagtggacatcatatatttcctagtattttttgtttttattattatcttgcttctgcaagaatgaacttcgtgttctgtttgattgatttttttttttttatacaatttggcattttgatttagattgagactctctagtatagagagcctcg

SEQ ID NO: 13340 - DNA, 1145 bp, Triticum aestivum
cgtcgtgccttcggtcagtctcacacgacgcggccgagcagcggtttcaacgcagacgtacgccgggaccgcactgcacgacagccatctcttccgtgcggttccaagctccaactcccacgcccgtctcccccgagatcaggaggagcacgccgcaccggagcgccgagacctcgaagccttcgtctccacctcggagcagagatggggctcacgttcaccaagctgttcagccgcctctttgccaagaaggagatgaggattctcatggttggtcttgatgccgctggtaagaccaccatcctctacaagctcaagctcggagagatcgtcaccaccatcccaaccatcggatttaacgtcgaaactgttgaatacaagaacatcagcttcactgtttgggatgtggggggccaagacaagatcaggcccctgtggaggcactacttccagaatacgcagggcctcatttttgttgtcgacagcaatgatagggaacgtgttgttgaggctagggatgagctccacaggatgctgaatgaggatgagctgcgtgatgctgtgttgcttgtatttgcaaacaaacaagatcttcctaatgccatgaatgctgctgaaatcaccgacaagcttggtctgcactccctgcgccagcggcactggtacattcagagcacttgtgcaacgtctggcgaagggttgtacgagggacttgactggctctccaacaacattgccaacaaggcttgaagcgtctcgacaagtgcttcatcaagaaacaaacgtgctggatgtctcaacaactcactgctaccattttacatattgtgatatatatacactgcacaagagatagtatgtgtgcgtatgtgacaggcagaagctcccttctttaagtgagctagtatcaggtcaggttgtcttttttgtatggatattatcagctgctgttcggtggttttacaaggtttaatgtgtcgacaatgtgtgtctgaacccctatctttttgagttttagtaagattggattatggttgccaatgttggttggttcagttgagtgatgtggatggtacatgttgcgaacatacttatgtgagcgatgttttcagtagttctgtatacgatccagtcggtgctggttc

SEQ ID NO: 13341 - DNA, 1117 bp, Triticum aestivum
ccgttcctaacggaaccggtaacgaccggggcccgaaccggccgaacgtagggttagtacgtaacgaccacgaggtacgtcgggggcgaccggccactgcacgacagccatcatcctccgtgcggttccaagctccaactcccacgcccgtctccccctagatcaggaggagcacgccgcaccggagcgccgagacctcgaagccttcgtctccacctcggagcagagatggggctcacgttcaccaagctgttcagccgcctcttcgccaagaaggagatgaggattctcatggttggtctcgatgccgctggtaagaccaccatcctctacaagctcaagctcggagagatcgtcaccaccatcccaaccatcggattcaacgtcgaaactgttgaatacaagaacatcagcttcactgtttgggatgtggggggccaagacaagatcaggcccctgtggaggcactacttccagaatacccaagggctcatttttgttgttgacagcaatgatagggaacgtgttgttgaggctagagatgagctccacagaatgctgaatgaggatgagctgcgtgatgctgtgttgcttgtatttgcaaacaaacaagatcttcctaatgccatgaatgctgctgaaatcaccgacaagcttggtctgcactccctgcgccagcggcactggtacattcagagcacttgcgcgacgtctggcgaagggttgtacgagggtcttgactggctctccaacaacattgccaacaaggcttgaagcgcctcgacaagcgcttcatcaagaaacaaacgtgctggatgtctcaacaactcactgctaccattttacatattgtgatatatatacactgtacaagagatagtatgtgtgcgtatgtgacaggcagaagctcccttctttaagtgagctagtatcaggtcaggttgtccttttttgcatggatgttatcagttgctgttcggtggttttacaaggtttaatgtgtcgacaatgtgtgtctgaacccctatcgttttgagttttagcaagattgaattgtggttgccaatgttggttggttcagttgagtgatgtggatggtacatgttgcgaacatact

SEQ ID NO: 13342 - DNA, 1099 bp, Triticum aestivum
cggtttaggtccctttcgggtcacggtacgttccacgaaaaggaccgagtggtagtctaacgcagagtaacccggggacccggcgacctagcacgacagccatcctccgtgcggttccaagctcctactcccacgcccgtctcccccgagatcaggaggagcacgcccgctgcaccggagcgccgagacctcgaggccttcgtctccaccccggaggagagatggggctcacgttcaccaagctgttcagccgcctcttcgccaagaaggagatgaggattctcatggttggtctcgatgccgctggtaagaccaccatcctctacaagctcaagctcggcgagatcgtcaccaccatcccaaccatcggatttaacgtcgaaactgttgagtacaagaacatcagcttcactgtttgggatgtggggggccaagacaagatcaggcccctgtggaggcactacttccagaacacgcaagggctcatttttgttgttgacagcaatgatagggagcgtgttgttgaggctagagacgagctccacaggatgctgaatgaggatgagctgcgtgatgctgtgttgcttgtatttgcaaacaaacaagatcttcctaatgccatgaatgctgctgaaatcaccgacaagcttggtctgcactccctgcgccagcggcactggtacattcagagcacttgtgcgacgtctggcgaagggttgtacgagggacttgactggctctccaacaacattgccaacaaggcttgaagcgcctcgacaagtgcttcatcaagaaacaaacgtgctggatgtctcaacaactcactgctaccattttacatattgtgatatatatacactgtacaagagatagtatgtgtgcgtatgtgacaggcagaagctcccttctttaagtgagctagtatcaggtcaggttgtcttttttgtatggatattatcagttgctgttcggtggttttacaaggtttaatgtgtcgacgatgtgtgtctgaacccctatcttttcgagttttgttaagattgaattgtggttgccaatgttggttggttcagttgagtgatgtggatggtacctgttg

SEQ ID NO: 13343 - DNA, 909 bp, Triticum aestivum
ccgtgcggttccaagctccaactcccacgcccgtctcccccgagatcaggaggagcacgccgcaccggagcgccgagacctcgaagccttcgtctccacctcggagcagagatggggctcacgttcaccaagctgttcagccgcctctttgccaagaaggagatgaggattctcatggttggtctcgatgccgctggtaagaccaccatcctctacaagctcaagctcggagagatcgtcaccaccatcccaaccatcggatttaacgtcgaaactgttgaatacaagaacatcagcttcactgtttgggatgtggggggccaagacaagatcaggcccctgtggaggcactacttccagaatacgcagggcctcatttttgttgtcgacagcaatgatagggaacgtgttgttgaggctagggatgagctccacaggatgctgaatgaggatgagctgcgtgatgctgtgttgcttgtatttgcaaacaaacaagatcttcctaatgccatgaatgctgctgaaatcaccgacaagcttggtctgcactccctgcgccagcggcactggtacattcagagcacttgtgcaacgtctggcgaagggttgtacgagggacttgactggctctccaacaacattgccaacaaggcttgaagcgtctcgacaagtgcttcatcaagaaacaaacgtgctggatgtctcaacaactcactgctaccattttacatattgtgatatatatacactgcacaagagatagtatgtgtgcgtatgtgacaggcagaagctcccttctttaagtgagctagtatcaggtcaggttgtcttttttgtatggatattatcagctgctgttcggtggttttacaaggtttaatgtgtcgacaatgtgtgtctgaaccctat

SEQ ID NO: 13344 - DNA, 864 bp, Chrysanthemum coronarium
cggaaatcaaaccttgtgttctcttgtctcccatcccagggatcctcatacgatggggcttacatttaccaaacttttcagccggctttttgccaagaaagagatgcgtattttgatggttggtctcgatgcagctggtaagaccaccattttgtacaagctcaagctcggagagattgtcactaccatcccaaccattggatttaacgtggagactgtcgagtacaagaacatcagctttactgtctgggatgtcgggggtcaagacaagatccgtccactatggaggcactacttccaaaacacacagggtcttatctttgtggttgatagcaatgatagggatcgagttgttgaggcaagagatgagttgcacaggatgttgaatgaggacgagctaagagatgcagttcttcttgtatttgccaacaaacaagatctgcctaacgcaatgaatgctgctgagattactgataagcttgggctccagtctctccgacaacgccactggtatatccagagcacttgtgctacttcgggtgaaggactttatgaggggttggactggctctccaacaacattgctaacaaggcatgaggggttggaataccagcggcaagttttgcttttcattatttggtcaggttactttcgcgtcttgtagctcttgtggttggtgcgagcagttatggaactttgtttgttaaaaaggctttttgcctttgatatatagggcatgtatgatgcaatgttttgtggatttctagtatttgcaaaggtatatgtcatgttcagagagattaatgtcgcatgtttatatatgcttttttaagctagtacacaattataaatcttaatctaaa

SEQ ID NO: 13345 - DNA, 1087 bp, Phaseolus vulgaris
tctattctcgttgacgctactcaccccatctcgcgttgctgcaaagcattcttcgtctctctccttctctctctttctctctctctctcagcgatttctgtatacacgaacgtttcatctccgaagggatccataagctgaaggagaaatggggctgacattcacgaagcttttcagtcggcttttcgccaagaaggaaatgcgaattctgatggttggtcttgatgctgctggtaagaccactatcctctacaagctcaagctcggagaaatcgttacaacaattcctaccattgggttcaatgttgagactgtagaatacaagaacattagcttcactgtttgggatgttggtggccaggacaagattcgtcccttgtggaggcactacttccagaacactcagggtcttatttttgttgtagacagcaatgatagggacagagttgttgaggctagagatgagttgcataggatgttgaatgaggatgaactgagagaagcagtattgcttgtgtttgctaacaaacaagatcttccaaatgcaatgaatgctgctgagattacggacaagttgggtctccactctctcagacagcgccactggtacattcagagcacctgtgcaacctctggggagggcctttatgaaggtctggactggctttccaacaacattgccaataaggcttaatgcctttgggagtcttgcggattggtattctggatgcaggggtgaacattatctagcttttgtttcttggtcctcttccgagacaactcgaatatgtgttcatgtaatgtggtttaggacatcgacatctcggtgctaaatgttgtaggaatttgtttcttgggatgtgtaatactctgagctttctattgggtttggatgcaatgtccataactgtaatggagatactaattcaatgcgtcaccaggttctgatttatagttttattttggttatgtatctttcatataatgagtatgaaatggggattttgtttatttttttgtaagttaccctaaaaaactatattcacttcatacttttaaagatatgcccatgcttaaatttgtgttt

SEQ ID NO: 13346 - DNA, 982 bp, Abies balsamea
aactctttcatccgcggggtctgcgattttacagaatttctgagtttctctcaaggttggcaagatggggctcacgttcaccaagctctttcagcgcctgtttgccaagaaggaaatgcgtattctgatggtgggtcttgatgctgctggtaagaccaccattctgtacaagctgaagcttggggaaattgtcaccacaattccaactattggtttcaatgtggagaccgtggagtacaagaatattagcttcactgtttgggatgtcggaggtcaggacaagatccgaccattgtggagacattactttcagaatacccagggtcttatatttgtggtggatagtaatgacagggaccgtgttgttgaggcaagagatgaattgcataggatgcttaatgaggatgagttacgcgatgctgttctcctcgtatttgcaaacaagcaggatcttcctaatgcaatgaatgctgctgagataaccgataagcttggtctgcattctttgcgtcagcgccattggtatatccagagtacctgtgctacgtctggtgaaggactgtatgaaggcttggattggctttctaacaacattgcgaacaaggcataatgtcgaagcagagtattgaaactatgatgtctttgagaatgggttggattcggtgccttctgagtattggttggatactttatgggatgtagtggacgtgtttcatgcttctcctagtaaattgaagtagataaatagttaaagggggttgaggatctattctgtagtgtactgatccttagtttagttatcgtgttgtttgaaattttgcatgtctacaattgttttgtaatcaactatgaattcttctagtggttcctcaggattccagttttcgatttaatgccctgtgccccctccttaccttgtttgtggattcaaaagtactgtcactgaaattttcaaagtaatatattctttcgaatttatata

SEQ ID NO: 13347 - DNA, 753 bp, Acacia harpophylla
gggctctcctgaatctgaatctagccgagccttcgggcaaaacgactcctcatttcggtctctctctgctttcttctttgctaccattttataaaaaatggggctgtcttttaccaagcttttctctcgtctctttgccaagaaagagatgcgcattctaatggttggtcttgatgctgctggtaaaaccacaatcctgtataaactcaagttgggagagattgtcaccacaatccccactattggatttaatgtgaagactgtagagtataagaacattagtttcactgtgtgggatgtcgggggtcaggataagattcgacctttgtggagacactacttccaaaacacacaagggcttatctttgttgtggatagcaatgatcgagatcgtgttgttgaggctagagacgagttgcacaggatgctgaatgaggatgaattaagggatgctgtattgcttgtttttgcaaacaaacaagaccttcccaatgcaatgaatgctgctgaaatcacagataaattaggtctgcattctctccgacagcgccactggtatatccaaagcacatgtgctacttctggggaaggattatacgagggactggactggctttcgaacaacattgccagcaagggttaaaggacgcagggtgctggctgtttttcctcaattatgatagcaagctgtgccctgtcagcactattacaatatctgtgcctttctttctttttattatacagtgaaatcta

SEQ ID NO: 13348 - DNA, 1040 bp, Amorphophallus konjac
ttcccagtttcctcctcctccgacggcgaacagcggaggagaaacgagcaccgacttcgaagcttcgtctcatttcgtcgtcggaagccccggttgctggtcgctgctgcggtgctctcctctcctcccttcgtgaacgaagatggggctaacgttcacgaagctcttcagccggctcttcgctaagaaggagatgaggatccttatggtcgggcttgatgccgccggtaagacgaccatcctgtacaagctaaagctgggagaaatcgtcaccaccattcccaccatcggttttaatgtagagactgtggagtataagaacattagcttcaccgtttgggatgttggtggtcaggacaagatcaggccactttggaggcactacttccaaaacacacagggccttatctttgtcgtggatagcaatgatagggatcgtatcgttgaggcgagggatgagctccataggatgttgaatgaggatgaattacgtgatgctgtgttgctcgtttttgcaaacaaacaagaccttccaaatgcaatgaatgctgctgaaattactgataagcttggcctgcactccctgcgtcagcgacactggtatatccagagcacgtgtgccacctctggtgaaggactttatgaggggctagattggctctcgaacaacattgccaacaaggcttgaagatttcttcgcagtaccaggcgttgaggaaaatgtttgactacgatgctgctagtactatttaaaggccggcacgtggagcttttctggaatcctgctgctgtatttctttatcgtcatctttatttctttcatttcattgccacccaattatctaagaacgtccttggggacagtcgacatccatctccagtctgtgtagtagtagctaagatacctctgttgaatttcttaagagtttgtgatgttttgtaccataactatagatgggtttacgagtggtattgtgtttatctggtctgtgcaaatacaggtggacattaaacaacatgaatagttgagaatatttttg

SEQ ID NO: 13349 - DNA, 999 bp, Amorphophallus konjac
ggtcggaggagaaacgagcaccgacttcgaagcttcgtctcatttcgtcgtcggaagccccggttgctggtcgctgctgcggtgaacgaagatggggctaacgttcacgaagctcttcagccggctcttcgctaagaaggagatgaggatccttatggtcgggcttgatgccgccggtaagacgaccatcctgtacaagctaaagctgggagaaatcgtcaccaccattcccaccatcggttttaatgtagagactgtggagtataagaacattagcttcaccgtttgggatgttggtggtcaggacaagatcaggccactttggaggcactacttccaaaacacacagggccttatctttgtcgtggatagcaatgatagggatcgtatcgttgaggcgagggatgagctccataggatgttgaatgaggatgaattacgtgatgctgtgttgctcgtttttgcaaacaaacaagaccttccaaatgcaatgaatgctgctgaaattactgataagcttggcctgcactccctgcgtcagcgacactggtatatccagagcacgtgtgccacctctggtgaaggactttatgaggggctagattggctctcgaacaacattgccaacaaggcttgaagatttcttcgcagtaccaggcgttgaggaaaatgtttgactacgatgctgctagtactatttaaaggccggcacgtggagcttttctggaatcctgctgctgtatttctttatcgtcatctttatttctttcatttcattgccacccaattatctaagaacgtccttggggacagtcgacatccatctccagtctgtgtagcagtagctaaagatacctctgttgaattttcttaagagtttgtgattgttttgaccataactatagatgggtttacgagtggtattgtgtttatctggtctgtgcaaatacaggtggacattaaacaacatgaatagttgagaatatttttggcaaaaat

SEQ ID NO: 13350 - DNA, 888 bp, Amorphophallus konjac
ccgtccttatctgctccgctttgatcggaattgttgatctaggtgagcgaacatggggctaacgttcacgaagctcttcagccggctcttcgccaagaaggagatgaggatccttatggtggggcttgatgccgccggtaagacgaccatcctgtacaagctcaagctgggggaaatcgtcaccaccatccccaccatcggctttaatgtagagaccgtggagtataaaaacattagcttcactgtttgggatgttggtggtcaggacaagatcaggccactgtggagacactacttccaaaacacacagggccttatctttgtcgtggatagcaatgatagggatcgtatcgttgaggcaagggatgagctccataggatgttgaatgaggatgaattacgtgatgctgtgttgctcgtttttgcaaacaaacaagaccttccaaatgcaatgaatgctgctgaaattactgataagcttggcctgcactccctgcgtcagcgacactggtatatccagagcacgtgtgccacctctggtgaaggactttatgaggggctagattggctctcgaacaacattgccaacaaggcttgaagatttcttcgcagtaccaggcgttgaggaaaatgtttgactacgatgctgctagtactatttaaaggccggcacgtggagcttttctggaatcctgctgctgtatttctttatcgtcatctttatttctttcatttcattgccacccaattatctaagaacgtccttggggacagtcgacatccatctccagtctgtgtagtagtagctaagatacctctgttgaatttcttaagagtttgtgatgttttgtaccataactatagatgggtttacgagtggtattgtgt

SEQ ID NO: 13351 - DNA, 805 bp, Amsonia hubrichtii
ctctgttggcagcaagaagatgggattgtctttcaccaagcttttcagccggctatttgccaaaaaagagatgcgcatattgatggtgggtcttgatgctgctggtaaaacaacaattttatacaaactcaaacttggtgagatagttacgactattcccaccattggatttaatgtggagactgttgaatacaagaacatcagctttactgtctgggatgttggtggccaagacaagatccggcctctgtggagacattacttccaaaacactcagggtctcatctttgtggtggatagtaatgaccgagatcgtgttgttgaagcacgggatgaactgcaccggatgttgaatgaggatgaactgagggaagctgtgctgctcgtttttgccaacaagcaagatttgcctaatgcaatgaatgctgctgagattactgataaacttggtcttcattctctccgccaacgtcattggtacatccagagcacttgtgcaacatctggtgaaggactttatgaggggttggactggctttcaaacaacattgctaataaggcgtagttcacagttgaagttggatgtattttgctgatgaagcaagtccagaatatacttcaacatttctccctccgggattcagacttgcctgtctctttccattctgtctcctccctttgaaagcgatgcagaagctgccgttaaagaagtttcagaatgcctatatatgagttttccaagttgtagtagtatatctttagaaagaagtgtttgtttttagataaacataaaatggttacaaaa

SEQ ID NO: 13352 - DNA, 1094 bp, Brassica rapa
tatattcgacgtatttttaacgcttactggatgatataagtagagatttttttctgtcaaacacaaaaaaaaaaaaaaaaaaatcatcgtgaaacgttggaaagcgacgagcatcggcatcagatctcgtgcggcggttgtgttcttcgggtttagaataaaaggaaaggataggagatggggctgtcatttgggaagctgttcagcaagctgtttgcgaagaaagagatgcgtattctcatggttggtctcgatgctgctggtaagaccaccatcctctacaagctcaagcttggtgagatcgtcaccaccattcccaccattggtttcaatgttgaaactgtggagtacaagaacattagcttcaccgtgtgggatgtcgggggtcaggacaagatccgtccactgtggagacactacttccagaacacacagggacttatctctgtcgtggacagcaacgatcgtgaccgtgttgttgaagccagggacgagcttcacaggatgctcaacgaggatgaattgagggatgcagttctgcttgtttttgctaacaagcaagatctccccaacgctatgaacgctgctgagattactgacaagcttggccttcactctctccgccaacgccactggtacattcagagcacttgtgccacctctggagaaggactctacgagggtcttgactggctctccaacaacattgctaacaaggcatagaaaaggaggtagcaagattcctccctgcttgtttcgctagtactataaaaacgaaaccaagattttattatcatatgttcgtcttctcgcatctcaaactcaaaaccatatcacattttgtactttcctttaataactcacctcttttactttcggatattaatttctttattcaaatttgaacttcggaaacttacaatctacaacacacaaaatacatgaaagcgcacacattaatcaaacaagtaagaaaacaaaaacacatgtcaacctcaaaagcccatgaaagcagagacaacatgtgtggttgtcgagccaacacagccccctatccacttactgcccggacaaaccccgaatctacttcaccg

SEQ ID NO: 13353 - DNA, 894 bp, Fagus grandifolia
ccccatattacgcgttcgtgtgaagctttaatctctctctctttgtctctctgagttttctctaacttgatccctctgcgaagctctccgaagggatccatagccagaaacagaaatggggctgacattcacgaagctcttcagccggcttttcgcgaagaaagaaatgcgaatactgatggttggtcttgatgcagctggtaagactaccattctctacaagctcaagcttggtgagatcgtcacaaccattcctaccattgggttcaatgtggagactgtggaatataagaacatcagcttcactgtctgggatgttgggggtcaggacaagatccgtcccttgtggaggcactacttccagaacacacagggtcttatatttgtggtggacagcaatgacagagaccgaattgttgaggcaagggatgaattgcataggatgttgaatgaggacgaactgcgagatgcagtgttgcttgtatttgctaacaaacaagatcttcctaatgcaatgaatgctgcggagattactgataagcttggcctcaactctctccggcaacgtcactggtacatccagagcacctgtgcaacctcaggagaggggctttatgagggtttggattggctctcaagcaacattgcgaacaaggcatgaagctcctggggagttgttttgttgtgcactgacaattctggatgcaggggtgaatattatctagttctttttaaagacaattggattgtggttatgtccttttatttcgggaaatgatctttttattaggaactttgtggctatattgtaatagaaaaattttatgtgggatatatatacttgagtctttttgttggggttgtatgcaattctcctagctgtaatcataacca

SEQ ID NO: 13354 - DNA, 1459 bp, Cannabis sativa
gttgaaataaggtccatattaattgaggaaggaaagggaggaaaggggtatatataggaaaatccgaaatctgagaattgttagatctcattccattccatttcagatttgagttacaaaataaaacccagaatcaaaaatgggactttcgttcggcaaattgttcagcaaattgttcgccaagaaagagatgaggattttaatggtgggtcttgatgcagctggtaaaaccaccattttgtacaagcttaaattaggggaaattgtaaccaccattcccaccattggatttaatgtggaaactgttgaatacaagaacattagctttacagtttgggatgttgggggtcaagacaagattcgacctttgtggagacattattttcaaaacacacaaggacttatctttgtggttgatagtaatgaccgtgatcgtgctgttgaggctagagatgagttacacaggatgttgaatgaggatgaattaagggatgctgttctgcttgtgtttgctaacaaacaagatctacccaatgctatgaatgctgctgaaattactgataagcttggccttcattctcttagacaacgccactggtacattcagagcacatgtgccacttccggggaagggttgtatgagggtcttgactggctttccaacaacattgctaacaaggcttagatgactctggcaatggtcatttgttatacaggtttttcatgccacagaagctattgttttttccttcttcttttgttttactcatcagatgatattcaaagttgttttgttgttactttgtaataattcttcattccattctgtgtaccttgactattcttattattattattacactactatggttttttgatttgatatttcattgtagaatatcaacatgtattaccaacatataaattcataaactattagccattgaaaactctaaattccagtcaaatggagcagagtgagtgagagttataataaagattctgaagctagtattactgcaatggtgtgcattttattccataggggggcaagaagagaatcttaaaggtttgattttgacattggtgttggggtagtactacttgttgtattcattcactattcagtgtttggttggttagattagattgccaaaagaaatggggggtatcccatcccaattcccatcatccatttgggacccccctctatgcaggcatacaatgcctacctatatatttatatacatgtaaatataaacctgaaaatacattccaagtaaagttaaatgtcatacatagccccattagccctcagtggaagagaaaagtacaccacccatcaccttaagtgacttcaaaaagagatctcaaaagacaaaaaagcaatccttggaagagttaaacttgtattttcataatagtttggtgaccttcacatacctaatccctacaccac

SEQ ID NO: 13355 - DNA, 973 bp, Gossypium hirsutum
ttttgagagggaaagatcttctttcaaccgcgcctaataaccgctcggatttttctcagacgtgaaaaaaatggggctgtctttcaccaagctattcagccggctatttgccaaaaaggagatgcgtatactgatggttgggcttgatgctgctggtaaaaccaccattctttacaagctgaagttgggagagattgtcactaccattcccaccatcggtttcaatgttgagaccgttgaatacaagaacatcagcttcactgtttgggatgttggtggccaggacaagatccgaccattgtggagacactatttccaaaacatgcaaggacttattttcgtggttgatagcaatgatcgtgaccgtgtggttgaagctagagatgagttgcacaggatgttgaatgaggatgagttgagggatgctgtgcttctagtatttgcaaacaagcaagatcttccaaatgctatgaatgctgctgagattaccgacaagcttggccttcattctctccgccagcgtcactggtatatccagagtacatgcgccacatctggtgaaggactgtacgagggactggactggctctcaaacaacattgcaaacaaggcatagatggcgtaattgacttgtcagtctcagaaaatgccagccccttttggaattattgatgtttctacgtccgttaaaatgttttggtttttcatgttcttttgtttcttgcaaactttgtcatttgttgcttcttgtagtttaagaataattgataaaattttcggtttccattgttgttcttggtagttggaaaaaaacaatgttttccccaatctcgaggccattcctttcttgatggaaattaacaggttaagtcggtttctttaatctttaaatataaagataccagattcctttggattctttaatgcttgttttagcatgtgcagtaactgcaattttttttcttaaaaaaac

SEQ ID NO: 13356 - DNA, 852 bp, Taraxacum officinale
cggggattggtaaactcacggttctcaacgtccactttccttcactcaaaccccttccaactaataaatactacgcctactctctctgcatcgcaaatttcatcggtgatcgccggctctcccactccgtaagatctctgtcccatcatacaaagatggggttgaccttcaccaagcttttcagtcgcctttttgctaaaaaggagatgcgcattttgatggttggtctcgatgcagctggtaaaactaccattttgtacaagctcaaattgggggagatcgttaccactattccaaccattggattcaatgtggaaactgttgagtacaagaacatcagctttactgtatgggatgttggtggtcaagacaagattcgccccttgtggaggcactacttccaaaacacacaagggcttatctttgtggttgacagcaatgatcgtgaccgtgtggtggaggctagagatgaactacacaggatgcttaacgaggatgagttaagagatgcagttttgcttgtgtttgccaacaaacaagatcttccaaatgctatgaatgctgctgagattactgataagcttggcttgaattctctcagacagagacactggtatattcagagcacatgtgccacctctggtgaaggtctatatgaaggtctggattggctttccaacaacattgctaacaaggcttaaaagagatcatcattgtcatcttcttaatggattactgcaactactattagtgtttgttttttttaaatattttgagttgtgggtgttatatgtaaacctaaatttgtgttactttttacatactttcaacattgagatgtcttatggataa

SEQ ID NO: 13357 - DNA, 1025 bp, Euonymus alatus
ccaacgttactcgaatctggccaaagctttaacgccgtcaaagcgtctctctctctctctcactctctctccacatctatataatcagcttctcggtcctttccttctcctcgttctccgtctcccgaggcaggcttcacaagatctgcccctttagcctatctgagttgaaaagatggggctttcttttggcaagcttttcagccgactttttgccaagaaagagatgcgaattctgatggtaggtcttgatgctgcgggtaagaccaccatcttgtacaagctcaagttgggagagattgtcaccacgattcctacaatcggattcaatgtggagacggtggaatataagaacataagcttcacagtttgggatgtggggggtcaggataagattcgtccattgtggagacactacttccaaaatactcaaggtcttatttttgtcgttgatagcaatgatcgtgatcgtgtagttgaggctaaggatgaactgcatcggatgttgaatgaggatgagttgagagatgctgtgctgcttgtatttgcaaacaaacaagatcttccaaatgctatgaatgctgcggagattactgacaagcttggccttcactcactccgtcaacgccactggtatatacagagcacctgtgcgacatctggtgagggactttacgagggactggactggctctccaacaatattgctaacaagggataattgtccgagtcaatttgacttttttgggcagatgtgattctagtttaggcaatgtggtgttctggatttgtttattttaaccccgtaattgtcgtcgtcgtcgtggtgtgaattggatactgtcttcagatatggctaccaactattattataggagtttgttctttgttgatggaatagttgttggttacatggtttccatgcgatcgttcctttattatgagtttcgtaaatgaattctcatccaaggtcgagctgaattcggttgttgatcttcgtaaacaatggcatgcaatattgcagt

SEQ ID NO: 13358 - DNA, 1036 bp, Euonymus alatus
acccaacgttactcgaatctggccgacgctttaacgccgtcaaagcgtctctctctctcacgctctctccacatatatataaccagcttctcggtcctttccttctctcgttctccgtctcccgaggcaggcttcacaagatctgcccctttagcctatctgagttgaaaagatggggctttcttttggcaagcttttcagccgactttttgccaagaaagagatgcgaattctgatggtaggtcttgatgctgcgggtaagaccaccatcttgtacaagctcaagttgggagagattgtcaccacgattcctacaatcggattcaatgtggagacggtggaatataagaacataagcttcacagtttgggatgtggggggtcaggataagattcgtccattgtggagacactacttccaaaatactcaaggtcttatttttgtcgttgatagcaatgatcgtgatcgtgtagttgaggctaaggatgaactgcatcggatgttgaatgaggatgagttgagagatgctgtgctgcttgtatttgcaaacaaacaagatcttccaaatgctatgaatgctgcggagattactgacaagcttggccttcactcactccgtcaacgccactggtacatacagagcacctgtgcgacatctggtgagggactttacgagggactggactggctctccaacaatattgctaacaagggataattgtccgagtcaatttgacttttttgggcagcaaccagcggcaaaatgtgattctagtctaggcaatgtggtgttctggatttgtttattttaacctcgtaattgtcgtcgtcgtgtgtgaattggatactgtctttagatatggttaccaactattattataggagtttgttgtttgttgatggaatagttgttggtttcatggtttccatgcgatcgttcctttattatgagtttcataaatgaattctcatccaaggtcgagctgaatttggttgttgatcttggtaaatattggcatgcaatgttgcagtgttt

SEQ ID NO: 13359 - DNA, 824 bp, Adiantum capillus-veneris
cgctaaatcgggactagactcgttctttcgctctcccgtgttcttgtgtgctctctctgtgtgtgcgtacgagagagcgagaaaccatgggtctcaccttcaccaagctcttccagcgattgttcgccaagaaggagatgcgcatcttgatggttggtctcgatgctgctggaaaaaccaccattctctacaagctcaagcttggcgagatcgtgactaccattccaaccatagggtttaatgttgaaactgtggagtacaagaacatcagcttcacagtgtgggatgttggaggccaagataagattcgccctctttggaggcactacttccagaatacccaaggcctgatctttgtcgtggacagtaatgacagggatcgtgtggtggaagctcgcgatgaacttcatagaatgcttaatgaggatgagctacgggatgctgtgcttcttgtcttcgcaaacaagcaggatcttcccaatgctatgaatgcagctgagatcacagacaaattgggcctacactctcttcgtcaacgccactggtatattcagagtacatgtgccacatcaggcgaaggtctttacgagggcttggattggctctctggtaacattgccagcaagggttaggagaaggtttcctagtaaacatgaacttttttgaagatcttgcttagggaatttcatatgagactgattgttgaattatcatgcgagtaagttatgtatctggtcatgacattggttgtgtttgccttctggggacaaactcatgttgaaatatcatgcttgacagcttgttatgatgtcaaattggtgtgc

SEQ ID NO: 13360 - DNA, 848 bp, Linum usitatissimum
acacacctcctccttcatttcgttctctgtctgtagtttcaagatgggtctatcattcaccaagctgttcagccggctatttgccaaaaaagagatgcggattctgatggtgggtctcgatgcagctggtaagactacaatcttgtacaagctcaagcttggagagatcgtgacaaccattcccaccattggattcaatgttgagaccgtggaatacaagaacatcagcttcactgtctgggatgttggaggtcaagacaagatccgtccattgtggagacactacttccaaaacactcaaggactgatctttgtcgttgatagcaacgatcgcgatcgtgtggtcgaggctagagatgaacttcatcgcatgttgaatgaggatgagttgagggatgcagttctgctagtctttgccaacaaacaggatctcccgaatgccatgaatgcagctgagatcacggacaagcttggccttaattcccttcgtcagcgccactggtacatccagagcacctgcgctacctctggtgaaggactctacgagggactcgactggctgtccaacaacattgccaacaaggcatagaggactgtggtagacttcacgaagccttatgtaactgcttcgatactgccgctagcgcgaacccataatatgatgtttttcgtgtttgttttgaggggtatgtcgatgtatcctgtaatcgtttgcaagtgatgttggtaattctatctttttgtagattctcaaaataataatctttcatacgtattgttaaatatgattctgtaacgtgactcacaagttacctcttttttcacattgggaaaaacactaattaatc

SEQ ID NO: 13361 - DNA, 1022 bp, Gnetum gnemon
ggacgaacagaaatcctccgttcattttggtgccgactgacgaaggattccagcaggcaggcaaacaagaatcaggcacaacacagctcactgaggctttgaataccggtaatccaatccaatccaatcgccggaggagatggggctgacgtttacgaagctgttccaacggctcttcgccaagaaagagatgcgtattttgatggtgggtctggatgctgctggtaagaccacaatcctgtacaagctcaagctcggagagatcgtcacgactattcccacaatcgggtttaacgtggagacagtggaatacaagaacatcagctttaccgtctgggatgttgggggtcaggacaagatccggccattgtggaggcactatttccagaacacacagggtttgatttttgttgttgatagtaatgatagagatcgaattgttgaggcaagagatgaattacataggatgctcaatgaggacgaacttcgcgatgctgttcttcttgttttcgcaaacaaacaagaccttccaaatgcaatgaatgctgcagagatcaccgataaacttggcttgcattctctgagacagcgtcactggtatatacagagcacttgtgcaacctctggtgaagggttatatgaaggtttagattggctctcaaacaacattgcaagcaaggcttgatttgggcgcgtggtcttgttcataactgcatgtctttgtgcttggaatgtagtattcagaatgatttagaggaaaatgtttctttgtttaatgaaatggatgtttggataatacttttgtgactttgacttatgaaattgattggtggaattttagttagttaagggttttttttaaaatttattcgatttgaatatgatctcagctagaggattgacacatttagtggttaacattttgttagtattatacataatggaagagtatggtattgaatgtcatcattttgatgaaccgcttaatattttcttgccatattaaattgtttcatcttttt

SEQ ID NO: 13362 - DNA, 975 bp, Zea mays
ccgaagccgaggaggagaggggagcagcgagatcgtgcgcgcctccgagatctccacgaaggttggtgccagacctgctgcttgtgtcttcccttcctgatcacgtttcaattctgcttgctaggagttgtggtaacatggggctcaccttcacgaagctcttcagccggctcttctccaagaaagagatgaggatccttatggttggtctcgatgcagctggtaagaccaccatcctctacaagctcaagctcggagaaatcgtgaccaccatccctacaatcgggtttaatgtggagactgttgaatacaagaacattagcttcactgtctgggatgttggaggtcaggacaagatcaggccattgtggaggcactatttccagaacacccaaggccttatctttgttgttgatagcaatgacagagatcgtgttgttgaagcaaaggatgagctccacaggatgctgaacgaggatgaattgagggatgctgtcttgctcgttttcgcaaacaagcaagatctaccaaatgcaatgaacgctgctgagatcaccgataagcttggtctccattccctgcgccaacgccactggtatatccagagcacttgtgctaccacaggagaaggtttgtacgagggtcttgattggctctccaacaacattgcaaacaaggcctgaatggacaattctgctgtttcacggagcacatctgcacatggcgaggcatggtcattttgaccctcagacgatcattgtttcattggaaagtatcgtatttctatgctaggcttttcagagagattactctctaagaaactgatccgatattaagacactataattggcattggcactagtagatcgtttactgagtaatgcagtttattttaatgtatcccaattgtgttgtaagatacaactatgcgtcggaattacccattcaatttgaatctagatacgtagtttttgt

SEQ ID NO: 13363 - DNA, 2030 bp, Petroselinum crispum
gtatctatttgtttctacatatactcgcttaatttaattcgtagcttttaaatctcatcttctatttcaattgcttatagggaatcagatccatttcttttttgtgatccgttagatataacaattatagttataatatgtaattatcgatctgtttggatctgagatttttaattatttgtgagaatttaacgtttttgaagatcaatcagatgggatttgttcaaaaggtccgtaattagggtcctcatttttgtttgtttttcgctttcgtgttgtcgaagatcgttgttgtcgttgtgtgtcattgttaatttgatgagaatatcgttgtttcgtatatattcacaaattgtaaacaccagaattgttacgataaatatctgttttttcagatatgctatgttgaatgttaattacttggaatttggtagacaaatcttgcttatatgtatcaatgtgaccccttctataaaagatgaaggcttgaaagaatgattatcaatttacatttagttgtaggcttttgaatcatatgtttctcggacttggctttaggtgtccaatatggatagtgtccgcttggaaatattttgaaaggttttgcatttgttggtactcggtcaagaattgcgtgttcattctatttttgagtgtctgatttgggtacacgaggtgaaatgtggagtcgggtctatgtagtccgaaactagtctaaaagatattgttaaattgtcctgttttaggcacctgatcttcaacttctctcatacccttgtcctgttttagatttgcttaaattaatgttaggtttgacttttattactggcctaaacagatattaggaaaaatgggtttgtctttcaccaagctgttcagtcggttgtttgcaaagaaggagatgcgtatacttatggtcggtctcgatgctgctggtaagaccaccatattatacaagctcaaactgggagagattgtcaccaccatccctactattggattcaacgtcgagactgtagaatacaagaacatcagctttacagtttgggatgttggtggtcaggacaagatccggcccttgtggagacactattttcaaaatacccaaggtctcatcttcgtggttgatagcaatgatagggatcgtgtggttgaggctagggatgagcttcacaggatgctgaatgaggatgagctgagggatgccgtgcttcttgtatttgctaacaaacaagatttacctaacgccatgaatgctgctgagataactgataagctgggtcttcactccctcaggcagcgtcactggtatatccagagcacatgtgcgacatctggagaagggctgtacgagggtctggactggctctccaataatattgctaacaagggttgatgacatgatctttcatatgttcttgagtggaagctgtcagataggatctgcaaccctttttcttttggatttttgttttgttcaacttactttcgtgaatgatctgtttggttttcagcttattgtttatagcacacttatctgtataagttttgaccttggcatggttaggacaagtgttgccttttagtccatgagtttctttaaaaactagttgtatcaaggttattatcagtaatgaaacgatgtttattggtgacatttacattataggaaaatgacactgagagtaggagagtaaactgtagactttacatgtcctttagcataacatatcaaatttatatggaaaaacacctaggttttcttggaagatttgccatggaacaatgctcgcacgctactgtgaatagcaacagtattatatttggtctgattatatcattgggcatgatatcatcaatgattaaaattcaacctcttcatttatgatcgtcctgtttataagctattgattcagcgagattagtaatgtccttgtgcctaaaattttctgtattttgatcagtgattaatgcaatcttcgactagctttaccatgactttgctccaattgctcggaatcttcccaagg

SEQ ID NO: 13364 - DNA, 1769 bp, Petroselinum crispum
gatattttcatagaattagtttggtttcgtatgattaatgaaagtgaggtgagattatgtaaatattgtgttgcatgttatatgtcgaagtgtgcatgtgacttgtgaaggtgtgatctgtttggacttgtagtttactgtttatcgtgactgtttttatagaattgttgtttttcaggtttgattagtgtagtttagttgttaattctccggctttttggaagctagattatatcattagttgtgatttctattgctatgatgctatcaatgaaatatgcgatatatgcttttcttaatattttaaaaaggaaatggaataagtttggtttcatataataaatcaaagtgaggtgagattatgtaaacgttgtgtgccatgtatctcgaaatgtgcatgtgacttgtggaggtgtggatctgtttgcacttgtaggttactgtttacaattattataaaaataagcatgttgtttagttagtcaacttaggatttgacttgagttatttgtttacgaacaacggaacaaggcattttggttcaactgataagaaaactgtatgagaattttaatataactgtcactgctgattgtgcgtgttgatcaccttattggtctgggtacgcttgtactgtttactgaaaatggttgatatgtattgtgatgtactgatgtttttcatcaattggttgtgttttatggatgtgtcagataaaagatggggctctctttcaccaagcttttcagtcgtctttttgctaagaaagaaatgcgcattctcatggttggtctcgatgctgctggtaaaaccacaattttgtacaagctcaagttgggtgaaattgtcactaccattcctacaattggttttaacgtagagactgttgaatacaagaacattagcttcactgtgtgggatgttggtggtcaggacaagatccgacccttatggaggcattatttccaaaacacacaagggctcatctttgtggtggacagtaacgatcgggaccgtgcggtggaggcaagagatgaactgcacaggatgttgaatgaggatgaactgagagatgcagtgctcctagtgtttgctaacaagcaagatcttccaaatgcaatgaatgcagctgagatcactgacaaacttggcttgcattcacttcgacagagacactggtacattcaaagcacgtgtgctacatctggagagggactatacgaaggactggattggctttcaaacaacattgctaacaaggcttaagaagtttcttgatggttatatccagtatccaagtcaatctatgggcactgtcggcacctggacccaggtgccggtgttgcagatatttttgtttctaagattagttactgtggatgttgatctgatgatgtgagaatgtcgaaacggtgatgtaagatgttgtgctgatgggtttttattcttgaagttgctaataaatacattgctacagagcaattacatgtaggtttcttgtttcatgcttcatgcttcatgcttcattcctttgtatggaggttacagggtagatttgcctagttatcaaattacttaaattggcctacgtgggccttgatgcccttaaattgaccaaactacttgggcgttggtgacaattccgcttttattaatgtttcaaattcaaattataaatcataaattcataatgtttcgacaccatctttgatcttagaaccattattagtttgtaaaggtttctttaggactgatttatttatttattt

SEQ ID NO: 13365 - DNA, 1682 bp, Petroselinum crispum
tctcgatctctctcgattttcgtgtaagtttctctcctgcttctcctccttcaaatttcttgttgttatgtatgtatatatctcacggatcttacttgattctgttgaattgtttaattaatattaaaattcatgtaattatcaattttaattcatatatatgtgcttctcctctccaaggtgtatgtatgtaatgttgttagttctgattagttttgtttcggggtttaagctccgtttgtttcccggaaaataacttgagtttccgtaaatttactaaatagttgagaatttctgttagggattaaatttatttaaattccgaatggaagtagaggctaattgtggtttgttaatgtaatttacgcaacatatgattcgttttcgatatcttgatgatgaaaatataagcaatccatttttccccccccccccccccccccccccccccccccccccttccgtgattattagcttgtgagaatgtcgtaatgttaagatatgctgttatacaatgtaggtccataagagggtcatacttgcatccagtgtttttgtttttgaaatttgtgtgacgaaaatgatttgcaacgcatacgaaggatggaggatttgagctgctaatgttgttcgtaattatgggatagtccgttgtggaagtaaccgaatttgttttattagttctaggattaactaggattaattgaacttgactttgcccgcgcccctttctgtttacttctagattttaatttaataaattagcttgaaaatgggttttgagtcttttgagttgtactggcctaacagttaataggaaaaatggggttgtctttcactaagctgtttagtcggttgtttgccaaaaaggagatgcgtatacttatggtaggtctcgatgctgcgggtaagaccaccatattgtacaagctcaaattgggagagattgttactaccattcctacaattgggtttaatgtggagactgtagaatacaagaacatcagctttactgtctgggatgtcggtggtcaggacaagattcggcccttgtggcgtcactatttccaaaatacccaagggctgatctttgtcgttgatagcaatgatagggatcgtgtggttgaagcaagggatgagttgcacaggatgctgaacgaggatgagctgagagatgcagtgcttcttgtttttgctaacaaacaagatttacccaatgccatgaatgctgctgagataaccgataagcttggtcttcactcgctcaggcagcgccactggtacatccagagtacatgcgcgacgtctggggaagggctgtacgagggtctggactggctatccaacaatattgctaacaagagttgatgatgtgaattttgaagactttttgagctggatccagaacggatacgcccgttttctttgggatttatgttttatgcatgttatttcgtgtgattgatctgttttgtgttcagtttattgtttatattacttatttatactagttttatccttgacagtggttaggacgagctctctgcctttatagtcattgagttccttgaaacgctagttgtaacgaggttattattaatgaatgaagttatggattaacaactacttgaatagatgttgataaaaatcaatattattagcctcattatactcgcagaggc

SEQ ID NO: 13366 - DNA, 1147 bp, Papaver somniferum
tcaagaaggagatatttattatgcgtctcgatttcgtttcctttttattctctcttcttcgctgacctttattaccccattttacgcgtctctaccttttccctctctctcaaccccgaagaacctttggaagaagatctcaaaacaaatagatctgatttgaaggagttattgtaagacacgaatcatggggttatcattcactaagctttttagtcggctatttgctaagagagagatgcgtattttgatggttggtctggacgctgctggtaagactaccattttgtacaagctcaagcttggagagattgtaaccacaattcctaccattgggtttaatgtcgagactgttgaatacaagaacatcagcttcactgtctgggatgttgggggtcaagacaagatccgtccactgtggaggcactacttccaaaacacccaaggtcttatctttgttgttgatagcaatgacagagatcgtgttgttgaggcaagggatgaattgcataggatgttaaatgaggacgagttacgcgatgctgtgttgcttgtttttgctaacaaacaagatcttcccaatgcaatgaatgctgctgaaatcactgataagcttggcctccactcccttcgccaacgccattggtacatccagagtacatgcgcaacttctggggagggactttacgagggtttagattggctatccaacaacattgccaacaaggcttaaagcggttgaagatggtgattttcttggattggccggctttagtttttctggatgcaggggtataatattcaagcttctcgtgagatagatgtggctttcagaacagccagtttataggacttaaaaaggatctctctgttaacaaatacgctctcttttatatgctttgcccttttctctctcttctatttgttgtgctcaagttcttactggcttttttagctaatccttttagctgttacaaacaaatacattctgtggtgttttaaaattacttatttggttatgcttgccatctgtttattcttttttgttcctgtgcaataaatctggacgagcagtgcactggttcagctcttgcaaagagatgtgcttagctctagctctgttctcctttttttggtgcaaaaaaaa

SEQ ID NO: 13367 - DNA, 867 bp, Papaver somniferum
aaatagatctgatttgaaggagttattgtaagacacgaatcatggggttatcattcactaagctttttagtcggctatttgctaagagagagatgcgtattttgatggttggtctcgatgctgctggtaagactaccattttgtacaagctcaagcttggagagattgtaaccacaattcctaccattgggtttaatgtcgagactgttgaatacaagaacatcagcttcactgtctgggatgttgggggtcaagacaagatccgtccactgtggaggcactacttccaaaacactcaaggtcttatctttgttgttgatagcaatgacagagatcgtgttgttgaggcaagggatgaattgcataggatgttaaatgaggatgagttacgcgatgctgtgttgcttgtttttgctaacaaacaagatcttcccaatgcaatgaatgctgctgaaatcactgataagcttggcctccactctcttcgccaacgccattggtacatccagagtacatgcgcaacttctggggagggtctttacgagggtttagattggctatccaacaacattgccaacaaggcttaaagcgggcgaaggtagtgattttcttggattgtggccggctttagttttttctagatgcaggggtataatattcaagcttcttgtgagatagatgtggctttcagaacagccagtttataggacttaaaaaggatctctgttaacaatgctttgcccttttttctttctcttctatttgttgtgctcaagttcttactggcttttttagctaatccttttagctgttacaaacaaatacattctgtggtgttttaaaattacttattgggttatgctttgc

SEQ ID NO: 13368 - DNA, 1015 bp, Pseudotsuga menziesii
gtagaaacgaactcttcatcagcggggtctgtgattttacaggatttctgatattctccccagtttggcaagatggggcttacgtttaccaagctctttcagcgtctgtttgccaagaaggaaatgcgtattctgatggtaggtcttgatgctgctggtaagacaaccattctgtacaagctgaagctgggagaaattgtcaccacaattcccactattggttttaatgtggagactgtggagtacaagaacattagcttcactgtttgggatgtcggaggtcaggacaagatccgaccactatggagacattactttcagaatacccaaggccttatatttgtggtggatagtaatgacagggaccgtgttgttgaagcaagggatgagttgcataggatgctgaatgaggatgagttgcgagatgctgttctccttgtatttgcaaacaaacaggatcttcccaatgcaatgaatgctgctgagataactgataagcttggcctgcattctttgcgtcagcgccattggtatatccagagtacctgtgcaacttctggtgaaggattgtacgaaggcttggattggctttctaacaacattgcaaacaaggcataatgtctttgcatagtaatgatgctatgattcctttgagactgggttggattctgtgccttgagtattcgttggatactttctgggatatagtggatgtgtttcatgcttctcctagtgaattgaagtagataaatagttaaggggcgttgaggatctattcagtggtgtactgatccttaatttacttattttgttgtttgaaattttgcatgtctacaattgtttcataaacaactatgaattcttccagtgggttcctcaggatttcagtgtgcaatttattgccctgtgccccctctttttgccttgtttgtggattcaaaagtactgttactgaaattccaaggttacatattctttcgaatttatatatattgcatgttatgcatgtaccagg

SEQ ID NO: 13369 - DNA, 1386 bp, Pseudotsuga menziesii
aggaatctcgttgaagcttcaagagggggaacggaatatataaatgaatatagggatcataatttatgctatcccgggtttcctgaatggaatatattcaaatataaatacatccctagaatcattcctgcttgcttcctccaaccgcataagtaactgtcaactgcagatgctctggtgattgcatagctgcgaaggggcgtaaacgaagagctccaaaagaaagagattggtctcttcctctctcttctagggaggccatctgggattctttgtgcagtccgctagcatttttaattttacttcggaagttgttcatctaaaagcttacaagatggggctcacttttaccaagcttttccagcggctttttgcaaagaaggaaatgcgcatccttatggtgggtctcgatgcagccggtaagaccaccattttgtacaagctcaagctgggagagattgtcactactatcccaaccattggtttcaatgtggagactgtagaatacaagaatatcagcttcactgtttgggatgttggaggtcaggacaagatccgaccactttggagacattacttccagaatacccagggtctaatatttgtggttgacagcaatgacagagaccgtgttgttgaggctagagatgaattgcaccggatgctgaatgaagatgaactacgtgatgctgtcttacttgtatttgcaaacaagcaagatcttccaaatgctatgaatgccgcagagatcactgataagcttggtctgcattctctgcgtcagcggcattggtatattcagagcacttgtgcaacttctggtgaaggcctttatgaaggcttggattggctgtcaaacaacattgccaacaaggcataaattggaatgcatctaatttctatattgggcatgaggtagattccttcggagttacaatgactgacaaccactggcatggattttctaaaggagagcttgacttaatttgttattttgatagctcggttgctatggatttctgagtacttacaacttagtcgttattttgcaagaatctgggatttttctttctgccagctgtgctatatttactatattagctcttttatacatctaactattgtcttttgattgaggagacttgtataattagatttttagaggattgaaaggctttcctatgttcaatatggacaaatataattttgctttctagggaaaaacagaaagtagttcagtatttacatcaatatttaatcccgcagaagatattatcgctgtattcttttctcgtggaccagttgagggtgtctgattgttaaaattatgttgaatatgctgtatgctgcatcactgtgaaagcagcagtagaaagtgtacaccgg

SEQ ID NO: 13370 - DNA, 873 bp, Chenopodium quinoa
ctttctctctcctctttctctctctacaccattttctctctcctcgcttcacagaagttagtgactaattcaaggggagaaatatggggcttacattcactaagctgtttagccgtctcttcgcgaagaaggaaatgagaattcttatggtgggtctcgatgcagctggtaagaccaccattctttacaagctcaagctcggtgagattgtcactactatccccactattggatttaatgtggaaactgttgaatacaaaaacatcagcttcactgtctgggatgttgggggtcaagacaagatccgtccattgtggaggcattacttccaaaacactcaagggctcatcttcgtggttgacagtaatgatagagaccgtgttgttgaggcaagagatgagttgcacaggatgttgaatgaggatgagttgcgcgaagcagtgttgcttgtgtttgctaacaagcaagatcttcccaatgcaatgaatgctgctgaaattactgataagcttggcctgcactctctccgacagcgtcactggtatatccagagcacttgtgcaacctctggtgagggactttatgaaggattggattggctttccaacaacattgcaaacaaggcttaaggaattgagattttgtcatggactgttggtcctggatgcaggggtgaacattatctaagtcgcttcgtttttaaccatttttaccttagagaactcagtttgtggttgtaattttgtggacggcagctataagccttttgcttagagctttgcaaatggatatatgttactaaaatagtgttgagcgttgtttgtacttcaaagattctttgggttcccattttgtgaattgcaatagttgtaa

SEQ ID NO: 13371 - DNA, 1195 bp, Chenopodium quinoa
tcctcctcctctctcactcatattctacgctatctttctctctctacaccattttctctctcctcgcttcacagaagttagtgactaattcaaggggagaaatatggggcttacattcactaagctgtttagccgtctcttcgcgaagaaggaaatgagaattcttatggtgggtctcgatgcagctggtaagaccaccattctttacaagctcaagctcggtgagattgtcactactatccccactattggatttaacgtggaaactgttgaatacaaaaacatcagcttcactgtctgggatgttgggggtcaagacaagatccgtccattgtggaggcattacttccaaaacactcaggggctcatcttcgtggttgacagtaatgatagagaccgtgttgttgaggcaagagatgagttgcacaggatgttgaatgaggatgagttgcgtgaagcagtgttgcttgtgtttgctaacaagcaagatcttcctaatgcaatgaatgctgctgaaattactgataagcttggcctgcactctctccgacagcgtcactggtatatccagagcacttgtgccacctctggtgagggactttatgaaggattggattggctttccaacaacattgcaaacaaggcttaagaaattgagattttgtcatggactgttggtcctggatgcaggggtgaacattatctaagtcgcttcgtttttaaccatttttaccttagagaactcagtttgtggttgtaattttgtggacggcagctataagccttttgcttagagctttgcaatatggatatatgttactaaaagtgtcaaatagcgttgagcgttgtttgtacttcaagattctttgggttcccatttgtgaattgcaatagttgtaactgaagttaaatactaggcttcttttcgtgactccttatagtagtgatccagtttagtgattttgtattactatccataaatcagtccacattattcgtttaatcttttgccaagtagtttattggctttgtgcatctggataatgcaatctgtattatctggatagtacaaggccagttagcgattggttaagaatttgcaatattttttagtgttaattttgtttcactacattgattgtgttagcgactgaattgtatggtggatcttttactgatgtatgacatttctatg

SEQ ID NO: 13372 - DNA, 890 bp, Sarracenia psittacina
ttcctccaccgttgtttgttgggggagcggaggacatctccattctcacagggtggattacaaagaaagaagatagagacacacacagatctgttctgctcctatctcccaatccgcttccttagacacaaagatggggttgtctttcaccaagcttttcagtcggctgtttgcaaagaaagagatgcgcatattgatggtgggtcttgatgcagctggtaagactaccattctttacaagctcaagctgggagagatagttaccacaatccctaccattggatttaatgtggagactgtggaatataagaacattagctttactgtttgggatgtcggcggccaagacaagatccgacctttgtggagacattacttccagaacacacagggtcttatcttcgtggttgatagtaatgatcgagatcgtgtggttgaagcaagggatgagctgcacagaatgttaaatgaggatgagttgagggatgctgtgctcctggtatttgcgaacaagcaagatcttccaaatgcaatgaacgctgctgagataactgataagcttggtcttcactcccttcgtcaacgccactggtacatccagagcacgtgtgccacttctggggaagggctgtatgaaggattggactggctctcaaacaacattgcaaataagggatagacagtcagatgttggtttggtttcctactgcccctaagagagttgtaaaatttctttggtgttcagattctcgaccatgttgttttgtttactcctatatactttacaaattggggtttcctttgcagacattgctgtttgtttcctatagtttcagaacatctataaattttagttctgcctcatttatgtatctcattttctttgattc

SEQ ID NO: 13373 - DNA, 791 bp, Senecio madagascariensis
tttaaaaagacacctctaatatcgttcctttaaataacacccctctacgctttcatcatctccacatttctcagatcgacggctcccagatttcaatctattttccgatacccaacgatcaaagatggggctgtcttttacgaagctattcagtcgtttgtttgcgaaacgagagatgcgtattctgatggttggtctcgatgcagctggtaaaaccactattttgtacaagcttaagttgggagaaattgtcaccactatccctactattggatttaatgttgaaactgttgaatacaagaacatcagctttactgtctgggatgttgggggtcaagacaagatccgacctttgtggaggcactacttccagaacacacaaggtcttatctttgtggttgacagcaatgatcgtgatcgtgtggttgaggccagagatgagctacacagaatgcttaatgaggatgaactaagagatgcagtgttgcttgttttcgccaacaagcaagatcttccaaatgcaatgaatgctgctgagataactgacaagcttggcctgcattctctccgacagcgacactggtatatccagagcacatgtgctacctctggggaaggtttgtacgagggactcgattggctttccaacaacattgctaacaaggcttaaaagggactcgcaagaatatggtgtatacatattataaactatctttgttaagaaggaatagataatttcttcttggcgaacactcgtatttccttcagcttacctagacaatatatatcat

SEQ ID NO: 13374 - DNA, 849 bp, Sorghum bicolor
ccgcctcccccatttctcttcccctgcgatccgagcccgcacccgcagggaagagaagggatcacctgatcaccagggcgcggcctcgcgatctcgcggaggagcggagatggggctcacgttcacgaagctgttcagccggctcttcgccaagaaggagatgaggatcctcatggtcggtctggatgcagctggtaagaccaccatcctctacaagctcaagctcggcgagatcgtcaccaccatccccaccattggatttaacgttgaaactgtcgagtacaagaacattagtttcactgtttgggatgtcggtggtcaggacaagatccggcccctgtggaggcactacttccagaacacccagggcctcatttttgttgtagacagcaacgacagagagcgtgttgttgaggccagagatgagctccaccggatgctgaacgaagacgagctccgtgatgctgtgcttttggtgtttgcaaacaaacaagatctgcctaatgccatgaatgctgctgaaatcaccgataagcttggcctgcactcgctgcgccagcggcactggtacatccagagcacatgtgctacctctggtgagggtttgtacgaggggcttgactggctttcgaacaacattgccaacaaggcttgaagcatctaggcagggcttcaatcaatggaaacactctggatacttggggtacgaactgcctctaccattacagcgatgaactatagtcgtgtctgtcggatgtggggatgtttttgggaggataaaaggctctttggtcaaggagctaggtatcagatgttttcgtggtattgttaatttctgttttggtttgt

SEQ ID NO: 13375 - DNA, 931 bp, Sorghum bicolor
gaccgcaccaccacgagctcccgcctccgccgatccgcgcacgcagatcgccgaagcccggcggcgcagagcccaaggggagggagggagctcgcggcggcggaggaggaaggcgttcgccacagtcgcggtgagatttcctttgggaagagatggggctctcatttgggaagctgttcagccgcctcttcgccaagaaggagatgaggattctcatggtcgggctcgatgccgccggtaagaccaccatcctctacaagctcaagctcggcgagatcgtcaccaccatccccaccatcggattcaatgttgaaactgttgagtacaagaacattagcttcaccgtttgggatgttggtggccaggacaagatcaggcccctgtggaggcactactttcagaacacacagggacttatttttgttgtagacagcaatgacagggaacgtgttgttgaggctagagatgagctccacaggatgctgaatgaggatgagctgcgtgacgccgtgctgcttgtatttgcaaacaaacaagatcttcctaatgctatgaatgctgctgaaattactgacaagcttggtctgcattccctgcgccagcgtcactggtacatccagagcacttgtgctacgtctggcgaagggttgtatgaggggcttgactggctttccaacaacatcgccaacaagtcttgaagcttttcggctgggctcctagcaagaggaagacgtctgaacaacttatggctgctctttttacatattattactgagacaatctacagtagatagtgtgggtgcttattggaaaaaaaaacttcagagctctcttttgagggattgatactagattggattgtatttttgtttttgggtcggtatcatcgcctgttcggtttcacaaaactgtcagtcatatattttaccta

SEQ ID NO: 13376 - DNA, 1310 bp, Picea glauca
ggaatcaaagtttatgcaaccacgggtctcctgaatggaatatattcaaatataaatatatcctagaatcaatcccgattacctcttccagcctcatccgtaactgtcaactgcggatgctctggtgattacatagcagtgaaggggcgtaaacgaagagttccaaagtaaatagagtgatccctccctctctttaatcgggaagccttcggggattcttctgcgcagtccctcaacagctctgcttgcattttcaatttcccttcgggagttgttcaactcaaagctgaaaagatggggctcactttcaccaagcttttccagcggctttttgcaaagaaggagatgcgcattcttatggtgggtctcgatgcagccggtaagaccaccattttgtacaagctcaagctgggagagatcgtcactactatcccaaccattggtttcaatgtggagactgtagagtacaagaatatcagcttcactgtttgggatgttggaggtcaggacaagatccgaccgctctggagacattacttccagaatactcagggtctaatatttgtggttgacagcaatgatagagaccgtgtagttgaagcaagagatgaattgcatagaatgttgaatgaggatgagctacgagatgctgttcttcttgtatttgcaaacaagcaggatcttcccaatgcaatgaatgctgctgagataactgataagcttggcctgcattctttacgtcagcgccattggtatatccagagtacttgtgctacttctggtgaaggactgtatgaaggcttggattggctttctaacaacattgcaaacaaggcataatgttgaagcatagtaatgatgctgtgatgcctttcagaatgggtttggattctgtgcattttgagtattggttggatactttctgcgattgtagttggacgtgtttcatgcttctcctagtaaattgaagtagataaatagttaaggggggttgaggatctattctgtggtgtactgatccttagtttacttgttttgttgtttgaaattttgcatgtctacaattgtttcataatcaactatgaattcttccagtgggttcctcaggatttcagtgtgcaatttattgccctgtgccccctctttttgccttgtttgtggattcaaaagtactgttactgaaattccaaagttacatattcttttgaatttatatatattgcatgttatgcatgtaccagatgcctgtatatgatgttgcttgtagtgccttttgaattttcccaaattatggatatacatatgaaccg

SEQ ID NO: 13377 - DNA, 1072 bp, Fragaria vesca
aagttgacgaccctcacaaatttaagcgtcctctctctcttctctctctctctctcgcttttagatccctctgtgaaatctcatcgaagggatccgcagtcagaatggggctcacgttcacgaagctgttcagccggcttttcgccaagaaagagatgcgaattctgatggtcggtctcgatgccgctggtaagaccaccatcctgtacaagctcaagctcggtgagatcgtcacgacgattcctactatcggatttaatgttgagaccgtggaatacaagaacatcagcttcacagtctgggatgtcgggggtcaggacaagatccgacctttgtggaggcactacttccagaacacacagggtcttatctttgttgtggacagcaatgacagagaccgtgttgtggaggctagggatgaattgcacaggatgttgaatgaggatgagctgcgagaagctgtgttgcttgtttttgccaacaaacaggatctccccaacgcaatgaatgctgctgaaattactgataagcttggcctccactctctccgacagcgtcactggtacatccagagcacttgtgcaacatctggagagggtctatatgaaggcctggattggctctccaacaacattgctaacaaggcttgatccctatttgggtatcgttttgaggattggcaattctggatgcaggggtgaatattatctagttcgtttttggtttctttgagacgattgaatttgttgttaaatctatttctcccggaaatggtcatttcattcgtaggacctttaattgttatatttgtaatagaagaagaatggttggtcaaatgtatacatttgagcttttgattgaatttggatacagtgttccgagttgtaattggataccctccttaccttctaagttacctttgcctttttcttttctttgctatatattcagtcttcttttattttattttgtaagctggttgagtgctgttttatattcttttctgcaaattcttctgagcctgacttattctttataaaatcgtcggctttctaggtcccaagatcttata

SEQ ID NO: 13378 - DNA, 871 bp, Saccharum officinarum
ctcttcccctgcgatccgagcccgcacccgcagggaggagaaggaagggatcacctgatcaccagggcgcggcctcgcgatctcggagcggagatggggctcacgttcacgaagctgttcagccggctcttcgccaagaaggagatgaggatcctcatggtcggtctcgatgcagctggtaagaccaccatcctctacaagctcaagctcggcgagatcgtcaccaccatccccaccatcggatttaatgttgaaactgtcgagtacaagaacattagtttcactgtttgggatgtcggtggtcaggacaagatccggcccctgtggaggcactacttccagaacacccagggcctcatttttgttgtagacagcaacgacagagagcgtgttgttgaggccagagatgagctccaccggatgctgaacgaggacgagctccgtgatgctgtgcttttggtgtttgcaaacaaacaagatctgcctaatgccatgaacgctgctgaaatcactgataagcttggcctgcactcgctgcgccagcggcactggtacatccagagcacgtgtgctacctctggtgagggtttgtacgaggggcttgactggctttcaaacaacattgccaacaaggcttaagcatctaggcagggcttcaaccaatggaatcactctggatatacttgggtgcaaactgcctctaccattacagctatgtactatatagtcgtgaccgtgtcagatgtgggggtgaaaggctcttttggtcaaggagctaggtatcagatgttttcggggtattgttaattttctgtgcttttgttttggtttgtgcaaggtatgccatgtccgactgcgtgctgtgtgtact

SEQ ID NO: 13379 - DNA, 1145 bp, Panicum virgatum
cctatatattcaactccccgtgcaacgcctcgccctctctctccgcctcccccattcctcttcccctgcgatccgaggccgcacccgcagccgcagcaagtcactgaatctcaatccggagaagccatcacctgatcaggcgaggcctcgcgatctcgcgcaggagcggagatggggctcacgttcacgaagctgttcagccgcctcttcgccaagaaggagatgaggatcctcatggttggtctcgacgcggctggtaagaccaccatcctctacaagctcaagctcggcgagatcgtcaccaccatccccaccataggatttaatgttgaaactgttgagtacaagaacattagcttcactgtttgggatgttggtggtcaggacaagatccgtcccctgtggaggcactacttccagaacacccagggcctcatttttgttgtggacagcaacgacagagagcgtgttgttgaggccagagatgagctccatcgtatgctgaatgaggacgagctccgtgatgctgtgcttctggtgtttgcaaacaaacaagatcttcctaatgccatgaacgctgctgaaatcaccgacaagcttggcctgcactccctgcgccagcggcactggtacatccagagcacatgtgctacctctggtgagggtttgtatgaggggcttgattggctttccaacaacattgccaacaaggcttgaggcatcttggcagggctccaatgaatgaaaatactttggatgttgggagcacatattgcctttaccatactgctatgcaccatatagttgtgactgagataatgtgggggtgttttggggaggataaggctcctttgtcaaaggagctagttatcagatgttttcgtgggtattgttaattgtccactcttctgttttggtctgtgcaaagtttactatatgtcgtgctgtgtacccttcagtatgaggcgttgtagtgttcgacttgcctcttggcatgactagcttaatggtcgcgtagtttgttgtgtgcagcatatattccctcccgcgtttgtttagtaccatcatgagtgcttgtccgttcgtttgatggcgcattccaaattggaacctctgggatccattctggattcaccttcggggac

SEQ ID NO: 13380 - DNA, 3079 bp, Panicum virgatum
gtcccacttcctcctatatattcacttccccgtgcccgacgcccgggcctccctccgcctcccccattcctcttccccagttcccctgcgatccggggccgcacccgcagggaggagaagcgatcacctgatcaccagggcgacgcctcgcgatctcgcgcaggagcggagatggggctcacgttcacgaaactgttcagccgcctctttgccaagaaggagatgaggatcctcatggttggtctcgacgcggctggtaagaccaccatcctctacaagctcaagctcggcgagatcgtcaccaccatccccaccataggatttaacgttgaaactgttgagtacaagaacattagcttcactgtttgggatgtcggtggtcaggacaagatcagacccctgtggaggcactacttccagaacacccagggcctcatttttgttgtggacagcaacgacagagagcgtgttgttgaggccagagatgagctccatcgtatgctgaacgaggacgagctccgtgatgctgtgcttctggtatttgcaaacaaacaagatcttcctaatgccatgaatgctgctgaaatcaccgacaagcttggcctgcactccctgcgccagcggcactggtacatccagagcacatgtgctacctctggtgagggtttgtatgaggggcttgactggctttcgaacaacattgccaacaaggcttgaggcatctttggcagggctccaatcaatgaaaatactttggatgttggagcgcatattgcctttaccatactgctatgcactatatagtcgtgactgtgacagataatgtgggatgtttttgggaggataaggctcctttggcaaaggagctagttatcagatgttttcgtgggtattgttaattgtccgcgcttctgtttttgtatgtgcaaggtatactgtgtcgcgctgtgtacccttcagtctgaggcgttgtagcatccgacctccctctgtcgtagccagggtttcagaaaccgtccgggaaccgccggtttccgggattttttcccgtttccagtccggtctgagacagtaaaccgggtccggttttttatattttaggcttctaaatccaaaaatacaaaagtaaattttttgtgctactgttccggttctgaacagtaccaccggttttttaaaccctggtcgtagctagcttaatgatcgcagtgcttgtcagtttgtttcattggcgtattccaaactgggggctctggctgacgtcctggctatacttctccttcggggacgttttcccctggtcaggctcgcatcatatatttgtattttggccctgtttggatactctaattcagttaaaagttgagttagtttgtaactcatgactaactccaaactaacttcaaagcagcaggtccattttgtacgttgtaccatcctcgtcaaggtcgaaaagattcagtccgctgcacgcacgcaccgaaatctctcggggtaaacgtcggccggcaagcgattctcatcaaagtctaatcgtagagatgccctgaaccaggccataatgtgacgtgaaatttggttcgggaaccaggccagcgtggatcccgcgtcaggaatcgtgcgacatgatgaggaccagtgaagctggtcccaccaataccatggtggggcccacaatttgcctggggagactgcctcgcgatggagccaggcacaggtatcctggccaatccggccatcctccttcctcagattccctattcctctctcttccccgtccaatgccgacggtagttggtattcccagatccgcgaatcacggtagctccttcggcgagcaatatcgataagctgagacgatgcaagagtaggagatagagatgggagctatatccatgtaacaatggcggctgagagagatgaaacaagaggcggcgatgtgcagggaacgtcctgcaacaatggcggccggtgcccagaagtcgccgggccaaggcgttttggtccagctcaatatagggaacggtaatgaatcacgcaatggcacattggcgatgagcacgagggggctctaacctgctaccctttcatgaatccttccctttttaacttcacaagctggaaccaacatgggaggtgataaccagccaggggggcggtaggattgtcaggacaagtgaaattaatgagggagatgactgctgtggccgggcttctggtaatgcaaatttgatgatgctacatatagtttgaattcagagaagtttggttctaccaacaattgtagccaacaagtatcttcttcagcagattggtgatgcttcagtaggaatttctagaataccagatagtcacataatgaatcacagagggtgattatgatgcagagacatttgtgatcggcaacaaacatgtgcataaagctttcatggagatagctgaccacatgaaattgaaggaaactagtaatgcgaatgggtacaaagtgaaacagatgcaagtggcacagaatatggcaatggttctgaaactgatggtgaaacaagaggcaacctgtttgggacagccgggtctagtgcaggtttaagtgattctgagttcttgagtttgagtgcaccagatgtgaaagtaaggcatcgcaggccagggatcaaatgatacaggatacacattgagatgattaaaagagaagatgatgaaaaaatcaagaaagaaagcgaggaagacagtgaagatgcaccacctgtggtcttgacgaccacaaaaaacctcagaatattcagcgaaagtgttgttatggctgctatttgaggtgtaatttcagcagcaatccgacataggggtttagctgattatgagtggttattttaaaatggtagatgagtattttggcattattgcagattcaattgccttgcatcaatattcagcaagccattcgcaaacctttgtacaacaactgtctagatgtaagggtatcaagaaccatattctgttttggtacaagtcttagttgcaactgttttagtgttgatggtaaagctgccctacgaaaatgtttttgtgattatctacatct

SEQ ID NO: 13381 - DNA, 826 bp, Camellia sinensis
tatatcgagcgtcggtttcaagctttccccttggccctctctctctctctctcctctcccgcgctttatctctctagatccctctccaaaagctgcccccagggatccaccgccaaaaagaaaaatggggttgacattcaccaagcttttcagcaggctttttgccaagagagagatgcgtattcttatggttggtcttgacgccgctggtaagaccaccattttgtacaagctcaagcttggagagattgtgaccacaattcctaccattggctttaacgttgaaactgttgagtacaaaaatatcagcttcaccgtgtgggatgtcggtggccaggacaagattcgcccattgtggagacactatttccagaacacgcagggtctcatttttgtggttgatagcaacgacagagaccgtgttgttgaggcaagggatgaattgcatcgcatgttgaatgaggatgagttacgagatgcagtgttgcttgtatttgctaacaaacaagatcttcctaatgcgatgaatgctgctgaaattactgacaagctcggcctccactctctccgacagcgtcactggtacatccagagcacctgtgcaacctctggggagggtttgtatgaggggttggattggctctccaacaacattgctaacaaggcatgaggtaacactgaatgttattgcggggtgatcctggatgcagcgtggtttttatctagtctctttttcctttttcttcctcccctctctcagacatgtgtggttgggttatgaatttcatatttcgaaaggcatttcactttctgttaggattttgca

SEQ ID NO: 13382 - DNA, 1065 bp, Triphysaria pusilla
gtatttacattagccgaacatagtagctcaaccgggggagctggctcgaccgaaatagaacgtgccggctcgattgagatcttaatttgcttacattaattcggtgcgtacaaaggtctaccattttctccttccccaaacacttttttccagagttccttcatcaatagaaaaatggggttatctttcacgaagcttttcagccggctgtttgcgaagaaggagatgcggattcttatggtaggtctcgatgctgctggtaagaccaccatattgtacaagctcaaactgggagaaatagtgactaccattcctacaattggattcaatgtggagacagtggaatataagaacataagcttcactgtttgggatgttgggggtcaagacaagatccgaccgttgtggaggcattactttcagaacactcaagggctgatttttgtggttgatagtaatgatcgagaccgtgttgttgaggctagggacgaactgcataggatgttaaatgaggatgaactgagggatgcagtgctcctagtatttgctaacaaacaagatctcccaaatgctatgaatgctgctgagataactgataagcttggacttcactctcttcgtcaacgtcattggtatatccagagtacatgtgccacttctggtgaaggtctatatgaagggctggattggctctccaacaacatcgctaacaagggttgaggagatgtttgatgaattttggtatctgtatccatgttgaagtgaaaaatctggttttcgtttttcggcatttgtttgatgccatcatcttatgttatttcttttgttgcggcttaggtagtcaaatcgtaatgtctactttgcaatttgctccagggatattttattttttgcagatatactatttcagtattgtgtttcttttctggaaagatagtggcactcttgttgtgtaatgttttttcgtgtgaactgtgtacccttaactaaacaactcaattaattttacttagttctagtacctttatttatttcgttttgtttactttaaaaaaaaaaaaaaaa

SEQ ID NO: 13383 - DNA, 877 bp, Triphysaria pusilla
ttagcatttggtgtctcatctcggcgagatctgccctttttcatcatcttcttctcaaatccctatcgcaatctcgaaaaaatgggtttgtctttcaccaagctttttagccggctgtttgccaagaaagaaatgcgtattcttatggtaggtctcgatgctgctggtaagacaactatattatacaaactcaagcttggagagattgtgacaaccattcctacgattggatttaatgtggaaacagtggaatacaagaacattagcttcactgtctgggatgtcgggggtcaagacaagatccgaccattgtggaggcattactttcagaacactcaggggttgatcttcgtggttgatagtaatgatcgggatcgtgttgttgaggctagggatgaactccacaggatgttgaatgaggatgaactgagggatgcagtgcttcttgtatttgcaaacaaacaagatctgccaaatgccatgaatgctgctgagataaccgacaagcttggacttcactctctccgtcaacgccattggtatatccagagcacatgtgctacatctggggaagggctgtacgaggggctcgactggctctccaacaacattgctaacaagggataagaagtgatgttcgaagaatttaggtacctcgatacttgttgaaaccgaggctgtcatttcgatattgtattttttcttctgattaatctcatgccatttagttttaatatcagcagatagtcatctccatctgtggagattgagaattgcttatgtaatttcagcacttatactgttgcattatgtttctttggctgcctgcttaatatctaataataaacaatagaatagttaacccaaaaaaaaaaaa

SEQ ID NO: 13384 - DNA, 923 bp, Vicia sativa
ctccaaagcttccttcacacacgaagctttcatcgccaaagggaggatcgaataagggaaggagaaatggggctgacattcacgaagctgttcaatcggttatttgctaagaaggagatgaggattttgatggttggtctcgatgcggctggtaagaccactattctttacaagctcaagctgggagagatcgtcactactattcctaccattgggttcaatgtggagaccgtggagtacaagaacattagcttcactgtttgggatgtcggaggtcaagacaagatccgtcccttgtggaggcattacttccagaacactcagggtcttatatttgttgtagacagcaatgacagggatagagttgttgaggccagagatgagttacatagaatgttgaatgaggatgaattgagagatgcagtattgcttgtctttgccaacaaacaagatcttcccaatgcaatgaatgctgctgaaattactgacaagttgggtcttcactctttgagacagcgccactggtacatccagagcacctgtgcaacctctggggagggtctttatgaaggtttggactggctttccaacaacatagccaataaggcttaattctttatcgggagtgttgtggattggtggttctggatgcaggggtgaatattatctagctttcctttttgagtcttgtggagcagtaattctggatgcagaggaaaatattatctagcttttatttctctgtcatcttccaaatcaacttgaatttgtgtttcatgtttaggatatcttggtgcctaaaattgtagtaggaatttgtttcatgggctttgtattacttttgagctttctattgggtttctatatgcaatgtccatacctgtaatggagatacaattaaatgtgactcattttctgatttt

SEQ ID NO: 13385 - DNA, 894 bp, Zamia vazquezii
cccaggccgcaacacatacgccagagccccttctctcactcagcagcaaggcttcgtgatttattcgctttagggtaatttctggggtgtggagatggggctgacattcaccaagctttttcagcgcctatttgcgaagaaggaaatgcgcatattgatggtaggtcttgatgctgccggaaaaaccaccattttgtacaagctcaagctcggagagatcgtcaccaccattcccacaataggcttcaatgtggagactgtggaatacaagaacattagcttcaccgtgtgggatgttggaggtcaggacaagatccggccactatggagacactactttcagaacactcagggtcttatctttgtggtggacagcaatgatagagaccgtgtggtcgaggcaagagatgagttgcacagaatgcttaatgaggatgaattacgagatgcagtactgcttgtatttgcaaacaagcaggatctaccgaatgcaatgaatgctgctgaaattacagacaagcttggcctgcactctttacgtcagcgccactggtacatccagagtacatgtgctacttctggcgaagggctgtacgaaggcctggattggctttcaaataacatcgcaaacaaggcttgagtttgaagcatgaaggtgtgcatcatcattcctttgagaatgggatagattgtaatgatgctacatagtattttagttagacataggccgattctttcacatactgattgccttgttccttgattcctctgtgcctgcaattgttttgtaatactttgattatgcctctacggtatttaagatttcaacatacaagctataaatgtattatgacatctattcaggctggatgaacattgagaattttgatttca

SEQ ID NO: 13386 - DNA, 2834 bp, Brachypodium distachyon
ccagtcgcagaacagaaggaagcgaaggtgtccatgcgggctccggttgcgcgcgactgggcgaggtgcaaagcccacgtgacggtgggcctcgtgatctctataataacccgcgcttcgggccgcctggtccgcaccgcaccgcaccgcacgacagccacaacctctcgcgttgattcgagcggttccaagcatcaaacccccccatctccgccgggatcagcggcgaagcggagcggagagagctcgaagcgcggaggcggccgtcgtcgtcgtcgccatctcggaggagagatggggctcacgttcaccaagctgttcagccgcctcttcgccaagaaggagatgaggattctcatggtcggtcttgatgccgctggtaagaccaccatcctctacaagctcaagctcggagagatcgtcaccaccatcccaaccatcggatttaacgttgaaactgttgaatacaagaacatcagcttcactgtttgggatgtcgggggtcaggacaagatcaggcccctgtggaggcactacttccagaatacccagggactcatttttgttgtcgacagcaatgacagggagcgtgttgttgaggccagagatgagctccacaggatgctgaatgaggatgagcttcgtgatgctgttctgcttgtatttgcaaacaaacaagatcttcctaatgccatgaatgcggctgaaatcaccgacaagcttggtctgcactccctgcgccagcggcactggtacattcagagcacttgtgctacatctggcgaagggttgtacgagggacttgactggctctccaataacattgcaaacaaggcttgaagcgtctcgacaactgcttcaaggaacagatccgctggatgtctgaacaactcactgctgccattttctatattctgatatcctccttctgatatatgtatacactaaaaatattgtatcggtgcttgtgaagacagaggctgccctttaaggggggctagtatcaggttgtttcttcgtgtggtatcatctctcctttgagggggctagttcggttttacaaggtttaccgtgtcgaccatatgcatgtacctgtatacgtttttgaaatgtagtaaagttgaggtgccttgccaattgttgctagctctgctcagtgatttggatgttgctaatgtagatgcgaacgttgttcttacagtcctacagttatactccactttgagctgagcgtatcttatttattttcgctgatcggtcccatgtccgatgtggtttcttctgtatttccgtattggctgtcagtatcgttatacggcaccaatatttttgggaagtccactcgcgtaatggatgattgattgttgggtgtatatggcaccatcggcatggagttgtgtacttgtgttttgtcgacaatcttccgttctaatgcagcggagtatcgtagaaccgggtcaccggacaccgggacacggtgaatcacagacaaccgtatatgcctcgaaatatgcagatgttgttacgatattcgggtggagccgattcaacgcaacacctgactcatgtttcaccctagagaaatttgctctattttgtttttgggttcccaaatcaagttttctttttgagaaaccaaatcaagtttcttatacgtactgagctactccctccgtttcataattcttgtctcagatttgcgtctagatacatgtaagactccgacaagaattatgaaacaaagagaatatttttgtaagttattagtgtttcacctcacgagtgtttcagcaatactccctcagtcccatatttcggttacgagattccctgctgggattgagggggattaggaggaaaatgaacataaccgaactatgccttaagactttctatacatttatctagacgttttttagacatagatacatttatatttggacaaatttgagtcatttaatatgagaagaagggagtacatttttcattaatatttcgtcctgatgtcagtaacgtttgcaaagttaaatcgtcgttatctttttttagcgaaatttatcttcttcttttttttagcgccggaggaagggaaaggtggcgtcggcgacagcggtcgactgggcgcgttgtttcaaaggccaagtgatggtgggcctagcgcccttctatatagcccgcctggtccgcaccggcagtccggcaccgcaccgcacggcagccacagcctcgcgttgtattcgtactgttccaagaaaaagaaaaaaagctccaactccacccgtctccgccgagatcaggagcccgcggcgcagcggagcggagagagctcgaagtgcggaggaggccgtctgtcctcgccaactcgggggagagatggggctcacgtttaccaagctgttcagccgcctcttcgccaagaaggagatgaggattctcatggtcggtcttgatgctgctggtaagaccaccatcctctacaagctcaagctcggagagatcgtcaccacaattccaaccatcgggtttaatgttgaaactgtcgaatacaagaacatcagtttcactgtttgggatgtcgggggccaggacaagatcaggcccctgtggaggcactacttccagaatacacagggactcatttttgttgttgacagcaacgacagggaacgtgttgttgaggccagagatgagctccacaggatgctgaatgaggatgagcttcgtgatgctgtgttgcttgtatttgcaaacaaacaagatcttcctaatgccatgaatgcggctgaaattactgacaagcttggtctgcactccctgcgccagcgacactggta

SEQ ID NO: 13387 - DNA, 790 bp, Mesembryanthemum crystallinum
atagggtcagagcgacgtccttctctctcttcctcatctgtgttgaagatggggctctctttcaccaagctgttcagtaggctttttgccaagaaagagatgaggattcttatggtgggtctcgatgcggctggtaagaccaccatattgtataagctcaagctgggagagatcgttaccaccattcctaccattggattcaatgttgagaccgttgaatacaaaaacatcagcttcactgtgtgggatgttggaggtcaggacaagattcggcctttgtggagacattacttccagaacactcaagggcttatctttgtggtggatagcaatgatcgtgatcgtgctgtcgaggcaagggatgagctccaccggatgttgaatgaagatgagttgagggatgctgtgctcctggttttcgccaacaagcaagatcttccaaatgcaatgactgctgctgagatcactgacaagcttggtcttcactcccttcgtcaacgtcactggtatatccaaagcacatgtgctacttccggtgaaggtctttacgagggactggactggctgtccaacaacattgccagcaaggcttaaatgatgggacctggctgagcttaggattgagttattttggatttgctggccacaccttttgctggaattgaaatttgatttgagatttggcccttttttttgatttgcttggctttttaaacattcacaagagtgatgcgttttgttgttacgcattatgacactttggttattccaaaaaattgctcttgcgaca

SEQ ID NO: 13388 - DNA, 1013 bp, Vigna unguiculata
atctcgcgttgctgcaaagcattcttcgtttctctctctctttctctctctcagcgatttctgcatacacgaacgtttcatctccgacgggatccacaagctgaaggagaaatgggactgacattcacgaagcttttcagtcggcttttcgccaagaaggaaatgcgaattctgatggttggtcttgatgctgctggtaagaccactatcctctacaagctcaagctcggagagatcgttacaacaattcctaccattgggttcaatgttgagactgtagaatacaagaacattagcttcactgtttgggatgttggtggccaggacaagattcgtcccttgtggaggcactatttccagaacactcagggtcttatttttgttgtagacagcaatgatagggacagagttgttgaggccagagatgagttgcataggatgttgaatgaggatgaactgagagaagcagtattgcttgtgtttgccaacaaacaagatcttcctaatgcaatgaatgctgctgagattaccgacaagttgggtctccactctctcagacagcgccactggtacattcagagcacctgcgcaacctctggagagggcctttatgaaggtctggactggctttccaacaacatcgccaataaggcttaatgcctttgggagtcttgcggattggtattctggatgcaggggtgaacattatctagcttttgtttcttggtcctcttccgagacaactcaaatatgtgttcatgtaatgtggtttaggacatctcgtgctaaatgtagtaggaatttgtttcttgggatgtgtaatactctgagctttctgttgggtttggatgaaatgtccataactgtaatggagatactaattcaatgcgccaccaggttctgatttatagttttattttggttatgtatctttcatatattgagtatgaaatggggatttttgtttatttttttgtaagttacccatacttaaatttttgtttgttgaagta

SEQ ID NO: 13389 - DNA, 939 bp, Elaeis guineensis
aagagaagagacgagaagagggatttacattcgtcgagccctcaccgctcgctctctctttatcgcttgctagcaaatctccttcgaagaggattctctgaagcggagaaaaaatggggcttaccttcacgaagctcttcagccgtctttttgcgaagaaggagatgaggatcttgatggtcgggcttgatgcggctggtaaaacgactatcctgtacaagctcaagcttggagagatcgtcaccactatccccacaatcggattcaatgtggagactgtggagtacaagaacatcagcttcactgtttgggatgttggtggtcaggataagatcagacctttatggaggcactacttccagaacactcagggccttatctttgttgttgatagcaatgatagggatcgtattgttgaggcgagggatgagctccatcggatgctaaatgaggatgagttacgtgatgctgtgttgcttgtgtttgcaaacaaacaagaccttcctaatgcaatgaatgctgctgaaattactgataagcttggccttcattctctgcgtcagcgacactggtacatccagagcacttgtgcgacctctggtgaggggttgtatgaggggctggattggctctccaacaacattgccaacaaggcttaaaattttcaacgttgctgggcaaagggtttgaaatataattctgggttatatatgcctcttgcagttgcggtgggtgtttggtgtatgatagtcttttagccatcagtttgttggccaaggatcatttaccatctttttttttttttcgttttttctaggtttctttcattttgttctactgttcggaacctttctttttctgtgagcgttgtagtaattgacttatgcagtctgcagagtagtgttatatgatcttattacatttccgtgggttgagtaa

SEQ ID NO: 13390 - DNA, 1459 bp, Orobanche aegyptiaca
gtaagccagtaggatttataatttttcttctaacacatcaaaccggcggacattttagtataaaataccactggctgacgattttcactactcccttaaaaagtttgtttttgttaaataatctctcgcgttgttctcaagtagttccgtattttctctcagcagaagccctctcccatttagcagatctaacgttctccgggatctaaagcaagaaagagaaatgggtctgacattcacgaagctttttagccggctttttgccaagaaggagatgcgcattctgatggttggtcttgatgctgctggtaagaccaccatcttgtacaagctcaagcttggagagatcgtcactactattcctaccattggtttcaacgttgagactgttgagtacaagaacattagctttactgtctgggatgttgggggtcaggacaagattcggccattgtggaggcactacttccaaaacacccagggtctcatattcgtggtggatagcaatgacagggaccgtgttgtggaggcaagggacgagttgcataggatgttgaatgaggatgagctgagagatgcagtgttacttgtatttgcaaacaagcaagatcttcctaatgcaatgaatgctgctgaaataaccgagaagcttggcctgcactcactcaggcagcgccactggtacatccagagcacctgtgctacctcaggggaggggctatatgagggcctggattggctctctaacaatattgctaacaaggcataaatgttggcagttcgtttggacgttgctgggtgcagttggcttttatctagtcttctatactagttgtgtggcaatgcttttttttttccaatttttaatgtgtttttgttgttttggttaggaaccgtttaaatggctgtgaagaacacaatggcttgtttcatatatttgttcaaaaaaaaaaaatggtttgaatgtaatactcggtcgttaggcttcattgtctaatgcggccagctttttgctacataatacccactttattgtggttcatcaatatatggattgtgcatgagcccgatctgtatcagcgcacacataatgaatagtggattacttccatcgacagaccagaaagaaaggaaacggccgattttattaataatgataatttatgcattgccaacatacactttatggctattattaatatcgagtgatttatatatagaaaatttactcgcatacctgtgagatatcttttgtttccagcaacttttatgtttgttgtgaggatagtctattagtcgaccttcaaagtcatctagggatggcatgactggatctttatgttgcttcgttgccgtaccctgcatagtgtttctgctccgttccaacgaaatattttttctggttcatgttaaattttaacatttgtcttatttcgaagttattaattgtaatattacc

SEQ ID NO: 13391 - DNA, 1072 bp, Orobanche aegyptiaca
aaggggcaactgggttgttacaagaacaagtaggggcaatatagacattacgaagaacagctggagggcgtcccgcataaataaccaccggttgacgattctcggtcgtccccgaaaaatagttccgcgtcagcctcaggcagctccatatttctatctttgcaaacagcagaaacaaactcctcttgctaacattttagcaaatctatcgttctcaggtatcaaaagcaagaaggatcaatggggttgacgtttacgaagcttttcagtcggctttttgccaagaaggaaatgcgcattctgatggttggtcttgatgctgctggtaagaccacaattctatacaagctcaagctcggagagattgtcactaccattcctaccattggcttcaatgtggagactgttgagtacaagaacatcagcttcactgtttgggatgttgggggtcaagacaagatccgtccattgtggaggcactacttccaaaacacccaaggtctcatattcgtggtggatagcaatgacagggaccgtgtagttgaggcgagggatgagctacataggatgttgaatgaggatgagttgagagatgcagtattacttgtgtttgcaaacaaacaagatcttcctaatgcgatgaatgctgctgaaataactgacaagcttggccttcagtcactcaggcagcgccactggtacatccagagcacctgtgctacctcaggggaggggctatatgagggcctggattggctctctaacaatattgctaacaaggcataaattttggcagttcgtttggacgttgctgggtgcagttggcttttatctagtcttctatactagttgtgtggcaatgcttttttttttccaatttttaatgtgttttttttttttggttaggaaccgtttaaatggctgtgaagaacacaatggcttgtttcatatatttgttcaaaaaaaaaatggtttgaatgtaatactcggtcattaggcttcattgtctaatgaggccagctttttgctacataatacccactttattgtggttcatcaatatatggattgt

SEQ ID NO: 13392 - DNA, 1165 bp, Abies balsamea
aagccccgcctgggtctactgaatggaatatattgaaatataaatacatccctatagaatcaatcccggttgcctcctccagccgcatccgtaattgcagatgctcgggtgattacataacagtgaagggttgtaaacgaagagctccaaaagaacgagggtggtctcgggaagccatcaggggatttttctctgttgtccctcaacagctctgctcgcattttcaatttcccttgtgaagttgttcaactcaaagcttaaacgatggggctcacttttaccaagcttttccagcggctttttgcaaagaaggagatgcgcattcttatggtgggtctcgatgcagccggtaagaccactattttgtacaagctcaagctcggagagatcgtcactactatcccaaccattggtttcaatgtggagactgtagaatacaagaatatcagcttcactgtttgggatgttggaggtcaggacaagatccgaccactttggagacattacttccagaatactcagggtctaatatttgtggttgacagcaatgatagagaccgtgtagttgaggctagagatgaattgcaccggatgctgaatgaggatgaactgcgtgatgctgtcttactggtatttgcaaacaagcaagatcttccaaatgcaatgaatgctgcagagatcactgataagcttggtctgcactctctccgtcagcgccactggtatattcaaagcacttgtgcaacttctggtgaaggtctttatgaaggcttggattggctttcaaacaacattgccaacaaggcataaattggaatgaatctaatttctatattgggcatgaagtattttagccaggaagtagttactattactgacagccactggcttggattttctgaagaagacttctactcgattcagtatcttgatagcttgattgctatgcgtttgagtatctacgactttgtcattatcgtgcaagaatctgggattttctttttgccagttgtgctatatttactatattagctcttttatacatcttactattatgttttgatttagaagacttgtataattagattttagaggattgaaaggcttttctacgatcaatatggacaaatattatgttgctttccaaatttattagttggaaaaa

SEQ ID NO: 13393 - DNA, 541 bp, Antirrhinum majus
aaaatatggggctatcttttggcaagctttttagtcggttatttgcgaagaaagagatgcggattcttatggttggtcttgatgctgctggtaagacgactatattgtacaaacttaagctcggagaaatagtgacgaccattcccacaattggattcaatgtggagacagtagaatacaagaacataagcttcactgtttgggatgtgggtggtcaagacaagatccgaccactatggaggcattatttccaaaacactcaagggctgatcttcgttgtcgacagtaatgaccgagatcgtgttgttgaggctagggatgagctgcataggatgttaaacgaggatgaactgagagatgctgtgcttcttgtttttgcaaacaaacaagatcttccaaatgctatgaatgctgctgaaataactgacaaactggggcttcactcgcttcgccaacgtcattggtatatccaaagcacatgtgctacctctggggaagggttatatgaggggctggactggctctccaacaacattgctaa

SEQ ID NO: 13394 - DNA, 1332 bp, Musa acuminata
gttaccggcagtcacgtgactcgctgtctcctgaagaaggaagcggagtgaccactggctctcgagtcttgtatttgtcgtctatataaaggcgccccttcctactctctttccatcgagagaacgtgcaatcgaggagtcatctcaccgtcgaatcgatctctccccgtggtttccgggagcgtaggaacgatggggctcaccttcacgaagctgttcagccggctctttgcgaagaaggagatgaggatcttgatggtgggtcttgacgctgctggtaagacgaccatcctctacaagctcaagctcggagaaattgtcaccaccattccaaccatcgggttcaatgtggagactgtggagtacaaaaatattagctttaccgtttgggatgttggtggtcaggacaagatcagacctctctggaggcattacttccagaacacacagggccttatttttgtggttgacagcaacgacagagatcgaattgttgaagcaaaggatgagcttcacagaatgcttaacgaggatgagttgcgggacgctgtattgcttgtttttgcaaacaaacaagatcttccaaatgcaatgaatgctgctgaaatcaccgacaagcttggtctgcattccttgcgccagcgacactggtacatccagagcacttgcgctacctctggtgagggtttgtatgaggggcttgattggctctcgaacaacattgccagcaaggcttaaatggccaggaagtgcttagtttaaatattcttacttcgtgccagtttgattgcttttgggacatgagaggtaacagaattttagtgtaatttatatggattgtattacctcagctttttgcattttaagacatcagatttcatgtattcagaaattagatgtgttagtgtctgcttgctgcctgtgattctagttcatttacaaacagatgatttgtgaattgagttcatcacctgcggacgtctgccttttctcctgtgtaatctacttgctatggtgtaatttacaccgtgcgagctaatttgtggcttagaacattattagtagactaaacgatgatcccttcttacaaggccggtactgacttggctggttcttctgattccttcaacaaatgcggaaaaggaaaatctacagctgccttcagctttggtaaatttgattttgatgctttggttgatataggttgtataacatgtgcatggcaatagcagattcgtccatacccatcaatggaaattgacatcgtagtttttggttctgcactgatctattaaatgagtttagccttggccggtcggctttacaccgggg

SEQ ID NO: 13395 - DNA, 848 bp, Ocimum basilicum
tcggcgctcatcttcaatttaaagatggggctgtctttcacaaagcttttcagccggctgtttgccaagaaagagatgcgtatactcatggtcggtcttgatgctgctggtaagactaccattctttacaagctgaagcttggagaaattgtcaccacaattcctaccattggtttcaatgtggagactgtggagtataagaacattagcttcactgtttgggatgtcggaggccaggacaagatccgtccattatggaggcattatttccagaacacccagggccttatctttgttgtcgacagcaatgaccgtgatcgtgttgttgaagcaagggatgaattgcacaggatgctgaatgaggacgagttgagggatgctgttctccttgtttttgcaaacaagcaggatcttccaaatgcaatgaatgcggcagagataactgacaagctgggccttcattccctacgccaacgtcactggtatatccagagcacctgcgctacttctggcgaagggctctatgagggattggactggctttcaaacaacattgccaacaagggttaaggtcctgagctcaaaacagccttgtgggagtttacattctttatcgtttggctcatctcgtgttcacgccacttggatcaaatcaaaaagttgccatcttattcaaatgtgtagttaataataatttgtagattttatcgtcaactttatggtttttcctactactgttttgtggaataggtgcaagttctttaatgctacaatattacttttgatgatatggttttgttaataaagtacgttctcttgagatatgttttctcaatgaccgagtacgg

SEQ ID NO: 13396 - DNA, 913 bp, Phaseolus vulgaris
gccaagagaaactgaaccctctctctttcagtcgttctccgagaacaaaaaatcgcgattcgctcttctcttcgaaatcgtgaacaaaaaatcgagaagagcgaattggagtgagagaggatggggttgtcgttcactaagctgttcagcaggttgttcgcgaagaaggaaatgaggattctgatggtaggtcttgatgctgctggtaagacaaccatcttgtacaagctcaagcttggagaaatcgtcaccactatccccaccatcggatttaatgttgagactgtggagtacaagaacatcagcttcactgtgtgggatgttggtggtcaggacaagattcgtccactatggaggcattatttccagaacactcagggtctcatttttgtggtggatagcaatgatagagatcgagtggttgaggcaagggatgagttgcacaggatgctgaatgaggatgaacttagagaagctgttttgcttgtttttgccaacaagcaagatcttcccaatgcaatgaatgctgcagaaataaccgacaagcttggtcttcattcactccgtcaacgccactggtatatccagagcacttgtgcaacttctggagagggtctctatgagggtctggagtggctttctaacaacattgccagcaaggcatgagacatttgaaaaaatttccgttgtctggggattttatgcgagtctggcagttcttggagaaagatggtaaagttttatatagttaaggttgtaatagctgaacacttgttagaagtattctcttttgtgttaacttgggtttgtatgattgcttaaattagctaatacttttagctataataagtggaacttttgttcgtgttcattttgttagtttgtttatcgattgaatattttcattgcgttt

SEQ ID NO: 13397 - DNA, 810 bp, Bupleurum chinense
tggggctgtcctttaccaaactcttcagccggctcttcgccaagaaagaaatgcgcatactgatggtgggtctcgatgcagctggtaaaacaaccatattatacaagctcaagctgggagagatagttacaacaattcctactattggatttaatgtggagactgtggaatacaagaacattagcttcactgtctgggatgttggaggccaggacaagatccgtcctttgtggagacattacttccaaaatacccaaggcctcatatttgtggttgatagcaatgatcgagatcgtgtagttgaagcaagagatgaactgcacagaatgcttaatgaggatgaattaagggatgctgtcctacttgtatttgctaacaaacaagatcttcccaatgcaatgaatgctgctgagattactgataagctaggccttcattctcttcgtcagcgccactggtatattcagagcacatgtgccacttcaggtgaaggtctatatgagggtctggactggctctcaaataacatagcaaacaaggcgtagacagcttttgatcggagtttgactcttctaaggaagcagataagagttcttcaatatctcttgttttgagatcttcatgacaatgggattgagtttctcatatttctcttcttccagagatgtgtaccatgtgtttatgttggcttctttactatgtttgaggtctcttaaaagttatgtttggtttcttctaggttcattataggtcgtagtattactcatttcatgtgattctccatgtgaccatgtcgtccgacgacggtgt

SEQ ID NO: 13398 - DNA, 724 bp, Daucus carota
atacatacgcacattacacacaccccttcgctctgttttcctctccttcgaaatctaccatttttaggagtgctaaagatggggctgtcctttaccaaactcttcagtcggctctttgccaagaaagagatgcgcatactgatggtgggtctcgatgcagctggtaaaacaactattctttacaagcttaagctgggagagatagttaccacaattcctactattggatttaacgtggaaactgttgaatacaagaacatcagctttaccgtctgggatgtcggaggccaggacaagatccgccctttgtggagacattacttccagaatactcagggcctcatatttgtggttgatagcaatgatcgagatcgtgtagtcgaagcaagggatgagttgcacaggatgcttaatgaggatgagttaagggatgctgtcctacttgtattcgcaaacaaacaagatcttcctaatgctatgaatgctgctgagattactgataagcttggccttcattctcttcgtcagcgccactggtacatccagagcacatgtgccacttcaggtgaaggtttatatgaaggtctggactggctctccaataacattgcaaacaagtcgtagacatcttgctcagagtttgaatcttcactgcaaccagatagagttcttcatattcttttgttctgagatctgtcaagacagtcggatagtggtttttgca

SEQ ID NO: 13399 - DNA, 983 bp, Castanea mollissima
aaaaacaaaatatcgcggctctcctctccttccttctttccttcctccaatccttcacaggttcggtactgtgaggttgcttaaaaatggggctgacatttacgaagctgtttagcaagctatttgcgaagaaagaaatgagaattctgatggtaggtctcgatgctgctggtaaaactaccattttgtacaagctcaagctcggtgaaatcgttactaccatccctaccatcggatttaatgtggaaacagtggaatataaaaacatcagtttcactgtttgggatgttggtggtcaagacaagatccgtccattgtggaggcactacttccaaaacactcagggtcttatttttgtggttgatagcaatgacagggatcgtgttgttgaggcaagggatgagttgcacaggatgttgaatgaggatgaactcagggaggctgttttgcttgtatttgccaacaaacaagatctgcctaatgcaatgaatgctgcagagataactgataagcttggcctgcattctctccgccaacgccactggtacatccagagcacgtgtgcaacttctggagagggtctctatgaggggttggattggctttccaacaatattgctagcaaggcatgagccattaaagaattttggttcctagcgatttgggagaggacgcttcccctttctcagtgttgtaatagcagaatgtttgtctagaactttctatattttggcttgtatggttgctacattagctaagtacttttagctgtaaaccaaactttcatgtttgttccaatgtcttttgggcatggccgcacttaatagttatttttgcttgccttataactgattggtgtgcaatgcaatctttctattgtacaaaagagtggagctacgaccatttaagcaatgtcctaaaggccccaattggaagaggacccttaatagaatatattatatttatttgttttatagtattgc

SEQ ID NO: 13400 - DNA, 1176 bp, Citrus clementina
aaacaaagaatgaatggacaaccaaacaaatatgaataactgatcttaacaccgaccgaagtaccgaaccctcctctctgaccatcttttcgctgactccgtcaaaatctcatcaaaaaatttttaaaataaaaaaaactcactttaaaaaaaattgaaaaaaaaaaagaatcaacaattaatttcaaacgtccttaattttcgagacctataaaatctagaaaaagcccaccatttttgtagttttattttaatttgaatttttggtttaagtggtgttcggcagctccctcttgatcagattagattacaaatcctttctcttctttctgagagcaaaaatggggctgtctttcaccaagcttttcagtaagttatttgcaaagaaggagatgcgaattcttatggttggtcttgatgcagctggtaaaaccacaattttatataagcttaagttaggggagatcgttaccaccatccccaccattggtttcaatgtggagactgtggaatacaagaatattagcttcactgtctgggatgttggaggtcaagacaagattcgacctttgtggagacactattttcaaaatacacaaggtcttatctttgtggttgacagcaatgatcgtgaccgtgttgttgaggctagagatgagctgcacaggatgttgaatgaggatgagttgagggatgctgtgttgcttgtgtttgcaaacaaacaagatcttccaaatgcaatgaatgctgccgagatcactgacaagcttggccttcattctctccgacaacgtcactggtatatccagagcacttgtgccacttctggagaagggctctacgagggactagactggctctcaaacaacattgctaccaaggcttagtggactagttgtagtcaagcattcggagactgagtacagttgcaatttatagatgttattgactagctattgctacaagttctatgctgtttattcgggattcaagtctttaattgatagtaggaaagcaaatgttagttttttttgggtccttttctgtatttgtttgttgttgaattcgataactattaatttgtaatttctttcttgttgacattggtaaaatttgtcctatcaaaattgtgagttatttgaaataaagtatttttgctgtgtgacaattatcaaa

SEQ ID NO: 13401 - DNA, 1038 bp, Panax ginseng
aagcagtggtatcaacgcagagtacatgggccggcggatctcttttctctgtgttgaaatcaattctcagtggattcttcaggcgaaggtttccagagaaaaattctcagcacagtatttctgtctcagtgttgagcaagttataagcagctgaggtacaagaaagatggggttgtctttcacaaagctgttcagcaggctttttgcgaagaaagagatgcgcattctgatggtaggtcttgatgctgctggtaagactaccattttgtacaaactcaagcttggagaaattgtcacaacaatccctactataggatttaatgttgagactgtggaatacaagaacattagcttcactgtttgggatgttggtggtcaggataagatccgtccactgtggaggcactacttccagaatacacaaggtcttatctttgtggtggatagcaatgacagagagagagttgttgaggcaagggatgagttgcataggatgttgaatgaggatgaactcagagatgctgttttgctcgtctttgctaacaaacaagatttgcccaatgcaatgaatgctgcggagataacagacaagcttggtcttcattctctccgtcaacgtcactggtacatccagagcacatgtgccacctcaggggagggtctttatgaagggctggattggctttccaacaacatcgctaacaaggcatgaactgaatgagtttggttgccggttgtattttccctgtagacattgggtagatactatttaggacgtttgtcaatccagccagagattatgttcgttcttgatgcagtaaaatggttgctggtgaaagcttattgtcagcttgatatcactgctttggctattacatagctggaaaaaaatacttattttgttatgatggtaaattcattttcaatgaactacacatgttagtctattttcagaggtattgaacggatttggattttgggaatgcaaatgagacttgttaaattcaaccaaatagatattgaccaagggatttttca

SEQ ID NO: 13402 - DNA, 880 bp, Panax ginseng
agtgttgagaaagttataagcagctgaggtacaagaaagatggggttgtctttcacaaagctgttcagcaggctttttgcgaagaaagagatgcgcattctgatggtaggtcttgatgctgctggtaagactaccattttgtacaaactcaagcttggagaaattgtcacaacaatccctactataggatttaatgttgagactgtggaatacaagaacattagcttcactgtttgggatgttggtggtcaggataagatccgtccactgtggaggcactacttccagaatacacaaggtcttatatttgtggtggatagcaatgacagagaaagagttgttgaggcaagggatgagttgcataggatgttgaatgaggatgaactcagagatgctgttttgcttgtctttgccaacaaacaagatttgcccaatgcaatgaatgctgcggagataacagacaagcttggtcttcattctctccgtcaacgtcactggtacatccagagcacatgtgccacctcaggggagggtctttatgaagggctggattggctttccaacaacatcgctaacaaggcatgaactgaatgagtttggttgccggttgtattttccctgtagacattgggtagatactatttaggacgtttgtcaatccagccagagattatgttcgttcttgatgcagtaaaatggttggctggtgaaagcttattgtcagcttgatatcactgctttggctattacatagctgcaaaaaatacttattttgttatggtaaattcattttcaatgaactacacatgttagtctattttcagaggtattgaacggatttggatttttggaaatgcaaatgagacttgttaaatttaaa

SEQ ID NO: 13403 - DNA, 1275 bp, Vitis vinifera
gttcaaaaatccctctgtaatatgtgttgataattgaattgatcggaacccatatatttaacatatgggtgcaaatattgacttggaaattggtccttctcggaggcttgcagcacgggggcggtgaggtgcgaagaaattacgcttaggaggaggggcgttttcgtcatctgggtaaacaaaattaaattgaaaacaccggcggttgtgtcctttaaattggctctctaattgacgatcctcaccccatattcatatattgcgcgttgcttccaagctttcattccttctcagatccctctgccaaagcgccagctcttcaaagggatccatagcctgaaagagatatggggctgacgttcaccaagctgttcagtcggcttttcgccaagaaagagatgcgcattctgatggtgggtcttgatgctgccggtaagacaaccatcctgtataagctcaagcttggagagatcgtgacgacaattcctaccattggattcaatgtggagaccgtggaatacaagaacattagcttcaccgtgtgggatgtcgggggtcaggataagattcgtccattgtggaggcactacttccaaaacactcagggtcttatatttgtggtggatagcaatgacagagatcgagttgtcgaggccagggatgagttgcacaggatgctgaatgaggatgagctccgtgaggctgtgctgcttgtatttgctaacaaacaagatctccctaatgctatgaatgctgccgagataactgataagcttggcctccactctctccggcagcgtcactggtacatccagagcacctgtgcaacctctggtgaagggctttacgagggattggattggctctccaacaatattgctaacaaggcttgaggcaactgtggagtctgttcctgtggatgggcggtcctggatgcaggggtgaatattatctagtcatcttcgtttttattcgttttttttcctttcctttttatatttttccttgagacagttggcttgtggtaatgcttttttcatgaggaagcgtttatttagaacaacatatttgtaatagaagaatggttggttggatatacatatacttaacaagtttttgtgggggctgtggatgtcacgcttgtagctggtaccgaaactaatttggtgtacatcccattttgaaatggatttttataatattataggcgttgtttcgtttaattccataattttcaattgttggcatgatagatgagacaatccgcaggtattc

SEQ ID NO: 13404 - DNA, 831 bp, Heritiera littoralis
gggttagttttcgacattgttgtttttccattccttccttcatcttcttgggcggcttcccttttgtttcaatttctcgccatccaagataaaaggatggggctgtcttttgctaagctgttcagccggctgtttgctaaaaaagagatgcgaattcttatggtgggtcttgacgctgctggtaagactaccatcttgtataagctcaagctcggagagattgtcactaccattcccactattgggtttaatgtggagactgtggaatataagaacattagcttcactgtttgggatgttggtggtcaggacaagattcgacctttgtggaggcactacttccaaaatactcaagggttaatctttgttgttgatagcaatgatcgtgaccgtgtggttgaggccagggatgagcttcaccgtatgctaaatgaggatgagctaagggatgctgttctgcttgtatttgcaaacaagcaagatctaccaaatgctatgaatgctgctgagatcactgataagcttggccttaactccctccgtcagcgccattggtatatccagagtacatgtgccacttccggtgaaggcctgtatgagggtctggactggctctcgaacaacatagctaacaaggcttgaggattggtcgaaattcaatgacatctcaggcagcaaatctttgtgggatttgaatttttcaatgccattttatgttctcgggttgttcttttctttcaagttttactagaaatgtattagcctgtgttagatatatttactgtgctagatataggcaatttgcctgccttgtagatcgatttcaaataa

SEQ ID NO: 13405 - DNA, 900 bp, Ipomoea batatas
tacgcgttgatcgtaggcttcatttctcccttcgtctctctctccctctctcgcgttttctctcactagatccctcgttcataagcttctctcagggatcatcaggaagaaagagaaatggggctgacattcaccaagctcttcagcaggctttttgccaagaaggagatgcgtattctgatggttggtcttgatgcagctggtaagacaaccatattgtacaagctcaagctgggagagattgtgactaccatccctaccattggtttcaatgtggagactgttgaatacaagaacatcagcttcacagtttgggatgttgggggtcaggacaagatccgtccattgtggaggcactatttccagaacacacaaggtctcatctttgttgttgatagcaatgatagagatcgtattgtggaggcaagagatgaattgcacaggatgttgaatgaagatgagctccgtgatgctgtgctgcttgtgtttgctaacaaacaagatcttccaaatgcaatgaatgctgctgagatcactgataagcttggtctccactctctcaggcagcgccactggtacatccagagcacctgtgctacctctggagaaggtctttatgaagggcttgattggctttccaacaacattgccaacaaggcctagacaggtaaagaattctctcgtgggttgatcctggatgcaggcgggtttttatctagtttctttccccaagtcggtgtggttatgaacatccttttaaaggcacttataatctttgtaggactttgaattggctttttgtagtacaaagagttggatatatgtaatttcatgtctagatttgagtacaatgttttgaatttgtaaacgatgattaatttgttgcttacgttgcgtctg

SEQ ID NO: 13406 - DNA, 999 bp, Ipomoea nil
gcttcgatattacgcgttgatcgcaaggcttcatttctccctttggctctgtctctctctctctcgcgttttctctcactagatccctctttcataagcttctctcagggatcatcaggaagaaggagaaatggggctgacattcaccaagctcttcagcaggctttttgccaagaaggagatgcgtattctgatggttggtcttgatgcagctggtaagacaaccatattgtacaagctcaagctgggagagattgtgactaccatccctaccattggtttcaatgtggagactgttgaatacaagaacatcagcttcacagtttgggatgttggaggccaggacaagatccgtccattgtggaggcactatttccagaacacacaaggtctcatctttgttgttgatagcaatgatagagatcgtattgtggaggcaagagatgaattgcacaggatgttgaatgaagatgagctccgtgatgctgtgctgcttgtatttgctaacaaacaagatcttccaaatgcaatgaatgctgctgagatcactgataagcttggtctccactctctcaggcagcgccactggtacatccagagcacctgtgcaacctctggagaaggtctttatgaagggcttgattggctttccaacaacattgccaacaaggcctagacaggtaaagaattctctcgtgggttgatcctggatgcaggcgggtttttatctagtttctttccccaagtcggtgtggttatgaacatccttttaaaggcacttataatctttgtaggactttgaaatggctttttgtagtacaaagagttggatatatgtaatttcatgtctagatttgagtacaatgttttgaatttgtaaacgatgattaatttgttgcgtctgttaatggtttagcactttgatcttgctgttttctgagttgcctttcctgcaatttgctggcttttggcattgacatgggtcattggtaatggcaa

SEQ ID NO: 13407 - DNA, 910 bp, Jatropha curcas
gatcccccggggctgcaggtctctatctccttttcgctctcttctctctcgatcttgctcctcgacgtctctctgagataataagatggggctttctttcaccaagctcttcagtcggctgtttgccaagaaggagatgcgaatccttatggtgggtcttgacgcagctggtaagacaacaatcttgtacaagctcaagcttggagaaattgtcacgaccatccccacaattggatttaatgttgagactgtggagtacaagaacataagcttcactgtctgggacgttggtggtcaggacaagattcgaccattatggagacattacttccaaaacactcaagggctgatatttgtggttgatagcaatgaccgtgaccgtattgttgaggctcgagatgagctgcatcgcatgttgaatgaggatgagttgagagatgctgtgctgcttgtatttgctaacaagcaagatcttccaaatgctatgaatgctgctgagattactgataagcttggcctccactctcttcgccaacgccattggtatatccagagcacatgtgccacttcaggtgaagggctttatgaaggacttgactggctctccaataacattgctaacaaggcataggatatgggtcagttttcaacaatgtgagctgcactctgctgcaaatttgtttattttggtgtcttctggatctcttatcatgtaattgttgagataatgtatttcttagatatcaatactgtaatagaaattggcaaaattattcctgtagattttaaataattgatgattcaccgttcgtacatgtgcctccatagacctccaatgtgaaatttttggaaattcctgtttaaaaaaaagggggggcccggtacccaattcgcctatatgatcgtatac

SEQ ID NO: 13408 - DNA, 1128 bp, Pinus pinaster
aattcggcacgaggcagaaacgaactctccatcagcggggtctgcgattttacagaatatctggttttctctcgagttttgcaagatggggctcacgttcaccaagctttttcaacgtctgtttgccaaaaaggaaatgcgtattctgatggtgggtcttgatgctgctggtaagactaccattctgtacaagctgaagcttggagaaattgtcacaacaattcccactattggtttcaatgttgagactgtggagtacaagaatattagctttactgtttgggatgtcggaggtcaggacaagatccgaccactatggagacattactttcagaatacccagggtcttatatttgtagttgatagtaatgacagggaccgtgttgttgaagcaagagacgaattgcataggatgctgaatgaggatgagttgcgagatgctgttctcctcgtatttgcaaacaagcaggatcttcccaatgcaatgaatgctgctgagataactgataagcttggcctgcattctttgcgtcagcgccattggtatatccagagtacctgtgctacttctggtgaaggactgtatgaaggtctggattggctttctaacaacatcgcaaacaaggcataatgttgaagcatcgtaatgacgctatgaagcttttgagaatgggcttgtttccatgtcttctgaatattggttggatactttctgcagtgtagtggacgtgtttcatgcttctcctagtaaattgaagtagataaatagttaaggggggttgaggatctattcttgtggtgtactgatccttagtttacttaatttgtttgaaattttgcatgtctacaattgttacataatcaactatgaattcttccagtgggttcctcaggataatcggtgccccatctttttggctcgtttgtggattcaaaagtactgttactgaaattccaaagttacatattcttttgaatttatatatattgcatgttatgcatgtacgaggtgcttgtatatgatgttgcttgtagtgccttctgaattttcctatattatggatacacatgactgggctgtactagctttagataactaaatgaattttctattcagagcagagatat

SEQ ID NO: 13409 - DNA, 1402 bp, Pinus pinaster
acgaacgaaaggttatgcatcctccggtgtcgtgaatggaatatattcaaatataaccataaatatccctggagtgagtccaacttaccttcctccagccgcatccgtaactgtcaaccggagatgctctggtgattaatcacgttgcactgaacgggtgtaaacaaagagctccaaaggaaagagagtgatctctccctcttttctggggaggcatcgggatttttctgcgcagtccctcaacaggtcttcttgcattttcaatttgcattcggaagttgctcaactcgaagctgaaaaaatggggctcactttcaccaagcttttccagcggctttttgcaaagaaggagatgcgcattcttatggtcggtctcgatgcagccggaaagacgaccattttgtataagctcaaactgggagagattgttactactatcccaaccattggtttcaatgtggagactgtagaatacaagaatatcagcttcactgtttgggatgttggaggtcaggacaagatccgaccactttggagacattacttccagaatactcagggtctaatatttgtggttgacagcaatgatagagaccgtgtagttgaggctagagatgaattgcaccggatgctgaatgaggatgaactacgtgatgctgtcttacttgtatttgcaaacaagcaagatcttccaaatgctatgaatgcagcagagatcactgataagcttggtctgcattctctgcgtcagcgtcattggtatatccagagcacttgtgcaacttctggtgaaggcctttatgaaggcttggattggctttcaaacaacattgccaacaaggcataaactggaatgcatccaatttctttattgggcatgaactatattagccatgaggtagattccttcagattacaatgattgagccactggcatggatttgctaaagaagaccttgactcgattcattttcttgatagcctgattgctatgcatttaccaacaactttgtcattattgttcaagaacctgggatttttctttctgacagttgtgctatattgactattatagctcatatatatatatatatagctgttatctgttgactgagaagacttgtataattagattttagaggactgaaaggctttgctatgttaactaggaacaaatataatgttgctttccaaatttattagttgggaaaacagaaagtagttcagtatttacatcaatatctgaaaactgtatcagatatttatatctatagtcttatcctgttgaccagttgaggtttcctgattgtgaagtttatagtgataatgcttgtatgctgcatcactgtgaaagctatagcagtctaagtgtacacctgtgttatgttagttattagtagtc

SEQ ID NO: 13410 - DNA, 983 bp, Mimulus guttatus
aataaaattccccaactcttcattcatcgtagcgtacaatagcagcagcatttggtttctccactgcagcctccgaaccaagatctgcccttctctctcattttcagatcaatcgtctttcctttcatccggtgactaaaaatggggttatctttcagcaagttgttcagcagattgtttgcaaagaaagaaatgagaattcttatggtaggtctcgatgcggctggtaagaccactatattatacaaactcaagcttggtgaaatcgtgaccaccattcctacaattggattcaatgtggagacagtggaatacaagaacattagcttcactgtctgggatgttgggggtcaagacaagatccgaccattgtggaggcattactttcagaacactcaagggcttatttttgtggtagatagtaatgatcgagatcgtgttgttgaagctagggatgaacttcataggatgttgaatgaggatgaacttcgggatgcagtgcttcttgtatttgcaaacaaacaagatcttccaaatgccatgaatgctgctgagattactgacaagcttggacttcactctctccgtcagcgccattggtatatccagagtacatgtgccacctctggggaagggctatacgaggggctcgattggctctccaacaacattgctaacaagggatagaaagagatgtcggaataattgtttgttgtttaccggtttgttgaacccaagatttgtctttttttacttttgtggcttttgttcaaagttattcaatgctgactattttgtcctgtagattgtctccattttttatggagattctaaatttgcgtatgtaatttcagcacttatatatagcttgtctcgtcgcgcttctttggctgttttatttttcaaatgagaatgcatctctctccactatgggttgatgaaaatatgaaactggtagctagcgaatgctgaattttatgtga

SEQ ID NO: 13411 - DNA, 1175 bp, Citrus sinensis
aaacaaagaatgaatggacaaccaaacaaatatgaataactgatcttaacaccgaccgaagtaccgaaccctcctctctgaccatcttttcgctgactccgtcaaaatctcatcaaaaaatttttacaataaaaaaacccactttaaaaaaaattgaaaaaaaaaagaatcaacaattaatttcaaacgtccttaattttcgagacctataaaatctagaaaaagcccaccatttttgtagttttattttaatttgaatttttggtttaagtggtgttcggcagctccctcttgatcagattagattacaaatcctttatcttctttctgagagcaaaaatggggctgtctttcaccaagcttttcagtaagttatttgcaaagaaggagatgcgaattcttatggtcggtcttgatgcagctggtaaaaccacaattttatataagcttaagttaggggagatcgttaccaccatccccaccattggtttcaatgtggagactgtggaatacaagaatattagcttcactgtctgggatgttggaggtcaagacaagattcgacctttgtggagacactattttcaaaatacacaaggtcttatctttgtggttgacagcaatgatcgtgaccgtgttgttgaggctagagatgagctgcacaggatgttgaatgaggatgagttgagggatgctgtgttgcttgtgtttgcaaacaaacaagatcttccaaatgcaatgaatgctgccgagatcactgacaagcttggccttcattctctccgacaacgtcactggtatatccagagcacttgtgccacttctggagaagggctctacgagggactagactggctctcaaacaacattgctaccaaggcttagtggactagttgtagtcaagcattcggagactgagtacagttgcaatttatagatgttattgactagctattgctgcaagatctatgctgtttattcgggattcaagtctttaattgatagtaggaaagaaaatgttagttttttgttgggtccttttctgtatttgtttgttgttgaattcgataactattaatttgtaatttctttcttgttgacattggtaaaatttgtcctatcaaaattgtgagttatttgaaataaagtatttttgctgtgtgacaattatcaaa

SEQ ID NO: 13412 - DNA, 855 bp, Phalaenopsis aphrodite
gaaagatggggctgacatttacgaagctcttcagccggctttttgccaagaaggaaatgaggattctcatggttgggcttgatgctgctggtaagacgacaattctttacaagcttaagctcggagagatcgtcactaccattcctaccattggattcaatgtcgagactgtagagtacaagaacattagcttcactgtctgggatgttgggggtcaggacaagatccgaccattgtggaggcactatttccaaaatacccagggccttatcttcgttgtggatagcaatgacagagatcgtgttattgaggcaagggacgagctccatagaatgcttaatgaggatgagcttcgagatgctgttcttctagtgttcgcaaacaaacaagatcttccaaatgcaatgaatgctgctgaaatcactgataaacttggtcttcattcccttcgtcagcgacattggtacatccagagtacctgtgctacttccggtgagggactgtatgaggggcttgattggctctctagcaacattgccaacaagggttaaagcttttgcgagatctctagatggaggaacggggagggttgcatctctaaaattgtgtttgagtttggtggtgagtgttaagtctcggattattgaacttggtaaatggttttgttaaatgcgcatggtgtctttataaatttgtactcctatggcactaaaaaaaggcttcagcttgctcaagtaaaaatctatatatttttcccctcttttattcatcttatcatcacacttgttgttaatctgctgcctcttattaattagggtgaaagaaaattgaaatgtggttcattttcggtgaacc

SEQ ID NO: 13413 - DNA, 844 bp, Phalaenopsis aphrodite
agcggagaaagctcgaaggcagaggagacggaccggctcctcacctttgctctttgatcaaccgactgatttaagaagccccagagaaaagatggggctgacatttacgaagctcttcagccggctttttgccaagaaggaaatgaggattctcatggttgggcttgatgctgctggtaagacgacaattctttacaagcttaagctcggagagatcgtcactaccattcctaccattggattcaatgtcgagactgtagagtacaagaacattagcttcactgtctgggatgttgggggtcaggacaagatccgaccattgtggaggcactatttccaaaatacccaaggccttatcttcgttgtagatagcaatgacagagatcgtgttattgaggcaagagacgagctccatagaatgcttaatgaggatgagcttcgagatgctgttcttctcgtgtttgcaaacaaacaagatcttccaaatgcaatgaatgctgctgaaatcactgataaactaggtcttcattcccttcgtcagcgacattggtacatccagagtacctgtgctacttccggtgagggactgtatgaggggcttgattggctctctagcaacattgccaacaagggttaaagcttctgcgagatgtctagatggagaaacggggtgggagggttgtgtctctaaaattgtgtttgagtttggtggtgagtgtcaagtctcggattattgaacttggtaaatggttttgttaaatgcgcatggtgtctttctaaatttgtactcctatggcactaaaaaaaggcttcagtttgctcaagtaaaaatctatatattttt

SEQ ID NO: 13414 - DNA, 927 bp, Phalaenopsis aphrodite
gatgccattacaagcagccctaaccctcattagaccgtctctttcctccgaacgagtgaagacagggaggagaagcggagaaagctcgaaagcagaggagacggaccggcagacttccatcctcaccttcgctctttgatcaaccgactgatttaagaagccccagagaaaagatggggctgacatttacgaagctcttcagccggctttttgccaagaaggaaatgaggattctcatggttgggcttgatgctgctggtaagacgacaattctttacaagcttaagctcggagagatcgtcactaccattcctaccattggattcaatgtcgagactgtagagtacaagaacattagcttcactgtctgggatgttgggggtcaggacaagatccgaccattgtggaggcactatttccaaaatacccaaggccttatcttcgttgtagatagcaatgacagagatcgtgttattgaggcaagagacgagctccatagaatgcttaatgaggatgagcttcgagatgctgttcttctcgtgtttgcaaacaaacaagatcttccaaatgcaatgaatgctgctgaaatcactgataaacttggtcttcattcccttcgtcagcgacattggtacatccagagtacctgtgccacttccggtgagggactgtatgaggggcttgattggctctctagcaacattgccaacaagggttaaagcttctgcgagatgtctagatggagaaacggggtgggagggttgtgtctctaaaattgtgtttgagtttggtggtgagtgttaagtctcggattattgaacttggtaaatggttttgttaaatgcgcatggtgtctttctaaatttgtactcctatggcactaaaaaaaggcttcagtttgctcaagtaaaaatctatatatttttc

SEQ ID NO: 13415 - DNA, 1383 bp, Pinus taeda
ctccagcggcatccgtaagtgtcaaccggagatgctctggtgattaatcacattgcagtgaacgggtgtaaacaaagagctctaaaggaaagagagtgatctctccctcctttctggggaggcatcgggatttttctgcgcagtccctcaacaggtcttcttgcattttcaatttgcattcggaatttgttcaactcgaagctgaaaaaatggggctcactttcaccaagcttttccagcggctttttgcaaagaaggagatgcgcattcttatggtcggtctcgatgcagccggaaagacgaccattttgtataagctcaaactgggagagattgttactactatcccaaccattggtttcaatgtggagactgtagaatacaagaatatcagcttcactgtttgggacgttggaggtcaggacaagatccgaccactttggagacattacttccagaatactcagggtctaatatttgtggttgacagcaatgatagagaccgtgtagttgaggctagagatgaattgcaccggatgctgaatgaggatgaactacgtgatgctgtcttacttgtatttgcaaacaagcaagatcttccaaatgctatgaatgcagcagagatcactgataagcttggtctgcattctctgcgtcagcgtcattggtatatccagagcacttgtgcaacttctggtgaaggcctttatgaaggcttggattggctttcaaacaacattgccaacaaggcataaactggaatgcatccaatttctttattgggcatgaactatattagccatgaggtagattccttcagattacaatgactgacaatcactggcatggatttgctaaagaagaccttgactcgattcattttctcgataccctgattgctatgcatttaccaacaactttatcattattgttcaagaacctgggatttttctttctgacagttgtgctatattgactactatagctcttatatatatatagctgttatctgttgactgagaagacttgtataattagattttagaggactgaaaggctttgctatgttaactaggaacaaatataatgttgctttccaaatttattagttgggaaaaacagaaagtagttcagtatttatatcaatatctgaaaactgtatcagatatttatatctgtagtcttatcctgttgaccagttgaggtttcctgattgtgaagtttatagtgataatgctgtatgctgcatcaatgtgaaagctatagcagtctaagtgtacacctgtgttatgttagttattagtagtctttttgttttgggataaacagaatgatgtacgggacttaatagtctaggttgagttgacctctttcttccttttt

SEQ ID NO: 13416 - DNA, 1005 bp, Pinus taeda
aggcctctgcagaaacgaactcttcatcaccggggtctgtgattttacaggatatctggttttctctcgagttttgcaagatggggctcacgttcaccaagctttttcaacgtctgtttgccaaaaaggaaatgcgtattctgatggtgggtcttgatgctgctggtaagactaccattctgtacaagctgaagcttggagaaattgtcacaacaattcccactattggtttcaatgttgagactgtggagtacaagaatattagctttactgtttgggatgtcggaggtcaggacaagatccgaccactatggagacattactttcagaatacccagggtcttatatttgtggttgatagtaatgacagggaccgtgttgttgaagcaagagacgaattgcataggatgctgaatgaggatgagttgcgagatgctgttctcctcgtatttgcaaacaagcaggatcttcccaatgcaatgaatgctgctgagataactgataagcttggcctgcattctttgcgtcagcgtcattggtatatccagagtacctgtgctacttctggtgaaggactgtatgaaggtttggattggctttctaacaacatcgcaaacaaggcataatgttgaagcatcgtaatgacgctatgaagcctttgagaatgggctggtttccatgccttttgaatattggttggattaggatactttctgcagtgtagtggacgtgtttcatgcttctcctagtaaattgaagtagataaatagttaaggggggttgaggatctattcttgtggtgtactgatccttagtttagttaatttgtttgaaattttgcatgtctacaattgttacataatgaactatgaattcttccagtgggttcctcaggatttcggtgccccatctttttggctcgtttgtggattcaaaagtactgttactgaaattccaaagttacatattcttttgaatttatatatattgcatgttatgcatgta

SEQ ID NO: 13417 - DNA, 634 bp, Salvia sclarea
cggcacgaggcgactgtgaagacgatctgcttttcttcattcctaataatttcatttgtatttcttcatcaccaatttagaaaatggggttgtctttcaccaagcttttcagtcgactgtttgcgaagaaggagatgcggatccttatggtaggtcttgatgctgctggtaagacaactatattgtacaaactcaagctgggagaaatagtcacaactattcctacaattggattcactgtcgagacagtcgaatataagaacattagcttcactgtttgggatgttgggggtcaagacaagatccgaccgttgtggagacattactttcagaatactcaaggtctaatctttgtggttgatagtaatgatcgagatcgtgttgttgaggctagggacgagctgcataggatgttaaatgaggacgaactgagggatgccgtgttgctagttttcgctaacaaacaagatcttccaaatgccatgaatgctgctgagataactgacaagctaggacttcactctctccgtcaacgccattggtacattcagagtacatgtgccacctccggtgaagggctatacgaggggctcgactggctctcgaacaacattgccaacaaggcttaagaagg

SEQ ID NO: 13418 - DNA, 983 bp, Glycine max
tggctctgcttcttcttcttttgaattaagagatggggttgtctttcaccaagctttttagccggctctttgccaagaaagagatgcgtattctcatggtaggtcttgatgctgctggtaagactaccatcttgtacaagctcaagctgggagaaattgtcacaaccattcccacaattggatttaatgtggagactgtggaatataagaatattagctttactgtatgggatgtgggtggccaagataagattcgtcctttatggagacactacttccaaaacactcaggggcttatctttgttgtggatagcaatgatcgtgaccgtgttgttgaggctagagatgagctccaccggatgttgaatgaggatgagttgagagatgctgttctcctggtatttgccaacaaacaagatcttccaaatgctatgaatgctgcagaaatcacagacaagcttggtcttcattctcttcgccaacgccactggtatatccagagcacatgtgctacctctggggaaggactatatgaaggactggagtggctctccaacaatatagctaacaaggcttagggacattttgtggaatgccgctatttcttgcttattatattatgaggttgatgggttgctgcttctcttatatagcattataatatatatatatattttactcttttaagtcttttctttttctttatttaggtgtttgatactatatcatagcaatcgtattgaatcctgtagaatttttaaataattaatgaattacaaactatacatgacgcgatcatgcttttcaatccttcatggctgcatcagtcaataatccctaaacctttaaatttaaagcttccattaatcagatgtcccggtggacgctttagaaatttcacttaatatgtagtacagtactttgattatgcggaaacagtaataattctgtaatcaatggttctggtagcactgcatttttct

SEQ ID NO: 13419 - DNA, 918 bp, Saccharum officinarum
ctcttcccctgcgatccgagcccgcacccgcagggaagagaaggaagggatcacctgatcaccagggcgcggcctcgcgatctcggagcggagatggggctcacgttcacgaagctgttcagccggctcttcgccaagaaggagatgaggatcctcatggtcggtctcgatgcagctggtaagaccaccatcctctacaagctcaagctcggcgagatcgtcaccaccatccccaccatcggatttaacgttgaaactgtcgagtacaagaacattagtttcactgtttgggatgtcggtggtcaggacaagatccgccccctgtggaggcactacttccagaacacccagggcctcatttttgttgtagacagcaacgacagagagcgtgttgttgaggccagagatgagctccaccggatgctgaacgaggacgagctccgtgatgctgtgcttttggtgtttgcaaacaaacaagatctgcctaatgccatgaacgctgctgaaatcaccgataagcttggcctgcactcgctgcgccagcggcactggtacatccagagcacatgtgctacctctggtgagggtttgtacgaggggcttgactggctttcaaacaacatcgccaacaaggcttgaagcgtctaggcagggcttcaatcagtggaaacactctggatacttgggtgcaaactgcctctaccattacagctatgaactaatagtcgtgactgtgtcagatgtgggggtgttttttgggaggataaaaggctcttttggtcaaggagctaggtatcagatgttttcgtggtattgttaattttctgtgcttttgttttcgggttgtgcaaggtataccatgtccgactgtgtgctgtgtactcgccaccgttctataatgtgctgtatactctcgcc

SEQ ID NO: 13420 - DNA, 868 bp, Triphysaria pusilla
cagcatttggtgtctcatctcatctcggcgagatctgcactttttcatcatcttcttctcaacccctatcgcaatctcgaaaaaatgggtttgtctttcaccaagcttttcagccggctgtttgccaagaaagaaatgagaattcttatggtaggtctcgatgcagctggtaagaccacgatattatacaaactcaagcttggagaaattgtgacaaccattcctacaattggatttaatgtggaaacggtggaatacaagaacattagcttcactgtctgggatgtcgggggtcaagacaagatccgaccattgtggaggcattactttcagaacactcaggggttgatcttcgtggttgatagtaatgatcgtgatcgtgttgttgaggctagggatgaactccacaggatgttaaatgaggatgaactgagggatgcagtgcttcttgtttttgcaaacaaacaagatcttccaaatgccatgaatgccgctgagataaccgacaagcttggacttcactctctccgtcaacgccattggtatatccagagcacatgtgctacatctggggaagggctgtacgaggggctagactggctctccaacaacattgctaacaagggataagaagcgatgttcgaataatttaggtatctcgatccttgttgaaatcgagcatgtcttttcgacattctgattttttaattagttgtactgttaacagatagtcattttcatctctggagactgagatttgcttaatttctgcacttatacttgtctcattgtgtttatttggctgcgtgcttaatatctatgatgtgtcatttagcatgtttggaaacacttttcagatctactttta

SEQ ID NO: 13421 - DNA, 1046 bp, Tripterygium wilfordii
gaggcagcttcacaagatctgccctatagcctatctgagttgaaaagatggggctgtcttttgccaagcttttcagccggctttttgccaagaaagagatgcgaattctgatggtaggtcttgatgctgcgggtaagaccaccatcttgtacaagctcaagttgggagagattgtcactacgattcctacaatcggattcaacgttgagaccgtggaatataagaacataagcttcacagtttgggatgttgggggtcaggataagattcgtcccttgtggagacactacttccaaaatactcaaggtcttatttttgtcgttgatagcaatgatcgtgatcgtgtagttgaggctagggatgaactgcatcgaatgttgaatgaggatgagttgagagatgctgtgctgcttgtgtttgcaaacaaacaagatcttccaaatgctatgaatgctgcagagattactgacaagcttggccttcattcactccgtcaacgccactggtatatacagagcacctgtgccacatctggtgagggactttatgagggactggactggctctccaacaatattgctaacaagtcataatggacttttttggggcaacctgcggcaaaatttgattcaactttaggctatgtggtgttctggatttctttcttttaaccctgtaatggtcgtgtgaattgtatcttgtctttatattattatatagccttataggagttgggtgtttgtccatgtagatccctaatgtttgatggtttccatacgattgttcgtgtattgccctgtatcaatcttggggagacagattcagacgtgatcataatctctctgcgttgtagtacatgatgttgaaagacttcataattacgttataagcgttgttgcattcagtgagagcattcttcaatgctcctgcttttgtgcccctcacagtccctcgacggaagtatttgtgtttgatagtcatcaatgtcaaaccctctctgctgatgggccttataggtttttattgaatgtttgtttgtttgtttg

SEQ ID NO: 13422 - DNA, 821 bp, Valeriana officinalis
tattttcaaagggcagtcttccaagatctgcccctccaaatcatctctccattctcatcagtttttgttgaagcataaattgagaaaaatggggctgtcctttacgaagctatttagtcggctttttgccaagaaagagatgagaattcttatggtaggtctcgacgctgctggtaagaccaccatattatacaagctcaagctcggagagattgtcactaccattcctacaatcggttttaatgtggagaccgtggaatacaagaatatcagcttcactgtgtgggatgttggaggtcaagacaagatccgacccttgtggagacattacttccaaaacacacaaggtttgatctttgttgttgacagtaacgatcgtgatcgtgttgttgaggccagggacgagcttcaccggatgttgaatgaggatgaactgagggatgcagtgcttcttgtgtttgctaacaaacaagatcttccaaatgccatgaatgctgccgagattactgataagcttggtctccattctcttcgacaacgccactggtacatacagagcacatgtgccacttctggagaagggttgtatgagggattagactggctctccaataatattgctaacaagtcttgatgggcggatgaatattcgatgaccttaggagcatggctctatcgttttttttattttccgaagattttcatagcataatacatatatatattacatatatcttgtctgaatgatgatttccagtcgtgttttgtattctgttggttatatcgcaaccagattgctttcatgatataagttggaattt

SEQ ID NO: 13423 - DNA, 1064 bp, Brachypodium distachyon
ctatatagcccgcctggtccgcaccggcagtccggcaccgcaccgcacggcagccacagcctcgcgttgtattcgtactgttccaagaaaaagaaaaaaagctccaactccacccgtctccgccgagatcaggagcccgcggcgcagcggagcggagagagctcgaagtgcggaggaggccgtctgtcctcgccaactcgggggagagatggggctcacgtttaccaagctgttcagccgcctcttcgccaagaaggagatgaggattctcatggtcggtcttgatgctgctggtaagaccaccatcctctacaagctcaagctcggagagatcgtcaccacaattccaaccatcgggtttaatgttgaaactgtcgaatacaagaacatcagtttcactgtttgggatgtcgggggccaggacaagatcaggcccctgtggaggcactacttccagaatacacagggactcatttttgttgttgacagcaacgacagggaacgtgttgttgaggccagagatgagctccacaggatgctgaatgaggatgagcttcgtgatgctgtgttgcttgtatttgcaaacaaacaagatcttcctaatgccatgaatgcggctgaaattactgacaagcttggtctgcactccctgcgccagcgacactggtacattcagagcacttgtgctacatctggtgaagggttgtatgagggacttgactggctctccaataacattgccaacaaggcttgaagcgtctggacatctgctccagcaactcactgccgccattttacatatatgtgacactctaaacagattatatgggtgcttgtgaaaacaggagctctcctttgagagagctagtatcaggttgtttcttcgtgtgggtattaacagtgtttctgtttggtttacaaggtttaccgtgttgaccatatgtatgcacccgtgtgttttcgagatgatacagtagcgttgtggaatagtgccagttcggatctggttccttgtgtaccctcgtgtggctgtcggtatcactatttgtcgataatgtttgcgg

SEQ ID NO: 13424 - DNA, 903 bp, Cleome spinosa
ctcccgagtcttcgcgttgatttgaagcttctctctctatcggagatcccttcgcatcgatttcgaaagggtcaccagctgaaggaaaatggggctttcatttgctaagctttttagccggctttttgccaagagggagatgcgcatccttatggtaggtcttgatgctgctggtaagacgaccattttgtacaagctcaaacttggtgagatcgtaaccaccattcccaccattgggttcaacgtggagactgttgaatacaaaaacatcagcttcaccgtttgggatgtcgggggtcaggacaagatccgtcccttgtggaggcactatttccaaaacacacaaggtttgatatttgtggtggatagcaatgacagagatcgtgttgttgaagcaagagatgaacttcacaggatgttgaacgaggatgagctgcgcgatgcggtgctgctggtatttgcaaacaagcaggatctgccaaacgcaatgaacgctgctgagataactgataagctcggcctccactctctgaggcagcgccactggtacatacagagcacatgtgctacaagtggggagggactgtacgagggtctggactggctttcaaacaacatcgctaacaaagcctgagggttaactgtatgcgatggaccggacgcacgctcggagcggtgaaagcaatatgtttttcgtttactttatcaagaagaagaaaaagtatcactttggtggagtgtctttgctattatgtttggttactgaagtgttttgaatttttgggattgtgtgatgtttccttctgtcacgtaaccaaagtagagaacttcttaagactgcgcattttatcttctccttctttgggtttgcatattctaattccaagttcaaaatctggaagc

SEQ ID NO: 13425 - DNA, 917 bp, Rosa hybrid cultivar
cacacattttcaagctctctcattcattccccttctctctctctctctctctctctctctctcgcttttagatccctctgtgtgaaatctcagggatccgcagtcagaatggggctcacgttcacgaagcttttcagccggctttttgccaagaaagagatgcgaattctgatggtcggtctcgatgccgctggtaagaccaccattctctacaagctcaagctcggtgagatcgtcacaacaattcctactattggatttaatgttgagaccgtggaatacaagaacatcagcttcacagtctgggatgtcgggggtcaggacaagatccgacctttgtggaggcactacttccagaacacacagggtcttatctttgttgtggacagcaatgacagagaccgtgttgttgaggcaagggatgaattgcacaggatgttgaatgaggatgagctgcgagaagctgtgttgcttgtttttgccaacaaacaggatctccccaatgcaatgaatgctgctgaaattactgataagcttggcctccactctctccgacagcgtcactggtacattcagagcacttgtgcaacctctggagagggtctatatgaaggcctggattggctctccaacaacattgctaacaaggcttgatccctatttgggagtcgttttgaggactggcaattctggatgcaggggtgaatattatctagttcgttttttgtttctccgagacaattgaatttgttgttaaatctatttctcccggaaatgatcatttcatttgtaggacctttaatggttatatttgtaatagaagaatggttggtcaaatgtatacatttgagcttttgattgaatttggatacagtgttctgagttgtaattggatttcagacataccctccaaaaaa

SEQ ID NO: 13426 - DNA, 919 bp, Solanum phureja
cttattaccctctccaaatttggcgttaatctcaggcttcactctctcgttctttcttcattagatccctcttccataatcatctttcagttctcttttagcatagggacaccaacaaggagaaatggggttgacattcaccaagcttttcagccggcttttcgccaagaaagaaatgcgaattctcatggttggacttgatgcagctggtaagaccaccatattgtacaagctcaagctgggcgagatcgttactactattcctaccattggtttcaatgtggagactgttgagtacaagaacatcagcttcactgtttgggatgtcgggggtcaggacaagattcgtccattatggagacactatttccagaacactcagggtctcattttcgtggttgatagcaatgacagagatcgtgttgtggaggcaagagatgagttgcataggatgttaaatgaggatgagcttcgggacgcagtgcttcttgtttttgctaacaaacaagatcttcccaatgcaatgaatgctgccgaaataactgataagcttggactgcactctctcaggcagcgtcactggtacattcagagcacctgtgcaacatctggagagggactttatgagggtcttgattggctttccaacaacattgctaacaagtcctaaggcactggaagagttcttgcgggttgatactggatgcaggcagatttttatctagtttctttcccaagtcagtgtggttatgaacattgtcttgaaaggcattttgcatcttgttagaacttaatgaaatggctttgtaatacaagggttggatatatatgtaatgttgtttgtttaggtttgagtatatacttccataaatttgtatacaaagactagttcattaatgacgtttttgttagtcattga

SEQ ID NO: 13427 - DNA, 936 bp, Manihot esculenta
cgtccgctccgtccctctcatctcttttccattttgctccggagctcttctaggtttctcctagatagaaaagatggggctttcattcaccaagcttttcagtcggctatttgctaagaaagagatgcgaattcttatggtgggtcttgatgctgctggtaagaccaccatcttgtacaagctcaagctgggagagattgtgactaccattcctacaattgggtttaatgtggagactgtggaatacaagaacatcagcttcactgtctgggatgttggtggtcaggacaagattcgacctttatggagacattacttccaaaacacacaagggctgatatttgtggttgatagcaatgatcgtgatcgtgtggtggaggctcgggatgaactgcatcgtatgttgaatgaggatgagttgagagatgctgtgttgcttgtatttgcaaacaagcaagatcttccaaatgctatgaatgctgctgagattactgataagcttggtcttcactcacttcgtcaacgccattggtatatccagagcacatgtgccacctcaggtgaaggtctttacgagggacttgaatggctttccaacaacattgctaacaaggcgtagagggatgtttcagtttcctgccacatctctgattgcagtctgctttaaaatttggttaattgttgtccctggatttctcatcctgtaattgttgagagaatgcgtcttagatattgtttactgtaatagaaattggcaaattgttcatgtagactttaaataattgatgattgactgtccgtatatgttacatgatatgcctcttgatcaaaggagtttgtttcttccaatgagcagtcgatgctttatggtaattttgctgtgaatataaagaggcattatgcagttggtgcgaaaggaccctcgctcttaattga

SEQ ID NO: 13428 - DNA, 812 bp, Aquilegia formosa
cagacatggggcttacatttacaaaactttttagccggctttttgccaagaaagaaatgcgtattttgatggttggtctcgatgcagctggtaaaactacaattttgtacaagcttaagcttggggagattgtcacaacaattcctaccatcgggtttaatgtggagactgttgaatacaagaacatcagctttactgtttgggatgttggtggtcaggacaagatccgtccattgtggaggcactatttccagaacacacaaggtcttatctttgtggtcgatagtaatgacagagatcgagttgttgaagcgagggatgaattgcataggatgttgaatgaggatgagttgcgagatgctgtgttactggtattcgctaacaaacaagatctccccaatgcaatgaatgccgctgagattactgataggctgggccttcattctcttcgccaacgccactggtacatccagagcacatgtgcaacctctggggagggcctgtatgaggggttggactggctttccaacaacattgctaataaggcttgaggtagctgggtttgcatcgtattggtgtattctggatgcaggggtggatgttatctaggcttttttacaagtcgtctcgttcatcttttcggtgaagagtagactcaagagatttttttatttagactaatagtaaccgtgctgtaataggagaatgtgttgtgatatattcttataagctttcccaggtcgagaacttgcttcttaagctaatccttttagctgtgactaaagattatttcattatatcatctatatttg

SEQ ID NO: 13429 - DNA, 1095 bp, Conyza canadensis
gctatatcagaaaaccttcagctggatttgccaaaagtgtcaatattgagaaataacctgaggcaatatcaagatgggtctgactttcaccaagttgtttagccgattatttgccaagaaagagatgcggattttaatggtaggtctcgatgctgccggtaagactactatattatacaagttaaaacttggggaaatcgtgacgacaattcctaccattggattcaacgttgagactgttgaatataagaacatcagcttcactgtctgggatgttggtggtcaagacaagattcgtccattgtggagacactacttccaaaacacacagggtcttatctttgtggtggatagcaatgacagggatcgagttgttgaagcaagggatgaattgcataggatgttgaatgaggatgaacttagagatgccgtcttgttagtttttgctaacaaacaagatctgccaaatgccatgaatgctgctgaaattaccgacaagcttggtcttcattcacttcgtcaacgccactggtacattcagagcacatgtgcgacatccggtgaggggctttatgaagggctggattggctcttaaacaacattgctaacaaggcaagttaatatgacaactaaggttgcttatagtttaatatagggattatggcatcggaatgtaaccaactatgactcaatgattatgtaatgtagtgacctttcaaattggctatctgatataagtaccttccatttttgttcttttaatgtatcctaccgggtaacatcctatttgtaaccggtaatgccacgttggacgtaaaaaagaatagggattaaggcaccggagtgtaaccaactatgagcaaatggttatgtaatgtagtgacctacgaaagtgttaaattgatgtaagaacctctctgttttgttcactcgatgtatgctaccgtgttactccgacgactttatactccggtcatcttctccagataatttcagacactatcttcggtaacaacaattttttcggagagcaaatgtgaaattgtaactaaatgtttaacttcaatcccaaacacaaatcaacactagatata

SEQ ID NO: 13430 - DNA, 778 bp, Lippia dulcis
agaaacaagtgttaaaattggtttctgggtgtgatatgcagagaaaatggggttgtctttcaccaagctttttagccggctgtttgccaagaaggagatgcgaattcttatggtaggtcttgatgctgctggtaagaccacaatattgtataaactcaagttgggagaaatagtgacaacaattcctacaatcggattcaatgtggaaacagttgagtacaagaacataagcttcactgtctgggatgttggtggtcaagacaagattcgaccattgtggaggcattacttccagaacactcaagggttgatttttgtggtagatagtaatgatcgagatcgtgttgttgaggctagggatgagcttcatagaatgttaaatgaggatgaactgagggatgcagtgctgctagtttttgccaacaaacaggatcttccaaatgctatgaatgctgctgagataactgacaagcttgggcttcactcccttcgtcaacgccattggtatatccagagcacatgcgccacctctggagaagggctatacgaggggcttgactggctctcgaacaacattgctaacaaggtaggttgagtgactcctcgaaggagctgatggaaattgattgcatcttctgagttttgtattttccttggcttacatgtactgtgcttactttttttaaatatgtagtatatcgtagatactggtatcctactattactatgtacaagactttcagactctgaaatcaatggtttgacaatccaaaaagaa

SEQ ID NO: 13431 - DNA, 878 bp, Amaranthus tuberculatus
tggggctttctttcacgaaactgttcagcagactgttttcaaagaaggaaatgcgtatattgatggtgggtctcgatgcggctggtaagactaccatcttgtataagctcaagttgggagagattgtcaccaccattcccaccattggatttaatgtggagactgttgagtataagaacattagcttcactgtgtgggatgttggaggtcaagacaagatccgtccattgtggagacactacttccagaacacacaaggactcatctttgtggttgacagtaatgatcgagaccgtgtcgttgaagcgagggatgagcttcacaggatgctgaatgaagatgaattgagggatgctgttctgctagtgtttgctaacaagcaggatcttcccaatgcaatgaatgctgcagaaatcacagacaagcttggtctccactcactccgtcaaagacactggtatatccaaagtacgtgtgcgacatcaggtgaagggctatacgagggtttagactggctatcgaacaacatagcaagcaagggttaaacgatggcttcaccggtttacatctaggacaaggatgattgaaaattcgttttcggttatgtgactcttatacattcatgttaaaagtttttcaatagcatatatttttctactttgtgtattttgagtttgagacatgagattaatttggtacctttctagtattgtcattttgtcaagagttgtttatagttcattgtcattctctttgagctcacgttctcctttcatttggatgcatttgttctcactttctaaaccggctatagatgctgacttgaattgttgaatttcaatcgttcgataaacgtaagacattcttttcgactaact

SEQ ID NO: 13432 - DNA, 904 bp, Amsonia hubrichtii
catttccccagattacgcgtcggtctcaggctctcattacttctcattttctcttcgctccgatccctcacctctctcgaaggccatctcagggatcatccataagaaagcaatatgggattaacgttcacaaagctgttcagccggctctttgccaagaaggagatgcgcattctgatggtaggtcttgatgcagctggtaagaccaccatcttgtacaagctcaagctcggagagatagtgaccacaattcccactattggttttaatgttgagactgttgagtataagaacattagcttcactgtttgggatgttggtggtcaggacaagatccgtcccttgtggaggcactacttccaaaacacacaaggtcttatctttgtggtggatagcaatgatagagaccgtattgtggaggcaagggatgagttgcataggatgttgaatgaggatgagctgcgagatgcagtgttgcttgtatttgccaacaaacaagatctccctaatgcaatgaatgctgctgagattaccgataagcttggtctgcactccctgcggcagcgccactggtacatccagagcacctgtgcaacttctggagagggtctttacgaaggactggaatggctttctaacaacattgctaataaggcataaagcaacataggaaatatttttcatgggatgatactggatgcaggcggctttttatctagtcttttctatgttatggtgttatgaattgcaattttaagtcagtatatcttttaactgtctacttgtaatagattgctcggttttatgtaattgcaagtgtttgtctaggttttgaatataatgtcaagaggtatgaacatgtgaacgctgatttttttactggtagaactgtaaacagattgat

SEQ ID NO: 13433 - DNA, 1060 bp, Catharanthus roseus
aagcaaacggtagagattgcaactgtcaattgatgattgaaccacctcactcaggttgaaaattctcattcccattttgcgcgttgatctcaagctttcatttctaatcaatatctcagaatcgcagatccttccttctcttatcgaaggcttctccgggatcattagtagaaaagaaaaatgggattatcctttgcaaagttgttcagccggctctttgccaagaaggagatgcgcattctaatggtaggccttgatgcagctggtaagactaccatcttatacaagctcaagcttggagagatcgtgaccacaattccgaccattggttttaacgtggagaccgtggagtataagaacatcagctttactgtttgggatgttggtggtcaggacaagatccgtcccctatggaggcactacttccaaaatacacagggtcttatctttgtggtggatagcaatgacagagaccgtatagtggaggcaagagatgagttgcatagaatgttgaatgaggatgagctacgagatgcagtattacttgtatttgctaacaaacaagatcttcctaatgcaatgaatgctgctgaaataactgataagcttggtcttcactcccttcggcagcgccactggtatattcaaagcacctgtgcaacttctggagaggggctctatgaggggctcgattggctttccaataacatttctaataaggcataaagtgacatatatggagttatattaaggggtcgatcctggatgcagccaagcattcccccaagatatagaaacaatttcccttttttacaggagctttggttcttttcctacgcttgcaaagtgtgatctcctccgcttcttctcttctataagagctgaaatcattgaagctattccttaggatctagtgcacctgagactttgccaatcccacatttagaatatcggaaaggtggttattcccggaaaactggccttttatctagtcttttttcttctattacgaatttcaggttaagtccctatatcaatagatatacataaatagctagct

SEQ ID NO: 13434 - DNA, 799 bp, Castanea mollissima
aagatggtcgatctaatttagtaatttacccaacaaaatttaaacgcgtctctctttaaaattcaaaatttaaaagcatcccgttttttgcgaagtacttcctagtatatataggaacagagaaacggatagaaagagaaaatccaaaaaaagcatttgatccttaatctgaatctgaatctaatttagctctgagcaccatttccattcgaaatacagaatggggctgtctttcaccaagcttttcagccggctttttgctaagaaagagatgcgtattcttatggttggtctcgatgctgctggtaaaaccacaatattgtataagctcaagttaggagaaatagttaccaccatccctaccattggatttaatgtggaaactgtggaatataaaaatattagcttcactgtgtgggatgttggtggtcaggataagattcgacctttatggaggcactacttccaaaacacacaagggcttatatttgtggtagatagcaatgatcgagaccgtgttgttgaggctagagatgagctgcacaggatgttgaatgaggatgaattaagagaggctgtgttgcttgtgttcgcaaacaagcaagatcttcctaatgcaatgaatgctgctgagatcactgataagcttggccttcattctctccggcaacgccattggtacatccagagcacatgtgcaacttctggtgaaggattgtatgagggactggattggctctcaaacaacattgctaacaaggtttagaggattgcgggctggtctctctatacttttctt

SEQ ID NO: 13435 - DNA, 903 bp, Gossypium hirsutum
actcaagctctctctgcctctctttcttccatttgcttcaaaatcaaattcaaaatctctctgcgattttctccaaagggatcagcaattagggaagagaaatggggctgacattcacgaagctttttagccggctttttgctaagaaggagatgcggattttgatggtgggtctcgatgcagccggtaagactaccatcttgtacaagctcaagcttggagaaattgttaccaccattccaaccatcggatttaatgtggagactgtggaatataagaacatcagtttcactgtgtgggatgttggtggtcaggacaagattcgtccgttgtggaggcattacttccagaatacacagggtctcatcttcgtggttgacagcaacgacagagaccgtgttgttgaggctagggatgaattgcatagaatgttgactgaggatgagctgcgagatgcagtattgcttgtatttgcaaacaagcaggatcttccaaacgcaatgaatgctgctgaaataactgataagcttggtcttaattcccttcgacagcgtcactggtacatccagagcacctgtgcaacatctggtgaagggctctatgagggtctggattggctttcaaacaacatagctaacaaggcctgaagccattaagaagtggtatttgcagtatcaaaaattctggatgcaggggtgaacattatctagtcttattttcttcaattattattatgccctcatttttcgactgtgacagctggattgttgttatgcgtttctatttttggagatgaccatattagtttggaccttgtggttatatattgcaaacaaaaaattggtttgattggatgtataactctttctgtaacaaaaacttatttgcaattgcatgaattgc

SEQ ID NO: 13436 - DNA, 914 bp, Solanum melongena
tgccgtagcaaaggaaaaggcgacgaacgacagctccatttcgagatttacatattcgaattctccgatcgccggtcgcagatctccgatcaccgttgtacagagatggggctatctttcaccaaactctttagtcgcctctttgctaagaaggaaatgcgtattctcatggttggtctcgatgccgctggtaaaaccacaattctctacaagctcaagttgggggagattgttaccactatacctactattggtttcaatgtggaaacagttgaatacaagaacatcagctttaccgtgtgggatgttgggggtcaggacaagattcgacctctatggagacattatttccagaacacacaagggctcatctttgtggttgacagcaatgaccgagaccgtgtagttgaggctagggatgagctacataggatgttaaatgaggatgaattaagagaggctgtgctgcttgtttttgcaaacaaacaagatcttccaaatgcaatgaatgctgctgaaatcactgataagcttggacttcattctcttcgacagcggcactggtatatccagagtacgtgtgccacttccggggaagggttgtacgagggacttgattggttatcgaacaatattacaaacaaggcttagtgcatcaagtagatcctgctcttgctcgcttgcgctggctcacttacctatatctggattatagatattaaacaccattgcttttgccacaatctcttagtttgattgttttggatagaagtgattaagctctgaataatacctcgcagttatttcccctttttttttgttgttttaaacaatatcccatggttaaaattacttgtggttgttggttagttactacatcgcttgcaatgtgagtataatattggtttttgtat

SEQ ID NO: 13437 - DNA, 907 bp, Solanum melongena
accctctcagaatttcgcgttagtcttaggcttcactctctcttatgtttttttctcattctttcttcattagatccttttcctaaagcttctttcaggatcattaacaagaaggagaaatgggtctgacattcaccaagcttttcagccggctttttgccaagaaagaaatgcgaattctcatggttggacttgacgcagctggtaagacaaccatattgtacaagctcaagttgggagagatcgtcactactattcctaccattggtttcaatgtggagactgttgagtacaagaacatcagcttcactgtttgggatgtcgggggtcaggacaagattcgtccattatggaggcactatttccagaacactcagggtctcattttcgtggttgatagcaatgacagagaccgtgttgtggaggcaagagatgagttgcataggatgttaaatgaggatgagcttcgggatgcagtgcttcttgtttttgctaacaaacaagatcttcccaatgcaatgaatgctaccgaaataactgataagcttggactgcactctctaaggcagcgtcactggtacattcaaagcacttgtgcaacatctggagaggggctctatgagggtcttgattggctttctaacaacattgctaacaagtcttgagacaatggaagagttcttgcgtggatacagacaggtttttgtgtagtttctttccccaagtcagtgtggttatgaaaattgtcctgaaagacattttgcatcttgttaggacttgatgagatgaaatggctttgtaatacaacggttggatatatatgtaaagctatttgtttaggttggagtatactttcataaatttgtaaacaaagactagttgattaataacatttttgttaattgtt

SEQ ID NO: 13438 - DNA, 900 bp, Euonymus alatus
cggccggggcccatacaaacgcgttggtgtcaagctttgtctctgtttgcgcttcgcaaattctctgagaagctcttgaaagagggactaatagtggtaaggagaaatggggctgacatttaccaagctcttcagccggctctttgccaaaaaagagatgcgcattctgatggtgggtcttgatgctgctggtaagacaaccatattgtacaagctaaagcttggtgagatcgtcaccactatcccaactattgggttcaatgtggaaactgtggaatacaaaaacattagtttcactgtgtgggatgttgggggtcaggacaagatccgtcccttgtggaggcactacttccaaaacacacagggtctcatttttgtcgtagacagcaatgacagagaccgagttgttgaggctagggatgagttgcacaggatgttgaatgaggatgagctgcgagatgcagttttgctcgtatttgccaacaaacaggatctgcctaatgcgatgaatgctgctgagattactgataagcttgcgctcaactccctccgtcagcgtcactggtacatccagagcacttgtgcaacctctggagaggggctttatgagggtttagattggctatccaacaacattgctaacaaggcgtaaatctgttgggaaaacgattgtggactggcaattctggatgcaggggtgaatattatctagtgttttttcttccttacattttttgttttgtttctctcattttgggacagtctgatttgttatgtgatgatgatcctttattttgggccggttggtgatattgtaatagaagattgattgttatgtgtttttgctcttatatatggtgtttgaatgcaaagttgttggcttaattaacacctttggtg

SEQ ID NO: 13439 - DNA, 834 bp, Euonymus alatus
cctaagccacactcttctcgcgggcaagttctctctctctaaattttcggcttgaagaaaatggggctttcattcacgaagctttttagtcggctctttgccaagagagagatgcgtatcctcatggtgggtcttgatgctgccggtaagaccaccattctctacaaactcaagctgggagagatagtgaccaccattcccactattgggtttaatgttgagactgtagaatacaagaacattagctttacagtctgggatgttgggggccaggacaagatccgacctttgtggagacattactttcaaaacactcaagggcttatctttgtggttgatagcaatgaccgagaccgtgtggttgaggccagggatgagctacacaggatgttgaatgaggatgaattgagagaggcagtgttgctagtgtttgctaacaagcaagatctgccaaatgctatgaatgccgctgagataactgataagcttggtcttcactctctccgtcagcgccactggtatatccagagtacatgcgccacttctggtgaggggctgtacgaaggcctcgactggctctcaaataatattgcaaacaaggcatagacagtgggaattctgagttttggattgcagcgagttctggaacacacagctggttgttccttatttttgttttaccgtgccgttacttaatagaatctgttacttgagtcggattatttgtgtttctcatgcaagcattgcaattgtttaccccgtagttacagaataattcctacatttcaaattttaatctttctgcctattttctcggtcgttatctggttttag

SEQ ID NO: 13440 - DNA, 897 bp, Euonymus alatus
tctcgggcttgaagaaaatggggctttcattcaccaagctttttagtcggctctttgccaagaaagagatgcgcatcctcatggtgggtcttgatgcggctggtaagaccaccattctctacaaactcaagttgggagagatagtgaccaccattcccactattgggtttaatgtggagactgtagaatacaagaacattagctttaccgtctgggatgtcgggggccaggacaagattcgacctttgtggagacactacttccaaaatactcaagggcttatctttgtggttgatagcaatgaccgagaccgtgtggttgaggccagggatgagctacacaggatgttgaatgaggatgaattgagagaggcagtgttgctagtgtttgctaacaagcaagatctgccaaatgctatgaatgcagcagagataactgataagcttggtcttcactctctccgtcagcgccactggtatatccagagtgcatgcgccacttctggtgagggtctgtatgaaggacttgattggctctcaaataatattgcaaacaaggcatagacagcggaattctgagttttggattgcagcaagttgcggaacgcacagctagttgttccttattttgttttgccgtacgatttctttgtagaatctctgttacttgagtcagactattatgtgttttctcatgcaaacgttgctattgtttacccctagttgcagaataattcttacatttcaaattttcatctttctgcccattttctcgtttaatgaaactccctttcaaccttcctacatgcgggattcttgtattggaagaggtgaagtacaggcagtagtaataacaaaactgagctgaatatgcatagcattcagaatcatgatatta

SEQ ID NO: 13441 - DNA, 829 bp, Fraxinus spp
aaaaattataatttctcgcgttaatcgtagccagttccctcactgcctttctcacaagatccatatctcagggatcaaaagctagaaagagaaatggggctgacattcacgaagctgctcagccggctttttgccaagaaggaaatgcgcattctgatggttggtcttgatgctgctggtaagaccaccatcctgtacaagtttaagctcggagagatcgtaactaccattcctaccatcggttttaatgtggagactgttgagtacaagaacatcagcttcactgtttgggatgtcggtggtcaggacaagatccgtccattgtggaggcactacttccaaaatactcaggggctcatatttgtggtggacagcaatgacagggatcgtgttgtggaggcaagggatgaattgcacaggatgttgaatgaggatgagctgagagatgctgtattacttgtatttgccaacaaacaagatcttcccaatgcaatgaatgctgctgaaataacagacaagcttggcctgcactcgctgaggcagcgtcactggtacatccagagtacctgtgctacctccggagaggggctttatgagggtctcgactggctctcaaacaacattgctaacaaggcataatgcgttatggaattgttgagttgaagccccgatgcgagttggtttttatctagtcttatacctatagtctgtgtgtaatggattttaacacgagtcttttgatttttgtttaggacgacttatgctatatcacattttatatgattgcaaacatatgtttactatataatgctattgaaacctcatctga

SEQ ID NO: 13442 - DNA, 854 bp, Panax ginseng
ccccctcctaccctgtttactcatcgagaatgtgtttttcagtctccgcatctgatagacagagcggttttttggaacgacagctccatttagagatctctgcattctaacgctcccatcgcgcacctcatcctcaatatagagatggggctgtcttttaccaagcttttcagtcgcctatttgctaagagagaaatgcgcattctaatggttggtctcgatgccgctggtaaaaccccaattttgtacaagctcaagttgggtgaaattgtcaccactatccctacaattggctttaatgtggagactgttgaatacaagaacattagcttcactgtgtgggatgttggtggtcaagacaagatccgacctttgtggaggcactatttccaaaacacacaagggctcatctttgttgttgacagcaatgatcgagaccgtgtggtcgaggctagagatgaactgcacaggatgttgaatgaggatgaactgagagatgctgtactccttgtgtttgcaaacaagcaagatcttccaaatgccatgaatgctgctgagattactgacaagcttggtttgcattctcttcgacaacgacattggtatattcagagcacatgcgccacatctggagaaggtctatacgagggactggattggctttcaaacaatattgctaacaaggcttagtgggctactctaccggctcagttggtactcaaagaaatacattggtgcagtcaatctggttataagtgttgttgcaatgactctttgtataattgcttttggtggtttggatttcaatttcttgtcgtggtgagagaggaaaaagatgatgttaaatttccctt

SEQ ID NO: 13443 - DNA, 831 bp, Eragrostis curvula
cgtgaagcagcagacccgcgcgctcgagatctccacgaagccgcggcaacatgggtctcaccttcacgaagctattcagccgcctcttctccaaaaaggagatgaggatcctcatggtcggtctcgatgcggctggtaagaccaccattctctacaagctcaagctcggagagatcgtcaccaccatccccacaattgggttcaatgtggagactgttgagtacaagaacattagcttcactgtctgggatgtcgggggtcaggacaagatcagaccattgtggaggcactatttccagaacactcaagggcttatctttgttgttgatagcaatgacagagatcgtgttgttgaggccagggatgagcttcacaggatgctgaatgaggatgagttgagggatgctgtcttgctcgtttttgctaacaaccaagatctgcccaatgccatgaatgctgccgagatcaccgataagcttggtctccattccctgcgccaacgccactggtatatccagagtacttgcgccaccacaggagaacgtttgtacgagggtcttgactggctctccaacaacattgcaaacaaggcctgattggacttgactacggttttgtggagtacatgacggttgcattttcctcatacggatccatgggtctttttgaccaccagactttattataatttcattggaatgtttgttgagtatttgccaggcttacgagagagctggattgttatggtgcgtaattactatctaaagacaatttcgaatatcacgactctgtaattggccctctttcaccaaacaacaaccaaacacaaaa

SEQ ID NO: 13444 - DNA, 1001 bp, Lupinus angustifolius
ggatctgtgttcacgtgctataaattcgcgcaaacggtgcaaaagcagcttcatctctcttctcttcgttgttttgggaagagattttcattcacaattccgtctcttttacaagaaagaaaaggaatagttcaaaatggggctatcttttacaaagctattcagccggttgttcgcgaagaaagagatgcgtatacttatggtgggtctcgatgcggctggtaagaccaccattctgtacaagctcaagcttggagagattgtcaccaccattcccaccattgggtttaatgtggaaactgttgaatacaagaacatcagcttcactgtctgggatgtcgggggtcaggacaagatccgtcctttgtggagacattacttccaaaacacacaaggacttatttttgtggttgacagtaatgacagggaccgtgctgttgaagctagagatgaactgcataggatgttgaatgaggatgagttgagagacgctgtgctcctagttttcgcaaacaagcaagatcttccaaatgctatgaatgctgctgagataactgataagcttggtcttcattctcttcgtcagcgtcactggtatatccagagcacttgtgccacctctggtgaagggctttatgaaggacttgactggctctcaaacaacattgcaaacaagggctagagttttactggcatcagtgcaagaaattctgtttactgtagccactaccatccatctcctgtgtttttggccctgcatagattttcattgctcgagcatgtattatttgtcttgggaaaaaaacagctatttttttaccagtctgaagaataatttgaattttttattgtataaccaaaatagcattatttaccgttacccattgatttgtgaaatcgatttacttattttaagtcttatgttgtatgtataactataatactatttggagcaatgttattccaagttaatttgctgaggaaaagtaaaacaaaaggaa

SEQ ID NO: 13445 - DNA, 1807 bp, Marchantia polymorpha
ggtcccacacgtgaacatggaggacacgaagctggacggttatgacattcccaagggctcttctatctggatcaatgtctgggccatggctcacaacccggagatcttccccgacccttttgtgctcaagcctgaaagatttctcaacaaagaagtgggtttggccggcgaagaccccagctacattgtgttcggtgctggaagacgaatttgccctggatctccactcgccatgaactgcacgcacatgatagtcggtagcctagctcagaggtatgatatcaagttccctagcgattggactaaagacaagaagaccgtcttcggcttcatccccaaggagcgtgctcttgaggtttgcttcaccaagagagaagggttttagaattcattggcacagccgcttgaacttccatctgaacatgtgaaaaatcgcctgacgaggatccgggcacatagcaatattatatgagatagcctgcattgggcctaaagctccaagattcctgagtggtcaagccaatctataatagctactcatagatctctctctctccctcccactctctcctctctctcgcgcagagcggagcctgagttcgtgtgtatctgtccgtccgtctgtttgtctttccttccttccttccttgagccccagccaggccccagccccgcccaggccagagcgccgcttcgacgcttgtcttctctttggtgcttcgacgcttgtcttctctttcgtgcgtcggtgggggcggagcagttggtggtggccggtgattgtgtagagagcgcgagccaagatggggctcacgttcaccaagttgtttcagcgtctcttctctaagaaggagatgcgaatcttgatggtgggtctcgatgcggctggtaagacgaccattttgtataagttgaagcttggcgagatcgtgacgaccattcctacaatcggattcaatgtcgagactgtagagtacaagaacattagtttcactgtgtgggatgtaggaggtcaggacaagatccgccctctgtggaggcactatttccagaacacgcagggtttgatcttcgtggtggacagtaacgatagagatcgtattgttgaggcccgtgatgagttgcatagaatgttgaatgaggatgaacttcgcgatgccgtattgttggtatttgccaacaaacaggatttgccgaacgccatgaatgcggcggagattaccgacaaattggggcttcactctttgcgccagcgccactggtatatccagagtacatgtgctacttcaggagagggtttgtacgagggtcttgactggctgtcaagcaacatcgcaaacaaggcttgattcagtacggcttacacactaggtggaaagccacaaggtagcgcagacagtgttagtctcgcggcagtgggatttctgtggtgttggagggctcgtcaagctgcagctggcgtgactggggttctttataatatggatgataaacagtcgcagattctcctaagatttcgttgagtgaagggcaagtttagatcaacgaagtctgcagaattctttttctgaactttctctctttcgacaacctaagtcattgcttgctatcctctgactccggtggtaggagaaacgttaaaatcttgaagaggtgttcaagataggattgacagataggcatgatagattttgttgcgaaagttttccgaactcgtagtttttgagtgttttccttcctacaacaatcaagaggttgttgggacctatccccccactcgtgtacaagtgcaagatattctttatct

SEQ ID NO: 13446 - DNA, 872 bp, Nicotiana benthamiana
aacctcttaaataaatatttcgcgttagtctcaggcttctctctctcgctcttcctcgtgttctctcactagatccctctttccaaagctttcttcagggatccttaagaagaaagagaaatggggctgacattcaccaagcttttcagccggctatttgccaagaaggaaatgcgtattctcatggttggtcttgacgctgctggtaagaccaccatattgtacaagctcaagttgggcgagatcgtcaccactattcctactattggtttcaatgtggagaccgttgagtacaaaaacatcagcttcaccgtttgggatgttgggggtcaggacaagatccggccattgtggaggcactatttccagaacactcagggtctcatttttgtggttgatagcaatgacagagaccgtgttgtggaggcaagagatgaattgcacaggatgttgaacgaggatgagcttggggatgctgtgctgcttgtttttgctaacaaaaaagatcttcctaatgcaatgaatgctgctgaaataactgataagcttggactccactccctcaggcagcgtcactggtacatccagagcacttgtgcaacttctggagagggactttatgaggggcttgattggctttctaacaatattgctaacaaggcctaaaccaacgtagagttgttgcgggttgatcctggatgcagacgggtttttatcttgttctttttccttttttcccccattctcagaatctgtgtggttatgagtatccctggaaagtgatttgcttcttggtaggacctcttgaaatgtttttgtaatacagtgattggatatatgtaattgctgtttgtttggtttcaagtaaggct

SEQ ID NO: 13447 - DNA, 965 bp, Quercus alba
aaaaaagagaaaatccaaaaaaagcatttgatccttaatctgaatctgaatctaatttagctctgagcaccaaaatggggctgtccttcaccaagcttttcagccggctttttgccaagaaagagatgcgtattcttatggttggtctcgacgctgctggtaaaaccacaatattgtataagctcaagttaggagaaatagttaccaccatccctaccattggatttaatgtggaaactgtggaatataaaaatattagcttcactgtgtgggatgttggtggtcaggacaagattcgacctttatggaggcactacttccaaaacacacaagggcttatatttgtggttgatagtaatgaccgagaccgtgttgttgaggctagagatgagctgcacaggatgttgaatgaggatgaattaagagaggctgtgttgcttgtgtttgcaaacaagcaagatcttcctaatgcaatgaatgctgctgagatcactgataagcttggccttcattctctccggcaacgccattggtacatccagagcacatgtgcaacttctggtgaaggattgtatgaggggctggattggctctcaaacaacattgctaacaaggtttagaggattgcgggctggtctctctatacttttcttaagtgattgtggcaagaaaagaggatttttcgtttttgtttaattcttttgtatcctactaccccttaatgtgtactttggttgcgatcaaaattaaattttctgtgagctattggcatttgcttaaatacacagtaactcatgaaatatttaagttctgtttgtggtgatattttatcaatatcagaggaaggggtgaataaataatttatagaatacaaattttattctgccaaaaaatataaaaatatgccaaacagccaaagccctaatagtaataagtttgattaccgcatttgggaattgcattgt

SEQ ID NO: 13448 - DNA, 1626 bp, Elaeis guineensis
cgacgacgcgacgtacgtaacgtacgtacgtactccgtagatcgaccgcccctaacgtacccccttaccggtcggttggacccgttacggtccgaaggtactcagggaaagcaagagaacagacgaagaaaaaattccatctatcgctctctctctcagcttcttcgaagaggattctctgcagggagaaaaatggggctgaccttcacgaagctattcagtcgtctatttgcgaaaagggagatgaggatcttgatggttgggcttgatgcagctggtaaaacgaccatcctctacaagctcaagctaggagagatcgtcaccaccatccccacaatcggattcaatgtggagactgtggagtacaagaacattagcttcactgtttgggatgttggtggtcaggataagatcaggcctttatggaggcactacttccagaacactcaggggcttatctttgttgttgatagcaatgacagagatcgtattgttgaggcaagggatgagctccatcggatgctaaatgaggatgagttacgtgatgctgtgttgctggtgtttgcaaacaaacaagaccttcctaatgcaatgaatgctgctgagattactgataagcttggccttcattctctgcgtcaacgacactggtacatacagagcacttgtgctacctcgggtgaggggttgtatgaggggcttgattggctctcgaacaacatcgccaacaaggcctaaaattttcagcatgctgggtatagcgtttcaatatgtttctggattacatataccttttgcagttgtggtgggtggcttgctgtggggacactttgtggccatcagtttgttggtcgtggataaattaccatctttttcctaattttctttcactcatgttgtagcgttcagaacctgtcaccgagtgggctttggtgtatttgacttaatgcagtctacagggtagtgttatgtgatctatttacatttcagtggttattgtacagggttgtgttctgctttgggttgatgagaagctgtgtagctaatagctgcagatgttagccctgctgttaattgccttatcatcgtatgtaagcggagatgatattgatattgctgcttctacagtattgtgtaaaaagatatttccacttcagaatgcgtctagggttttcacctcttcattgaaatttatcatcctaaatatgagggatttaatgctccagctggatgtcaagatctcatgtttgtcctcgcccgcaaccctcggttgttgcagttgttattgggtgtttagatcgatgatgcaattaaagccaggctctgtgagatacgcgaccatttcagagctgatacaacgaaaaaccctatacctttaaaccctacctttatcataaaacccaaaaaggctgtaggaaggaagctgtgtatatgaactaaagacaacattctggatacagttttgttgactcgtttacaatggggcatcaggttggagaaagcaactcgagctagaattcttacaggcgatttatcagacttttatcttgaaaaaagatcagccatgccggatcgcaacaacatgcttcgttggagtataactcagtgattctcccaataaaaagc

SEQ ID NO: 13449 - DNA, 942 bp, Phalaenopsis aphrodite
cggaggaggaggacgatcgggttcgcattcgttttaatattcgccagtaatcatctagatctgtttgcgtacatctcttgattggtgggaagatggggcttacgtttacgaagctctttagccgtctctttgcgaagagggagatgaggattttgatggttggtcttgatgccgctggtaagaccacgattctttacaagctgaagctcggagagattgttactaccatcccaactattgggttcaatgtagagactgttgagtacaagaacattagcttcactgtttgggatgttggtggtcaagataagatcagaccattgtggaggcactatttccagaatacacaaggccttatttttgttgttgacagtaatgacagagatcgagtcattgaggcccgggatgagctgcacagaatgctaaatgaggacgagctgcgtgatgctgtcttgcttgtgtttgcaaacaaacaagacctgccaaatgctatgaatgcagccgaaatcactgataagcttggtcttcattcgcttcgtcagcgacactggtacattcaaagcacttgtgccacctctggtgagggcctgtacgaggggctcgactggctttccagcaacattgccaacaagggttgaaacttgtactttgatcagaatacgccgattgttcgttttctatcgctatcgaagagtattttctgacattttcttttgcatttaagagcacatatccaattagttgtaatgcaagatcttgtgttgtggtctgatattctgtgttttttggcgacttatcctatttgcactgcagtgttgttacaaattctatttgtttccagtgttacgtgcgttttataatagctgttatgtagagcacacactctgttgaagatttttaattttctagcattatgtacaagtataaagacttcagttttat

SEQ ID NO: 13450 - DNA, 888 bp, Solanum tuberosum
ccgtgccacagcagaggaaagcgcggtgaacgacagctccatttcgagatctacctattcgaattctccgatcgccggtcgccgatctccgttacacagagatggggctgtctttcaccaaactttttagtcgcctctttgctaagaaagaaatgcgtattcttatggttggtctcgatgctgctggtaaaaccacaattctctacaagctcaagttgggggaaattgttaccactatacctactattggcttcaacgtggaaacagttgaatacaagaacatcagctttactgtgtgggatgttgggggtcaggacaagattcgacctctatggaggcattatttccagaacacacaaggcctcatctttgtggttgacagcaatgacagagaccgtgttgttgaggcaagggatgagcttcataggatgttaaatgaggatgaactaagagaggctgtgctgcttgtttttgcaaacaaacaagatcttccaaacgcaatgaatgcggctgaaatcaccgataagcttggacttcattctcttcgacagcggcactggtatatccagagtacatgtgccacttctggagaagggttatacgagggacttgattggctatcgaacaatatttcaaacaaggcttagatcatcaattagactctgctctcgcttgtcgctcacttacctatatctggagtatagttgttaaacaccatttggttattttggatagaaagaagattaatctctgaaaaatatcctgcatttctttcccttttcatgttttttcttgttaatgaaatcccatggttcaaattacttgtggttgttggttagttgctacattgcttgcaatgtaaaacatatttgagtataatattgtttt

SEQ ID NO: 13451 - DNA, 728 bp, Rosmarinus officinalis
cggccgggggaagctttcattgcttaatatctcatcactcattcagaatctcagatccgtctcgtctcgaagccttttcggggatagtttgtaaagaagaaaaatgggactatcgtttgcaaagttgttcagccggcttttcgccaagaaagagatgcgcattctaatggtaggccttgatgcagctggtaaaactaccatcttatacaagctcaagcttggagagattgtgaccacaattcctaccattggttttaatgtggagaccgttgaatacaagaacatcagctttaccgtttgggatgtcggtggtcaggacaagatccgtcccctatggaggcactacttccaaaatacccagggtcttatctttgtcgtggatagcaatgacagagaccgtatcgtggaagcaagagatgagttgcatagaatgttgaatgaggatgagctacgagatgcagttttacttgtatttgctaacaaacaagatctaccaaatgcaatgaatgctgcggaaataactgataagcttggtctccactccctccggcagcgccactggtacatccaaagcacctgtgcaacttctggagagggactttatgaggggctggattggctttccaataacatttctaataaggcataaagcaatacggagttaataaaggggttgatgctgaatgcgacggcttttatctggtctttttctattctattgtgaattt

SEQ ID NO: 13452 - DNA, 836 bp, Rosmarinus officinalis
aaaataggtcaatatataatattgcctctgagctagatctgactctgctcagacccctcctctttccgctagtttcttcatcgttagaaaatggggttgtctttcaccaagctttttagccggctttttgccaagaaggagatgcgaattcttatggtaggtctcgatgctgctggtaagaccacgatattgtataaactcaagttgggagagatagtgacaacaattcctacaatcggattcaatgtggagacagtggagtataagaacataagcttcactgtttgggatgttggtggtcaagataagattcgaccattgtggaggcattacttccagaacactcaagggttgatttttgtggtcgatagtgatgatcgagatcgtgttgttgaggctagggatgagctgcatagaatgttaaatgaggatgagctgagggatgccgtgctgctagtttttgctaacaagcaggatcttcccaatgctatgaatgctgctgagataactgacaagcttgggcttcactctcttcgtcaacgccattggtatattcagagcacatgtgccacctctggagaggggctatacgaggggcttgactggctctccaacaacattgctaacaagtcttaaagaagaaaagttggatggatttcggcatcaatatccttgttcaggagtaccgttttgtgggtattttcccatacaatcctgtactgtgataacttgtttctttttactttttgatatcgtagatagtggtatcctactatgtacaattgagttccaccgctgtttcagactctgcaattatgctttgggcctctttggcc

SEQ ID NO: 13453 - DNA, 840 bp, Picea glauca
ggatattcgttcatctcaggcctctgcagaaacgaactcttcatcagcggggtctgcgattttacaggatatttgattttctctcaagtttggcaagatggggctcacgttcaccaagctctttcagcgtctgtttgccaagaaggaaatgcgtattctgatggtgggtcttgatgctgccggtaagaccaccattctgtacaagctgaagcttggagaaattgtcaccacaattcccactattggtttcaatgtggagactgtcgagtacaagaatattagcttcactgtttgggatgtcggaggtcaggacaagatccgaccactatggagacattactttcagaatacccagggtcttatatttgtcgtggatagtaatgacagggaccgtgttgttgaagcaagagatgaattgcatagaatgttgaatgaggatgagctacgagatgctgtcctgctagtatttgcaaacaagcaggatctcccaaatgcgatgactgctgctgaaatcaccgataagcttggtctgcactctttacgtcagcggcactggtatattcaaagcacttgtgcgacttctggtgaaggtctttatgaaggcctggattggctttctaacaacattgcaaacaaggcataatgttgaagcatagtaatgatgctgtgatgcctttcagaatgggttggattctgtgcattttgagtattggttggatactttctgcgatgtagtggacgtgtttcatgcttcccctagtaaattgaagtagataaatagttaagggggttgaggatctattctgtggtgtactgatccttagtttacttgttttgttg

SEQ ID NO: 13454 - DNA, 592 bp, Helianthus annuus
agtgtccggtaaaggaatacttgttttactatcctaagcaagcaacaccaacatggggttgacattcactaagttgtttagtcggttgtttgcgaagaaagagatgcgtattttgatggtaggtcttgatgctgctggtaagacgactatattgtacaagttaaagcttggagaaattgtgacgacaattcctaccattggattcaatgttgaaaccgttgaatataagaacatcagcttcactgtctgggatgttggtggccaagacaagattcgtccattgtggaggcactacttccaaaacacacaggggcttatctttgtggtggatagcaaggacagggatcgtgttgttgaggcaagggatgaattgcataggatgttgaatgaggatgaacttagagacgctgttttgctggtttttgctaacaaacaagatctgcctaatgccatgaatgctgctgaaattactgataagcttggccttcattcactccgtcaacgtcattggtacattcagagcacatgtgcaacatctggtgagggcctttatgaagggctggattggctctctaacaacattgctaacaag

SEQ ID NO: 13455 - DNA, 764 bp, Tabernaemontana elegans
acatcgccaacgtgaattgcatttaattgcacgctccggtggtaattgctggttcccttgattcctctattctgcaatcgactagactttggggagaggacgaggacgaggacgtcagtacctgagagagatctccgtcgagctggtttcatctcttcctctggtgttagtcgggcatacgaatttgcagcaggaacatgggattgtctttcaccaagcttttcagtcggctatttgccaaaaaagagatgcgcatattgatggtgggccttgatgctgctggtaaaacaacaattttatacaaactcaaacttggtgaaatagttacgactattcccaccattggatttaatgtggagaccgtggaatacaagaacatcagctttactgtctgggatgttggtggtcaagacaagatccggcctctgtggagacattacttccaaaacactcagggtctgatctttgtggtggatagtaatgaccgagatcgtgttgttgaagcacgagatgaactgcaccggatgttgaatgaggatgaactgagggaagctgtgctgcttgtttttgccaacaaacaagatttgcccaatgcgatgaatgctgctgagatcactgataaacttggtcttcattctctccgccaacgacattggtacatccagagcacttgtgcaacttctggtgagggactttatgaggggttggactggctttcgaacaacattgctaatcaggcgtagttcacggttgaaattggttaa

SEQ ID NO: 13456 - DNA, 819 bp, Utricularia gibba
gaagaggggagaagatgggtctcacattcacaaagctttttagtcggctttttgccaagagggagatgcgtatcttaatggttggtcttgatgctgctggtaaaacaaccatcttgtataagctgaagcttggagagatagttactacaattccaacaattggtttcaatgttgaaactgttgagtacaagaacataagcttcacagtttgggatgttggtggccaggacaaaatccgtccattgtggaggcactacttccaaaatactcagggactcatatttgtagtcgacagcaatgatagggaccgtgttatagaggctagggatgaactgcataggatgttaaatgaggatgagcttagagatgctgtgttgcttgtgtttgctaacaagcaagatcttcccaacgcaatgaacgctgctgaaattactgacaagttaggcctgcactccctcaggcagcgtcattggtacattcagaccacctgtgcgacatctggggaggggctgtatgaaggactggattggctctcaaacaacattgcaagcaaggcatgaatgttgaagtggtctactgcacctagttttgtccagtgttatactgtgtgtgtgtcaccgtgttgctacaggctcttgaaaaactgctcgttctgttagttaccttgtggaacgtatacttgtctttttttttatccatcggttttgaatgtaaaacgacggccggaatccgtcttctggcccctagaacataatccacttgtcacttagtggaatatgcgatagaaaattagtgcacagtatgaataaagggttgtac

SEQ ID NO: 13457 - DNA, 586 bp, Vinca minor
aagctttcgacagtgttgagtagtgcatagcagagacaaagcacagatggggctaacgttcaccaagctgttcagcaggctctttgccaagaaagagatgcgaattctgatggtaggtcttgatgctgctggtaagactaccatcttgtacaagctgaagctcggagagattgttaccaccatccccactataggtttcaatgttgagactgtagaatacaagaacattagcttcactgtctgggatgttggtggccaggacaagattcgtcctttgtggaggcattacttccaaaacactcagggtcttatctttgtggtggatagtaatgatagggatcgagttgttgaagcaagggatgagctccatagaatgttgaacgaggacgaactacgagaagctgtcttgcttgtatttgctaacaaacaagatctgccaaatgcaatgaatgctgcagaaattactgacaaacttggtctccattctctccgccagcgccattggtatattcagagcacttgtgcaacttccggggagggcctgtatgaagggctggattggctgtccaacaatattgctaacaag

SEQ ID NO: 13458 - DNA, 860 bp, Vinca minor
cagcggaagctctcgagagtgttgagtggtgcatagcagagacaaagcacagatggggctaacgttcaccaagctgttcagcaggctctttgccaagaaagagatgcgaattctgatggtaggtctcgatgctgctggtaagactaccatcttgtacaagctgaagctcggtgagattgttaccaccattcccactataggtttcaatgttgagactgtagaatacaagaacattagcttcactgtctgggatgttggtggtcaggacaagattcgtcctttgtggaggcattacttccaaaacacccagggccttatctttgtggtggatagtaatgatagggatcgagttgttgaagcaagggatgaactccataggatgttgaacgaggatgaattgcgtgaagctgtcttgcttgtatttgctaacaagcaagatctaccaaatgcaatgaatgctgcagaaattactgataagcttggtctccattctcttcgccagcgccattggtatattcagagcacctgtgcaacctccggggagggcctctatgaagggctggattggctttccaacaatattgctaacaagtcatgaagcaggaaaaggaatctcgatgtggttcgtaattttgtggggttcatatggatactgttttgctttatgtcgttggcaatttctagataatgaaagcttattgttttcctttttaacatggaaatctttacatagcacaagtttggcttgatgtgttttattgtttagttaatcttttgaactgatgaactcgttctcctttattcttatcgtgtagtcctctccatcataagtgatgggtttggtataactttttttcctt

SEQ ID NO: 13459 - DNA, 956 bp, Momordica charantia
ggaacctcggaaccggaacgctctcgtatccctctttcccttcagatttctcaccaattcgagagtgctgtgattgttgcccggattgagggtagcagaaatggggttgacctttacgaagcttttcggcagacttttttctaagaaggagatgcgcattttgatggtgggtcttgatgctgctggtaaaaccacgatcttgtataagctaaagctcggagaaatcgtgaccaccatcccgactatcggatttaatgtggagactgtagaatacaagaacatcagctttaccgtttgggatgttggtggtcaggacaagatccgtccactttggaggcattatttccagaatacacagggccttatttttgttgtggatagcaatgatagggaccgagttgttgaggcaagagatgagttgcacaggatgttgaatgaggatgagcttagagatgccgttttgcttgtatttgctaacaagcaagatcttcctaatgccatgaatgctgcagaaataaccgacaagcttggtcttcactctcttcgccagcgccactggtacatacagagcacttgtgcgacatctggagagggcctgtacgaaggcttagactggctttccaacaacattgttagcaaggcttgaggcggtaaatgatttgggtgttcaggactatgttcagagttctcaccattctggaaaggatagttttgttttgtttcagcgattattttattgctatcaatttaggggaaaaggtttgggctatacttatacatgtactcccgatgctttaagctattcttagcttttaaaagtgcattcttttcatttaataccaagttcagtatttttgggacattttctatggctatggtattactttcttcttcccttcacaatttgatatattgtatcattttatggattctactgcattcttaaagaatctaag

SEQ ID NO: 13460 - DNA, 1055 bp, Beta vulgaris
cggccgggggacggacccgttgatattataaacttcataacgggcggacactcaagaattgcccgccgtccaccctcttgccctagctcttttttctctctcctcaatatttgttgaagaaaatggggctctcattcacgaagcttttcagtcgccttttcgcgaagaaagaaatgagaattttaatggtaggtctcgatgcggctggtaagaccaccattttgtataagcttaagcttggagagattgttaccaccattcctaccatcggtttcaatgttgagaccgtggaatacaagaacatcagctttactgtgtgggatgttggaggtcaagacaagatccgacctctatggagacattacttccaaaacacccaaggtctcatctttgtggtggatagcaatgatcgtgatcgtgctgttgaggcaagggatgagctgcacaggatgttgaatgaggatgagttgagagatgctgtcctcctggtatttgctaacaagcaagatcttccaaatgctatgactgctgcggagattactgataagcttggtctcaactcccttcgtcagcgtcattggtatatccagagcacgtgcgccacttctggtgaaggtctctacgaaggactggactggctgtccaacaacattgctagcaaggcttagatggcaggatatgcccggctgagcgtaggatgagaatatgtgtggattttgcagcacctgttcaagtgggagatgatattgagcgtttggcatgtgtttttctttgttgtgttaaaaatcacaagagttattgtgttaatgtgattatgtttatgaaggttttgttatgatcatagaaattgttatatcaatacttttgtagattcagaataactaaaatgtatctcaggaaaagagtttgtttcatgttgatatatatactgtgacggtgatattcttttggagcaaaacgatggcagttccattttatagttgtgttattgtagctttgtagggactctaggttgattaaagtagtgttggactttcgtccatctgatttagttg

SEQ ID NO: 13461 - DNA, 784 bp, Cephalotaxus harringtonia
aagaggttttcaaagtgttttgagttgttcaaggcgatcaccatcatcatcatcgccttttgagcttcatctagcaggttttacgatgggtttaactttcaccaagcttttccagcgtatgtttgccaagaaagaaatgcgaattcttatggttggtcttgatgcagctggaaagactaccattttgtacaagttgaagctgggagagattgttacaactattcccactattggctttaatgtggagactgtggaatataagaatattagcttcacagtttgggatgtcggaggtcaggacaagattcgaccactgtggaggcactactttcagaatacacagggtcttatctttgtggtggatagcaatgatagagaccgtatagttgaggccagggatgagttgcacaggatgttgaacgaggatgagctacgtgatgcagtcctgcttgtttttgcaaacaagcaggatcttccaaatgcaatgaatgctgctgagatcactgataagcttggtctgcactccctacgccagcgacactggtatatccaaagcacttgtgctacttctggtgaaggcctctatgaaggcttggattggctttcaaacaacattgcaagcaaggcttgagcatgatgcatgcttgtaacgaatgggtttagtgatccaccctatgtttttgatcaagagttgtgcagtatattggcccttaatatttggatcatttagcttttataatatgtatacttcaaatatttcactcttctaagaataagcaatttt

SEQ ID NO: 13462 - DNA, 912 bp, Cucurbita pepo
aactctcaaatttcattctgctggacttctcttccagatctcaactgatctttaacacacggattcattttattcgttttctgtgattgttgcccatagagggaagcagaaatggggctgaccttcacgaagctcttcagcagcctcttttctaagaaagagatgcgcattttgatggtgggtcttgatgctgctggtaaaaccacgatcttatacaagttaaagctcggagaaattgttaccaccatccccactatcggatttaatgtggagactgtagagtacaagaacatcagctttaccgtttgggatgttggtggtcaggacaagatccgtccactttggaggcactatttccagaatacacaaggccttatttttgttgtggatagcaatgatagggaccgagctgttgaggcaagagatgagttgcacaggatgttgaatgaggatgagcttagagatgctgttttgcttgtatttgctaacaagcaagatcttcctaatgccatgaatgctgcagaaataacagacaagcttggtcttcactctcttcgtcaacgccactggtacattcagagcacatgtgcgacatcgggagagggcctgtacgaaggtctcgactggctttccaacaacattgctagcaaggcttgaagcggtaaatgattttgatggttattcaggcatttgttcagagtttttgttattctgggacggatagtttcatttgatttcagtgattatcttagttgggaaacatttggctataccttaaaatgtactctaagttgttaatggctgatttcagcggatagactccttacctccttagctcctagaagtccattattgtactgttttccagttaatatcaactcctattttatccgatcaatctgattatgaact

SEQ ID NO: 13463 - DNA, 898 bp, Cyclamen graecum
agcctctcgttgacgctcatttctctcgatctctctgcgtagaaccttgtgcagggattaaccaacagaaaagagacatgggtttgacattcacaaagcttttcagccggctttttgccaagagggagatgcgtattcttatggtaggtcttgatgccgctggtaagaccaccatactctacaagctcaagctcggtgagattgtgaccacaatccctactattggctttaacgtcgaaactgttgagtacaaaaacatcagctttactgtgtgggatgttgggggtcaggacaagatccgtccattgtggaggcactatttccagaacacccagggtctcattttcgtggtcgatagcaatgacaaagatcgtgttgttgaggcaagagatgagttacaccgcatgttgaatgaggatgagctgagggatgcagtattgcttgtctttgctaacaaacaagatcttccgaatgcaatgaacgcagctgaaataaccgataagcttggtctccactctctccgacagcgccactggtacatccagagcacttgtgcaacctccggggagggcctgtatgaggggttggactggctctccaacaacattgcaaacaaggcttgaggacgacgggggttgacactggatgcaggatggtttttatcaagtcttatttgtttcttgttggggctgtatgttgtcgtcaatttcgtattataagttttcttgctgatcaaggattttgccgtggctatctgtctataacagaatggtttgttgaattcctgtattgtcagacactgctccagatttgactatgaatatgcttataattagtagctcctttgtttttcactcggtatcgatgtttttatttcatgtttagttatattgcgagg

SEQ ID NO: 13464 - DNA, 681 bp, Ananas comosus
caagcttccaatctctctctcttgctagatcccttttaccccaagggatcaatcaccagcaaagagacatgggtttgacattcaccaagcttttcagccggctttttgccaagagggagatgcgtattcttatggtaggtcttgatgccgctggtaagaccaccatcctctacaagctcaagcttggtgagattgtgaccacaatccctactattggctttaacgtcgaaactgttgagtacaaaaacatcagctttaccgtgtgggatgttgggggtcaggacaagatccgtccattgtggaggcactatttccagaacacccagggtctcattttcgtggtcgatagcaatgacaaagatcgtgttgttgaggcaagagatgagttacaccgcatgttgaatgaggatgagctgagggatgcagtattgcttgtctttgctaacaaacaagatcttccgaatgcaatgaacgcagctgaaataaccgataagcttggtctccactctctccgacagcgccactggtacatccagagcacttgtgcaacctccggggagggcctgtatgaggggttggactggctctccaacaacattgcaaacaaggcttgaggacgacgggggttgacactggatgcaggatggtttttatcaagtcttatttgtttcttgttggggc

SEQ ID NO: 13465 - DNA, 681 bp, Podocarpus macrophillus
gctttcaagatgggcctgacctttacaaagctctttcagcggctttttgccaagaaggagatgcgcattctgatggtaggacttgatgcggctggtaagactaccatattgtacaagcttaagttgggagaaattgtcaccacaatcccaaccattggattcaacgtagagacggttgaatacaaaaatattagcttcactgtttgggatgttggtggtcaggacaagattcgaccactgtggagacattatttccagaatactcagggtcttatctttgtggtagacagcaatgatagagatcgtatagtggaagcaagggatgagcttcacaggatgttgaatgaggatgagttacgcgatgctgtgctccttgtgtttgcaaacaagcaggatcttccaaatgctatgaatgctgcagagattactgacaagcttggtttgcactctttgcgccagcgccattggtatatccagagcacttgtgctacatctggcgagggcttatacgaaggcctggactggctctccaacaacattgcaaacaaggcctgaaacaacattgcaaacaaggcctaagacagaagcatacacggtttatcgttatcgttgcatttttacagggttgtttttgaaaacattgtaggatctcgttggtattcagtttttaggacgtgtttg

SEQ ID NO: 13466 - DNA, 973 bp, Sequoia sempervirens
tttcaaatgttttagtgttcgcaattacaggagttcatctagcgcctgttcaacgcgatcactgactttttcgaggtgaaagaaaaacatcttgattttccagggttttaggttgaacatctaccaggccttacaatgggtttaactttcaccaagcttttccagcgtatgtttgccaagagggagatgcgaattcttatggttggtcttgatgcagctggaaagactactattttgtataagttaaagctgggagagattgttacaaccattcccactattggctttaatgttgagactgttgaatacaagaatattagcttcacagtttgggatgttggaggtcaggacaagattcgaccactgtggaggcactacttccagaatacacagggtcttatctttgtggtggatagcaatgatagagaccgtgttgttgaggcaagggatgagttgcacaggatgttaaatgaggatgagttacgtgatgcagtcctgcttgtttttgcaaacaagcaggatcttccaaatgcaatgaatgctgctgagatcactgataagcttggtctgcactccctacgccagcgacactggtatattcaaagcacttgtgctacttctggtgaaggcctctatgaaggcttggattggctttcaaacaacattgcaagcaaggcttgaggataatgaatgcttgtaaggaatgggagtgatcctccctatgtttttaatcaagagtaagggaagaggagttgtgtagtgtattagccttttgaaaatggatcattttgcttttataatgtattcctacaagtatttcactcttctaagaattaagcaatttttatatgtggggctctttaatctccaagaacccagtttcccctatttcgttgtgagttatttacaagagctcatatctgttgtatatggtcgaacagaaatgccaaatattaaaatttgtaaagatagc

SEQ ID NO: 13467 - DNA, 912 bp, Amsonia hubrichtii
ccttagatttgagtctttgcctaagggcagtctttcaagatctgccctcgcttcaccgaaattcgatcaatctctgctctctccatcgcattattctcgatcgcataagaagggaaggatgggtttgtcatttaccaagctctttagccggctttttgccaagaaggagatgcgtattctgatggtgggtctcgatgcggctggtaaaactacaatattgtacaaactcaagctgggagaaattgtcaccaccattccaaccattggtttcaatgtcgaaaccgtggaatacaagaacatcagctttactgtctgggatgttgggggtcaggacaagattcgaccattgtggagacactacttccaaaatactcaaggacttatctttgtcgttgatagtaatgaccgtgaccgtattgttgaggctagggatgaactgcacaggatgttgaatgaggatgaactaagggaggctgtcctgcttgtgttcgccaacaagcaagatcttccaaatgcaatgaatgcagcagagatcactgacaagcttggtcttcattctctccgtcaacgccactggtatatccagagcacatgtgcaacatccggtgaagggctttatgaggggttggactggctctccaacaacattgctaacaaggcctagagcagcataatcaatccgatgattttgatgatatatctttgctaaagtggaacatcagatatttccttcgcgtcttgtatttttttaatatttgatcttgcttctgcaagattgaaccgcacatcctgtttgcttgttgttttcgatataatttggcactttgatccatttagtttcagactttctagcttagagagctttgttcttttggccgtatgttgcagttattctttaatatctagtattat

SEQ ID NO: 13468 - DNA, 858 bp, Cucurbita pepo
ttcagatctgtctcctgaaggccccgaattcgagagttctttgattgtttctcttagagggaagtagaaatggggttgaccttcacgaagctcttcggcaggctcttttctaagaaagagatgcggattttgatggtgggtcttgatgctgctggtaagaccacgatcctgtacaagctaaagctcggagaaattgttaccaccatccccactattggatttaatgtggagactgtagagtacaagaacatcagctttaccgtctgggatgttggtggtcaggacaagatccgtccactttggaggcactatttccagaatacacagggccttatttttgttgtggatagcaatgatagggaccgagttgtcgaggcaagagatgagttgcacaggatgttgaatgaggatgagcttagagatgctgttttgcttgtatttgcaaacaagcaagatcttcctaatgccatgaatgctgcagaaataactgacaagcttggtcttcactctcttcgtcagcgccactggtacattcagagcacatgcgcgacatctggagaggggctgtacgaaggtctagactggctttccaacaacattgctagcaagggttgaagcggtaaatgatctgatggtcgttcaaattcccgcgcccttctttggctagtttgtttatctcgccctcaagagtcctcatccttctagtacccatagtttcgtttgatttaagagatagttttagttgggaaacatttgactacactttaaatttcactccaagttgttaattgctgctttaagcgtatacttcttggctcctcgaaatgcattattgtactgctttcgtatcgtttaata

SEQ ID NO: 13469 - DNA, 1099 bp, Mimulus guttatus
aagaaaaaggtaaacagaaagaaaagaattgcagaaactaaattcaaattctggtccttcagatcttagcgtacaatacccacatttggtctccccaaatattctctctctctcttcttcccctcatcactcctctctctctctctctctccatcaacagaaatggggttatctttcactaagcttttcagtcgactgtttgcaaagagggagatgcggattcttatggtaggtctcgatgcagctggtaagaccactatactgtacaagctcaaactcggagaaatagtcacaactattcctactattggattcaatgtggagacagtggaatacaagaacataagcttcactgtctgggatgtcgggggtcaagacaagatccgaccactgtggaggcattactttcagaatacgcaagggcttatttttgtagttgatagtaatgatcgagatcgtgtcgttgaggccagggatgagctccataggatgctcaatgaggatgaactgagggatgccgtgctacttgtatttgcaaacaaacaagatcttccgaatgctatgaatgctgctgagataactgacaagcttggtctccactctcttcgtcagcgtcattggtatatacagagcacatgtgcaacatctggtgaagggctatacgagggtctggactggctctccaacaacattgctaacaagggttaagcagcaaatgttggatgaatcttcagttggtttatcactctacccttgttcaagtgaagattgtctgtctatcttccgtttcgtattgtttttcttttttctttgtcgtagatatagagacatatagtcatatcgtactatgatgtataaattgcccgtaatattctgcaattgtactatttcagcatttttgcctctttttaatgcatcgatctattctctccctcgtcgtggataattttttttctttagtgatgctttgacaaatttttggtaccacgcgcttcataaggacactcgtattcatatactcgtattagtatatagacgtttacttaatcttttctcaacaattataaaacttcttactacggctcttgtttgctcaaca

SEQ ID NO: 13470 - DNA, 1016 bp, Phalaenopsis aphrodite
cttccattcgtgcagagcggaggaggaggacgatcgggttcgcattcgttttaatcttcgccagtaatcatctagatctgtttgcgtacatctcttgattggggggaagatggggcttacgtttacgaagctctttagccgtctctttgcgaagagggagatgaggattttgatggttggtcttgatgccgctggtaagaccacgattctctacaagctgaagctcggagagattgttactaccatcccaactattgggttcaatgtagagactgttgagtacaagaacattagcttcactgtttgggatgttggtggtcaagataagatcagaccattgtggaggcactattttcagaatacacaaggccttatttttgttgttgacagtaatgacagagatcgagtcattgaggcccgggatgagctgcacagaatgctaaatgaggacgagctgcgtgatgctgtcttgcttgtgtttgcaaacaaacaagacctgccaaatgctatgaatgcagccgaaatcactgataagcttggtcttcattcgcttcgtcagcgacactggtacattcaaagcacttgtgccacctctggtgagggcctgtacgaggggctcgactggctttccagcaacattgccaacaagggttgaaacttgtactttgatcagaatacgccgattgttcgttttctatccctctcgaggagtattttctgaccttttcttttgcatctaagagcacatatccaattagttgtaatgcaaaatcttgtgttgtggtctgatattctgtgtttttgtctacttgtcctatttgcactgcagtgttgttacaaattctatttctttccagtgttacgtgcgttttataatagctgttatgtagagcacacactctgttgaagatttttaattttctagcattatgtacaagtataaagacttcagttttattgagcttctgtttgaaaattttacatcattctgttgaaataaagcttgtcgtttctat

SEQ ID NO: 13471 - DNA, 930 bp, Podocarpus macrophillus
gcgtcttttccctcacaaagatagccatattctcgaccatctgaattttttcgcaggcttgggtgaggaggggctcttagatctgttgggcgcctgagtgtgaagtaggttttggtggcgttttcagtttagcgagatgggtcttacattcaccaagctctttcaacggttgtttgccaagaaggagatgaggattctgatggtgggtctcgatgcagctggtaagaccaccatattgtacaagttgaagcttggggaaattgtgaccaccattccgacaattggtttcaatgttgagactgttgagtataagaacatcagcttcacggtttgggatgttggtggccaggacaagatccgacctttatggagacactactttcagaatacacagggtcttatttttgtggtcgatagtaatgacagagaccgaattgtagaggcgagagatgagctgcacaggatgttgaatgaggatgaattacgagatgctgttcttcttgtatttgctaacaaacaagatcttcccaatgctatgaacgctgcagagattactgacaagctgggacttcactccttgcgtcagcgccattggtacattcagagcacttgtgctacttctggtgagggtctgtacgaaggcttggattggctgtctaacaacattgcaaacaaggcttgagatggaagcattttctgaggctagctatgcgtttgagaatttgttgtcggattcttttagtgatgtaatagatatgctgaaccagtcatagtaacttcagtagatagtatcttaaaggattggggatcaattccattgtgaactgatccttagtttacttgttttatttgaggttttgcgaggctacagttgtttttgtagtagactactatcaattattacaattatcttttgagatttcagttcac

SEQ ID NO: 13472 - DNA, 772 bp, Selaginella moellendorffii
gtccttgcctcatttgcgtcctagggtttttgtgcttcttctttctgggctgggagtctctccgggcgcctgagcggatcgacgagcagccatggggctcaccttcacgaagctcttccagcgcctcttcgcgaagaaggagatgcgaatcctcatggtggggctcgatgcagctggtaagaccaccattctctacaagctcaagctgggcgagatcgtgacgaccatcccgaccatcggatttaatgttgagacggtcgagtacaagaacatcagcttcaccgtgtgggatgttggcggtcaggacaagatccgacccttgtggagacactatttccagaacacgcaaggtctgatcttcgtggttgatagcaacgacagagaccgtgttgtggaagccagggacgagctccaccggatgctcaacgaggacgagctgagagatgcggtgctgttggtattcgcgaacaagcaagatcttcccaacgccatgaacgctgccgagatcaccgacaagctcggcttgcattccctccgccagcgtcactggtacatccagagcacttgtgctacctccggcgagggtctctacgaagggctcgactggctgtcgaacaacatcgcgaacaagggctgagtgattgccgtggggaccggtcgatccatttgaagttttgcgctttcatcatcgtccattgcatgactacctacaaatatatagactacaaatgtggctttgcttagatataaatgaattctctttcattactta

SEQ ID NO: 13473 - DNA, 756 bp, Selaginella moellendorffii
agggtttttgtgcttcttctttcttggctgggagtctctccgggcgcctgagcggatcgacgagcagccatggggctcaccttcacgaagctcttccagcgcctcttcgcgaagaaggagatgcgaatcctcatggtggggctcgatgcagctggtaagaccaccattctctacaagctcaagctgggcgagatcgtgacgaccatcccgaccatcggatttaatgttgagacggtcgagtacaagaacatcagcttcaccgtgtgggatgttggcggtcaggacaagatccgacccttgtggagacactatttccagaacacgcaaggtctgatcttcgtggttgatagcaacgacagagaccgtgttgtggaagccagggacgagctccaccggatgctcaacgaggacgagctgagagatgcggtgctgttggtattcgcgaacaagcaagatcttcccaacgccatgaacgctgccgagatcaccgacaagctcggcttgcattccctccgccagcgtcactggtacatccagagcacttgtgctacctccggagagggtctctacgaagggctcgactggctgtcgaacaacatcgcgaacaagggctgagtgattgccgtggggaccggtcgatccatttgaagttttgcgctttcatcatcgtccattgcatgactacctacaaatatatagactacaaatgtggctttgcttagatataaatgaattctcttctttcattacgtatat

SEQ ID NO: 13474 - DNA, 980 bp, Taxus baccata
cacagatttttgtgtataagtagaagaggtgcggaagaggttttcaaaggctcttctctgtgttcgtcttccatctcgtgccttttcctacttagctcgacgcgatcatcgtcaccggctttgaatttttcaaattcggcgttaactttgaggattttttgggttaatctgccgggtcttacgatgggtttaactttcaccaaacttttccagcgtatgtttgccaagaaagaaatgcgaattcttatggtcggtcttgatgcagctggaaagactaccattttgtataagttgaagctgggagagattgttacaaccattcccactattggctttaatgtagagactgtggaatacaagaatatcagcttcacagtctgggatgttggcggccaggacaagattcgaccactgtggaggcactactttcagaatacacagggtcttattttcgtggtggacagcaatgatagagaccgtatagttgaggcaagggatgagttgcacaggatgttgaatgaggatgaattacgtgatgcagtcctgcttgtttttgcaaacaagcaggatcttccaaatgcaatgaatgctgctgagatcactgataagcttggtttgcactccctacgccagcgacactggtatatccaaagcacttgtgctacttctggtgaaggcctctatgaaggcttggattggctttcaaacaatattgcaagcaaggcttgaggatgatgcatgctttgtaacaaatgggttcagtgatccaccctatgtttttgatcaagagtaagggatgaggagttgtgcagtgtattggcccattaaattcagatcattttgcttttataatatgtattcgtataattatgtcactcgtctaaaaataaacaatttttatctttgagagtgtttttatctccaagaattcagtttcgtcttctctgttgtgagttatttataagagctcatttcataac

SEQ ID NO: 13475 - DNA, 651 bp, Rhizophora mangle
gtaaattatttcccagaaggacagcgcctcctcctattttgtcggtttgagatccctttgaagaccctgaaaaatggggctgtctttcacgaagttgtttagccgtctgtttgctaagaaggagatgcgtatactaatggtgggtcttgatgctgctggtaagaccaccattctctacaagctcaagctcggagagattgtcaccaccattcccaccattggatttaatgtggaaactgtggaatacaagaacattagcttcactgtgtgggatgttggtggccaagacaagattcgacctttgtggagacactactttcaaaacacccaggggcttatctttgtgatcgacagcaatgacagagatcgtgttgtcgaagccagagatgagttgcacaggatgttgaatgaggatgagttgagagatgctgtgttgctagtgtttgcaaacaaacaagaccttccaaatgcaatgaatgctgcggaaataactgacaagcttggtctgcactcactccggcaacgccactggtatatccagagcacatgtgccacttctggagaaggattatatgagggcctggactggctgtcaaacaatattgcaaacaaggtataggtggcactactattaaggttctgatttgcgac

SEQ ID NO: 13476 - DNA, 1066 bp, Amorphophallus konjac
ccgaattctccaccacacgccaccattccttcgtctaaggcgagttgaacagtttctttcctcttcgcttggattaaagatggggctatctttcaccaagcttttcagtaggctttttgccaagaaggagatgcgaatcctcatggtaggtcttgatgctgcgggtaagactactattttgtacaagttgaagctgggggagattgtctccaccattcctaccataggatttaatgtggagacagttgaatacaagaacattagctttaccgtttgggatgttggtggtcaggacaagatccgtcctttgtggagacattactttcagaacacacaaggacttatctttgtcattgacagcaatgaccgagaccgtattgttgaggctagagatgaacttcacaggatgttaaatgaggacgagctgagagatgcagtgttgcttgtatttgcaaacaagcaagatcttcctaatgctatgaatgcagcggagattaccgataagcttggcctgcactcactccgccaacgccactggtacatacagagcacgtgtgccacttctggggaaggcctatacgagggactggattggctctcaaacaacatagctagcaaggcctgaagcaagagatgattactgcaccccatttgatcaagatggatggaatgagaatagaagctgcccctgagaatagaagctgcccctcttggcattgcatcacctggcatgagaaataagtgattttgcagtttggggacgacttggaagaggaaacaggtctttggatgttacacgttccaatcttctggcaaaacaccagtgaagcaacagcccactgttaacgattttgtcctctgaagaggaattagaagagaaaggactgtgatacattgttgtgtaaacttgtttcatttaatcctttgcggcacagtacatgcaaaccgttttgttttaactcccggtggctaggcatatataatgggatatttacatgtagtcccctgtaatatgtcgtattatgatgtgtgtccttgagtttcatgatttgtcgaagacatcccc

SEQ ID NO: 13477 - DNA, 558 bp, Brassica juncea
tgcacaagatggggttgagtttcgcgaagctgtttagcaagctctttgcaaagaaggagatgaggattctgatggttggtcttgatgctgctggtaagaccactattccctacaagctcaagctcggtgagatcgtcaccaccatccccactattggtttcaatgtggaaactgtggagtacaagaacatcagtttcactgtgtgggatgtcgggggtcaggacaagatccgtcctttgtggaggcactacttccagaacacgcagggtctgatctttgtcgtggacagcaacgacagagacagagttgttgaggctagagatgaacttcacaggatgcttaatgaggatgagctgcgtgatgctgtgttgcttgtgtttgctaacaaacaagatcttccaaatgctatgaatgccgctgaaatcacggataagcttggccttcactccctgcgtcagcgtcactggtacattcagagcacatgcgccacttcaggtgaaggactctacgaaggtcttgactggctgtccaacaacatcgctggcaaggcgtaatgaa

SEQ ID NO: 13478 - DNA, 974 bp, Pennisetum glaucum
ttttttcttcgccccgcccgaagtcgaggaggatagagggggagcaggagctgcgagatcgcgcgcgccccagatctccaggaagttgttgcaacatggggctcacattcacgaagctcttcagccgcctcttctccaagaaggagatgaggattctcatggtcggtctcgatgcagctggtaagaccaccatcctctacaagctgaagcttggagagatcgtcaccaccatccccacaatcgggtttaatgtggagactgtcgaatacaagaacattagcttcactgtttgggatgtcgggggtcaggacaagatcaggccactgtggaggcactactttcagaacacgcaagggcttatctttgttgttgatagcaatgacagagatcgtgttgttgaggcaagggatgagctccacagaatgttaaatgaggatgagttgagggatgctgtcttgctcatttttgctaacaagcaagatctgccaaacgcaatgaatgctgctgatattaccgataagcttggtctccattcccttcgccaacgccactggtacatccagagcacctgtgctaccacaggagaaggtttgtacgagggccttgactggctctccaacaacattgcaaacaaggcctgattagacaatcctgtggctccatggagtacatggcggttgcattttccgcacaaacagatccatgggtcgttttgaccttgagacttgattattatttcgttggcttgcttgtcaagtattgcatttctttgctaggcttttcagagagctggtttgtccttatgtggcgtgattatactctccaaatacctgtttcaatattaagacactgtaattggccattggcactagatcgtgtaccagtaatgcagttcatttcaaagtattctgtcattgttcagtatttgatgtacctgtacgttgaatttgccacaaatgtacccacccgccaca

SEQ ID NO: 13479 - DNA, 1046 bp, Orobanche aegyptiaca
cttctcagcaagatctgcccttttattcttcttcttcttttcctcaaatctcctgtttcgtcttattccaatctccgtaagatctctatttttgacattttcaggcaaaaagatggggttgtccttcaccaagcttttcagccggctgtttgccaagaaggaaatgcgtattcttatggtaggtctcgatgctgctggtaagaccactatattatacaaactcaagcttggagaaatagtgacaaccattcctacaatcggattcaatgtggagactgtggaatacaagaacataagcttcactgtctgggatgtcgggggtcaagacaagatacgaccattgtggaggcattactttcagaacactcaagggttgatctttgtggttgatagtaatgatcgggatcgtgttgttgaggctagggatgagctccacaggatgttaaatgaggatgaactgagggatgcagtgcttcttgtttttgcaaacaaacaagatcttcctaatgctatgaatgctgctgagataaccgacaagcttggacttcaatctctccgccaacgccactggtatatccagagcacatgtgctacttctggggaaggcctgtacgagggcctggattggctatccaacaacattgctaacaagtcttgaaaacccgatgttggaagaaatctttttgttattggtatctcaatcgtagttgaagtggagatagctttctcgtcttgtagcgtttgttgaaagcaaattctgaactacgactattcttcatggatagtccttcgccttttattatatgtagattgagattccacttctgtaatttcagccattatacaatcctttgaaaatttataattttttatctggcaagcatacttatctcgcaatcgtcgtagaatattcgtctacaggatctttaatttttaaaaatttataatttcatgcaacaaaaatgcttgcgttgttgattgcaaaaatcgcaccgccaaaagtttctgtgatgaattgcgaaggttcttaaataaaaaaaaaaaaa

SEQ ID NO: 13480 - DNA, 820 bp, Papaver somniferum
caaagcgcagaactgatttagaggattcatagtgagacagagtcatggggttgtctttcactaagctttctagccggctgtttgccaagagagagatgcgtattctgatggttggtctcgatgctgctggtaagactaccatcttgtacaagctcaagctaggagagattgtcactacaattcctaccattgggtttaatgtggagactgtggaatacaagaacattagcttcacagtttgggatgtcgggggtcaggacaagattcgtccactgtggaggcactacttccaaaacactcaaggacttatctttgtggtggatagcaatgaccgagaccgagttgtcgaagcaagggatgaattgcaccggatgttgaatgaggatgagttacgagacgctgtgttgcttgtttttgctaacaaacaagatctccctaatgcaatgaacgctgcagagataaccgataagcttggccttcactctcttcgccaacgccactggtacatccagagcacatgcgcaacctctggagagggactttatgagggtctggattggttatccaacaacattgcaaacaaggcgtgaggcggcaatggaaatcagcagtagaggtttgtcgggggggttttgggttttctggatggcgggggtaaatttaaatccaagcttttgctgagatgggcttttggatgtggaatggcttccataggagtcatttcataggacttttatcttcttttttttgttaacaaatactgttgtaacaggagaatactcggtttgatgatatgatgctttataagcttgcttgtttt

SEQ ID NO: 13481 - DNA, 812 bp, Silene vulgaris
atatttgtaggaaacgatggggctatcattcactaagttgttcagcagattatttgcgaagaaagagatgagaattttgatggtaggtctcgatgcagctggtaagaccaccattttgtacaagctcaagcttggtgagatcgtcaccaccattcccaccattggattcaatgtcgagactgtggaatacaaaaacatcagtttcactgtctgggatgttgggggtcaagacaagattcgtcctttgtggaggcattacttccagaacacccaaggactgatctttgtggtggatagtaatgatcgtgatcgagctgttgaagcaagggatgagctgcacaggatgctgaatgaggacgagctaagggatgccgttctccttgtttttgccaacaagcaagatcttccaaatgcgatgactgctgcagagattacggacaagcttggtcttcattcccttcgtcagcgtcattggtatatccaaagcacatgtgccacatccggtgagggtctttatgagggtctggactggctctccaacaatattgcaagcaagtcttagacgacaggttcggcttaggaccaggttgaagtgagagctgctattgaaatagaggccttttgttttatgttctataatgaaaccaagttgtgtagtcaaatgcttatctagctatttttattgtgcatcaatacttcgtagattcttaatataattctgaaatgtaagcagtagtgcgtgacatgtttataatacgagaactatcgacggtcacattcttttgatcaatgttcgggttgagatttcacta

SEQ ID NO: 13482 - DNA, 826 bp, Eutrema parvulum
gttgtgtttgtgcagtaaaagcaagatgggaggcagtttcgccaagctttttagtcggctctttgccaagaaggagatgcgaattctgatggttggtcttgatgctgctggtaaaaccactattctatacaagctcaagctcggagagatagtcaccaccatccccactattggtttcaatgtggaaactgtggagtacaagaacattagtttcacagtgtgggatgtcgggggtcaggacaagatccgtcccttgtggaggcactacttccagaatactcagggtctgatctttgtcgtggacagcaacgacagagacagagttgtcgaggctagagatgaactgcacaggatgctgaatgaggacgagctgcgtgatgctgtgttgtttgtgtttgccaacaagcaagatcttccaaatgcgatgaatgctgctgaaatcacagataagcttggccttcactccctgcgtcagcgtcactggtacattcagagcacatgcgccacttctggtgaagggctctacgaaggtctggactggctgtccaacaacatcgccggcaaggcgtgatgaagtaaaactgcattgcatcgagatgattctgcctgctgtgtgttgggaatttttctggatgcaagagaagactataaatattatctgaatgtgaatgttttgattgtgcaagtagatgtcttgtacctaaatcttactagaaagaataaatagttttcgtgtattttaatttgatgaaacctggattgactattgaatattattgctatcttattattgcgtatttcatttgcaagggtcaacataaatttt

SEQ ID NO: 13483 - DNA, 1074 bp, Zostera marina
gggtaggattaaaaaatagagtataaagttgaaatacaagtaattttccaaccaccttccatttctcgttcacccctattcctgcattcgtctcactctgatctcttcccggaagagagaaaatgggtctcagttttgcaaagctctttagtaggatttttgccaagaaggaaatgcgaattttgatggttggtctcgatgctgctggtaagaccaccatcctgtacaagctcaagcttggagagattgtcaccacaatacctaccattggttttaatgtggaaactgtggaatataagaacatcagcttcaccgtgtgggatgttggtggtcaggacaagatccgtccgttgtggaggcattactttcagaatacacagggtctcatatttgttgtagacagcaatgatagggatcgtgttgttgaagcaagagatgaacttcacagaatgctaaatgaggatgaactgagggatgctgttttgcttgtttttgctaacaaacaagatcttccaaatgccatgaacgcagcagaaattaccgataaacttggccttcagtctctcagacaacgccactggtacatacagagcacatgcgcaacttctggtgagggactgtatgaaggattggactggctttccaacaacatcgctaataaggcctaaaatatctaagctccgactatatcaggtgctacgttgttaaagatgtattttgcaaatagtttgggcttttgggaggtgggggtgggaaagaagcaggggtgaacaacattcaatttatgtctaatgacaacactaaggtctaaggatacatttgagcatttaagaattaagactgatgtttcttttcgtatttttatttcgaaaactgtttcatatatactttggttttactgatatttaaattgtcacctgctactgctgtcaatttggtgccaaatattattgtataaacaattgaccattcaaacgtaacttggatttggtgaaagcatatataatgtaatcagaatgctgctaaaaacatgaaatccttattacatttgttatgaatattaatcgctacttg

SEQ ID NO: 13484 - DNA, 918 bp, Distylium racemosum
tcattttagcgatttagttctggaaagcgccggctttcaagatgggtctcaccttcaccaagcttttccagcggctatttgccaagaaggagatgcgtatattgatggtaggtctcgatgcggctggaaagactaccattttgtacaagcttaagctgggagagatcgttacgacgatcccgactattggtttcaatgtagagacagtggagtacaaaaatattagcttcactgtttgggatgttggtggccaagacaagattcgaccactttggagacactatttccagaatactcagggtcttatctttgtggtagacagcaatgatagagaccgtatagtggaggcaagagatgagcttcacagaatgttgaatgaggatgagttacgagatgctgtgcttcttgtgttcgcaaacaaacaggatcttccaaatgcaatgaatgctgcagaaattacagacaaacttggtttgcattctttacgtcagcgccattggtatatccagagtacctgtgctacatctggggaaggtttatatgaaggcctggactggctttcaaacaatattgcaaacaaggcttgagaatgaagcatatagaatgtacatcggtacaattttacacggtcgtgttgaatatattttatgatctttgctgatattcatgttgtaatacacatttcatagtggatcaagtcccggtttatccacgaattcttttctatgctaatttttgcatctatatttgttgtgcaatcgactcagaagttggtgcatcgtgtagtatttcaagtttgaagaagtaacctacttatgtggccctccatttctgtgactttcctggttttgagatgatttaaatctgccaagtccatcttcagaaacttttcaatgttattgcgatttcttagttgaa

SEQ ID NO: 13485 - DNA, 750 bp, Fagus grandifolia
aaaaaatcgcggctctcattccttccttcctccaatccctccacaggtagctagagaggtagagcaagaatggggctgacatttacgaagctatttagcaagctttttgcgaagaaagaaatgcgaattctgatggtaggtctcgatgctgccggtaagaccaccatattgtacaagctcaagctcggtgaaatcgtaaccaccatccctaccatcggatttaatgtggagacagtggaatataaaaacatcagcttcaccgtttgggatgttgggggtcaagacaagatccgtccactgtggaggcactacttccaaaacactcagggtctcatttttgtggttgatagcaatgatagggatcgaattgttgaggcaagggatgagttgcataggatgttgaatgaggatgaactcagggaggctgttttgcttgtatttgccaacaaacaagatcttcctaatgcaatgaatgctgcagagataactgacaagcttggcctgcattctctccgccaacgccactggtacatccagagcacatgtgcaacttctggagagggtctgtatgaggggttggattggctttccaacaacattgctagcaaggcataagcgattaaagaattttggttcctagcgatttgggagatgacgccttctcagtgactgttgtaatagcagaatgtttgtctagaccttatatattttggtttgtatggttgctactttagctaaatacttttagct

SEQ ID NO: 13486 - DNA, 1088 bp, Cenchrus ciliaris
cttcgccccgcccgaagtcgaggaggagagagggggagcaggagctgcgagatcgcgcgcacccgagatctccaggaagttgttgcaacatggggctcaccttcaccaagctcttcagccgcctcttctccaagaaggagatgaggattctcatggtcggtctcgatgcagctggtaagaccaccatcctctacaagctgaagcttggagagatcgtcaccaccattcccacaatcgggttcaatgtggagactgtcgaatacaagaacatcagcttcactgtctgggatgtcgggggtcaggacaagatcaggccattgtggaggcactacttccagaacacgcaagggcttatctttgttgttgatagcaatgacagagatcgtgttgttgaggcaagagatgagctccaccggatgttaaatgaggatgagttgagggatgctgtcttgctcatttttgctaacaagcaagatctgccaaacgcaatgaatgctgctgatattaccgataagcttggtctccattcccttcgccaacgccactggtatatccagagcacctgtgctaccacaggagaaggtttgtacgagggtcttgactggctctccaacaacattgcaaacaaggcatgattggacaattctgtggcttcgtggagtacatggtggttgcattttccgcagaagcagatccatggtcgttttgacctcgagacttattattatttcgtcggaatgcttgtcaagtattgtatttctttgctaggcttttcagagagctggggtgttcttatgtggcgtgaatactctccaaatacctgttccagtattaatacactgtaattggccattggtactagatcgtttaccagtaatgcagttcatttcaaaatattctgtcattgttcagtatttgatgtacctgtacgtcgaatttggccgtgtacccgccacactggtccgtgggtaacaggcgttaagctgaagggtgttcagagccacatcgtgtcatgtgactcaggtctatctcgtgtttgcgattacacctgcactgctgattcttcacagaatgaattggttccggtg

SEQ ID NO: 13487 - DNA, 947 bp, Cichorium intybus
ttaacgcaaagatttaaaaccgaaacgtgactgggaccatttgatttggtttaagaactcacggttctcaaacgtccacttttcttcactcaaaccccttcaagtaataattactacgcctactctgcatcccttcctgtccatcgcaaatttcgtcggtgatcgccggctcctcattccttaagatctccgacccatcatacaaagatggggttgtctttcaccaagcttttcagtcgcctatttgctaagaaagagatgcgcattttgatggttggtctcgatgcagctggtaaaaccaccattttatacaagctcaaattgggagaaattgtaaccactattcctaccattggattcaatgtggaaactgttgagtacaagaacatcagcttcactgtatgggatgttggtggtcaggacaagattcgccctttgtggaggcactatttccaaaacacacaagggctaatctttgtggttgatagcaatgatcgtgaccgtgtggtggaggctaaagacgaactacacaggatgcttaatgaggatgagttaagagatgcagttttgcttgtgtttgccaacaaacaagatcttccaaatgctatgaatgctgctgagattactgataaacttggcttgcagtctctaagacagcgacactggtatatccaaagcacgtgtgccacatctggagagggtctatatgaaggtctggattggctttccaacaacattgctaacaaggcttaaaagagatcatcatgattatggtcttcttagtgggttactgcaactactgttggtgtttgtttctaaatcttttgagttgtgggtattatatgtaaacctaaatttgtgccgcttttttagtatttacattgagatgtctaatggataaatagcatggtttacgccttttttgtgtttttgccactattacaaca

SEQ ID NO: 13488 - DNA, 1347 bp, Distylium racemosum
cttgtagtcaagtttgactaaccgtgacggcttgaggggagcacggttaactagggttgaatctagggtaaacgagcgagtcaggaggtctatatattctctatgatggccgagctcacatatcatcccaggcctccgtagaaaccgtcaatttcattaacagggcctgtgatttctgactacatctgaattttccacaagtttggcaagatgggtctcacattcaccaagctttttcaacggctgtttgccaagaaggagatgcggattctcatggtgggtctcgatgcggctggtaagacgaccatattgtacaagctgaagcttggtgaaattgtcaccaccattcccaccatcggtttcaatgttgagactgttgagtataagaacattagcttcactgtgtgggatgttggtggccaggacaagatccgaccgttgtggagacactactttcaaaatactcagggtcttatttttgtggtggatagcaatgacagagaccgtattgttgaggcaagggatgagctgcatcgaatgctgaacgaggatgagttgcgagatgctgttctccttgtatttgcaaacaaacaggatcttcccaatgcaatgaatgctgctgagataactgacaagcttggtctgcactctttgcgtcagcgccattggtatattcagagcacttgtgctacttcaggtgaaggcctgtatgaaggcctggattggctttctaacaacatagcaaacaaggcttgacgtgaaagcatttttctgaggctagccttgcatctgagaatgtgttggatttttttggggttgtaacagatatgtttaacaagttcttagtaaatttcagtagtaataggatagaggattggggatcaatgccatcctgaattgatccttagtttttaatttttttaattttttcatggctacaattattttgtaatattttattatgaatttttgcaattgccctttctgaattcagtacacccttcctctgcccaacacttcatattttattgctcatattttatgctcttgtttgtaataataggtctaacctgaatattcttaaaagtttcccgagttcctgagttcctttgccatgcttatgtattattagataattttatatgtttctgaaggagccagtggtctccaagatcttaaatatttgtggatggctggaatgcaatttaatgacagacactagtagcaaatataatgcagtacaaaatatggtttaacgttttcaaatatcagtttaggctggaagttgatcaagcctacaatagagtgcccctatacaaagaaatcaattcttcacaagtatctggg

SEQ ID NO: 13489 - DNA, 778 bp, Actinidia deliciosa
tgcggcggtccggtggtggtggacgacagcttctcttccaagatctgcgtctctcaacacttcatacaaagatgggtctgtccttcaccaaacttctcagtcgcatgtttgctaaaaaagaaatgcgtattctgatggttggacttgatgcggctggtaaaaccacaattttgtacaagctcaagttgggtgaaattgtgaccactattcctaccattggattcaatgtggagactgttgaatacaagaacatcagctttaccgtgtgggatgttggtggccaggacaagatccggcctttgtggaggcactactttcaaaacacacaaggtctcatctttgtggttgacagcaatgaccgagatcgtgtagttgaggcaagagacgagcttcacagaatgttaaatgaggatgaattaagggatgctgtcctgcttgtgtttgccaacaaacaagatcttccgaatgcaatgaatgctgctgaaatcaccgataagcttggtctcaattctcttcgacagcgccactggtatatacagagcacttgtgccacctcgggagaagggctttacgagggactggactggctttcgaacaacattgcaagcaaggcttagtgagctgtcctggtttcttctacatgttgtgcgtattgtgtggttatcatcatcagcataggtgtttgatgcatttgttgttgttattactttttgttgttcaagatttgtaatacactggaagaaataagttgatttcttgtttgcattgttaaaaaaaa

SEQ ID NO: 13490 - DNA, 1025 bp, Picea glauca
cttctcgactgcagcgctaggtgttcgagaggcaccagagatctctttgcggggagccattcttctcccctggaatctcagatctgactcttcaactcgggatctctaacaggtggtcaagatggggctcacttttactaagctttttagccggctcttcgcaaagaaggaaatgcgcattttgatggttggtcttgatgctgctggtaagactaccatcttgtataagctgaagctgggagagattgttaccaccatccctaccatcggattcaatgtcgaaactgtggagtacaagaacatcagcttcactgtgtgggatgttgggggtcaggataagattcgaccactgtggaggcactactttcagaatacacagggtcttatctttgtggtggatagcaatgacagagaccgtgtagctgaggcaagggatgagttgcacaggatgttgaatgaggatgagttacgagatgcagtcctgctagtgtttgcaaacaagcaggatctcccaaatgcgatgactgctgctgaaatcactgataagcttggtctgcactctttacgtcagcggcactggtatattcaaagcacttgtgcgacttctggtgaaggtctttatgaaggcctggattggctttcaaacaacattgcaaacaaggcttaaggatgatgcttgggaactgagttggtacagtgaatgggtttagtgacgcatttgatgtctttgccgacgagtaagggacaaggagttgtgtggtgaattggcccttacatttgttcctataagtaacaaatactatattattttgtatttatctaagaatttggggggtttccttcttgggtgtatgttatatctgagatttcggtttccttttctttgttggaagctaattatgaaaaagtattagttatatatgcttgaagcgaagtgcagaaatgctgagtattaaaagctccaaaggttaacagtatctattaaagactcaaggaattatactaaaaaaattatgtaagagtac

SEQ ID NO: 13491 - DNA, 968 bp, Juglans hindsii x Juglans regia
tgtgttggtcccggggatcggccattacggccggggctctcaaaaaatcgcggcttgccaatcgtctccgctccgctcatccctttagatccttcgtcgaaagagccgactgatcgataggcagctaggactagaactagaagtaagaatggggcttacattcgcgaagttgttcagcaagctttttgccaagagagaaatgcgtattttgatggtaggtcttgatgcggccggtaagaccactatcttgtacaagctcaagctcggtgaaattgtcaccacgatccctactatcgggtttaatgtggagacggtggagtataaaaacatcagcttcactgtttgggatgttggtggtcaggacaagatccgtccactgtggaggcactacttccaaaacactcagggtctaatttttgtggttgatagtaatgacagggatcgagttgttgaggctagggatgagttgcacaggatgttaaacgaggatgaactgagggaggctgttcttcttgtatttgccaacaaacaagatcttccaaatgcgatgaatgctgcggagataactgacaagcttggtctccattctctacgccaacgccactggtacatccagagcacgtgtgccacttctggtgagggcctgtacgaggggttggattggctttccaacaacattgctagcaaggcatgagacatcaaagaaatctggtttctggcgatctgggagtatgaatgcacttttcccgtggctgttgtaatggctgaatgtttgtctaggccgtttatatatatgggtttgtgtggttgctactttagctaaatacttttagcttctaaacaaagcttttatgttgttaccatcttttttggtcacgaccgcacttaatggtaatgcttgttcgccttattattgacggtcggaattttacattggatgaaagaatgaaggcaatgtcactgtcatg

SEQ ID NO: 13492 - DNA, 966 bp, Vinca minor
agatttgagtttgccaaaagggcagtctctcaatatctgcccctgttttcacccaaaattcgatcaatccttcctctctccgtccgatttattctcgattccgcttaagaaggaaagatgggtttgtcattcaccaagctctttagccggctttttgccaaaagggagatgcgtatactgatggttggtctcgatgcggctggtaagactaccatattgtataagctcaagctgggagaaattgtcaccaccattccaaccattggtttcaatgtggagacagtggaatacaagaacatcagctttaccgtctgggatgttgggggtcaggacaagatccgaccattgtggagacattacttccaaaatactcaaggacttatctttgtcgttgatagtaatgaccgtgaccgtgttgttgaggctagggatgagctacacagaatgttgaatgaggatgaactgagggatgctgtcctccttgtgtttgctaacaaacaagatcttccaaatgcaatgaacgcagcagagatcaccgataagcttggtcttcattctctccgtcaacgccactggtatatccagagcacatgtgcaacatctggtgaagggctttatgagggattggactggctctccaacaacattgctaacaagtcctagagcagcattatcaatccaaggattttgcagatatctttgtgaaagtggacatcatatatttccttgtatttttttctctcgttattatcttgcttctgttcggtttgtttttttatacaatttggcattttgattaagattcggactttctagtaaatagagagatttgttcttttggtcttatgttgctcaagttcgtcccttgctactatgtgaaagttgttcattctctttctgtggccgggttatagttgctcaatattttaatttttgcaattgttaagagacttcaaatatcgagct

SEQ ID NO: 13493 - DNA, 1087 bp, Amorphophallus konjac
ttcctcggcgcttgcagcgcttccttgttggtggcggtgggcgtctctctcatctgagatctttccctccattcccacagctgcatctcgcccactgcagcggattcctctccaatctccatcttcgcctccagacataaagatgggtctttctttcaccaagctctttagtaggctttttgccaagaaagagatgcgcatcctcatggtgggtcttgatgctgcgggtaagactaccattttgtacaagttgaagctgggggagattgtgactacaattcctaccataggatttaatgtggagacagttgagtacaagaacattagcttcacagtgtgggatgtcggtggccaggacaagatccgtcctttgtggagacattacttccagaacacacagggactcatctttgtggttgacagtaatgaccgagaccgtattgttgaggctagagatgaactccacaggatattaaatgaggacgagctgagagacgcggtgttgctggtttttgccaacaagcaagaccttcctaatgctatgaacgcggccgagatcactgataagcttggcctgcactcccttcgccagcgccactggtatattcagagcacttgtgccacctccggggaaggcctgtacgagggattagactggctctcgaacaacattgctagcaaggtctgatacggcggatcaactgggccccgtccgtcacatgcttgccaaagtttttaagaattccaccagccatcttgacggccacactagttcttcctctctcaggctttagatattacagtattgtgatcttcgtaggtaggtatcatcgagtggtgttctgatccttgcttagtgtacatatatatatagggcgggaaacggtgagagtttgttcatgttagccactcctgtttcactgacataattgcttcgttgttgagcaatgatagttttgaaatttaggtttggtctcttcatatctgtgcaggattttggcttaccttgcatgtaaggttggaaatggcccaagctcggctcatttagtatgtaatcgaattttatgcaaaccaaagtttgaatttt

SEQ ID NO: 13494 - DNA, 938 bp, Brassica rapa
attatatacgtagagattttcagtgtaaccacaaaaaagaatcatcgggaaacgttggaagggtcatcggagctgagatctctcgtgcggcgttgtttcttgggtttggaagaaaacatgggggtgtcattcgggaagctgttcagcaagctgtttgcgaagaaagagatgagaattctgatggtgggactggatgcagctggtaagacgaccatcctctacaagctcaaacttggtgagatcgtcaccactatccctaccattggtttcaatgttgaaactgtggaatacaagaacattagctttaccgtctgggatgtcgggggtcaggacaagatccgtccattgtggaggcactacttccagaacacacagggacttatctttgttgtggacagcaacgatcgtgaccgtgttgttgaagcgagagacgagcttcacaggatgttgaacgaggatgagttgagggatgcagttctgcttgtctttgctaacaagcaagatcttcccaacgcaatgaacgctgctgagattactgacaagcttggccttcactctctccgccaacgacactgggacattcagagcacatgtgccacctctggagaaggactctacgagggacttgactggctctccaacaacatcgcaaacaaggcatagaaaggatgtagcaagatccctcttcacttgttttgtttataaatcaaggaaagaagggttctgtttcgctagtactatcttcatatcttcttcttcttctcaaaaactcaaaaccataatcatactttgtactttcatttaataacgatgtttttttgttttaatttttttcttccgtaattgagtaaaatcacttttgtttattcttttcaaccagatctttactttggatattagtttcgttattcaaatttgcacctcgggtgtatacaatc

SEQ ID NO: 13495 - DNA, 1030 bp, Cedrus atlantica
gttggccttccggaccccatattcattcatctcaggcctctgtagaaccaacctttcatcagcggggtctgtgattttacagcattttcgattttctctgcagtttggcaagatggggcttacgttcaccaagctctttcagcgtttgtttgccaagaaggaaatgcgtattctgatggtgggtcttgatgctgccggtaagaccaccattttgtacaagctgaagcttggggaaattgtcaccacaattcccactattggtttcaatgtggagactgtggagtacaaaaatatcagcttcactgtttgggatgtcgggggtcaggataagatccgaccattgtggagacattactttcagaatacccagggtcttatatttgtggtggatagtaatgacagggaccgtattgttgaagcaagagatgaattgcataggatgctgaatgaggatgagttacgagatgctgttcttcttgtatttgcaaacaagcaggatcttcccaatgcaatgaatgctgctgagataactgataagcttggtctgcattctttgcgtcaacgccattggtatatccagagtacctgtgctacgtctggtgaaggactgtatgagggcttggattggctttctaacaacattgcaaacaaggcataatgttgaagcagagtaatgaaactgtgatgcctttgagaatgtgttggattccatgcgttttcagtattggttggatgctttctgggatgtagtggacgtgtttcatgcttctcctagtagattgaagtagataaatagttaaggggggttgaggatcttttctgtgctgtactgatcctcagtttacttattttgtttgaaattttgcatgtctacaattgttttgtaatcaactatgaattcttccagtggttcctcaggattccagtgtgcaatttattgccctgtcgccccccctcctttgaccttgtctgtagattaaaaggtactgttactgaaattttcaaagttatatattctttcgaatttata

SEQ ID NO: 13496 - DNA, 1021 bp, Cichorium intybus
ttaacgcaaagatttaaaaccgaaacgtgactgggaccatttgatttggtttaagaactcacggttctcaaacgtccacttttcttcactcaaaccccttcaagtaataattactacgcctactctgcatccctcttgtccatcgcaaatttcgtcggtgatcgccggctccacattccttaagatctccgtcccatcatacaaagatgggattgtctttcaccaagcttttcagtcgcctttttgctaagaaagagatgcgcattttgatggttggtctcgatgcagctggtaaaaccaccattttatacaagctcaaattgggagaaattgtaaccactattcctaccattggattcaatgtggaaaccgttgagtacaagaacatcagctttactgtatgggatgttggtggtcaggacaagattcgccctttgtggaggcactatttccaaaacacacaagggctaatctttgtggttgatagcaatgatcgtgaccgtgtggtggaggctaaagacgaactacacaggatgcttaatgaggatgaattaagagatgcagttttgcttgtgtttgccaacaaacaagatcttccaaatgctatgaatgctgctgagattactgataaacttggcttgcagtctctaagacagcgacactggtatatccaaagcacgtgtgccacatctggagagggtctatatgaaggtctggattggctttccaacaacattgctaacaaggcttaaaagagatcatcatgattcatgattcatgagtatggtcttcttagtgggttactgcaactactgttggtgtttgtttctaaatcttttgagttgtgggtattatatgtaaacctaaatttgtgccgcttttttagtatttacattgagatgtctaatggataaatagcatggtttacgccttttttgtgtttttgccactattacaacaaatgtttggttttatttggccattttgacatgctatagcatatgaaaccggttttgatgtc

SEQ ID NO: 13497 - DNA, 874 bp, Fagopyrum esculentum
tggggttgtctttcggaaaactcttcagtaggctcttctcgaagagagagatgcgcatacttatggtaggtctcgatgctgctggtaagactaccatcttgtacaaactcaagttgggagagattgtgaccactattccaacaattgggtttaatgtggagactgtggagtacaagaacatcagcttcaccgtctgggatgtcgggggtcaagacaagatccgaccattgtggagacattactttcaaaacactcaaggacttatctttgtggttgatagcaatgatcgtgatcgtgttgttgaagccagggatgagctccacagaatgctgaatgaggatgaattgagggatgctgtgttgcttgtatttgccaacaagcaagatctcccaaatgccatgaacgctgccgaaatcactgacaagcttggactccactctcttcgccaacgacattggtacattcagagcacatgtgcaacttctggtgaaggactttatgagggtctagattggctctcaaacaacattgcaagcaagggataaaaaacttcattttgtagcttctgggctgggctatatattctgttgcggcaaagattcatccaagcatagattcttctatagtattaatcccttggagtggagtgcccttatgtatacaacgtaaggtttacattttttcttacagatattgttatttgttttctatagtttatgaatactttcgttagacccaagactgttgcgttgatttttctcgagtgtatgcgttatgttcattagtattggttacttgttaattaaaaaaaaaagaaaaacaaaaaactaaactgcgtgtatacctacctacgtctcttcgtagaacgtacgtc

SEQ ID NO: 13498 - DNA, 1108 bp, Vitis vinifera
ccattagatccttctctgaagcttttgagaggcgagttgttctttctcctcttctattccgttgattcagttgacttcaattcagatctctctcgatctcaagtgctatatccgctgatctccccatgctgatcggttgaattcgaatagattcgttgttttggtctttatttctttagaattcttaggagattcgctgtttttgagccttttctggttcgactttgacctttaattgtgcatcgagtaatccatagtgaggtaagagaaaaacagagatggggctgacatttacaaagcttttcagcaggctttttgccaagaaagagatgcgaatcttgatggtaggtcttgatgctgctggtaaaaccactatcttatataagctcaagcttggagaaatagtcacgaccattcctactatcggatttaatgttgagacagtggaatataagaacattagcttcactgtttgggatgttggtggtcaggacaagattcgtcccttgtggcggcactacttccagaacacccagggtcttatttttgttgtggatagcaatgatagggatcgagttgttgaggcaagggatgagttgcataggatgttgaatgaggatgaactgagggattctgttttactggtatttgctaacaaacaagatcttcctaatgcaatgaatgctgcagaaataactgacaagctcggtctccattctcttcgccaacgccactggtacatccagagcacatgtgcaacctcgggagagggtctctatgagggtttggagtggctttccaacaacattgctaccaaggcatgaggcagccaaagagtctcattcaggataggattttctctgatgcatgtgtagacaattataggcttataatgagatcctagaaaccgagaggacatttcctccgaattttccaatgacaatattgtaatagtacagtcatggggttagttatactttttgtgagtgtttgggctttataagctatcgtttgggtctgtattactgtttctactttagctcatacttgtatggtggtgtcatctttttctgaatggattgtgctgtgctacttattctgttcccag

SEQ ID NO: 13499 - DNA, 974 bp, Quercus alba
actcaaaaaacaaaatatcgcggctcccctctccttccttctttccttcctccaatccttaacagttaatcaggttcggtactgtgaggttgcttaaaaatggggctgacatttacgaagctgtttagcaagctttttgcgaagagagaaatgagaattctgatggtaggtctcgatgctgctggtaaaactaccattttatacaagctcaagctcggtgaaatcgttactaccatccctaccatcggatttaatgtggaaacagtggaatataaaaacatcagtttcaccgtttgggatgttggtggtcaagacaagatccgtccattgtggaggcactacttccaaaacactcagggtcttatttttgtggttgatagcaatgacagggatcgtgttgttgaggcaagggatgagttgcacaggatgttgaatgaggatgaactcagggaggctgttttgcttgtatttgccaacaaacaagatctgcctaatgcaatgaatgctgcagagataactgacaagcttggcttgcattctctccgccaacgccactggtacattcagagcacatgtgcaacttctggagagggtctctatgaggggttggattggctttccaacaatattgctagcaaggcatgagccattaaagaattttggttcctagcgatttgggagaggacgcttcccctttctcagtgttgtaatagcagaatgtttgtctagaactttatatatttggcttgtatggttgctacattagctaaatacttttagctgtaaaccaaactttcatctttgttccaatgccttttgggcatagccgcacttaatagttatttttgattgccttataactgattggtgtgcaatgcaatctttctattgtacaaaagagtggagctacgaccatttaggcaatgacctaaaggccctcaattggaagagagcccttaatagaatatattata

SEQ ID NO: 13500 - DNA, 1027 bp, Quercus alba
gtcactcaaaaaacaaaatatcgcggctctctccttccttccttccttccttctttccttcctccaatctttcacaggtcatttctctctctctctctctaaaatcccatcgcagatcttaattgatagatccatcaaattatcgtagttaatcaggttcggtactgtgaggttgcttaaaaatggggctgacatttacgaagctgtttagcaagctttttgcgaagagagaaatgagaattctgatggtaggtctcgatgctgctggtaaaactaccattttatacaagctcaagctcggtgaaatcgttactaccatccctaccatcggatttaatgtggaaacagtggaatataaaaacatcagtttcaccgtttgggatgttggtggtcaagacaagatccgtccattgtggaggcactacttccaaaacactcagggtcttatttttgtggttgatagcaatgacagggatcgtgttgttgaggcaagggatgagttgcacaggatgttgaatgaggatgaactcagggaggctgttttgcttgtatttgccaacaaacaagatctgcctaatgcaatgaatgctgcagagataactgacaagcttggcttgcattctctccgccaacgccactggtacattcagagcacatgtgcaacttctggagagggtctctatgaggggttggattggctttccaacaatattgctagcaaggcatgagccattaaagaattttggttcctagcgatttgggagaggacgcttcccctttctcagtgttgtaatagcagaatgtttgtctagaactttatatatttggcttgtatggttgctacattagctaaatacttttagctgtaaaccaaactttcatctttgttccaatgccttttgggcatagccgcacttaatagttatttttgattgccttataactgattggtgtgcaatgcaatctttctattgtacaaaaaaaaaaaaaagttaattaatcgcgatctagaactaggacacgcgag

SEQ ID NO: 13501 - DNA, 862 bp, Quercus alba
gggacgtcactcaaaaaacaaaatatcgcggctctcctatccttccttccttccttctttccttcctccaatctttcacagttaatcaggttcggtactgtgaggttgcttaaaaatggggctgacatttacgaagctgtttagcaagctttttgcgaagagagaaatgagaattctgatggtaggtctcgatgctgctggtaaaactaccattttatacaagctcaagctcggtgaaatcgttactaccatccctaccatcggatttaatgtggaaacagtggaatataaaaacatcagtttcaccgtttgggatgttggtggtcaagacaagatccgtccattgtggaggcactacttccaaaacactcagggtcttatttttgtggttgatagcaatgacagggatcgtgttgttgaggcaagggatgagttgcacaggatgttgaatgaggatgaactcagggaggctgttttgcttgtatttgccaacaaacaagatctgcctaatgcaatgaatgctgcagagataactgacaagcttggcttgcattctctccgccaacgccactggtacattcagagcacatgtgcaacttctggagagggtctctatgaggggttggattggctttccaacaatattgctagcaaggcatgagccattaaagaattttggttcctagcgatttgggagaggacgcttcccctttctcagtgttgtaatagcagaatgtttgtctagaactttatatatttggcttgtatggttgctacattagctaaatacttttagctgtaaaccaaactttcatctttgttccaatgccttttgggcatagccgcacttaatagttatttt

SEQ ID NO: 13502 - DNA, 917 bp, Quercus alba
atggggactgcgcccaaaatcagctgttaaataacgcagagaagaaacttcattcacgtcactcaaaaaacaaaatatcgcggctctcctatccttccttccttccttctttccttcctccaatctttcacaggttcggtactgtgaggttgcttaaaaatggggctgacatttacgaagctgtttagcaagctttttgcgaagagagaaatgagaattctgatggtaggtctcgatgctgctggtaaaactaccattttatacaagctcaagctcggtgaaatcgttactaccatccctaccatcggatttaatgtggaaacagtggaatataaaaacatcagtttcaccgtttgggatgttggtggtcaagacaagatccgtccattgtggaggcactacttccaaaacactcagggtcttatttttgtggttgatagcaatgacagggatcgtgttgttgaggcaagggatgagttgcacaggatgttgaatgaggatgaactcagggaggctgttttgcttgtatttgccaacaaacaagatctgcctaatgcaatgaatgctgcagagataactgacaagcttggcttgcattctctccgccaacgccactggtacattcagagcacatgtgcaacttctggagagggtctctatgaggggttggattggctttccaacaatattgctagcaaggcatgagccattaaagaattttggttcctagcgatttgggagaggacgcttcccctttctcagtgttgtaatagcagaatgtttgtctagaactttatatatttggcttgtatggttgctacattagctaaatacttttagctgtaaaccaaactttcatctttgttccaatgccttttgggcatagccgcacttaatagttatttttgattgacctt

SEQ ID NO: 13503 - DNA, 1053 bp, Quercus alba
atggggacgtcactcaaaaacaaaatatcgcggctctcctctccttacttccttccttccttctttccttcctccaatctttcacaggtcatttctctctctctctaaaatcccatcgcagatcttaactgatagatccatcaaattatcgtagttaatcaggttcggtactgtgaggttgcttaaaaatggggctgacatttacgaagctgtttagcaagctttttgcgaagagagaaatgagaattctgatggtaggtctcgatgctgctggtaaaactaccattttatacaagctcaagctcggtgaaatcgttactaccatccctaccatcggatttaatgtggaaacagtggaatataaaaacatcagtttcaccgtttgggatgttggtggtcaagacaagatccgtccattgtggaggcactacttccaaaacactcagggtcttatctttgtggttgatagcaatgacagggatcgtgttgttgaggcaagggatgagttgcacaggatgttgaatgaggatgaactcagggaggctgttttgcttgtatttgccaacaaacaagatctgcctaatgcaatgaatgctgcagagataactgacaagcttggcttgcattctctccgccaacgccactggtacattcagagcacatgtgcaacttctggagagggtctctatgaggggttggattggctttccaacaatattgctagcaaggcatgagccattaaagaattttggttcctagcgatttgggagaggacgcttcccctttctcagtgttgtaatagcagaatgtttgtctagaactttatatatttggcttgtatggttgctacattagctaaatacttttagctgtaaaccaaactttcatctttgttccaatgccttttgggcatagccgcacttaatagttatttttgtattgccttataactgattggtgtgcaatgcaatctttctattgtacaaaagagtggagctacgaccatttaggcaatgacctaaaggccctcaattggaagagagcccttaatag

SEQ ID NO: 13504 - DNA, 936 bp, Quercus alba
atcaacgcagagtacatggggacgtcactcaaaaaacaaaatatcgcggctctcctctccttccttccttccttccttctttccttcctccaatctttcacagttaatcaggttcggtactgtgaggttgcttaaaaatggggctgacatttacgaagctgtttagcaagctttttgcgaagagagaaatgagaattctgatggtaggtctcgatgctgctggtaaaactaccattttatacaagctcaagctcggtgaaatcgttactaccatccctaccatcggatttaatgtggaaacagtggaatataaaaacatcagtttcaccgtttgggatgttggtggtcaagacaagatccgtccattgtggaggcactacttccaaaacactcagggtcttatttttgtggttgatagcaatgacagggatcgtgttgttgaggcaagggatgagttgcacaggatgttgaatgaggatgaactcagggaggctgttttgcttgtatttgccaacaaacaagatctgcctaatgcaatgaatgctgcagagataactgacaagcttggcttgcattctctccgccaacgccactggtacattcagagcacatgtgcaacttctggagagggtctctatgaggggttggattggctttccaacaatattgctagcaaggcatgagccattaaagaattttggttcctagcgatttgggagaggacgcttcccctttctcagtgttgtaatagcagaatgtttgtctagaactttatatatttggcttgtatggttgctacattagctaaatacttttagctgtaaaccaaactttcatctttgttccaatgccttttgggcatagccgcacttaatagttatttttgattgccttataactgattggtgtgcaatgcaatctttctattgtacaaaa

SEQ ID NO: 13505 - DNA, 941 bp, Tripterygium wilfordii
aagataaggtcgtcatctctcacgacttgcgacttgcccttatcgctcctcctcccatcctcaattgacaattgtgtcgaacgctgctacctaggggcctgagcagacatggggctcagcttcacgaagcttttcagccgacttttcgctaagaaggagatgcgcattttgatggtgggtctcgatgctgctggtaagaccaccatattgtacaagctcaagcttggagagatcgtcaccaccatccctactataggttttaatgtggagacagttgaatacaagaatatcagcttcactgtttgggatgttggtggtcaagacaagatccgtcctttgtggaggcattatttccagaacactcagggtcttatctttgtggtcgatagcaacgacagggatcgcgttattgaggcaagggatgaactacataggatgttgaatgaggatgaactgagggaggctgttttgcttgtatttgccaataaacaagaccttcccaatgcaatgaatgctgcagaaataactgacaagcttggtctccattctcttcgtcaacgccactggtacatacagagtgcatgtgctacttctggggagggtctttatgaggggttggattggctttccaacaacattgctagcaaggcatgaggtagttgaggattctggcacttgcattagattttgcagcatcagcagtactacagaggactagagggtagttcctcatcttctccagcaactattgtaatagcacagtagttgtttatattcacatccacgcataatatgagtgttatatgctatagctcaatacttttaccatgagcagaactccaatgaaaagtacaaacctgttcgaacgggcaccggatcagcatttagcattctgtttttggcctgtaatcattctctcagactattttctcatctagcac

SEQ ID NO: 13506 - DNA, 604 bp, Acacia harpophylla
gaggctctgctctgattgtattcggatctgcactcaaatcagcgatcttcttatctctctccatctgaaagaagagatgggcctgtctttcggtaagctttttagccgtctctttgccaagaaagagatgcgtattctgatggtaggtctcgatgctgctggtaagactaccatcttatacaagctcaagctgggagagatcgtgaccaccattcctaccattggctttaatgtagagactgtggaatacaaaaatattagcttcaccgtctgggatgttggtggccaggacaagattcgtcctttatggagacactatttccaaaatacacaagggcttatctttgttgttgatagcaatgatcgtgatcgtgttgttgaggccagagatgaacttcaccggatgttgaatgaggacgagttgagagatgcagtacttcttgtatttgccaacaagcaagatctaccaaatgctatgaatgctgccgaaatcacagacaagcttggccttcattctctccgtcagcgccactggtacatccaaagcacgtgtgccacttctggtgaaggactctatgagggactggactggctctcaaacaat

SEQ ID NO: 13507 - DNA, 798 bp, Amaranthus tuberculatus
acttctctttctacctctgtatttctctctgctcttcaaagaatcacatatcgtagtgggtggtgatcaagtcaactgagggaaaatggggcttacattcacaaagctgtttagccgcttgtttgcgaagaaggaaatgcgaattctgatggtaggtctcgatgctgctggtaagaccaccatcctctacaagctcaagcttggtgagatcgtgactactatccccactattggattcaatgtggaaactgttgaatacaaaaacatcagcttcactgtctgggatgttggaggccaagacaagatccgtccattgtggaggcactacttccaaaatacacaggggctcatctttgtggttgacagtaatgatagagaccgtgttgttgaggctagggatgaattgcataggatgttgaatgaggatgagctgcgtgaagcagtactgctggtctttgcaaacaagcaggatcttcctaatgcaatgaatgctgctgaaattactgataagcttggcctgcactctctccgacagcgtcactggtatatccagagcacttgtgcaacctctggggagggactctatgaaggtttggattggttatccaacaacattgcaaacagggtttaaggaatcaatgttttgttacggactggatgcaggggtgaagattatctaagtcacatctttacgtagagaactgagtttgtggttgtaattttgtggacgggagttataagctctttgcttagagcttcagatatggatatgtttctaaatagagcgttgtgtgtacg

SEQ ID NO: 13508 - DNA, 989 bp, Amaranthus tuberculatus
ctctctgctcttcaaagaaatcacatatcgtagcgggtggtgatcaagtcaactgagggaaaatggggcttacattcacaaagctgtttagccgcttgtttgcgaagaaggaaatgcgaattctgatggtaggtctcgatgctgctggtaagaccaccatcctctacaagctcaagcttggtgagattgtgactactatccccactattggattcaatgtggaaactgtcgaatacaaaaacatcagcttcactgtctgggatgttggaggccaagacaagatccgtccattgtggaggcactacttccaaaatacacaggggcttatctttgtggttgacagtaatgatagagaccgtgttgttgaggctagggatgagttgcataggatgttgaatgaggatgagctgcgtgaagcagtattgctggtctttgcaaacaagcaggatcttcctaatgcaatgaatgctgctgaaattactgataagcttggcctacactctctccgacagcgtcactggtatatccagagcacttgtgcaacctctggggagggactctatgaaggtttggattggttatccaacaacattgcaaacagggtttaaggaatcaatgttttgttacggactgtaaaggtcctggatgcaggggtgaaaattatctaagtcacatttggtttatagccatctttacgtagagaactgagtttttggttgtaattttgtggacgggagttataagctctttgcttagagcttcagatatggatatgtttctaaatagagcgttgtgtgtacgagattcaagctttgggttacgatttatgtaaggtaaaacatatgtaactgaagctagtattaggccttttgcatgcgcttgatagtgacaattcagttgtattgctatcctttgaatttcgtctccaaattattcatttgtcaactagtttagttggcctcctgatattggattatgatttatgcaac

SEQ ID NO: 13509 - DNA, 812 bp, Brassica napus
gatataagtagagatttttttctgtcaaacacaaaaaaaaaaaaaaaaaaatcatcgtgaaacgttggaaagcgacgagcatcggcatcagatctcgtgcggcggttgtgttcttcgggtttagaataaaaggaaaggataggagatggggctgtcatttgggaagctgttcagcaagctgtttgcgaagaaagagatgcgtattctcatggttggtctcgatgctgctggtaagaccaccatcctctacaagctcaagcttggtgagatcgtcaccaccattcccaccattggtttcaatgttgaaactgtggagtacaagaacattagcttcaccgtgtgggatgtcgggggtcaggacaagatccgtccactgtggagacactacttccagaacacacagggacttatctttgtcgtggacagcaacgatcgtgaccgtgttgttgaagccagggacgagcttcacaggatgctcaacgaggatgaattgagggatgcagttctgctgtttttgtctaacaagcaagatctccccaacgctatgaacgctgctgagattactgacaagcttggccttcactctctccgccaacgccactggtacattcagagcacttgtgccacctctggagaaggactctacgagggtcttgactggctctccaacaacattgctaacaaggcatagaaaggaggtagcaagattcctccctgcttgtttcgctagtactataaaaacgaaacaagatttatacaatgtcgctcccactacactctgtctacccttaatttatatgaaagctagctcc

SEQ ID NO: 13510 - DNA, 706 bp, Centaurea maculosa
attcattttatgttcctccaaatctatctcattctttagcttccatcattctccctcaattgttcctatctccggtaccctagatcatagagagatgggcctgtctttcggaaagttgttcaagcgattgttcactaagaaagaggtacgcattttgatggtcggtcttgatgcagccggtaaaacgacaattttgtacaagctcaaattgggggaaattgtcaccactattcctaccattggattcaatgtggagactgttgagtacaagaacattagcttcaccgtatgggatgttggtggtcaagacaagattcgaccattgtggaggcactacttccagaacacacaaggtcttattttcgtggtagatagcaatgatcgtgaccgtgtggttgaggctagagatgagctacatcggatgcttaacgaggatgaattgagagatgcggtattacttgtgtttgccaacaaacaagatcttccaaacgctatgaatgctgctgagatcacagataagcttggcctacattctcttcgacagagacattggtatattcagagcacatgtgcaacttcaggggaaggtctttatgaaggactggattggctttcgagcaacattgctagtaaagggaaacattagatatcttgtagagggaactcaacctttacttttaaccatttctttgaataatacttaaga

SEQ ID NO: 13511 - DNA, 1164 bp, Ceratodon purpureus
gccccggactcctctgtccgtgtgttggcactcgcttgtcgcagcgttgtggagagtcaccaaccagccagccagggttagagggtgccgctgcgagaggagggtttgctgttttcctgctgctgttgctgcctcgctctcgctctctcgcccctctgcccggccgagtcccgatctccagcgccgtccccgcggggtgctgccgccatggggctcaccttcaccaagctcttccagaagctcttctccaagcgggagatgcgcatcctcatggtcggtctcgacgccgccggtaagaccaccatcttgtacaagctcaagctcggcgagatcgtcaccaccattcctaccatcggtttcaatgtggagaccgtggagtacaagaacatcagtttcactgtctgggatgtcggaggtcaggacaagattcggccgttgtggaggcattacttccagaacacgcagggattgatctttgtggtggatagtaacgatagagaccgtgttgtggaagccagagacgagctgcatcggatgctgaacgaggacgagcttcgtgatgctgtccttctggtgtttgccaacaagcaagatctgccgaatgcaatgaatgccgccgagatcactgacaagcttggtctgcactcactccgacaacgccactggtacattcagagcacatgcgcaacctctggagagggtctgtatgaagggctcgactggctgtcaagcaatatcgcaaacaaggcataagtgtggtgctgaggagtgctgcttttcatattccatgagcttttatgcaacctataccgacttggcaccatttgcttttagttttgaacttgcacatcgctttccaacgcttgtttctctcaacaccttacatacgtttctctcggagaagaatattgtcctaatgaaatctgtgtgcctctgtgtacgcttctcaactgcttgcgttttgtcgttcggaagggtcatattacaatccattttgtaaccacaagttgtacgctgcaattcagatacctgtagggttgttcgtcgatttatttggttaacttcttgtttgattgaattattgatttgctgaactatgtcagacttggatgcgatcattgtatcaacttataattaaatgtccccttcgcgtggcactactcg

SEQ ID NO: 13512 - DNA, 1236 bp, Cycas rumphii
gagagggtttggtggatatagcgttgcagactaagatttgggtctgtttctactcgaattcgacctctagacgtctcagcgcttccccaaggcaagcccccgttttattctgatcagaaggagctgcgtttcgggttcaccttcagctgccgagatgggtttaactttcaccaaacttttccagcggatgtttgccaagaaggagatgcgaatccttatggttggtcttgatgcagctggaaagactaccattttgtacaagttaaagctgggagagatcgtcacgacgattcccaccatcggcttcaacgtggagacagtggaatacaagaacattagctttactgtctgggatgttggtggtcaggacaagattcggccactgtggaggcactactttcagaatacgcagggtcttatctttgttgtggatagcaatgacagggaccgtatagttgaggcaagggatgaactgcacaggatgttgaacgaggatgaattacgagatgcaatcttgcttgtatttgcaaacaagcaggatcttccaaatgcaatgaatgctgcagagatcactgacaagcttggcctgcactctttacgccagcgacattggtacattcagagcacatgtgctacctctggtgaaggactctatgaaggccttgattggctttcaaacaacattgcaagcaaggcctgaggctgatgcttaatgtctttgggatgggatagattcttttaggacaacagtaatgaaagggtataatggtccacttcgtacttttgctagagacagagatgaggatgagttccacagtgaactgagccttggtttctgtactgattattttgttcctttaaatctgcatacctataattatcttgtaatcaactaagaattcaggggttttgctttggagtatttatggctttcatttccttgcgaatgatagaaacatttattgtatttgtacaagtttgaatagaagcgcagaaatgcttaatagagacatttaccgtagattttgaatagaagtccagaaatactaaatattaatttttgtaaaggtttaacaatatttatgaagtacgcgatgtattataaaagtttttgttgaccacattatgctggaacaattgctgtgagtgaaaattttgatatctggaaaacttacagcatagatccagatgttggatacaacatgagtaaataaaatacctgaaactgcacaggga

SEQ ID NO: 13513 - DNA, 1197 bp, Cycas rumphii
tcctctcaccttgcctcattcttaattctccatagtcgagaaaatcttggtagccaacatttttataagaagaggaatattacaaataaaacgtcaaggaggaagataggttttggagttaacggcaaccgcgagctacatcatgatcacatgtagaacacgtagatctgcgctgctaagctcctattaaggaccagttttccggaatttattcgttgatgtatagtctgccatatcaggcggggcctttatagagaacgatctctgcatttttctcacgagaagaagctgcaagtccatcggatttgcgtccaaatctccgaatttcgccaagttttgaagatgggtcttacattgagcaaggttttcagccgtctgtttgcgaagaaggagatgcgtattctgatggtgggtcttgatgctgctggtaagaccaccattttgtacaagttgaagctgggagaaattgttaccacaattcccacaattggcttcaatgtggaaactgtggagtacaagaacattagcttcactgtttgggatgttgggggtcaggacaagatccgaccgctatggagacattactttcagaatactcagggccttatctttgttgtggatagtaatgacagagaccgtgttgtcgaggcaaaagatgagttacacaggatgttgaatgaggatgaattacgagatgcagtcctccttgtgtttgcaaacaagcaggatcttcccaatgcaatgaatgctgctgagatcactgacaaacttggcctgcactccttacggcagcgccattggtacattcagagcacttgtgccacttctggtgaaggcctgtacgagggtttggattggctttcaaacaacattgcaaataaggcttgagattgaagcatgaggatgagcctcagtatgcatacgaggatggggttgattcatttatggctgtaatggacatgtttaatgatttaggtagacaatatctcttgggtttgggtatcatttctgcactgaacaggtcttcagtttgcttattgttttgttcttacaaattttgcatgcctacaattgtcttttaatcaactaagaattctgtcatttgttctttctggattcattttagaaatctattctgtggtgaactgatcttcagtgtgtagttctgttgttataaattttatgtgcctataattg

SEQ ID NO: 13514 - DNA, 922 bp, Euonymus alatus
caaacctttaaacccgtgtgaataacggacagctctttctctagctcgctttcctcgcctaagccacactcttctcgcgggcaagtcctctctctctaaattttcggcttgaagaaaatggggctttcattcaccaagctttttagtcggctctttgccaagagagagatgcgtatcctcatggtgggtcttgatgctgctggtaagaccaccattctctacaaactcaagctgggagaaatagtgaccaccattcccactattgggtttaatgtggagactgtagaatacaagaacattagctttaccgtctgggatgtcgggggccaggacaagattcgacctttgtggagacactacttccaaaatactcaagggcttatctttgtggttgatagcaatgaccgagaccgtgtggttgaggccagggatgagctacacaggatgttgaatgaggatgaattgagagaggcagtgttgctagtgtttgctaacaagcaagatctgccaaatgctatgaatgcagcagagataactgataagcttggtcttcactctctccgtcagcgccactggtatatccagagtgcatgcgccacttctggtgagggtctgtatgaaggacttgattggctctcaaataatattgcaaacaaggcatagacagcggaattctgagttttggattgcagcaagttgcggaacgcacagctagttgttccttattttgttttaccgtacgatttctttgtagaatctgtgttacttgagtcagattatttgtgttttgtcatgcaaacgttgctattgtttactcctagttgcagaataattcatacatttcaaattttcatctttctgcccattttctcgtttaatgaaactccctttcaaccttcctacatgcgggattcttgtattg

SEQ ID NO: 13515 - DNA, 994 bp, Gossypium raimondii
ggcgtatcccgttttggatctatcaatctccaaatccccgtaaaaacactgaaagacagcacctttgatttcgagggaggggtgtagatcttcgcttctctcctttgattgtcttcgcgtaataatcgtacacatttctctcagacatgaaaaatggggctatctttcacaaagctattcagttggcttttctccaagaaagagatgcgcatattgatggttggacttgatgccgctggtaaaaccacaattctttacaagctcaagttgggagagattgtcactaccattcccaccataggtttcaatgttgagaccgtggaatacaagaacatcagtttcactgtttgggatgttggtggccaggacaagatccgaccattgtggaggcattacttccaaaacacacaaggacttatttttgtggttgatagcaatgatcgcgatcgtgtggttgaggctagagatgagttacataggatgttgaacgaggacgagttgagggatgctgttctgctagtattcgcaaacaagcaagatcttccaaatgctatgaatgctgctgagattactgacaagcttggtcttcattctccccgccagcgccactggtatatccagagcacatgtgccacttccggtgaaggactgtacgagggactggactggctctcgaacaatattgcaaacaaggcatagatggcataattgagttcagtcaccactaattcaggttcctttttgagttatatggatgtctaccccagttcaagtgtgctgtatttttcatggtttctcgcaaaaattgccatttgttgcttgtagttcaagaataattgttaaattttttggtttttccttgtggtattatctgaatatagctaccaaaagaaacaaacagttttgggccattcttccttggtgaaaattgatggttacgccgtttgattgctgtaatgttaaatatataaatacaatataatgtcgtttcttt

SEQ ID NO: 13516 - DNA, 629 bp, Nuphar advena
gagagagagagagaggtagaagcggacgaagggccgtagcttcttgggttcgcggtacagccctcagatccaagtagcagagatggggctgactttcaccaagcttttcagtcgcctttttgcaaagaaagagatgcgtatactaatggttggtctggatgctgcgggtaagaccaccatcttgtacaagctgaagcttggagagattgtgaccaccattcctactatcggattcaatgttgagactgtagaatacaaaaacatcagcttcacagtttgggacgtcggtggtcaggacaagattcgacctctgtggagacactacttccaaaacacgcaaggcctcatcttcgtggtggatagcaatgaccgagatcgtgttgttgaggcaagggatgagctgcaccggatgctgaatgaggatgagttgagagatgcagtgctacttgtttttgctaacaagcaagatcttccaaatgcaatgaatgctgctgagataaccgataagcttggccttcagtctctccgccaacgccactggtacatccagagcacttgtgcaacttcgggtgacgggctttacgagggcttggactggctctccaataacattgccaacaaggcctcac

SEQ ID NO: 13517 - DNA, 857 bp, Elaeis guineensis
gctcctcctgagatctcatttcttttccttctcttccccctcacgtgaagatggggctgtctttcaccaaactattcagtcggctttttgcaaagaaagagatgcgtattcttatggtaggtcttgatgctgctggcaagaccaccatcttgtacaagctgaagctgggagagattgtgaccactattcctaccattggatttaatgtggagacagtggaatacaagaacattagcttcactgtgtgggatgttggtggtcaggacaagatcagacctctgtggagacattacttccagaacacccagggccttatctttgtcattgacagcaatgacagagatcgtattgttgaggctagagatgaattgcacagaatgcttaatgaggatgaattgagagatgcagtgctgcttgtctttgcgaacaagcaagatcttcccaatgccatgaatgctgcagagatcactgataaacttggcctgcactccctccgccaacgtcactggtacatccagagcacatgtgccacatctggggagggtctttatgagggactggagtggctctcaaacaacattgcgaacaaggcatagatattgctggctggataccttgttggagcttaaaacattgttaggatcttctgttaaccacatgtgtttgctagagctctgctccaagaatcaatttgcttatgtttctatctttcatagactcgagcatttgttgtctcatctagaccaacaataatctggaaatttgttcttacctagatgttaaatttttgctttctttttttctctttctttacctgctaattctgtcgttggaataccttgcctgggtgatataat

SEQ ID NO: 13518 - DNA, 818 bp, Pinus taeda
cctcctcctccccttttcggcagcagtgctaggtgttcgagaggcgtctcagatctctttgcggggagccattcttgtcccctcgaatctcagatctgacccttcaactcgggatctctaacaggcggtcaagatgggactcacttttaccaagctttttagtcggctcttcgcaaagaaggaaatgcgcattctgatggttggtctcgatgccgctggtaagacgaccatcttgtataagctgaagctgggagaaatcgttacgaccatccctaccatcggattcaatgtggaaaccgtcgagtacaagaacatcagcttcactgtgtgggatgttgggggtcaggacaagatccgtccactatggagacactacttccaaaatactcagggtctcatctttgtggttgatagcaatgatagagaccgtgttgtagaagcaagggatgaactacatagaatgctgaatgaggatgaactacgtgatgctgtattgcttgtgttcgcaaataagcaagatcttccaaatgctatgaatgctgcagagataactaacaaacttgggatgcattccgttaggcagcgccactggtatatccaaagcacttgtgccacttctggcgagggcttgtatgagggcttggattggctctctaacaacattgcaaacaaggcttgaagaaatatggtgaactgggttcctggaattttgtagggcaatgtcgtcatatttcatttttgtcagagacagtttggagaaataagtgcagtcaaactgacttttgactactattcaatttcttctatgggtttgattg

SEQ ID NO: 13519 - DNA, 869 bp, Rosmarinus officinalis
aaaataggtcaatatataatattgcctctgagctagatctgactctgctcagacccctcctctttccgctagtttcttcatcgttagaaaatggggttgtctttcaccaagctttttagccggctttttgccaagaaggagatgcgaattcttatggtaggtctcgatgctgctggtaagaccacgatattgtataaactcaagttgggagagatagtgacaacaattcctacaatcggattcaatgtggagacagtggagtataagaacataagcttcactgtttgggatgttggtggtcaagataagattcgaccattgtggaggcattacttccagaacactcaagggttgatttttgtggttgatagtaatgatcgagatcgtgttgttgaggctagggatgagctgcatagaatgttaaatgaggatgacctgagggatgccgtgctgctagttttttctaacaaacaggatcttcccaatgccatgaatgctgctgagataactgacaagcttgggcttcactctcttcgtcaacgccattggtatatccagagcacatgcgccacctctggagaagggctatatgaggggctcgactggctctccaacaacattgctaacaagtcttaaagaagaaacgttcgatggatttcagcatctatacccttgttcaagagaaccgttttgtgggtattttcccatgggatcctgtactgtgattacttgtttccttttttatatcgtagatagtggtatcctactatgtacaattgagattttacacatgtttcagactgcaattaatgctttgggcctctctttggcacctttattctggaattaaatgcatatctgaaaacttt

SEQ ID NO: 13520 - DNA, 623 bp, Triphysaria pusilla
tttcgtttggtgtctccagggcagcctcacaccaagatctgcccttcaaatcttcattcttctcaaatttcgtataccaatcgcccaaaaaatgggtttgtctttcaccaagcttttcagccggctgtttgccaagaaagaaatgcgtattcttatggtaggtctcgatgctgctggtaagacaacaatactatacaaactcaagcttggagagattgtgacaaccattcctacaattggatttaatgtggaaacagttgaatacaagaacattagcttcactgtctgggatgttgggggtcaagacaagatccgaccattgtggaggcattactttcagaacactcaagggttgatatttgtggttgatagtaatgaccgggatcgtgttgttgaggctagggatgaactccacaggatgttgaatgaggatgaactgagggatgcagtgcttcttgtttttgcaaacaaacaagatctcccaaatgccatgaatgctgctgagataaccgacaagcttggacttcactctctccgtcaacgccattggtatatccagagcacatgtgctacatctggggaagggctgtacgaggggctcgactggctctccaacaacattg

SEQ ID NO: 13521 - DNA, 856 bp, Triphysaria pusilla
tacgtatctcattccttgtgctggttgaagagatctcgagctcacaggtctctacacctctcatcctcctcgatttgaaagatggggttgtctttcaccaagcttttcagccggctgtttgccaagagagagatgcgtatactaatggttggtctcgatgctgctggtaaaaccaccattctctacaagctcaagctcggcgaaattgtcaccactatccctactattggattcaatgtggagactgtggaatataaaaatattagcttcactgtttgggatgttgggggccaagacaagatccgtccattatggaggcattatttccaaaacacccagggcctaatctttgttgttgacagcaatgatcgagaccgtgttgttgaagcgagagatgaactgcacagaatgttgaatgaggatgaattgcgagaagctgttctcttggtgtttgccaacaaacaagatctcccaaatgcgatgaatgctgctgagataactgacaaactgggccttcattctctccgccaacgccattggtacattcagagcacatgtgcaacttctggtgaggggctgtacgaggggctagactggctttcaaacaacatcgctaataagtcttgaaatctttgagatcgaaatgctgttttgagctctgttgttcaaccatggttcccgttatgcacaatgttatcttttatatgtattttttgggatgatttgtagatttttgttggtgtttgttgatctctctctatatattcttgcttgtgaaagtaggagtgaatattgtgttgaacttacgagtttgagggcagtaagtattaagaaaataaatgtatgttggataatc

SEQ ID NO: 13522 - DNA, 871 bp, Triphysaria pusilla
cttgtgctggttgaagagatctcgagctcacagatctctacacctctcatcctcctcgatttgaaagatggggttgtctttcaccaagctcttcagccggctatttgccaagagagagatgcgtatactaatggtcggtctcgatgctgctggtaaaaccaccatcctctacaagctcaagctcggcgaaatcgtcaccacaatccctactattggattcaatgtggagactgtggaatacaaaaatattagcttcactgtttgggatgttggaggccaagacaagatccgtccattatggaggcattatttccagaacacccagggcctaatctttgttgttgacagcaatgatcgagaccgtgttgttgaagcaagggatgaactgcacagaatgttgaatgaggatgaattgcgagaagctgttctcttggtgtttgccaacaagcaagatctcccaaatgcgatgaatgctgctgaaataactgacaaactgggccttcattctctccgccaacgccattggtacattcagagcacatgtgcaacttctggtgaggggctgtacgaggggctagactggctttcaaacaacatcgctaataagtcttgaatgctttgtttgtgagatcgaagtgttgattttagctttgccgttcaaacttggttccgtttatgaacaatgctatattttcagtgtattttttgggataatttgtagatttttgttggtgtttgttgatctctctctctatatatattcttgcttgtgaaagtaggagtgaatattgtgtcgaacttacgagtttgagggcagtgagtattaagaaaataaatgtatgttggataatcgaccaaatttgagctttgg

SEQ ID NO: 13523 - DNA, 881 bp, Triphysaria pusilla
cttgtgctggttgaagagatcttgagctcacagatctctacacctctcatcctcctcaatttgaaagatggggttgtctttcaccaagcttttcagccggctgtttgccaagagagagatgcgtatactaatggttggtctcgatgctgctggtaaaaccaccattctctacaagctcaagctcggcgaaattgtcaccacaatccctactattggattcaatgtggagacagtggaatataaaaatattagcttcacggtttgggatgttggaggccaagacaagatccgtccattatggaggcattatttccagaacacccagggcctaatctttgttgttgacagcaatgatcgagaccgtgttgttgaagcaagggatgaactgcacagaatgttgaatgaggacgaattgcgagaagctgttctcttggtgtttgccaacaagcaagatctcccaaatgcgatgaatgctgctgagataactgacaaactgggccttcattctctccgccaacgccattggtacattcagagcacatgtgcaacttctggtgaggggctgtacgaggggctagactggctttcaaacaacatcgctaacaagtcttgatcaatgctttgtttgtgagatcgaagtgttggtttgagctttgccgttcaaacttggttccgtttatgaacaatgctatcttttcagtgtatttttgtgataatttgtagatttttgttggtgtttgttgatctctctctctctctctctatacattcttgcttgtgaaagtaggagtgaatattgggtcgaacttacgaatttgaggtcaatgttagtattaagaaaataattgtatgttggataatcgaccaaattcgagctttgg

SEQ ID NO: 13524 - DNA, 797 bp, Utricularia gibba
ttacgttcacaaagcttttcagccggctttttgccaagaaggagatgcgcattttgatggttggtcttgatgccgctggtaagaccacaattttgtacaagttgaagcttggagagattgtcaccaccattccaaccatcggtttcaatgtggagactgtggagtacaagaacattagcttcaccgtctgggatgttggtggtcaggacaaaatccggccactgtggaggcactatttccaaaatactcaaggtctaatatttgtggttgatagcaatgatagggaccgtgttgtggaggcccgcgatgaattgcataggatgttgaatgaggatgagctgagagatgcagtgttgcttgtttttgctaacaagcaagatcttcccaatgcaatgaatgctgctgagataactgacaagctcggcctccactccctcaggcagcgtcattggtatatccagagcacttgtgctacttccggggaaggactttacgagggattggactggctgtcaaacaatatcgccaacaaggcgtgatcgtcccaagtggtccgcggggtgcatcttatgtctttatccttgatacttgtgttctgtgttgtatttcgcttctggctgtggtggccactctgctgctcgacacctgtgcctgcttttcaaatcaatattcacccaggaagaaggaataaaaaactttattcgcagctgcgattacatttttgttcacacaactcttcttcataatgttccattgtcgaagaataaaggtgtatgcgtatatgcatcatgtatttg

SEQ ID NO: 13525 - DNA, 938 bp, Valeriana officinalis
agactcacgcctctcaaaaaaccgcatacgtctctctcctctcgctcctcaattttcctgcgaagctttcgagagaatctggtgaagcgagatcaagatggggctcacctttacgaagctgttcagtaagttatttgcgaagagggagatgcgtatacttatggtaggtcttgatgcagctggtaagactacaattttgtacaagctcaagcttggagaaattgtcaccacaattccgacaatcggattcaatgtcgaaactgtggaatacaagaacattagcttcacagtgtgggatgttggaggtcaggacaagatccgtccattgtggaggcactacttccaaaacacacagggtctcatcttcgtggtggatagcaacgatagggaccgtgttgttgaggctagagacgagttgcacaggatgctgaacgaggatgaacttagagatgctgttttactcgtatttgccaacaaacaagatctaccgaacgccatgaacgctgctgaaataaccgacaagcttggcctccattctcttcgacaacgccactggtacatccagagcacctgtgcaacctctggagaaggtctttatgaaggtctcgagtggctctccaacaacatagctaccaaggcgtaaggctagattcggtaatgaggtttgtggatttcgctggattttaagttgatatatagatacatacatataaagaaaaacatactatgtagacattttgtgagccctttgagtattgtatgtagcaagatttgttaccctaaaacctactacttttttttgttattcccggttttatatttttgatattatgttacttgaatcattactacttgagttgtaaaccctgtattcaaacatctgtttaagatgtttcacaattggatttgtaactaattctttatcatacgtagtttga

SEQ ID NO: 13526 - DNA, 799 bp, Primula obconica
attcacaaagcttttcagcaggctctttgctaagaaagagatgcgtatactgatggtgggtctcgatgcagctggtaagacgaccattctttacaaactcaagcttggagagatcgtcacaacaatccctaccattgggtttaatgtggagactgtggagtacaagaacattagcttcactgtttgggatgtcgggggccaggacaagattcgcccattatggagacattacttccagaacacacagggacttatctttgtagttgatagcaatgaccgagatcgtgtggttgaagcaagggacgagctgcacagaatgttgaatgaggatgagttacgggatgcggtgcttctggtatttgccaacaagcaagatcttccaaatgcaatgaatgctgctgaaataactgataagcttggtcttcactcactccgccaacgccactggtacatccagagcacttgtgccacatctggggaaggactgtatgaaggcttggactggctctcaaacaacattgccaataaggcataggcagttggatggtgatctcggactctcggggttacattgtgcaattgcatttgcaggcataggcagttcgtaatttctgtagtgttctaatttgcgcccttattgaattcgttactttttttttcgaagctttcattttggagcttgttatctacgttctccctttatgagaatactaaatgtggacagttggtattgtactaatgtactgaaagataattacatgttatcttctcctctctaatgttcaatttcgaaattcat

SEQ ID NO: 13527 - DNA, 967 bp, Pteridium aquilinum
agactgctgcatttaacgctaaatcggagagaacatttctctctttctctctcctcgcgctcgctctcgtcgttcgaactctccctcgctctcgcgtgtgtttcctgcgcgcgcgagacagtcgccatgggtctctccttcaccaagcttttccagcgactgttcgccaagagggagatgcgcatccttatggtcggcctcgatgcagccggtaaaaccaccattctgtataagcttaagctcggggagatcgtcaccaccattcctaccataggattcaatgtcgagactgttgagtacaagaacatcagtttcacagtgtgggatgttggaggccaagacaagattcgccctctctggaggcactattttcaaaacacccagggcctgatatttgttgtagacagtaatgatagagaccgtgtagtggaggctcgcgatgaacttcaccgaatgcttaatgaggatgagctgcgggatgctgtgcttcttgtctttgccaacaagcaggatcttcccaacgcaatgaatgcagctgaaatcacggacaagctgggtctacactctcttcggcagcgccactggtatattcagagtacttgtgctacatctggagaaggactctatgaaggcttggactggctgtctggcagcattgctagcaagggttaaaagctgatctgcttgtgagacgatgtttgaggatctctgttagtcaatgtttatatcagattgaatgttaaattattaccctagtaaggtctgtggtggatgatacagtgtgtttccttacttggaaaagtcggaagatgatgtttgttatcccttttttggtaagaagacttgtatttgaagtgttatgcacagaagttggtgacgatgtcctagtggagctcaagttctgtttcttgttttatgccagtcgaaaggtagtttagctttgttggctattctgtgcaaaaaagaa

SEQ ID NO: 13528 - DNA, 1125 bp, Sciadopitys verticillata
gtttgccctgcaatttacaggattctacctcgggacctctcccagttcttcagggcgaacatacgcttttttaaatttgaaaaaatcctgttcgcttttcaggtcttttcgttgaaatccggacgatccatcagatcttacaatgggcttaagtttcaccaagcttttccagcgtatgtttgccaagaaggaaatgcgaattcttatggtcggtctcgacgcagctggaaagactaccattttgtataagttgaaattgggggagattgttacaaccattcccactattggctttaatgtcgagactgtggaatacaagaacattagtttcacagtttgggatgttggaggtcaggacaagattcgaccactgtggaggcattactttcagaatacacagggccttatctttgtcgttgatagcaatgatagagaccgtatagttgaggcaagggatgagctgcacagaatgttgaatgaggacgagttacgagatgcagtactgctggtatttgcaaacaagcaggatcttccaaatgcaatgaatgccgctgagatcactgataagcttggtctgcactccctacgccagcgacactggtatattcaaagcacttgtgctacttctggtgaaggcctctatgaaggcttggattggctttcaaacaacattgtaagcaaggcttgacagtgctgcacatttattaagcgctgtaacaaatgggtttagtgatccacccaatgtttttgatctagtctaagtgatgaggagttgtgctgtgcattggtcctttacatccgggtcctttacatccggatcactttgcttttatgtagctgttcctattaatgtttcgtactcttctaagagttaagggatttttgttttttagtgcttaatctccaagcagtttcttctttattgtgatttaattataagagcatattttagttgtatatggttacatatgagtgcagaaatactaaatgttagaatttctaaaggttaagctggtgattaagcatttggttggtgcatttttgttaactgaatctatacaaattaagacacttaatgtcataacccagatgcatgagaacaagacattaaattgtaaaaactgc

SEQ ID NO: 13529 - DNA, 872 bp, Tabernaemontana elegans
gccccccttcaccgaatttcgatcaatctttgctttttccatcgtattattattcttgattgcataagaaggaagtatgggtttgtcatttaccaagctctttagccggctttttgccaagaaggagatgcgcatactgatggtgggtcttgatgcagctggtaagactaccatattgtacaaactcaagctgggagaaattgtcaccaccattccaacaattggctttaacgtggaaactgtggaatacaagaacatcagctttactgtctgggatgttgggggtcaggacaagattcgaccactgtggagacattacttccaaaatactcaaggacttatctttgttgttgatagtaatgaccgtgatcgtattgttgaggctagagatgagctgcacaggatgttgaatgaggatgaactaagagatgctgtcctgcttgtattcgctaacaagcaagatcttccaaatgcaatgaatgcggcagagatcactgataagcttggtctgcactctctccgtcaacgccactggtatatccaaagcacatgcgcaacatctggtgagggtctttatgaagggttggactggctttccaacaacattgctaacaggacctagagcagcagcataataaatcccgtgattttgcagatgaatctttctaaagtggacatcagatatttccttgtcgtcttgtttttttttttttttttaatttgatgcaatttctgttcgcttctttgtttttgatacaatttggcgtattgatccatctagtttcagactttctagtgtagtgggctttatgtttcttttggccgtatgttgcactcattcttctctggatagtattatgaaaatttgttgg

SEQ ID NO: 13530 - DNA, 1562 bp, Zamia vazquezii
caaggtgtatgtgaacgctgtggttatatttctagccagaaatggtgcaaagcatgtgttttattagatggcttgaatcgaggcctccccaaacttggaatcagccgaactagaggacgtaacagacagaaaatggataatgagcctgttgcaaatggagaagcaaacattcctcaagatgagatgccagagagtaaacaatgtgggtcacttgatttttgataaatctccattcatgagaacatatttcaagcaaatccttcatcttttttttgaagggaaaactttattatgaatgccaacaagcaagaaattttttcaagcataaacacttcttcacaatttaccctctattaaatccctacaatttaccctctattaaatcccttgtatgttttctttgcaatgctaggaggtcctctaaatatttcattttggaatgataaagtattacattctttcagaaaatagaattttcacttccacaaagaaggaaggatgtaaaatctcattatggaatgtaacataaaatcagcaaaatatttacattaacatccatatagaatgtattattaaacattcaaatattgaagcgcccctgacaagccacattgatatacttagcgttgcaggcgaggactcaacgagaaatttggggcgatttctactcgaatttgacccccagacgtctcaacgcgttcgaaaggcgagcccccgttcatttttaagatcagaaggagctgcctttctggtacgctactgctgccaagatgggtttaacttttaccaagcttttccagcggatgtttgccaaaaaagagatgcgaatccttatggttggccttgatgcggctggcaagactaccattttgtataaattgaagctgggagagattgtcacgacgattcccaccattggtttcaatgtggagactgtggaatacaagaacatcagcttcacagtctgggatgttggtggtcaggacaagattcggccattgtggaggcactactttcaaaatacgcagggtcttatctttgtggtggatagcaatgacagagaccggatagttgaagcaagggatgaattgcacaggatgctgaatgaggatgaattacgagatgccatcttgcttgtgtttgcaaacaagcaggatcttcccaatgcaatgaatgccgcagagatcactgacaagcttggtctgcactctctacgccagcgacattggtacattcagagcacttgtgctacctctggcgaaggactctatgaaggcctggattggctttcaaacaacattgcaagcaaggcttgaggatgatgcttgggaagggatagatagttgtaggacacaagtagtgaacgagtctagtgatccacctggtactgctagagacagggaagaggatgagttttgcagtgagctgacccttggtttccgtactaaatattttgttcctatgaatttgcatacctataattatcttgtaatcaactaagaattctggaatttggctttggaatattaatggttttcatttgcttgggaatgatagaaata

SEQ ID NO: 13531 - DNA, 770 bp, Arnica chamissonis
acattcaccaaactctttagtcggctctttgccaagaaagagatgcgtatcttgatggtgggtcttgatgcagccggtaagacaaccattttgtacaagctcaagcttggtgagatcgtgacaacgattcctaccattgggtttaatgtggagactgtggagtacaaaaacatcagcttcactgtctgggatgtagggggtcaggacaagattcgtccattatggaggcactacttccagaacacacaaggtcttatctttgtggttgatagcaatgacagggatagagttgttgaggcaagagatgagttacataggatgttgaacgaggacgagcttcgagatgcagtcttgcttgtatttgctaacaaacaagatcttccaaacgcaatgaatgctgctgaaatcactgataagcttggcctccattccctccgacaacgccactggtacatccagagcacctgtgcaacctcaggagagggactttacgagggtctggattggctttccaacaacatcgcgaacaaggcataagatgaagcaagaccaaaccgaactgaacgtggatcttggatgttgcaagcttttgcggtgtggtgggatttgtttgttgaacagcttttgtggtagcaaatgtgtctattgatacaatattggttactgtttaaaagcattatctaaagtttgtaatagaggataattttgattgttttattactatatgattgttttagacaatagttttgctcttatgctaaacttatttc

SEQ ID NO: 13532 - DNA, 773 bp, Brassica napus
ggttgagtttcgcgaagctgtttagcaagctctttgcaaagaaggagatgaggattctgatggttggtcttgatgctgctggtaagaccactattctctacaagctcaagctcggtgagattgtcaccaccatccccactattggtttcaatgtggaaactgtggagtacaagaacatcagtttcactgtgtgggatgtcgggggtcaggacaagatccgtcctttgtggaggcactacttccagaacactcagggtctgatctttgtcgtggacagcaacgatagggacagagttgttgaggctagagatgaacttcacaggatgcttaatgaggatgagctgcgtgatgctgtgttgcttgtgtttgccaacaaacaagatcttccaaacgctatgaatgccgccgaaatcacagataagcttggccttcactccctgcgtcagcgtcactggtacattcagagcacatgcgccacgtcaggtgaaggactgtacgaaggtctggactggctatccaacaacatcgctggcaaggcgtaatgaagtaaaatagcattgcatcgagatgcttcttcctgctgtatgttggtaaagtttctggatgcaagagaaagcttataaatattatatgaacctttttgctactggctattgtatgaatgttctgattgtgcaagtagatgtgtacctaaaaaccttactagtatgagcccctttaaatagttttcgtgcatttttatttgttcaaaccttggattgatgaatgaatgt

SEQ ID NO: 13533 - DNA, 1170 bp, Ceratodon purpureus
cagcgcgttcaagtccgagagtttgtagacggggaagagaggggggctttggctggggactgtctctcccatcggccttcttttgtcgcagcttctggagagagggagtgtgcgtctcggcgccagggttacaggtgccgctgcggggggagggtttgctgttttcctgctgttgctgcctcgctctctctcgctctccgagtcccgatctccagcgtcgtccccgcggggtgctgccgccatggggctcaccttcaccaagctcttccagaagctcttctccaagcgggagatgcgcatcctcatggtcggtctcgacgccgccggtaagaccaccatcttgtacaagctcaagctcggcgagatcgtcaccaccattcccaccatcggtttcaatgtggagactgtggagtacaagaacattagtttcactgtttgggatgtcggaggtcaggacaagattcggccattgtggaggcattacttccagaacacccagggactgatctttgtggtggatagtaacgatagagaccgtgttgtggaagccagagacgagctgcatcggatgctgaacgaggacgagcttcgtgatgctgtcctcctggtgtttgccaacaagcaagatctgccgaatgcaatgaatgccgccgagattactgacaagcttggtctgcactcactccgacaacgccactggtacattcagagcacatgcgccacttctggagagggtctgtatgaaggccttgactggctgtccagcaacatcgcaaacaaggcataagtgtggtgttaaagagtgctgtttctaccttcccaagagctgtcatgcaatctgcaccgacttggcaccatttcgtgttaattttgaacttgcacgtcgcttaggccagcatctttttctcattcccttatatacgtttctctcggagaagaatattgtcctaatgaaatctgtgtgccattgtgtacgcttctcttcactgattgctttgttacgcccggaagaggccattcttggtcgtttttataaacagttttacagtacagtacacattcgcgaacttagtcaaatggtttatgcgaatttcagaatccatttttttaagatattacagctaatgtcgttttcgattgcaatttcattaaatctctaaaagatctttc

SEQ ID NO: 13534 - DNA, 1365 bp, Physcomitrella patens
ctctgtctgtggctcgctcgctcgcaggcgtcgagacttagacgcctttcgaccacgcctcccgaccttctgtctctaagggcatttcggtcgaagctcgttctcgcttgtggtccgttcgcttctcgtgactcgggccaagggtagagcggccgtcgtcaaggttgtggtgctctcttacggcggtcatctgctcgccgatctcactccgatctcttcgagtttggtgaagagtttgccgccatgggcctcacattcaccaagctcttcaccaagctgttctccaagcgggagatgcgtattcttatggtaggtcttgatgcagctggtaagacgaccattttgtacaagcttaagctcggggagatcgttaccaccattcccaccatcggtttcaacgtggagactgtggagtacaagaacattagtttcacagtgtgggatgtcggaggtcaagacaagatccggccattgtggaggcattacttccagaacactcagggtcttatctttgtggtggatagtaatgatagagaccgtgttgtggaggccagggatgagctgcatcgaatgttgaacgaggatgagctacgggatgctgtcctccttgtgtttgccaacaagcaagatctaccgaatgcaatgaatgctgctgagatcaccgacaagcttggtttgcactctcttcgtcaacgccactggtacatccagagcacttgtgccacttctggtgagggtctgtacgaaggacttgattggctttccagcaacattgcgaacaaggcttaagtgtggagcatcgaagtgccgcctcctctcgtttcactagcttttttgctgcctgcattacgacggcactattccacttgagttttgtacttgcagatttgcctcgtctctttgtctctctccatgccttagatgagtataatgttgtcaatgaaatctgcgcgtcttatacacgtatctcattattgattgcattgttacatcctttaggggcctctctttttcatttttgcaactgttcttcatgcgaaatggacattgaggataattctttagtcttattcatatctacaagataatttgcttcagaaagttcttagacaagcagcagtcgtgactctccggtcaattctgtgcatgcttgcaattctagttgtggattagcgttagtacgatttatgaaatgacgtgagttcatacttggtattatgcttatggattaagaagttaatatgcggtgtgaacgggatttaagtaatgttttgattgattgctaatgttcaaatatgacaatgtagtgtattatctaaaacatttgatgttatcaatcattttcctattttactaagaacacag

SEQ ID NO: 13535 - DNA, 1706 bp, Chenopodium quinoa
aggctaattttagattgttggagttgagaggaagcgaagatggggcttactttcaccaagctatttagcggactattctccaagaaggagatgcgtatacttatggtaggtctcgatgcggctggtaagactaccatcttgtataagctcaagttgggagaaattgtcaccaccatccccaccattggatttaatgtggagactgttgagtacaagaacatcagcttcactgtgtgggatgttggaggtcaggacaagattcgtcccttatggagacactacttccagaacacacaaggtctcatctttgtggttgacagtaatgatagagatcgtgtagttgaagcgagggatgaacttcaccggatgctgaatgaggatgaactaagggatgcagttctgctagtgttcgctaacaagcaggatctccccaatgcaatgaatgctgcagaaattaccgacaagcttggtctccattccctccatcaacgacactggtatatccagagtacatgtgcaacatcaggtgaaggtctgtatgaaggtctggactggctgtccaacaacatagctagcaaggtttaaatgactagaccttcccggttcacatttagaacgaggatagttgggtttacactagcattttatgccacttttgttgttaagtttacgttgctagtttttcatagcttatgttgttcagtgacagtttgtcatttgcttcctgtagtgtaagttcgagacatgagattgattgctacgagcgtagagtaaaaagtaaatttccatttactgatttcatcttttatggatttgcctttgactgtacaagaatatgtggagctcagtatgtctggaagcacaggagaacgttcttttgctgatattattacaagtattcgatactgggttattcatagtattactataccctccctattcattgcgggttggttattcgtcagcacgggtttagcttacgatgtgtttggaagccctcgaccaaacgaatatttcacagagagccgacaaggaattccattaataaccggacgttttgactctttggagcaacttgatgaatttagtagatccttttaggaggcccaatgaccatagatcgaacctatccaatttttacagtgcgatggctggctattcacggactggctgtacctaccgtttttttttggggtcaatatccgcaatgcagttcatccaacgataaacaaaaccgaatccgaattatagagctatgacacaatcaaacccgaacgaacaaaatgttgaattgaatcgtaccagtctttattggggtctattactcatttttgtacttgctgttttattttctaattattttttcaattaaataaagagaaggaaagaaatagatagaatatagaattcgattatagagtaggaattctcttatcccattcggaaggacctcatttcataattatccatgactgtttatgtctctagcacgaccacttgatgaaatgtggagggaagtggggtaaatggccgatactactggacgaattcctctttggataataggtactgtagctggtattcttgtgatcggtttactaggtattttcttttatggttcatattctggattaggctcatctctgtagtaagtagtaatttgattaatcgtatagacatgaaagtataagaactcaacgggacct

SEQ ID NO: 13536 - DNA, 1028 bp, Ceratodon purpureus
gtgtcgccccggagctctcccttggtgctgcgcattggggtttcggtgtcctctcggtgttctctctcgcttgccttgccctcctctgctcggccgagtcccgatctccagcgccgtccccgcggggtgctgccgccatggggctcaccttcaccaagctcttccagaagctcttctccaagcgggagatgcgcatcctcatggtcggtctcgacgccgccggtaagaccaccatcttgtacaagctcaagctcggcgagatcgtcaccaccattcccaccatcgggttcaatgttgagaccgtagagtacaagaacatcagtttcaccgtttgggatgtcggaggtcaggacaagatccggccattgtggaggcattactttcagaacactcagggtttgatcttcgtggtcgatagtaatgatagagatcgtgtcgtggaggcaagagatgagctgcatcgcatgctcaacgaggatgagctgcgtgatgctgtccttcttgtgttcgctaacaagcaggatcttccaaatgcgatgaatgccgctgagattactgacaagctcggactccactcattgcgccaacgccactggtatattcagagcacttgtgctacgtctggcgagggcctgtacgagggattggattggctctcgagcaacattgcgaacaaggcttaactgtgcctgtgaatattctgatatgcgagaccttgtacgcctgagtgggattccattagttcgaaggcgagaggctctagtgggccctattgtagactttattaggtcggttagttttttgattgacaacgtttctttgtactaatgctttagtaagcacaatgcctccgaggcttatgtatgcaatttagatccttcgaggatcagatgcctcagattgtaggtattgatatttcggttggtttacatggaggtatgtctttttaaatctgagatgccttcaacaattgtagtggtaatgcccctgatttattgtgattcattaataatatttggcagttcacg

SEQ ID NO: 13537 - DNA, 1402 bp, Populus trichocarpa
aacacatacttacaagctaagctttcaagtttccgcgataaccactggccacaattgcgatcacccgaaataataataataattaaaaaataataataataataattaaaataacagaaattcaaataaagggagttcgttttgtttgctatttgtaaccccgattttggcgctaccctttataaacacatagacgatagtcacgatacagagagagagggagagaggggcagaaacgcatttctctttgttaaaaaaaaattagatctcaaacttctcttgtctcctccacaggcaccgcgttgtaataaggcaggcaagatggggctctctttcacgaaattacttggccggttgttctcaaagaaggaaatgcggattctgatggtaggtcttgatgctgctggtaaaaccaccattctttacaagctcaagttgggagaaattgtcaccaccatccctaccattggatttaatgtggaaactgtggaatacaagaatattagcttcactgtttgggatgttggtggtcaagataagattcgccctttgtggagacattacttccaaaacacgcaagggcttatctttgtggttgacagtaatgaccgagatcgagttggtgaggctagagacgagctgcacaggatgttgaatgaggatgagctgagggatgctgtgctccttgtgtttgcaaataagcaagatcttccaaatgcaatgaatgctgctgaaatcactgataagcttggtcttcattctctaaggcaacgccactggtatatccagagcacatgtgccacttcaggagaagggctttatgaaggattggactggctttcaaacaacattgctagcaaggcttaatggactggagttgaaattttctcaacaatgtgtgctagcatttgatgttttgttttagatgttgcctccattctttattctttctttttctcacaagatttgttttataaattcatatttcatgtgtcagtactctgtttgtctttttaattaacatacactatgcagactatttgcatatatattctgaatataagccatgagtagtttggagtgtccgtcaagtcacgatatagattcatttaccgttatcacaatactctagagaagcacggaatgtctaaatactgtttgaacattgccatttgattttttctcctggctaatctaaggaggcctttgtcttaatcaggtgccggagataaaacccggcatgggaatcacattcaaattatatagttaatccagctagtttaaatacctagttgctcagtttccagtttatcctgacagaatgtgatccaaatacatatcagataacctataggcaccctttaggttgcctccataatcaatttggcaggtataaagcttg

SEQ ID NO: 13538 - DNA, 1147 bp, Musa acuminata
ataaaggccgggagactgctctgcgccctaacacaagttgtggtgttcgatttcttctccttctccctcttgcgacgatagagaagcctcgtcgaagaaatcttgtgggttagagttctattttgcgtcggcaccgtttatcagcggtgagacgagatggggcttacgttcacaaggctgtttagccgactcttcgcgaagaaggagatgaggattttgatggtagggcttgatgcggctggtaaaaccacgatcctgtacaagctcaagctcggagagatcgtgaccaccatccccactattggcttcaatgtggagactgtagagtacaagaacatcagtttcactgtttgggatgttggtggccaagataagatcagacctctatggaggcactacttccagaacactcagggtcttatttttgtggttgatagcaatgacagagaccgtattattgaggcaagggatgaacttcataggatgcttaatgaggatgagctacgtgatgctgtgttgcttgtgtttgcaaataagcaagatcttcccaatgcaatgaatgcagctgagattactgataagctcggactgcattccttgcgacaacgacactggtatatacagagcacatgtgccacatctggtgaagggttgtacgaggggctggattggctctccaataatattgtcagtaaggcttgaaactcgtgtcattgtggtctaagcttctactattgctccgttagacatgcaccttccacagcggcttgggtattgctttgatgacattcccaggcagcttgttgctcgtggataaatcatcctgacctcggttatcttttctcttctcaacaacttttttattttttgtagtaatcacacttccgtatcatgtataagtttgacaaagattatgttatataatatagtgtggcatggttgtaatggtttccggtgtgtttataaggattgtagaacaaaatttcaagttcttatttgtagatatgccgcagtctgatgcaggtggacgacaagaaatgatgcagatgggtttaggggctttgcacttgaatgaaattagttttcccttctttacagctttacgtttgaccatagtgaggttgaatttagtttagtgaatgttttt

SEQ ID NO: 13539 - DNA, 1148 bp, Cycas rumphii
cggcacgagggcagaccgagagggtttggtggatatagcgttgcagactaagatttgggtctgtttctactcgaattcgacctctagacgtctcaacgcttccccaaggcaagcccccgttttattctgatcagaaggagctgcgtttcgggttcaccttcagctgccgagatgggtttaactttcaccaaacttttccagcggatgtttgccaagaaggagatgcgaatccttatggttggtcttgatgcagctggaaagactaccattttgtacaagttaaagctgggagagatcgtcacgacgatccccaccatcggcttcaacgtggagacagtggaatacaagaacattagctttactgtctgggatgttggtggtcaggacaagattcggccactgtggaggcactactttcagaatacgcagggtcttatctttgttgtggatagcaatgacagggaccgtatagttgaggcaagggatgaactgcacaggatgttgaacgaggatgaattacgagatgcaatcttgcttgtatttgcaaacaagcaggatcttccaaatgcaatgaatgctgcagagatcactgacaagcttggcctgcactctttacgccagcgacattggtacattcagagcacatgtgctacctctggtgaaggactctatgaaggccttgattggctttcaaacaacattgcaagcaaggcctgaggctgatgcttaatgtctttgggatgggatagattcttttaggacaacagtaatgaaagggtataatggtccacttcgtacttttgctagagacagagatgaggatgagttccacagtgaactgagccttggtttctgtactgattattttgttcctttaaatctgcatacctataattatcttgtaatcaactaagaattcaggggttttgctttggagtatttatggctttcatttccttgcgaatgatagaaacatttattgtatttgtacaagtttgaatagaagcgcagaaatgcttaatagagacatttaccatagattttgaatagaagtccagaaatactaaatattaatttttgtaaaggtttaacaatatttatgaagtacgcgatgtattataaaaacctcggccgaatctttggatcca

SEQ ID NO: 13540 - DNA, 980 bp, Distylium racemosum
agtttgcgttcgaggagctcagcagatctctgtgggaagttcgatctccctctgttttatttgtcgcgatcagatctgagactcgaacccggaatctctcacaggcttcaggatgggactcactttcaccaagcttttcaacaggctttttgcgaagaaggaaatgcgtattctgatggtgggtcttgatgctgccggtaagactaccattttgtataagctgaagcttggagagatcgttactaccatcccaacaattggattcaatgtggaaactgttgaatacaagaacatcagcttcactgtatgggatgttgggggtcaggacaagattcgtccactgtggagacactacttccagaatactcaaggtcttatatttgtagttgatagcaatgacagagaccgtatagtggaagcaagggatgagttgcatcgaatgctgaacgaggatgagctgcgagatgctgtgttacttgtctttgcaaacaagcaagatcttcccaatgcaatgaacgcagctgagatcactgataagcttgggttgcattctcttaggcagcgccattggtatattcaaagcacatgtgcgacttctggtgagggcctttatgagggcttggaatggctttcaaacaatattgcaaacaaggcttgaacaaagatggggtccctgaattttgtaggccaagattgtctcatgtctttatttgatagagacagttcgaggagaagaattcaaccaaatgcagtcaaactgattcaggagtgtggcacactattttcatcgtactttgactgcttatatttgtctggtttctactatggatttttattgtgccaactgcactaatttagaaagctggcggagcttatatgacagtgtgtgagtagttattatttcattgttcttattgcgggtattcattttgagaattgctttatggcattgtatgctttaatgtcaactataatgaagg

SEQ ID NO: 13541 - DNA, 1139 bp, Orobanche aegyptiaca
tttgcggttcctcctagctagatctgccccttttcttctctgatcgaactccattcttctgattttcatctctgacgaaaatggggctgtccttcaccaagcttttcagccggctgtttgccaagaaagaaatgcgtattcttatggtgggtctcgatgctgctggtaagaccaccatattatacaagctcaagctgggagaaattgtaactaccattcctacaattgggttcaacgtggagactgtggaatacaagaacattagcttcactgtttgggatgttgggggtcaagacaagatccggccattatggaggcattactttcagaacactcaaggattgatctttgtggttgatagtaatgatcgagaccgtgttgttgaggctagggatgagctccacaggatgttaaatgaggatgaactgagggatgcagtgcttcttgtttttgcaaacaagcaagatcttcctaatgctatgaatgctgctgacataaccgacaagcttggacttcaatctctccgccaacgccactggtatatccagagcacatgtgctacttctggggaaggcctgtacgagggcctggattggctatccaacaacattgccaacaagtcttgaaaatccgatgttggaagaaatctttttgttattggtatctcaatcgtagttgaagtggagatagctttctcgtcttgcagcgtttgttgaaagcaaattctgaactacgactattcttcatggatagtccttcgccttttatcatatgtagattgagattccacttgtgtaatttcagccattatacaatcctttgaatttatatttttttatctggcaagcatacttatctcgcaatcctcgtagaatatttatctacaggatctttaatttttaaaaatttataattttcatgcaacaaaaatgcttgcgttgttgattgcaaaaatcgcaccgccaaaagtttctgtgatgaattgcgaaggttcttaatatctttgttatagttgacgaaactgtaccaggtactattatctgtatgatctcgtcattattttccccagagagcaaatgcaggtcttgtttattagtacaatttatagggacattccaaatcaagcttaaaatgtacgt

SEQ ID NO: 13542 - DNA, 849 bp, Lippia dulcis
ttccaagagatcaaaagcaagaaagggaaatggggttgacattcacaaagctgcttagccggctttttgccaagaaggagatgcgcattttgatggttggtctcgacgcagctggtaagaccaccatcctgtacaagctcaagctcggagagattgtcaccaccatcacaaccattggcttcaatgtggagactgtagaatacaagaacattagcttcactgtgtgggatgtcgggggtcaggacaagatccgcccattgtggaggcactacttccagaacactcagggtcacatctttgtggtggatagcaacgatagggaccgtgttgtggaagcaagggatgaattgcacaggatgttgaatgaggatgagctgagagatgctgtactacttgtatttgcaaacaaacaagatcttcctaatgcaatgaatgctgctgaaatcactgacaagcttggcctacactcgctcaggcagcgccactggtacatccagagcacttgtgccacctctggtgagggactctatgagggacttgactggctctccaacaacattgctaacaaggcttagagcttttttggagttgtttacgcgagagctaatactggaaactgtcgaggttttgtctagtttttttcttaaccacatattgctttgaaacaatgttttcatctatgtttaggaccttcaaaatgtctctatatcagacaatggtttgttttatatgtcgtcctatgtttgattagttttgaatgtaatattcagacacagactaggattttggattattatttgattgcccacgcttacttatataaactgcttgatctccacgaaaaaagaa

SEQ ID NO: 13543 - DNA, 1424 bp, Physcomitrella patens
cgcgtcatcacttcgaagaatgctctcatctccacgcacccaattccacaagaaaatccacattaaaaaatgggacaaaaaggtggacgttgcattctccgagtttctcagagtcagattctgcagaatccaatcaaactgtatgaagaaagaaactgtgcactcgtcaaattccgagatgtcgattgtggacgccaatggcttcatagttacctcgattgggacctcgatgggaattactatgtgacggtactcgggggcactcggtgaatgggggggtgggggacttggaacttgaggaagtggaagtctgttcaagtcttgttatcgacctcccattctgtcccccattgtgagcgtgtgtgtgtgtatgtttgtgtgtgttatcgttgccgcttttctggtgcgtggcttgttgctctgtccagggttagaggcccgcttgccagggaagggtttgctattttttccgccacttccgagtccgcgcaccttggggtagcttcttccgctttcagatctattgttcccgcggggctctgccgccatggggctcaccttcaccaagctctttcagaagctgttttctaagcgggagatgcgtattcttatggttggtctcgacgcagctggtaagaccactattttgtacaagctcaagctcggcgagatcgtcaccaccattcccaccatcggttttaacgtggagactgttgaatacaagaacattagtttcactgtgtgggatgtcggaggtcaggacaagatccgtccattgtggaggcattatttccaaaacactcagggtcttatctttgtggtggacagcaatgatagagatcgtgttgtggaagccagagacgagcttcatcggatgttaaatgaggatgagttgcgtgatgctgtccttcttgtgtttgcgaacaaacaagatttgccgaatgcaatgaacgctgcagagattaccgataagcttggtctccactcacttcggcaacgccactggtacatccagagcacctgtgcaacttccggagagggtctgtatgaaggccttgactggctgtcaagtaacatcgcaaacaaggcataattgttgttggctagttctgtgttttcatccaaaagcttttatgcaacccagagagtgggcaccgttccttttgaattttgtatgtgcagattggctgccacgatgttccctcagtgctgtagaagagcagaatgctgtattaatgaaacgtgcgtgccttttatacgtttctcttcgtcgcttgcgttactacgtccagcagggccactcattatcagttttgtaactcttttacatgcagtacagtattctggaatttgtctcagtccaacattcgtctcgaatcttatcgaaaacactccgatatcacagattgtttgttctcgtcgca

SEQ ID NO: 13544 - DNA, 936 bp, Sciadopitys verticillata
cttgtgttcaaattgtcagttcattatcaaggcctgcgatttctgtaaaaatctgtgaatttcccaagtgtggcaagatgggtctcacattcaccaagctttttcaacggttatttgccaagaaggagatgcgtattctgatggttggtcttgatgctgctggtaagaccaccatattgtacaagttgaaacttggcgaaattgtcaccaccattccaactattggcttcaatgttgagactgtcgagtataagaatattagcttcactgtttgggatgtcgggggtcaggacaagatccgaccattgtggagacactactttcagaatacgcagggtcttatttttgtggtggatagtaatgacagggaccgtattgtcgaggcaagagatgaactgcataggatgctgaacgaggatgagttgcgagaagctgttcttcttgtctttgcaaataaacaggatcttcccaatgctatgaatgccgctgagataactgacaagcttggcctgcactccttgcgtcagcgccattggtacattcagagcacttgtgccacttctggtgaaggtctgtacgaaggcttggattggctttctaacaacattgcaaacaaggcatgatatggaaacagctttttgaggctagctatgcattttgagaatggattgcattcttttaggaacgtaacagatatgtttaacaagtccactagtaaattgaagtagataatagcttggataattggggatccattccattgtgaagtgatcctctattttagttgattgttttatttgcaattttgcacgtctacaattatttcaattatttttgtaatcaactactatgaaattttttgcaagtgttccttctgatttggtgcacaaacctcagtccaatgtacttcttattgccccttgattgtcataaaac

SEQ ID NO: 13545 - DNA, 569 bp, Cirsium arvense
gtgggtctgtctttcaccaagctattcaagcgtttgttcgctaagaaagagatgcgcattctgatggtcggtcttgatgcagctggtaaaaccacaattttgtacaagctcaaattgggagaaattgtcaccactattcctactattggattcaatgtggagactgttgagtacaagaacatcagcttcaccgtatgggatgttggtggtcaggacaagattcgacctttgtggaggcactacttccagaacacacaaggtcttatttttgtggttgatagcaatgatcgtgatcgtgtggttgaggctagagatgagctacatcggatgcttaatgaggatgaattgagagatgcagtattacttgtgtttgccaacaaacaagatcttccgaatgctatgaatgctgctgagatcacagataagcttggcctgcattctctccgacagagacactggtatattcagagcacatgtgcaacttctggggaaggtctttatgaaggactggattggctttccagcaacattgctagtaaaacgaaacattagagggaagtcaacctttg

SEQ ID NO: 13546 - DNA, 593 bp, Liriodendron tulipifera
gcatctcgagatctgctttcgaatcgcttgaaatcaccgtcgccctctcgcagacacgaagatggggctgtctttcaccaagcttttcagtcggctttttgccaagaaagagatgcgtattctcatggtgggtcttgatgctgcgggtaagaccaccattttgtacaagctcaagctgggagagatcgttaccaccattcctaccatcgggtttaatgtggagaccgtggagtacaaaaacattagctttactgtttgggatgtcgggggccaggacaagatccgacctctgtggaggcattacttccaaaatacacaaggtcttatctttgtagttgacagcaatgatcgagaccgtgttgttgaggccagggatgagctgcacaggatgttaaatgaggatgagttgagggatgcggtgctgcttgttttcgcaaataagcaagatcttcccaatgcaatgaatgctgctgagattactgataagctcggccttcactccctccgccaacgccactggtacattcagagtacatgcgccacttccggggaaggactgtatgagggactggactggctctccaacaacattg

SEQ ID NO: 13547 - DNA, 815 bp, Nuphar advena
caacattctccgttcttatttctctctctctctctctctcaaggaaatctcctacgttcttccttcgtttctggatgggattgtcttttacaaagctctttagccggctttttgccaagaaggaaatgcgtattttgatggttggtcttgatgcggctggtaaaactactatcttgtacaagctcaagctgggcgaaatcgttaccacaatccctactattgggtttaatgtggaaactgtggaatacaagaacatcagcttcactgtgtgggacgtcggtggtcaagacaagattcgcccattgtggaggcactacttccaaaacacacagggccttatctttgttgttgacagcaatgacagggatcgcattattgaggcaagggatgagttgcacagaatgttgaatgaggatgaactgcgtgatgctgttctgcttgtattcgcaaacaaacaagatctaccaaatgcaatgaatgcagctgagataactgataagcttggccttcattccctgcgccaacgccactggtacatccagagcacatgtgcaacttccggagagggtctgtacgagggcctggattggctctccaacaacatcgctaacaagtcctgagccatctgcttcatgatttccactgtcttcgtggatacaagatcgatgttgctttgctttttgtgttaaggtggtgggtaatggctgtgataattaggaaaccattatgcgactcgtatagctttttgttactgagaatgatctatatcaagacctattatattatatttcatttcttcctgctcttggttgatc

SEQ ID NO: 13548 - DNA, 980 bp, Orobanche aegyptiaca
tctgcccttctctgctcccccccaccttctctttcttcagagcttcttcgtctttggaaaatggggttatctttcaccaagctttttagccgactgtttgcgaagaaggagatgcgaattcttatggtaggtcttgatgctgctggtaagaccaccatattgtacaaactgaaattgggagaaatagtgacgaccattcctacaattggattcaatgtggagacagtagaatataagaacataagcttcactgtttgggatgttggtggtcaagacaagatccgaccattgtggaggcattactttcagaacactcaagggctgatttttgtagttgatagtaatgaccgagatcgtgttgttgaggctagggatgagctgcataggatgttaaatgaggatgaactgagggatgctgtgctcctagttttcgcaaacaaacaagatcttccaaatgcaatgaattctgctgagataactgacaagcttggacttcagtcactccgtcaacgtcgctggtatatccagagtacctgtgccacttctggtgaagggctatatgaggggttggactggctttccaacaacattgctaacaaggcttaaggagagacgttggatggattttgctatatttatccttgttggagtgaagattcgcttttccgtttcccagctttagttggttgctatcctttgctgtaattatttatcttttttcttagatattcatatcctaatgattattctctttttccgtcttatttgagattcactcctgtgacattttccaaatagtttgtccctcttttgggctttgttatttctggaaagataatggctcgcacttcagcgtggatgtgttttatgtttttttttccttctcgcatatgttgaattttgataaactggtagtcccagccttttctgttggtgatgttgacaagaaaagacataagtttagaaatggttacttgact

SEQ ID NO: 13549 - DNA, 2501 bp, Physcomitrella patens
cgcagtaggggtcgcactcgtgtcgagattctacaggcggacttcgcttacaactcaagcaactctaggaacaatcaatcgaaagtgcgaatcctcacatcctgtcaccactttgcgatctagagaccacatctccttatgccaatttcgctgaagaacttattagatgcaggaatccaatgaatcggtctcgaaagtgatgaagatctcagttcaaagagtgaactcacaaaaaactattctaaaaaacaaattggcggaacgcgtccgcagtgaagtcgcggccaatatcgccacctcgattgggtcccaaaacggggtatcattcgaggtgtgatggatcgggacccaggattgggccgggaatgggcgggcagccctcggaggggaaggtcgttcaagtcttgtagacaagcttcgagtccgtcctttattttttctgcgtaggagtgtgtgtgctgctatagttgctctctcttcgtgtgcatcgccctcctattgagccccagggttagagctgctgttgtagtgcagtcgtttttctatctatttattatattcagtgttttggtttgacgctgcttctcgctgcagtagcttgcgcttgctccccgtctactgcagccgcggggtgctgccaccatggggctcacttttactaagctcttccagaagctgttctccaagcgggagatgcgtattctgatggttggtctcgacgcagctggtaaaaccaccatcctgtacaagctcaaactcggcgagatcgtcaccaccattcccaccatcggttttaacgtggagaccgttgaatacaagaacataagtttcaccgtgtgggatgtcggaggtcaggacaagattcgaccattgtggaggcattacttccaaaacacccagggactcatttttgtggtggacagcaatgatagagaccgtgtcgtagaagctagagatgagctgcatcggatgttgaatgaggatgagctgcgcgatgctgtccttcttgtatttgccaacaagcaagatttaccgaacgcaatgaatgctgcagaaattaccgataagcttggtctgcactcacttcgccaacgccactggtatattcagagcacctgtgcgacttctggagagggtctctatgaaggtcttgactggctgtccagcaatatcgctaataaggcataattgcggttggtgcgagtcctgccttttcccatccaaaagcttctatgcaacctgcgcaaagttggcgtcactttactacaattatctacgtgcacataggttgccactatgttttttcagtgctgtagaagaccagaacgctgtcttaatgaaatctgcatgtcttgtatacgtttctcattattgattgcattactatgtccattagggccattcattgtgagttctgtaactctccacatgcaaatatagactcttggaatcttttcatgggcctcgtagcctgctaaagaacctttatgaatagatagttgatgaagatactggttgaatcttacgaccgtgctacgcattgattcactaacaattctggacactattttatggaattctttcattgagccaaccgtctcgcacccgaatatgttgccttcacgtacttccaatcttatataaatcaacggcgtacattcaggcaacactatttgctgataacttcaaactttctcatcactgtagactacttactgaaagttacctcgacactagtctctgataccatcccctgcagagtatcacatctcttcatggtgcacacatcaatattgacacaaacatccaacatccctggaaacggattcaacaacacaaacaacgttcgtataccaaaaagatgtgacacatctaccaatgtctcgcaatgatggtcatttattgccttagagtgctgtttctttattccttttttgtatgcaataaaacaaaaacaaccacgtagcaacttctaggaattctacagcaaaccgtcgataccgaatcccatgcgagagagatggtagcgaccagaagtcggctggcgggggaggagtcataacgatgcctcgaaccaccacacacttgaggcccgtctccgcacttggatctcaccactggcagcctccagtcacatctcaatgacggattctgtctgtttcaggattgggtccgagaaccgggccgacgaccggcgctctcgaagccgcgccatggagacgaggtgcagatgcggagctgtcgacagcaaagccggtccgtcgcagatctctctcattactccgcctccctccctccattgctaagcattcgcttccacttcattcctcctctcaaactgaagaaccgtctcttgtcattagatccgtcctcgtcgttgtcgtagctggttgctgtccccctccccttcccccagaggggcgctttcaatatggggctcacgtttacgaagctgttcacgcgactgttctccaagcaggagatgcgcattttaatggtgg

SEQ ID NO: 13550 - DNA, 695 bp, Secale cereale
gcaccgcactgcacgacagccatcctccgtgcggtcccaagctccaactcccacgcccgtctcccccgagatcaggaggagcacgccccggagcgccgagaccccgaagccttcgtctccaccccggaggagagatggggctcacgttcaccaagctgttcagccgcctcttcgccaagaaggagatgaggattctcatggttggtctcgatgccgctggtaagaccaccatcctctacaagctcaagctcggagagatcgtcaccaccatcccaaccatcggatttaacgtcgaaactgtcgaatacaagaacatcagcttcactgtttgggatgtggggggccaagacaagatcaggcccctgtggaggcactacttccagaatacgcaagggctcatttttgttgttgacagcaatgatagggagcgtgttgttgaggctagagacgagcttcacaggatgctgaatgaggatgagctgcgtgatgctgtgttgcttgtatttgcaaacaaacaagatcttcctaatgccatgaatgctgctgaaatcaccgacaagcttggtctgcactccctgcgccagcggcactggtacattcagagcacttgcgcgacatctggagaagggttgtacgagggacttgactggctctccaacaacattgcaacaggctgaagcgtctcgacaagtgct

SEQ ID NO: 13551 - DNA, 715 bp, Triphysaria pusilla
aaaatggggggttctttcacgaagcttttcagtcgactgtttgcgaaaaaggagatgcggattcttatggtaggtcttgatgctgctggtaagaccaccatattgtataaactcaagctgggagaaatagtgacaaccattcctacaattggattcaatgtggagacagtggaatataagaacataagcttcactgtttgggatgttgggggtcaggacaagatccgaccgttgtggaggcattactttcagaacactcaagggctgatttttgtggttgatagtaatgatcgagaccgtgttgtagaggctagggatgagctgcataggatgctaaatgaggatgaactgagggatgctgtgctcctagtctttgcaaacaaacaagatctgcccaatgctatgaatgctgctgagataactgacaagcttggtcttcactctctccgtcaacgtcattggtatatccagagtacatgtgccacttctggtgaagggctatatgaggggctcgactggctctccaacaacatttctaacaagagttgaggagaagagatgtttgatcaatttctgttatctgtattcatgctgaagtgaattatccgtttcccggcatttgttcaatgctgtgatcacttattttttgtcgtaggtattcaaatcgtaatgtcttacaagcacactatttcagaatttcattttgcctttttac

SEQ ID NO: 13552 - DNA, 1020 bp, Triphysaria pusilla
agaggggcttgaccaaaaccgagcggctcgacccgttggtgtgtaaaaggactacaagggacagctcctccgaaacaagatctgcaactctgcttcaccgagcactcatcccattttcagtgttttcgtcatcaatcaataaaatggggggttctttcacgaagcttttcagtcgactgtttgcgaaaaaggagatgcggattcttatggtaggtcttgatgctgctggtaagaccaccatattgtataaactcaagctgggagaaatagtgacaaccattcctacaattggattcaatgtggagacagtggaatataagaacataagcttcacagtttgggatgttgggggtcaggacaagatccgaccgttgtggaggcattactttcagaacactcaggggttgatttttgtggttgatagtaatgatcgagaccgtgttgtagaggctagggatgagctgcataggatgttaaatgaggatgaactgagggatgctgtgctcctagtctttgcaaacaaacaagatctgcccaatgctatgaatgctgctgagattactgacaagcttggacttcactctctccgtcaacgtcattggtatatccagagtacatgtgccacttctggtgaagggctatatgagggtctcgactggctctccaacaacatttctaacaagagttgaggagaagagatgtttgatcaatttcggttatccgtatccatgttgaagtgaattatccatttcccggcattttttcaatgctgtgatcacttattttttgtcgtaggtattcaaatcgtaatgtcttacaagcacactatttcagaatttcattttgcctttttctattcctggtatgaaaaaggctctcatatctgtttaatgttttttttctcaaatgttgaaatttgatcaactgggtacaccacgaatataaaagcaaagtaccagttaaatgctgaagtatcattttgaaatggatatgtggatttgaatgaaaaaaaaaaaaaaa

SEQ ID NO: 13553 - DNA, 904 bp, Triphysaria pusilla
aaatgactaaagcgcgtattgctcagttaatgcgcatagacgacctatccttgtgctgttctagttgaagagatcttaaacactcacagatctctacacctctctctcactttgaaagatggggttgtcattcaccaagctcttcagccggctgtttgccaagagagagatgcgtatactaatggtcggtctcgatgctgctggtaaaaccaccatcctctacaaactcaagctcggcgaaattgtcaccacaatccctactattggattcaatgtggagactgtggaatataagaatatcagcttcactgtttgggatgttggaggccaggacaagatccgtccattgtggaggcattatttccagaacacccagggcctaatctttgttgttgacagcaatgatcgagaccgtgttgttgaagcgagggatgaactgcacagaatgctgaatgaggatgaattgcgagaagctgttctcctagtgtttgccaacaagcaagatctcccaaatgcaatgaatgctgctgaaataaccgacaagctgggccttcattctctccgccaacgccattggtacattcagagcacatgtgcaacttctggcgaggggctgtacgaggggctggactggctttcaaacaacatcgctaacaagtcttgaatgctttcagtttgaagtgatgtttcgagctttgctgaagcatactgtcattcaaccttggcgccagttacatacatcactatctttgatgatttcgaatttgagggcaatgtcggtattaagaaaataaatgtatgtcggatagtttgaccaaaatcgaaactctggctattatgtactctatatcagacctctcctttcccagtcattttcatgatacttaaagcatattgttagttt

SEQ ID NO: 13554 - DNA, 622 bp, Lotus japonicus
acgggaggagcagagagaaagagatctcatctccatttctccaagaatagcggaagaaaatgggtctctctttcaccaagctgttcagccggttgtttgccaagaaggagatgcgtatacttatggtgggtctcgatgctgctggtaagaccaccattctctacaagctcaagctcggagaaattgtcaccaccattcccaccattgggtttaatgtggaaactgtggaatataagaacatcagcttcactgtctgggatgttggaggccaagacaagattcgtcctttgtggagacattacttccaaaatacacaagggcttatttttgtggttgatagcaatgaccgagatcgtgctgttgaagctagggatgagctgcacaggatgttgaatgaggatgagttgagagatgctgtgcttctagttttcgcaaacaagcaagatcttccaaatgctatgaatgctgctgaaataaccgacaagcttggtctccattcacttcgccagcgtcactggtatattcagagcacatgtgccacctccggtgagggactttatgaaggactcgactggctctcaaacaacatcgcaaacaaggttagtgaatgataattattttg

SEQ ID NO: 13555 - DNA, 737 bp, Cocos nucifera
aaaattacataacagcaaaacggcaactatcaaacggccaatcgggacgctcccggctaggtcgtagcgtgacggtgaggagacgtccgttatctacggtcccaataaatgggcccttcgtttctttgcggtgtggttgtgggcagctccttctcagatctcctttcttttccttctcttcctccctcgcgtgaagatggggctgtctttcaccaaactattcagtcggctttttgcaaagaaagagatgcgtattcttatggtaggtcttgatgctgctggtaagaccaccatcttgtacaagctgaagctgggagagattgtgaccactattcctactatcggatttaatgtggagacggtggaatacaagaacattagcttcactgtatgggatgtcggtggtcaggacaagatcagacctctgtggagacattacttccagaacacccagggccttatctttgtcgtcgacagcaatgacagagatcgtattgttgaggctagagatgaattgcacagaatgcttaatgaggatgaattgagagatgcagtgctgcttgtctttgcaaacaagcaagatcttcccaatgccatgaatgctgcagagatcactgataaacttggcctgcactccctccgccaacgtcactggtacatccagagcacatgtgccacatctggtgaggggctttatgagggactggaggggctctcaaataacattgctaacaagg

SEQ ID NO: 13556 - DNA, 1016 bp, Zingiber officinale
gcgagttcgatttctccgcagcgcctccttccttgatcgaggagaaccctctcgtcttggataaaatttatttagctttgaagaggatggggcttacgtttacgaagctgtttagccgactctttgcgaagaaagagatgaggatcttgatggtcgggcttgacgcggccggtaaaactacgatcttgtacaagctcaagctcggagagatcgttaccaccatccccactatcgggttcaatgtggagacggtagagtataagaacattagtttcacagtctgggatgttggtggccaagacaagatcagacctttgtggaggcactacttccagaacactcaaggccttatttttgttgttgacagcaatgacagagatcgtatagcagaggcaagggatgaacttcataggatgcttaatgaggatgaattacgtgatgctgtgttgctcgtatttgcaaataagcaagaccttccaaatgcaatgaatgcagctgaaattactgataaacttggattacattcactgcggcagcgacactggtatatacagagtgcatgtgctacatctggtgaaggcttgtatgaagggctggattggctctctaacaatatcgttaacaaggcttgaagcagcatggagctagtaagcttaaatctatgatcagtaaaacatatatgttagcaacagtgtgtcgcttttgctagatgcttatctgcatgagtcaaagtgctactacacatggatcagttaccttgctattctacctctaacgtttctataatatatatatatatacattttattagatattctgtgtgatggcctgcaaaatgtcgtgtaatattattgcgcataatagtttttcaaaagttctaatttgtgagttaatttgtacttgtaccgtgctagtttcctgtctttaacgttttgattatcattccatccaaatttttctgtaatctttctctactatagtaaaaggtgattacgacacctcatattccttatcct

SEQ ID NO: 13557 - DNA, 642 bp, Zingiber officinale
cgtcttgggaattttaattcgctttgaagaggatggggcttacgtttgcgaagctgtttagccgactcttcgcgaagaaagagatgaggatcttgatggttgggcttgacgcggctggcaaaaccacgatcttgtacaagctcaagctcggagagatcgttaccactatccccactatcgggttcaatgtggagactgtagagtataagaacattagtttcacagtctgggatgtcggtggccaagacaagatcagacctctgtggaggcactacttccagaacactcaaggccttatttttgttgtcgacagcaatgacagagaccgtatagcagaggcaagggatgaacttcataggatgcttaacgaggatgaattacgtgatgctgtgttgctcgtatttgcaaataagcaagaccttccaaatgcaatgaatgcagctgaaattactgataaacttggattacattcactgcggcagcgacactggtatatacagagcgcctgtgctacatctggtgaaggcttgtatgaagggctggattggctctctaacaatattgttaacaaggcttgaagcaacatggagtaagcttacatctatggatcagtaaaaacatatatgtttagtaacagtggtg

SEQ ID NO: 13558 - DNA, 606 bp, Actinidia deliciosa
acgaggagagagaaaggaagggcgagaatacgcagagatctgtttcgctcttgcactcagacacgaagatggggctgtctttcacaaagcttttcagtcggctttttgcaaagaaagagatgcgaatattgatggtgggtcttgatgcagctggtaagacaaccattctttacaagctgaagctgggagagatagtcactacaattcctaccataggattcaatgtggagactgttgagtataagaacattagctttactgtttgggatgttggtggccaggacaagatccgacctttgtggagacattacttccaaaacacacagggtcttatctttgtgatcgatagcaatgaccgtgatcgtgtggttgaagcaagggatgagctgcacagaatgttgaatgaggatgagttgagagaggctgtgcttctggtatttgcaaacaagcaagatcttccaaatgcaatgaatgctgcggagataactgataagcttggccttcactctctccgccaacgccactggtacatccagagcacatgcgccacttctggtgaagggctgtacgaaggactggactggctttcaaacaacattgctaata

SEQ ID NO: 13559 - DNA, 1475 bp, Physcomitrella patens
ggcagcctccagtcacatctcaatgacggattctgtctgtttcaggattgggtccgagaaccgggccgacgaccggcgctctcgaagccgcgccatggagacgaggtgcagatgcggagctgtcgacagcaaagccggtccgtcgcagatctctctcattactccgcctccctccctccattgctaagcattcgcttccacttcattcctcctctcaaactgaagaaccgtctcttgtcattagatccgtcctcgtcgttgtcgtagctggttgctgtccccctccccttcccccagaggggcgctttcaatatggggctcacgtttacgaagctgttcacgcgactgttctccaagcaggagatgcgcattttaatggtgggtcttgacgctgctggtaagacgactattctgtacaagctgaagttgggcgagatcgtcaccaccattcctaccatcggtttcaacgtggagaccgtggaatataagaacattagttttaccgtgtgggatgtcggaggtcaggacaagatccggccattgtggaggcattacttccagaacactcaggggttgatcttcgtcgtggacagtaacgacagagatcgagttgtggaagctagggatgagcttcttcgtatgctaaacgaggacgagctgcgtgatgcagtcctgcttgtgtttgccaacaaacaggatcttccaaacgccatgaatgctgctgagatcaccgacaagctgggacttcactcgctgcgccagcgccattggtacatccagagcacgtgtgcgacgtctggagaggggctatacgagggtctggattggctctcaagtaatattgctaacaagtcttgattggttacgcgcatggagatatcgatatgtgaaggtttgtacaccaagtgaggtttcattagctgaaaggggaaaaggtgtattatacgtatagtagatctgttaaggtggtgtagcgtgaaataggcgtcgttagaatgatttcgtctctgtgtgttctttagtaaacaagatgaattcagtaagcaagttaaccaattagcacattttacacccatggctttggatttgcatcatagttttttgcaactatctgtcggatgaaatttttctttatcctatcaataattttatctcaatcacaaaattcattacacatcttgcagtgaactgaaggcgctgaggattttgataacaatagagggtgaagaggaaagacgatgcacatcctcctaacgcaagttacgagtacctgattcacactgcttacaaactctttgcgaaggtcatttgtacctgcagctgcagcagcgcagggccatctagtttgcaaggtatctgatccgtcaactgtttctacccacatgcatacctcccctccgatcataagattctgcccatcaatgtctgttatatctgtggaaggtgcagtatcgtagaatttgtctcaggtggcg

SEQ ID NO: 13560 - DNA, 1105 bp, Populus trichocarpa
cgttgactccctcggcgccccgaaataaagaaattcgaacaaccgtgttagttatttttaactccgactatcgcgtcaccctttaataaacacagagagacagaagaggaaacgcatttccttgttaaagagagcgaagaaaatcagatctcaaactggtcactcctcgacacaccacgaagaggaagaattgaggaaaggcgagatggggctgtcattcacgaaattacttggccgattgttctcgaagaaagaaatgcgaattctgatggtaggtcttgatgctgctggtaaaaccaccattctttacaagctcaagttgggagaaattgtcactactatccctaccattggatttaatgtggaaactgtggaatataagaatattagcttcactgtttgggatgttggcggtcaagacaagattcgtcctttgtggagacattacttccaaaacacgcaaggacttatctttgtggttgacagcaatgaccgagatcgagttggtgaggccagagacgagctgcacaggatgttgaatgaggatgagctgagggatgctgtgctccttgtatttgcaaataagcaagatcttccaaatgcaatgaatgctgctgagataactgataaactcggtcttcattctctaagacaacgccactggtatatccagagcacatgtgccacttcaggagaagggctttatgaaggattggactggctttcaaacaacatttctagcaaggcttagtggactggagttttaaattttctcaacaatgcgtgctagcatttgatgttgggttttgtagatgctgccaccattcttttcttccttttcacaagagttgtcttataaatttatatttctcatttcagtactctggttgtctttttaagttacatcagtgtgtagactattggcatttgcatcagaatatattctgaataagctccaagtaattgagtttcaatcaagctgattatgatcatgagtttcagtcaagttatgatatatattcagtctccgatattgcaatatcatgcagttttgaacattgccatctgaattttacacccggctaatcttagaagacctttgatt

SEQ ID NO: 13561 - DNA, 862 bp, Pteridium aquilinum
gccacaattaccatcacaagccattgcgtttcttaaagagggggggagatctgaggaggaggcggaggtgagatctgagagagacctctgagagaggcaagcagtagcagcagccatgggtctcaccttcaccaagctcttccagcgcctcttcgccaagaaggagatgcgcattctcatggtcggtctcgatgctgcgggtaaaaccaccatcctctacaagctcaagcttggcgagatcgtcaccaccatcccaactatcggtttcaatgttgaaactgtggagtacaagaacatcagcttcactgtctgggacgtgggaggccaagataagatccggccattgtggcgacattacttccagaacacgcaaggtcttatctttgtcgtagacagtaatgatagagatcgtgtagtggaagcccgagatgagcttcatagaatgctgaatgaggatgagctacgagatgctgttcttcttgtattcgctaacaagcaggatcttccaaatgcaatgaacgcagctgagatcacagacaagctgggtctacattctttgcgtcagcgccattggttcattcagagcacgtgtgcaacttcaggagaaggtctttatgagggcttggactggctttcagccagtatagcaaagaaggattaattgactatgctgcttcagctttgctaggtgtcttggttgtggtggtgcctcttgagcgagtatttgatggctgctttcacttagctgctagtctgtaatcaacaagctgtaaagtcatgcgttgctctttcggttttgctgcgaaagttgatgtacacatttcttgttaatcaatgaaacaattatcaaacatttcttgtt

SEQ ID NO: 13562 - DNA, 1254 bp, Abies balsamea
tatagtacgttccgagtgcagaccgtgctgcgacagaagagacaggggtgaggtttctcacgattttcacgcactcgactcgaactcggaacctcttgacaattctccattcagtttctcgaattcgggctaatctactgtttgagtttttgtgggtcgactagaaactcatttcctaagatgggtttaactttcaccaagcttttccagcgaatgtttgctaagagggagatgcgaatccttatggttggtcttgatgcggctggaaagactactattttatacaagttgaagctaggagagattgttacaacaattcccaccattggctttaatgtggagactgtggaatacaagaacataagctttacagtttgggatgtgggaggtcaggataagattcgaccattgtggaggcactactttcagaatacccagggtcttatctttgtggtggatagcaatgacagagaccgtgtagctgaggcaagagatgagttgcacaggatgttgaacgaggatgagttacgagatgcagtcctgcttgtgtttgcaaacaagcaggatctcccaaatgcaatgactgctgctgaaatcactgataagcttggcctgcactctttacgccaacggcactggtatattcaaagcacttgtgccacttctggtgaaggcctttatgaaggcctggattggctttcaaacaacattgcaagcaaggcttaaggatgatgctcaataactgagttggtacagtgaatgggtttaatgatgcatttgatgtctttgccaaagattaagggacaaggatttgtgtagtgaattggcccttaaatttgttccgataagtggcaaatactatattatttcgtatacatcttaaggatttgggggttttcctttttggttgtatgttatctctgagaattctgtttccttttctttgttgggagtttgattatgaaatttttttagttatatatgttggaagcggagtgcagaaatacttaatattaaaagctctaaaggttaactgtatctattaaagacttgaggaactatactctacaaaaaaattatgcaggagcaaggaaaacttcatgattatacatgagatacctgattacagcacaagaaaaataaaagatagaaattgacacttaagagtctattcaaccacccatctctccactaaaactcaggccacagatacatgataaatggccagtggaagtggtaactatgacagatgac

SEQ ID NO: 13563 - DNA, 1030 bp, Musa acuminata
cccgcggcctccgctctcgtccttctcatcgagaggcgagaagcgtcgcctgagaaatcgttcggtggttcttctctcctttccaattcgactggtcctcttccttctcgtggatttgatcgtttccaatttgtattctcatcgataattttcggtgaacaagatggggctcacctttacgaggttatttagccggctcttctcgaagaaggagatgaggatcttgatggtcgggcttgatgcggctggtaaaacgacgatcttgtacaagctcaagctcggagaaatagtcactaccatccccactataggatttaatgtggagactgtagagtacaagaacattagtttcaccgtttgggatgttggtggtcaagataagatcagacctctatggaggcactacttccagaacactcagggccttatttttgttgtcgacagcaatgacagagatcgtattattgaggcaagggatgaactgcataggatgctaaatgaggacgagttacgtgatgctgtgttgcttgtgtttgcaaataaacaagatcttccaaatgcaatgaatgcagctgaaattacagataagcttggcctccattccctgcgtcaacgacactggtacatacagagcacatgtgctacatctggtgaaggtttgtacgagggactggattggctctccaacaatatcgtcagcaaggcttgaaacttttgacatggtggactaagcttattggcacggtgctttgtttctccgatccgcaaccagttgctcatggatcaattatcttgacattagttgtcgtctcttcttgctgtggttatcggactcgtgatagtggtcctggcataatatgatcgtgtgatcaattatcaacttctagttgtattatgtgatgttttcaagcattatattaatagcatctccaggttgttattggtaaatatgatgtagtcatacccaaacctaatatatttgagactgagttgtgtggttcaatcggattatagctctgccttgtgatct

SEQ ID NO: 13564 - DNA, 1054 bp, Distylium racemosum
cgacgacgtacaaggagaaagagagagggtcgagcccaacagcggtataagtaaaacaagtgcggaagagagatttatatcaatcaggtgatctcagggattcgatttctttcgggcttctccgtaattctggcagggggtcatccgtttttcaaatttgaaaaatcgtgcatctttggggctgctctttccttggaatccaggcgatctcggagatttacgatgggtttaactttcacgaagcttttccagcgtatgtttgccaagagggagatgcgaattcttatggtcgggctcgatgcagcaggaaagactaccattctgtataagttgaaactgggagagattgttacaaccatccccactatcggctttaatgtggagactgtggaatataaaaacattagtttcacagtttgggatgttggaggtcaggacaagattcgaccactctggaggcactactttcagaacacacagggtcttatatttgtggtggatagcaatgatagagaccgtatagtcgaggcaagggatgagttgcacaggatgttgagtgaggatgagttacgagatgcagtccttctggtcttcgcaaacaagcaggatcttccaaatgcaatgaatgctgctgagataactgataagcttggcctgcattccctgcgccagcgacactggtatattcaaagcacttgtgctacttctggtgaaggtctctatgaaggcttggattggctctcgaacaacatcgcaagcaaggcttgaggatgatgcgtagttactgaaatagttgtaaagaatgggtttagttatccgcctgctgtttttgatcaagggatgagaagacatgcattggattggccctttacatatggatcatttttgctattatgtgttattataaacattccgtattcatatgaatattaagggatcttttctttttacgattgcttttatctccaagaattcaggttcttctctgttgtgagttgattacatgacaactttgagttgcatatatcatatatgtgcagaaaattttagtgac

SEQ ID NO: 13565 - DNA, 891 bp, Euonymus alatus
attaaataattacttgaaagggaaacgttgactaagttccgggaagataagctcgtcatctctcacggagtgcgacttgcccttatcgctcctccttccatcttcgattgtgtcgaacgctgctacctaggggcctgagcagacatggggctcagcttcacgaagctttttagccggcttttcgctaagagggagatgcgtattttgatggtgggtctcgatgccgctggtaagaccaccatattgtacaagctcaagcttggagagatcgtcaccactatccctaccataggttttaatgtggagacagttgaatacaagaatatcagcttcactgtttgggatgttggtggtcaagacaagatccgtcctctgtggaggcattatttccaaaacactcagggtcttatctttgtggttgatagcaacgacagggatcgtgttatcgaggcaagggatgaattacataggatgttgaacgaggatgagctgagggaggctgttttgcttgtatttgccaacaaacaagaccttcccaatgcaatgaatgctgcagaaataactgataagcttggtctccattctcttcgtcaacgccactggtacatacagagcgcatgtgctacttctggggagggcctttatgaggggttggagtggctttccaacaacattgctagcaaggcttgaggtagttgacgatttggcgcttgcatttgcagcatctgcaaatactgtagagggtagttcctcatcctctccagtgactattgtaatagcactatagttgtttagattcacttccacgcataatatatatgagtgttatcggctttagctcaatactttaccatgagcagaactccaatgaaaagtgcaaacctgttctaa

SEQ ID NO: 13566 - DNA, 1482 bp, Physcomitrella patens
gagagattctggaagctccgtccctcccacactctctctctggcttggattcctccaactcctttacatcaaacccagagaaggctttaaacccattacagaaacacagggaaggagacttacctaccgaaagcgcggttatagggcgcgacaagttggggagttgagcctccacgagtgcttcgaggccacataaacggcccccagaacacgacccagggacggaagcattcgtcacaggtcctccgcggggccactcacagcccccatccacgtccccagacccagactcgcacctcgattgggtccaggaacctggttgacgaagcgcgcagtctcgaaccgcgcgattgctttaccagtctccagcgagggcttctcctaaagcgcggcttgcctcgttgatcttcgtcactgcgacctctcgcgtcgcttccttctggtttgtttgtttgtgttgctgctgctgcgaggggcgctctggggttagctcgcttgtcggtttctttgctgtgcggttccgttctgtatctcccccacccgtcgtggtttagtcgccgtccccgcggggtgctgccgccatggggcttacgttcacgaaactgttcacgaaattgttctcgaagcgggaaatgcgcattctgatggtaggtctcgacgcagctggtaagaccaccattttgtacaagctgaagctgggcgagatcgtcaccaccattcccaccatcggattcaatgtggaaaccgtagaatacaagaacattagtttcaccgtttgggatgtcggaggtcaggacaagatccggccactgtggaggcattacttccagaacactcaagggctgattttcgtggtggacagtaacgacagagatcgtgttgtggaagctagggatgagctccatcgcatgctgaatgaggacgagctgcgtgatgctgtcttgctggtttttgccaacaagcaggatctaccaaacgccatgaatgccgccgagattactgacaaactcggactccactcattgcgccaacgccattggtacatccagagtacctgcgcgacgtctggagaaggattatacgaagggctggattggttgtcgagcaacattgccaataagtcttgaatgatggtgcctgtgaatatggcgagatgcgaaactttggggactcacgtgataacccattaactaaggcaaaagaatgtagtcccgtattttagactcgactaggtgttgtaaggtagatcttctgatttttaatgataacgtcgctgtgtatgagtgctttgttaggcacgatatattggaggaacgtctatgcaaatatgcaaccaaggtcctttatctatcacttccatgcttgtatctgagtattttttgtgtgtggttttgcaatctctctataatttggagatctgttgtgtatgatatacagccatcaagcatgtggaacaattttgatgagatatgtgaaatatta

SEQ ID NO: 13567 - DNA, 1086 bp, Physcomitrella patens
ccaacggagacatcatcatccacgcggtgttctggaaactaagagctcttcgccctgcaccctcgttcttgttgttgttgttggtttgtgaggggtgctctgtctggggttagcctgcgcgttggtttcatcgctcgtatctcctcacccgtcgtggtttagtcgccgtccccgcggggtgctgccgccatggggcttacattcacaaaactgttcacgaaattgttctcgaagcgggagatgcgcattctgatggtaggtctcgacgcagctggtaagaccaccattttgtacaagctgaagctgggcgagatcgtcaccaccatccccaccatcgggttcaatgtggagaccgttgaatacaagaacatcagtttcaccgtttgggatgtcggaggtcaggacaagatccgaccattgtggaggcactatttccagaacactcaggggttgatcttcgtggtggacagcaacgatagagatcgtgttgtggaagcaagagatgaacttcatcgcatgctaaacgaggacgagctacgtgatgcggtcctactcgtgttcgccaacaagcaggatctgccaaatgccatgaatgctgcagagatcactgataagcttgggctccactcactccgccaacgccattggtacattcagagcacctgtgcaacttctggagagggtttgtacgagggtctggattggttgtcaagcaacattgccaacaagtcttgattacggcgatatgtggaattctatgctcctaagtgagctgtcccttagctgaaatgtgaggatttagtgaactcctattgtagagtttttgagatggcgtagcttagaaattctgattttgaatgataatgtctctcagtccgagtgcctcagtaagcaggatgccttgaaggcagttgtatgcacatatggaatttaggcccttaaatgtatcacagctctatgatttgatcttagtttgaatttgcatgatttgtctccaattattttataattttagagtaaatgttagcacttggattgtttaagttgtgtttcttcgcttgtcatcgtgatgtagtggatgcatga

SEQ ID NO: 13568 - DNA, 1258 bp, Podocarpus macrophillus
gtcgaaagtagattctgctctcgaataaataaaataaaagatattctcaaccctaaccatcagtcgcgtggaagacgtacacacagtatataataatcagacgagctgggtaacacatttctcagcagctcttcttccgtccagcttgccgggatttgaactcggatctatcgattttggaaaaaacatctcttttgaaatccgagcgacacagcagatatcaggatgggtttgactttcaccaaacttttccagcgtatgtttgccaagagggagatgcgaattctcatggttggtcttgatgcagcaggaaagactaccattctgtataagttgaaactgggagagattgttacaaccatccccactattgggtttaatgtggagactgtggaatacaagaacatcagcttcacagtctgggatgttggaggtcaggacaagattcgaccactttggaggcattactttcagaacacgcagggtctcatctttgtggtggatagcaatgatagagaccgtatacttgaggcaagggatgagttgcacaggatgttgaatgaggatgaattacgagatgcagtcctacttgtgtttgcaaacaaacaggatcttccaaatgcaatgaatgctgctgagataactgataagcttggtctgcactctctacgccagcgacactggtatattcaaagcacttgtgctacttctggtgaaggcctatatgaagggttggattggctttcaaacaacattgcaagcaaggcttaaggactatgcttaatcactgaaatagttgtagagaatggttttggtgatcctgctgacgttttccatcaagaagattcatgcaatgaattggcatgtaactagactaccattttgctttttataatgtattcttataaatattccatataaatctgaagggacattttgggtgtttttgtatgttagaatttagtttccttcctttgttgagttcattacaagacatcttcaagatgaatatcctcaatataaaaatgcagaaatgctaaaaattggaatttccaaaagtgaaactggtaaatgtgtattgtcaagcggtggcgagttttaattattgaaagaagcataaatacacgcaatgcttattaaacttctctcgagcatctcagtaggaaatatattgattgcaagggacctgtgtaaaatggattaatatgcatttggcgatgcactgattatagttcgtaacctattcagtaaacatatc

SEQ ID NO: 13569 - DNA, 739 bp, Triphysaria pusilla
tctttcacgaagcttttcagccggctgtttgcgaagaaggagatgcggattcttatggtaggtctcgatgctgctggtaagaccaccatattgtacaagctcaagttgggagaaatagtgactaccattcctacaattggattcaatgtggagacagtggaatataagaacataagcttcactgtttgggatgttgggggtcaagacaagatccgaccgttgtggagacattactttcagaacactcaagggctgatttttgtggttgatagtaatgatcgagaccgtgttgttgaagccagggacgaactgcataggatgctaaatgaggatgaactgagggatgctgtgctcctagtatttgctaacaaacaagatctcccaaatgctatgaatgctgctgagataactgataagcttggacttcactctcttcgtcaacgtcattggtatatccagagtacatgtgccacttctggtgaaggtctatatgaagggctcgattggctctccaacaacattgctaacaagggttgaggagatgtttgatgaatttcggtatatgtatccatgttgaagataaaattctggtttccgtttttaggcatttgtttgatgcgatcctcttctgtcatttcttttgtttcgtcgtagttagtcaaattgtaatgtctactttgcaatttgctccagggatattttattttttgcagatatactatttcaatattgtgtttct

SEQ ID NO: 13570 - DNA, 824 bp, Curcuma longa
cgtcttgggaaatttaattcgctttgaagaggatggggcttacgtttgcgaagctgtttagccgacttttcgcgaagaaagagatgaggatcttgatggttgggcttgacgcggctggtaaaaccacgatcttgtacaagctcaagctcggagagatcgttaccactatccccactatcgggttcaatgtggagactgtagagtataagaacattagtttcacagtctgggatgttggtggccaagacaagatcagacctctgtggaggcactacttccagaacactcaaggccttatttttgttgtcgatagcaatgacagagaccgtatagcagaggcaagggatgaacttcataggatgcttaatgaggatgaattacgtgatgctgtgttgctcgtatttgcaaataagcaagaccttccaaatgcaatgaatgcagctgaaattactgataaacttggattacattcactgcggcagcgacactggtatatacagagcgcatgtgctacatctggtgaaggcttgtatgaagggctggattggctctctaacaatattgttaacaaggcttgaagcaacatggaggaagcttaaatctatgatcagtaaaacatatatgttagtaacagtgtggtacttttgctagatgcttatctgctgagtcaagtgctacacctggatcagttaccttgttattctacatctatcgtttgtaatattttttttttttttgcatattgttaaatattctatgtaatatcatgacggcctgcaatatgtggtgtaatattattgcgcataatggtcttttaaaagttc

SEQ ID NO: 13571 - DNA, 932 bp, Euonymus alatus
taagaggaagatattaaataattacttgaaagggaaaagttgagagtaaagttccgggaagataagctcgtcatctctgatctctcacggagtgcgacttgcccttatcgctcctccttccatcttcgattgtgtcgaacgctgctacctaggggcctgagcagacatggggctcagcttcacgaagctttttagccggcttttcgctaagagggagatgcgtattttgatggtgggtctcgatgccgctggtaagaccaccatattgtacaagctcaagcttggagagatcgtcaccactatccctaccataggttttaatgtggagacagttgaatacaagaatatcagcttcactgtttgggatgttggtggtcaagacaagatccgtcctctgtggaggcattatttccaaaacactcagggtcttatctttgtggttgatagcaacgacagggatcgtgttatcgaggcaagggatgaactacataggatgttgaatgaggatgagctgagggaggctgttttgcttgtgtttgccaacaaacaagaccttcccaatgcaatgaatgctgcagaaataactgataagcttggtctccattctcttcgtcaacgccattggtacatacagagcgcatgtgctacttctggggagggcctttatgaggggttggagtggctttccaacaacattgctagcaaggcatgacgtagttgaggatttggcgcttgcatttgcagcatctgcaaatactgtggagggtagttcctcatcctctccagtgactattgtaatagcacgatagttgtttagattcacttcctcgcataatatatattagtgttatcggctttagctcaatacttttaccatgagcagaactccaatgaaaagtgcaaacctgttctaatggacaccggatcagcat

SEQ ID NO: 13572 - DNA, 977 bp, Zea mays
ttcttaaaaacttgttaaattcatatttaaggacctttacataactgctctaagttccattgatacgtttcatcgattttcggaggaatttattcgaggaatctagtgtttgaccggctccgctcgattctgcttcgttaccacgcgggtgctatcgaatcttggcggagatggggctcacgttcacgaagctgttcaggcggctattcgccaagaaggagatgaggattctcatggtcggtctcgatgcagctggtaagaccaccatcctctacaagctcaagctcggcgagatcgtcaccaccatccccaccattggatttaacgttgaaactgtcgagtacaagaacattagtttcactgtttgggatgtcggtggtcaggacaagatccggcccctgtggaggcactacttccagaacacccagggcctcatttttgttgtagacagcaacgacagagagcgtgttgttgaggccagagatgagctccaccggatgctgaatgaggacgagctccgtgatgctgtgcttttggtgtttgcaaacaagcaagatctgcctaatgccatgaacgctgctgaaatcaccgataagcttggcctgcactccctgcgccagcggcactggtacatccagagcacatgtgctacctctggtgagggtttgtatgaggggcttgactggctttcgaacaacatcgctaacaaggctcgaagcatctaggcaaggcttcaatcagtggaagcaaactgcctctaccattacagctatgaagtatatagtcgtgactgtgtcagacgtggtgtgttttgggaggataaaaggctcttttggtcgaggagctaggtatcagatgttttttatggtacctgtaattttccgtgcttctgttttggttttgtgcaaggtataccatgtctgactgtgtgctcgccactgtctgagtcgttgtactatcccgggccggcctgtccg

SEQ ID NO: 13573 - DNA, 648 bp, Epimedium sagittatum
gattacgtccgggtggaagctgagcattccttcgtataaccccatttaaagcgcgttgctgaaaagggctgaggaggttcattcattctcttgctctgcgtaccttctccaaagaaagatggggctcactttcacgaagctttttagccggctttttgccaagaaagagatgcgtattctgatggttggtctcgatgcggctggtaagactaccatattgtacaagctcaagctcggagagattgtcacaacaattccaaccattggatttaatgtggagactgtggaatacaagaacatcagcttcaccgtttgggatgttggaggccaggacaagatccgtccattgtggaggcactacttccaaaacacacaaggtttgatctttgtggttgatagtaacgatagggaccgagttgttgaagcgagggacgagttgcacaggatgctaaatgaggatgagttgcgggatgctgttctgctcgtgtttgctaacaaacaagatcttcctaatgcaatgaatgctgctgagataactgataagcttggtcttcattctctccgccaacgccattggtacatccagagcacatgtgcaacttctggagagggtctttacgaggggttggactggctctccaaacaaca

SEQ ID NO: 13574 - DNA, 694 bp, Glycyrrhiza uralensis
gaccgaataaacgacgttacgaaatttattagatctgtgttccgcgttctataaatccgtggtggcctggctgtgagagcagctccatttcttttctctttgttgcaaggagaagagatccgcgttcaccttcttcgcaaatcgctctcttcttcaagaatacttgaaaatggggctgtctttcaccaagctattcagccggctatttgccaagaaagagatgcgtatactcatggtaggtctcgatgctgctggtaagaccaccattctgtacaagctcaagctcggagagatcgtcaccacaattcccacaattgggtttaatgtggaaacagtggaatataagaatatcagcttcactgtctgggatgtcgggggtcaggacaagatccgtcctctgtggagacattacttccaaaatacacaaggacttatttttgtggttgatagcaatgacagggatcgtgttgttgaagctagagatgagctgcataggatgttaaatgaggatgagttgagagatgctgtgcttctagttttcgcaaacaagcaagatcttccaaatgctatgaatgctgctgagataactgataagcttggtcttcattctctccgtcagcgtcactggtatatccagagcacatgtgccacatctggtgaagggctttatgaaggacttgactggctctcaaac

SEQ ID NO: 13575 - DNA, 953 bp, Physcomitrella patens
cgaggagtagccagttgttgccgctctttatttctcctgttggcggggtgcgcgggggatagatagcttgattctgtgccgagctgagctggttttgttgcctgcttaccagatccgtcaaaagcttgttgtcgtcccggcggggtttctgccgctatggggctcacgttcactaagctgttctccaagttgttttcgaaacgggaaatgcgtattctgatggtgggtctcgacgcagctggtaagaccacgattttgtacaagctgaagctgggtgagatcgtcaccaccatcccgaccatcgggtttaatgtggagactgtagaatacaagaacatcagttttaccgtttgggacgtcggaggtcaggacaagatccgaccattgtggagacactacttccagaatactcaggggttgatttttgtggtggacagtaatgatagagatcgtgttgtagaagcacgggacgagctgcatcgcatgttgaatgaggacgagctgcgtgatgcggtactgctggtgtttgccaacaagcaagatctcccagatgccatgaacgctgctgagataactgataagcttgggctccactcactgcgccagcgccattggtatatccagagcacatgcgcaacttccggagagggtttgtacgagggattggattggctttcaagcaacataactaacaagtcttgatcggttgaacgtgtgtatacggcaatatatggagctttgtggacctcaatgacactccatttacttgaggtttagagggtgtggcgcgcccgcattgtagacttggttaggtgttgtaggttaggacttactatttttgaatgacgctgtccctagtgcttaggtgagcgcagtgcctgaggcatgtgtaagctaaaatgctatttaggtccttgatggatctatctacctttcatttatgtgttcggatg

SEQ ID NO: 13576 - DNA, 557 bp, Fragaria vesca
atggggctgtcgttcaccaaacttctcagcagactgtttgctaagaaagagatgcgtattcttatggtgggtcttgatgcggccggtaagaccaccattttgtataagctgaagttaggcgaaatcgttaccaccattcctaccattggatttaatgtggaaacagtggaatacaaaaacatcagcttcactgtgtgggatgttgggggtcaagataagattcgacctctgtggagacactacttccaaaacacacaagggcttatctttgtggttgacagcaatgaccgagatcgtgctgttgaggctagagatgaggtgcacaggatgttgaatgaggacgagttgagggatgctgtgcttcttgtctttgcaaacaagcaagatcttccaaatgccatgaatgctgatgaaatcaccgataagcttggccttcattctcttcgacaacgccactggtatatccagagtacatgtgccacttccggtgaaggcttgtatgagggattagactggctttcaaacaacattgctaacaaggcatgttaaacttttct

SEQ ID NO: 13577 - DNA, 687 bp, Triphysaria pusilla
tttttcatcatcttcttctcaaatccctatcgcaatctcgaaaaaatgggtttgtctttcactaagctttttagccggctgtttgccaagaaagaaatgcgaattcttatggtaggtctcgatgctgctggtaagacaacaatattatacaaactcaagcttggagagattgtgacaaccattcctacaattggatttaatgtggaaacagtggaatacaagaacattagcttcactgtctgggatgtcgggggtcaagacaagatccgaccattgtggaggcattactttcacaacactcaggggttgatcttcgtggttgatagtaatgatcgggatcgtgttgttgaggctagggatgaactccacatgatgttgaatggggatgaactgagggatgcagtgcttcttgtttttgcaaaccaacaagatctgccaaatgccatgaatgctgctgagataaccgacaagcttggacttcactctctccgtcaacgccattggtatatccagagcacatgtgctacatctggggaagggctgtacgaggggctcgactggctctccaacaacattgctaacaagggataaacaatgatgtttgaagaatttaggtatctcgatgcttgttggaatcgaggtttcgtatcaatattgtggtttatgttcagattaatctcatgttaa

SEQ ID NO: 13578 - DNA, 878 bp, Triphysaria pusilla
tacgtatctcattccttgtgctggttgaagagatcttcagctcacagatctctacacctctcattttcaatttgaaagatggggttgtctttcaccaagcttttcagccggctgtttgccaagagagagatacatatactaatggtcggtctcgatgctgctggtaaaaccaccattctctacaagctcaagctcggagaaatcgtcaccacaattcctactattggattcaatgtggagactgtggaatataaaaatattagcttcactgtttgggatgttggaggccaagacaagatccgtccattatggaggcattatttccagaacacccagggcctaatctttgttgttgacagcaatgatcgagaccgtgttgttgaagcaagggatgaactgcacagaatgttgaatgaggatgaattgcgagaagctgttctcttggtgtttgccaacaagcaagatctcccaaatgcgatgaatgctgctgaaataaccgacaaactggggcttcattctctccgccaacgccattggtacattcagagcacatgtgcaacttctggtgaggggctgtacgagggtctagactggctttcaaacaacatcgctaacaagtcttgaatgctttgtttgtgagatcgaagtgatgttttgagctttgccgttcaaccttggttccgtttatgagcaatactatcttttcaatgtattttttgtgataatttgtagatttttgttggtgtttgttgatctctctctctatattcttgcttgtgaaagtaggagtgaatattgggtcgaacttacgagtttgaggacagtgagtattaagaaaataaatgtatgttggataatcgaccaaaatcgagctttgg

SEQ ID NO: 13579 - DNA, 772 bp, Vicia sativa
ggattaacattcacaaagctgttcagtagattatttgccaaaaaggaaatgagaattttgatggttggtcttgatgctgctggtaagacaactattttgtataaactcaagcttggagaaattgtcactaccattccaaccattggatttaatgttgaaaccgtggagtacaagaacatcagctttactgtgtgggatgttggcggtcaggataagatccgtccattgtggaggcactacttccagaacacccagggtgttatttttgtggttgatagtaatgatagagacagagtggttgaggcaagggatgagctgcacaggatgttgagtgaggatgaacttagagatgctgttttgcttgtttttgcaaacaaacaagatctccccaatgcaatgaatgctgcagatattaccgataaacttggtcttcattcactccgccaacgccactggtatattcagagcacttgtgcaacttctggagagggtctttacgagggtttggaatggctttcaaacaacattgcaagcaagtgaatcctcttgagtgttacttgggtttgtatgattgcttaaatgagctaatactttaagctataattggaactcttgcaatcactttttgtgtgacttgatgtttattttaatagtttcattatcagttgaacatttctgtggtttctgttcttagagttttaccaataataattttgtcacatgattgatgtagcagaattggaaaatgtataagaatagttattactgtgca

SEQ ID NO: 13580 - DNA, 889 bp, Echinochloa colona
gccggctgttcgccaagaaggagatgcggatcctcatggtcggtctcgacgccgccggtaaaaccaccatcctctacaagctcaagctcggcgagatcgtcaccaccatccccaccatcggtttcaatgttgaaactgtcgagtacaagaacattagcttcaccgtctgggatgtcgggggtcaggacaagatcagacctctctggaggcattacttccagaacacacagggtcttatctttgttgtggacagcaatgaccgtgaccgtgttgttgaagccagagatgagctccacaggatgctgaacgaggatgagctacgtgatgctgtgctgcttgtttttgccaacaagcaagatcttcccaacgctatgaatgctgctgagatcactgacaagcttggactgcactccctgcgccagcgacactggtacatccagagcacctgtgccacaactggtgagggtctgtatgagggtctggactggctgtccagcaacattgctagcaaggcttgaggtctggctttggatatcaactgcgaactgactaggagctccggatgtatcatggaaacttaggacagaatcgcctttgcaatgcgttaggtgtcttctaccggcacgatatatttttttgtttggaatatgtaatgatgtcaccgttaaatgtttgttctaccctactctactgttggatgttctttgaacctgttcattttgcacaaggattggagttccaatatcatgctactctggaaagttattatataccaacattcgtagtacctgattagttcattagctaagccaaggaggtcgaacatcatgttatatggtaatccagatcctgtctacgctcaatattatcttggagtgtctcttgtcag

SEQ ID NO: 13581 - DNA, 788 bp, Lippia dulcis
agcttttcagtcggctttttgccaagaaagaaatgcggattcttatggtaggtcttgatgctgctggtaagaccaccatattgtacaaactcaagctcggagaaatagtgacaaccattcctactattggatttaatgtggagacagtggaatacaagaacattagcttcactgtttgggatgttggtggtcaagacaagatccgaccactgtggaggcattactttcagaacactcaagggctgatttttgtggttgatagtaatgatcgtgatcgtgttgttgaggctagggatgagctgcataggatgttgaatgaggatgaactgagggatgcagtgctacttgtatttgccaacaaacaagatcttccaaatgctatgaatgctgctgagataactgacaagcttggacttcattctctacgtcaacgtcattggtatatccagagcacatgtgccacatctggggaagggctgtacgagggattggattggctgtccaacaacattgccaacaaggcttaagaagaatgttccaagatgattggtatgtgaaaatcctagttcaagtgtggaggttggattgccttcaccattttgtgtctttttattaaagaacggtctcatagtacgcttgcctttcttcataggtagtcatattctattgtgtagattgagattcctttttgtaatttcagcagtgtgtctcgagatacttggtacttctgctcctactttctagtatgatgatgtcctctctgatttgataaaattaatgaattgtaa

SEQ ID NO: 13582 - DNA, 937 bp, Cedrus atlantica
tacagaagaatcaggggcgagtttttctgacgatttttcacgcgctagattcgaactttggaacccctcgacaaccctctaagtcgatcattcagtttttcgaactcggggtacccccctgttttgagtttttgttgttcagctagaaacccagctcttaagatgggtttaagtttcaccaagcttttccagcgaatgtttgctaaaagggagatgcgaatccttatggttggtcttgatgcggctggaaagactactattttatacaagttgaagcttggagagattgtcacaacaattcccaccattggctttaatgtggagactgtggaatacaagaacattagcttcacagtttgggatgtgggaggtcaggataagattcgaccgctgtggaggcactactttcagaatacacagggtcttatctttgtggtggatagcaatgacagagaccgtgtagctgaggcaagagatgagttgcacaggatgttgaatgaggatgagttacgcgatgcagttctgcttgtgtttgcaaacaagcaggatctcccaaatgcaatgactgctgctgaaatcactgataagcttggtctgcactctttacgccagcggcactggtatattcaaagcacttgtgccacttctggtgaaggactttatgaaggcctggattggctttcaaacaacattgcaaacaaggcttaaggatgatgctcagtatgttggtacagtgattgggtttagtgatgcatttgatgtatttgccaaagtgtaagggaggaggactactttagtgaattggcccttacatttgttctgataagtaacagatactatattattttgtattcatctaagaatttggtggttttcctttttgggtgtatgttatctctgagaattcagtttccttttctttgttgggagtttgatt

SEQ ID NO: 13583 - DNA, 1575 bp, Pinus pinaster
attcacgcaacctcgttatggatgcttaccctgccctttctctcacctgcaaactgtcactcaccacaaccttctgtttaaaagcgattccccttttggaagataaaagcacagaagaatcaaatgtgaccacgctgggcaaaacacggtcggtgcgtagagtttcttttaacccaggttaaaacttggatatttgagtaggagatcacgtaggaaaaacaaggactccagagcgcacatcgtgctgagattgaagaaagaggtgcgagttcgatcgccactttcacgcagcagattcgaactctgaacatctcgacaattccccaagccgatcatttagtttttcgaattcggtgtaacatcctcttctgagttttgtgggagagctagaaactcagcttttaagatgggtttaactttcaccaagctattccatcgaatgtttgctaagagggagatgcgaatccttatggttggacttgatgcggctggaaagactactattttatacaagttgaagctgggagagattgttacaacaattcccaccattggctttaatgtggagactgtggagtacaagaacattagcttcacagtttgggatgtggggggtcaggataagattcgaccactgtggaggcactactttcagaatacacagggtctcatctttgtggtggatagcaatgacagagaccgtgtagctgaggcaagagatgagttgcacaggatgttgaatgaggacgagttacgagatgcagtcctgcttgtgtttgcaaacaagcaagatctcccaaatgcgatgactgctgctgaaatcactgataagcttggcctgcactctttacgccagcgacactggtatattcaaagcacttgtgcgacttctggtgaaggcctttatgaaggcctggattggctttcaaacaacattgcaaacaaggcttaaaagatgtggtttggtaactgagttggtacagtgaatgggtcctagtgatatgcatgcatttgaagtctttgccgaagagtaagggacaaggagtcgtctggtgaattggcccttacatttgtacctagaagtaacaaatactataatattttgtatttatctaagaatttgggggttttcctttttggctctatgccatatgttgtgatttcggtttcttttctttgttggaagctgattatgaaaaagtattagttatatatgcttgaagctaagtgcagaaatgctaaatattagaagctccaaaggttagcagtatatattaaagactcaaaaaattatgtaagagttcggaaaactccacgaggatatgtgagatacctgagcatggaacaagaaaataaaagatagaaatcgctactaaaaaacaattaacgcccttctctccaccaatctccaggccatagatacattataaatggctggtagatatgcagatgactagggtggtctcatttttgaaccttgcaactcttatattgtcaggttcttcacttcaatgcactgcgtgtgcatacatcaattttgcaactatttatgagaggcggatgaaattattatat

SEQ ID NO: 13584 - DNA, 1387 bp, Pseudotsuga menziesii
cgagtgcataccgtgccgaggtacaagaaacaggggcgagctttctcacggttttcacgcagtagattcgaacgcggaacatctcgacaattcatcaagtcgatcgttcagctcttcgaattcgtgataatcctctgttttgggttttcgtcggagaactagaactcagcttttaagatgggtttatctttcaccaagcttttccagcgaatgtttgctaagagggagatgcgaattcttatggttggtcttgatgcggctggaaagactactattttatacaagttgaaactgggagagattgttacaacaattccaaccattggctttaatgtggagactgtggaatacaagaacattagcttcacagtttgggatgtggggggtcaggataagattcgaccactgtggaggcactactttcagaatacacagggtctaatctttgtggtggatagcaatgatagagaccgtgtagctgaggcaagagatgagttgcacaggatgttaaacgaggatgagttacgagatgcagtcttgcttgtgtttgcaaacaaacaggatctcccaaatgcaatgactgctgctgaaatcactgataagcttggcctgcattctttacgtcagcggcactggtatattcaaagcacatgtgccacttctggtgaaggcctctatgaaggcctggattggctttcaaacaacattgcaaacaaggcttaaggatgatgctcaataactgagttggtacagtgaatgggtttagtgatgcatttgatgtctttgccgaattgtaagggacaaggagtcgtgtggtgaattggcccttacatttgttccaataagtaacaaatactatatcattttgtattcatataagaatttgggggttttcctccttgggtgtatgttatatctgagatttcggtttccttttctttgttgggaattgattatgaaaaagtacattagttttatatggatggagtgaagtgcagaaatgctaaatatgaaaagctctaaaggttaacaatatctagtaaagactttcggaattatactcaaaaagttatgtaagattacggataactccatgattatacgtatagagcaagaaataaagagagaaattgcgacttaaaacattcaacacccttctgtccatcaaatctacaggccacatacattacaaatggccagtgcaagtggtacatgtgcaggtgattactgtgggttctcgtttctcaaccttgccacgctttttattgtcaggttctgcattcaatgcgttgcgtgtgcatacatttattttgcaatttgttttacgagaggccgatagaaaattataataattaaaagttttgcaacgccatgagtatttagaaac

SEQ ID NO: 13585 - DNA, 1313 bp, Picea glauca
acgtaggaaaaacataaacgccagagtgcataccgtgctgagatagaagaaagaggggcgacttttatcgcgattttcacgcagcagattcgaactgggaacatctcaataattctccaagtccatcattcagtttttcgaattcgggataacctcctgttttgagttttgtgggagagctagaaactcggcttttaagatgggtttaactttcaccaagcttttccagcgaatgtttgctaagagggagatgcgaatccttatggttggtcttgatgcggctggaaagactactattttatacaagttgaagctgggagagatcgttacaacaattcccaccattggatttaatgtggagactgtggaatacaagaacattagcttcacagtttgggatgtggggggtcaggataagattcgaccactgtggaggcactactttcagaatacacagggtcttatctttgtggtggatagcaatgacagagaccgtgtagctgaggcaagagatgagttgcacaggatgttgaatgaggatgagttacgagatgcagtcctgctagtgtttgcaaacaagcaggatctcccaaatgcgatgactgctgctgaaatcactgataagcttggtctgcactctttacgtcagcggcactggtatattcaaagcacttgtgcgacttctggtgaaggtctttatgaaggcctggattggctttcaaacaacattgcaaacaaggcttaaggatgatgcttgggaactgagttggtacagtgaatgggtttagtgatgcatttgatgtctttgccgacgagtaagggacaaggagttgtgtggtgaattggcccttacatttgttcctataagtaacaaatactatattattttgtatttatctaagaatttggggggtttccttcttgggtgtatgttatatctgagatttcggtttccttttctttgttggaagctaattatgaaaaagtattagttatatatgcttgaagcgaagtgcagaaatgctgagtattaaaagctccaaaggttaacagtatctattaaagacttaaggaattatactcaaaaaattatgtaagagtacggaaaacttcatgattatacgtgagataaatgagtatagaacaagaaaataaaagatagaaaatttgctaaaaaaacattcaacacccatctctccaccagcaatttacatgccacagattcattacaaatggctggtaaatatgcaggtgactggtgggtctcgtttctgtaaccttgcaattcttctatttcaggttctgcacttaat

SEQ ID NO: 13586 - DNA, 1095 bp, Picea glauca
gtaaacgccagagtgcataccgtgctgagataaagaaagaggggcgacttttatcgcgattttcacgcagcagattcgaactgggaacatctcaataattctccaagtccatcattcagtttttcgaattcgggataacctcctgttttgagttttgtgggaaagctagaaactcggttgtgagtgaaatacaatcgtgaggacgaaggctttcttatgcccatactcaatttttgaacggaggctttcttatgcacattcattctgaagatcacttcaacttcaaaatcaagcttttaagatgggtttaactttcaccaagcttttccagcgaatgtttgctaagagggagatgcgaatccttatggttggtcttgatgcggctggaaagactactattttatacaagttgaagctgggagagatcgttacaacaattcccaccattggatttaatgtggagactgtggaatacaagaacattagcttcacagtttgggatgtggggggtcaggataagattcgaccactgtggaggcactactttcagaatacacagggtcttatctttgtggtggatagcaatgacagagaccgtgtagctgaggcaagagatgagttgcacaggatgttgaatgaggatgagttacgagatgcagtcctgctagtgtttgcaaacaagcaggatctcccaaatgcgatgactgctgctgaaatcaccgataagcttggtctgcactctttacgtcagcggcactggtatattcaaagcacttgtgcgacttctggtgaaggtctttatgaaggcctggattggctttcaaacaacattgcaaacaaggcttaaggatgatgcttgggcaactgagttggtacagtgaatgggtttagtgatgcatttgatgtctttgccgcgagtaagggacaaggagttgtgtggtgaattggcccttacatttgttcctataagtaacaaatactatattatttgtatttatctaagaatttgggggttcttcttggtgtatgttaaatctgagatttcggtttccttttctttgttggaagctaattatagaaaagtattagttatat

SEQ ID NO: 13587 - DNA, 1467 bp, Pinus taeda
acagaagaatcaaatgtgaccgcgctggtcaaaacaggagtcgctgcgtagagtttcttttaacccaggttaaaactgggatatttgagtaggagatcacgtaggaaaaacaaggactcgagagtgcacatcgtgctgagatagaagaaagaggtgcgagttctatcgcgactttcacgcagcagattcgaactctgaacatctcgacaattccccaagacgatcatttagtttttcgaattcggtttaacatctccatctgaattttgtgggagagctagaaactcagcttttaagatgggtttaactttcaccaagctattccatcgaatgtttgctaagagggagatgcgaatccttatggttggacttgatgcggctggaaagactactattttatacaagttgaagctgggagagattgttacaacaattcccaccattggctttaatgtggagactgtggagtacaagaacattagcttcacagtttgggatgtggggggtcaggataagattcgaccactttggaggcactactttcagaatacacagggtctcatctttgtggtggatagcaatgacagagaccgtgtagctgaggcaagagatgagttgcacaggatgttgaatgaggacgagttacgagatgcagtcctgcttgtgtttgcaaacaagcaagatctcccaaatgcgatggctgctgccgaaatcactgataagcttggcctgcactctttacgccagcgacactggtatattcaaagcacttgtgcgacttctggtgaaggcctttatgaaggcctggattggctttcaaacaacattgcaaacaaggcttaaaagatgacgtttggtaactgagttggtacagtgaatgggtcccagtgatatgcatgcatttgaagtctttgctgaagagtaagggacaaggagtcgtgtggtgaattggcccttacatttgttcctagaagtaacaaatactataatattttgtatttatctaagaatttgagggttttcctttttgggtgtatgtcatatattgtgatttcggtttcttttctttgttggaagctgattatgaaaaagtattagttatatatgcttgaagctaagtgcagaaatgctaaatattagaagatccaaaggttagcagtatctattaaagactcaaaaaattatgtaagagttcggaaaactccacgaggatacgtgagatacctgagtatggaacaagaaaataaaagatagaaatcagtctaaaaaaacaattaacggccttctctccaccaatctccaggccatagatacattataaatggctggtagatatgcagatgactagggtggtctcgtttttgaaccttgcaactcttatattgtcaggttcttcacttcaatgcactgcgtgtgcatacatcaattttgcaattgttttatgagaggctgatgaaaattattata

SEQ ID NO: 13588 - DNA, 718 bp, Curcuma longa
aatcgattgtgcttattagtggtggaaacgatggggcttacttttacgaggctgtttagccgtctctttgcgaagaaggagatgaggattttgatggtcggacttgatgcggctggaaaaacgacgatactgtacaaactcaagcttggagaggtggtcaccaccatccccacaattggattcaatgtggagaccgttgaatacaaaaacattagtttcacagtttgggatgttggtggccaggataagattaggccactatggaggcactacttccagaatacacaaggacttatatttgttgttgacagcaatgacagggatcgtgttttggaggcgagggatgaactgcacaggatgctaaatgaggatgaattgcgtgatgctttgttacttgtatttgccaataagcaagacctaccaaatgcaatgaatgctgctgaaattactgagaagcttggactgcattccctacgtcaacgacactggtacatacagagtgcttgtgcaacatctggtgaaggtttgtatgaggggctggattggctttccagcaacatggccagtaaggcttgaaacttgtaattaggcgatcttgaatatattgcttgtggatctaattatcagcttggttctcttttgtcttgctcttttacggtgtaatatgatatgtgcaaacaatatggtgtgatgatagttttatagcgtgatagtagta

SEQ ID NO: 13589 - DNA, 632 bp, Actinidia deliciosa
gttgtattcaggctccatctctccctctctctttctctctctagatccctctgcaaaatattccagcagggatccatagcaagaaagcaaaatggggctgacattcaccaagcttttcagccggctttttgccaagaaagagatgcgtatccttatggttggtctggatgctgctggtaagaccaccattttgtacaagctcaagctgggggagattgtgaccacaatccctactattggctttaatgtcgaaactgttgagtacaaaaatataagtttcaccgtatgggatgttggtggccaggacaagattcgtccattgtggaggcactatttccagaacacacagggcctcatctttgtggtggatagcaacgacagagaccgagttgttgaggcgagggatgaattgcatcgcatgttgaatgaggatgagctgcgagaggcggtgttgcttgtatttgctaacaagcaagatcttcctaatgcaatgaacgctgctgaaataactgacaagcttggcctccactctctccgacaacgtcactggtacatccagagcacctgcgcaacctctggggaggggctgtacgaggggctggattggctctccacaacatcgctaacaagtc

SEQ ID NO: 13590 - DNA, 555 bp, Prunus persica
aacaaaatggggctgtctttcaccaaactgttcagccgactgtttgctaagaaagagatgcgtattcttatggtgggtcttgatgcttctggtaaaaccaccattttgtacaagctcaagttaggcgaaattgtgaccaccatccctaccattggatttaatgtggagactgtggaatataagaacattagcttcactgtctgggatgttgggggtcaagacaagattcgacctctatggagacactacttccagaacacacaagggctgatctttgtgatcgacagcaatgatcgagatcgtgttgttgaagccagagatgagatgcacaggatgttgaacgaggacgaattgagggaagctgtgcttcttgtgtttgcaaacaagcaagatcttcccaatgcaatgaatgctgctgagatcacagataagctcaaccttcattctcttcggcaacgccattggtacatccagagtacatgcgccacttctggagaaggtttgtacgagggattggactggctttcaaacaacatcactagcaaggcatgttaa

SEQ ID NO: 13591 - DNA, 2949 bp, Solanum lycopersicum
aaaatgttatataaaatgacgactcagctaaaaattctctttttccgtgccacagcagaggaaagcgcggtgaacgacagctccatttcgagatctacctattcgaatctccgatcgccgatcgccggtaagccgtcgtcgtctcttaacgtacgaacttttttttctatcgaatgaactagtttgacattcatctgcatgaagatcgatctgccttatagttcgtaatttgctgatttctagatgttgttccgatgctcttagaaaaaattgttgtctcagtaattcatcctctaactttgaaaaaaaaattgaaatggatcaaagtcaaacgtgtattagtggacacattcagcttgtaactgtagttgacaagtatactgtggatttaatgcacctcgagctggcctggatacaaacaagtaaactaaaataaagcatacatgcggatgtaagcaatggaagtgttgaatgtgctttgatttagcaaatagaatttgagctatgtgatttccaaatatgaagttagttagaggttgatttggaatttgattgtttaggaataaggttactagtacgtgttttctgataatttttttaattataaccttgttgtttttgtaattttttcgtgctttgctttcatgtatctggatttgatcatcttgctatagttattatacttttaaccaatagctgaagtgtcttctgtcgtgataatgggcgggcaatgggcatgcacattgcttgagcaagaaatatgtacatattcgcgtatgagaacttttgagagtatatcttcattaaatctacatcaatgatcataatgggttagtgagcattgtgacatacagctttcctgtcacaaaatcgtggatctgcctctacttcttgcatatttgactatgtttaacaattttagaaatagagagttgcagaatgtttacacggtcgatgctgtatgtacagtgtggttactgaaggctgaaattttaagattgttattttctggctaaatactgttattggttttgaggaatatcatttcctaaataatgcttgatagtttctgtggcgattgaaaaggatacgagaacataatcgggtcatctgaatttctatgagaggtgttgtatcttttttttgcactagaaatgaactattactgtgtcgatctcatgtactcgggggatttcatatataatggtatttatcattatagagttgtcaagagaactgatgcagccttttgcggtgaggttattggaataattcacttattgtgtttaaagttgtacttgttacaatgtccattgcaaattgaaattgtggaaaatgagtgttggtggtatcattagcaacttttgaggaataactaacaaggacagggagaaggctttctggcctgggttgtacatgtgagcttgtaagtatcagagagaacaggttctatatttaacattaccaattttttaaaagagaagtatcagagagaacaaggtgaaaagacgcagagtattgtaagaaccacacctagaattctttggaataactcctcaacaaaggctgcagataaagcaacataagttctggacaagtcatggagtcaattcataatgcttcatagttgaatagaacataatctattaaattcttgtttttttcttactagcagtatttgacttcatagacatatggcataaatacagtatgaaatagataattaaagatccaatctgcataaatgttctgcaagatacaaagtacttcagagctacatgcaacaaaagatttttccttctctttccgcaagatgctatttgtttttatttttgaaattaattgtattaccatagtcaaagtgaccggaattagtgaaagttttatattgattctctgatctttataaaggatctcgtccatttttcagttacacagagatggggctgtctttcaccaaactttttagtcgcctctttgctaagaaagaaatgcgtattcttatggttggtctcgatgctgctggtaaaaccacaattctctacaagctcaagttgggggaaattgttactactatacctacaattggcttcaacgtggaaacagttgaatacaagaacatcagctttaccgtgtgggatgttgggggtcaggacaagattcgacctctatggaggcattatttccagaacactcaaggcctcatctttgtggttgacagcaatgacagagaccgtgttgttgaggcaagggacgagcttcataggatgttgaatgaggatgaactaagagaggctgtgctgcttgtttttgcaaacaaacaagatcttccaaacgcaatgaatgcagctgaaatcaccgataagcttggacttcattctcttcgacagaggcactggtatatccagagtacatgtgccacttctggagaagggttatacgagggacttgattggctatcgaacaatatttcaaacaaggtatgtgtttattgacaatcaaaccccttccctttccctttccgatatcgttgtcagcctctcttctcatttctaatttgttctatctggttcaatttcaggcttagagcatcaattagattctgccctcgcttgtcgctcgcttacctatatctggagtatagatgttaaacaccgtttggttattttggatagaaagaagatcaatttctgaaaaatatcctgcatttctttcccttttcatgctttggttagttgctactttgcttgcaatgtaaaacattaatattgttttttcgtatcgtagccggagctactttaacccttttaattgtgtcttccccgtctccaacacacttcatcttcaccctagcttccgacccttgtaattttgtatatatatccatgaataaattgatgatataaagaagcattgatgatataaagaagcatggaatggacgtttcaa

SEQ ID NO: 13592 - DNA, 559 bp, Cucumis sativus
cggaaatgggtttgacctttacgaagctcttcggtaggcttttttctaagaaagagatgcgcattttgatggttggtcttgatgctgctggtaagacaacgatcttgtacaagctgaagcttggagaaattgtgaccaccattcccactatcggatttaatgtggagactgtagaatacaagaacatcagctttaccgtttgggatgttggtggtcaggacaagatccgtccactttggaggcattacttccagaatacacagggccttatttttgttgtggatagcaatgatagggacagggtcgtagaggcaagagatgagttgcataggatgttgaatgaggatgagcttagagatgctgttttgcttgtatttgctaacaagcaagatcttcctaatgccatgaatgctgcagaaataactgacaaactcggtcttcactcccttcgccagcgccactggtacatccagagcacatgtgcgacatccggggagggcctgtacgaaggtttggattggctttccaacaacattgttagcaaggtaaatacaccttt

SEQ ID NO: 13593 - DNA, 817 bp, Salvia sclarea
ctactagaccttggctgtcactcacgaagcttttcagccggctgtttgccaagaaagagatgcgtattctcatggtaggtctcgatgctgctggtaaaacaaccattctctacaagctcaaacttggagaaattgtcaccaccattcctaccattgggtttaatgtggagactgtggagtacaagaacatcagtttcactgtttgggatgtcgggggtcaagacaagatccgtccactatggaggcattatttccagaacacccagggccttatctttgttgttgacagcaacgaccgtgatcgtgttgttgaagcaagggatgaattgcacaggatgctcaatgaggacgagttgagggatgcagttctgctcgttttcgccaacaagcaggatcttccaaatgcaatgaacgctgcagagataactgacaagctgggccttcactccctccgccaacgccattggtacatccagagcacatgtgcgacttccggtgagggactctacgagggactggattggctgtcgaataacattgccaacaagagttaagctctcgagatgaccttgcagcatggcctgtgggggctttgattctttatcactcggatcgtcgagcactatgcttactgccttgggtccagtcgagatcgttgccgtcgtctttagtatcttctctatgtagttaataataatttgtagattttgttatcagccgtgtggttcttcctactactgttttctgttttgtggtataggatcgagttgtgtaatagaaaacttacctaccttcgcagtgagtgacaggctagtag

SEQ ID NO: 13594 - DNA, 1268 bp, Musa acuminata
ccaagacagcgggcccacgtggggcccacctataaagcctggtaaccggcggcggtggcggtggcggtggatcgcgatgtgcgtgagtttgacgcggtatgttgtcctcgcctcccccggttaacgataaaacgctggctgcgggagcagggcgccatctccttcctcctcttccttggtcgcagcagaggcctcgtccgagagacctccgtggtgaacaagatggggctcaccttcacgaggttgttcagccggctctttgcgaagaaggagatgaggatcttgatggttgggctcgacgcggccggtaaaacgacgatcttgtacaagctcaagctcggagagatagttaccaccatccccactattggattcaatgtggagactgtagagtacaagaacattagttttactgtttgggatgttggtggtcaagataagatcagacctctgtggaggcactacttccagaacactcagggccttatttttgttgtagacagcaatgacagagaccgtattatcgaggcaagggatgaactccacaggatgcttaatgaggatgagttacgtgatgcagttttgcttgtgtttgccaataagcaagatcttccaaatgcaatgaatgcagctgaaattactgataagcttggcctgcattccctgcgtcaccgacactggtatattcagagcgcatgtgctacatctggtgaaggtttgtatgaggggctggattggctctccaacaatatcatcaccaaggcttgaaacttgtagcaaggaacatactgcttggtcagatatatgccataatggcatgaacttgtccgtcgtggtccagttctgttgacattagtgctataattttttttcttttttctgtagtattagtaataatagcccgacttgtaagataaaaggttgagaaagatgctgcgtggttgtatggtgtgctaatatgattatgatcaatctgtgtttgatgttctaattgatcatttggtgggcaaatttctcttggcatccttctccaagctttttccatcatcactaacaaatcgcaatatactggaaaatttcttacagaatttgccaaatattcacaggcttatttcgacatggcttcaacatatgccaaattccttgcgaaaaaagatttgacttcattatccaacttgaagtcgatctccaattgtcatatatttggatgatcaaaattcaagttctgaaagcagtctcttatatcgtggtcttcgggtgatgtgggc

SEQ ID NO: 13595 - DNA, 889 bp, Bupleurum chinense
ctctcacacaccgatcgatcgatcgatctacaccggagagaaaagagtgcaaatatacatctttctctcccttaatctccagtgttaaagatggggctgtcctttaccaaactcttcagccggctctttgccaagaaagaaatgcgcatactgatggtgggtctcgatgcagctggtaaaacaaccatattatacaagctcaagctgggagagatagttacaacaattcctactattggatttaatgtggagactgtggaatacaagaacattagcttcactgtctgggatgttggaggccaggacaagatccgtcctttgtggagacattacttccaaaatactcaaggcctcatatttgtggttgatagcaatgatcgagatcgtgtagttgaagcaagagatgaactgcacagaatgcttaatgaggatgaattaagggatgctgtcctacttgtatttgctaacaaacaagatcttcccaatgcaatgaatgctgctgagattactgataagctaggtcttcattctcttcgtcagcgccactggtatattcagagcacatgtgccacttcaggtgaaggtctatatgagggcctggactggctctacaaataacatagcaaacaaggcgtagacagtcttttgattggagtttgactcttctaaggaagcagataagagttcttcaatatctcttggtttgagatcttcatgacaatgggattgagtttctcatatttctcttcttccagagatgtgtaccatgtgtttatgttggcttctttactatgtttgaggtctcttaaaagttacgtatggtttcttctaggttcattataggtagtagtattactcatttcatgtgattctccatgtgaccatgtcg

SEQ ID NO: 13596 - DNA, 952 bp, Festuca arundinacea
tcaagcctctactcgcttcttgcttcgggcgattccatccgagcgagcggaggagcggagaggaggcggcggcggcagcggaggaggtagatcgtcgatggggctctccttctcgtcgctcttcggggcgctgttcgccaagaaggagatgcggatcctcatggtcgggctcgacgccgccggcaagaccaccatcctctacaagctcaagctcggcgagatcgtcaccaccatccccaccatcgggttcaacgtggagactgttgagtacaagaacatcagcttcaccgtttgggatgtcgggggccaggacaagataaggcctttgtggaggcactacttccagaacactcagggccttatctttgttgttgacagcaacgacagagatcgtattgctgaggcgagagatgagctccacagaatgctgaatgaggatgagctgcgcaatgctgtgttgcttgtttttgctaacaagcaagaccttcccaatgccatgaatgctgctgaaataacagataaacttggtctccactctctgcgtcagcgacactggtatattcagagtgcttgtgctacaagtggggagggtctgtatgaagggctggactggctctccagcaacatagccagcaagtcatgaatgcttccattgggctggccgaagcagcaggtggctggagaaatgactgtaatatatagtcatgttaaaatgatgtcgagttttgacatgtccttgcaactcaatctttgtgctgttatcacactgttagtcacggatgaatgctgtatgggtggttgaatgtacacaaaacgataactgttctgctataatgtgaacttttatgccagctgttcccgaatctgatgatcaccttgccctcgttatgtgcagtgtgtacgcagatgtattctgcaaacgattaatctcattcttgagaataatttatcc

SEQ ID NO: 13597 - DNA, 636 bp, Fraxinus spp
ttttcagccgtctgttcgccaagaaagagatgcggattcttatggtgggtcttgatgctgctggtaagaccaccatattatacaagctcaagctgggagaaatagttacaaccattcctacaattggattcaatgtggagacagtggaatacaagaatatcagcttcactgtctgggatgttgggggtcaagacaagatccgaccattgtggaggcattactttcagaacactcaagggctgatcttcgttgttgatagtaatgatcgtgatcgtgttgttgaggctagggatgagctgcataggatgttgaatgaggacgaactgagggatgcagtgcttctagttttcgctaacaaacaagatcttccaaatgccatgaatgctgctgagataactgacaagcttggacttcactctctccgtcaacgccattggtatatccagagcacatgtgccacctctggggaagggctttatgaggggctggactggctctccaacaatatcgccaacaaggcatagaagagacaatatttgatgattatgatagcttgactctcgtcaaagaggagattgtctttcttttcccgggtctttttttatctcgttgtcttgaaaattccgtactttgatc

SEQ ID NO: 13598 - DNA, 592 bp, Actinidia deliciosa
ctctcgatcccctctgcaaaatccgctagcagggatctaccccaagaaagataaatggggttgacatttaccaagcttttcagccggctttttgccaagaaagagatgcgtatccttatggttggtcttgacgctgctggtaagaccaccattttgtacaagctcaagcttggggagattgtgaccacaattcctaccattggttttaacgttgaaactgttgagtataaaaatatcagcttcaccgtgtgggatgttggtggccaggacaagattcgcccattgtggaggcactatttccagaacacacagggtctcatttttgtggtggatagcaatgatagagaccgtgttgtcgaggcaagggatgaattgcatcgcatgttgaatgaggatgagttgcgagatgcagtgttgcttgtatttgctaacaaacaagatcttcccaatgcgatgaatgctgctgaaataactgacaagcttggcctccactctctccgacagcgtcactggtacatccagagcacttgtgcaacttctggggaggcgctctatgaggggttggattggctttccaacacattgctagcaa

SEQ ID NO: 13599 - DNA, 1145 bp, Lolium multiflorum
gtggtggaaaattagaggaggaagggtgctgaaatcacggagtgctaaaacaagataaccaaccaacagcatacacctaatcccgtaacattatttccgtaacagattgcccgtaggtctagcattttcgctcttctctccaaccacaccttggctgcatcttcccctcaacctcaagcctctactcgcttcttgcttcgggcgattccatccgagcgagcggaggaccggagaggggagacgcggcggcggaggaggcagatcgtcgatggggctctccttctcgtcgctcttcggggcgctgttcgccaagaaggagatgcggatcctcatggtcgggctcgacgccgccggcaagaccaccatcctctacaagctcaagctcggcgagatcgtcaccaccatccccaccatcgggttcaacgtggagactgttgagtacaagaacatcagcttcactgtttgggatgtcgggggccaggacaagataaggcctttgtggaggcactacttccagaacactcagggccttatctttgttgttgacagcaacgacagagatcgtattgctgaggcgagagatgagctccacagaatgctgaatgaggatgagctgcgcaatgctgtattgcttgtttttgctaacaagcaagacctgcccaatgctatgaatgctgctgaaataacagataaacttggtctccactctctgcgtcagcgacactggtatattcagagtgcttgtgctacaagtggggagggtctgtatgaagggctggactggctctccagcaacatagccagcaagtcatgaatgcttccattgggctggccgaagcagcaggcggctggagaaatgactgtaatatataggcatgttaaaatgatgtcgagttttgacatgtctttgaaactcaatctttgtgctgttatcacactgttagtcacggatgaatgctgtatgggtggttgaatgtacacaaaacaaaaactgttctgctataatgtgaacttttatgcccagctgttcccgaatctgatgatcaccttgccctggttatgtgtagtgtgtacggagatgtattctgcaaacgattaatctcattcttagaataatttatcctgtgttgtctttgagcgaactc

SEQ ID NO: 13600 - DNA, 884 bp, Phalaenopsis aphrodite
gttttcctcctatttttcgcggggtgcggagtgagaggatcggccattgttacccgttgtcgtggagagcatttgccattgatttgttaggagtaatctactggtgcgggtagagatggggctcttatttacgaagctctttagtcggctatttgctaagaaggagatgcggattctgatggtcggtcttgatgccgctggtaagaccacgatcctgtacaagctgaagcttggggaaattgtcacaaccatcccaactattgggttcaatgttgagactgttgagtacaagaacattagcttcactgtttgggacgttggtggtcaggataagatcagacctttgtggaagtactacttccaaaatacgcagggtctcatttttgttgtcgacagtaatgacagagaacgtgttattgaggccagggatgaactgcaccggatgttaagtgaggatgagctgcgagatgccgtcttgctcgtgtttgcaaacaaacaggacctaccaaatgcgatgaatgctgctgaaattaccgataaacttggcctccattctcttcgtcaacggcactggtacatccagagcgcttgcgccacttccggtgaaggcctctatgaggggctcgattggctttccagcaacattgcctctaggggctgacacaatcaaaggagcacttctatgttagcgggtggatcatgattgaaatatgcagacggattgatttttcagattcaggaatattaatctatattttgttttcgctgatatataaagagaataaatatatttataattttatatccatcgatttattttttgttttaatttttggctcgtgatatttagtttctgttgcaggtatatatttgacttgttgtgt

SEQ ID NO: 13601 - DNA, 968 bp, Pseudoroegneria spicata
aggagaggaggaggcgacggaggagaagtttggtacggagatcgatggggctgtcgttcgggacgctgttcggggcgctattcgcgaagaaggagatgcggatcctgatggtcgggctcgacgccgccgggaagaccaccatcctgtacaagctcaagctcggcgagatcgtcaccaccatccccaccatcgggttcaacgtggagacagtagagtataagaacatcagcttcactgtttgggatgttggtggccaggacaagataaggcctttgtggaggcactacttccagaacactcagggccttatctttgttgttgacagcaacgacagagaccgtattgctgaggcaagagatgagctccacaggatgctgaatgaggatgagctgcgcaatgctgtattgcttgtttttgctaacaagcaagatcttcccaatgccatgaatgctgctgaaataacagataaacttggtctacactctctgcgtcagcgacactggtacattcagagtgcttgcgctacaagtggggagggtctgtatgaagggctggactggctctccaacaatatagccagcaagtcctgaaagcttccaatggattggcagggccgcagaagcaactagcggctggacaaatgactggagtatgtaggcatgttaaaatgctgccagtgttgacatgtctttgtaagctcgatctttccgccattatcacactgttactatgttgtatcaatgattgaatgtacacacgaggaaaacctttatgctatagtgaaaatgatgccatgtcaggtgctcctcagcctaatgagtgttgatgatcctgccccggttttgtgaaccgagatgtattctgcacgtgattagtctcattcctgcgtatatttgattcgtgtctgtagacaacaaatgttgcgacgtgtttggtatttgaggattatggtaatctcgttttggata

SEQ ID NO: 13602 - DNA, 1059 bp, Secale cereale
gactaaaatcacggagggagccctctcacatctcgcttacacgctgggcccaccggacgccagtcaaaacgaatccctccgcctcgcgtaggacgcacgctctcctcttcttcttctccaaaggcaaccacacctccctctgcgtctccgtagcctctactcgcttgtgctttgggcgattccatccgaggcgaggagagagaggagaggaggaggcggcggaggagaagtttggtagggagatcgatggggctgtcgttcgggacgctgttcggggcgctgttcgcgaagaaggagatgcggatcctgatggtcggcctcgacgccgccgggaagaccaccatcctgtacaagctcaagctcggcgagatcgtcaccaccatccccaccatcgggttcaacgtggagacagtagagtataagaacatcagcttcactgtttgggatgttggtggccaggacaagataaggcctttgtggaggcactacttccagaacactcagggccttatctttgttgttgacagcaacgacagagaccgtattgctgaggcaagagatgagctccacaggatgctgaatgaggatgagctgcgcaatgctgtattgcttgtttttgctaacaagcaagatcttcccaatgccatgaatgctgctgaaataacagataagcttggtctacactctctgcgtcagcgacactggtatatccagagtgcttgcgccacaagtggagagggtctgtatgaagggctggactggctctccaacaacatagccagcaagtcctgaaagcttccaatggattggcagggccgcagaagcaactagcggctggacaaatgacttggaatatgtaggcatgttaaatgttgccagagtgttgacttgtctttgtaagctctatctttgagcagttatcacactgttactatgttgtatcaatgattgaatgtacacacgaggaaaacctttatgctatagtgaaaatgatgccatgtcaggtgttcctgagcctgatgagtgatgatgatcctgccccggtgttgtgaaccgaaa

SEQ ID NO: 13603 - DNA, 1054 bp, Picea glauca
tcattcagttttcgtaattccgggataacctcctgttttgtagctttgtgggagagctagaaactcggctttaaagatgagtttaactttcaccaagcttttccagcgaatgtttgctaagagggagatgcgaatccttatggttggtcttgatgcggctggaaagactactattttatacaagttgaagctgggagagatcgctacaacaattcccaccattggatttaatgtggagactgtggaatacaagaacatcagcttcacagtttgggatgtggggggtcaggataagattcgaccactgtggaggcactactttcagaatacccagggtcttatatttgtcgtggatagtaatgacagggaccgtgttgttgaagcaagagatgaattgcatagaatgctgaatgaggatgagctacgagatgctgttcttcttgtatttgcaaacaagcaggatcttcccaatgcaatgaatgctgctgagataactgataagcttggcctgcattctttacgtcagcgccatcggtatattcagagcacttgtgcaacttctggtgaaggcctttatgaaggcttggattggctttcaaacaacattgccaacaaggcataatttggaatgcgtctaatatctatattgggcacgaagtttattagccatgaagtagattccttcagaattacaatgatcgacagccactggcatggattttttaaagaagaccttgactcgattcattttcttgatagcttgattgctatgtattttacaacttgtcattattgtgcgagaatctgggatttttctgtctgccagttgtgctatattgactatattagctctgctacacatctaactattatcttttgattgagaagacttgtataattagattttagtggattgaaaggcttttctatgttcaataggaacaaatataatgctgctttccaaatttattagttgggaaaacagaaagtagttcagtatttacattagtatctgaagcttctataagatatttatatctgtattcttttcctg

SEQ ID NO: 13604 - DNA, 1003 bp, Triticum aestivum
cgctctcctcttcttctccaaaggcaaccacacctccctctgcgtctccgtagcctctactcgcttgtgctttgggcgattccatccgaggcgagaagaggagaggagagcagaggaggaggcgacggaggagaagttcggtagggagatcgatggggctgtcgttcgggacgctgttcggggcgctgttcgccaagaaggagatgcggatcctgatggtcggcctcgacgccgccgggaagaccaccatcctgtacaagctcaagctcggcgagatcgtcaccaccatccccaccatcgggttcaacgtggagacagtagagtataagaacatcagcttcactgtttgggatgttggtggccaggacaagataaggcctttgtggaggcactacttccagaacactcagggccttatctttgttgtcgacagcaacgacagagaccgtattgctgaggcaagagatgagctccacaggatgctgaatgaggatgagttgcgcaatgctgtattgcttgtttttgctaacaagcaagatcttcccaatgccatgaatgctgctgaaataacagataagcttggtctacactctctgcgtcagcgacactggtatattcagagtgcttgcgccacaagtggggagggtctgtatgaagggttggactggctctccaacaatatagccagcaagtcctgaaagcttccaatggattggcagagccgcagaagcaactggcggctggacaaatgactggaatatgtaggcatgttaaagtgctgccagagtgttgacatgtctttgtaagctctatctttgagcagttatcacactgttactatgttgtatcaatgattgaatgtacacacgaggaaaacctttatgctatagtgaaaatgtcaggtgctcctgagcctgatgagtcatgaagatcctgccctgattttgtgaaccgagatgtattctgcgcgtgattaatctcattcctgtgtataattgatccc

SEQ ID NO: 13605 - DNA, 1134 bp, Triticum aestivum
aagcaaccacacctccctccgtgtctcagtagcctctactcgctcgtgctttgggcgattccattccatccgaggagagaagaggagaggaggaggcggcggaggagaagtttggtagggagatcgatggggctgtcgttcgggacgctgttcggggcgctgttcgccaagaaggagatgcggatcctgatggtcggcctcgacgccgccgggaagaccaccatcctgtacaagctgaagctcggcgagatcgtcaccaccatccccaccatcgggttcaacgtggagacagtagagtataagaacatcagcttcactgtttgggatgttggtggccaggacaagataaggcctttgtggaggcactacttccagaacactcagggccttatctttgttgttgacagcaacgacagagaccgtattgctgaggcaagagatgagctccacaggatgctgaatgaggatgagctgcgcaatgctgtattgcttgtttttgctaacaagcaagatcttcccaatgccatgaatgctgctgaaataacagataagcttggtctacactctctgcgtcagcgacactggtatatccagagtgcttgcgccacaagtggagagggtctgtatgaagggctggactggctctccaacaacatagccagcaagtcctgaaggcttccaatggattggcagggccgcagaagcaactagcggctggacaaatgactggaatatgtaggcatgttaaaatgctgccagagtgttgacatgtctttgtaagctctatctttgagcagttatcacactgttactatgttgtatcaatgattgaatgtacacacgaggaaaacctttatgctatagtgaaaatgatgccatgtcaggtgtccctgagcctgatgagtgatgatgatcctgccccggttttgtgaaccgaaatgtattctgcgcgtgattaatcttgttcctgtgtatagttgatccgtatctctagacaacaaatgttgcaacgtgtttggtatttgaggattatggtaatgtcgttttagataagctggttttgcagatttggttccgggaaaaagatttggttttgtttttatagtttttctatagctaaatgttgttggatgg

SEQ ID NO: 13606 - DNA, 998 bp, Triticum aestivum
gcacgctctcctcttcttctccaaaggcaaccacacctccctctgcgtctccgtagcctctactcgcttgtgctttgggcgattccatccaaggacagaagaggagaggagaggagaggaggaggcggcggaggagaagtttggtagggagatcgatggggctgtcgttcgggacgctgttcggggcgctgttcgccaagaaggagatgcggatcctgatggtcggcctcgacgccgccgggaagaccaccatcctgtacaagctcaagctcggcgagatcgtcaccaccatccccaccatcgggttcaacgtggagacagtagagtataagaacatcagcttcactgtttgggatgttggtggccaggacaagataaggcctttgtggaggcactacttccagaacactcagggccttatctttgttgttgacagcaacgacagagaccgtattgctgaggcaagagatgagctccacaggatgctgaatgaggatgagctgcgcaatgctgtattgcttgtttttgctaacaagcaagatcttcccaatgccatgaatgctgctgaaataacagataagcttggtctacactctctgcgtcagcgacactggtatatccagagtgcttgcgccacaagtggagagggtctatatgaagggttggactggctctccaacaacatagccagcaagtcctgaaggcttccaatggattggcagggccgcagaagcaactagcggctggacaaatgactggaatatgtaggcatgttaaaatgctgccagagtgttgacatgtctttgtaagctcgatctttgagctgttatcacactgctactatgttgtatcaatgattgaatgtacacacgatgaaaccctttatgctatgtgaaaatgataccatgtcaggtgctcctggcctgagcctgatgagtgatgatgatgatcctgccctggttttgtgaaccgatatgtattctgcacgtgattaatct

SEQ ID NO: 13607 - DNA, 995 bp, Lupinus angustifolius
attttggtgtacccttttatagagaaaaattgatatttgatattgttcctttcaatctgaatctcctccaatcttcatttatctctctcctcttttcctttttccattaccataaaaaatggggttgtcttttgggaagcttttctctcgtctcttcgctaagaaagagatgcgtattctgatggttggtcttgatgctgctggtaaaaccacaatattgtataaactcaaattgggagagattgtcaccactattcctaccattggatttaatgtggaaactgtggagtataaaaacattagcttcactgtatgggatgttggtggtcaagataagattcgacctttgtggagacactacttccagaacacacaagggcttatttttgtggtggacagcaatgatcgagatcgtgttgttgaggccagagatgaattgcacagaatgctgaatgaggatgaattaagggaagctgttctgcttgtttttgcaaacaagcaagatcttcccaatgcaatgaatgctgctgagattactgataagcttggtctacactctctaagacaacgccactggtatatccaaagtacatgtgctacttcaggtgaagggttatacgaaggactagactggctttcaaataacatttctagcaaggtttcttatatttttttagtctgaagccaaggtttaaactttatagtctttcttattttcttactactgttttttatcatttgctttctctcttctttcagggttagagatatcatggaggtgctgattacttttccaaattgttcatgacaactgattttcggattataggcatcaattctgttgtaattctttttgcttctgttcttttatgatataacaattatcatttgtcctttgtaatcaggttttggttcaaataaatattatccatgtatgaaactactggactacaagtctgcttaaagtgttgtattccacattttgtatttccaca

SEQ ID NO: 13608 - DNA, 1223 bp, Brachypodium distachyon
gcctgctgctagcaagctgctgccctgcccctccccactcccctccgcaagctccggttttaatctaggctcctcggccgccggcttcatccccagctcagctccgctcccatccgccgccgccgtcgagcggggtagagatagagagagtcccagtcactgacaccctggcccaaaaaacgcatcctctttcgtctcgcttacaagctggccccacgtgtcaggccgaaacgaatccaacctctcgcgtaggtagaacgcacgctctcctcttattcttcttcttcctcctcttcctcttcaccaaagcccaaaggcaaaccacgcctagcatccactcgcttcgcttgtgctttggcgattccattcgggaaggagaggtccaagaggaggcagggtccagagaggggttggagagcgatggggctgtcgttcgggacgctgttcggggcgctgttcgcgaagaaggagatgcggatcctgatggtggggctcgacgccgccgggaagaccaccatcctctacaagctcaagctcggcgagatcgtcaccaccatcccaaccatcgggttcaacgtggagacagtagagtataagaacatcagcttcacagtttgggatgtcgggggccaggacaagatcaggcccctgtggaggcactacttccagaacactcagggccttatctttgttgttgacagcaatgatagagaacgtattactgaggccagagatgagcttcacagaatgctgaatgaggatgaactgcgcaatgctgtattgcttgtttttgctaacaagcaagatcttcccaatgccatgaacgctgctgaaattactgataagctcggtctccactctctgcgtcagcgacactggtatattcaaagcgcttgtgctacaagtggggaaggcctgtatgaagggctggactggctctccaacaatatagccagcaagtcatgaatacttccactgggctggctggcagaaagaagcaaactagcgaactggacaaaaatggccggagtatatatatgcatgttaaaatgctgtcaagccttaggcttgtgtttggtttggaaactcaagtctttgagctgttatcgtatcacactgttgtccacccacggacgaatgttgttgtgtacttgtatggatggtttgaattgaatgtgtaccaaaggaaaacaaactgttatgctttagtgaaatgatgccat

SEQ ID NO: 13609 - DNA, 1548 bp, Conyza canadensis
ttcaccaagttgtttagccgattatttgctaagaaagagatgcggattttaatggtaggtctcgatgctgccggtaagactactatattatacaagttaaagcttggggaaatcgtgacgacaattcctaccattggattcaacgttgagactgttgagtataagaacatcagcttcactgtttgggatgttggtggtcaagacaagattcgtccattgtggagattctacttccaaaacacacagggtcttatttttgtggtggatagcaatgacagggatcgagttgttgaggcaagggatgagttgcacaggctgttgaatgaggatgaacttagggatgctgttctactcgtgtttgctaacaagcaagatttgccaaatgcaatgaatgctgcagaaattactgacaagcttggtcttcattcacttcgtcaacgccactggtacattcagagcacatgtgcgacatctggtgaggggctttatgaagggctggattggctctttaacaacattgctaacaaggcaagttaatatgacaactaaggttgcttatagtttaatatagggattatggcatcggaatgtaaccaactatgactcaatgattatgtaatgtagtgacctttcaaactggctatctgatgtaagtaccctccatttttgttcttttaatgtatcttaccgggtaacatcctatttgtaaccggtaatgccacgtttgacgtaaaaaagaatagagattaaagcaccggagtgtaaccaactatgagtgaatggttatgtaatgcagtaacttacgaaagtgttaaaattgatgtaagaacctctctgttttgtttactcgatgtatcctaccgggttactccgacgactttatactctggtcatcttctccggctaatttttgacactatcttcggtaacaacattttttcctgagagcaaatgtgaaactgtgactcaatgtctaacttcaatcccgaacacaaatcaacactagatatagatagatgcatatatacatttattgatttcagaacacgattcaataataatcatactcaaaccttaatccctaaatcggattgtgttatgatcaccccatcatcgttaactataaagatccggtaatcccatacccacgacaatcaagatccagcaacttttgtttacaacggggtaaaagggggagattttgacagagaatgacgacggtggttgtctgggtggcggctgacaattatttattttattggtggcaatcagcggtgacacttgttcggatgtggagacagtggagagatggacacacctcttaaatggaagtaaaaatgagaccgagaccacccactacaaccacgtcagagtctaagaccatccactatccatttcgtcggagttcataacccacaaccgtaaccatgaccgtacaacaggtcaaccggtatatgaaaagtacaaaaatgagaggttcttacatcagatagccttttttaaagataactacataacataaccattcagtcatagttggttacactc

SEQ ID NO: 13610 - DNA, 609 bp, Flaveria ramosissima
atattccacaagccccttttcctctttctctcattttcctcgatcgatccctctccaaaaagtctttttgcagggatcctcgcttgaaataaaatggggctaacattcaccaagctctttagcaggctctttgccaagaaagagatgcgaatcttgatggtgggtcttgatgcagctggtaagacaaccattttgtacaagctcaagcttggtgagatcgtgacaacaattcctacgattgggtttaatgtggagaccgttgagtacaaaaacatcagcttcactgtctgggatgttgggggtcaggacaagattcgtccattgtggaggcactacttccagaacacacaaggtcttatctttgtggttgatagcaatgacagggatagagttgttgaggcaagagacgagttgcataggatgttgaacgaggacgagcttcgagatgcagtcttgcttgtatttgctaacaaacaagatcttccaaatgcaatgaatgctgctgaaatcactgataagcttggcctccattccctccgacaacgccactggtacatccagagcacttgtgcaacctcaggagagggactttacgagggtctggattgg

SEQ ID NO: 13611 - DNA, 857 bp, Avena sativa
gtgattcgattcgaggggaggagaggagaggaagcgcagaggcggcggaggcggaggagaaagccgaggagggagatcgatggggctctcgttctcgtcgctcttcggggcgctgttcgcgaagaaggagatgcggatcctgatggtcgggctcgacgccgccggaaagaccaccatcctgtacaagcttaagctcggcgagatcgtcaccaccatccccaccatcgggttcaacgtggagacagtagagtataagaatatcagtttcactgtttgggatgtcggtggccaggacaagataaggcctttgtggaggcactacttccagaacactcagggccttatctttgttgttgacagcaacgacagagatcgtattgctgaggcgagagatgagctccacagaatgctgaatgaggatgagctgcgcaatgctgtgttgcttgttttcgctaacaagcaagatcttcccaatgccatgaatgctgctgaaataacagacaagcttggtctccactctctgcgtcagcgacactggtacattcagagtgcttgtgctacaagtggggagggtctgtatgaagggctggactggctctccagcaatatagccaccaagtcatgaatgcttccaatgggctggccgaagcaacaagcggctggacaaatgactgtaatatataggcatgttaaaatgatgtctgagttttgacatgtcttttaagactcgaatccttgagctgttatcacactgttactcatggtcggattaatgttgtatgggtggttgaatgtactatacaaaacgaaaactgttatgccataatgtaaacttttatcccaggtgctcctgagtc

SEQ ID NO: 13612 - DNA, 1046 bp, Avena sativa
gaagcacgctctcttctcctccaaaggcaaccacacctggctgctccgtctcctctagcctctactcgcctgttctttggcctttgggtgattcgattcgaggggaggagaggagaggaagcgcagaggcggcggaggcggaggagaaagccgaggagggagatcgatggggctctcgttctcgtcgctcttcgggacgctgttcgcgaagaaggagatgcggatcctgatggtcgggctcgacgccgccggaaagaccaccatcctgtacaagcttaagctcggcgagatcgtcaccaccatccccaccatcgggttcaatgtggagacagtagagtataagaatatcagcttcaccgtttgggatgtcggtggccaggacaagataaggcctttgtggaggcactacttccagaacactcagggccttatctttgttgttgacagcaacgacagagatcgtattgctgaggcgagagatgagctccacagaatgctgaatgaggatgagctgcgcaatgctgtgttgcttgttttcgctaacaagcaagatcttcccaatgccatgaatgctgctgaaataacagacaagcttggtctccattctctgcgtcagcgacactggtacattcagagtgcttgtgctacaagtggggagggtctgtatgaagggctggactggctctccagcaatatagccaccaagtcatgaatgcttccaatgggctggctgaagcagcaagcggctgaacaaatgactgtaatatataggcatgttaaaatgatgtccgagttttgacatgtctttgaagactcaaatccttgagctgttatcacactgttactcacggtcggattaatgttgtatgggtggttgaatgtactatacaaaacgaaaactgttatgctataatgtaaacttttatgccaggtgctcctgagtctgatgatcacctcgccctcggtctgtgtagtgtgtacccagatgtattgtgtcgcacgattaatctgattcttgagaataattgatccatgtgttatcagag

SEQ ID NO: 13613 - DNA, 899 bp, Avena sativa
ggagatcgatggggctctcgttctcgtcgctgttcggggcgctgttcgcgaagaaggagatgcggatcctgatggtcgggctcgacgccgccggaaagaccaccatcctgtacaagcttaagctcggcgagatcgtcaccaccatccccaccatcgggttcaatgtggagacagtagagtataagaatatcagcttcaccgtttgggatgtcggtggccaggacaagataaggcctttgtggaggcactacttccagaacactcagggccttatctttgttgttgacagcaacgacagagatcgtattgctgaggcgagagatgagctccacagaatgctgaatgaggatgagctgcggaatgctgtgttgctggtttttgctaacaagcaagatcttcccaatgccatgaatgctgctgaaataacagacaagcttggtctccactctctgcgtcagcgacactggtacattcagagtgcttgtgctacaagtggggagggtctgtatgaagggctggactggctctccagcaatatagccaccaagtcatgaatgcttccaatgggctggctgaagcagcaagcggctgaacaaatgagtgtaatatataggcatgttaaaatgatgtccgagttttgacatgtcttagactcaaatccttgagctgttatcacactgttactcacggtcggattaatgttgtatgggtggttgaatgtactactatacaaaacgaaaactgttatgctataatgtaaacttttatgccaggtgctcctgagtctgatgatcacctcaccctcggtctgtgtagtgtgtacccagatgtattgtgcgcacgattaatctgattcttgagaataattgattcatgagtcgtgggaggcaaggcacaca

SEQ ID NO: 13614 - DNA, 1225 bp, Ostreococcus lucimarinus
atgggcatcacgttcgccaaactcttccagcgcctgttctccaagaaggagatgcggattctgatggttggtctcgatgccgcgggtaagacgacgattctttacaagctcaagctcggggagatcgtcacgacgattccgaccattgggtttaacgtcgaaaccgtcgagtataaaaacatttcgttcacggtttgggacgtcggtggacaagataagattcgcccgttgtggagacattacttccagaacacgcagggtttgattttcgtcgtcgacagtaacgatcgcgatcgtgtctccgaggcgcgcgacgagttgcaccgcatgttgaacgaagacgaactccgagacgcggtgttgttggtgttcgccaacaagcaagatttgccgaacgcgatgagcgcggcggaaatcacggacaagcttggcttgcactctttgcgtcagcgtcactggttcattcaatccacgtgcgccacctctggtgaaggtctctacgaaggtctcgactggctatcctcgaacatttcgcagcgtgcgtaagcggcgggcgcgacgaggcttggatgttcggcgagtgagacgatttaaacaaaatagagtggtagagcggcggtgagtgccgtcgagcgtgcgcgcgtataggcgaagtaacagttaaacgaagacctgggaaaggaacgtgtagtgacaacgaagagaaacaggagcgcgcgagcgcggcgttgtgatgaaaattcaaaccagatgatgcaattcctttctaatgttaaacgtgctacgtctcgtctacttggattgtatcgtgactacttcagcgcgctcgcggcgtccacgagatcgctcacttccaaacgcgccgatcctttgcccatggtgctgctcaggtacgcctttcgcacgtacttgctcgcgttcggcgcacctttccctttaggtctcagcgccaagagctcacgaaacacggtggcaacgttttccaccaaatgttcctcctcgaagttcacttttccaaccatgacgtgcacgatggcgtttttctccgctctaaactccacgcgcccgccgaggtgttcgcgcaccgcctcggcgacgtccgtcgtcaccgtccccaatttcggattcggcatcaaccctcgcgggcctaagatccgcgcgatctccttcaacttcgacatcatccccggcgtcgcgatcgccttatcgaactgaatcgtccccg

SEQ ID NO: 13615 - DNA, 561 bp, Prunus mume
gtttagaacaaaatggggctgtctttcaccaaactgttcagccgactgtttgctaagaaagagatgcgtattcttatggtgggtctcgatgcttcgggtaaaaccaccattttgtacaagctgaagttaggcgaaattgtgaccaccatccctaccattggatttaatgtggagactctggaatataagaacattagcttcactgtctgggatgttgggggtcaagacaagattcgacctctatggagacactacttccagaacacacaagggctgatcttcgtgatcgacagcaatgatcgagatcgtgttgttgaagccagagatgagatgcacaggatgttgaacgaggacgaattgagggaagctgtgcttcttgtgtttgcaaacaagcaagatcttcccaatgcaatgaatgctgctgagatcacagataagctcagccttcattctcttcggcaacgccattggtacatccagagtacatgcgccacttctggagaaggtttgtacgagggattggactggctttcaaacaacataactagcaaggcatgttaa

SEQ ID NO: 13616 - DNA, 606 bp, Triphysaria pusilla
cgtatctcattccttcttgtgctggttgaagagatcttgagctcacagatctctacacctctcatcctcctcgatttgaaagatggggttgtctttcaccaagcttttcagccggctgtttgccaagagagagatgcgtatactaatggttggtctcgatgctgctggtaaaaccaccattctctacaagctcaagctcggcgaaattgtcaccacaatccctactattggattcaatgtggagactgtggaatataaaaatattagcttcactgtttgggatgttgggggccaagacaagatccgtccattatggaggcattatttccagaacacccagggcctaatctttgttgttgacagcaatgatcgagaccgtgttgttgaagcaagggatgaactgcatagaatgttgaatgaggacgaattgcgagaagctgttctcttggtgtttgccaacaagcaagatctcccaaatgcgatgaatgctgctgaaataaccgacaaactgggccttcattctctccgccaacgccattggtacattcagagcacatgtgcaacttctggtgaggggctgtacgagggtctagactggctttcaaa

SEQ ID NO: 13617 - DNA, 714 bp, Triphysaria pusilla
aaaatggggggttctttcacaaagcttttcagccgactgtttgcgaagaaggagatgcgaattcttatggtaggccttgatgctgctggtaagaccaccatattgtacaaactcaagttgggagaaatagtgacaaccattcctacaattggattcaatgtggagacagtggaatataagaacataagcttcactgtttgggatgttgggggtcaagataagatccgaccgctgtggaggcattactttcagaacactcaagggctgatttttgtggttgatagtaatgatcgagaccgtgttgtagaggctagggatgggctgcataggatgttaaatgaggatgaactgaggggtatgctcctagtctttgcaaacaaacaggatttgcccaatgctatgaatgctgctgagataactgacaagcttggacttcactctctccgtcaacgtcattggtatatccagagtacatgtgccacttctggtgaagggctatacgaggggctcgattggctctccaacaacatttctaacaagggttgatgagagatgtttgatgagttttggttatctgtattttcggcatttgttcaatccgatcatctgctttgttcacttcttttatgttttagatagtcgaatcgtaatgtcttttgatattcatatttttgcaaacaattatttcagtaatgtgcctcattttggctttct

SEQ ID NO: 13618 - DNA, 576 bp, Guizotia abyssinica
tctcagggatcctcactagctagaggatggggctaactttcaccaaactctttagccggctctttgccaagaaagagatgcgtattttgatggtgggtctcgatgcagctggtaagacaaccattttgtacaagctcaagcttggcgagattgtgaccacaatccctaccataggttttaacgtggagactgttgagtacaaaaacataagcttcactgtctgggatgttgggggtcaggacaagattcgtccactatggaggcactacttccagaacacacagggccttatctttgtggttgatagtaatgacagggacagagttgttgaggcaagagatgagttgcacaggatgttgaatgaggatgagttaagagatgcagttctccttgtgtttgctaacaaacaagatctcccgaatgcaatgaatgctgctgaaatcactgataagctcggtctccactccctccgacagcgccactggtacatccagagcacttgtgcaacctctggagagggactttacgagggactggactggctttccaacacattgcaaacaaggcatgaggcaa

SEQ ID NO: 13619 - DNA, 696 bp, Primula obconica
ttttcagtcggctttttgccaagaaggagatgcgtatccttatggtaggtctcgatgccgctggtaagaccaccatcctgtacaagctcaagctcggtgagattgtgaccacaatccctaccattgggtttaacgtggaaactgtcgagtacaaaaacatcagctttaccgtgtgggatgttgggggtcaagacaagattcgtccattgtggaggcattatttccagaacacccagggtctcattttcgtggtggatagcaatgacagagaccgtgttgttgaggcgagagatgagttgcaccgcatgttgaatgaggatgagttgcgggatgcagtattacttgtctttgccaacaaacaagatcttcctaatgcaatgaacgctgctgaaataactgacaaacttggtctgaactctctccgacagcgccactggtatatccagagcacttgtgcaacctccggtgagggcctgtatgaggggttggattggctctccaacaacattgcaaataaggcttgagtatgggggcttgatacttggatgcaggatggtctttttatctagtctaatttttttttacttcctttttttcttgtgagacaatatattgtcatcgacttcaattttaagtgtttatgttgattaaggattttgcaatgtctattgatctttatcagaaaggtttgttgaa

SEQ ID NO: 13620 - DNA, 755 bp, Secale cereale
gatcaggaggagcacgcccggacgcgccgagacctcgaagccttcgtctcaaccccggacggagagatggggcgtcacgttcaccaagctgttcagcgcctcttcgcgaagaaggagatgaggattctcatggttggtctcgatgccgctggtaagaccaccatcctctacaagctcaagctcggagagatcgtcactaccatcccaaccatcggatttaacgttgaaaccgtcgaatacaagaacatcagcttcactgtttgggatgtggggggccaagacaagatcaggcccctgtggaggcactacttccagaatacgcaggggctcatttttgttgttgacagcaatgatagggagcgtgttgttgaggctagagacgagcttcacaggatgctgaatgaggatgagctgcgtgatgctgtgttgcttgtatttgcaaacaaacaagatcttcctaatgccatgaatgctgctgaaatcaccgacaagcttggtctgcactcccttcgccagcggcactggtacattcagagcacttgcgcgacatctggagaagggttgtacgagggacttgactggctctccaacaacattgccaacaaggcttgaagcgtctcgacaagtgcttcatcaagaaacaaacgtgctggatgtctcaacaactcactgctaccatttttacatattgtgatatatatatacactgtacaagagatagtatgtgtgcgtatgtgacagacagaagctctctt

SEQ ID NO: 13621 - DNA, 1104 bp, Arabidopsis thaliana
tctgtatcatcgtttctcaaaatctctggtatattgattttctcggtctttgatctccatctttcttaagagtatcaagtgattgatcgattgatttatctggtttatacgttcttcttctttttgttcatggtctaaaggtgctagctaaaggaaaaaaatggggcttaatttcacaaagttgttcagccggctttttgccaagaaagaaatgaggattctgatggtaggtcttgatgctgctggtaagaccactatcttgtataagctgaagcttggcgaaatcgtcactaccatcccgaccatcggattcaacgtggagactgttgaatacaagaacatcagcttcactgtttgggatgtggggggtcaggacaagattcgtcccttgtggaggcactatttccaaaacactcaaggtcttatattcgtggttgatagcaacgacagggaccgagttgtggaagcgagggatgagttacatcgcatgttgaatgaggatgaactgagggatgctgtccttcttgtgtttgcaaacaaacaagatcttcccaacgcaatgaatgctgcagaaataactgataagcttggtcttcactctcttcgccaacgccattggtacattcaaagcacttgtgccacatctggagaaggtctctatgaaggccttgattggctctccaacaacatcgctaccaaggtaaataacttaaatatcccattttaaaactaagtagaaatttgaaaggaacactcttttgaaagtattgatgcacttaaataacatccttaggggttttagattatatctatatatacagttttggagacatttagaggaaaaaatcattattcatgaatactgatcaaaccttcattttgattgagtactgagtaggcatgatgaagctgaacactttttgtccttggagaccattagtgattgtggagaagaaagaagtattatgtctgattttacaacggtttatagcatccatccgttgatgcttgtgtcattgtgtgttaaaacgtcaaaaatggatttgtgatagtttttacttttacctttttgtttgtttcttctaaacttatggaaatgttctt

SEQ ID NO: 13622 - DNA, 728 bp, Nicotiana benthamiana
gcctctgctctttttattattcttacccctctaactattcggcgttaatctcaggcttccatttctctcattctctctctacattttctccttctctcttcattagatccctctttcaaaagcttctttcagggatcatcaacaagaaggggaaatggggctaacattcaccaagcttttcagccggcttttcgccaagaaggaaatgcgaattctcatggttggacttgacgcagctggtaagactaccatattgtacaagctcaagctgggggagatcgtcactactattcctacgattggtttcaatgtggaaactgttgagtacaagaatatcagcttcactgtttgggatgttgggggtcaggacaagattcgtccattgtggaggcactatttccagaacactcagggtctcattttcgtggttgatagcaatgacagagaccgtgttgttgaggcaagagatgagttgcacaggatgttgaatgaggatgagcttcgggatgctgtgctgcttgtttttgctaacaaacaagatcttcctaatgcaatgaacgctgctgaaataactgataagcttggactgcattccctcaggcagcgtcactggtacattcagagcacttgtgcaacatctggagaggggctctacgagggtcttgattggctttctaacaacattgccaacaaggtacgtgtacgctttctaattgaataaatttgtc

SEQ ID NO: 13623 - DNA, 605 bp, Citrullus lanatus
tgctgtgattgttgcgcagatagaaggaagcggaaatggggttgacctttacgaagctcttcggtaggcttttctctaagaaagagatgcgcattttgatggttggtctcgatgctgctggtaagaccacgatcttgtacaagctgaagctcggagaaattgtgaccaccattcccactatcggatttaatgtggaaactgtagaatacaagaacatcagctttaccgtttgggatgttggtggtcaggacaagatccgtccactttggaggcattacttccagaatacacagggccttatttttgttgtggatagcaacgatagggaccgagtcgtagaggcaagagatgagttgcacaggatgttgaatgaggatgaacttagagatgctgttctgcttgtatttgctaacaagcaagatcttcccaatgccatgaatgctgcagaaataactgacaaacttggtcttcactcccttcgccaacgccactggtacatccagagcacctgcgcaacatctggagagggcctgtacgaaggtttggattggctttctaacaacatcgttagcaaggtaaatgctccttccatttgatcccaatct

SEQ ID NO: 13624 - DNA, 995 bp, Marchantia polymorpha
gaggtgtcgggcccagacagaccagaaaggatcgctttgctgtagtttggaaaagtggagttgttcaggaagctcaagaagctcggagccaaaatggggctcactttcaccaagctgttccagcggttttttgccaagaaggagatgcgaattttgatggtgggtctggatgcggccggaaagacgacgattttgtacaagctgaagctgggagagatcgtgaccaccattccgacgatcggcttcaacgtggagacggtggagtacaagaacatcagcttcacggtctgggatgtgggaggtcaggacaagatccggcctctgtggaagcactacttccagaacactcagggcttgattttcgtggtggacagcaacgacagagatcgtgttaccgaagcccgtgacgagctgcacagaatggtgaatgaagatgagcttcgtgatgcagtgctgctggtttttgccaacaagcaggatctgcccaatgctatgaacgctgccgaggtcaccgacaagctgggcctgcactcgctgcgccagcgccattggtacattcagagcacctgtgccacctccggcgagggcatgtacgaaggcctcgactggctgtccagcaacattgccaacagctgattctgttcgctgcaacgaccttcatgcctgccccttcacgaggtcgcccaggccatcatcgtctgccagtagtggccggggttttttcaatatggacctggatctgaagcatcgttcagcagcagcagcagcagctccgagacagtcagattgtcgtatctagtgctgcccaatgtctgcagatttgtgtgtctatggtgtggagacttcctgcagtggatagtctgacggctatgagcagtgacaaacgactcgcttgtacactgtggcgagtttctctttcattagatctcctcgatcgatggatgcgctgaaaaggcttctatccatgtcctgtcctcgtttgctcgacgatcgaa

SEQ ID NO: 13625 - DNA, 728 bp, Nicotiana benthamiana
ttattaatgctagtttcaaaaaagaatctctctatttctcttcttggtaaaaagctgctcttcaacacattgtagggacttcgcatattgctaaatgcctaaatctgccctctcttcttccaaatcagctactagctctttttcccacgcagttttaaagatggggttgtctttcactaagcttttcagtcggctatttgccaagaaggaaatgcgaattctcatggtaggtcttgatgcagctggtaagacaaccatattgtacaagctcaaactgggagagattgttaccactattcctaccattggatttaacgtggagactgtggagtacaagaacattagtttcactgtctgggatgttggtggccaggacaagattcgaccactgtggagacattactttcaaaacacgcaaggactcatctttgttgttgacagtaatgatcgggaccgtgttgttgaggctagagacgagctgcacaggatgttgaatgaggatgaactgcgggacgctgtgctgcttctgtttgccaacaagcaagatcttccaaatgctatgaatgctgctgagattactgataagcttggtcttcactccctccgtcaacgtcactggtacattcagagtacatgtgccacctctggggaaggactttacgagggacttgactggctctccaacaacattgcgagcaaggtacgtagagattatcacacaggaattc

SEQ ID NO: 13626 - DNA, 586 bp, Cajanus cajan
ataatggggttgtcttttggcaaggttttctctcgcctctttgctaagaaagagatgcgaattcttatggttggtcttgatgccgctggtaaaaccacaatattgtataaactcaagttaggggagattgttaccaccattccaactattggatttaacgtggaaactgtggagtataagaacattagcttcactgtgtgggatgttggtggtcaggataagattcgaccattgtggagacactacttccaaaacacacaagggcttatttttgtggtggacagcaatgatcgtgatcgagttgttgaggctagagatgagttgcacaggatgctgaatgaggatgaattaagagatgctgtattgcttgtttttgcaaacaaacaagatcttcctaatgcaatgaatgctgctgaaataactgataggcttggtctaaactctctgcgacagcgccactggtatatccaaagtacatgtgctacttctggtgaaggtttatacgagggactagactggctttcaaataacatttcaagcaacaaggtttcccttaaaaaataaaattgttttggtctacaacaag

SEQ ID NO: 13627 - DNA, 964 bp, Glycine max
accgttttttagaaagagtgtgttgtttttttcttttcctgaatctacatctcggtggacttctctctcttctcgttctaatcatgtgagtttgtctcttttttgaaatatgaattcaattcctttcatatatttctcgtttattgtttgtaatgtattcaatttgaatttgtgtataagatttcatcgtattgatcaaagcatggtcccattgtgaaataaatttctttatatgttaacgatttccggttgtgactcgattgaattttcttataatggggttgtcctttggcaagcttttctcaaaactctgcgctaagaaagagatgcgaattctcatggttggtcttgatgctgctggtaaaaccacaatattgtataaactcaagttaggggagattgtcaccaccattcctactattggatttaacgtggagactgtggagtataagaacattagcttcactgtgtgggatgttggtggtcaggataagattcgaccattgtggagacactatttccaaaacacacaagggcttatttttgtggttgacagcaatgatcgcgaccgtgttggcgaggctaaagacgagttacacaggatgctgaatgaggacgaactaagagatgctgtgttgcttgtttttgcaaacaagcaagatcttcccaatgcaatgaatgctgctgaaataactgatagacttggcctaaactctctgcgccagcgccactggtatattcaaagtacgtgtgctacttctggtgaaggtctatacgagggactagactggctttcaaataacatttcaggcaaggcttccttcaaatgatagaattgtgttcgtctacatcaagatttgttggcgtcagtgctgttgtagttttatgatcttttattacccttggtgtgttgtcttgttcttcttcctgtctaatctgatttcaattcaaataaatactattg

SEQ ID NO: 13628 - DNA, 1004 bp, Echinochloa colona
ccgactcttcgccaagaaggagatgaggatcctcatggttggtctcgacgcggctggtaagaccaccatcctctacaagctcaagctcggcgagatcgtcaccaccatccccaccatcggatttaatgttgaaactgttgagtacaagaacatcagcttcactgtttgggatgttggtggtcaggacaagatccggcccctgtggaggcactacttccagaacacccagggcctcatttttgttgtggacagcaacgacagagagcgtgttgttgaggctagagatgagctccatcggatgctcaacgaggatgagctccgtgatgctgtgcttctggtgtttgcaaacaaacaagatctccccaatgccatgaatgcagctgaaatcactgacaagcttggccttcactccctgcgccagcggcactggtacatccagagcacatgtgcgacctcaggtgagggtttgtatgaggggcttgactggctttccaacaacattgcaaacaaggcttgaggcatcttggcagggctccgatcaatgcaaatactttggatatcggagcgcatactgcctttatcatactgctatgaactatatagtcgtgacaatgacagataatgtggggtgttttggggagtataaggctccttccttggtcaaggaggtagctatcagatgtttccgtgggtattgttaattgtccgtgcttctgttttggtttgtgcaaggtatatgctatgcccgtctttgatctgtgtactcgtcagtctgaggcgttgaggcgttgtagtatggatctgcctcttggcattgctagcttaatggttgcgtaattgtcgtgtgcagcatatctttcctctcgcgtttgctgtgaagttttttaggtttgttgtcgtagtaccatgatgagcgcgtgttagtttgtttgtgtattccttctggaacctctggccgacttgctcactatactgggcgcacgctgaattctctttatataacg

SEQ ID NO: 13629 - DNA, 649 bp, Brassica juncea
tggatgggattataagtagagattatttttcgttgtccgttaaaaaataaaatcaaatcgtgaaacgttctcgcaggccatttgcttagacgaaccatcggcatcagagagaggttagatctcgcgcggcgttgtttcttcgatggggctgtcatttgggaagctgttcagcaagctgtttgcgaagaaagagatgaggattctgatggtgggtctcgacgctgctggtaagaccaccatcctctacaagctcaagcttggtgagatcgtcacaaccattcccaccattggtttcaatgttgagactgttgaatacaagaacattagcttcaccgtctgggatgtcgggggtcaggacaagatccgtccattgtggaggcactacttccagaacacgcaggggcttatctttgttgtggacagcaacgatcgtgaccgtgttgttgaagccagggacgagcttcacaggatgctcaacgaggatgaactgagggatgcagttctgcttgtttttgctaacaagcaagatctacccaacgcaatgaatgctgctgagattactgacaagcttggccttcactctctccgccaacgtcactggtacattcagagcacatgtgccacctctggagaaggactctacgaagga

SEQ ID NO: 13630 - DNA, 601 bp, Brassica juncea
cgggggtttcgatcgtcctcgcgcatttagcgtttctcttaagcttctctctctctctcggttaacgttcttctttagagtaaaagagcacaagatggggttgagtttcgccaagctatttagcaggctgtttgcaaagaaggagatgcgtattctgatggttggtcttgatgctgctggtaagaccactattctctacaagctcaagctcggtgagattgtcaccaccatccccactattggtttcaatgtggaaactgtggagtacaaaaacatcagtttcacagtgtgggatgttgggggtcaagacaagatccgtcccttgtggaggcactacttccagaatactcagggtctgatctttgtcgtggacagcaacgacagagaccgtgttgttgaggctcgagatgaactgcacaggatgctcaatgaggacgagctgcgtgatgctgtgctgcttgtgtttgccaacaagcaagatcttccaaatgcgatgaatgcagctgaaatcacagataagcttggccttcactccctccgtcagcgtcactggtacattcagagcacatgcgccacttcaggtgagggactttacgaaggt

SEQ ID NO: 13631 - DNA, 1042 bp, Mesostigma viride
ttcggcacgagggggagctgaagagacaggttgccatagattgccgcagggcgccgactgtctgctgtcggggaaatcatctgctagctcattctaggtttggcggagtccccgccgtgtggtagcctcgactagtgaccatggggctcaccttctcaaagctgttccagaagctcttctccaagaaggagatgcgtattttgatggtcggattggatgcggctggtaaaactaccatcttgtataagctgaagcttggagagatcgtcaccaccattccaaccattggcttcaacgtggaaactgtcgagtacaagaacatcagcttcacagtgtgggatgtcggtggtcaggacaagatccgacctctctggaggcactacttccagaacacgcaaggtttgattttcgtggtggatagcaacgatcgtgaccgtatcggcgaggccagggacgagttgcaccggatgctgaacgaggacgagctccgggatgccttgctgctggtgttcgccaacaagcaggatctgcccaacgccatgaacgctgctgagattactgacaagctggggctgcacgccctgcgccagaggcattggttcatccaaagcacttgcgctacttccggagagggtctgtatgaaggactggattggctatccaccaacattagtaacaagcaataattggccagacgctcaatccacgtgctggagcggttgccttaaccttcgttggaatatcgaagaggtgcctaaggattcttcggcccggctttgttcggaaacacggagagctgcctagggggtctctgaacccacttttttccccgctgcaacagcccatgcaccttcattgaccgttggtgacggtgcttctgtcgccatgatcgccatagttgttccaatgttgcaggaataaataacgtagcgcctgcgatgatttgatcttgatgcttgtgaaatatttttcctgggttggtaggtgaatgaagaaagtccaatccataccacatgattaatacataatccttcagttttat

SEQ ID NO: 13632 - DNA, 750 bp, Leymus cinereus x Leymus triticoides
cctctttgcgaagaaggagatgaggattctcatggttggtctcgatgccgccggtaagaccaccatcctctacaagctcaagctcggagagatcgtcaccaccatcccaaccatcggatttaacgtcgaaactgtggaatacaagaacatcagcttcactgtttgggatgtggggggtcaagacaagatcaggcccctgtggaggcactacttccagaatacgcaagggctcatttttgttgtcgacagcaatgatagggagcgtgttgttgaggctagagacgagctccacaggatgctgaatgaggacgagctgcgtgatgctgtgttgcttgtatttgcaaacaaacaagatcttcctaatgccatgaatgcggctgaaatcaccgacaagcttggtctgcactccctgcgccagcggcactggtacattcagagcacttgtgctacgtctggcgaagggttgtacgagggacttgactggctctccaacaacattgccaacaaggcttgaagcgtctcgacaactgtttcaaggaacaaacttgctggatgtctcaacaactcactgctagtaccattttacatattgtgatatatatacactgtacaacagatagtgtatgtgtgcgtatgtgacggcagaagctctcttctttaagtgagctagtatcaggtcaggttttttttttgtatggatattatcagtatttctgtgcggtggttttacaaggtttattttgtcgtcca

SEQ ID NO: 13633 - DNA, 793 bp, Carthamus tinctorius
cggggggccccatattctaaaatcccccctcgctctctcgttcccttttcgatcgatccctctccaaaaggcttttagcagggatcctcaccagcaataatatggggctaacattcaccaaactctttagccggctctttgccaagaaagagatgcgcatactgatggtgggtctcgatgcagctggtaagacaaccattttgtacaagctcaagcttggtgagatcgtgacaacaatccctaccattgggtttaatgtggagactgtcgagtacaaaaacatcagcttcactgtgtgggatgttggtggtcaagacaagattcgtccactatggaggcactacttccagaacacacagggtcttatctttgtggttgatagcaatgacagggatagagtcgttgaggcaagagatgagttgcataggatgttgaacgaggatgagcttcgtgatgccgtcttgcttgtatttgctaacaaacaagatcttccaaatgcaatgaacgctgctgaaatcactgataagctcggcctccattccctccgacagcgccactggtacatccagagcacctgtgcgacatctggagagggactttatgagggtttggattggcttctaacaacatcgctaccaaggcataagatggtaccggactgagtcttggatcaacttctcctgtgtggggatttgttggtaaaagacagagggcttttgtgcttctgctctcgtagtgatgttttgatataatatttggctgtattgcaagtactttttaaaacctaaagctg

SEQ ID NO: 13634 - DNA, 1118 bp, Secale cereale
cggttagtctaacgacgagatacgctagggcgtccctcctcctctcctccattctctcctcctcctcctgccaccgatcccgaaccagggaggaacccggcgcgaggagggcaaaggaagagaagagaagaggagaccgccgagccgagcgcgcgaccgcacgcacaggacagcacgcgccgcgatcccgcgcaggagcggagatggggctcacgttcacgaagctgttcagccggctcttcgccaagaaggagatgaggatcctcatggtcggtcttgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgtttgcaaacaagcaagatcttcctaatgccatgaacgctgctgaaattactgacaagcttggcctgcattctctgcgccagcgacactggtacatccagagcacatgtgctacctctggagaggggttgtacgaggggcgttgactggctgtccaacaacattgccaacaaggcttgaagcatctcggcaggggcttctatggatctggataagctggatattcggactaatactgcctttacgtattataaactatatagtcttgacagataatgtgggtgttttggaaagataaagctctttgtcaaagagctagctatcagattgttttcgtgggtgttaaattgtccgtggcgctgtttgtttgcccatcatggttttactatgtccgctgtgtgtactctgtactcgccactccgacagacttgagacattgtagtattgacttgtcttgcatagtttgtcagcgtgagggtaccgtgtctcttctgaattgctatggcttgtgttgatttcatgtgcaaagtacattttccatcccgaaa

SEQ ID NO: 13635 - DNA, 689 bp, Brassica oleracea
tttctaacgagatcatcaagtgttggcaggctacaacctctgtgtttggataagttttaagactctttcaacgtctcctagtgggttgtgcggtaaagcaagatgggtttgggttttgccaagcttgttagcagtctctttgcaaagaaggagatgcgactactgatggttggtcttgatgctgctggtaagaccactattctttacaagctcaagctcggagagattgtcaccaccatccccactattggtttcaacgtggaaactgtggagtacaggaacatcagtttcacagtgtgggatgtcgggggtcaagacaagctccgtcccttgtggaagtactacttccagaacactcagggtctgatctttgtcgtggacagcaacgacagagacagagttgttgaggctagagatgaactgcacaggatgctcaatgaggacgagctgcgtgatgctgtgttgcttgtgtttgccaacaagcaagatcttccaaatgcgatgaatgcagctgaaatcacagacaagcttggccttcactccctgcgtcagcgtcactggtacatccagagcacaagcgccacttcaggtcaaggactgtacgaaggtctggaatggttatccaacaacatcggtggcaaggcgtaatgacgcaaaactgcattgcatcgagatgcaagagaagatta

SEQ ID NO: 13636 - DNA, 1166 bp, Chlamydomonas reinhardtii
gggggcacttggctctaggcctcctttctttagacaccagcaaagatgggtctgatggtttctaaggccctcagccggctctttggcaagaaggagatgcgcattctgatggtcggtctggacgccgctggtaagactaccatcctctacaagctgaagctgggcgaaatcgtgacgactattcccaccatcggcttcaacgtggagactgtggagtacaagaacattagcttcaccgtgtgggatgtcggtggccaggacaagatccgccctctgtggcggcactacttccagaacactcagggcctcattttcgtcgtggacagcaatgaccgcgatcgtattggggaggccaaggatgagctgcaccgcatgctcaacgaggacgagctgcgggacgccgtgctgctggtcttcgccaacaagcaggacctgcccaacgccatgaacgcggcggagatcacggagaagctgggcctgcacggcctgcgccagcgccactggtacatccagtccacgtgcgccaccagcggcgagggcctgtacgagggcctggactggctgagccaaaacatccagaacaagtcgtgagcgagcagagtggtacagtgagacagactagcgagatgtggctgatgagggcgtgggccatggctgcggccccaggtacaggagttctggtgggtggatgtgtcgggatgcgtggtgcgcgtcgtcatgcagtcgggtggtcatgcgcggatagccatcgcagcgcgggctcgcaatgccattagcctgctagtagatgtgcacatcgcgggcatgttagattgtttaggtcccttatgctgaaccattatttctccagaagaaggcatgcaataccctgtcgcttgcacggtgacgcttgacccctggcatgggtagtgcggtgttgtggagggctctgccatttcagggcccgcatgtaactttaaccgcatgtgacatattgactttcatcggaggcgcgctgtgtcctggggcgctccttgtggggtagacattgggcgggtgcgcttgtgggagcgccggcgcgcaggtttgcagtgatgcctggggtccacatcagccttccttgcagtctaccatgattgagatgctcgcaactgcaaggcaggttgacctgcagacgtcaatgtgac

SEQ ID NO: 13637 - DNA, 807 bp, Panax ginseng
ggaacgacaactccatttagagatctctgcattccaacgttcccatcgcccacctcatcctcaatatagagatggggctgtcttttaccaagcttttcagtcgcctatttgctaagagagaaatgcgcattctaatggttggtctcgatgccgctggtaaaaccacaattttgtacaagctcaagttgggtgaaattgtcaccactatccctacaattggctttaatgtggagactgttgaatacaagaacattagcttcactgtgtgggatgttggtggtcaggacaagatccgacctttgtggaggcactatttccaaaacacacaagggctcatctttgttgttgacagcaatgatcgagaccgtgtggttgaggctagagatgaactgcacaggatgttgaatgaggatgaactgagagatgctgtactccttgtgtttgcaaacaagcaagatcttccaaatgccatgaatgctgctgagattactgacaagcttggtttgcattctcttcgacaacgccattggtatattcagagcacatgcgccacatctggagaaggtctatacgaggtggctttcaaacaacattgctaacaaggcttaatgggctactctaccggctcacttggtactcaaagaaatacattggtgcagtcaatctggttacaagtgttgttgcaattactctttgtataattgcttttggtggtttggatttcagtttcttgtcgtggtgagagaggaaaaagatgatgtattatgactgtctgttaaatttccctttgaattatctgcttaataa

SEQ ID NO: 13638 - DNA, 758 bp, Nicotiana benthamiana
agttttatgccaattgtttgataaattcccaatttaatgctagctttaaaaaatcactctttttctcttcttcttaaaaagctgctcttcaacgcatcggagggactacccatattcctaaatctgccctctcttcttccaaattagctactagctttttttccctcgcagttttaaagatgggattgtctttcactaagcttttcagtcggctatttgccaagaaggaaatgcgaattctcatggtaggtcttgatgcagctggtaagacaaccatattatacaagctcaaactgggagagattgttaccactattcctaccattggatttaatgtggagactgtggagtacaagaacattagtttcactgtctgggatgttggtggtcaggacaagattcgaccattgtggagacattacttccaaaacacgcaaggactcatctttgttgttgacagtaatgatcgggaccgtgttgttgaggctagagatgagctgcacaggatgttgaatgaggatgaactgcgggacgctgtgctgcttctgtttgccaacaagcaagatcttccaaatgctatgaacgctgctgagattactgataagcttggtcttcactccctccgtcaacgtcactggtacattcagagtacatgtgccacctctggggaaggactttacgagggacttgactggctctccaacaacattgcgagcaaggtacgtgagattatcacacaggaattcattgatcatttc

SEQ ID NO: 13639 - DNA, 626 bp, Adiantum capillus-veneris
cttcgccaagaaggagaggcgctggaagagcttggtaaaggggaggagtgagcaatctgagaaggtgagatctaggagcgagcggcagcggcggcgacagcagcagcagccatgggtctcacctttaccaagctcttccagcgcctcttcgccaagaaggagatgcgcatcctcatggttggtctcgacgcggccggtaaaaccaccattctctacaagttgaagcttggcgagattgtcaccaccatccctacaatcggtttcaatgttgaaacggtggagtacaaaaacatcagttttactgtatgggatgtgggaggtcaggacaagatccgtccactatggaggcactacttccagaacacgcaaggtctgatctttgttgttgacagtaacgacagagaccgtgtggtggaagctcgggatgagctgcatagaatgctgaatgaggatgagctacgagatgcagtccttcttgtgtttgccaataagcaagaccttccaaatgcaatgaatgctgctgaaataacagataagctgggcttgcactcattacgtcaacgccactggtatattcaaagcacatgtgcgacatcaggtgaaggtttatatggagggtttggact

SEQ ID NO: 13640 - DNA, 849 bp, Cynara scolymus
ttaatctacgctccctctctgcatctacttgcgtctcctccgaatttcgtcggtgatcgacggctccccatttcaaccatctccgtcactctcctacaatcgccgaccgatcatatcacgatggggttgtcttttaccaagctttttagccgcttgtttgctaagaaagagatgcgcattttgatggttggtctcgatgcagctggtaaaacaacaattttgtacaagctcaagttgggagagattgtaaccacaattcccactattggctttaatgtggagactgttgagtacaagaacatcagctttactgtttgggatgttggtggtcaggacaagatccgacctttgtggaggcactacttccagaacacacaagggcttatctttgtggtcgatagcaatgaccgtgaccgtgtggtggaggctagagacgagctgcacaggatgcttaatgaggatgaactaagagatgcagtgttgcttgtgtttgccaacaaacaagatcttccaaatgctatgaatgccgctgagatcactgacaagcttggtctgcattctctccgccaacgccactggtacatccagagcccatgtgccacctctggagaaggtctatatgagggactggattggctttcaacaatatcgctaacaaggcataaacagggctgggcggtgtggtgaacttcgtcccttccccttagtccgtcaatgtggttgagttgaggttctttatatcttagtgtacaacccaaagacgtttaatccctcgaccgactctgttcttgaatgaatcccatatgatggatgggtcgtcttgtaatctaaattctgcaggcttgattc

SEQ ID NO: 13641 - DNA, 746 bp, Heritiera littoralis
gaattcgcgttggtttcaagctctcgtttctcaaaacattttctttcttccgtctgggttggttcaaattcaaaatctcttacagatccctctgcgattatttccaaagggatcgacagcaagggaaaagaaatggggctaacattcacgaagcttttcagccggctttttgccaagaaggagatgagaattttgatggtgggtcttgatgctgctggtaagactaccatcttgtacaagctcaagcttggggagattgtcaccactattcccaccattggatttaatgtggagacagtggaatataagaacatcagtttcactgtgtgggatgttggtggtcaggacaagattcgtcccttgtggaggcattacttccagaatacacagggtctcatcttcgtggttgacagcaatgacagagaccgtgttgttgaggctagggatgaattgcatagaatgttgaatgaggatgagctgcgagatgcagtgctgcttgtatttgcaaacaagcaggatcttccaaatgcaatgaatgctgctgaaataactgataagcttggcctccattcccttcgacagcgtcactggtacatccagagcacctgtgcaacctccggggaggggcttttatgagggtctggattggctttccaacaacattgctaacaaggcctgaagtcattaaggagatatttgcaatgggaaattctggatgcaggggtgaatattatctagtctttttc

SEQ ID NO: 13642 - DNA, 545 bp, Triphysaria pusilla
tttttcatcatcttcttctcaaatccctatcgcaatctcgaaaaaatgggtttgtctttcaccaagctttttagccggctgtttgccaagaaagaaatgcgaattcttatggtaggtctcgatgctgctggtaagacaacaatattatacaaactcaagcttggagagattgtgacaaccattcctacaattggatttaatgtggaaacagtggaatacaagaacattagtttcactgtctgggatgtcgggggtcaagacaagatccgaccattgtggaggcattactttcagaacactcaagggctgatatttgtggttgatagtaatgatcgtgatcgtgtagttgaggctagggatgagctccacaggatgttaaatgaggatgaactgagggatgcagtgcttcttgtttttgcaaacaaacaagatctgccaaatgccatgaatgctgctgagataaccgacaagcttggacttcactctctccgtcaacgccattggtatatccagagcacatgtgctacatctggggaagggctgta

SEQ ID NO: 13643 - DNA, 951 bp, Nicotiana tabacum
gaggcatccgctaaaagaagaacagaacatcctaagctttcgtattttattgtcatttctaatctaaagggcagagtcttttctagatctgcccccttctctcgctctctcctgattcgctgttcatcacttcattgagaaaagatgggtttatccttcgggaagcttttcagtcggctgtttgccaagaaggagatgcgtattctgatggtcggtcttgatgcagctggtaaaaccaccatattgtacaagctcaagctgggagagattgttaccactattcctaccattggtttcaatgtggagactgttgaatacaagaacataagcttcactgtctgggatgttggtggtcaggacaagatccgaccattgtggaggcattacttccaaaacacacaaggacttatctttgtggtcgatagtaatgatcgtgatcgtgttgttgaagctagagatgagctgcaccggatgttgaatgaggacgaactgagggatgctgtgctgcttgtgtttgctaacaagcaagatcttcctaatgctatgaatgctgctgaaattactgacaagcttggtcttcattctctccgtcaacgtcattggtacattcagagcacttgcgctacctctggagaagggttgtatgaggggcttgactggctctcaaacaacattgcaaacaaagggttgaacgcgagatccatgatttttgcagctatgtttttgtcaatatagacttcaacaatgtctagagcacttatgtacttactgatctttctttcgcgagatagatctgcgtatcctattgttatcagtacatttgcccttttcttttaaagaatggtactctgcagtaactttaggttaaattcatgtaatattttgcactttggctgacatatgcccagcgactttgccttcaatattttattttaattgagattaaggttc

SEQ ID NO: 13644 - DNA, 676 bp, Flaveria ramosissima
ggatcttcttcagaaacagaatggggttaacattcaccaaactctttagccggctctttgccaagaaagagatgcgtattttgatggtgggtctcgatgcagctggcaagacaaccattttgtacaagctcaagcttggtgagatcgtgacaacaatccctaccattggatttaatgtggagactgtcgagtacaaaaacatcagcttcaccgtgtgggatgttgggggtcaggacaagattcgtccactctggaggcactactttcaaaacacacaaggtcttatctttgtggttgatagcaatgatagggatagagttgttgaggcaagagatgagttacataggatgttgaacgaggacgagcttcgagatgcagtcttgcttgtatttgctaacaaacaagatcttccaaatgcaatgaatgctgctgaaatcactgataagcttggcctccattccctccgacaacgccactggtacatccagagcacttgtgcaacctcgggagagggacgtttatgaggggtctggattggctctccaataacatcgcgaacaaggcgtaagatgataccgaatgtggatcttggatgctttttaagtgatgacattgtttttgtgttcgtgggatttgtttgttaaacaggattttgttggtagcaaatgtgtctact

SEQ ID NO: 13645 - DNA, 828 bp, Gnetum gnemon
ttttaaaagatgggtctttctttcaccaagctcttccagcgaatgtttgctaagaaagagatgaggattcttatggtgggccttgatgcagctggaaagactacaatattgtacaaattgaagcttggagaaatcgtcacgaccattccaacaattggtttcaatgtggaaacagttgaatataaaaatataagttttacggtttgggatgttggaggtcaggataagatcagacctttgtggagacactatttccaaaatacgcagggtcttatctacgtggttgatagcaatgacattgagcgaatacccgaggctcgagatgagttgcacagaatgctgagtgaggatgagcttagagacgcagttctcctagtgtttgcaaacaagcaagatctacctaatgcaatgagtgctgctgagctcactgacaaacttggtttgcattctttacggcagcgacgttggtatattcaaagtgcatgtgcaacttctggtgaaggactctatgaagggctggattggttgtcaaacaacatttcaaataagacctgaaaatagtgcaagcatacaagtttgtgaagcttatggcctcatccatctggcgtctgcttataaagacaataaaattaagtaaaacagcctttacctagaactttgtattttgaacttataccatttgtcgggttttgtaaacttctggatgcatttgtgggtttgcatatgttttctgctctctatggcaacataaaagacatctgtaaatagcagccaaaaggacttttgcagtgactattttgaaggacataaaggtgcatttaaatatag

SEQ ID NO: 13646 - DNA, 864 bp, Petroselinum crispum
acttctgtaagttgtgttttctcaggacttcaacctcatcatgggacaatccttcaccaagctatttagtagtctatttgctaagagagaaatgagaattttgatggttggtcttgatgctgctggcaaaaccactattttgtacaagctcaagttgggtgaagtcgtcaccactattcctactattggttttaatgtagagacagttgaatacaagaacattagcttcactgtgtgggatgttggtggtcaggacaagattcgacctttgtggaggttttattttcaaaatacacaagggatcatctttgtagtggacagtaatgatcgagagcgtatgatggaggcaagagatgaactgcacaggatgttgaacgaggatgaactgagaaatgcagtactccttgtgtttgcaaacaagcaagatcttccaaatgccatgaatgctgccgagatgactgacaaacttggcttgcattctcttcgacagagaaactggtacattcagagcacgtgcgctacatctggagagggcctatacgaggggctggaatggctttcaaacaacattgctaataaggtttaaggaatttcttggtagttctatcggatatcgtattcaatccggttgcagtcatcacctggctattgtcgttgtttttgcttatagaattgcttacgaggggtgttgtgctagtgatgttacacactgtgctaaacgttttcattcttgagttgcttgttatatacattgctgcagagcaatgacatgttgtagtgagtgtttaaagatgtaaaaatatatcaaataacttgaactgtattgcttgaactgtattggcccaggtacttgttcaaatttcc

SEQ ID NO: 13647 - DNA, 1523 bp, Volvox carteri
tgcaacatatacacgtcacacagcctgcactgtggacgataaattacataaaacctacttttgtttcatttaggccaagattacttaaagtttggtcctctttctgcgaccttcttttttggcccccagcgggcgtccatagcctaatacccttctttaacatcatcggcaaagatgggcctgatcatttcgaaggcactgagccggctcttcggcaagaaggagatgcgcatcctgatggttggtctggatgctgctggtaagacaaccatcctctacaagctgaagctgggcgaaattgtgacgactatccccacaattggcttcaatgtggagacggtggaatacaagaacattagctttaccgtctgggatgtcggtggccaggataagatccgcccactttggaggcactacttccagaacacgcagggccttatctttgtgatcgatagcaatgatcgcgagcgtgttggtgaagcaaaggatgagcttcatcgcatgctgaacgaggatgagcttcgggatgctgtgctgctggtgtttgcgaacaagcaggacctgcctaacgcgatgaacgctgcggagatcactgagaaacttggtctgcatgggctgcgtcacaagtgctggtacatccagagcacgtgcgccacatcaggcgagggcttgtacgaaggcctggattggcttagccagaacattgccgccaagtcgtaagcaggtttcgccaaggagatgcgtgaaacaggggttgtgcgcctagacgagggcgttgtgggatggaagctgattatcaaggcggcgtagttacatgactgtcggcggtgtggagtggatgagtggatgaagtgaaggaggatttaaggtttgccagtaggacccattggaactcccgatcccccggtggtaatcttgcgtgtgggcccttggattgtaggatgatggcgctcatgtagatgaaatgcagccacatagcaatgacacattctttttcctcacgttgaggtcgagtgctatctatcttagggggtctgactggtgacattttcaccccggactgaaaaggcgagtgaacagggcaaatgcggtcaggatggtagtggcggagtactcgagcaatgctgttgtaaggattatatgctgcgaaccaaaatgagtatcacaagttagggtaagaagcggtgtggatgcggtgttgggaggttgccattcccgaccagcacggtacgggaaaatgtcgtacagtgcaagttctccttacattgagacaacgtcggccagctgagttggcctttcaccgcgtccgcttctatggtgctgggatgcgtctctagggggcatcctgtttacacagtattattaacggatacagacatcactgctagtcggcatgctattaggagtatcagcgtcacaaatcgctggtagactcttgttggttccattaaccagtttgcttcgggcaatgcactatagcacatgcacaaatcagttgaaaggtaaacggggtcaaagtaacc

SEQ ID NO: 13648 - DNA, 877 bp, Festuca arundinacea
ctcttcgccagaaggagatgaggatcctcatggtcggtctcgatgcggctggtaagaccaccatcctctacaagctcaagctcggcgagatcgtcaccaccatccccaccatcggatttaatgttgaaactgtcgagtacaagaacattagtttcacagtttgggatgtcgggggtcaggacaagatcaggccactgtggaggcactacttccagaacacccagggccttatttttgtagtggacagcaacgacagagagcgtgttgttgaggccagagatgagcttcaccggatgcttaacgaggatgagctgcgtgatgccgtgcttctggtgttcgcaaacaaacaagatcttcctaatgccatgaacgctgctgaaatcaccgataagcttggcctgcattcccttcgccagcgacactggtacatccagagcacatgtgctacctctggtgagggtttgtacgaggggcttgactggctgtccaacaacattgccaacaaggcttgaagcatctcggcagggcttctattgatctggataagctggatgatattcgggctaatactgcctttacgtattataaactatatagtcttgacagataatgtgggtgttttggcaagataaagctcttttgttaaaagggctagctatcagattgttttcgtgggtgttaattgtccttggcgctgtttgtttgccctgcccatcaaaggtcttactatgtcaactctgtactctgtacttgctactcttgagactcgaaacattgtagtgttgacttatcttgccatagattgtcagtgcgtgggctaagatgtttacttaacgaaaaaaaaaaaaaaaaaaaaaaaaaaaaaaaaaaaaaaaac

SEQ ID NO: 13649 - DNA, 901 bp, Echinochloa colona
gagatggggctcacgttcacgaagctgttcagccgactcttcgccaagaggagatgaggatcctcatggttggtctcgacgcggctggtaagaccaccatcctctacaagctcaagctcggcgagatcgtcaccaccatccccaccatcggattcaacgttgaaactgtcgagtacaagaacattagcttcactgtttgggatgtcggtggtcaagacaagatcaggcccctgtggaggcactacttccagaacacgcagggtctcattttcgttgtggacagcaatgacagggagcgtgttgtcgaggctagggatgagctccacaggatgctgaatgaggatgagctgcgtgatgctgtgctgcttgtatttgcaaacaaacaagatcttcctaatgccatgaatgctgctgaaattactgacaagcttggcctgcattctctgcgccagcggcactggtacatccagagcacttgtgctacatctggtgaagggctgtacgaggggcttgactggctttccaacaacattgccaacaaggcttgaagcttttcggcaggtctctcaggaagaggaagacgtccgaacaccttattgctaccgttttacatattatgattattatacaatcaacaatagatagtgtggagtgcttgtgaaaaaagaaaagtcgggctctctttggaggggctagtaccagattgggttgtgtttttgttttgtggcattttgggtccttattatcgcctgctcggtttcacaaaaactgattctgtcgaccatgtgtacttaaaacttcggtgatggccggtgtggcaaattaaattaacatgatgtgccatgtggattttgccgatccagtgcaacctgtggcaaataaattcgaggtgctttgccgt

SEQ ID NO: 13650 - DNA, 1044 bp, Marchantia polymorpha
gagatgcggatcttgatggtaggtctcgatgcggccggaaagacgactatcttgtataagttgaagctcggagagatcgtgaccaccattcctaccatcgggttcaatgtagagaccgtcgagtacaagaacattagcttcaccgtatgggatgtcggaggtcaggacaagattcgtcctctgtggaggcactacttccagaacacacagggtttgatcttcgtggttgacagtaatgacagagatcgtgtcgtcgaggcccgcgacgagctgcaccggatgttgaacgaggacgagctccgcggagccctcttgctggtgttcgctaacaagcaggatctgcccaacgccatgaacgcagctgagatcaccgacaagctcggcctgcactctctgcgccagcgccactggtacatccagagcacatgcgccacttcaggagagggtctgtacgaggggctcgactggctgtcgagcaacattgccagcaaggcttgatttacataacacagcctcagatgtgttagactagagatgggaagaaagccttatggtagttcaacgcagacgtggtcactcaaactcgctggcgccagctctagtgagatttctctgtgatagtcaatcgatctcactcacggcagttgtgaggtatctgtgacggtcattcgatctcacccaaggcactagtgagatacctgtgatgacaggagttgtttatattatgatatacagtcgcagattcttaccttcacgttgttgattagtgacatttttaggtcaacgggatcggtcttgcgcgaaattctttgttgtatttcttacttccactcaacaaacctcgaagtcattgctttcatttgtctactcttcctatgacgctcattgatgtagaagcagatacagcgattttctggaaggcgctgttcaagatagtttgttgaacagtctctctcccactgtgcgcggtcgtacgtacacgccgcgtagatttggaagtttctataaaagctggttgttgtgagcgaaagcctaaaaaaaaaa

SEQ ID NO: 13651 - DNA, 675 bp, Fagus grandifolia
gtagctagagaggtagagcaagaatggggctgacatttacgaagctatttagcaagctttttgcaaagaaagaaatgcgaattctgatggtaggtctcgatgctgccggtaagaccaccatattgtacaagctcaagctcggtgaaatcgtaaccaccatccctaccatcggatttaatgtggagacagtggaatataaaaacatcagcttcaccgtttgggatgttgggggtcaagacaagatccgtccactgtggaggcactacttccaaaacactcagggtctcatttttgtggttgatagcaatgatagggatcgaattgttgaggcaagggatgagttgcataggatgttgaatgaggatgaactcagggaggctgttttgcttgtatttgccaacaaacaagatcttcctaatgcaatgaatgctgcagagataactgacaagcttggcctgcattctctccgccaacgccactggtacatccagagcacatgtgcaacttctggagagggtctgtatggaggggttggattggctttccaacaacattgctagcaaggcataagcgaattaaagaattttggttcctagcgatttgggagatgacgccttctcagtgactgttgtaatagcagaatgtttgtctagaccttatattattttggtttgt

SEQ ID NO: 13652 - DNA, 820 bp, Panax ginseng
gttgtatcaaagtggcagtaagttcgaatgctctaataagcttggttgtttgcttctttctgtagttgctttcggactatcctttgttctttctcttcatctgtgtataggggatgtttttactctaataaaagtttggatcattgctcgagcttagtctgattgaatcttcatctttaaaagtcgatgtatggcagaaacgcattagatccctacctgaagactctacaaagggatcatttctcagaaacagaatggggctaacattcaccaagcttttcagccggctttttgccaagaaagaaatgcggattctgatggttggtcttgacgctgctgggaaaaccactatactgtacaaactcaagcttggggagattgtgacaacaatccctactattggctttaatgttgagactgttgaatacaaaaacattagcttcactgtctgggatgtcggaggtcaggacaagattcgtccattatggaggcactacttccaaaacacacagggtcttatatttgtggttgatagcaatgatagagaccgagttgttgaggcgagggatgagctgcatagaatgttgaatgaggatgagctgcgagatgcagtgttacttgtatttgccaacaaacaagatcttccaaatgcaatgaatgctgctgaaataactgataagcttggcctccactcccttcggcagcgtcactggtacatacagagcacctgtgcaaccgtccggggaagttctttatggagggttggattggctttccaacaacattgctaacaaggcatgagctgatgtagacgtttttt

SEQ ID NO: 13653 - DNA, 785 bp, Castanea mollissima
cagttcagcaatgggtttagcaatttctcgactagtgaagatgcttttcgctaagaaagaaatgaggattctgatggttggtcttgatgcagcggggaaaacaactatcctctataagctgaaacttggagaaattgttactacaataccaactattggattcaatgtggaaactgttgaatacaaaaatgttagcttcacagtctgggacgtaggagggcaggacaagattcgaccattatggagacattactttcagaacacccaaggtctgatctttgtggtggatagcaatgacagagaaagagtttcagaagccagagatgagctccaccggatgctaagtgaggatgagcttcgcgatgcaactttactagtatttgccaataagcaagaccttccaaatgctatgagtgtttctgaaatcactgataaactaggcctgcattcactccgtcaacgccgctggtacatccaagctgcatgtgccactaatggccaaggactttatgaaggtcttgattggctatccagcaacatctctagcaaggcataacttaggcagctatcaaaggtttatgcaccttatcttaaagcaattatgccatatcaatccagcgagtgtgcaactaaacttgatactttcacaagtgaaaagcatttgactgggccttatatacgtgtgtaattttcaattattattgtgaacaaactattacacattatagtgtgaaacctctaattctacattaggtgtgaagaatggtgtgtggatttaaaagctt

SEQ ID NO: 13654 - DNA, 526 bp, Conyza canadensis
ttcacaaagttgtttagccaactatttgccaagaaagagatgcgaattttgatggttggtcttgatgctgctgggaagactaccatcttgtacaagctaaagcttggagaaatcgtgactacaatccctacgattggatttaatgttgagaatgttgaatataagaatatcagcttcactgtctgggatatcggtggccaagacaagattcgtccattgtggagattctacttccaaaacacacaaggtattatttttgtggtggatagcaacgacagggatcgaattattgaggcaagggacgagttgcacaagctgttgaatgaggatgaacttaggaatgctgtcctactggtgtttgctaacaagcaagatttgccaaatgcaatgaatgctgcagaaataaccgataaacttggtcttcattcacttcgtcaacgccactggtacattcagagcacatgtgcgacatccggtgaggggctttatgaagggctggattggctctctaacaacattgctaaca

SEQ ID NO: 13655 - DNA, 1191 bp, Quercus alba
atttgaaagcataacttgaatttccttcttccaactttctgttcagtttcagcaatgggtttagcaatttctcgactagtgaagatgcttttcgctaagaaagaaatgaggattctgatggttggtcttgatgcagcagggaaaacaactatcctctataagctgaaacttggagaaattgttactacaatacccactattggattcaatgtggaaactgttgaatacaaaaatgttagcttcacagtctgggacgtaggaggacaggacaagattcgaccattatggagacactactttcagaacacccaaggtctgatctttgtggtggatagcaatgacagagaaagagtttcagaagccagagatgagctccaccggatgctaagtgaggatgagcttcgcgatgcaactttactagtatttgccaataagcaagaccttccaaatgctatgagtgtttctgaaatcactgataaactaggcctgcattcactccgtcaacgccgttggtacatccaagctgcatgtgccactaatggccaaggactttatgaaggtcttgattggttatccagcaacatctctagcaaggcataacttaggcagctatcaaaggtttatgcaccttatcttaaagcaattatgccatatcaatccagcgagtgtgcaactaaacttgatactttcacaagtgaaaagcatttaactggaccttatatacgtgtgtaattttcaattactattgtgaacaaactattacacattatagtgtgaaacctctaattctacattaggtgtgaagaatggtgtgtggatttgaaagcaactctagtacctaatgacaaaatatctcaccaagagaaagataagaaaattattaatagggaaagggaagttagggaaaaggcagtcacaaatttgaaagcttgtgatcatcaacaactagacaaaattaatggatgttttcattatggcacaatttaccttttggttgaggtgtggaagcttactgtgataagaatttggccatagttaagagtgcaagcattattaaatgtaataattgcctttacagtatgcactgtatctacaactatgttacattcaagttttacacttacagaggccactctgtcacaccttgtgtttatgctgagaactcagagaaatattttagttcacaatttt

SEQ ID NO: 13656 - DNA, 488 bp, Ananas comosus
gctgttcagcaggctttttgctaagaaggagatgaggatccttatggtaggtctcgatgcagctggtaagactacaatactgtataaactcaagctcggggaaatcgtcacaacaattcctacaattggattcaatgttgagacagtggagtacaagaacattagcttcaccgtgtgggatgttgggggtcaggataagattcgtccattgtggaggcattacttccaaaatacacaggggcttatatttgtggtagatagcaatgacagggatcgagttgttgaggcaagggatgagttgcataggatgttgaatgaggatgagctgcgggatgcagtgttgcttgtgtttgccaacaagcaagatctgccaaatgcaatgaatgctgcagaaattaccgacaagcttggtcttcattcactccgtcaacgccactggtacatccagagcacatgtgcaacttctggagaaggtctttatgaagggc

SEQ ID NO: 13657 - DNA, 928 bp, Panax ginseng
caactccatcccatctcacccaccaccctccaaaactcgccatatcaaaaggatcagcagtgtcaccagaacgacacacgacctggtccctttcttcctccttcaacacacaccactcgataccccaccacaaccaccgccaacatgggtctcgctttctctaagctgttcgaccgcctctggggcaagaaggagatgagaatcttgatggtcggtctcgacgccgccggaaagaccactatcctgtacaagctcaagctcggtgaaatcgtcaccaccatccccacaatcggcttcaacgtcgagaccgtcgagtacaagaacattcagttcaccgtgtgggatgtcggtggacaggacaagatccgccctctgtggaggcattacttccagaacacccagggtatcatcttcgtcgtcgactccaacgatcgcgaccgtgtcgtcgaggctcgcgaggagcttcagcgcatgcttaacgaggacgagctccgcgacgctctcctcctcgtcttcgccaacaagcaggatctgcccaacgccatgaacgctgccgagattactgacaagcttggcctgcactccctcaggaatcgcggttggtacatccagtcaacttgtgctacctccggtgacggtctctacgagggtctcgagtggctcagcagctctctgcgcaaggccggccaccagtagagccttacacacgccgcgaatccgccaacgcacgaaatcgcgcaaatgcatcacgttattgtcacgagaagcgcgatccagctgtgcaccagcagagacctcttacaaacaaaaaggtacacgtcatgaaatggaaagcatatcttgcgattcgagagagggggccgtggggagagtgcgagagagcggaagctgcatcctccttgggaagtagcgggaagatgggagtttt

SEQ ID NO: 13658 - DNA, 1126 bp, Hordeum vulgare
ccccaacgcctggccactctctccccccttctctctcgcgaccccctgtttccgccccccttctccggctccggcgccggcgaacccaccgcggatcgagcggttcctccgatcaggagagacaaaccgagaggaagagcacctacgcgggaggagaggagatggggctcacgtttaccaagctgttcagccgcctgttcgccaagaaggagatgcggatcctgatggtgggtctcgacgcagccggaaagaccaccatcctctacaagctcaagctcggcgagatcgtcaccaccatccccaccatcgggttcaatgttgaaactgtggagtacaagaacatcagcttcactgtctgggatgtcgggggtcaggacaagatcaggccactgtggaggcattacttccagaacacgcagggtctcatctttgttgttgacagcaacgatagggaccgtgttgttgaagcaagggatgagctccacaggatgctgaatgaggatgagttacgtgatgctgtgctgcttgtgtttgctaacaagcaagatcttccaaatgccatgaatgctgctgagatcactgataagcttggcctgcactcccttcgccagcgacactggtacatccagagcacttgtgctacaacaggggagggactgtatgaaggcctggactggctgtccagcaacattgccaacaaggtatgcctagattttccttgtcagcggactgcaaaacatcctcttctccatgtgcaaaattaatgacaggcttctttgtcggtctattaatctcgtccattttaacgtgtgcttgcagtcctaaattttcgtcaagattttgaaagagctaggagcgctttggatggatgattcaatcaccgggtacctagggattgtgttgggatgggatggtgctatgctattcccgtatgtactgtgtattttcctgagatcaacagttaccgagctccggctgtggtttcactgtcatactattgttttattgtattttgagccctaagatgtttctgaagtaaacagctaaagagagtcctgttcaatttcgtaataagtgttcaagcatctatctgtctatctatctatgcatgtatatattcagcacc

SEQ ID NO: 13659 - DNA, 676 bp, Flaveria ramosissima
atatctctctctcttcgaatcgatcgattgatccctttctaacaagcttttctcagggatcctcactagcaagaggatggggctaactttcaccaaactcttcagccggctctttgccaagaaagagatgcgtatattgatggtgggtctcgatgcggctggtaagacaaccattttgtacaaactcaagctcggcgagattgtgaccactattcctaccataggttttaatgtggagactgttgagtacaaaaacattagcttcacagtgtgggatgtcgggggtcaggacaagattcgtccattgtggaggcactatttccagaacacccagggtcttatctttgtggttgatagcaatgacagggacagagttgttgaggcaagagatgaattgcacaggatgttgaatgaagatgagttgagagatgcagttctccttgtgtttgctaacaaacaagatcttccaaatgcgatgaatgctgctgaaatcactgataagcttggtctccactctctccgacagcgtcactggtacatccagagcacttgtgccaacctcgtggggagggctttattgaaggtttggattggctttccaacaacatagcaaacaggcatgaggcaacgagagggtggatgtcggcagtttgtgttactggtttggaagttgttg

SEQ ID NO: 13660 - DNA, 706 bp, Carthamus tinctorius
atttccacactccatttctctctctcacttctccatctctcacttcaaatcgatccattcatccatctccaacaagctttttctcagggatcctcaccagcaagaggatggggttaactttcaccaaactgttcagccggctctttgccaagaaagagatgcgtatattgatggtgggtctcgatgcggctgggaagacaaccattttgtacaagctcaagctcggcgagattgagaccaccatcccaaccataggttttaatgtggagactgatgagtacaaaaacattaacttcacagagtgggacgttggacgtcatgacaagattcctccactatggaggcattatttccagaacacacaggggcttatctttgtggtcgaaagcaatgacacggacagagttgttgatgccacagatgagttgcacaggatgttgaatgaggatgaattaacagatgcagttctcctagtgtttgctaacaaacgagatctcccaaatgccatgaatgcagctgaaatcactgataatctcggcctccactccctccgacagcgccactggtacatccagagcacttgtgcaacctctggagaagggctttatgagggactggattggctttccaacaacatagcaaactaggcatgaggaggtgactgattttgttgtgagggcttgtagtgcatgcaagatttgctatt

SEQ ID NO: 13661 - DNA, 853 bp, Malus domestica
tgtggcagctgaattcgatagaaaaatggggcttacgttcacgaagctcttcagccggctctttgccaagaaggagatgcgaattctgatggtgggtctcgatgcagccggtaagaccaccatcttgtacaaactcaagcttggagaaatcgtcaccaccatccccaccattggatttaatgtggagacagtggaatacaagaacatcagcttcaccgtctgggatgtcgggggtcaagacaagatccgtccattgtggaggcactacttccagaacacacaaggtcttatctttgtggttgatagcaatgatagggatcgagttgttgaggcaagggatgaattgcacaggatgttgaatgaggatgaactaagggatgctgttctgcttgtatttgccaacaaacaagatcttcctaatgcaatgaatgccgccgagataactgataagcttggtcttcattctctccgtcaacgtcactggtacatccagagcacttgtgcaacctctggagagggtctgtacgaggggttggaatggctttccaacaacattgctagcaaggcaagcatgagagaattgaggccaatgagtttggtttcttgccttggagattgtgggtgagtatagttttctttatttcaatgaatgttgtaatagcagaatgttttgccgagactttctctgaattcgtgtgtgtatttgctactttagctacactgtttagctgtaaacgaagtttctatgttgttacgattgttttgacacacgagccaaggttatattttatcatgtttgctttgttaatccgtgtttgcactaaaaaaattctgtatgttagaagattgtgta

SEQ ID NO: 13662 - DNA, 856 bp, Eutrema parvulum
ttatgaatgcataatctctgttttgttttgcatgtttcaggatcacttaggtaaaggaaaatggggctttcatttgcaaagcttttcagccggctttttgccaagaaggagatgcgtatccttatggttggtctcgatgctgctggtaagaccaccattttgtacaagctcaagcttggtgagattgtaaccaccatcccgaccattgggtttaatgtggaaacagttgaatacaaaaacatcagtttcactgtgtgggatgtcgggggtcaggacaagatccgtcctttgtggaggcactacttccagaacactcaaggtctgatatttgtggtggatagcaatgacagagatcgtgttgttgaagcaagagatgaacttcacaggatgttaaacgaggatgagcttcgtgatgcagtactgcttgtgtttgcaaacaagcaggatcttccaaatgcaatgaatgctgctgagataactgataagcttggactccactctctccggcagcgccactggtacatccagagcacatgcgccaccaccggtgagggactgtacgaaggtctggactggctctccaacaacattgctaacaaagtaagccttccaataaacattccatattatattttttcttcttctaagcgtgcactataattataatatataaccaaagtttgctttcgttttgtagtcatttgataatgttctacttttacttgcaggcttgagttttgtgagctttggattccgagagaatgtttatctctgtttctttttaaaaaaaaaccttctctttttgttttgaattttgatgattatggagttatatatgttgcctgttaaaaaggat

SEQ ID NO: 13663 - DNA, 1232 bp, Picea glauca
ctttggcctttctcccacctgcaaactgttcctcaccacaaccttctgttcaaaagtgattccccttttggaagatcaaagcagcgtgtgctcccaagaagcatcaaatgtgaccacgatggtcaaacacggtcactgcggtagagtttattttaccccaagttaaaactgggatattttagtagggaaccacgtaggaaaaacataaacgccagagtgcataccgtgctgagatagaagaaagaggggcgacttttatcgcgattttcacgcagcagattcgaactgggaacatctcaataattctccaagtccatcattcagtttttcgaattcgggataacctcctgttttgagttttgtgggagagctagaaactcggcttttaagatgggtttaactttcaccaagcttttccagcgaatgtttgctaagagggagatgcgaatccttatggttggtcttgatgcggctggaaagactactattttatacaagttgaagctgggagagatcgttacaacaattcccaccattggatttaatgtggagactgtggaatacaagaacatcagcttcacagtttgggatgtggggggtcaggataagattcgaccactgtggaggcactactttcagaatacacagggtcttatctttgtggtggatagcaatgacagagaccgtgtagctgaggcaagggatgagttgcacaggatgttgaatgaggatgagttacgagatgcagtcctgctagtgtttgcaaacaagcaggatctcccaaatgcgatgactgctgctgaaatcactgataagcttggtctgcactctttacgtcagcggcactggtatattcaaagcacttgtgcgacttctggtgaaggtctttatgaaggcctggattggctttccaaacaacattgcaaacaaggcttaaggatgatgcttgggcactgagttggtacagtgaatgggtttagtgatgcatttgatgtctttgccgacgagtaagggacaaggagttgtgtggtgaattggcccttacatttgttcctataagtaacaaatactatattatttgtatttatctaagaattggggggttttccttcttggtgtatgttaaatctgagattcggtttcctttttctttgttggaagctaattatgaaaaagtattagttatatatgcttgaagcgaagtgcagaaatgctgagtattaaaagctcca

SEQ ID NO: 13664 - DNA, 883 bp, Lotus japonicus
gggcgaaggccctgtctgttagagcagagaagttccatctcttttctctttgttccaattgcaaagagaagagatctcgcgttcttcaagatttgtgcttgaaaatggggttgtctttcaccaagctgttcagcaggctctttgccaagaaagagatgcgtattcttatggtaggtctcgatgctgcgggtaagactaccattctctacaagctcaagcttggagagattgtcaccaccattcccaccattgggtttaatgtggaaaccgtggaatataagaacatcagcttcactgtctgggatgtcggaggtcaggacaagatccgtccactgtggagacattacttccaaaatacacaaggacttatttttgtggttgatagcaatgacagggaccgtgctgttgaagctagagatgagctgcataggatgttgaatgaggatgagttgagagatgccgtgctactagtttttgctaacaagcaagatcttccaaatgctatgaatgctgctgagataactgataagcttggtcttcattctctccgtcagcgtcactggtatatccagagcacatgtgccacgtctggtgaagggctttatgaaggacttgactggctctcaaacaacattgcaaacaagcatagagagttattagtcaaggtgcaagaagttgagtttactttcacgatgtgatctccagcgtctgatttacttgcccggattagattttcattgcaacatgtattatttttcttcaaaaaagaacagcagtctattactgaagaataattcgaattcattttttccatgtataaccaaatagcattgttgaccctttcatattttgaatgatttaaagtgtcatgtttatttgtatg

SEQ ID NO: 13665 - DNA, 559 bp, Festuca arundinacea
ccgccaacatgggtcttaccttctccaagctgttcgaccgactgtggggcaagaaggagatgagaatcctcatggttggtctcgatgccgccggaaagaccaccattctgtacaagctgaagctcggtgaaatcgtcaccaccatccccacaatcggcttcaacgtcgagactgtcgagtacaagaacatccaattcaccgtgtgggatgtcggtggacaggacaagatccgccctctctggagacattacttccagaacacccagggtatcatcttcgtcgtcgactccaacgatcgcgaccgtgttgtcgaggcccgcgaggagctccagcgcatgctcaacgaggacgagctccgtgacgctctcctcctcgtcttcgccaacaagcaggatttgcccaacgccatgaacgcagccgagatcaccgacaagcttggcctgcactccctgaggcagcgcgcctggtacatccagtcgacttgcgccacctccggtgacggtctctacgagggtctggagtggctcagcaactccctccgcaaggccggccaccagta

SEQ ID NO: 13666 - DNA, 1250 bp, Secale cereale
aaccctttactctatccctagaaacacaggcctcgacgccgtaaaccgcaaacatgggtctcgccttttcgaagcttttcgaccgactgtgggggaagaaggagatgcgaattctgatggttggtcttgatgccgccggtaaaaccaccattctctacaagctcaagcttggtgagatcgtcaccaccattcccaccatcggcttcaacgtcgagaccgtcgagtacaagaacattcaattcaccgtgtgggatgtcggtggtcaggacaagatccgtcctctgtggaggcactacttccagaacactcagggtatcatcttcgtcgtcgactccaacgatcgcgaccgtattgttgaggcccgagaggagctccagcgcatgctcaacgaggatgagctccgcgatgccattctccttgtcttcgccaacaagcaggatcttcccaacgccatgaacgccgccgagatcacagacaagcttggcctccacagcctgcgacaacgcgcctggtacatccagtccacttgtgctacctcaggtgacggtctctatgagggtctcgagtggctcgccaacaccctccgaaaggcgggtcaccagtagaaagattgacgagaagcatctcttaaagaaacccgcctttttctcttgctctgccacatactctcaaatggctctttgtgtcgactcgaggtttcggttgtaatttgcaaagttatcggtcaaccaatcgaaaatgaatccttgaaccaaagtcgcatctattcacgttttctgttaaagcaacctgtttctacgcttcctccgtctctcaatggtgcttcactgtgagcctctcggttaacgtttgtttgccatctgccagcgtcagctcgcctcccgaggaccacagaacgtgctttctttttttctttcctggaggaaaagtcgggtgatgatgggaggcgtcttatggggaaccccggggtatatgtacagtcgtcaaatcgggtgtcgtgtttgttctttgaaaaaatgcattatttgcagattttatacgaatactctcgcaaaccgtggcgcactggtacatctatcatttgctgttttttttccatttcctttccatatcgctttggggaacatgaccatgatgatcaactcgagtaacgaggagtagaaacgaggcatgaattcggggccactatgagattaagtcgttgtagagattctaactgttttattccatctttatacataaaaaaaaaa

SEQ ID NO: 13667 - DNA, 1034 bp, Picea glauca
attccatcctcatacaactttactgtgaaggccaatagacattgtcgacctgattcaataagctttaccatcacaatactttcttcgcgcaaataatctcatatcacacattcaatcatgggtctcacgttctcgaagctgttcgatagactatggggaaagaaggagatgcgaatcttgatggtcggtcttgatgctgctggaaagactactattctgtacaagctcaagttgggtgagattgttaccacaatcccaacaattggattcaacgtcgagacagtagagtacaagaacattcaattcacagtctgggatgtcggaggacaagacaagattagaccattgtggagacattacttccagaatactcaaggtatcatcttcgttgtcgacagcaacgatcgtgatcgtgttgtcgaagctcgtgaggagttgcaacgtatgcttaacgaggatgaactgagggatgcccttctcttggtctttgccaacaagcaagatttgcctaatgccatgaacgccgccgaaattactgataagcttggtcttcactctcttcgacaacgtgcttggtacattcaatctacttgcgctacatctggagatggtctttacgaaggtctcgaatggttgagcaactccctccgcaaggccggacacaactagagatctggagtaatgggacacacgcaggaaatgattaagctacgatggtcatacaaagagttcttgcattgaaacttcgataccggtcttatctctccctctatctatccctctattccccattaatccgccccataacaaatctcttgtgctcctatgtgaaccaggagggaggacgattgtgcgttgaggaatttccataatttgaagaacaaaacgtcggtcttgtgccacaacacaagacaggtcttgctgtgggtttgatttggggactttttttgaatttgaaacaagagaggaaggacaagtggatgaatgttaacatgtttatctacttttaaatcaataggtcaccccagaaaaaa

SEQ ID NO: 13668 - DNA, 1233 bp, Triticum aestivum
gacctctttttctatacctagacacacaggcctcgaagccgtaaaccgcaatcatgggtctcgctttctcaaagctcttcgaccgactgtgggggaagaaggagatgcgaattctgatggttggtcttgatgccgccggtaaaaccaccatcctctacaagcttaagcttggtgagattgtcaccaccattcccactatcggcttcaatgtcgagactgtagagtacaagaacattcaattcaccgtgtgggatgtcggtggtcaggacaagattcgtcctctgtggagacactacttccagaacactcagggtatcatcttcgtcgttgactccaacgatcgcgatcgtattgtcgaggcacgagaggagctccagcgcatgctcaacgaggacgagcttcgcgatgccatccttcttgtctttgccaataagcaggatcttcccaacgccatgaacgccgccgagatcacagacaagcttggcctccacagcctgcgacaacgcgcctggtacatccagtccacctgtgccacctccggtgacggtctctatgagggtcttgagtggctcgccaacaccctccgaaaggcgggtcaccagtagaaaggtgtcgagaggcctctccataaaaactcgctttttctctcctgctctgccatatactctcaaatggctctttgtctcgactcgaggtttcggttgtaatttgcaaagttattggtcaaccaatcgaagataaatccttgaaccaaagtcacgtctattcacgttttctgtttaagcaacctcttttaacgctttcttcctctctcaatggtgcttcactgtgagccttctggtcaacaatatctgcttgccatcgctagcgtcagctcgcttcctgaggaccacagaacgtactttctcttttttcttcttggaggaaaagtcgggtgatgatgggaggcgtcttatggggatccccgggatatttgtacagtcgtcaatcgggtgttgtttgctctttgaaaagaatgcatcctcgctgattttacaatactctcggcaaacccgtggcacactggtataccttccgtttgttaatttcttcttcccatgtcacttagggacatgacatgatgagcaactcaagtacgagggttataaatgaggcagtcgaaattccggggtccacccgcaagttttgagcgtgtgtagtagattctatatgtttagtccaaaaagaaaagta

SEQ ID NO: 13669 - DNA, 645 bp, Chrysanthemum coronarium
agtcctagggaaaacgaaaagaagctagaaatacaagcatcctaattagcacgactcgaccctccattttgagcaaaaaagatggggcttactttcaccaaattgtttagcgcgctatttgccaagagagagatgcgaattttgatggttggtctcgatgctgctggtaaaactaccatcttatacaagctaaagattggagaaatcgtgacaacaatccctacaatcggtttcaatgttgagactgttgaatataagaatatcagcttcacagtctgggatattggtggccaggacaagcttcgtcccttgtggaggttctacttccaaaacacagaaggcattatatttgcgattgatagcaatgacagggatcgagttcttgaggcaagggatgagttgcataaaatgctgaatgaggatgaacttagagatgccgtcctcctagtcttggctaacaaacaagatttgcccaatgcaatgaatgctgcagaaataacagagaagcttggtctccattctcttcgtaaacgcccttggtacatccagagcacttgtgcaacatctggtgaggggctttatgaaggtctagaatggctctccaagaacatcgctaacaaggcataataaacaactaaagggggg

SEQ ID NO: 13670 - DNA, 649 bp, Chrysanthemum coronarium
tagggaaaacgaaaagaagctagaaatacaagcatcctaattagcacgactcgaccctccattttgagcaaaaaagatggggcttactttcaccaagttgtttagcgcgctatttgccaagagagagatgcgaattttgatggttggtctcgatgctgctggtaaaactaccatcttatacaagctaaagattggagagatcgtgacaacaatccctacaattggtttcaatgttgagagtgttgaatataagaatatcagcttcacagtctgggatattggtggccaggacaagcttcgtcccttgtggaggttctactttcaaaacactgaaggcattatatttgcggttgatagcaatgacagggatcgagttcttgaggcaagggatgagttgcataagatattgaatgaggatgaacttagagatgccgtcctcttagtgttggcaaacaaacaagatttgccgaatgcaatgaatgctgcagaattaacagacaagcttggtctccattctcttcgtaaacgcccttggtacattcagagcacctgtgcaacatctggtgaggggctttatgaaggtctagattggctctccaagaacattgctaataaggcataataaacaacttcaggggtgactgaccta

SEQ ID NO: 13671 - DNA, 1025 bp, Coffea canephora
tcttctactaaatttttcaagtgagtgaatttggacagcttaaagtacgacgtacctaattttctttttctagtttcctgattatttggtacagaaatgggtttggcaatatcaaggtttgcaaaaatgctctttgcgaagaaagaaatgaggattctgatggttggtcttgatgccgctggcaaaactactattctgtacaagttaaagcttggagagattgttactaccatccccactataggcttcaatgtagagacagtggaatacaaaaacgcaagtttcacagtatgggatgtaggaggacaggataagattcgacctttatggaggcactactttcagaacactcagggccttattttcgtagttgatagtaatgacaaagaaagaatttcagaagcaagagatgagctccatcgaatgcttaatgaggaggaactacgtgatgccatccttcttgtctttgccaataagcaagatctcccaaatgccatgagagtctctgaaatcacagataaacttggcctccactcactccgtcagcgccgctggtatatccagagtgcctgcgcaacttcgggtcagggactctacgagggcctagattggttgtctagcaatatctcaagcaaggcataactgcagaagctgtcaacttggcgcctccagaacttatttccttacgtctagacaggtaatgaatcacaaattcctgctaaagaaatttaggatgcagaacgggcatgagcaagtgaaagccccgtcattttgcatcgagtaagtgtaatgcagaaggtctgatactgtgtgcgaaatggcatcttcttctgttcctatttttctttttgccttttttgctgtgatggtaatgaatcacttcttagcccctgcctgaactgtttctttggaactaaaggtagtacaattattccacatggttgattcctgtaaacttcaaccaatgatgatgaactcagcaagagaaatgggatactcatttagttcaaaaaaaaaaaaaaaaa

SEQ ID NO: 13672 - DNA, 817 bp, Gossypium hirsutum
cttttaccacttattcctcaccatctatactcacaacttgttcctgctccaatattttcagttaaaaataagagttgcagctatgggaacggcaatatctagattggtgaggatgctttttgcaaagaaagaaatgaggatattgatggtgggactggatgctgctggcaaaacaacaatcctttacaagttgaagcttggagagattgtcactaccataccaaccatcggatttaatgtggaaacagttgagtacaaaaatgttagcttcactgtctgggatgttggaggacaagataagatacgacctctatggagacactactttcagaatactcagggccttatttttgtggtggatagtaatgacagagaaagggtatcagaagctagagatgagcttcacaggatgctcagcgaggatgaactgcgtgatgcaaccttacttgtctttgcaaacaagcaagatctcccaaatgccatgaccgtttccgaaatcacggacaaacttggcctgcattcacttcgccaacgccgttggtacatccaagctacttgtgccagctctgggcaaggactttatgaaggtcttgattggctatccagcaatatctctaacaaggcataatctagccgaccctccaaaagaaagacttgaaaataccagcagccatgggcatgtaactatatatcttcattgttcagtagattttgaaccaattttacaattaagaaactaatatatatatgtatgtatgtatgtatgtatgtatctatgcatgtatagatctttgtgtgtgatatatcataaagaaac

SEQ ID NO: 13673 - DNA, 900 bp, Eucalyptus grandis
atcctcagcgaatgtatttacttcttcctgccgctctctgtttaagctcaaccatttgaatcacaaacttctatcctctccttccatctttcacgtatcagttgccaagatgggtttggcgatatctcggtttgtgaaaatgctcttcgccaagaaggagatgagaattctgatggtgggtcttgatgccgctggaaagacaaccatcctctacaagttgaagctcggtgaaatcgtcaccacaattcccacaattggattcaatgtcgaaactgtcgagtacaagaatgtgagcttcactgtctgggatgtcggcggacaggacaagattcgacccctgtggagacactactttcagaacacccaaggacttatctttgtggtggatagcaatgacagagagagggtatcggaagcaagggacgagcttcatcggatgctgagtgaggatgagttgcgcgatgcgacactgctggtgtttgcaaataagcaagaccttccaaacgcaatgagtgtctcggagattactgataagttgggcctgcactcactccgacagcgccgctggtatatacaggcagcctgtgcaaccaatggccaaggactctatgaaggtctcgattggttatccagcaacataaccaccaaggcataattgatgcagcagctgaagctatggatgaaacgccccagtccgatgaaatgcatatcaaattataaaggcttgaacagataaaagaaagacaaatcatgtacctctataaaacagtgagaattcactactgctcttcacttatttttcaaagctgctattaatatcctatacgagaaaatatagtactctctatgtctgaacttgaagttgtgatgatatgctgatgaaaaaccagtttctccaca

SEQ ID NO: 13674 - DNA, 850 bp, Festuca arundinacea
ctttttcttttttgtgtaattttctttgatctaggaaacaaaataaaataaaacgaccaagatgggtaacatgtttgcaaaactctttcaaggcctttttggcaaaaaagaaatgagaattttgatggtgggattggatgctgctggtaagacaacaattctgtacaaactcaagctgggagaaatcgttacaacaattcccacaatcggatttaacgttgagacggtagaatacaagaacataagtttcacagtatgggacgtcggtggtcaggataagatcagacctctgtggaggcattacttccagaacacacagggactgatatttgtggtggacagtaatgacagagagcgtgtgggagaggcgagggaggagctgatgagaatgttggctgaggatgagctccgtgacgctttactacttgtgttcgctaacaaacaggatctaccgaatgccatgaacgcagcagagataaccgataagctagggcttcactccctgcgtcagcgtaactggtacattcagtctacctgcgccaccagtggagacggtctatatgaggggctcgactggctgtccaatcagctcaagaatcagaagtgattgacatgtaggcttgtccaatcagacattgattccacgtgcttgacacattgcatgttttacttagtcccgcctcttgtgctaggcattgctctatttgtgttaatataaactatttcttatatctgtgaagtatttatcaatcagtttaaattctagggttatatgtcacatttgatttgggaattattacactgaaatggtattaaatttttcagggcacagccaaaaaaaaaaaaaaaa

SEQ ID NO: 13675 - DNA, 893 bp, Gossypium raimondii
ctcaccatctatactcacaacttgttcctgctccaatattttcagttaaaaataagagttgcagccatgggaatggcaatatctagattggtgaggatgctttttgcaaagaaagaaatgaggatattgatggtgggactggatgctgctggcaaaacaacaatcctttacaagttgaagcttggagagattgttactaccataccaaccattggatttaatgtggaaacagttgagtacaaaaatgttagcttcactgtctgggatgttgggggacaagacaagatacgacctctatggagacactactttcagaatactcagggccttatttttgtggtggatagtaatgacagagaaagggtatcagaagctagagatgagcttcacaggatgctcagcgaggatgaactgcgtgatgcaaccttacttgtctttgcaaacaagcaagatctcccaaatgccatgaccgtttccgaaatcacggacaaacttggcctgcattcacttcgccaacgccgttggtacatccaagctacttgtgccagctctgggcaaggactttatgaaggtcttgattggctatccagcaatatctctaacaaggcataatctagccgaccctcccaaagaaagacttgaaaataccagcagtcatgggcatgtaactatatatcttcattgttcagtagattttgaaccaattttacaattaagaaactaatatatatatatatatatatgtatgtatctacgcatgtatagatctttgtgtgtgatatatcataaagaaacatttggccagtggttcaagaaagtggatacaatagctgataagctcctctcattttgtactagcaatcattgaaatcaaactaggaatactttaagag

SEQ ID NO: 13676 - DNA, 869 bp, Heritiera littoralis
ggttttcttcttattcctcaccatctaaactcacaacttgtttctgctccaattgttcgaggtctgtgaaccaagttttgcttgaaacagctgcagcgatgggaatggcaatatctagattggtgaggatgctttttgccaagaaagaaatgaggatattgatggtgggacttgatgctgcggggaaaacaacaatcttttacaagttgaaacttggagagattgttactaccattccaactattggatttaacgtggaaactgtagagtacaaaaatgttagtttcaccgtgtgggatgttggaggacaagataagattcgacctctatggcgacactactttcagaacactcagggcctcatttttgttgtggatagtaatgacagagaaagagtatcagaagccagagatgagcttcacaggatgctaagcgaggatgaactacgtgatgcaacgttacttatcttcgctaacaagcaagatcttccaaacgccatgaccgtttctgaaatcactgacaaacttggcttgcattcacttcgccaacgccgttggtatatccaggctacatgtgccacctctggccaaggactgtatgaaggactggattggctatccagcaatatctctagcaaggcataatccaggcagcccctctttcaatatagaaagtcatctgctcccaaagaaagacatgaatatgccagaagtgaagagcatataactaaatcttcattattcagtagattttgaaccacttctacaatcaagaaactataatatatatgtgtgtgggtgatacatcataaggaaatgttcttgggtggttcggtaaagtcgattcataactctaattttgttactatc

SEQ ID NO: 13677 - DNA, 564 bp, Nicotiana tabacum
tgggacttcccatattcctaaatctgccctctcttcttccaaatcagctactagctttttttcccacgcagttttaaagatggggttgtctttcactaagcttttcagtcggttatttgccaagaaggaaatgcgaattctcatggtaggtcttgatgcagctggtaagacaaccatattgtacaagctcaaactgggagagattgttaccactattcctaccattggatttaacgtggagactgtggagtacaagaacattagtttcactgtctgggatgttggtggtcaggacaagattcggccactgtggagacattacttccaaaacacgcaaggactcatctttgttgttgacagtaatgatcgggaccgtgttgttgaggctagagacgagctgcacaggatgttgaatgaggatgaactgagggacgctgtgctgcttgtgtttgccaacaagcaagatcttccaaatgctatgaacgctgctgagattactgataagcttggtcttcactccctccgtcaacgtcactggtacattcagagtacatgtgccacctc

SEQ ID NO: 13678 - DNA, 854 bp, Ananas comosus
gaacccagtcctctgtacatcaattatattacctccacaccggcccgcgccatctccaaccaccaccgcgcctcttgaactgaacccgttcgagagtcgacactcaccgcctcctccaccgcccaacacaagcagccgtacccaccacaaccgcaaccatgggtctcacattctcaaagttgttcgacaagctatggggcaagaaggagatgcgaattctcatggtgggcctggacgctgccggaaagacgacgattctgtataagctcaagcttggagagatcgtcaccaccatccccaccatcggcttcaacgtcgagaccgtcgagtacaagaacatccagttcaccgtgtgggatgtcggaggccaggacaagatccgccccctctggaggcattacttccagaacacccagggcatcatcttcgtcgtcgacagcaatgatcgcgatcgtgtcgtcgaggcgcgcgaggagcttcagcgcatgttgaacgaggacgagctccgggacgctctcctcttggtcttcgccaacaagcaggatcttcccaacgccatgaacgctgctgaaatcaccgacaagctcggccttcacagcctccgacaacgcgcatggtacatccagtccacttgcgccacgagcggagacggtctgtacgagggtctcgagtggctgagcaactcgctccgcaaggctggccacaactaagcgttgtgcgcatccagcgcctggacggcggcgattcgtccaggtctgctgcgctcgcgctgaggcccaaacgccgcacccccactcgccgaagaactctactcccacgatgtcgaaaccgtctatgaaatatgtgtgtgtgct

SEQ ID NO: 13679 - DNA, 943 bp, Triticum aestivum
catagccgttcgagagtctatacacccgccttcccacctcaccctcctcacactcgcacatccacctaccgcagtcatgggtctcacattctccaagctcttcgacaagctatggggaaagaaggagatgcgtattctcatggtcggtctcgacgctgccggaaagaccacgattctctacaagctcaagttgggtgaaatcgtcaccaccatcccaaccatcggtttcaacgtcgagaccgtcgagtacaagaacatccagttcaccgtgtgggatgtcggcggtcaggacaagatccgtcctctgtggaggcattacttccaaaacacccagggtatcatcttcgtcgtcgacagcaacgatcgcgaccgtgttgtcgaggcgcgcgaggagctccagcgcatgctgaacgaggacgagctgagggacgctctcctccttgtctttgccaacaagcaggatttgcctaacgccatgaacgctgctgaaatcaccgacaagcttggtctccacagcctccgacaacgtgcctggtacatccagtcgacttgcgccacgtctggtgacggtctgtacgagggtctcgagtggttgagcaactccctccgcaaggccggtcaccagtaagttcgccgctggggcgagctgtaatgtagcgagtcacgaaaaatgtcaagtgcctgtccctgcccaggcatctccataacgaacgcgcgtcccgcatgccacggacccatgaagtgttatttgcattggtgatgaaaatgtcaaatggaaatggtggagcggagcggagacgatgggtttctctggtctgtgtcaccattggagttttgtgagtgcgtgtgtggaatggggctatgacattgcgtttctaggaaggggttagggttgggagacaagagttgtttggttgcttttgcgtggtactatcaaatttga

SEQ ID NO: 13680 - DNA, 1003 bp, Panax ginseng
agatattaagcatagccccccgtttgcttactaacatttatttcttcatgtaagtgaaaaaagcaaggcaaactcctctttcatcatctcaattttgtatttcttgatcattagctgtgctgtgctgatagcagcaatgggtatggcgatatctcggtttgtgaaaatgctctttgctaagaaagaaatgaggattctaatggtgggccttgatgcggctggaaaaacaactatcctttacaagctcaaactcggagaaattgttactaccatccccaccattggtttcaatgtggagactgtggaatacaaaaatgtgagcttcacagtatgggatgtaggaggacaagataagatcaggcctctgtggaggcactactttcagaacactcaaggtcttatctttgtggtggacagtaatgacagagagagaattacagaagccagagatgagcttcatcggatgctgaatgaggatgaactacgcggtgcaacggttcttgtgtttgctaataaacaagatcttccaaatgcgatgaatgtttcagaaatcactgacaaacttggccttcactcactccgtcaacgccgttggtacatacagagtacttgtgcaacttccggccaaggactgtatgaaggtcttgattggctttccagcaatatcccaaccaaggcaacataaaaacaaccaattaaccttctccatcattcatatctttatgggttttaattctgaatacatactcgcctgggggatcttgttccatccatcataaacatacgaaagttttgtatgtacaagtgacaaacatgctttatgtattattaaccgtctactgtataatattttggtttaatactgtcgaatatgtaatgtgattgataattttgtttgcggttgtgaaaatggctgaaagaattcctaatacaattagatattatgtacaaaaaaaaaaaaaaacaaaaaaaaaacaaaaaaaaaacaaaaaaaagaaaaagt

SEQ ID NO: 13681 - DNA, 842 bp, Avena sativa
ctctttcgaataaattttagcttcatttttccgtaacaaatacatatcgaagcacaagaaatgggtctttcaatctctaaacttcttcagggactctttggaaaaaaggagatgcgtattctgatggttggcttggatgcagcaggaaaaacaaccatcttgtataaacttaaattaggcgaaattgttacaaccattcctactattggtttcaacgttgagactgtagaatataaaaacatttcctttaccgtttgggacgttggtggtcaagacaagatccgaccgttatggcgtcactacttccaaaatacccagggtattattttcgttgtcgattcaaatgatcgtgagcgtatctcagaagcacgggaagaacttcagcgtatgcttaatgaggatgaacttcgcgacgcacttcttctagtgttcgccaacaaacaagatttgcctaacgctatgaatgcagcggaaattactgataaacttgggcttcactctctccgacaacgtcattggtatatccaagccacttgtgccacgagtggtgatggtctctatgaaggtttggaatggttaagcaccaatttgaagcggaaagtctaattaataaaaaaagtccagatttgtacgatttacataaattgcttatcctcaatgttgtctacattttgttttctcacttttccccattttccttcatgccctactttaaagaccgggatcatttgtagatgggttactttataaaaaatactttccaatggtgttcattacatgtagtttagtaaaccttcaatattcaaagatgataattacagttcgttctatacataattaca

SEQ ID NO: 13682 - DNA, 1088 bp, Populus trichocarpa
cagttctctttcctccaagttgtaattcaaggtaaagcaaatccaactcttcattttcttttccagtctgaactttttgttctattttcatttgtgcaagttggtcttcgtccaaattgttttgaactaggtgaagcaatgggaatggcaatatctagactcgtgaagttactctttgcaaggaaagaaatgaggatcctgatggtgggtctagatgctgcagggaaaacaactatcctctacaagttgaagcttggagagattgttactaccatacctacaatagggttcaacgtggaaactgttgaatacaaaaacgttagtttcactgtctgggatgttggaggacaggataagattcgaccattatggagacactacttccagaacacccagggccttatatttgtggtggatagcaatgacagagaaagggttacagaagccagagatgagcttcatcgaatgctgagcgaggatgaactgcgtgatgcgacactgcttatttttgccaataagcaagaccttccaaatgctatgagtgtctcagaaatcactgataagcttggtttgcactctttgcgccagcgtcgttggtacattcaggctgcttgcgccacctctggccaaggactatacgaaggtcttgattggctgtcaagcaatatctctagcaaggcatgatcaaataagcatggaagttgctttccatgtcgtagccggtcgctattgctatccacaaagctagctagctagctaagtaaaggagtttattcttcacaaaagatgcatgtaatcagaatttcacgtggtgatgtgattctaaacaactagtactacagcttttggtataacttgtgttacagaaaattgagtgctggtgttttagcttatgtgatcggacgtcatcagtccgatctcttacaggagctgtccgggataactaacttgtaaaatgcacatgtttatcataaaaggtcaccttaatctctgttttgagaattttctcgcacataaaaattccctgatgttatacaaaacaatacattatgcttgccagctctttcggatgagaagtgctttcactt

SEQ ID NO: 13683 - DNA, 631 bp, Sesamum indicum
caaattaaaaaacgggtcaatatataaatcccagctcttcatgttgtaataccatttgatctctcaaagggcagcgcctctgtttaagatctgccctcctcttcttcccaaatcactcctctttcttcagattttctttatcaaatagaaaatggggttatcttttggcaagcttttcagccgactctttgccaagaaagagatgcgaattcttatggttggtcttgatgctgctggtaagaccactatattgtacaaactcaagctaggagaaattgtgacaaccattcctacaattggattcaatgtggagacggtggaatacaagaatataagcttcactgtctgggatgttggtggtcaagacaagatccgacctttgtggaggcattactttcagaacactcaagggctgatttttgtggttgatagtaacgatcgagatcgtgtggttgaggctagggatgagctgcataggatgttaaatgaggatgaactgagggacgctgtgcttcttgtttttgcaaacaaacaagatcttccaaatgccatgaatgctgctgagataactgacaaccttggacttcactctctgcgtcaacgtcattggtatatccagagcacatgtgcc

SEQ ID NO: 13684 - DNA, 909 bp, Ananas comosus
ccacgactcagttgtctacctacaccgactccaacatcgaattcagggccacgatattgtgcatcgctgtccctcacacgacgaccgagaccccacaacccaaataaatcccttatcatccacttctttttcgagccgggcgtcaacatcagatcgcaaagatgggtctcacattcagcaagctgttcgaccggctttgggggaagaaggaaatgagaattctgatggttggtttggacgctgccggaaagaccaccatcctctacaagttgaagctgggtgaaatcgtcacaaccattcccactatcggcttcaacgtcgagactgtcgagtacaagaatattcaattcaccgtgtgggatgtcggtgggcaggacaagatccggcctctgtggagacactacttccagaacacccagggtatcatcttcgtcgtcgactccaatgatcgcgaccgtattgttgaggcccgtgaggagttgcagcgcatgctaaacgaggacgagctgcgagacgctatccttttggttttcgcaaacaagcaggatctgcctaatgccatgaacgctgcggaaattacagacaagcttggacttcacagcctgcgacaacgcgcttggtatatccaatccacctgcgccacttccggtgatggtctgtatgaaggtctcgaatggctcgccacaactctccgcaaggcaggccaccagtaaaagaagcggcagattgtcggcgtcccaccccgttctccctcggtctcatcttcatggctcggttgtatctcgcaaagtatccctcaagacaatcgaatttagtccatatgatatggcatccgtatacctctccctctctcctcccgactggtggacttcccgcatagtgagccactaccgctgataattggcgggc

SEQ ID NO: 13685 - DNA, 725 bp, Cannabis sativa
tattaattgaggaaggaaagggaggaaaggggtatatataggaaaatccgaaatctgagaattgttagatctcattccattccatttcagatttgagttacaaaataaaacccagaatcaaaaatgggactttcgttcggcaaattgttcagcaaattgttcgccaagaaagagatgaggattttaatggtgggtcttgatgcagctggtaaaaccaccattttgtacaagcttaaattaggggaaattgtaaccaccattcccaccattggatttaatgtggaaactgttgaatacaagaacattagctttacagtctgggatgttgggggtcaagacaaggcaagaagccatttttattatattttcattcatagattcattcgacctttgtggagacattattttcaaaacacacaaggacttatctttgtggttgatagtaatgaccgtgatcgtgctgttgaggctagagatgagttacataggatgttgaatgaggatgaactaagggatgctgttctgcttgtgtttgctaacaaacaagatctacccaatgctatgaatgctgctgaaattactgataagcttggccttcattctcttagacaacgccactggtacattcagagcacatgtgccacttctggggaagggttatatgagggtcttgactggctttccaacaacattgctaacaaggtagctaccttagcttctgcact

SEQ ID NO: 13686 - DNA, 1117 bp, Vitis vinifera
gtagtttgttaattctatctacttttgtattgctaccattgattgaatggttttgttggtgatgcccattttaatctgttcatgttccagtgacattttataatcaagtatactcactttgtttgttttgagagtaattgcaaattctataactttatgtttgaattaggggttttgagagtatacttactgcttcaaattcatgtgccattgaaatggttgccaccgaaagaatattaaggaaaaaaaaaatgctagttccctttattcttttctccctcaaacctcatccgaatcccattctattccccccttttggaccacacctagcttgattgataaacttctaagcaggcacatagtctcttgttgcaggcctctgaagattgaacaagttttttcctcttcaaaactgcataggaagatatgggtttggtgatatctaggcttctgaagatgctctttgcaaagagagaaatgaggattctgatggtgggtctggatgcagcagggaaaacaaccatcttgtacaagctaaaacttggggagattgttactactattccaaccattggtttcaatgtggaaactgttgaatacaaaaatgttagcttcactgtgtgggatgtaggaggacaagacaagattcggcctttatggagacactactttcagaacactcagggtcttatatttgtagttgatagtaacgacagagaaagaatcttagaagcaaaagacgagcttcatcggatgctgagtgaggatgaactacgtgatgcaacactgcttgtgtttgctaataagcaagatctcccaaatgccatgagcgtttctgaaatcactgacaaaatgggcctgcattcgctgcgtcagcgccgctggtacatccagagcacttgtgccacatccgggcaaggactctatgaaggtcttgattggctatccagcaacatttctagcaaggcaagataagcaaggctcttctgaggttttttcttcttatatgtatataacttctcattgctatgttcctgttggggaaatattcaataaccttatgtagaatgtttgtttttgcttacaggcataactcaaactgccaccagaactctgg

SEQ ID NO: 13687 - DNA, 638 bp, Ambrosia trifida
ttagatgctacttcagaaagccgaagagcagaaaattgctagggaaaaaaaaaaaagaatggggatggcaatatcgcgcttggtgaaaatgttgttcgcgaagaaggaaatgaggattttgatggtaggacttgacgccgcaggcaaaactaccattctatacaagcttaaacttggagagatcgttactaccattccaacaatcggttttaacgtcgagactgtggagtacaaggatgttagctttacagtatgggatgtcggaggacaagacaagatccgacccttgtggaggcactacttccaaaacacgcaagggcttatattcgtgattgatagcaacgatagagacaggattacagaagctagagatgagcttcaccgcatgatcaatgaggatgctcttcgtgatgccacgatacttgtgttcgcaaataaacaagatcttccaaatgcaatgaaggcagctgaaatcactgataaactcggactccattccctaagaaatcgtcgttggtatatacagagtacatgtgcaacatctggagaagggctttatgaaggtcttgattggctttcaaacaatatatcaaccaagggataagagtcatcagtcatcactataatgcaaagacagt

SEQ ID NO: 13688 - DNA, 773 bp, Malus domestica
agggtattcgttttcttggtctcatgttattttaactacctctttggttaaagaagttggaagcaatgggcatggcaatctcaaggctggtgaagatcctctttgcaaggaaagagatgagaatactaatggtgggtctcgacgctgccggaaaaaccaccatcctctacaagctcaaacttggagaggttgtcactaccatacccacaattgggtttaatgtggaaactgttgagtacaaaaatgtgagcttcactgtttgggatgtcggaggacaagacaagattcgaccgctatggagacattattttcagaacactcaaggtcttatctttgtgctggatagcaatgacagagacagagttttggaagcaagagatgagctccatcgaatgctcagtgaggatgaactccgtgacgcaacactgcttgtatttgccaacaagcaagatcttccgaatgccatgaatgtctctgagatcactgataagcttggcctgcattcactccggcaacgcagatggtacattcaggctgctagtgccacatccggccaagggctctatgagggcctcgattggctatccagcaacatctcaaacaaggcatgatagataaacctgtctcctttaatgtcttgtttcttatttaccagatgttggatattgtatttttactggatatagtacttcattacttatatatttttactatacaatgtatttttactggatgatgtctttgcatatatacagacataacccatccagtct

SEQ ID NO: 13689 - DNA, 951 bp, Musa acuminata
atggacacgccacagctcctctcccttccaccatcgccgagttcggagtacgagagaggcgaagcgggaggagacacccgccccaccgaatcgcttaggaacaatggggctcaccttcacgaagttgttcagccgcctcttcgctaagaaggagatgaggatcttgatggtgggtcttgacgctgctggtaagacgaccatcctctacaagctcaagctcggagagatcgtcaccacgattcccactatcgggttcaatgtggagactgtggagtacaaaaacattagcttcaccgtttgggatgttggtggtcaggacaagatcagacccctttggaggcattacttccagaacacacagggccttatttttgttgttgacagcaacgacagagatcgtgttgttgaggcaagggatgaactccacaggatgcttaatgaggacgaattgcgggatgctgttttacttgtttttgcaaacaaacaagatcttccaaatgcaatgaatgctgctgagatcaccgacaagcttggtctgcattccctgcgcctacgacactggtacatccagagcacctgcgcacgaggggcttgattggttatccagcaacattgccagcaaagcttaaattggcaggaggtgcctcttgtcgagatattctccctttatatcagtgctggaacatgagaaccatcagaactttcagagtaattatgtgtattatttcacatcagcttcttgaattttaataccatagattttgcacgtttgaaaatatagatttctaggctacattgtgttttctaaatccactttttatcgctcattgatatcatctcaatagttaccaagcctgcttttctctactttttggatgttgattcttttggcatcgcataaactcatatatgtgcttaacaacttggtaggatcttagaggatttaaccgc

SEQ ID NO: 13690 - DNA, 1285 bp, Theobroma cacao
tagtctcccgaatcctattcttttttatcctttttaccttagtccacgtctctcatttagtttatagaatccaggtatatatttccatttggcttccctcttagtgctcaccatctagactcaccactagtttctgctgcaattttcctggtctgtcaaccgagttttccttgaaacagttgcagcaatgggagtgacaatatctagattggtgaggatgctttttgcaaagaaagaaatgaggatattgatggtgggacttgatgctgcaggcaaaacaaccatcctttacaagttaaaacttggagaaattgttactaccataccaaccattggatttaacgttgaaactgttgattacaaaaatgttagcttcactgtctgggatgttggaggacaagataagattcgaccattatggagacactactttcagaacactcagggccttatttttgtggtggatagtaatgacagagaaagaatatcagaagccagagatgagcttcacaggatgctgagcgaggatgaactacgtgatgcaacactgcttgtcttcgctaacaaacaagatcttccaaatgccatgactgtttctgaaatcactgataaacttggccttcattcacttcgacaacgccgttggtacatgcaggctacgtgtgccacctccggccaaggactttatgaaggtcttgattggctatccagcaatatctctagcaaggcatagtcccaagccagccctatttcaatacagaaagtgatcttttcccagagaaagacttgaaggtaccggtagtgaagggcaagtgactaagttttcaatgttaagtagattttcaaccaatctaaagattaagaaactacaatacatgtgtcatacatcataaagaaatgcttgtgggtggtttgctaaagtagattcaataggggataactctcgtattgtactattaaccagagaaataaaaatgaaaataatttaagagaatcaaactctctgaacaaaaaagcttaacttgtcagttttccattttagcatttgacactaggcagaaatgaagataaatgctgttgttataacaaaaaaatgttaaaaatctggatttgaagtgttcaaacctaagggctttctagcatttttggtcgtggattgtaacttttggcatcaaagcaggtgctaaggcacggatccaaatcctggaaaggattacctggtgtagtatgagagccattgagccagccattacaaggtgaaaagggctggagcatggtggtctct

SEQ ID NO: 13691 - DNA, 710 bp, Ricinus communis
gtatagcaatgggtatggctatatctaggcttataaagctactctttgcaaagaaagaaatgagaattctgatggtgggtttagatgctgcaggaaaaacaaccatcctctacaagttaaagctcggagagattgttactaccatacctaccattgggttcaatgttgaaactgttgaatacaaaaatgttagcttcactgtctgggacgttggaggacaggataagattcgaccgctatggagacattactttcagaacacacaaggtcttatctttgtggtggatagtaatgatagggaaaggatttccgaagccagagatgaacttcaacggatgttgagtgaggacgaactaagggatgcaactctactcgtttttgccaataagcaagatcttccaaatgcgatgactgtttcagaagtcactgataaacttggtctgcactcactgcgccagcgccgttggtacattcaggctacttgtgctacctctggccaaggactttacgagggtcttgattggctgtccagcaacatctctagcaagggataatccgagttcaaaattaccatctcatctcaatccggaaagttactactatgctaaagaaagactcaacacttatcacaagaggaacagaaaatcatgtaactacaacttcacatattatatattattttaaagcaattgttgtgaactattaatact

SEQ ID NO: 13692 - DNA, 999 bp, Vitis vinifera
gaagattgaacaagttttttcctcttcaaaacagcatgttggtgaactagacctttttcataaatttaagattgtggttttttcttctccttttcttcaaggaagatatgggtttggtgatatctaggcttctgaagatgctctttgcaaagagagaaatgaggattctgatggtgggtctggatgcagcagggaaaacaaccatcttgtacaagctaaaacttggggagattgttactactattccaaccattggtttcaatgtggaaactgttgaatacaaaaatgttagcttcactgtgtgggatgtaggaggacaacacaagattcggcctttatggagacactactttcagaacactcagggtcttatatttgtagttgatagtaacgacagagaaagaatcttagaagcaaaagacgagcttcatcggatgctgagtgaggatgaactacgtgatgcaacactgcttgtgtttgctaataagcaagatctcccaaatgccatgagcgtttctgaaatcactgacaaaatgggcctgcattcgctgcgtcagcgccgctggtacatccagagcacttgtgccacatccgggcaaggactctatgaaggtcttgattggctatccagcaacatttctagcaaggcataactcaaactgccaccagaactctgggctccttctcccagatcccttttactcaaaaggttacctactgaaaaaaagagacatggatatctactatgagtgcttgtaaccatactttatgtgcccatgtgattaacattatacaagtttagggcttatagcccctgattctacatcatcagacagaatgatgatcatgattctaaagcagctgttataagttataacattactaacaaagtaatgatcttcaataatgtgagttgtactcttgatttgttttcgttcgttgttaaagctctttgtttgtcgccctttaataagttataacattactaacaaagtaatg

SEQ ID NO: 13693 - DNA, 907 bp, Echinacea purpurea
cggccgggggaccgacaaacaaacgtcgtacaccataacttcgataaggaggactttcattcttttccacttcgtcgttgccatcgtcgcgcattctaatactacatttaaggcctcagatccttaaatccctaacctctttctataccgactatttttaagatcgacaccccccaaaaataccgccaagatgggtatggccttttcgaaagtgtttgaccggctatggggcaagaaggagatgagaatcctaatggttggtctcgatgccgccggtaaaaccaccattctgtacaagctgaagctgggcgagattgtcaccaccatccccaccattggcttcaacgtcgagactgtcgagtacaagaacattcagttcaccgtctgggatgtcggtggtcaggacaagatccgtcccctgtggagacattacttccagaacacccagggtatcatcttcgttgtcgactccaacgatcgtgaccgtatcaccgaggctcgtgaggagctgcagcgcatgctgaacgaggatgagctgcgtgatgctatcctgctggtctttgccaacaagcaggatctgcctaacgccatgaacgctgccgagatcacagacaagcttggccttcacagcttgaggcaacgcgcctggtacatccagtcgacctgcgccacttctggtgacggtctgtacgagggtctcgagtggctctccaactcgctccgcaaggccggccacaactaagtcctctcctctgctacgtagcaacgcgacaatgtcaaccgtctgccagcccagacactccacaaatagtacctctgtctccaacgccatggctgtcggctgaggccgatcttcggccgtggcttctctccggaatgcgtgcatcaatgtttaacgaattgggtg

SEQ ID NO: 13694 - DNA, 1216 bp, Rosmarinus officinalis
accgacaaacaaacggcgtacaccataacttcgataaggaggactttcattcttttccacttcgtcgttgccatcgtcgcgcattctaatactacatttaaggcctcagatccttaaatccctaacctctttctataccgactatttttaagatcgacaccccccaaaaataccgccaagatgggtatggccttttcgaaagtgtttgaccggctatggggcaagaaggagatgagaatcctaatggttggtctcgatgccgccggtaaaaccaccattctgtacaagctgaagctgggcgagattgtcaccaccatccccaccattggcttcaacgtcgagactgtcgagtacaagaacattcagttcaccgtctgggatgtcggtggtcaggacaagatccgtcccctgtggagacattacttccagaacacccagggtatcatcttcgttgtcgactccaacgatcgtgaccgtatcaccgaggctcgtgaggagctgcagcgcatgctgaacgaggatgagctgcgtgatgctatcctgctggtctttgccaacaagcaggatctgcctaacgccatgaacgctgccgagatcacagacaagcttggccttcacagcttgaggcaacgcgcctggtacatccagtcgacctgcgccacttctggtgacggtctgtacgagggtctcgagtggcttgccaacaccctgcgcaaggctggtcatcagtaacggcttttccatggtcaaacaagataaagctatagttaatatgcgcttgcgataccaaagctgttcacacggcgcattgattgcttgcccgcgttcacgtctttttagtcaacgtctacctctcctacctacatctagtcagcgtctttcggttttcggttgtaatttgcgaagttatcggtcaatggcaatcgaatagtccatcaacaaacaatattttgttgtcttttttcttctctgctttctgatcttgtgccccttggtgatggatattctttgacggcctcaatttccccacctttcacgaacgaacctaccatttgctatgaaacaacgttgattattatgatgatggatgagttggtttcaatgtctgtcgcttttcccggcggctcttgtcttatttctgcgtgaactttgttttttgttcttagggtctttccaagtttctagtgacatacgaaatgatactttgttgagatcc

SEQ ID NO: 13695 - DNA, 568 bp, Prunus persica
caatgggtatggcaatatctaggatggtgaagatgctctttgcaaggaaagaaatgagaatactaatggtgggtcttgatgctgctggaaaaaccaccatcctctacaagctcaaacttggagaggttgtcacaaccattcccacaattgggttcaatgtggaaactgttgaatacaaaaatgtaagcttcactgtctgggatgtaggaggacaagacaagattcggccactatggagacactattttcagaacactcagggtcttatctttgtagtggatagcaatgatagagacagggtttcagaagccagagatgagctccaccgaatgcttagtgaggatgaactccgtgaagcgacactgcttgtgtttgccaacaagcaagatcttccaaatgccatgagtgtttctgagatcactgataagcttggcctgcattcactccgccaacgccgctggtacattcaggctgcttgtgccacctctggccaaggactttatgaggggcttgattggctatccagcaacatctcaagcaaggcacgataagccaggctccttcagcc

SEQ ID NO: 13696 - DNA, 684 bp, Saccharum officinarum
ctaagaatccgtcatcatgggtctctcgttcagtaagctgctccaggagctcttcgggaagaaggagatgcgcattctcatggtcggactggatgccgcaggtaaaacgaccattctctacaagctcaagctgggagagatcgtgaccactatccccacgatcggcttcaacgtcgagactgtggagtacaagaacatctcgttcaccgtttgggatgtcggaggacaggacaagatcaggcccctgtggaggcactacttccagaacacccagggcatcatcttcgtcgtcgactcgaacgacagggagcgtgtggtcgaagcgcgggaggagttgcaacgcatgctcaacgaggacgagctcagggatgcgcttctcctggttttcgcgaacaagcaggatctgcccaacgccatgaacgccgccgagatcaccgacaagctcggcctgcactccctccgccagcggtcgtggtacatccaggctgcttgcgccacatcgggagacggcctgtacgagggtttggaatggctctcaaacaacctcaaaaagcgtggaacaaagtagactgctgcgaggttcagcaacgacggaggggctctgtccgacgagctcctgtacacgacgattttcataggatcctccgacgctcgtccttagccaatgcatgattggggcttcag

SEQ ID NO: 13697 - DNA, 759 bp, Acacia harpophylla
gggtttttgccttcccctgcttctaaagaaaaaaagagactggttctttttcttcccgatcctcgacgcagaggcaaagatgggtttggcaatatcgaggctatttcgattattttactcaaagaaagaaatgaggattctcatggttggtcttgatgcagctgggaaaacaacaatactttataaactaaaacttggagaaatcgtcaccaccattcccactataggcttcaacgtggagacagttgaatacaaaaatgtgagcttcaccgtgtgggatgtgggaggacaggacaagattcgaccattatggaggcattactttcagaatacacaagggcttatctttgtggtagatagtaacgacagagaaagaattgctgaagccagagatgagctccataggatgctgagtgaggatgaacttaggggtgctactttactggtgtttgccaataagcaagatcttccaaatgctatgagtgtctctgaaattacagacaaactcggattgcattcacttcgacaacgccgttggtacatccaggctacttgtgccacctctggacaaggactctacgagggacttgattggctatcaagtaacatatctaacagggcatgattcagtagcttatgatactaagcaacatatattgatgtttgatggcttgtgtagtagtacctaaaatctccatgatgtgtggcttgcgaaatccaaatggctctagttatgtaatttttacacttgcgttatac

SEQ ID NO: 13698 - DNA, 834 bp, Catharanthus roseus
ccttggacatttttaccaggtgggtgagtgagctcccatcaaccttaaatccctcttgcaggctgcagcaatgggtttggcaatatcaaggtttgtgaagatgttctttaccaagaaagaaatgaggatacttatggttggtcttgatgccgccggcaaaacaactatactgtacaagttaaagctaggggagattgttactacaatccccaccattggtttcaatgtagagactgttgaatacaaaaacgtgagcttcactgtgtgggatgtaggaggacaagacaagattcggcctttgtggaggcactactttcagaacacacagggcttgatttttgtagttgacagtaacgatcgggagagaatttcagaagccagagatgagctccatcgcatgcttaatgaggaggaacttcgtgaagccactcttcttgtctttgccaacaaacaagatcttcctaatgccatgactgtttctgaaatgactgataaactaggcctgcattcactccgtcaacgccgttggtatattcagagtacttgtgcaacttctggacagggactttatgaaggcctagattggttatctaccaacatctcaagcaaggcatgaaagaattgaagcagattcttggataagtgcttctcaattccatagacactgtttgttttaaattaaagctactgtaccttttgttctgtcatctatttataaaataagctctctgcactatctgctagaggtaatgggatggtttttattttctctgttattcatccttcagataattgaggacccaagttcctagcaagtaccaggcccttttcccc

SEQ ID NO: 13699 - DNA, 984 bp, Centaurea maculosa
actcctttattcccctaataccctttatctctcacttccatccataaaatatcaaccaccctaaacatgttttataaccttattcgaattttaggacaaaaaaaatttcgaagtaaatcactacaaaaaccaaattcgttgtgatcttctttcggtattcgttgtgatcttctttcggtatttttccacttttctttcgatttcttggttgtaacgaagcaaaatgggcatggcgatatcaaggttgatcaagatgttgtttgcaaagaaggaaatgaggattttgatggtaggactcgatgctgcaggcaaaacaaccattttgtacaagcttaaactcggagagatcgttaccaccattccaacaattggttttaatgtggagaccgtcgaatacaaggatgttagcttcactgtctgggatgtcggaggacaagacaagattcgacccctgtggaggcactactttcaaaacacacaagggcttattttcgtggttgatagcaacgatcgagatagaattacagaagctagagacgagcttcatcgtatgctcaatgaggatgcgcttcgcgaagccacaatactcgtgtttgccaataaacaagatctcccgaatgctatgaaagtttctgaactcactgataaacttggcctccattccctacgccatcgtcgttggtatatacaaagtacatgtgcaacatcaggtgaaggactatacgaaggtcttgattggttgtcctccaacatctctactaagggataagtcttggctcatgtgcccatttcaataaagttgcttacctactcatttcctttggacaagtatgtgtcatatgtgcaaccatttcatatatctcctttgtatggttgtaattctatccactaaaagcttgtactttatgttgtatggtaaatagtaaacttgtacttttttcttttttacaaattatttagggtctatttgattgttgaaaactg

SEQ ID NO: 13700 - DNA, 824 bp, Cichorium intybus
aatctaaacatactttaaacatttgattcgaacaaaaccaagttatatatcatgcatttgctgaaaatctctttacactaaacttcttttgttgtattactcctttatatcttcgaacttcataagtgtatcaagaaaaaatgggcatggcaatatcacgattggtaaagatgttgtttgcaaagaaggaaatgaggattcttatggtaggactcgatgctgcaggaaaaaccaccattctttacaagcttaaactcggagagattgttactactattccaacaattggttttaatgtggagactgtggagtacaaggatgttagctttacggtttgggatgtaggaggacaagacaagatccgaccattgtggaggcactactttcaaaacacacaagggcttatattcgtggttgatagcaatgatcgagatcgaattacagaagctagagatgagcttcaccgcatgctcaatgaggatgcacttcgtgaagccacaatacttgtgttcgccaataaacaagatcttccaaatgctatgagggtttcagaactaaccgataaacttggcctacattcacttcgccatcgtcgttggtatatacaaagtacatgtgcaacatctggtgaagggctctatgaaggccttgattggctctctagcaacatctctactaagggatgagtcatgactgcaatgcaaagctcaagaacccctcatctgccccttcccataaagttacttacctactcatattctcccacaattatgtaatttcatatatttgcattatcgtcgtactctttgcatcaaaacttgtac

SEQ ID NO: 13701 - DNA, 1222 bp, Cichorium intybus
aatctaaacatactttaaacatttgattcgaacaaaaccaagttatatatcatgcatttgctgaaaatctctttacactaaacttcttttgttgtattacacttatatcttcgaatttcttaagtgtatcaagaaaaaatgggcatggcaatatcacgattggtaaaaatgttgtttgcaaagaaagaaatgaggattcttatggtaggactcgatgctgcaggaaaaaccaccattctttacaagcttaaactcggagagattgttacaactattccaacaattggttttaatgtggagactgtggagtacaaggatgttagctttacggtttgggatgtaggaggacaagacaagatccgaccattgtggaggcactactttcaaaacacgcaagggcttatattcgtggttgatagcaatgatcgagatcgaattacagaagctagagatgagctacaccgcatgctcaatgaggatgcgcttcgtgaagctacaatacttgtgttcgccaataaacaagatcttccaaatgctatgagggtttcagaattaacggataaacttggcctccattcacttcgccatcgtcgttggtatatacaaagtacatgtgcaacatctggtgaagggctctatgaaggccttgattggctctctagcaacatctctactaagggatgagtcatgactgcaatgcaaagctcaagaacccctcatctgccccttcccataaagttacttacctactcatattctcccacaattatgtaatttcatacatttgcattatggtcgtactctttgcatcaaaacttgtactttataccatgctaaaatagaaagcttacaaattaaaaaaaaaaacacaatgataaatagtatgtgtacaagttttcaacaagaaacatcaattgtccatataattgtgtattgtgaccacacgatgagaagatattggttgggacttggaaaatagaatctcaaaagtcatctcaaaagtcgtgcctgatgatattttgactgttggtgttccaagatttacctctcaagtgatacattgatgtaggtttggtgtaaaactatagtatacggtctacctttttctttgttatacataagataatgtttttggatcatatttcatgtcctctcacaatcttatgtaacaactcatctcacatgaataaaaaagagtcttctaaaggaatttacaattgtt

SEQ ID NO: 13702 - DNA, 945 bp, Carica papaya
gggtaagattgtttctttcttgttttgttttgggttttggtttttctcttgttttgtgtttggaattttgtccatattttttgggtattgaattggtggtgacagaaatgggtgtagctatatccagactggtgagaattttttttgcaaagaaagaaatgagaattctaatggtgggtcttgatgctgctggcaaaacaacaatcctttacaagctcaaacttggagagattgttactaccattcccaccatcggatttaatgtggagactgtggagtataaaaatgttagctttactgtgtgggatgtaggaggccaagataagattagaccactgtggagacattacttttacaatacacaaggtttaatctttgtggtggacagcaacgatagagaaagaatcttagaagctaaagacgagctccatcggatgctcggagaggatgaacttcgtgatgcaacgcttcttgtcttcgctaacaaacaagatttaccaaatgcaatgaccgtttcggaaatcaccgataaacttggcctccactcactccgccaacgtcgttggtacattcaggctacgtgtgcttcctccggccaaggactctatgaaggccttgattggctctctagcaatatctccagcaaggcttaatctccagtcagcaccaaatacccatctctatatcgatacaaaaaacttacctaatgagtaaaaacttccaccatcactaaaatgaagcatatatattaatgtgcttgataaattttcagtaaatacgatcgtcaattactgtaatttttccatgtgaggtacctacgtatacaaacatggaacacatatggtgtgtactagctatatataaaatcaaaagtaccagtgtgactaactttaaaaggtttgtgtactattccacagcattagtactgaggaagaagtttgattt

SEQ ID NO: 13703 - DNA, 692 bp, Rosmarinus officinalis
accagcctatttcaacgcctcagtatcgattgcagcaatgggcttggcaatatcacgatttatgaagatgttcttttctagaaaagaaatgaggattcttatggttggtcttgacgccgcgggcaaaacaaccatattgtacaagctaaagctaggggagattgttactacaatccccaccattggtttcaatgttgagactgttgaatacaaaaacgtgagcttcaccgtgtgggatgtaggaggacaagacaagattcggcctttgtggaggcactacttccagaacacacagggcttgatatttgtagtggatagtaacgaccgagagagaatttcagaagccagggatgagctccatcgcatgcttaatgaggatgaacttcgtgaagccacgcttcttgtctttgccaataagcaagatcttccaaatgccatggttgtctctgaaatgactgataaacttggcctgcactcgctccgtcaacgcagctggtatattcagagtgcttgcgcaacttctggacagggactttatgaaggcctagattggttatctagcaacatctcaagcaaggcatgaaagaatagcagctgctcggtgtccttcgcgatgtactatcaacctttcttcccctctctaaagcattcaactacacattttatcagaggatctagtgtgtttcaagcgt

SEQ ID NO: 13704 - DNA, 968 bp, Tabernaemontana elegans
ctccttagggaaattttcactcttttccagtatcgattgcagcaatgggtttggcaatatcacggtttgtgaagatgttcttttctaagaaagagatgaggattcttatggttggtcttgatgccgctggcaaaacaacgatactgtacaagttaaagctaggggagattattactacaatccccacgattggtttcaatgtggagactgtggaatacaaaaatgtgagcttcaccgtgtgggatgtaggaggacaagacaagattcggcctttgtggaggcactactttcagaacacacagggcttaatttttgtagtggatagtaatgaccgagagagaatttcagaagccagagatgagctccatcgcatgctcaacgaggaggaacttcgtgattctacccttcttgtctttgccaacaagcaagatcttccaaatgccatgagtgtttctgaaatgactgataaactcggcctgcactcactccgtcagcgccgctggtacatccaaagtacttgtgcaacttctggccaaggactttatgaaggcctagattggttatctagcaatatctcaagcaaggcatgaagtatcagcagctgctcagtgccccttctgatgtgctatcaaacttcttcccctccctcaagcagtcaatcgcactatttttactagaaggacctagaatgttttccatgtttgttctttttattgtaaaaattggagcagattctgggatcgctacttctcagtccaataggaactgttttctgttgtggcttttgttatttgatctatgtatagaataatcttgctgtgtaagctgctagaggtattgcaatagtgtttattttcccagtccttcagatgattggagccaaactcctggtattttgcccaaaacctgttcaatttccatatctgataaatgtgtaaaaatgcatccatgtgtgcaattccaaaagt

SEQ ID NO: 13705 - DNA, 838 bp, Tragopogon dubius
attataaacctgatttttaatatttgattcgaagaagaaggagatatatatcgtctttgctcaaaatctcatatagtcaagcacaacgaaaacttgagcttctttcagggtgttgctcttttatatcttaaagtttattgggtgtatcaaggcaaaatgggcatggcaatatcgcgattggtaagaatgttgtttgcaaagaaggaaatgaggattcttatggtaggactcgatgctgcagggaaaaccaccattctttacaaacttaaactcggagagattgttactaccattccaacaatcggttttaatgtggagaccgtggagtacaaggatgttagctttacagtctgggatgtaggaggacaagacaagatccgacccttatggaggcactacttccaaaacacgcaagggcttatatttgtggttgacagcaatgaccgagatcggattacagaagctagagatgagcttcaccgcatgctcaatgaggatgcacttcgtgaagctacaatacttgtattcgccaataaacaagatcttccaaatgctatgagggtttctgaactcaccgacaaacttggcctccattcactacgccatcgtcgttggtatatacaaagtacatgtgcaacatctggtgaagggctttacgaaggtcttgattggctctctagcaacatttctactaagggataaatcaatgaatctatcattgtaatgcaaagctcaagagtccatcctctccccatttccacaattatgtaatttcatatatttgctttatggatgtactctttgcaccaaaacttgttctatatgctatatggaagtg

SEQ ID NO: 13706 - DNA, 980 bp, Citrullus lanatus
cactcaaccacccaactgtcatttgggtttgctcttcttcctcttatcccttgcgaagaacaagaattcctccaagtagttcatatcgttcagtgaaattttctggtttgaaatcttgatcggcagccatgggagtggcgatatctcgacttgtgaggatgctgtttgcgaagaaggaaatgaggattttaatggtgggtcttgatgctgctggaaaaacgaccattttgtataagttgaagcttggagagattgtcaccaccatacccaccataggttttaatgtggaaacggttgagtacaagaatgttagctttacagtgtgggatgttggaggccaagataagattaggcctctatggaggcactattttcagaacacacaaggtcttatctttgtggtggacagtaatgacaaagataggatatcagaagctagggatgagcttcacaggatgctcagtgagcatgaactggttgatgcaactgtgctcgtgtttgctaacaagcaagaccttccaaatgctatgactgttgctgaaatcactgataaacttggccttcactcactccgacatcgtcgctggtacatccaggctacttgtgccacttcaggccaaggattgtatgaaggtcttgactggctgtctagcaatatctcaaacaaggcctaatctcagttgttttgataaacatcttgggggaaagctctttaaggtgaagccagaaggaaaacctaaatttgtaactgaaatacctgtgcactctgatctgaagtgtttgaactctcatgtttttgtgtaaagttttggtttgagatccaagaaaaatatgtacaaaagcagtggtgctacccctataccatctgaacgataataacgaaaaattcacaaataaatgttgttcataaatgtggatcttgttgtaacgttaaaatccattaccattatcagagagttttctgtgatcttcattgtctc

SEQ ID NO: 13707 - DNA, 903 bp, Trifolium pratense
gggggtacatggggtcttatgttcatataatatagaaacaactcattaaattttaaataagttatatcttccctttctttcataagagattgaactcagaagaattcaagttttctacttttgggttgattttttgggctaaatttttcttgaacaaaaggcaaaaatgggattgacagtgtcaaggctaatgagattattttatgcaaagaaagaaatgaggattctgatggtgggtcttgatgcagctggaaaaacaacaattctctacaaactgaagcttggagaaattgttactacaataccaaccataggctttaatgtagagactgttgagtacaaaaatgttagcttcactgtctgggatgttggaggacaagacaagattcgaccattgtggagacactattttcagaatacacaaggccttatctttgtggtagatagtaatgatagagaaagaattttagaagccagagatgagctccatagaatgttaagtgaggatgaacttcgtgatgccactttacttgtatttgccaataagcaagaccttccaaatgctttgagtgtttcagaaattactgataaactcggtttacattcacttcgtcagcgccgttggtacatccagtcaacctgtgccacgtccggccaaggactctatgaaggccttgattggttgtcaagtaacatatctaacaagataagatgaatgaagatctgagttactttgtgatctttatcatatgaatattgaaactgtgggaggcacattctataatatgtatggcatcatgtttgcttatatattggtataaacttgtttgttaccttttgttaatttgaactacgaaccaactgtgatatcaacaattatgtacactttctaatagttcaggg

SEQ ID NO: 13708 - DNA, 837 bp, Lupinus angustifolius
cagaagcaacaatgggtctaacgatatcacggctattcagattactttattcaaagaaagaaatgaggattctgatggtgggtcttgatgcagctgggaaaacaacaatactctacaaactgaaactcggagaaatcgtcactaccatacccacaataggcttcaatgtagagactgttgagtataaaaatatcagcttcactgtctgggatgtgggaggacaggacaagattcgaccgttgtggagacattacttccagaatacacaaggtcttatctatgtggtagatagtaatgacagagaaagaatttcagaagccagagatgagctccataggatgctgagtgaggatgaacttcgtgaagctaccttactagtatttgccaataagcaagaccttccaaatgctttgagtgttgcagaaattactgataagcttggtttaaattcattccgccaacgccgatggtacattcaggcaacctgtgcaacatctggccaaggactctatgaaggacttgattggttatccagtaacatatctagcaaggcaaaatgaaccaatcactgattgtgtttcaaatggttgaagttggaactctataatgtgtatcacgtttagtttgcttatatgaataatcctaagtatgacacagacacatatagacttttattacatgtttgaactttgagtcagctacaatatttcaaggcatggaaattttataagtgacatatttaatggtcaaaattatcattatctaaagtagctacctctccttgtcaaaaagttttgacctttaaataattgcggggggttaacttttttattttat

SEQ ID NO: 13709 - DNA, 879 bp, Ananas comosus
cccaaggcgcaggcccccaatatattccctcccacaccgctgtcattccccgagcaacccactccgacgttaaatcgcatcgcatcaccatctctgtccgctctcgaggacagccctttagcaaataccttaccgtgaattcttagctctcagaacaagcctctgagctaaacaccgccaaaatgggaatgtccttttcgaaactcttcgccaacttcttcggtaagaaggagatgagaattttgatggtcggtctcgacgctgccggaaagaccactattctctacaagctcaagcttggtgaaatcgtcaccaccatccccaccatcggtttcaacgtcgagactgttgagtacaagaacatccaattcaccgtgtgggatgtcggtggacaggacaagattcgcccactgtggaggcattacttccagaacacacagggcatcatcttcgtcgtcgatagcaacgatcgcgaccgtgttgtcgaggcccgcgaggaactccagcgcatgctcaacgaagatgagctccgtgatgccatcctattagtctttgccaacaagcaggatcttcccaacgccatggccgctgctgaaattacagacaagctcggcctcaccagcctgcgggcacgcacttggtacatccaatccacttgcgctacctcgggtgacggtctcttcgagggtcttgaatggctctctgccaacctcaagaagcaggctccttaagtcactcaccacctaccgtaaaatcggtcctcaagtcaagcatggttcggttgtactccgcacaatatcttctagacaatcgactagtccatacaaattgcattcggtggttcgcgcctacgtcgtgaagagccactcatgatgaggt

SEQ ID NO: 13710 - DNA, 1175 bp, Prunus mume
acggtggatgtttgatgagcaggttctatcctattaacattctttttttcccgccaacttgcaacctgtagatatcacagccattcccatcccaacacagctgtgggctgtggcatgaaattcttgtcaaacaagttaaagcaattgttccttattcttctctaatcttcatcagaatccaattctcttgcccctttctttccttttctgccacttgccatacatttcattatttgttatataacacaagcaaaatatatttccttttgcttccctctgcttatcatctcttgaatcaccacaccttttctttctcctctgattttctgctctgttagcagcaatgggtatggcaatatctaggatggtgaagatgctctttgcaaggaaagaaatgagaatactaatggtgggtcttgatgctgctggaaaaaccaccatcctctacaagctcaaacttggagaggttgtcacaaccattcccacaattgggttcaatgtggaaactgttgaatacaaaaatgtaagcttcactgtctgggatgtaggaggacaagacaagattcggccactatggagacactattttcagaacactcagggtcttatctttgtggtggatagcaatgatagagacagggtttcagaagccagagatgagctccaccgaatgcttagtgaggatgaactccgtgaagcgacactgcttgtgtttgccaacaagcaagatcttccaaattccatgagtgtttctgagatcactgataagcttggcctgcattcactccgccaacgccgctggtacattcaggctgcttgtgccacctctggccaaggactttatgaggggcttgattggctatccagcaacatctcaagcaaggcacgataagccaggctccttcagcctcttatttcttattttagcaaatgtttgattgtatatctagtactggaaagtacttatatagattgtctttctatgcagacataatccagtcaggttgccaagaagactttctagtcctcctaaaggacaaaccttgtaactaagattaatttactttgcgatttttggttactgctgtaataaaatttctaagatgcaattgtgctacctgctatattggtttgtgtataatatttggccatcagaaagcattgccagtttataa

SEQ ID NO: 13711 - DNA, 1658 bp, Triticum aestivum
ccgatacgtggcatgaaggcagcgatctcctcccgttccacgtccgccattttgactcacaacagctttcttaagattgtgttagtaaattgacgggagttattatcccctattttctaagaagacagattcctcttttaaccattcaccatggggaatatgtttgcaaacctctttaaaggcctttttggcaaaaaggagatgagaatattgatggtcgggttggatgctgctggtaaaaccaccattttgtacaaactgaaattaggagagattgttactactattcctactattggattcaatgtggagactgttgaatacaagaacatcagcttcacagtgtgggatgtgggtggtcaggacaagatcaggcccctgtggcggcactatttccagaacactcaaggattgatatttgttgtggacagcaacgatagagagagaattggtgaagcaagggaggaactcatgcgtatgcttgcggaagatgaacttcgggatgctgtgctactcatatttgccaacaaacaggatctgccgaatgcaatgaatgctgctgaaataacagataaactgggtcttcactcactacgtaaccgcaattggtacattcaagccacctgtgcaacaagcggtgatggcctgtatgagggcctggactggctgtccaatcagctcaagagtgcaaatcgttaagtttcttcagttcaccctcctgaccatcagtggctgcctcatggcagtttctgcaagagagattgggactgtggccgcaaaacacattgctatttatctttcacggcaggactgtctgtttccaagaactctttggatgttttgctgcgtattatgaatcaagtttaactgagtatttgactgagtgtggttaattggatggtggaaacagattctacatcaacttgccatggttctggccatgtaacaagactaagttattgtgcttctcatgtgacttgtatttaataagttgatctagaatctgggtctggcctaggtttttaaatagtttgttacagtatccattcctaaggaggcataaagcctgttgttggctatttatgatttgttataagtaatttccttttaattcactcagtctataatgttatggtgtatttctctttttacgtactcatcccagtggtgaattttaaggtgtgagtgtgtgcgtcgcttcggatatcacatactttactcctgtagtgggatgtgagttcgactatgtacattgcttgtgaaattactccagcagtgggatgtgagagttcgtctttgtacattgcttgtgaaattttaataaaattgaaggactacaaaaacaaaatgcagtaagacatctttacagcagcctgaccgttacatgactgtctcatcatctgttgcttgtgatgctcggatggtctgctgatttgaggcacgaagaatgtttccccaactccagttgtgaaagtgaggttcttttaattttatatagttttgtccgtggaatctgaagtgcggttacttggaatccctgtgctgagtggggattttatagttatttttcattgaatagctacatcttttttatgagatttgtgcaaattatgacttatttgtttattcttataattgaagatagtgtatttatcaga

SEQ ID NO: 13712 - DNA, 539 bp, Artemisia annua
gacggctcccgatttcaaaaaactctcaaatctcttttccggtcgccggcgatcattcaaagatggggctgtcttttggcaagttgtttagtcgattgttcgctaagaaggagatgcgtattctgatggttggtctcgatgcggctggtaaaacaactattttgtacaagctcaagttgggagaaattgtcaccactattcctactatcggattcaatgttgaaactgttgaatacaagaacatcagcttcactgtgtgggatgttgggggtcaagacaagattcgacctttgtggaggcactactttcagaacacacaaggtcttatctttgtggtcgacagcaatgatcgtgatcgtgttgtagaagccagagatgagctacacaggatgcttaatgaggatgaattaagagatgcagtgttgcttgtttttgctaacaaacaagatcttccaaacgctatgaatgctgctgagatcactgacaagcttggctcgcaatctctccgacggcgacactggtatatccagagcacctgt

SEQ ID NO: 13713 - DNA, 574 bp, Manihot esculenta
gtgttgcaatgggtttggcaatatcaaggcttctgaagctgctctttgctaagaaagaaatgaggattctgatggtgggcttagatgcagccggaaaaacaactatcctctacaagttgaagcttggagagattgttactaccatacccactattgggttcaatgttgaaactgttgaatacaaaaacgttagcttcactgtctgggatgttggaggacaggataagattcgaccattatggagacattactttcagaacactcagggccttatatttgtggtggatagcaatgacaaggaaaggatttcagaagccagagatgagcttcataggatgctgaatgaggatgaactacgagatgcaacattgcttgtatttgccaataagcaagatcttccaaatgcaatgactgtttcagaaatcactgataaacttggcctacactcgcttcgccagcgaagatggtacattcaatctacttgtgctacctctggccaaggactctatgagggacttgattggctatccagcaatatctctagcaaggtaagttcattaacccacattctata

SEQ ID NO: 13714 - DNA, 858 bp, Centaurea maculosa
tcttattcaaattcggatacgaaaaaatctttcttattagaagaaatctttcgaagtaaatcatcacaaaaatcacattcgttgtgatctctttcaatatttttccttttatttctttcggtttcttggttgtaacgaagcaaaatgggcatggcgatatcaaggttgatcaagatgttgtttgcaaagaaggaaatgaggattttgatggtaggactcgatgctgcaggcaaaacaaccattttgtacaagcttaaactcggagagattgttaccaccattccaacaattggttttaatgtggagactgttgaatacaaggatgtcagcttcactgtttgggatgtcggaggacaagacaagattcgacccctgtggaggcactactttcaaaacacacaagggcttattttcgtggttgacagcaacgatcgagatagaattacagaagctagagacgagcttcaccgcatgctcaacgaggatgctcttcgtgaagccacaatactcgtgtttgccaataaacaagatctcccaaatgctatgaaagtttctgaactcactgataaacttggcctccattccctacgccatcgtcgttggtatatacagagtacatgtgcaacatcaggtgaaggactatacgaaggtcttgattggctatccaacaacatctctactaagggataagtcttgactcatgtgggcatttcaataaagttgcttacctactcattttctttggacaagtatgtgacatatgtgaaacacatttcatattatctgcattgtatggttgtaattctatccattaaaagcttgtactttatgttgtatggtaaatagtaaacttgtata

SEQ ID NO: 13715 - DNA, 1127 bp, Chrysanthemum coronarium
tgaaactcaaaagctaaaatcagcaaatcaaatgataccattctctttcggtcactctttgaaaaacatctaattcccactggaatcctgttccttgctcctttattccttaaataaagaccctttaacccattagctctgacattgatcaatttaaatttaaaacattgcagacattttaaacatctgattaccaagttctatatttttctttagctcaaaatctatcatagatttatagtaaaaccggaacaagaactaaaatctctcaatagtattacttgtttctgtctttcgatttcttggtagacaaaatgggcatggctatatcgcggatggtgagaatgttgtttgcaaagaaggaaatgaggatcctcatggttggactcgatgctgctggcaaaaccacgattctttacaagcttaaacttggagagatcgttactactatcccaacaatcggttttaatgtggagacggtggaatacaaggatgttagcttcacggtatgggatgtaggaggacaagacaagattcgacctttgtggagacactactttcaaaacacgcaagggcttatatatgtgattgatagcaacgatcgtgatagaattacagaagctagagacgagcttcaccgcatgctcaacgaggatgctcttcgtgaggctacaatacttgtttttgccaataaacaagatcttcctaatgctatgagagtttctgaaatcactgataaacttggcctccattctctacgcaatcgccgttggtatatacaaagtacatgtgcaacttctggcgaaggactctacgaaggcctggattggctctctagcaatatatcttctaagtgatgggtcctcagtcctcactagtcatgaaatgcaaagccaaagacagcaaaactcagagcccctcctctgccccattcataaagtggcttacctactagtactactctattttgttcaacaagtatgtatcataatattttcattatgcttgtattttatgcatcaaaacttgatattttctaccacaaacatatatcgtgtatcttaggaaacatgtatgctttatattatgcaactaatgtcctgtgtatctgtgttggttatttaact

SEQ ID NO: 13716 - DNA, 858 bp, Cirsium arvense
atctttcgaaataaatcatcacaaaaatcacattcgttgtgatcttctttcaattatttttccttttatttctttcggtttcttggttataaagaagcaaaatgggcatggcgatatcaaggttgatcaagatgttgtttgcaaagaaggaaatgaggattttgatggtaggactcgatgctgcagggaaaacaaccattctgtacaagcttaaactcggagagattgttaccaccattccaacaattggttttaatgtggagactgttgaatacaaggatgtcagcttcactgtttgggatgtcggaggacaagacaagattcgacccctgtggaggcactactttcaaaacacacaagggcttattttcgtggttgacagcaacgatcgagatagaattacagaagctagagacgagcttcaccgcatgctcaacgaggatgctcttcgtgaagccacaatactcgtgtttgccaataaacaagatctcccaaatgctatgaaagtttctgaactcactgataaacttggcctccattccctacgccatcgtcgttggtatatacagagtacatgtgcaacatcaggtgaaggactatacgaaggtcttgattggctatccaacaacatctctactaagggataagtcttgactcatgtgggcatttcaataaagttgcttacctactcattttctttggacaagtatgtgacatatgtgaaacacatttcatattatctgcattgtatggttgtaattctatccattaaaagcttgtactttatgttgtatggtaaatagtaaacttgtatattttgaattggaaaaagcagtgtgataatatttagaactcatt

SEQ ID NO: 13717 - DNA, 855 bp, Cynara scolymus
cgggatcggattttgacgaaatatctgtcaaataaatcataacagaacccgaattcattgcgacttctttcgtatctgttgtgttcgttttttcagtgttttctttccttcttttcgtttcttgattgtaacgaagcaaaatgggcatggcgatatcacggttgatcaagatgttgtttgcaaagaaggaaatgagaatcctgatggtaggactcgatgccgcaggcaaaaccaccattctatacaagcttaaactcggagagattgttaccaccattccaacaattggttttaatgtggagactgttgagtacaaggatgttagttttactgtgtgggatgtcggaggtcaagacaagattcgaccattgtggaggcactactttcaaaacacacaagggcttatattcgtggttgacagcaacgatcgagatagaattacagaagctagagacgagcttcaccgcatgctcaacgaggatgcgcttcgtgaagccacgatactcgtgtttgccaataaacaagatcttccaaatgctatgaaggtttctgaactcactgataaacttggactccattccctacgccatcgccgttggtatatacagagcacatgtgcaacatccggtgaaggactatacgaaggccttgattggctctctaccaacatctctactaagggataagcctgaagtcatgtgcccatttccataaagttgcttacctactcattttcttggacaagtatgtaacatatgtgcaactatctcatatatctgcatcatcgttgtattctatgcattaaacttgtacttcatatcgtatcgtaaatagtgaactttgtatatttcttag

SEQ ID NO: 13718 - DNA, 518 bp, Lolium multiflorum
cgagcggccgcccgggcaggtactacctgcgcgggaggagacgagatggggctcacgttcaccaagctcttcagccgcctcttcgccaagaaggagatgcggatcctcatggtgggtctcgacgccgccggaaagaccacgatcctctacaagctcaagctcggcgagatcgtcaccaccatccccaccatcggattcaatgttgaaactgtggagtacaagaacatcagcttcactgtctgggatgtcgggggtcaggacaagattagacctctgtggaggcattacttccagaacacgcagggtcttatctttgtcgtggacagcaacgatagggaccgtgttgttgaagccagggatgagctccacaggatgctgaatgaggatgaattacgtgatgctgtgttgcttgtgtttgctaacaagcaagatcttccaaatgctatgaatgctgctgagattactgataagcttgggctgcactcccttcgccagcgacactggtacatccagagcac

SEQ ID NO: 13719 - DNA, 1254 bp, Cucumis melo
cacggagccatccaactttcatttggtttctctcttctccctctttctctataagaattcataccgatcagttaactttgtggtttgaaatattttgatcggcagccatgggagtggcgatatctcggcttgtgaggatgttgtttgcaaagaaagaaatgaggattttaatggtgggtcttgatgctgctggaaaaacaaccattttgtataagttgaagcttggagagattgtcaccactatacccaccataggttttaatgtggaaacggttgagtacaagaatgttagctttacagtgtgggatgttggaggccaagacaagattagacctctgtggaggcattattttcagaacacacaaggtcttatctttgtggtggacagcaatgacaaagagaggatatcagaagctagggatgagcttcataggatgcttagtgagcatgaactggtagatgcaactgtgctagtgtttgctaacaagcaagaccttccaaatgctatgactgttgctgaaatcactgataaacttggccttcactccctccgaaatcgtcgctggtatattcaggctacatgtgccacttcaggccaaggattgtacgaaggtcttgattggctgtctagcaatatctcaaccaaggcctaatctcacttgttctgataaacatctttgggaaaagttctttaagtggaccgagaagaaaaacctaaatatgtaactgatttctgtgcactctgatctgcagtatttgaactctcgtgtttttatgtaaagttttggtttgagatccaagaaaaatatgtgcaaaagcagtggtgctaatcccgtataccatgtgaatgataataaagaaaatttcagaaatctggttcgtatatcccgtggatcttgtggtaaggatccattacggttgatcttgatcagagagttttctgtgaagttcattgtctcgggaggattccttgtccaccctttagtactctttcactttctttttttttcttttctttttttttcttttttttctttatgaaaaggagtactctttcactgtaagggtttgttgttgtttcttatcaccgaggttggtgccccatgtattcttggaggaatattgtcattaatcttatgagccatcatgaaaaactcaatcagtataactatgccaaaagaatggggccagagcaagccaattactaaaaaaaaagtgaataatttagacccaaaatagaaacattgaaatatt

SEQ ID NO: 13720 - DNA, 914 bp, Momordica charantia
acaatattccgaaaagacccaacttccatttgggttcactcttcttcctcttcaaagcattcgtacaggtacttccaccttaatcagttaattttgtggtttcgaaatcttgatcgagctgtggtttgaagtgaagtgaagcagttgcagggcaggcagccatgggagtggccatatctcggcttgtgaggatgctgtttgccaagaaagaaatgaggattctaatggtgggtcttgatgctgccgggaaaacaaccattctgtataagttgaagcttggagagattgtcaccaccatacccaccatcggtttcaacgttgaaacagttgagtacaagaatgttagttttacagtgtgggatgttggaggccaagataagatccggcctctatggaggcactattttcagaacactcagggtcttatctttgtggtagacagcaatgataaagaaagaatatcagaagccagggatgagcttcacaggatgctcagtgagcatgaactggttgatgcaactgtgctcgtgtttgctaacaagcaagaccttccaaatgctatgaccgttgctgaaatcactgataaactgggccttcactcactccgaaaccgccgctggtacatccaggctacttgtgccacttcgggccaaggactgtatgaaggtcttgattggctgtctagcaatatctcaaacaaggcctaatcctgtattgatgggaagctctttaaatgaagccaggaggaatttaagaaaactttgtaactgacctacctgggcactctgatctgcagtgattaaattctcatagtttgtatgcgaagttttggtttgaaatccaagaaaaatatgtacaaaagctaccccataccatgtgaacaataataacattttcataaataaatatgatga

SEQ ID NO: 13721 - DNA, 745 bp, Lippia dulcis
gttcggcagtctctagatttgtgaaaatgctgtttgctaagcgtgaaatgaggattctaatggtaggccttgatgctgctggtaaaacaactatactttacaaattgaagcttggagagatcgtcaccacaattcccactattgggttcaatgttgagacggtcgagtataaaaacgtgagcttcacagtctgggatgtgggtggacaagataagatacgtccattatggaggcactatttccagaatacacaggggcttatatttgtggttgatagcaatgacagggaaagaattgcagaagcaagggacgaacttcatcgaatgcttagtgaggacgaactgcgagacgcaacacttctggtatttgccaataagcaagatcttccgaatgctatgagtgtgcctgaaatcactgataagcttgctctccactctttacgccaacgccgttggtatatccagagcacctgtgcgacttctggactgggactctatgaaggacttgattggctatccagcaacatttcaagcaaggtttaaatcaaagcctctttcatggagttgcaagagaaaatctcttatattttgggcttttgtatgcttggcttctgtaattgactggtctctgtaattaaataaaatagacaaatactgtacctttttgcgattgcgattgtgactgtcaaaaccagacgactagttttcataaatataaggacgtaaatattactgccaaaaaaaag

SEQ ID NO: 13722 - DNA, 886 bp, Papaver somniferum
ttttctgagtttagtcagatactctgcaataatgggtatggccatctcaagactagtaaggatgttgtttgcaaagcgtgaaatgagaattttaatggttggtcttgatgctgctggaaagacaaccatcctctacaaactgaagcttggagagattgttactaccatacccaccataggttttaatgtagaaacagtggaatacaaaaatgttagcttcactgtatgggatgtgggaggccaagacaagattcgacctttatggagacactactttcagaacactcaagggctcatatttgtgattgacagcaatgacagagaaagaatagtagaagccagagacgagatccatcgaatgttgagtgaggaagaactacgtgatgccacactgctggttttcgccaataaacaagaccttcccaatgcaatgagtgttgcagagatcacagataaacttggcctgcactcacttcgtctacgccgttggtacatccaaagtgcttgtgctacctctggtgaaggactctacgaaggtcttgattggttatccaacaatatttctaccaagacataaatcttgatggcagcaaagactttggacttctcagtacagctcctacaagattgtatctaagaataaccgacgttactagtttggtttccctcgtatcatgttaggaccaagatatgttacatgatacattataattatgaaatgaatattgtcggacttattaaggctattgtaatgaaagtattctaatttggtgattcagttcaaaatataatcactatgcaacattacagactcatgaagtactgttgatatggtgagccgtgttatattaactgattcaaattatggctaaaagcatattttcaa

SEQ ID NO: 13723 - DNA, 942 bp, Triticum aestivum
tcgggggaccgcaccgcactgcacgacagccatctcttccgtgcggttccaagctccaactcccacgcccgtctcccccgagatcaggaggagcacgccgcaccggagcgccgagacctcgaagccttcgtctccacctcggagcagagatggggctcacgttcaccaagctgttcagccgcctctttgccaagaaggagatgaggattctcatggttggtctcgatgccgctggtaagaccaccatcctctacaagctcaagctcggagagatcgtcaccaccatcccaaccatcggatttaacgtcgaaactgttgaatacaagaacatcagcttcactgttggatgtggggccaagacaagatcaggccctgtggaggcactacttccagaatacgcaggcctcaattttgttgtcgacagcaatgatagggaacgtgttgttgaggctagggatgagctccacaggatgctgaatgaggatgagctgcgtgatgctgtgttgcttgtatttgcaaacaaacaagatcttcctaatgccatgaatgctgctgaaatcaccgacaagcttggtctgcactccctgcgccagcggcactggtacattcagagcacttgtgcgacgtctggcgaagggttgtacgagggacttgactggctctccaacaacattgccaacaaggcttgaagcgtctcgacaagtgcttcatcaagaaacaaacgtgctggatgtctcaacaactcactgctaccattttacatattgtgatatatatacactgcacaagagatagtatgtgtgcgtatgtgacaggcagaagctcccttctttaagtgagctagtatcaggtcaggttgtctttttttgtatggatattatcagctgctgttcggtggttttacaaggtttaatgtgtcgacaatgtgtgtctgaaccccta

SEQ ID NO: 13724 - DNA, 579 bp, Aquilegia formosa
gtataatctgtttgtaaacaatgggtttggctatatctcgactcgtaaggatgttgtttgcgaagcgtgaaatgcgtattttgatggtgggtttagatgctgctggaaaaactaccatcctgtacaaactgaagctcggcgagatcgttacaactatacccaccattggttttaatgttgaaactgtggaatacaagaatgttagcttcactgtatgggatgtaggaggccaagataagattcggcctctatggaggcactacttccaaaacacccaagggcttattttcgtggttgacagcaatgacagagaccgtgtgtctgaagccagggatgaactacatcgcatgctgagcgaggatgaattacgtgaggcaacacttcttatattcgcaaataagcaagatcttccaaatgcaatgagcgtttctgagatcactgacaaacttggccttcattcacttcgtcagcgccgatggtatattcagagtgcatgtgcaactgctggacaaggactgtatgaaggccttgattggttgtcaaacaatatctctaacaaggcaagtgtatatatataac

SEQ ID NO: 13725 - DNA, 864 bp, Chrysanthemum coronarium
acactactcgtctccgatctcaaaatcacttttctctcaattttccggttgccggcgatcatacaacaaagatgggggctgtcttttgggaagttgtttagtcgattgtttgctaagaaggagatgcgtattctgatggttggtctcgatgcggctggtaaaacaactattttgtacaagctcaagctgggagaaattgtcaccactatacctactattggatttaatgttgaaactgttgaatacaagaacatcagcttcactgtgtgggatgttgggggtcaagacaagattcgacctttgtggaggcactacttccagaacacacaaggtcttatctttgtggttgacagcaatgatcgtgatcgtgtggttgaagccagagatgagctacacaggatgcttaatgaggatgaactaagagacgcagtgttgcttgtttttgccaacaagcaagatcttccaaatgctatgaatgctgcggagatcaccgacaagcttggcttgcaatctctccgacaacgacactggtatatccagagcacttgtgccacctctggggaaggtctatacgagggactggattggctttccaacaacattgctaacaaggcctaaaacggactcacatgaacatggagtatacgtcttatgacaaacattgttagcattttatcacttcccttggctttcttaagactgtatacattatcacttgcagtattcgtacacctttatttctgtaatactatcttttgcaatatgcaaaatgaaaactgttacccttgagttgactgagacttggttaacctagttattgcaggcagttaacttgtattctgtttccatgaaacttgcgttcat

SEQ ID NO: 13726 - DNA, 848 bp, Solanum phureja
gacgactcagcttaatttctctttttccgtgccacagcagaggaaagcgcggtgaacgacagctccatttcgagatctactatttgaattctccgatcgccggtcgccgttacacagagatggggctgtgtttcaccaaacttattatttgcctctttgctaagaaagaaatgcgtattcttatggttggtctcgatgatgctggtaaaaccacaattctctacaagctcaagttgggggaaattgttaccgctatacgtactagtggcttcaacgtggaaacagttgaatacaagaacatcatctttactgtgtgggatgttgggggtcaggacaggattcgacctctatggaggcattatttccagaacacacaaggcctcatctttgtggttgacagcaatgacagagaccgtgttggtgaggcaagggatgagcttcataggatgttatatgaggatgaactaagagaggctgtgctgcttgtttttgcaaacaaacaagatcttccaaacgcaatgaatgcggctgaaatcaccgataagcttggacttcattctcttcattctcttcaacagcggcactggcatatccagagtacatgtgccacttctggagaagggttatacgagggacttgattggctatcgaacaaggcttagatcatcaattagactctgctctcgcttgtcgctcacttacctacatctggagtatagttgttaaacaccatttggttattttggatagaaagaagattaatctctgaaaaatattctgcatttctttcccttttcatgttttttcttgttaatgaaatcccatggttcaaattacttgtggttgtt

SEQ ID NO: 13727 - DNA, 1053 bp, Zostera marina
acccaaacatttctttctagaaatttcaaaataaaagggagagagagctccgaggattctggtgaagtttgaggtgagatttcgatcgatcctccattcgaattgtatctgtaaactattcgattgaggatgggggtggcgtttacgaaactgttaaattgtatttttgcgaagacggagatgcggattctcatggttggactcgatgctgctggtaaaactacgattctttacaagctcaagcttggagaggtcgtcaccaccattccaactataggttttaatgttgagactgtggaatacaaaaacattagcttcacagtttgggatgttggtggtcaggacaagatcagaccgctatggagacattattttcaaaacactcaaggtcttatctttgtggtggatagtagcgacagggatcgtgttggagaggcaagagatgaactccacaggatgataaatgaggatgagttacgggatgctgtattgcttgtttttgcaaataagcaagatcttccaaacgcaatgaaagctgatgaaatcactgagaaacttggccttgattccctgcgacagaggcactggtacatccaaagcacatgtgctacgaatggtgaagggttgtacgaaggactagattggctctctagcaacatctccggcaagagttcgaacctgagaagcagtaataatggttgagctgagagagagattaaacacatctggattgagattgtaagactcaacccaagacgtggggtgtgtggctgggtagtatctttggcgtggcacatataatcaattattgattttttattataattctaatttttgtcatttatggggggttgcatataaatatatgtatgtttgtgaaaagaatttgctaatatataatcttcaccatattgtatagtttactactttactgtatcaagtactgacccctcctttctaattcctaattcctaattattagtttattaattatgtatttaacatggacagttttttatgtggtgctaatacaaattaatattcaaaatttac

SEQ ID NO: 13728 - DNA, 979 bp, Secale cereale
gggaccgcaccgcactgcacgacagccatcctccgtgcggtcccaagctccaactcccacgcccgtctcccccgagatcaggaggagcacgccccggagcgccgagaccccgaagccttcgtctccaccccggaggagagatggggctcacgttcaccaagctgttcagccgcctcttcgccaagaaggagatgaggattctcatggttggtctcgatgccgctggtaagaccaccatcctctacaagctcaagctcggagagatcgtcaccaccatcccaaccatcggatttaacgtcgaaactgtcgaatacaagaacatcagcttcactgtttggatgtgggggccaagacaagatcaggcccctgtggaggcactacttccagaatacgcaagggctcattttgttgttgacagcaatgatagggagcgtgttgttgaggctagagacgagcttcacaggatgctgaatgaggatgagctgcgtgatgctgtgttgcttgtatttgcaaacaaacaagatcttcctaatgccatgaatgctgctgaaatcactgacaagcttggtctgcactcccttcgccagcggcactggtacattcagagcacttgcgcgacatctggagaagggttgtacgagggacttgactggctctccaacaacattgccaacaaggcttgaagcgtctcgacaagtgcttcatcaagaaacaaacgtgctggatgtctcaacaactcactgctaccatttttacatattgtgatatatatatacactgtacaagagatagtatgtgtgcgtatgtgacgacagaagctcccttctttaagtgagctagtatcaggtcaggttgtttttttgtatggatattatcagtattcccgcgtcgtggttttacaaggtttactttgtcgaccatgtgtgcatgaacccctatctttttgagttgtagtaagattgaattgtggttgccaaaa

SEQ ID NO: 13729 - DNA, 1589 bp, Cicer arietinum
aatcaaacataactacgtaaggaaattcatattattttttgtgtcgctttcatcttaaaataatcgagtcatttgatcattttacatatattaagaaaattttataaatgaatacttttactaaataattcttaggtattaatgcattatcaatgttataaatacataatagatgatattgcattaaaaatgatacaaaaaatattaattaaataatacaattgaaaaaaattactttgaaaattgaaaagttcattcattttttaacaatttttttacaaatgaatattgtgagagggaagaagtaatatttttctttttcaatgttactacaatttaatgcctatcatttaaaacaaaaatagcctcaaccgtaagctaaacaaagacacaccacaccgctctttattatcagaatcttattctagctttctcttatggagtattgatgcttgatgcaatttttttagtcgtatgttcatataataatacacaagcaacttattgaattatatcccccccttctttcataagagattggactcagaagaattcaagttttatacttttaggttgcttgaaccacaagcaaaaatgggtttgacagtgtcaaggctaatgagactattttatgcaaagaaagaaatgagaattttgatggtgggtctagatgcagctggaaaaacaacaatactctacaaattgaagcttggagaaattgtcactaccataccaaccataggcttcaatgtagagactgttgagtacaaaaatgttagcttcactgtttgggatgttggaggacaagacaagattcgaccattatggagacactattttcagaatacacaaggtcttatctttgtggtagatagtaatgatagagaaagaattttagaagccagagatgagctccatagaatgctgagtgaggatgaacttcgctacgcctcattacttgtatttgccaataagcaagaccttccaaatgctttgagtgttgcagaaattacagataaacttggtctacattctcttcgtcagtgtcgttggtacatacaatcaacttgtgccacgtcaggccaaggactctatgaaggacttgattggttatccagtaatatatctatcaagacaagatgaatcaagatctgagttattttctgatctttatcatatgaatattgagacttggctgcacattctataatatatatgacatcttgtttgcttatatataggcataaacttgagtgctaccttttattaatttgaactatatgaaccaactataatatcaatatcaatcactatgtgcgctttctaaaagttcagagcatataattattacactcttttgagtattatcatacaacctatagcagccttaagaaatatcagttacgtttgtttggacagaatttgaattttctacagttgggaaatcaacaatcaagtcattatagtttgattagaagtatcgcttgacctatgtagtaaccatagtcgagtgaattagaacataactatcttaccatctatatctgctattaacaagattctgatttgaaattttacttatgaggtac

SEQ ID NO: 13730 - DNA, 793 bp, Lupinus angustifolius
cattttttaatacttcatcatgggtctctcaatctcgaaattgctcagcgagctcttcggccggcgcgaaatgcgcattctcatggtcggattggatgctgctggtaaaacgactatcctttacaagttgaagctcggagaaattgtcaccaccatcccgacaattggattcaatgtggagactgtcgaatacaagaacatttctttcaccgtgtgggacgttggtggacaggacaagattcgccctctatggcgccactacttccaaaacactcagggtatcattttcgtggttgattccaacgacagagaacgtgttagcgaagccagggaggagttgcagcgaatgttgaatgaggatgagttacgggatgctttgttgttagtcttcgccaacaagcaagatttgccaaatgccatgaacgcctccgagatcacagacaagcttggattgcaaagcttgaggcagagggcctggtacatccaatccacctgtgctacctccggagacggtctttacgagggtctcgaatggctcagcaacaacttgaggaagcgtcaatcttaaagcaagccatgttttcctttgttctgtgactggttcccctcctcctcatcacccacaccatactaggagaggtcgatgtgtaatgcttttctagtacatccatcaatccaattcaacctttttctccgactacacgagtcataagtcccgccggtgtgattttcttctgtgtagtgtctgtttgtgggtgctgtgtcatgtgtatcttttgttggttgagttacg

SEQ ID NO: 13731 - DNA, 1210 bp, Medicago truncatula
taaataaagataccacgccaccctttattatcagaatcttattctagctttttatattggagtattgatgcctgacgcaattttttctggtctcatattcatataataaacaaacaactcattagattctgaggtaagttataaccttcttccccttcgtccataaatcataacaaattgaactcagaaaaattcaagttttatacgttttaagttgattttttgggctaaattttacctgaaacaaagacaaaaatggggttgacagtgtcacggataatgagattattttatgcaaagaaagaaatgaggattctgatggtaggtcttgatgctgctggaaaaacaacaatactctacaaactgaagcttggagaaattgtcactaccataccaaccataggcttcaatgtagagactgttgagtacaaaaatgtgagcttcactgtctgggatgttggaggacaagacaagattcgaccattgtggagacactattttcagaacacacaaggtcttatctttgtggtagatagtaatgatagagaaagaattttagaagccagagatgaacttcatagaatgctaagtgaggatgaacttcgtgatgccactttacttgtatttgccaataagcaagatcttccaaatgctttgagtgtttcagaaattactgataaacttggtttacattcacttcgccagcgtcgttggtacatccagtcaacttgtgctacatctggacaaggactctatgaaggccttgattggttatcaagtaacatatctaacaagataagatgaatcaagatctgatttactttgatctttatcatatggatattgagactttgctccacattctataatatgtactctatgacatattgtttgcttatatactggcatgaacttgagtaccttttgttaatttgaactatgaaccaactataatatcaatcactgtgtacactcttttattagaagtatattactagttagttagagaatcaacatattaactacaattactaacagactctaacttttttttactaacttttatatttttattagtctgttttggaacaaagttcagagtatgttctgcagaaaccaagcatatttacgcacacgtatgggcaattaattatcctttgtaggcatcattacactgtgtaggtatcagtctatcagactaagaggatcg

SEQ ID NO: 13732 - DNA, 843 bp, Rosmarinus officinalis
tgaagatatgtttttcttcaaatgtttgttatatttaatctaactcgaagatagtaacatcattttataaaactacgatatctaattgaacatataactatcgacgactcggtttcatttcttgtaatttcgtataccgtgtctttgtatttctttcttttgccggctgtaacgtgtaattctaattgtggaaattgtccaataatctatcacaatgggtaacatgttcgcaaatttattcaaaggcctttttggcaagaaagaaatgagaatattgatggttggcttggatgccgccggtaaaactactattttatacaaattaaagttaggtgaaatcgtaacgacaattcctacaatcggttttaacgtcgaaaccgttgaatacaaaaacattagctttactgtctgggatgtcggtggtcaagacaaaatccggcctttatggagacattatttccaaaatacacagggtttaatatttgtagtagacagtaacgatagagaaagaatcggcgaagcaagagaagaattgatgagaatgttagccgaagatgaactgagagatgctgtgcttttaatattcgccaacaaacaggacttaccaaacgctatgaatgccgccgaaattactgacaaattgggtcttcattcgttacgtaatcgaaattggtatattcaagctacttgcgctactagtggagatggtctttacgaaggattggactggctctctaatcagttgaaaaatgccaaccgctagtgacgaatgttcgcgttccgctgtatgaattttcctcaattgttgttctatagtataaataatttctcttcttttccccc

SEQ ID NO: 13733 - DNA, 913 bp, Amaranthus tuberculatus
acaaaataccgtcataatttctattattttcttgtgttttcttagaaatttgttgatatcgagagagatgggggtgatggtatcgagattagtgaggatgttatttgcaaagaaagaaatgagaatattaatggtgggtcttgatgctgctggtaaaaccaccattctttacaagcttaaacttggtgaagttgtcactaccatccctactattggatttaatgtagaaacagtggagtacaaaaatgtgagcttcaccgtttgggatgttggtggccaagataagataaggccattgtggaggcattacttccaaaacacacaaggtctaatatttgtggtagacaccaatgacagagacagaatcaatgaagccagagatgaactccacaggatgctaagtgaggatgagctgagtgatgcaacacttttagtatttgccaacaaacaagatctcccaaatgctatgcctgttgctgaagttactgataaacttggcctacactcccttcgacgccgccgctggtatatacaagctgcttgtgcaacctcaggtgaaggactctatgaaggtttagattggctttctagcaatatatttaacaaggtttagattgcatcagttgatgcctgaaagcgagagaatttgctcaaacatactgcattagtgctgatatctcatgtttactaaacttagtttcatttgcaaagagtaatctctgtcccttttaatttgcagtatagaattcaagaagatctcacatattttgagtgttatggtgcaaacttaaaagtacatgaaaagtattagttattaccataaactgtactatgtcttatctgtatgttcaagtcaaatgaagattgtatgtaatgtttcttgtgaattcatatagatagaatatcaatatac

SEQ ID NO: 13734 - DNA, 774 bp, Cleome gynandra
ctttaaaggaccatttcaaggaactagatctcgatcgctttggtttttcttcggatcgttaaaatgggactttcattcgggaaggctgttcagcaggctctttgcaaagaaagagatgcgtattctaatggtaggtcttgatgctgctggtaagaccaccattttgtacaagctcaaacttggagagattgtgaccactattcccaccattggattcaatgtggagacagtggaatacaagaacatcagctttaccgtatgggatgttgggggtcaagacaagattcgtcctttgtggagacattactttcaaaacacccaagggcttatctttgttgttgacagcaatgatcgagaccgtgttgttgaagccagagatgaacttcacagaatgctgaatgaggatgaactgagggatgccgtgctccttgttttcgctaacaaacaagatctgccaaatgcaatgaatgctgccgagatcactgacaagcttggtcttcactctctccgtcaacgacactggtacattcagagcacatgtgccacctccggtgaaggactgtacgagggtcttgattggctctccaacaatatcgcaaacaaggcttaatggtcatattcatctgagcaaatcgggaatttggataaggacgtagttagattcctcggtctcttgggggtatttcgggagtctttctttgaattaaatcaaccatttattggcaaattcttcatctctcatttgttctttaatttccaaacttttcttatgtt

SEQ ID NO: 13735 - DNA, 1144 bp, Lactuca sativa
ttgattcgaagaaaaccgagttatatatcttacatttgatcaagatttcttaaagtaaaccaaaccaaaaactcaaacttctttcggggttattactcttttatatctttggtttcttggttatatcaagtcaaaatgggcatggcgatatcaagatatgtaaggatgttgtttgcgaagaaggaaatgaggattcttatggtaggactcgatgctgcagggaaaaccaccattctttacaagcttaaactcggagagattgttactaccattccaactattggtttcaatgtggaaaccgtggagtacaaggatgttagctttacggtatgggacgttggtggacaagacaagatccgacccttgtggaggcactactttcaaaacacgcaagggcttatatttgtggtcgatagcaatgatcgagatcgagttacagaagctagagatgagcttcaccgcatgctcaatgaggatgcgcttcgtgaagctacaatacttgtgtttgccaataaacaagatcttccaaatgctatgagggtttctgaacttactgaaaaacttggtcttcattcactacgccatcgtcgttggtatatgcaaagtacatgtgcaacatctggtgaaggactctatgaaggccttgattggctctctagcaacatttctactaaggggtaagtcatcaatgcaatgcgaaactcaacgaatctctcatctgccccttcccataaagttacttacctactcatattcttccataattatgtaatttcatatatttgtattacgagtgtaccctttgcatcaaaacttgtacttcataccatactggattttaaactctataaaatcgaaaaagaaaacataataatgagtagtatttatacaagtagtcaatacaattgtattatcgtgcccacacatagggaaagtacaattgttggagagtcaaacaacaccatagtatagagttatgttatgttgtacctacaattgtattatgggttgttttgatagtttataacataatccaatttgattgagtaaacgtctggttttgtcggtatgagttatgtatagatacgagtcagatattactcagaagtagtttttaattgtggtatcaaagaatttatatccg

SEQ ID NO: 13736 - DNA, 1050 bp, Sesamum indicum
cattttaaaagcctcgcttcactctttaacttccaatttcctagtgagttcacaagaccgatctcatttatcagcaacgagtgttttagttcttttttgatcgattcgttgcagcaatgggtttggcattctcccggatgctaaaagcgctctttgctaaacgtgaaatgaggattctaatggtgggccttgacgctgctggcaaaacaactatactttacaaattgaaacttggggagatcatcactaccattcccaccatcggtttcaacgtggagaccgttgagtacaaaaacgtgagcttcacagtgtgggatgttggagggcaagataagatacggccgttgtggaggcactacttccagaacacacaaggcctcattttcgtggttgatagcaatgacagggagaggattacagaagccagggacgagctccatcgaatgcttaacgaggaggatctacgggacgcaacagttcttgttttcgcaaataaacaagatcttcctaatgcaatgactgttcctgaggtcactgataagctcggtctccactctttacgcctgcgtcgttggtatatacagagcacttgtgctacctctggccagggactctacgaaggccttgattggctatcaagcaatatttccactaaggtttaagcctgcagtgcagattaaagtcccaagtcctctccaaaagcaaaaccagctgtaaaacctgcagaggtttgacaatcgtgttttggagccaactccaaatggtaaaggcgcataatgagttaattactgggggcagaatcagaatcagaattatatatgtaccataaaaaggctgtgagtttcaaagcccatatgtagtcacagttccttacatttggacagacagacacacacattattcctgcagaaaccaaaaccagcaaatgctaaattaatgtcgcatcttacattacagctattgcaatttatgagaaacgaaggctgcattctaaccacacgaaaatattaccaagaggttcttggattcttggccatccttaatttctaa

SEQ ID NO: 13737 - DNA, 751 bp, Silene vulgaris
ttgctcgctcgctttctttcatcatgggttcggtattcgccaagttgttcaagggcctcattggcaagaaggagatgcgaatcttgatggtgggtcttgacgctgctggtaagaccacgatcttgtacaagttgaagctcggtgagatcgttacaaccatccccacaatcggcttcaacgtcgaaacggtcgagtacaagaacatcaacttcacggtgtgggatgtcggaggtcaggacaagatccgtccgctgtggcgccactacttccagaacacgcagggtctgatcttcgtcgtcgactcgaacgatcgcgaccgtatcggcgaggccaacgaggagctccaaaagatgctgcgcgaggatgagctccgcgacgcgacgctgctcgtgttcgccaacaagcaggatctcccgaacgccatgtcggtgtccgagatcaccgacaagctgggcctgcactcgctcggctcgcgcaagtggtacatccaggccacctgcgccaccaccggtgacggcctctacgagggtctcgactggctctcgagcgctctttcctccaaggcgtaagccaacaactcattcatctaatgatacatatgctctaggcaatgtatgttaggtgttgtagggcaatcagcgactacgactgcctcgactgcctcgaccaaactctcttcctctcttccgtcctgtctctgagctcgaagcattccctcctttcctgtccctctggtgctaatacagtaaaa

SEQ ID NO: 13738 - DNA, 837 bp, Fragaria vesca
ttcaaaaaatgggtatggcaatctctaggatgttgaagatgctgtttgcaaggaaagaaatgagaatactaatggtgggtcttgatgctgctggtaaaaccactatcctctacaagctcaaacttggagaggttgtcactaccatacccacaattgggttcaatgtggaaactgtggaatacaaaaatgtaagcttcactgtctgggatgtaggaggacaggacaagattcggccactttggagacactatttccagaacacgcaggggcttatctttgtggtggatagcaatgacaaagacagagtttcagaagctagagacgagctccatcgaatgctaagcgaggatgaactctccaatgcaacactgcttgtatttgccaacaagcaagatcttccaaatgccatgagtgtttccgagatcactgataagcttggcctccattcactccgccagcgccgctggtacattcaggctgcttgtgccacttccgggcaaggactttatgagggtcttgattggttatccagcaacatctcaagcaaaacatgatacaccaaccacttatgagaccagagtttcttatatatttcagcaaatgtttgattatgtggttgcagttgataaattatacatgtatatgtattgtatgtgtactttttgcatacaggcataattatgtagttgaatattcatacttctgtatgtatcttctctttcagtctttctagtcctctaaacaaaacattacaatgtatgtatgtttattagtagggatatcaatcctgattcatagttaataatttactaaaaatacaaagcatgattagcacaa

SEQ ID NO: 13739 - DNA, 714 bp, Volvox carteri
gcaacaaacaagcagcaaccatgggtatggccttttcgcgcgtgtttgagcgcctcttcggcaagaaggagatgcgcatcctcatggtgggtctcgatgccgccggtaaaaccacgatcctgtacaagctcaagctgggcgaggtggtcaccaccatccctaccatcggtttcaatgtggagacggtggagtacaagaacattagcttcacggtgtgggatgtgggtggtcaggacaagatccgtccgctgtggcgccactactaccagaacacacagggtctgattttcgtggtggactcgaacgatcgcgaccgtgtggacgcggctcgtgacgagctgcaccgcatgctgaacgaggacgagctgcgggactctgtgctgctggtattcgccaataaacaggatctaccgaacgcgatgagcgctgcagagatgacggacaagctgggacttcacggccttcgccaccgccaatggttcatccaggcgtgttgcgcgacgacgggtgacggtctgtacgagggtctggactggctgtcggccactcttcagaagcagaagtaagcttgtcgctcggaaacgttgctggtgctccaacttattgaggtcacttgattgctaatctggcgccaagagagaagaagcgagagttaggggagaaggacaggagaggctcccgccatgtaatagtgcatctattggtttgcaagcc

SEQ ID NO: 13740 - DNA, 708 bp, Actinidia deliciosa
caaaaagaaagcgtctcatcacacctaagatctgcgatcgacatcgcggatcctagccctctgcttttgacacccatccacaaaaatgggtttgtctttcaccaagcttttcagtcggctctttgccaagaaagagatgcgaatacttatggtgggtctcgatgctgcgggtaagaccacaatattgtacaagctcaagctgggagagattgtcacaaccattcctaccattggatttaatgtggagaccgtggaatataaaaacattagcttcactgtttgggatgttggtggtcaagacaagattcgaccattgtggagacactacttccaaaatactcaagggctgatctttgttgttgatagcaatgatcgggaccgtgtcattgaggctagggatgagctgcacaggatgttgaatgaggatgagttgagggatgctgtgctgctggtatttgcaaataagcaagatcttccaaatgccatgaatgctgctgagatcaccgacaagcttggtcttcactccctccgtcaacgccactggtacatacagagcacttgtgctacctctggagagggactgtacgagggtctggactggctctccaaaacatcgctagcaaggcttagaagatggcatgatggttcaaatacttctgggcctgaatgtctaaacagagagacctgatgcgattcttggatcttgga

SEQ ID NO: 13741 - DNA, 836 bp, Fagus grandifolia
atacgcagcaaccatgggcatggcctttttgcgaatcgcgcccgaagagaagcagagagcgaagtccgtagacaacaaagaagcagcaaccatgggcgtggccttttcgcgtgtgtttgagcgcctcttcggcaagaaggagatgcgcatcctcatggtgggtctcgatgccgccggtaaaaccacgatcctgtacaagctcaagctgggcgaggtggtcaccaccatccctaccatcggtttcaatgtggagacggtggagtacaagaacattagcttcacggtgtgggatgtcggtggtcaggacaagatccgcccgctgtggcgccactactaccagaacacacagggtctgattttcgtggtggactcgaacgatcgcgaccgtgtggacgcggcccgtgacgagctgcaccgcatgctgaatgaggacgagcttcgggactctgtgctgttggcgttcgccaacaagcaggatctgccgaacgcggtgagcgctgctgagatgacggacaagctgggactacacggccttcgccaccgccagtggttcatccaggcgtgttgcgcgacgacgggtgacggtctgtacgagggtctggactggctgtcggccacgctccagaaggcaaagtaaacatcacgcgctcgacgtacccaatgcatcgaccggtagttgggagagatatagacgactatatatcatgggtagtaggcgctgctatcactttgcatttcctctttcccgggcccacgtgcatttcgtgtcactcccccagccagtcgtagcaagcagtatcttgtttgcgagcgtgtgaagatcaaacatgccttac

SEQ ID NO: 13742 - DNA, 804 bp, Cannabis sativa
taaacaacaaaacattaaaagaaagaacattggcctctgtccaaaacttgatacaaagttttgaagatgggtttatcgatttctcgattcatgagaatgtttttcgccaagaaagaaatgagaattctgatggttggacttgatgcagctggaaaaacaaccatattatacaagcttaaacttggagaagttgttacaaccattcctacaattgggttcaatgttgaaactgttgaatacaaaaatgtgagctttacagtttgggatgttggaggacaagataagattagaccactatggagacattactttcagaacactcaaggtcttatctttgtagtggatagtaatgacagggaaaggatttcagaagctaaagatgagcttcacagaatgcttaatgaggacgagttgcgctatgcaacgctgttagtgtttgccaacaagcaagacctcccgaacgccatgagcgtttctgaaatcactgataaactaggcttgcattcaatgcgccagagacgctggtacattcaagcagcttgtgcaacagctgggcaaggactctatgaaggtcttgattggctatcaagtaacatttcaaccaaagcataacaacaaaactcatgtaatctcttcttaatctactcaaacaaacaaacaaactatcatatgtccataattatgcattgtaacataaaacaatagtaagtgatcaatcaaacaagaccagagaaacacacactaataaaaattgtaactttcttgtactataatcaatcatcaatcatttccattcattcccac

SEQ ID NO: 13743 - DNA, 1249 bp, Cannabis sativa
tatctcataatattcataaacaacaaaacattaaaagaaagaacattggcctctgttcaaaccttgatacaaagttttgaagatgggtttatcgatttctcgattcatgagaatgtttttcgccaagaaagaaatgagaattctgatggttggacttgatgcagctggaaaaacaaccatattatacaagcttaaacttggagaagttgttacaaccattcctacaattgggttcaatgttgaaactgttgaatacaaaaatgtgagctttacagtttgggatgtaggaggacaagataagattagaccactatggagacattactttcagaacactcaaggtcttatctttgtagtggatagtaatgacagggaaaggatttcagaagctaaagatgagcttcacagaatgcttaatgaggacgagttgcgctatgcaacgctgttagtgtttgccaacaagcaagacctcccgaacgccatgagcgtttctgaaatcactgataaactaggcttgcattcaatgcgccagagacgctggtacattcaagcagcttgtgcaacagctgggcaaggactctatgaaggtcttgactggctatcaagtaacatttcaaccaaagcataacaacaaaactcatgtaatctcttcttaatatactcaaacaaacaaacaaacaaactatcatatgtctataattatgcactgtaacataaaacaatagtaagtgatcaatcaaacaagaccagagaaacacacactaataaaaattgtaactttcttgtactataatcaatcatcaatcatttccattcattcccactagtaaaaatccaatcttttataaatggggttatttaatattattgaagctatgattatccccactttaaaattctgacatgattgttctgttatgaaaaatgtgatatttagctgtatatgatatggtggttggtttttggggagaaagctttattacataatttttgatagacttgactgactgacaagttaaagactctaaaaaccaggtgctcttattttgtgatatgatttataggtgagttcattgatgtctatagattcagtttatgaactttgtccctttttattattgctgctcattaatcttttcaactaaaatttttgtcatcaatcaatattctttttcttctttccagaaagaaacttgtcaccaagtcctaatttttgaaaaaatataaataaaaaactctttttttttat

SEQ ID NO: 13744 - DNA, 1048 bp, Cirsium arvense
gcgggggaacggcaaaacacaattttattagcatgaaacattacaaaatacataatacacacttccaaatacatgttttaaaacactttattcgaattttgatcaaaacaatcttttaaaatcagaacggaaaccaaattcggtgtgatcttttcttcagaattttatttctttcccttttgtggttgtaacgaagcaaaatgggcatggcgatatcacggctgatcaagatgttgtttgcaaagaaggaaatgaggattctgatggtaggactcgatgctgcaggcaaaaccactattctgtacaagcttaaacttggagagattgttaccacaattccgacaatcggttttaatgtggagaatgtcgagtataaggatgttagcttcactgtatgggatgtcggaggtcaagacaagattcgacccctgtggaggcactactttcaaaacacacaagggcttatattcgtggttgacagcaatgatcgagacagaattacagaatccagagatgagcttcaccgcatgctcaatgaggatgcgcttcgtgaagccatagtactcgtgtttgccaataagcaggatctcccaaatgctatgaaggtttctgaactcactgataaacttggcctccattccctacgccatcgtcgttggtacatacaaagtacatgtgcaacatccggtgaaggactatacgaaggccttgattggctctccaacaacatctctacaaagggataagccttgactcatgtgcccacttccataaagttgcttacctactcattgtcttggacaaaaatgtgacatatgtgcaactatttcatatctttgcacaatggttgtattatatgcattaaaaacttgtactttatgttatatcgtaaatagcaagcttgtatattttaaagggtaaaaacgttgtgataatatttggaacccattatcaaaaaagaagagagagagtgagtgagtaacagaaagaacatatagggagaagtgaaagagaagcacataaagcaagcaggcaactttgaatcaac

SEQ ID NO: 13745 - DNA, 739 bp, Cleome spinosa
actactttttgctcattttgcatctccacttgaagagagatgggcatggcaatatcaagaatgttaagatctttatttgcaaagaaagagatgaggatactaatggtgggtcttgatgctgcgggcaaaaccaccatcctttacaagctcaagctcggagagattgtcaccaccatccccactattgggtttaatgtagagactgttgagtacaaaaacgtgagcttcaccgtttgggatgttggaggtcaagacaagattcgaccgttgtggagacactacttccaaaacacacaaggcctaatatatgtggtggatagcaacgacagagagagaatccacgaagcaagggacgaactccataggatgctcagtgaggaggaactacgagaggcaacagtacttgtgtttgcgaacaagcaagatttgccaaatgcgatgacggtgtcggagatcacagataaactcggccttcattccctccgtctacgccgttggtatattcaggctacatgtgcaacctcgggccaaggactctacgagggacttgactggttgtcgagcaatatcacaagcaagacttgagaatatccaaattcacaagtattggatatcccttcctttctatctcctcatgggtttgtatgtgtggaaaaccaaagctatgctttgctgtattattattattattattaacaaataatgatgccttttattttcagtatttagggtataaaag

SEQ ID NO: 13746 - DNA, 929 bp, Cucurbita pepo
cgactcaacttttcatttgggtttgctcttcttcctcttctcgctttccaagcgcaagaattcttcgtcgcacaggtagttcatattagtcagttaattttgtggtctgaaatcttgatcggcaaccatgggaatggcaatatctcggcttgtaaggatgctgtttgcaaagaaagaaatgaggattttaatggtgggtcttgatgcttctggaaaaacaaccattttgtataagttgaagcttggagagattgtcaccaccatacccaccatcggttttaatgtcgaaacggttgagtacaagaatgttagctttacagtgtgggatgttggaggccaagataagatcagacctctatggaggcactattttcagaacacgcatggtcttatcttcgtggtggatagcaatgacaaagataggatatcagaagccagggatgagcttcacaggatgctcagtgagcatgaacttgttgatgcaactgtgctggtgtttgccaacaagcaagaccttccaaatgctatgactgttgctgaaatcactgataaacttggccttcactcacttcgacatcgtcgctggtacatccaggccacttgtgccacttcaggccaaggactgtatgaaggtcttgattggctgtctagcaatatctcaaacaaggtctaatcccagttgttttgatgaacaccttgtgggaaagctctttaaattaaaccagaaggaacctaaatatgtacctgaaagacctgtgcactctgatctgcagtgttgaattctcacgttttcgtgtatagtttcggtttgagatccaagaaagatatgtacaaaagcagtgatggaagaaccccatgccatgtgaacgataataaagacaaattaaaaataaatgttattttataaatgtgggtcttgttgctccacc

SEQ ID NO: 13747 - DNA, 806 bp, Guizotia abyssinica
ggaccaaaccaagcttcatatcacgagaaaatgggcatggcaatatcgcgtttggtgaaaatgttgttcgcgaagaaggaaatgaggattctgatggttggtctcgacgctgcaggcaaaacaaccgttctttataagcttaaactcggggagattgttactaccatcccaacaattggttttaatgtcgagaccgtggattacaaggatgttagcttcacagtatgggatgttggaggacaagacaagatccggcccttgtggagacactactttcaaaacacgcaagggcttatatacgtgattgatagcaatgatcgagataggattactgaagcgagagatgagcttcaccgcatgctcaacgaggatgcacttcgtgaggccacgatacttgtgtttgcaaataagcaagatcttccaaatgcaatgaagatttctgaaatcactgataaactaggacttcattcccttcgaaatcgacgatggtatatacaaagtacatgcgcaacatcaggcgaagggctatacgaaggtcttgattggctctcgagcaatatatcgaccaaggtataagagacctcactgtgatgcaaagacagctgctctgcaccttttcataaacgtgcttactatgtaatatatatgtgtgtgtaaatatatacacacactatggttgtattatatgcacaactatgctttatgcattgtatatctaagaaaacacccatttcattttatttctataaaatggtaccacatccattttataaaaactagccttatactcgcggcaagctctggcg

SEQ ID NO: 13748 - DNA, 936 bp, Cajanus cajan
agaattaagttaattttgttttcattttcctcagttttattaaaaggttgttttttcagctaaaattttggaggcaacgatgggtttgtcggtgtcacggctagtgagactgttttatgcgaagaaagaaattaggattttgatggtgggtcttgatgcagctgggaaaacaacgatactgtacaagctgaaactcggagaaatcgttactacaatacccacaatagggttcaatgtggagactgttgagtatagaaatgccagcttcaccgtctgggatgtgggagggcaggacaagattcgaccattgtggagacactactttcagaatacacaaggacttatctttgtggtagatagtaacgatagagaaagaattttagaagccagagatgagttgcatagaatgctgagtgaggatgaacttcgtgatgctacaatactggtgtttgccaataagcaagaccttccaaatgctttaagtgtggcagaaattacagataaacttggtttacattcacttcgcctgcgtcgctggtacatccagccaacatgtgccacatccgggcaaggactctatgaagggctagattggttatccagtaacatatctaacaaagcatgatgaaccaagctctgcatgcatttctcatcttcttcgatatgaatgccgagactattataatatgtataatatcttgtttgtttataggcataaatatatatgatgttatctgttatttgaactctgaatgaagtacctataaatcaagcactacgataaatgtaaccgtgcgaggcatgtaagaacataaattctgagtactatgctttgtacaccccactgaagtattaaagaatatcaatatcatttgtatagagtagcagatgtagaaatgattatggtccacctacattccccaatgaaactagctt

SEQ ID NO: 13749 - DNA, 496 bp, Pseudotsuga menziesii
cgaagcttttcgataagctatggggcaagaaggagatgcgcattctgatggtcggtctcgacgccgccggaaagaccacaattctctacaagctcaagctcggtgaaatcgtcaccaccatccccaccattggtttcaacgtcgagacagtcgagtacaagaacatctccttcaccgtgtgggatgtcggaggccaggacaagatccgtcctctctggaggcattacttccagaacacccagggtatcatcttcgtcgtcgacagcaacgatcgcgatcgtgttgttgaggcccgcgaggagctccagaggatgttgaacgaggacgagctgagggacgctctcctccttgtcttcgccaacaagcaggatttgcctaacgccatgaacgctgccgagatcaccgacaagcttggtcttcacagcctccgacaacgcgcttggtacatccagtcgacctgcgctacatcgggtgacggtctgtacgagggtctcga

SEQ ID NO: 13750 - DNA, 679 bp, Carthamus tinctorius
gcggggacttattcgagttttgggcgaaaacatctttcaagtaaatcatcacaaaaaccgtattcgttgtgacttgtgatatcttcttttagtatttctactttttcttctttcagtttcttggtagtagagaagcaaaatggggatggcgatatcaaggttgatcaagatgttgtttgtaaagaaggaaatgaggattttgatggtaggactcgatgctgcaggcaaaaccaccattttgtacaagcttaaacttggagagattgttaccaccattccaacaattggttttaatgtggggactgtcgaatacaaggatgttagcttcactgtctgggatgtcggaggacaagacaagattcgacccctgtggaggcactactttcaaaacacacaagggcttattttcgtggttgacagcaacgatcgagacagaattacagaagctagagatgagcttcaccgcatgctcaacgaggatgcgcttcgcgaagccacaatactcgtgtttgccaataaacaagacctcccgaatgcaatgaaagtttctgaactcactgataaacttggcctccattccctacgccatcgtcgttggtatatacagagtacatgtgcaacatcaggtgaaggactatacgaaggtcttgattggttgtccaacaacatctctactaag

SEQ ID NO: 13751 - DNA, 1103 bp, Panicum virgatum
ggaactggctgggccgatcaacccaaccgttcggctgcacaagcccagccgaacggctgatcagctcacgtggatgccgcagcccccagttcccatccagcaggcttttttgttgttggtgtcatttacttcaatttccagcaggctgaatcagccagtttgaaccgactagaaatttctgatggtcctgtagcggctgaatggctggcgcctccagcccagccaaaaaccaccatccgaacaggctgaaaaaccggtcggtgctgcggcgccacacgccacggaaaaaaagaaccgaattagaccggtcggtgattcagcgtagaattttatttttctttcatcaaatcaaaagaaagaaaagattttcagcgtggatcatcgcttggaccaatcccagccatccgttccggatcctgcagcaaccaggaagcactccccctcttcctccccactaccatccccgccagccggcacgaagcgcggcgttaatatctccacccctcccggctcctcccctccccccatcctcctcctcaggtcttccccctcctcccccgatccccaaatcctccggatttcgcactcagccgcggcgcaggtggtgaagggaggcagagaggggaaacatggggctcgcgttcgggaagctcttcagccggctcttcgccaagaaggagatgcggatcctcatggtcggcctcgacgccgccggtaaaaccaccatcctctacaagctcaagctcggcgagatcgtcaccaccatccccaccatcggtttcaatgttgagaccgttgagtacaagaacattagcttcaccgtctgggatgtcgggggtcaggacaagatcagacccctctggaggcattacttccagaacacacagggtcttatctttgttgtggacagcaacgaccgtgaccgtgttgttgaagccagagatgagctccacaggatgctgaacgaggatgagctacgtgatgctgtgctgcttgtttttgccaacaagcaagatcttcccaacgctatgaatgctgctgagatcaccgacaagcttggattacactccctgcgccagcgacactggtaagaaataaaatga

SEQ ID NO: 13752 - DNA, 806 bp, Valeriana officinalis
ttgtgagttaacattatttttggaattaagaatggggatggcgatatcaagaatggtaaaagcaatgtttgcgaagaaagaaatgaggattttgatggtgggtcttgacgctgccggaaaaacaactattctctacaagcttaaacttggcgaaatcgtttccactattcctaccatcggttttaatgtggaaactgtggaatacaagaatgtgagcttcacagtttgggatgtaggaggtcaagacaagattcgaccgctatggaggcactattttcagaatacacaaggacttatctacgttgtcgacagtaatgatagggatagaatttcagaagctcgagatgagcttcatcgcatgcttaacgaggatgcattgcgtgattcaactctcctcatatttgcaaacaaacaagatcttccgaattctatgtctgtatcagagatcactgataaactctccttgcattctctacgtcaacgccgctggtacatacagagtacttgtgcaactgctggtcaagggctttatgaaggtctagattggctctcaagcaatatttctacaaaggcataatgtaaaaaggaaatctgctatggaaattttatattttggcaactattttatgtatgttgaaaattctcaatttaatatccctttgaatagttttggtgcattatttgaatctgagagtaaaattgaaataaataagagtgagagtctttataaatgaagatgaacataatatatgagtcaatctcagtcaactgatgttatatatttaattcttagatttgtaaatagt

SEQ ID NO: 13753 - DNA, 1491 bp, Cocos nucifera
cgcaaagcaagaataaagcactcggtatcaattccacctttattccttatctcttcagaatcctgtgccttttcttcgggccacgcctctcatgaggctcatattactggcatttcttcctctcagtcgcccggccttctgcggtttgtctgagatctcgcagattcagcttagagttccatcgatccttctgctgctgcgatgggtctggcgatctcgaggctggtgaagatgctgtttgcgaagcgggagatgaggatactgatggtgggacttgatgctgctgggaagacaacaattttgtacaaactgaagcttggagaggtcatcaccaccatccccactatcggttttaatgtggagactgtagagtacaagaatgtcagcttcactgtatgggatgttgggggccaagataagattcgacctttatggaggcactactttcagaatacccagggactcatatttgtagttgacagcaatgatagagaacgtattttagaagctagaaatgagctgcatcggatgttgggtgaggatgaactacaaggtgctacactgcttgtgttcgccaataagcaagaccttccaaatgcgatgactgtatctgaaattactgataagcttggcttacatgcacttcgccagcgccgttggtatatccagagcgcatgtgccaccacaggggatggactatatgaaggccttgattggctgtcgagtaatatatccaataagacaagataatccgtttcttctattagtatgacgttgatcaggtgtttctaccgcctgttgttgtgattttctatggccatacggggtgaagataacttttgtattgacatgaacagcttatttttgttcttgtttgcatacgaagctaccttatggtgtgttatttggcagctctccgtgatagacaataatacaaaggtgtttgcgtacatagatctttatgtgacggataataataacaaaggatatagtgttgacagaatgggaggtgttataacagatattcttctccctgcctatcagccagaggaacctgttctcagaaaaatagtgggtattcgttgtgtgctatctgcagcatggatgcgacaagcagccgtttatggacatccttggaacggtgtatgttggtatgcagtgtatatggttcctaaagctggaattccaggacgaccaggcaaatccatataaacaatggtatgttcaattttaatctattccgtctcaaaaaattttgcatttgaaagatccacagccttcacgtcccttctaggcttccggctttcttgtgtcagaaagcttcgtggaatctgtttaaacagctcaagtctgccttaacattaggtggagctgagcttaaacttggaagttagtctttaagttggaaactgataactgaaccgagtttggtttggcttattccatctcagcttcactgcatgcttgtttgggggagcagcaacatatcag

SEQ ID NO: 13754 - DNA, 1010 bp, Chrysanthemum coronarium
gattcgaagaataccaagttctatatattgcttagctcaaaatctgtaacagttttatagtataacctgaacaaaaactaaaatctttgagtagtattactttttgctgtctttcaattttttggttgtatcaagacaagatgggcatggctatatcacggatggtgagaatgttgtttgcaaagaaagaaatgaggatcctcatggttggactcgatgctgctggaaaaaccacaattctttacaagcttaaacttggagagatagttactaccatcccaacaatcggttttaatgtggagaccgtggagtataaggatgttagtttaacggtatgggatgtaggaggacaagacaagatccgacccttatggaggcactactttcaaaacactcaagggcttatttatgttattgatagcaacgaccgggatagaattatagaagctagggatgagcttcaccgcatgcttaacgaggacgctcttcgtgaggccacaatactcatatttgccaataaacaagatcttcctaatgctatgagagtttctgaaatcactgataaacttggtctccattctctacgcaatcgccgttggtatatacaaagtacatgtgcaacttctggcgaaggactctacgaaggccttgattggctctctagcaatatatctactaagtgagtagtcctcagtcatcactagtcatgaaatgcaaagccaaagacaacaaaactcagagccccctcctctgccccattcatacagtggctttactaggctactagtactattgtatgttgttcagaaagtatgtaccataatatcttcattatgctggtattttatgcatcaaaacttgttactacacaagtttctaccacatatatatatcctatatctatctcttgggaaacatttatggtttatgttatgcaactaatgtcctgtttatatatgtggttggttatttaactgaatgcagcaagtattgttactacaagattcctt

SEQ ID NO: 13755 - DNA, 567 bp, Cucumis sativus
ccatattacgcgtcgctctgaaggtccatttctcttgctctcttcatacccttcaatacacctctgtgcagctctcagaggaacttccgcgttacgaacagagatggggctcaccttcggaaagctcttcagtcggctgtttgctaaaaaagagatgagaattctgatggttggtcttgatgccgctggtaagacgaccattctctataaactcaagcttggagagatcgttacaactattcctaccatcgggtttaacgtggagactgtggaatataagaacatcagcttcactgtctgggatgtcggtggtcaggacaaaattcgtccattgtggaggcactatttccagaacactcaaggtcttatatttgtggtggacagtaacgatagagaccgtgttgttgaggcaagagatgagttgcatagaatgttgaatgaggatgagcttcgagatgcagtactactagtgtttgctaataaacaagatcttcccaatgcaatgaatgccgctgagattacagacaagcttggtcttcactctcttcggcagcgccactggtaatc

SEQ ID NO: 13756 - DNA, 633 bp, Panax ginseng
ctgatagacagagcggttttttggaacgacagctccatttagagatctctgcattctaacgctcccatcgcgcacctcatcctcaatatagagatggggctgtcttttaccaagcttttcagtcgcctatttgctaagacagaaatgcgcattctaatggttggtctcgatgccgctggtaaaaccacaattttgtacaagctcaagttgggtgaaattgtcaccactatccctacaattggctttaatgtggagactgttgaatacaagaacattagcttcactgtgtgggatgttggtggtcaagacaagatccgacctttgtggaggcactatttccaaaacacacaagggctcatctttgttgttgacagcaatgatcgagaccgtgtggtcgaggctagagatgaactgcacaggatgttgaatgaggatgaactgagagatgctgtactccttgtgtttgcaaacaagcaggatcttccaaatgccatgaatgctgctgagatcactgacaagcttggtttgcattctcttcgacaacgacagttgggtatattccaggacgctaacattcgacggccacgagtccgcggacgaaggtcgatacggacggtacggagtagtgatcgc

SEQ ID NO: 13757 - DNA, 753 bp, Raphanus sativus
gggcaggccattggcatcagagagacagagagagcttggatctcgcgcggcgttggcttttcggtttgtgattaaaaaaaaaaagaaaggatgggggtatcattcgggaagctgttcagcaggctttttgccaagaaggagatgcgtattctcgtcactaccattcctaccattggtttcaatgttgagactgtggaatacaagaacattagctttaccgtttgggatgttgggggtcaggacaagatccgtccattgtggaggcactacttccagaacacgcagggacttatttttgttgttgacagcaacgatcgtgaccgtgttgttgaagccagggacgagcttcacaggatgctcaacgaggatgaattgagggatgcagttttgcttgtttttgctaacaagcaagattttcccaacgcaatgaacgctgctgagatcactgacaagcttggccttcactctttccgccagcgacactggtacattcagagcacatgtgccacctctggagaaggactttacgagggacttgactggctttccaacaacatcgctaacaaggggtagaaagcaggtagcaggatccgtctttgcttgttttgttttatacatcaaggtgaggggcctctttctagcactacaaaacgaaaccaagtttttttttgttatgtcatacatttttcttttgtctgttgtttttcaacaattagcattttctttcaataaataataaggtttttttttttt

SEQ ID NO: 13758 - DNA, 590 bp, Sesamum indicum
aaaaaaaaaaaaaccgtagttaataaactctcgcgttattctcaagcagctccatatttctctgtacacgctctcttctaatccgccagatctatcgttctcggggatctaaagcaagcaagagaaatggggctgacattcacaaaactgtttagccggctttttgccaagaaagagatgcgcattctgatggttggtcttgatgctgctggtaagaccaccattctgtacaagctcaagcttggagagattgtcactactattcctaccattggtttcaatgtcgagactgttgagtacaagaacattagcttcactgtctgggatgttggtggtcaggacaagatccgcccattatggaggcactacttccagaacactcagggtctaatatttgtggtggatagcaatgacagggaccgtgttgttgaggcaagggatgaattgcatagaatgttgaatgaggatgagctgagagatgcagtattacttgtatttgcaaacaagcaagatcttcctaatgcaatgaatgctgctgagattacggacaagcttggcctgcactctctcaggcaacgccactggtacat

SEQ ID NO: 13759 - DNA, 717 bp, Silene vulgaris
aaggtagaaatgggagcaatgttgtcaaagttagtgaagatgatgtttgcaaagaaagagatgagaatactaatggtgggtcttgacgccgccggtaaaaccaccattttatacaagctcaaacttggtgaagttgtcaccaccatccctactatagggtttaatgtggaaaccgtcgagtacaagaatgttagcttcaccgtttgggatgtcgggggccaagacaagattagaccattgtggaggttctacttccaaaatacacaaggccttatctttgtaatcgatagcaatgaccgggacagggtcattgaagcaagggatgaactccataagatgcttagtgaggatgaacttaaggatgcaacagttctagtgtttgcaaataagcaagatcttcctaatgcaatgactgttgctgagattactgataaacttggcctcaattcccttcgtcatcgtcgctggtacatacaatctgcttgtgctccttctggtgaagggctgtatgaaggcttggattggctttctagcagtatttccaaggtttgatgtgctgatatatacccgcggtaacttgaaccgtcaatccgtcaggccagggccttgttgcatcttattagacaattgaactattaatttctagtaatggttgcttaatttgaaatgatatacgtactgtcaatgtaatatatagagtgattatattatagaccg

SEQ ID NO: 13760 - DNA, 791 bp, Spinacia oleracea
aaagaaagaaaaacaaagatgggggcaacgctatcaagattgataaaaatgatgtttgcgaagaaagaaatgaggatattaatggtaggtcttgatgctgctggcaaaaccaccattctttacaagctcaaacttggtgaagttgtcactaccatcccaactattgggtttaacgtggaaaccgtggactacaaaaatgtagggttcactgtttgggatgttggtggccaagacaagatcaggcctttgtggaggtactactaccagaacacacaaggtcttatcttcacggtggacagtaacgacagggagaggattgctgaagctagagacgagctccaccggatgctaaatgaggatgagctaagggatgcaactcttttagtgtttgccaacaagcaagaccttccaaatgcaatgactgttgctgagattactgataaacttggcctccactccctccgccagcgacgatggtatatacaagcggcttgtgctacctcgggtgaaggactctatgaaggtctagactggctttcgagcaatatatcgatcaagccttgatgatgttatgatgcctgcaagcaagagagttaggagcattgttacccaattataaatacatatatgttggacttttcgatcattgtagaaaaaatgagtgttcattattggtgtattgtgttgctaaccatcatgagtactacgtacgaagcactacgtatgtttttatgtaatcttgctatgcatccgaaaaaagtaactagattggaaacattatacggagtatg

SEQ ID NO: 13761 - DNA, 707 bp, Arachis hypogaea
tcaagagtagttaaaaatggggctgaacagcttcgtgaaagtcagccggctcttcgccaagaaagagatgcgtattctcatggttggacttgacgctgctggtaagaccaccattctctacaagctcaagcttggagagatcgtcaccaccattcccaccattgggttcaatgtggaaactgtggaatacaagaacatcagcttcactgtctgggatgttggaggccaagacaagatccgtccattgtggagacattacttccaaaacacacaagggcttatttttgtggttgacagcaatgacagggaccgtgttgttgaagcaagagatgagctacataggatgttgaatgaggatgagttgagggatgccgtgcttctagtttttgctaacaaacaagatcttccaaatgctatgaatgctgctgagataactgataagcttggtcttcattctctccgtcagcgtcattggtatatccagagcacatgtgctacctctggtgaagggctttacgaaggacttgactggctctccaacagaggtagcacatgtgctacctctggtgaagggctttacgaaggacttgactggctctccaacaatattgcaaacaaggcatagagttctaccagttatcatgaaggactccagtcagtggttacggtctcgcatatctgattttctgtccgttcctttagatttt

SEQ ID NO: 13762 - DNA, 1700 bp, Glycine max
aaaaggctgattcttcaaattccttctttcatctcccttaacttcgccataaaatatccaaattaacaaaacaggtattaaaaaagtagtgggttgtgcttttgctttgcgtctccgcagcatgaagtgaaaattgttttgctacatattcgattgctttggtttgacgctaatgtaacttctgtaccgtgcgatccgaatcttacataagggacaagaaaattcatatcacatcacatgatcacttttgcatggaggagtgtgagaaaatcataatttcctttttattttttcatgaacaaatgttagtagttaattgttaatattttataaaaaaaaaatacttttttcttctatctttttttacttttatcaccaaatcaatcttataaccctctaattccctttttattgcccatgttttcaaatggcatgcccatcaatcattttattctctcagcaatcaacatgtgaatcctattctcactttctattagtgcagtattgatgcctggtgttattttctggttacatgtaccaacaacagattcagttttaagtttcccctgcttctcaacaaaaaaattacattttttcagcttaaatattggttgaaccagaggcaacaatgggtttgacggtgtcacggctattgagattgttttatgcaaggaaagaaatgaggattctgatggtgggtcttgatgctgctgggaaaacaacaatactctacaaactgaaacttggagaaatcgtcactacaatacccacaataggcttcaatgtggagactgttgagtacaaaaatgtcagcttcaccgtctgggatgttggaggacaggacaagattcgaccattgtggagacactacttccagaatacacaaggtcttatctttgtggtagatagtaacgatagggaaagaattttagaagccagggatgagttacatagaatgttgagtgaggatgaacttcgtgacgctacagtattggtatttgccaataagcaagatcttccaaatgctttaagtgttgcggaaattacagataaactcggtttacattcactccgcctgcgtcgctggtacatccagccaacttgtgctacgtccggccaaggactctatgaggggctagattggttatctagtcacataactaacaagacaagatgaaccaagctctgattgcgtttctgatcttcgattgaatactgagactgttatatatattatgtacaatatctcgtttgtttataggcataaatgagtggtatctgttatttgaagtttgaaccatctataaaaatatcaataactatgatataagtatataaactctgaggagtattatgtacacgttacaccccgctttcagtatttaataatattaagagaaatgttaccagtatattctttaacatgctattttgaacacattattttttattaattattgaaaatcataaatttatgtgggtgttacctctcatttaatgtctctctcctcatttctttagtttttaataacttttaatcaatagaaaaatatgtgataagaggagtgtgccgctagtacttctttattattaaatggttcatgtatgtatagagcagcaaatgtatactactctagtgtaaaaggcaagcatgaaaaattatgacaatgtaattaagaaaaaaacaagaaacttatatt

SEQ ID NO: 13763 - DNA, 545 bp, Chrysanthemum coronarium
gtgaaggacagcttctctcttgtgtgcaagagagagatctatcattctatttggggccgatctcttcaattcctttacttgaaaaatggggctgtctttcaccaagcttttcagccggctctttgccaagaaggagatgcgtattctcatggtgggtcttgacgcagctggtaagaccacgatcctttacaagctcaagctcggagaaatagtcacaactattcctacaattggatttaatgtggagactgtggaatataagaacatcagcttcaccgtatgggatgttggtggccaggacaaaattcgtccactgtggaggcattacttccaaaacacacagggtcttatatttgttgtggatagcaatgacagagatcgtgttgtcgaagcaagagatgaattgcacagaatgttgaatgaggatgaactgagagatgctgtgttgctcgtatttgccaacaagcaagaccttcctaatgcaatgaatgctgctgaaataaccgacaagcttggtcttcattcactccgtcaacgccactggc

SEQ ID NO: 13764 - DNA, 873 bp, Citrus clementina
  Sequence also found in Organisms: Citrus sinensis
tctctaatttgcttccctatagttctcagttctctagagttacaggtcgcagctcataatttcttcttcaattttcaagagaaacaatgggtatggtaatatcaagactgaaaatgctgtttgcgaggaaagaaatgaggattttaatggtgggtcttgatgctgctggaaaaacaaccattctttacaagctcaaacttggagagattgttactaccatacccacaattggattcaatgtggaaactgttgagtacaaaaatgtaagcttcacggtgtgggatgtaggagggcaggataagataagaccattgtggcgacactactttcaaaacacacatggtctgatattcgtggtcgatagtaatgatcgagaaagaattggggaagccaaagatgaactgcatagaatgctgagcgaggatgagctgcgtgaggccgtattgcttgtatttgctaacaagcaggatctcccaaatgccatgagtgtttcagaagtcactgacaaacttggcctgcactcacttcgccaacgtcgctggtatatccaggcagcttgtgccacctctggtcaaggactttatgagggtcttgattggctctctagcaatgtctctgccaagggttaattcttcgtcatgaaattgaaagctttggtttcctgctgtctgctacttgtcttgtcgattgagaagaacaaacttcacacgctattagaagaaaaccattaaacttctgttctatgaacatgaatgacttgaacttcatgtactctttgagacattgatcagtaattcagtacttcgtcactctctttctatgataccatttcttggtgtaattcttcaatatgaaaagaatgattttcatgtt

SEQ ID NO: 13765 - DNA, 771 bp, Flaveria ramosissima
atacattttaaagacatcatattcaacataaccaagttttgaagtaaaccacaaccaaacttatttgtttcagttactcaatcacatcgatcaaggatgggcatggctatatcgcgattggtgaaaatgttgtttgctaaaaaggaaatgaggattttgatggtaggactcgacgctgcaggcaaaaccactattctttacaagcttaaacttggagagatcgttactaccatcccaacaatcggttttaatgttgagactctggagtacaaagatgttagctttactgtctgggatgtaggaggacaagacaagatccgacccttgtggagacactactttcaaaacacgcaagggctgatatttgtgattgatagtaatgatcgagaaaggattatagaagctagagatgagcttcaccgcatgctcgacgaggatgcacttcgtgaggccacaatactcgtgtttgcaaataaacaagatcttccaaatgcaatgaaggtttctgaaatcacagataaactggggcttcattccctacgcaatcgtcgttggtatgtacagagtacatgtgcaacatctggtgatgggctatacgaaggtcttgattggctctccagcaatatatctaccaagggataagagccatcagtcatcactgtattgcaaagacagccttccacatacatgcttacctacttattttctttaagtatgtaaaatatatctactcacattgtgattgtattctatgtatcaaaactgcatttt

SEQ ID NO: 13766 - DNA, 799 bp, Lactuca sativa
gtggaaaataagataaagatgatttttaagaattcttagaaatgtagtttttgttgtttgggaactgatgtggttgttcttttggtatttggggtgatggaaagggcagtttgggtattaaaggggaaaatttgttgatggtcactcatctccgttgacgcgtcacacctccttattttacgagcctctctttctacctctcctctccctccctcacttttagatcgatcgatcgctctccacaaaccttctctctcagcctcagggatcctcatcagataaaagatggggcttacattcaccaaactcttcagccggttgtttgccaagaaagagatgcgtatattgatggtgggtctcgatgcagctggtaagaccaccattttgtacaagctcaagcttggcgagattgtcacaacaatccctaccattggatttaatgtggagactgttgagtacaaaaacataagcttcacagtttgggatgtggggggtcaagacaagattcgtccactatggaggcactatttccagaacacacagggtcttatctttgtggttgacagcaatgacagggatagagttgttgaggcaagagatgagttgcacaggatgttgaatgaagatgagctaagagatgcagttctccttgtatttgctaacaaacaagatctgccaaatgcaatgaatgctgctgaaatcactgataagcttggcctccactccctccgacaacgccactggtaaataaattgcaacatcttattattattatagagtctaaaatcaaatatgctct

SEQ ID NO: 13767 - DNA, 572 bp, Glycyrrhiza uralensis
gacttttctgaaaacaccaaaaccaaacacaaggaggagagataagagatctcctctcccatttcgtccagaaaaattacttttttccccaaatctcaaagaatagttgaaaatgggtctgtctttcacgaagctattcagccggttatttgcgaagaaggagatgcgtatacttatggtgggtctcgatgctgccggtaaaaccaccattctctacaagctcaagctcggagagattgtcaccaccatccccaccattgggtttaatgtggaaactgtggaatataagaacatcagcttcactgtctgggatgttggtggccaggacaagatccgtcctttgtggagacattacttccaaaatacacaaggtcttattttcgtggttgatagcaatgatcgagatcgtgttgttgaagctagggatgagctgcacaggatgttaaatgaggatgaattgagagatgctgtgcttctagtttttgcaaacaagcaagatcttccaaatgctatgaatgctgctgaaataactgataagcttggtcttcattcacttcgtcagcgtcactggt

SEQ ID NO: 13768 - DNA, 582 bp, Lolium multiflorum
ccgtgcccttccttctccggctcctacgccggcgaacccaccgcggatccagtgattcctccgatcaggagaggcgaggcgggaggacgagagtactacctgcgcgggaggagacgagatggggctcacgttcaccaagctgttcagccgcctgttcgccaagaaggagatgcggatcctgatggtgggtctcgacgccgtcggaaagaccacaatcctctacaagctcaagctcggcgagatcgtcaccaccatccccaccatcggattcaatgttgaaactgtggagtacaagaacatcagcttcactgtctgggatgtcgggggtcaggacaagatcagacctctgtggaggcattacttccagaacacgcagggtcttatcttcgttgtggacagcaatgatagggaccgtgttgttgaagccagggatgagctccacaggatgctgaatgaggatgaattacgtgatgctgtgttgcttgtgtttgctaacaagcaagatcttccaaatgctatgaatgctgctgagattactgataagcttgggctgcactcccttcgccagagacactggtacct

SEQ ID NO: 13769 - DNA, 652 bp, Quercus alba
gacaactcgtatcgacatatcaacccaccacccggcgccgaccactacaactccatcgccgcactgcgcaccgacgccagaggcccaaacgatcaggcccccttatcaagcatcccacttcggcatcctcgtgttgattgacctcagactgctaccatgggtctcacattttccaagctcttcgaccggctctgggggaagaaggagatgagaatcttgatggttggcctggacgcggccggaaagacgacaattctctacaagttaaagctcggtgaaatcgtcaccaccatccccaccatcggtttcaacgtcgagactgtcgagtacaagaacatccagttcaccgtctgggatgtcggtggacaggacaagatccgacctctgtggagacattacttccagaacacccagggcatcattttcgtggtcgacagcaacgatcgagaccgtattgtcgaggctcgggaggagctccagcgcatgctcaacgaggatgagctgcgggatgccatcctcctggtcttcgccaacaagcaggatttgcccaacgccatgaacgcggccgagatcacagacaagcttggtctccacagcttgagacaacgcgcctggtacatccaatccacctgcgctacgtcgggcgacggtc

SEQ ID NO: 13770 - DNA, 752 bp, Helianthus annuus
catcacacattttaaacttttgattcgaccaaaccaactttcgtatcgagagaaaatgggcatggcaatatcacgattagtgaaaatgttgtttgccaagaaggaaatgaggattctgatggtaggacttgacgccgcaggcaaaaccaccattctttacaagcttaaacttggcgagattgttactaccatcccaacgatcggttttaatgtcgagaccgtggaatacaaggatgttagctttacggtatgggatgttggaggacaagacaagattcgacccttgtggcgacactattttcaaaacacgcaagggcttatatttgtgattgatagcaacgaccgagaaaggattacagaagctagagatgagcttcaccgcatgatccatgaggatgcacttcgtgaagccacgatactagtgttcgcaaataaacaagatcttccgaacgcgatgaaggtttctgaaatcacggatagactcggactccactccctacgaaatcgtcgttggtatatacagagtacatgtgcaacatctggcgaagggctatacgaaggtcttgattggttgtcgaccaatatatcggccaagggataagagtcttcaggcatcactataatgcaaagacagttcctctgtacccttccataaacatgcttacctcctcattttcttttagtttgtaactatatatacatatatataatgtacacacatgtgtgtatgtatattaaacatccttaaaact

SEQ ID NO: 13771 - DNA, 1028 bp, Triticum aestivum
gcggatcgagcgattcccccgatcaggagaggcgagccgggaggaagagcacctacgcgggaggagaggagatggggctcacgttcaccaagctgttcagccgcctgttcgccaagaaggagatgcggatcctgatggtgggtctcgacgccgccggaaagaccaccatcctctacaagctcaagctcggcgagatcgtcaccaccatccccaccatcgggttcaatgttgaaactgtggagtacaagaacatcagcttcactgtctgggatgtcgggggtcaggacaagatcaggccactgtggaggcattacttccagaacacacagggtctcatctttgttgtggacagcaacgatagggaccgtgttgttgaagcaagggatgagctccacaggatgctgaatgaggatgagttacgtgatgctgtgctgcttgtgtttgctaacaagcaagatcttccaaatgccatgaatgctgctgagatcactgataagcttggcctgcactcccttcgccagcgacactggtagccatgcgcagacttcccttgcttgtcttttctgtaatttaagatatatatgatcgtcatccttgtcgttataactggctcatttgccccaaccaacacatataataattttacagtacttgtgtgaagaaaatgaaattgatctgctgccctttggctttgtaatgcatgttggtgctcttatatttctttacggagggagtaataaattgttgttgttgttgcttgcaggtacatccagagcacttgtgctacaacaggggagggactgtatgaaggcctggactggctgtccagcaacattgccagcaagccctaaattttcgtcaagattttgaaggagctaggagcgctttggatggacgattgaatcaccgggtacctagggattgtgttgggatgggatggtgctatgctattcccgtatgtactgtgtattttcctgagatcaacagttactgagccagctccggctgtggtttcactgtcatactat

SEQ ID NO: 13772 - DNA, 597 bp, Solanum phureja
tgaacaagtagaagttcattttagagcaatgggtatgtcaatttccaagtttgtaaaaatgttatttgcaaagaaagagatgagaatattaatggtaggactcgatgcggctggcaaaacaaccatcttgtacaagttaaaactcggggaaattgtcactaccatacctactattggatttaacgtggagacagtggagtacaagaattccagcttcacagtatgggatgtgggtggacaagataagatccggcctctatggaggcactattttcagaacacacagggtctaatatttgttgtagacagtaatgatcgagatcgaatttcagaagccagagatgagctacatcgcatgcttaatgaggaagaattacgaggcgctacaattcttgtattcgcaaataaacaagaccttccaaatgctatgaatgttgcagatatcaccgataaacttggcctgcattcactccgacaacgacgctggtacattcagagtgcttgtgcaacatctggacagggactttatgaaggtcttgattggttatcacataatatcactggcaaggcaagaacattatggccttttcacctcct

SEQ ID NO: 13773 - DNA, 2037 bp, Amborella trichopoda
agggtgtgggtgccaccaccgcggccgtagcccgtttccgaagtctctgtcttttaaacctcaccgtctgcaccgaccgggaaagttggaaagtgcaggccccgggatcgtttctttatgcagcagtacctattgaacttggacaaatggaagaaagaagggcatgctgctctgcctttattccttagaatcttgttctcatctccttttatctacaattctctatccccttagaatcttgttctcatctccttttatctacaattctctatcccctcctttattcccctctcactttcaaatggaagctgtcttcaggagtccacgtttccctcctccatgctctctcatcttctgctctgctttgttttttcttcttggcttctcttcattaggtaaacatctctctctccattaacacactctgctagctgtgtcacactctcttactgccctcttctttgctgtcttcattgttgggctcttcttgctctttctttttctgtgctttttttttttgtttgggaattagtcatattgtcctttgtggtgcaaaagattgcagccatgggtatggcaatctctcgaatggtgcggatgctctttgcaaagcgggaaatgaggattctgatggtgggtctcgatgcggcagggaagaccaccatcctctataaactcaagcttggagagattgtgaccaccattcccaccattgggtttaatgtcgagactgtagagtacaagaatgtgagtttcactgtgtgggatgttggaggtcaagataagattcggccgttgtggaggcactacttccagaacactcaaggacttatctttgtggttgacagcaatgatagggaacgtatttcggaagctaaggatgagcttcaccgaatgctaagtgaggatgagctacgtgatgcaacactacttgtatttgccaacaaacaagaccttccaaatgcaatgcgtgtctcggagataactgataaacttggtttacactcccttcgtcagcgccgctggtacatccagagcacatgtgccacttctggtgagggactttatgaaggccttgactggctaagccagaacattacaaacaaggggatgacgtttggaatagtaaggtgaggtaagacgtcatttgaacatcagaaagacgcctcattccaaatttccttatttgtcaaagaatattaacttttataaatgtcattgaatgtcccctttggaaacattaaaagttcatggttgtaatagggagcaattgaatgtaatgccaatcagttgcttgtaagatgaaaattgactgggcgtgttttgttttgcaattttttttttttaattcttgttttaagttagtactcaacttgacaagaagcaactcagctttgtagtttggagcatagttgttggaaacgtctgtgaacctgaattgtttcaggaactggaatcgtgcctggctagaagattcccactctagggatcgttgtccgtacaataggaatcgttgagaatgagattcctagttttcaggaatggtatcaatcggaataagtccaagtttcatctacatatggaatcgagaatccaacttccttggaatcgagattcccatcccttgggatgacactccaatagtcaagtttcattaatatgtggagtcgagtttccgtcatttacggaatcaagtttccgacatatgtggaatcgagtttccgtcatctatggaatcgtgattctaacatatttggaatcaactatttgaagtatatggatcgatgattcatgctggtttgagatcgagaattacaatagcggaatcgagttttcgacatctctttatttgagtttctaacatatgtggtacatagatatattgttgtttggaataatgattctaacatatttagaatcaagtttctgaagtattggaggggcgagttggacaggtgtcactgcgtagattttttagatattagtactgcaatatcatttaggaagtgtcaggtgtcactgtgtagattgtttaga

SEQ ID NO: 13774 - DNA, 946 bp, Phaseolus vulgaris
gttgtaaaaatatacatcattttgagccaaaatttcgattgaaccagaggccacaatgggtttgacggtgtcacggctaatgagattgttttatgcgaggaaagaaatgaggatcctcatggtgggtcttgatgcagctgggaaaacaactatactctataaacttaaacttggagaaatcgtcactacaatacccacaataggcttcaatgtggagactgttgagtacaaaaatgtcagcttcactgtctgggatgttggagggcaggacaagattcgaccattgtggagacactactttcagaacacacaaggtcttatctttgtggtagacagtaacgatagagaaagaattttggaatccagagacgagttgcatagaatgctaagtgaggatgaacttcgcgatgctacagttctggtgtttgccaataagcaagaccttcctaatgctttgagtgttgcagaaattacagataaacttggtttacattcacttcgcctgcgtcgctggtacatccaaccaacctgtgccacatccgggcaaggactctatgaagggctagattggttatccagtcacatatctaacaagacaagatgaacaacgctttgagtgcgtttctgatcttccataaatgctcacactccattataaatgtgtaatataatatatcgtttcactataggcataaatgagttttatctgttatttgaacttcgaactacttataataccaatcactgtgatatatgtgtgacataatcgttcaaggcatgtaaactacataagttctgagttatcatgcgcacatacccagatgttgtattagacaaaatctatgtagtaacgcattgaacagcaaatgttgtagactacactatgtatacgcattatatttttgtaaaagatgtaatataaaatcattgacgtgtttttgcctaa

SEQ ID NO: 13775 - DNA, 530 bp, Castanea mollissima
cctgatctcacctttgcacaacacaaccctaccgcaatcatgggtctcacattttcaaagctcttcgataagctctggggaaagaaggagatgagaattctgatggttggtttggatgctgccggaaagacgacgatcctctacaagctgaagctcggtgaaatcgtcacaaccatccctacaatcggattcaacgttgagactgtcgagtacaagaacattcaattcaccgtatgggatgttggtggacaagacaagatccgaccactgtggagacattacttccagaatacccaaggtatcatcttcgtcgtcgatagcaacgatcgtgatcgtgttgttgaggcccgagaggagttgcaacgtatgttgaacgaggatgagctcagggatgctattctcttggtcttcgccaacaagcaagatttgcccaatgccatgaacgccgccgagatcaccgacaagttgggtcttcacagcttgagacagcgtgcctggtacattcaatccacctgtgctacctccgggga

SEQ ID NO: 13776 - DNA, 730 bp, Flaveria ramosissima
ggcatggctatatcgcgattggtgaaaatgttgtttgctaaaaaggaaatgaggattttgatggtaggactcgacgccgcaggaaaaaccaccattctttacaagcttaaacttggcgagatcgttactaccatcccaacaatcggttttaatgtcgagactctggagtacaaggatgttagctttacggtatgggatgtcggaggacaagacaagattcgacccttgtggagacactactttcaaaacacgcaagggctcatatttgtgatcgatagtaacgatcgagaaaggattatagaagctagagatgaacttcatcgcatgctcgacgaggatgcacttcgtgacgccacaatactcgtgtttgcaaataaacaagatcttccaaatgcaatgaaggtttcagaaatcacagataaactcgggcttcattccctacgcaaccgtcgctggtatgtacagagaacatgtgcaacatctggtgaagggctatacgaaggtcttgattggctctcaatcaatatatctcccaagggataagtcatcagtgtattgcaaagacagacagccttccaaaaacatgcttacctacttattttcttgaagtatgtataatatatctacacacacactatgattgtattctatgtatcaaaactgctattttgtgcatcacactgatatatgcatggtttatatataatatatggaaagaaaactatactta

SEQ ID NO: 13777 - DNA, 791 bp, Chenopodium quinoa
ttttttgaaattttgaaaaatttgagagattgttgaagcaaagatgggggtagcactatcgagattagtaaagatgatgtttgcaaagaaagaaatgagaattttaatggtgggtcttgatgctgctggtaaaaccaccatcctttacaaactcaaactcggtgaagtagtcactactatccccactattgggtttaatgtggaaactgtggagtacaaaaatgtaggcttcactgtttgggatgttggtggccaagacaagatcaggcctttgtggaggtactactaccagaacacccaaggtctaatctacgtggtggacagtaacgaccgagaaagaattgcagaagctagagatgagctccacaggatgctaaatgaggatgaactgagggatgcatctcttttagtttttgccaacaagcaagaccttccaaatgcaatgcctgttgctgagattactgataaacttggcctccactcccttcgtcaacgtcgctggtttatacaggctgcttgtgctacctctggtgaagggctttatgaaggtctagagtggcttaccagcaatataactacctagtcttgatattacgatgaactgcctgcaaattggagcattgttactgatatctaacatcagactttcctttcagaagtgaagctttacttattgcatagatgtatattattagtatataattcatgttaatttcatgcctcagtctgctgagaatgtttaatgatgaatgaatgtttgcaagtaaaatataatcttaatgttgactata

SEQ ID NO: 13778 - DNA, 949 bp, Pteridium aquilinum
tagagtgcgcggggcttttcatttcttcctctcgttcctcgttcctgggcagcctctcaattccttcagttacctcaacatctagaaaaaaagatgggctgtcttttgctaagttgttcagtcggctgttcgccaagaaagagatgcgaattcttatggtgggtcttgatgctgctggtaagactaccatcttatacaagctcaagctcggagagattgtcaccaccattcccactattgggtttaatgtggagaccgtggaatataagaacattagcttcactgtttgggatgttggtggtcaggacaagattcgacctttgtggagacactacttccaaaatacgcaagggctgatctttgttgttgatagtaatgatcgtgaccgtgtggttgaggctagggatgaacttcatcgtatgctaaatgaggatgagctgagggatgctgtgctgcttgtatttgcaaacaagcaagatctgccaaatgctatgaatgctgctgagataactgataagcttggtcttcactccctccgccagcgccactggtatatccaaagtacatgtgccacatctggtgaagggttgtatgagggactggactggctctccaacaacatagctaacaaggcttgagggatggtcaagtttgggtgacatcttggagcagcaatcgataatgtcgaattggaatgtttttatatgctattttgtgttgatgggttttggtttttcttgccttgtaaacttgcaagaatgtatcagattgtggttaggatttttactgtactagaaatgggcattttgccttgtagattgatttcaaataatctttgtccacagagttaacatattcattgttatcaggttattgttacatatcatgattttatttgttctctgcacgtctcaaaggatgatcattggtttattcttgttcaaaaaga

SEQ ID NO: 13779 - DNA, 1051 bp, Acacia harpophylla
ggctcctcaaagaatcgcggttggcactcgacgctcctccgatcctccccgtaaacttcgagagtgatctctagctagctacttcagcggtcaaaatggggttgacgttcaccaagctcttcagcaggctttttgccaagaaggaaatgcggattctgatggtgggtcttgatgctgctggtaagactacaatcctgtataagctcaagcttggcgagatcgtcaccaccatccctaccattggatttaatgttgagactgtggagtacaagaacatcagcttcactgtatgggatgttggtggtcaggacaagattcgtccactgtggaggcaccacttccagaacactcagggtcttatttttgtggttgatagcaatgatagagatcgagtagttgaggcaagggatgagttacaccggatgttgaatgaggatgaactgagagatgccgttctgcttgtttttgccaacaaacaagatctccctaatgcaatgaatgctgcagaaataactgacaagcttggacttcattccctccgccaacgccactggttagatcatattaacttttaagtaacctatgaaatatagctgtgcaacttctggagagtgaacttcccaaagaaagatatgatgttattttatgcaaatggtttaatccgtttcaggtacatccagagtacttgtgcaacttctggagagggtctctatgagggtttggactggctttcaacaacattgctaacaaggcatgaagctgataaaattttggttgccgtcgtgtcattccatgcaagtttggtagttctcgaagaggatgcttccttttattagtgaacgttgtaatagccagatgtttgttagaatttacctcctcttaaatgtaatttgggtttgtgtatgattccttgtattagctaatactttttagctgtaaccgacacactgttgcagcctcctttggcagagggcttgtctgtggtcattttgtcagctcgacagtcagtgaatatttctgtggggtcatgttgaagtattgctaaaaaaaa

SEQ ID NO: 13780 - DNA, 661 bp, Cucumis sativus
ccaactttcatttgggttctctcttctccctctttcactacaagaattcatatcgatcggttaacttgtggtttgaaatattttgatcggcagccatgggagtggcgatatctcgacttgtgaggatgctgtttgcaaagaaagaaatgaggattttaatggtgggtcttgatgctgctggaaaaactaccattttgtataagttgaagcttggagagattgtcaccactatacccaccataggttttaacgtggaaacggtagagtacaagaatgttagctttacagtgtgggatgttggaggccaagacaagattagacctctgtggaggcattatttccagaacacgcaaggtcttatctttgtggtggacagtaatgacaaagagaggatatcagaagctagggatgagcttcataggatgcttagtgagcatgaactggtagatgcaactgtgctagtgtttgctaacaagcaagaccttccaaacgctatgactgttgctgaaatcactgataaacttggccttcactccctccgaaatcgtcgctggtatattcaggctacttgtgccacttcaggccaaggactgtatgaaggtcttgattggctgtctagcaatatctcaaccaaggcaagttccagagctcataatgcttc

SEQ ID NO: 13781 - DNA, 736 bp, Plantago ovata
cattcgtcctgttctcagttcatcgcgtacctagctagcaatgggtttggctatatcgcgggtggtgaaacagatgtttgctaagcgcgagatgaggattcttatggttggccttgatgcagctggcaaaactactatactatacaaactcaaacttggggagattgttacaacgattcctacaatcggttttaatgtggagactgtcgaatacaagaacgtgagtttcacggtgtgggatgtaggagggcaagataagatccggccattatggaggcattacttccagaatacacaaggcctgattttcgtggtggatagcaatgacaaggaaaggattttagaggccagagatgaactgcacagaatgctgagtgaggatgaactgagaaaggcagtgttgttagtgcttgctaataagcaagatcttccaaatgcaatgtctgtttctgaagtcactgataagcttggccttcacactcttcgccaacgtaattggtacatacagagtacatgtgcaacctctgggcagggactttatgaaggtctggattggctatctagcaatattacatcaaaggcaaagatacacaactatgatccataaaaaaggaagtcatattttaatgtgatatggtatgatgtgcacgcttttaatctttacgtgtttgaatttaattataattttactagaaaggtggtatgtactacacgtaaaaacttatgttactctgtg

SEQ ID NO: 13782 - DNA, 554 bp, Picea glauca
attcgttcatctcaggcctctgcagaaacgaactcttcatcagcggggtctgcgattttacaggatatttgattttctctcaagtttggcaagatggggctcacgtccaccaagctctttcagcgtctgtttgccaagaaggaaatgcgtattctgatggtgggtcttgatgctgccggtaagaccaccattctgtacaagctgaagcttggagaaattgtcaccacaattcccactattggtttcaatgtggagactgtcgagtacaagaatattagcttcactgtttgggatgtcggaggtcaggacaagatccgaccactatggagacattactttcagaatacccagggtcttatatttgtcgtggatagtaatgacagggaccgtgttgttgaagcaagagatgaattgcatagaatgttgaatgaggatgagctacgagatgctgttcttcttgtatttgcaaacaagcaggatcttcccaatgcaatgaatgctgctgagataactgataagcttggcctgcattctttacgtcagcgccattggta

SEQ ID NO: 13783 - DNA, 600 bp, Secale cereale
cgacagccatcctccgtgcggttccaagctccaactcccacgcccgtctcccccgagatcaggaggagcacgccccggagcgccgagacctcgaagccttcgtctccacccccggaggagagatggggctcacgttcaccaagctgttcagccgcctctttgcgaagaaggagatgaggattctcatggttggtctcgatgccgctggtaagaccaccatcctctacaagctcaagctcggagagatcgtcaccaccatcccaaccatcggatttaacgtcgaaactgtcgaatacaagaacatcagcttcactgtttgggatgtggggggccaagacaagatcaggcccctgtggaggcactacttccagaatacgcaagggctcatttttgttgttgacagcaatgatagggagcgtgttgttgaggctagagacgagcttcacaggatgctgaatgaggatgagctgcgtgatgctgtgttgcttgtatttgcaaacaaacaagatcttcctaatgccatgaatgctgctgaaatcactgacaagcttggtctagacaactaccctagacgccagcggcactggtacattcagctga

SEQ ID NO: 13784 - DNA, 677 bp, Flaveria ramosissima
aatatattttcacatcgatcgatccctttcaagaaagcttctctctctcagggatcatcatcagaaacaggatggggctcacattcaccaagctcttcagccggctttttgccaagaaagagatgcgtatattgatggtgggtcttgatgcagctggtaagacaaccattttgtacaagctcaagctcggggagattgtgactaccatccctaccattggatttaatgtggagactgttgagtacaaaaacataagcttcactgtgtgggatgtggggggtcaggacaagatccgtccactatggaggcactactttcagaacacacaaggtcttatctttgtggttgatagcaatgatagggatagagttgttgaggcaagagatgagttgcacaggatgttgaacgaggatgagctaagggatgcagttcttcttgtatttgctaacaaacaagatctgcctaatgcaatgaatgctgctgaaatcactgataagcttggccttcactctctccgacagcgccactggtacatccagagcacttgcgccacctctggggaaggactttacgaggtttggactggctctccaacaacattgctaacaaggcatgaggtgatgatcgactgtaaaaggttggaaaacccgaggcgtagtttagcttttcggctggtc

SEQ ID NO: 13785 - DNA, 1164 bp, Conyza canadensis
cacacacacactcccgatatataaatatctgacgcgctctttctctcgtttgctaactgatttggtcggtggtcgataggtttcttcatttacaaccgatctccgtcgctctcttcaaccgtcaaccgatcgtattaagatgggtttgtcgtttaccaagctttttagccgtttgtttgctaagagggacgcgctctttctttttaccaacagatttggtcggtggtcgataggtttttcatttacaaccgatctctcttcaatcgtcaaccgatcgtatcaagatggggttgtcgttcaccaagctttttagccgtttgtttgctaagagagagatgcgtattttgatggttggtctcgatgcagctggtaaaacaacaatcttgtacaagctcaagttgggagagattgtaaccacaattccaactattggctttaaggtcgagactgttgagtacaagaacatcagctttactgttcgggatgttgggggtcaagacaagatccggccattgtggagacactactttcaaaacacacaagggcttatctttgtggttgatagcaatgatcgtgaccgtgtggtggaggctagagatgagctgcaccgaatgcttaatgaggatgaactaagagatgcagtgctgcttgtgtttgccaacaagcaagatcttccgaatgcaatgaatgctgctgaaatcaccgataagcttggcctgcattctctccgacaacgacactggtaatttacatattaaatacctccgtacatgaacctacacaagggcccatgaatatctgttctaatagaagttctatttgacaggtacatccaaagcacatgtgccacctctggagaaggtctagggggggggggggggggacagtgtacaatgaatgattgaatgttctttgggattgtgtaatcgaaattgcccttaaggctggctgtgtaattgttttgtattttttgttcttgtgttccttgtatacgtgtttcatgccgctttgcatcatgtaagtatgctacttttgtgcatcatgaaaaatggaagtaatcggttgccaaattatgttcttaacttaatcatagaaagagatatcacctaattttcttggatgcgtctatgtgatgttatttgtacaatcatgttgaaagaccag

SEQ ID NO: 13786 - DNA, 940 bp, Secale cereale
tcctccgtgcggttccaagctccaactcccacgcccgtctcccccgacgatcaggaggagcacgccccggagcgccgagacctcgaagccttcgtctcacccccggacggagagatggggctcacgttcaccaagctgttcagccgcctcttcgccaagaaggagatgaggattctcatggttggtctcgatgccgctggtaagaccaccatcctctacaagctcaagctcggagagatcgtcaccaccatcccaaccatcggatttaacgtcgaaactgtcgaatacaagaacatcagcttcactgtttgggatgtggggggccaagacaagatcaggcccctgtggaggcactacttccagaatacgcaagggctcatttttgttgttgacagcaatgatagggagcgtgttgttgaggctagagacgagcttcacaggatgctgaatgaggatgagctgcgtgatgctgtgctgcttgtatttgcaaacaaacaagatcttcctaatgccatgaatgctgctgaaatcactgacaagcttggtctgcactccctgcgccagcggcactggtacatcagagcacttgcgcgacatctggagaaggattgtacgagggacttgactggctctccaacaacattgcaacaaggctgaagcgtctcgacaagtgcttcatcaagaaacaaacgtgctggatgtctcaacaactcactgctaccattttacatattgtgatatatatacactgtacaagagatagtatgtgtgcgtatgtgacagacagaagctctcttctttaagtgagctagtatcaggtcaggtttgtttttttgtatggatattatcagtattcccgcgtcgtggttttacaaggtttactttgtcgaccatgtgtgcatgaacccctatctttttgagttgtagtaagattgaattg

SEQ ID NO: 13787 - DNA, 753 bp, Arachis hypogaea
tctttctccacataatcgcgttgctgcaaagcattcttttctctctctctctctctccctcttctctctctctctccgaacgttctgtttccagatcactcaaggctctcatttcccaacggttgaaggagaaatggggctgacattcacaaagcttttcagtaggctctttgccaagaaggaaatgaggattctcatggtgggtcttgatgctgctggtaagaccactatcctctacaagctcaagcttggagagatcgtcactacaattcccactattgggttcaatgtggagactgttgaatacaagaacattagcttcactgtttgggatgttggtggccaggacaagatccgtccattgtggaggcactatttccagaacacccaaggtcttatatttgttgtggacagcaatgacagggacagagttgttgaggccagagatgagttacatcggatgttgaatgaggatgaactgagagatgctgtattgcttgtgtttgccaacaaacaagatcttcctaatgcaatgaatgctgctgagattactgacaagctgggactccactctctcagacaacgccactggtacatccagagcacttgtgcaacatctggggaaggccttatgaaggtttggactggctttcgaacaacattgccaataaggcttaatgcttttggggagtcctgtggatcggtgattctggatgcaggggtgaatattatctagcttttattcttggtcct

SEQ ID NO: 13788 - DNA, 2173 bp, Oryza sativa
ctctcctgcacccgtctcacgtgcaccgcactctacctagaccaccaccaccaccagtccaccacacccggctcacgtagaccgcgtccacccaccgcggcggctcgaagcctccctccgctgcaaccaccgcgcgtcgaggcgtcgtctcctttttcttcggctcgacgaggtggggaggagatgagagaggccacgcgcgcgcacgagatcgatctccagcaaggtcttgcacaactgcggcaagatgggcctcactttcacgaagcttttcagccgcctcttctccaagaaggagatgaggatcctcatggtcggtctcgacgcagctggtaaaaccacaattctctacaagctcaagcttggagagattgtcaccaccattccaacaatagggtttaatgtggagactgttgaatacaagaacattagcttcactgtctgggatgtcgggggtcaagacaagatcagacctttgtggaggcactatttccagaacactcaaggtctcatctttgttgttgatagcaacgacagagatcgtgtggttgaggcaagggatgaactccacaggatgcttaatgaggatgagttgagggatgcggtgttgctggtttttgctaacaagcaagatcttcctaatgcaatgaatgctgctgagatcacagataagcttggtctccattccctgcgccaacgccactggtatatccagagtacatgcgccacaacaggagagggtttatatgagggccttgactggctctcgagcaacattgcaaacaagtatctgtcacgctctcatctttcaattgactgcaggcctgattggatgaccagaataccacattacatagcagttgcattttctggagaacggaggagatggtcattttgatactgagatttggattattatttcactggagtgttcgttgaatatattgtatttcttcgttaggcttttcagatctgagttgctactacaaaacatgagaaagagagagagcagagcagtacacacatcttcaatggcggaggagcacctggtcggcggcctgctgctcgagacggcggaggcgctcgacctccctgccgagcacgccgcagcgcaccatggccgccgccgtgcgccacagcaggcggaggtccccccacggctcggcgggcgccatccgcttgtgcaggtagctgtcgaacgtccggcgctgcacgtgctcgtcggcgcacatctccaccagcgcctccctcccggcgttcccgccgtagaacacccgctgcagcaggtccaggaaccggaacgtggggcggaactcgtcgtcccaccgccggaggtatcccgcccgtatcccggcctccgtcaccgcgccggtgagccgccactcgtcggccatggcgcggccgcagaggcgccccgacctggccgcgaagtagatgccctcgccggagcaccgggtgacgtagcccgccgcgtcgccgacgagcgccacgcgccccaccacgcggcgggggcgcgggtgctccgggatcgggtgcgcctccaccctgaccacgcggccgccggcgaccttgcccgccgcgcgcgcgcggatgcccgactggagcctcttgatctccggcttggcggccaccgtgcccgtcccgacggcgacgtggtcgcacttggggaagacccagccgtagaagtccggggagacgtcgccgccgacgtacatctcggcgaggtcgtcgtagtaggccatggcctcgtcggggaggcggatgcgctcctggaacgcgatggccgtcgagtagtcccccgcgccgacctcgcgggcgacacggctgttggcgccgtccgcgccgatgacggcgtcgacctcgaggacgcaccgggaggaggaggggccaccggagtcggaggagatgtagtggacgaggtaagggtcggtggcggggtcggcggggagggagagcgaggttggacggcgagaggacgcgcatgcgggtgacgcggcggtcgacgaggtcacgcgggatggcgaactcgtcgagcatgcagagcgggatggcgccgccgcagggcttggcgcccgacgggttgcgctcgaggaggaacgcctgcgcgcccgccgacgccagcgcctcggccgccgacgcgcccgcggggccgccgcccaccacggccacccgc

SEQ ID NO: 13789 - DNA, 491 bp, Phaseolus vulgaris
ttgtaatggcagacaatatgggtttgtcttttggcaagattttctctcgtctatgcgctaagaaggagatgcgaattctcatggttggtcttgatgctgctggtaaaaccacaatattgtataaactgaagttaggggagattgtcaccaccattcctactattggatttaacgtggagactgtggagtataagaacattagcttcactgtgtgggatgttggtggtcaagataagattcgacccttgtggagacactacttccaaaacacacaagggcttatttttgtggtagacagcaatgatcgtgatcgtgttgttgaggctaaagatgagttgcacaggatgctgaatgaggatgaattaagagatgctgtattgcttgtttttgcaaacaagcaagatcttcctaatgcaatgaacgctgctgaaatcactgataggcttggtctaaactctctgcgccaacgccactggtaaattaagtcctca

SEQ ID NO: 13790 - DNA, 1019 bp, Helianthus annuus
ggggacacaaatcatcgaaaaccccaccatatcaatctgaaattcgtccactggactctctccacgagagataattcttcgacacttcatttccttcgatgtaaattgtgtatttgcatccgaatgagtgtccagtagaaagtaatttattactatcataagctacaccaagatggggctaacatttgccaagttgtttagccgtctattgttgttgttgttgttgttaaaccttgtgtccggtgagaaagagatgcgcgttctgatgttaggccttgatgctgctggtaagactactatattatacaagttaaagtttggagaaattgtgacgacaattcctaccattggattcaatgttgagacagttgaatataagaataccagcttcaccgtctgggatgttggtggccaagacacgatccgcccattgtggaggcactacttcaaaaacacacagggacttatatttgtagtggatagcaatgacagggatcgtgttgttaaggcaagggatgtattgcataggttgttgaatgaggatgaacttagagatgctgctttgttggtttttgctaacaaacaagatctgccgaatgccatgaacgcctcagaaatcactgacaagcttggccttcattcacttcgtcaacgccactggtacattcaaggcacatgtgcaacatctggtgaggggctttacgaagggcttgattggctctccaacgacattgctaacaaggcatggttcctagaaaacatatgacgttctttctgctccgaccatctttatagatggaaactgcattgtagtagaccaaacttgagtgtggttatgttttaaactttcaagtaattggaatctttctagaaggaaattgtgtcgagttattgttaacaaacaaatattacaaactaccgattatgataattttggttgcacattttgcttttgttacttatgtgaattaaatgtaatctttaatttgagacacataggataatatactattgggtgt

SEQ ID NO: 13791 - DNA, 856 bp, Eutrema parvulum
tcatctttttgtcatttcagggtcaacagttaaaaaggaagatggggctttcgtttgcaaagcttttcagccggcttttcgccaagaaggagatgcggatccttatggttggtcttgatgctgccggtaagacaaccattctgtacaagctcaagcttggggagattgtaaccaccattcccaccatcgggttcaatgtggagacagttgagtacaaaaacatcagtttcacagtctgggatgtcgggggccaggacaagatccgtcccttgtggaggcattacttccagaacactcaaggtctgatattcgtgatcgatagcaatgacagagaccgagttgttgaagcgagagatgaacttcacaggatgttgaatgaagatgagcttcgggatgctgtattgcttgtgtttgccaacaagcaagatcttccaaacgcaatgaatgctgctgagataactgataagcttggccttcactctcttcgacaacgccattggtacatccaaagcacatgcgcaaccaccggtgaagggttgtatgaaggtctggattggctctccaacaacattgctaacaaagtaagacttctgatttctataggcttattcggtctaggttatgaacattatgtgacactgttaatagaccttcattacaatcttaggcttcggttatcttggtgtttctgatttcggttccttcttttactccattcgcaggcttgaggttatctcgaccagatattttgtgagagaattggaagcttcttcttcggagtgaactttgtttcttgtgttttaagacctattattggagtcacatttgtttaatttcttcaaggggtgaaaatgat

SEQ ID NO: 13792 - DNA, 767 bp, Mimulus guttatus
atcagcagttaaacaatggggttgtctttcacaaagctcttcagccggctgtttgcaaagagagagatgcgtatactaatggttggtcttgatgctgctggtaaaacaaccattctctacaagctcaaacttggtgaaattgtcaccaccattcctactattggattcaatgtggagacagtggaatttaagaacattaacttcactgtttgggatattggaggccaggacaagattcgtccactgtggaggtactatttccaaaacactcagggcctaatctttgttgttgacagtatcgatcgagaccgtattgtcgaagcaagggatgaactgcacaagatgttgaatgaggatcaattgagggatgctgttctattggtgtttgccaataagcaagatcttcccaatgctatgaatgctgctgaaataactgacaagttgggccttcattccattggcaagcgtcattggtatattcagagcacatgtgcaacttctggtgaagggctgtacgagggattagactggctgtcaaacaacattgctaacaagctcatgttaataatcattttaatgtgttttgctcacttttgcaggcgtaaatccttcagtcggaagtgacaatgcaccaccctgtggctttgttgttttcaatgaatttatgatatatctttatatttgtaaatcttgtgtatccgccttggtgaaactacttttatgaacttacatggatttgtaaacttcttttctaattttcttggttt

SEQ ID NO: 13793 - DNA, 669 bp, Solanum tuberosum
tttgaacaagtagtagttcattgtagagcaatgggtatgtcgatttccaagtttgtaaaaatgttatttgcaaagaaagagatgagaatattaatggtaggactcgatgcggctggcaaaacaaccatcttgtacaagttaaaactcggggaaattgtcactaccatacctactattggatttaacgtggagacagtggagtacaagaattccagcttcacagtatgggatgtgggtggacaagataagatccggcctctatggaggcactattttcagaacacacagggtctaatatttgtcgtagacagtaatgatcgagatcgaatttcagaagccagagatgagctacatcgcatgcttaatgaggaagaattacgaggcgctacaattcttgtattcgcgaataaacaagaccttccaaatgctatgaatgttgcagatatcaccgataaacttggcctgcattcactccgacaacgacgctggtacattcagagtgcttgtgcaacatctggacagggactttatgaaggtcttgattggttatcacataatatcactgggaaaggcataaattcaaagcagcatccagctcaagaaaatcctcttctttaaaccccaaacgcgttgattttaatagaagctatgactatacgtatattctga

SEQ ID NO: 13794 - DNA, 2369 bp, Triticum aestivum
tcgagagccctcaccctcccaatcccgccgcgctccagggatggccgccgccgccgccgccaccgccgccccgcccgccacgccctcctcccgtcccctccgcatgcctcccgcgccgtccaccgtccatccacagctcaggtgccatgccggccccagcccctcgctcctcgcgctgcgccaccgcgccgcccgcgccgcgccggcccgggccctgctcgacaaggtcacgcccttcaacttcggcgaggaggaggacgacggcggcgacgaccacccccgcgaggagtgcggcgtgttcggcgtcgtgggcgacccggaggcgtcgtcgctctgctatctcggcctgcagaagctgcagcatcgcggggaggagggcgccggcatctgcgccgccggggacgacggcaagctcaagtccgtgacggggctggggctcgtcagcgacgtgttcagggacccggcgcacctcgggagcctccccgggcaggccgccatcggccacgtccgctactccacctccggcggccaggcccagctgtgcaacgtgcagccgttcctcgccgggtaccggttcgggcagctcgcagtggcgcacaacggcaacctggtgaactacctgccgctgcgccacaagctggaggcgcagggctccatcttcaacaactcgtcggacacggaggtcatcctccacctcatcgccacgtcgctctcgcgcccgctgctcgcccgcatctgcgacgcatgcgagcgcctccagggcgcctactcgctgctcttcctcacggccgacaagctcttcgccgtgcgcgaccccttcggcttccgcccgctggtcatgggccgccgccccaacggcgccgtcgtgttcgcgtcggagacctgcgcgctcgacctcatcgacgccgtgtacgagcgggaggtggagcccggggaggtgatcgtcgtggaccgccgggacatgtccgtgtcctctgcctgcctcgtcccgcaccgcccgcgcaagtcgtgcgtgttcgagcacatctacttcgcgctgcccaactccatcgtgttcgggcacgcagtccacgagcggcgcaccgcctacggccgcgcgctggccgaggagtccccggcccccaccgccgacgtggtcatccccgtgccggactctggcttctacgcggcgctcggcttcgcgcaggcctcggggctcgagttccagcagggcctcatccggtcgcattacacgggccgcagcttcatccagccgacgcaggccatccgcgacctcgccgtgaagctcaagctcgcgcccgtgcggggcgtcatcacgggcaagagcgtggtggtcgtggacgactcgatcgtgcgcggcaccacgtcgagcaagatcgtgcgcctgctccgcgacgccggggcgcgcgaggtgcacatgcgcatctccagccccccggtggtcggccggtgccactacggcatcgacacgcccgacgagaaggagctgatatccaacaggctggacgtcgagggcgtgcgcgagatgatcggctgcgactcgctcggcttcctgacgctggacaagctccacagcatctacggcgacgaggcggacgagctctgcgacgcctgcttctcgcggaactacccggtgcctatgccggacaaggtgccggcgatggcatccgccgacgatgaagactgaccagaatgtgcgactagggaagggaagtggctctgtactccgcatgcttctataggattttgggcgtggcgaatctgtgtcgtggcaattgcattcatcgtttgaatttttgcaggtcttaagtttgtgtccctgagcggctagcgttccttggcctctcaaactgaggttgcgaaacctttttcttgagtcaatttatatactgtataagaaaggttgacaagtcaggcatctaatattgtttcgtcgccgacgtgaactgctagtgaattgcatttttcaagctcctgtgattcgggagcatttctattagttacatctgcaaagccaagcaaaaaattcatgtggaggtagtgttagttgtgtactgacggtgtggaacctgcgcattgctgattttgagtcaacgatgtaactagatagaagtcaaccggcaacattcctagcttggacactaaaccaacttgcatctggaaccaagtaagtgagcatgacattgacatgtatcatgagtcgagtgtaatcttggctacaacgaatatgttgtacggtagctagctgcttatgctgtcaggatttgctagtctgatgcttctgcttcagctctcagttatttgctttgacatattcaagcgctgtctctgaaatctcggtaggatgattccgacatgtgccacgccga

SEQ ID NO: 13795 - DNA, 2161 bp, Hordeum vulgare
gtagggcatacggcctccacacgcctggcggcgacctctttaaatcctgtccgttcacgcacgttcgggagggcatcctcgaaagccctcacctcaccctcccaatcccgccgcgttccagggatggccgccgccgccaccgccaccgccgtcccgcccgccacggcctcctccaacctcctcttcacgccccccgctccttcccccgtccatggacagctcaggtgccatgccggccccagcccctcgctcctcgcgctgcgccaccgcgccgcccgcgctgtgccggccagggccctgttcgacaaggtcacgcccttcaacttcggcgacggagaccgccctatcgaggaggacgacggcgacgaccacccccgcgaggagtgcggcgtgttcggcgtcgtgggcgacccggaggcgtcgtcgctctgctatctcggcctgcagaagctgcagcaccgcggtgaggagggcgccggcatctgcgccgccggggacgacggcaagctcaagtccgtgacgggcctgggtctcgtcagcgacgtcttcagggacccggcgcacctcaagagcctccccgggcaggccgccatcggccacgtccgctactccacctccggcggcaacgcccagctgtgcaacgtgcagccgttcctcgccggctaccggttcgggcagctcgcggtggcgcacaacggcaacctggtgaactacatgccgctgcgcaacaagctggaggcgcagggctccatcttcaacaactcgtcggacacggaggtcatcctccacctcatcgccacgtcgctctcgcgcccgctgctcgcccgaatctgcgacgcctgcgagcgcctccagggcgcctactcgctgctcttcctcacggccgacaagctcttcgccgtccgcgacccgttcggcttccgcccgctggtcatgggccgccgccccaacggcgccgtcgtgttcgcgtcggagacctgcgcgctcgacctcatcgacgccgtgtacgagcgagaggtggagcccggggaggtgatcgtcgtggaccgccgggacatgtccgtgtcctccgcctgcctcgtcccgcaccgcccgcgcaagtcgtgcgtgttcgagcacatctactttgcgctgcccaactccatcgtgttcgggcacgccgtccacgagcggcgcaccgcctacggccgcgcgctcgccgaggagtcccccgccccaaccgccgacgtggtcatccccgtgccggactctggcttctacgcggcgctcggcttcgcgcaggcctccgggctcgagttccagcagggcctcatccggtcgcattacaccggccgcagcttcatccagccgacgcaggccatccgcgacctcgccgtcaagctcaagctcgcgcccgtgcgcggcgtcatcacgggcaagagcgtggtggtcgtggacgactcgatcgtgcgaggcaccacgtcgagcaagatcgtgcgcctgctccgcgacgccggagcgcgcgaggtgcacatgcgcatctccagccccccggtcgtcggccgatgccactacggcatcgacacgcccgacgagaatgagctgatatccaacaggctggacattgagggcgtgcgcaagatgatcggctgcgactcgctcggcttcctgacgctggacaagctccacagcatctacggcgacgaggcggacgagctctgcgacgcctgcttctcgcggaaatacccggtggatccgccggagaaggtgccggccatggcatccgccgatgaagactgaccagaatgtgcaactagggaagtgcctctatactccgcatgctcttctataggattttgggcgtggcgaatcgtgtcgtggcaattgcattcatcatctgaaattttgcaggtcttaagtttgtatccctgagcggctagcattccatggcctctcaaattgaggttccgaaacctttttcttgagttaatcaatttatataagaaaggttgacagctcaggcatctaaggttgtttcgttgccttcctgaattgctaatgaattccatttttcaacctcctgctgaatcggaaacatttttaatagttaccttcctcggtcgcgtaatataagagcggaatacatccacaaagccaagcaaaaaatagataaatcatgtgg

SEQ ID NO: 13796 - DNA, 1507 bp, Gossypium raimondii
aaagaaaaaagacctcagcaaaggcagtccccaaaatcttgctctcttcactcctcctattttaaccatttcttccttgtcctcgccccttccctagcaagctacatttccatggccccccctgaattggttcaacccagtgataaaacaaacgttttcgctaaacaagtcactttgcgtaatcgtgcatatgttacgttcttggccggaaatggggactacgtgaaaggcgttgtagggttagccaaagggttaaggaaagtgaaatcggcgtaccctttagtggttgccgttttacccgacgtgcctgaggagcataggcggatcctggagaaccagggttgtatcgtccgagagatcgaacctgtttacccgcctgagaaccagacccagttcgccatggcctattacgtcatcaattactccaagcttcgtatttgggagttcgtggagtacagtaaaatgatatacttggacggcgacattcaggtatacgacaacatcgatcacctgtttgatctgcctgatgggcatttctacgcagtaatggattgcttctgtgagaaaacatggagccacaccccacaatacaggatcggttactgccaacaatgccctgacaaggtgaagtggcccgccgagatgggaaatcccccttcactttacttcaatgctggcatgttcgtgtttgagcccagccttgtgacttatgaatctctcttgaagactctcaaaatcacacaacctaccccatttgcggagcaggactttttgaacatgttctttaaggacatttacaagccgattcctttaatttacaaccttgttctcgccatgttatggcgtcatcccgagaatgtggagcttgaaaaagtgaaagttgttcactactgtgctgcgggatctaagccttggaggtacacagggaaggaggctaacatgcaaagagaagacattaagatgcttgttcagaaatggtgggacatttacaacgacgagtcacttgattaccgtaccagcgcggctgaaggagggacagagaccgtgaacctgcaaccgttcctggtggcactctctgaagttggtgcagtccatttcgtggccgccccatctgcggcgtaaatatgttgtgtaacgacgataaataacagttcataggtgtaaagaaatattgtaagaatcgagaaaggggcgatcctatgtggaaaacaaaggtggttttaaacaagggttggggaattggtgaaacgcttttagggggtttaaaaactatttagggcgttgtttttacttgatgaatggtgatgaaggtcgagtgtggggtcaaagtgggtgtttgtttattgtgtggctctggcaaaaagtcttgctgataaaatgtcattgtagtcttaaattttcagcaacggtgacataagaaatgaaaattgccacaaaaagtttgtgaatcacgacaacagatgcaaattgccacaaaaagaattccatatatacctttctccttttc

SEQ ID NO: 13797 - DNA, 1470 bp, Theobroma cacao
aaaggaaaaactcaacaaagccaaagcagaaagagctctcttcggtcctcctatagccatctccctcccggccctctcctacgttttggactcccatggctcctgaactggttcaagctgctgctaaaccaaccgctttcgccaaacctgtcacgttgcctaagcgggcttatgtcacgttcttggctggaaatggagactacgtgaaaggtgttgtagggttagccaaaggtttaaggaaagtaaaatccgcatacccattagtagttgccgttttgcccgacgtgcccgaggagcacaggcgggtcctggagaaccagggttgtatcgttcgagagatcgaacccgtttaccctcctgagaaccagacacagttcgccatggcttactacgtcatcaactattctaagctccgtatttgggagttcgttgagtacagtagaatgatatacctggacggagacattcaggtatttgacaacattgatcacctgtttgatttgcctgatgggcatttttacgctgtaatggactgtttctgtgagaaaacatggagccacaccccacaatacaagatcggttactgccaacagtgccctgacaaggtcaagtggcctgccgagatgggtcagcccccttctctttacttcaatgccggcatgtttgtgtttgagcccagccttttcacctataaaaatctcttggagacccttaaaatcacccctccgaccccatttgctgaacaggaccttttgaacatgttctttagggacatttacaagccaattcctttggtatacaaccttgttcttgccatgttatggcgtcatccggagaatgtggagctggacaaagttaaagttgttcattactgtgcagcggggtcaaaaccgtggaggtacacagggaaagaagagaacatgcaaagagaagacatcaagatgcttgtgcagaaatggtgggacatttacaacgacgagtcacttggttacaagaaaccaactgttgccgaaggagcggcagagcccgtgaacccgcagccattcgtggcggcgctctcagaagctggtgcagtccaatacgtgaccgccccatcagctgcgtaaacgtggccagctatattttagaagaaggatcggatcaacacatcaactaattaaaccatagatgtagaaaattgaagagtcgaaaagggagcaaattccttttccctattgaaaggcggaggtggtcttaaacagggattcgggaataaaagcttccaggtcttgccgtctgtttttttctttccttcttttcttggtgtcgaagtgatcaagtttagtggcaacttgacgtgtggggacagttgtatgcgtctgttcataatgcttttccgaaaagagtctctgctaatgaaagggtatgcagaattgtaatcttttgcagcaatgctggtgaaataaaaatacagtacatgtttctgaatca

SEQ ID NO: 13798 - DNA, 1380 bp, Gossypium hirsutum
gctctcttcagtcctccttcatcagtgatctcaatctccatcctatatatctcaccaagtaacacacattctcatggctcctgaactggttcaagcaggtgttaaaccaactgtgttggctaaaccagtcaccttgcccaagcgagcttacgttaccttcttggctggcgatggagattacgtgaaaggcgttgtagggttagccaaagggttaaggaaggtgaaatccgcataccctttagtggttgccgttttgcccgacgttcccgaggagcacaggcggattctggagaaccaggggtgtatcgtccgagagatcgaacccgtttacccgcccgagaatcagacccagttcgccatggcttactacgtcatcaactattccaagctccgtatttggaagttcgtggagtacagtaagatgatatacctggacggggatattcaggtgtacgagaatattgatcacctattcgacttgcctgacgggcaattctatgcagtaatggactgtttctgtgagaaaacgtggagtcataccccacaattcaagatcggttactgccaacagtgccctgacaaggtcaagtggcccgccgagatgggtcagccacctgcactttacttcaatgctggcatgtttgtgtttgagcccagtcttaccacctatgaaaacctcttggctactcttaaaagcacccctcctaccccatttgccgagcaggactttttgaacatgtactttaaggacatttacaaaccaattcctttggtctacaacctggttctcgccatgttatggcgtcatcccgacaacgtggagcttgacaaagtgaaggttgttcactactgtgcagcgggatcgaagccatggaggtacacagggaaagaagagaacatgcaaagagaagacgtgaagatgttggttcagaaatggtgggatatttacaacgacgagtctcttgattacgaaaaaccaaccattggtgaaggacaggcggcagagccggtgaacatgcagccgttcctggtggcactctcagaagctggtaaagtccaatacgtaacggccccatcagcggcttaataataaacaacatggccagctctgttttagaagaacaacgatccaaaaaaaaaaaaactactactaaacgtatagctgtagagaaaaagtaagcaatgtccttttccctagagaggttgaggaataaaagctattaggacttcttgatgaaagtttatggtaccaacttgtggtgtggtgtccgagttggaaatgtgtgttttaattcccaaacgagtcctgttaatcaaagagaagggtctgcagaaatggaccatattgtaatgttttgcagctatatatacatatggtta

SEQ ID NO: 13799 - DNA, 1537 bp, Gossypium raimondii
gcttctatttaaacacccttcggctgtctctaatggtacaaagaaattgaccccataagcaaagcttataactgtaagagctctcttcagtcctcctccatcagtgatctcaatctccatcctatatatctcaccaagtaacacacactcccatggctcctgaactggttcaagcaggtgttaaaccaactgtgttggctaaaccagtcaccttgcccaagcgagcttacgttaccttcttggctggcgatggagattacgtgaaaggcgttgtagggttagccaaagggttaaggcaggtgaaatccgcataccctttagtggttgccgttttgcccgacgttcccgaggagcacaggcggatcctggagaaccaggggtgtatcgtccgagagatcgaacccgtttacccgcccgagaatcagacccagttcgccatggcttactacgtcatcaactattccaagctccgtatttggaagttcgtggagtacagtaagatgatatacctggacggggatattcaggtgtacgagaatattgatcacctattcgacttgcctgacgggcaattctatgcagtaatggactgtttctgtgagaaaacgtggagtcataccccacaattcaagatcggttactgccaacagtgccctgacaaggtcaagtggcccgccgagatgggtcagccacctgcactttacttcaatgctggcatgtttgtgtttgagcccagtcttaccacctatgaaaacctcttggctactcttaaaagcacccctcctaccccatttgccgagcaggactttttgaacatgtactttaaggacatttacaaaccaattcctttggtctacaacctggttctcgccatgttatggcgtcatcccgacaacgtggagcttgacaaagtgaaggttgttcactactgtgcagcgggatcgaagccatggaggtacacagggaaagaagagaacatgcaaagagaagacgtgaagatgttggttcagaaatggtgggatatttacaacgacgagtctcttgattacgaaaaaccaaccattggtgaaggacaggcggcagagtcggtgaacatgcagccgttcctggtggcactctcagaagctggtgcagtccaatacgtaacggccccatcagcggcttaataataaacaacatggccagctctgttttagaagaacaacgatccaaaaaaaaaaaaactactactaaacgtatagctgtagagaaaaagtaagcaatgtccttttccctagagaggttaaggaataaaagctattaggttttgcttttcttttctttctttctctttttttacttgatgatgaagtttatgataccaacttgtggtgtggtgtccgagttggaaatgtgtgttttaattcccaaacgagtcctgttaatgaaagtgaagggtctgcagaaatggaccatattgtaatgttttgcagctatatttacatatggttatatgtatcacactctactatatctggatcagaagtgcccatttcca

SEQ ID NO: 13800 - DNA, 1550 bp, Populus trichocarpa
acctcagaaaccaaaaactcgaagccaccagaaaaaacagccagctttagtttcttctccatttcgtctctctcaaattctctttcaaacccttctctgtaaccctcattcacctccctctcccgcaaccgcaaccgcaacatggctcctgagcttatccaggctgctttgaaaccagccgggttcaccaaaccagctagctcacctagccgggcttatgtaacattcttggctggtaatggagattacgtcaaaggtgttgttgggttagccaaaggattaaggaaagtcaaaacggcatacccattaatcgttgcagttttgcctgacgtgccagaggaacacaggcggattttagagtcgcagggttgcatagtccgggaaattgaacccgtttatccaccagagaaccagacccagtttgccatggcttattatgtcatcaactactccaagctccgtatttgggagtttgtggaatacagcaagatgatatacctggatggagatatccaggtttatgacaacatagaccacttatttgatctgcctgatggtcatttctatgcggtgaaggattgtttctgtgagaaaacatggagccacactccacagtacaagattggctattgccagcaatgccctgacaaggttaaatggcctgctgagatgggtcaaccaccatctctttacttcaatgctggtatgtttgtatttgaacctagtatctccacctatcatgacctcttgaagactctcaaggtcactccgcctacgccatttgcagagcaggacttcttgaacatgtacttcaaggatatttacaagccaattcctctagtatacaatcttgttctcgccatgttatggcgtcacccagaaaacgtggagcttgacaaggtcaaagttgttcactactgtgcagcgggctcaaagccatggagatacactggcaaagaagagaacatgcaaagggaggacataaagatgctggtggagaaatggtggggcatttacaatgatgaatcgctggattacatgaaatttgtggcggatggtattgatgctgagctagtgaacttgcagtctttcattgcagctctctctgaagccggtgctgttcagtacgtcactgccccatccgctgcttagagatggaagagagagagagagagagagagagagcaacaacctatagatttataaatgatcagggtgaaagagaaatgtcggaatccttttactcttgaaattgggggcggtgatttcttgtctagaaagggaataaactttattttgatcgatagcagtccttaattatctttttcttggtagttaaatctgttgataatatgtgatgggcgttgtgtgcatgcacagaggtgcgccattgtaagctactggagcaatggtgaaatgaaaaatgtgcgtatgattaattaattactggagcaagagtagtttaatttactcctctttttttttcctttttttacgttttgcaatagaactcacatagttttactgcagcgagtaattctcacttttcg

SEQ ID NO: 13801 - DNA, 1439 bp, Populus trichocarpa
acagccagcccaaaacaacagccagctttcctctccatttcttctcttaagttctcttttaaagcctcctctctcactctctttcatctccctcttcgacgaccgcaacatggctcctgagcttgtacggtctgctttgaaaccagccgggttcaccaagctcgctagcttacctagcagggcttatgtaacgttcttggctggtgatggagattacgtgaaaggcgttgtcgggctagccaaaggcttaagaaaggtcaaaacggcatatccattaatcgtggcagtcttacctgacgtgccagaggaacacaggcagatcttggaatctcaagggtgtatagtccgggaaattgaacccgtttacccgccagagaaccagacccagtttgccatggcttactatgtcatcaactactccaagctccgtatttgggagtttgtggaatacagcaagatgatatacttggatggagatatccaggtttatgacaacatagaccacttatttgatctgcctgatgggcgtttttatgcggtgatggattgtttctgtgagaaaacatggagtcacactccgcagtacaagattggctattgccagcaatgccctgacaaggttaactggccagctgagatgggtcaaccaccatctccttacttcaatgctggcatgtgtgtgtttgagcctagtattgccacttatcatgatctcttgaagactctcaaagtcactcctcctaccccatttgcggagcaggactttttgaacatgtacttcaaggatatttacacgccaattcctctagtttacaatcttgttcttgccatgctatggcgtcacccagaaaatgtggagcttgacagggtcaaagttgttcactactgtgctgcgggctcgaagccttggagatacactggcaaagaagagaacatgcagagagaggatataaagatgctggtgaagaaatggtgggacatttacagtgatgaatcactggactccaagaaacttgtggcggattgtactactgatgctgagccagtgaacttacagccattcattgcagctctctctgaagccggcgctgttcaatatgtcactgccccatctgctgcttagagatgggaagaaagaaggatcaaagcactattatagatttagaagggatcaaagttggaatccttctcttgatagtaatttcttgggtatagaaaagagatacactatcttctttcttggtagtatctctattttccactctatccctctgctgattatgggtggagcaattgttaaattaatgcaaataaacatatgttgtgttacctagtttaattcactccctcttttcttgtttttttatccttaattcttggttcttcatggactttcattcaatttaaattcaaataaagtttatgtttttcaatgataa

SEQ ID NO: 13802 - DNA, 1496 bp, Manihot esculenta
agaataaccccgcaacaaagccaaaagcctcagcctaagcaggtttctgtagctcactagcgctctctctcttccacccactctctgtctgcgattctccttagacgctcactgcttttacttcctcgcctctctcgcaatcatggctcctgagcttcttcaatctgcaatgaaacccgttggattcaccaagccagcgactttgcctagccgggcttacgtgactttcttggctggcaatggtgattatataaaaggcgttgttgggttggccaaaggcttaaggaaggtgaaaacggcttacccattagtggtggcggttttacctgacgtgcccgaggagcacaggcggatccttgagtcacaaggctgcttagtccgggagattgaacccgtttaccctccagaaaaccaaactcagttcgccatggcatattacgtcatcaattactccaagctgcgtatatgggagttcgtggagtatagcaagatgatatacctggacggggacatccaggtattcgaaaacatagaccacctatttgatttgcctgatgggtacttgtacgctgtaatggactgcttctgtgagaagacctggagccacactgcacaatacaagatcggctactgccaacagtgccctgacagagtcaagtggcctgctgagatgggccagcccccatctctctattttaatgctggtatgtttgtgtttgagcccagcgtttccacataccatgatctgttgaagaccgttaagatcactcctcctacttcatttgcagagcaggactttttgaacatgtacttcaaggatatttacaagccaattcctctggtttacaatcttgttcttgcaatgttatggcgtcacccggagaatgtggagctcgacgaggtgaaagtcgttcactactgtgcagcgggctctaaaccatggagatacacgggcaaagaggagaacatgcagagagaggacataaagatgctggtgaagaaatggtgggacatttacaacgatgagtcgctggactacaagaaacctgcaggagacggggatgccgagccagttaaattacagcccttcattgcagctctttccgaagctggtgctcttcaatacgtcacagctccatcagctgcttgaagggcggaatatgtaaaagagcaaaagctagcaattgtacatatctagtgggagaccaaaaaaaaagaaagaaaaaaaaaagaaggaaagaaagaaaagggggcatgcaagtccttccacagagaaattaggtgaagagatctggggtcaaatgaagaggaacaagcttttggttttgggttttgtttctatctcgtcgttttctgaattctcagtttcgtacttgtcctagcatcatccggagaccgagtcacgggtggatgtgtaaacagggataaatattcctaatttgtattaggagttgtaatctattagagaaaataatattaattgtggttaattatct

SEQ ID NO: 13803 - DNA, 1392 bp, Vitis vinifera
taagccacaaacgcgccatcggcatcctcaattaagaaggaaagacaacccagagtcagattctccagcctcagctctctctagaaccgtcgtctctcttccttcccatcaactctagcacattcttgctcacatggctcctgaaatcatctccgcttcgggaaaaccgtccagatttttgaaaccggctagtcttccgaacagagcatacgtggccttcttggccggtaacggggactacgtgaaaggtgttgttgggttagccaaggggctgcggaaggtgaaatccgcttacccgcttgtggtggcggtgttaccggacgtgccggtggagcaccgccgagaactggaatcccaggggtgcatcgtcagagagattgagccggtttacccacccgagaaccagacccagttcgccatggcctattacgttatcaattattcaaagctccgtatctgggagttcgtggagtacagtaagatgatatacttggatggggatattcaagtctacgataacattgaccacctctttgagctaccagacggacatttctatgcagtgatggactgtttctgtgagaaaacatggagtcacacgccacagtacaagattggatactgccaacagtgtccggaaaaggttcagtggccggcggagctgggtcagccgccttcactttacttcaacgcaggcatgtttgtgtttgagcccagcctctccacctatgaagatctcttggaaaccctcaggatcacccctgcaaccccttttgcagagcaggatttcttgaatatgtacttcagggatgtatataagcctattcctctggtctacaatcttgtccttgccatgctgtggcggcatcctgagaatgtagagcttgataaagtgaaagttgttcactactgtgcagcggggtcgaagccatggaggtacacagggaaggaggacaacatgcagagagaggacattaagatgctggtaaacaaatggtgggagatatacaatgacaagtcattggattacaagaagacgaggatgatggcgaatgattacagcagtgttttgccgggggagcaggtgaatttggagccgttcattgcagctctttccgaggtggggcatgttgaatttgtgagagccccttcagcagcctagaagaggccagtactctcgtggagaagaggatccaaggggcatgcaatcagatgaccggtgaatttccattttcgagatgaaaatgttggttatttttgtggtttgggggtttgtcacggttagtgaatttttacgttgttcacttgtaatatccttaatgattgcccactataaggcaaattacttccagtcatacataaaatctcaaagacactctgttttatctgctg

SEQ ID NO: 13804 - DNA, 1476 bp, Euonymus alatus
aaaccaaaccagagcgagccagaaccaaagccacctaaagcttcctctctcagccaggcttcaatcagttgtcgattgtagaaatggctcccgagcttacgatgaaacaaaccgaattcaccaaaccaccggtgacactgccgagcagggcctacgtgacctttttggccggcaatgcagactacgtgaaaggcgtggtcggcttggccaagggattaaggaaggcgaaatcagtgtatccgttggtggtcgcctgtttgcctgacgtgcccgaggagcaccgggagattctccaatcacagggctgcatcgtcagagtgatcgagcccgtttacccccccgaaaaccagacccagtttgccatggcgtattacgtcatcaactactccaagctccgcatatgggagtttgtggagtacagtaagatgatatacttggacggtgacattcaagtgttcgagaacatcgatcatttgtttgatctcccagagggctacttctatgcagtgatggattgcttttgcgagaaaacatggagtcacactccacaatacaacatcggttactgccaacagtgcccggacaaggtgaagtggccggcggagatgggaaacccaccgtctctctacttcaatgctggaatgttcgtgtacgagcccagtctctccacatatgaagatctcttgacaaccgtcaaaactgttcctccgacatctttcgccgagcaggactttttgaacatgtacttcagggacatctacaagccaattccactggtttataatcttgtgcttgcgatgctttggaggcacccggagaatgttgagcttgagaaggtgaaggttgtgcactactgtgcggcgggatcgaagccgtggaggtacactggtaaagaagagaatatgcagagggaagacatcaagatgttggtccagaaatggtcggacatttatgatgatgaatcgctggattacaaggagcctgcggttgttgcggatggcgaacctgaaccggtgaatgtgcagccgttcatagcggcggctttgtcggaagctggggctgttcagtatgtgacagctccatctgctgcttaattaaagacaggtttttgatcactgctgatggaaaggaatactgaagtactaatttaatagggtaattgaagcactagttgaaaaaatacaaagataattcccttcatctaattgaattgtcttcagtaatgagaaagacaattgggtgcatttagagaaggaaaaataagcttctagctaatcttggttttgtctttttggtcttttttcttcgatccccacctgtttcttgatatggtgaaggccgtaggtttgtataacggcgtgtgttatgtagaatctttgtgagtgacagtataaacgagtattgtctatgcacaaaaatgctaaaagtgtagattcctccatggagaggttcaatgaaatgaatataattattact

SEQ ID NO: 13805 - DNA, 1289 bp, Citrus clementina
agcagaagcccatcccctctaaaattgctctctttctttctctttctctctgtgatctccctttctctctacaagttcttctaatctctaaagatggcccctcctgaactggtgcaaacagccgtgaaaccagccggactcggcgcaaaacccgcgagcttacccgggagagcttacgttacattcttggctggtaacggagactacgtaaaaggcgttgttggattggccaaaggtttaagaaaggtgaaaaccgcgtacccgttagtggttgccgttttgcctgacgtgcctgaggaacaccgcaatatcttggagtctcagggctgtattgtcagggaaatcgaacccgtttacccgcccgataaccaaacccaatatgccatggcctattacgtcatcaactactccaagctccgtatatgggagttcgtggagtacagtaagatgatatacttggacggagacatacaagttttcgagaacattgatcacttatttgatctgccggacgggtatttctacgcggtgatggactgtttctgcgagaaaacatggagcaagactccgcagtacaagatagggtactgccagcagtgtccggatagagtgaggtggccagctgaaatgggggaacctccagcactctacttcaacgccggtatgttcgtgtttgagcccagcatctctacctatcatgatcttctggaaactgtcaaagttacccctcctaccactttcgcggagcaggactttctgaacatgtatttcaagcacatttacaagcctattcctcttgtttataatcttgttctggccatgttatggcgtcaccctgagaatgttgagcttgacaaagtcaaagttgttcactactgcgcagcgggatctaagccgtggaggttcacaggagaggaagagaatatgcaaagagaggacgtcaagatgctggtgaagaaatggtgggacatttacaatgacgagtcattggattacaaaaagccttctgctgatggtaatgctgggtctgtgaacttgcagccattcattgatgctctctctgatgctgctgccgttcagtttgtgaccgccccatccgctgcttaaggaccttgtaccctgctgcggtaattggcaacggaattaaggggaagcctgaattctagagttttgggatgctgttaatatgtgcttcaaagttgtgttacggcaattgtaatttttcttagcaatggtaattaatgcagtacatgcttctaaatcatcactgtttaaggtttatttctcct

SEQ ID NO: 13806 - DNA, 1289 bp, Citrus sinensis
agcagaagcccatcccctctaaaattgctctctttctttctctttctctctgtgatctccctttctctctacaagttcttctaatctctaaagatggcccctcctgaactggtgcaaacagccgtgaaaccagccggactcggcgcaaaacccgcgagcttacccgggagagcttacgttacattcttggctggtaacggagactacgtaaaaggcgttgttggattggccaaaggtttaagaaaggtgaaaaccgcgtacccgttagtggttgccgttttgcctgacgtgcctgaggaacaccgcaatatcttggagtctcagggctgtattgtcagggaaattgaacccgtttacccgcccgataaccaaacccaatatgccatggcctattacgtcatcaactactccaagctccgtatatgggagttcgtggagtacagtaagatgatatacttggacggagacatacaagttttcgagaacattgatcacttatttgatctgccggacgggtatttctacgcggtgatggactgtttctgcgagaaaacatggagcaagactccgcagtacaagatagggtactgccagcagtgtccggatagagtgaggtggccagctgaaatgggggaacctccagcactctacttcaacgccggtatgttcgtgtttgagcccagcatctctacctatcatgatcttctggaaactgtcaaagttacccctcctaccactttcgcggagcaggactttctgaacatgtatttcaagcacatttacaagcctattcctcttgtttataatcttgttctggccatgttatggcgtcaccctgagaatgttgagcttgacaaagtcaaagttgttcactactgcgcagcgggatctaagccgtggaggttcacaggagaggaagagaatatgcaaagagaggacgtcaagatgctggtgaagaaatggtgggacatttacaatgacgagtcattggattacaaaaagccttctgctgatggtaatgctgggtctgtgaacttgcagccattcattgatgctctctctgatgctgctgccgttcagtttgtgaccgccccatccgctgcttaaggaccttgtaccctgctgcggtaattggcaacggaattaaggggaagcctgaattctagagttttgggatgctgttaatatgtgcttcaaagttgtgttacggcaattgtaatttttcttagcaatggtaattaatgcagtacatgcttctaaatcatcactgtttaaggtttatttctcct

SEQ ID NO: 13807 - DNA, 1574 bp, Lippia dulcis
cggcaccaatcttcaccgtccgatttcatcgtacggctatgcgtcgacgccaaatccaatatcaatggagggaaaacacacaccactatgtgtaacagttaccagttaaccgctatgtaacatccccttcttcctcattcgtcgctcccacaaacaaatcaaggcttctgataattaaaacactccatttgctttcttttgatccaagaaagaaagtctttttggtaaatataaagtaatactctcatggctcctgagctggttgcggcggcaggcaagccggctgacatggccaaaccggcggtgctgccgaggagggcgtacgttacttttttggccgggagcggagattatgttaaaggcgtggtgggtctggccaaggggctgaggaaggtgaaaacagcgtatcctcttgtggtggcagtgctgcctgacgtgccggcggagcaccgccgcatactggaggatcaaggctgtattgttagagagattgagcccgtttacccgccggagaatcagactcagtttgccatggcgtattacgtcatcaactactccaagctccgtatctgggagtttgtggagtacagcaagatgatatacttggatggtgatatccaagtgtacgacaacatcgatcatctgtttgatttggaagatgggtatttctatgctgtgatggattgtttctgtgagaaaacatggagccacaccccacaatacaagattagctactgccagcagtgcccggagaaggtcaagtggccggcggaaatgggcccacctccggcgctctatttcaatgccggaatgttcgtttttgagcccagtctttcgacatatgagaatctgttgaaaacactcagaattacccctcccaccccttttgctgagcaggatttcttgaacatgttcttcaaggatatctacaagcccattccgaatgtgtacaatcttgtcttagccatgttatggcgccacccggagaacgttgatcttgagaaagtgaaagttgttcactattgtgcagcggggtcgaagccgtggaggtacacggggaaggaagagaacatgcagagggaggacataaaaaagcttgttaagaaatggtgggacatttacgatgacgagtctttgaactacaagaaaccgacggtgcagaatgaggtagctgttgaggctggagcactgcagccgttgattgttgcagccatgacggagggcaatgcccctccgatgcagtatgttgcggccccttctgctgcttgactttggttcagccaaaagtcacagctggggatgtgtactatgtatatgcttaagaaggggagagttcctttttctgtcggttcttgaaggaagaatggttgtagagggagatccgagaggctaaggagaagagaaagcttgtattttggtgtcatttgcgtatatttttctagggtttgattgttcaaccttgtaagttgtaattggggaaccaagggggttgccattgatgttaaaagtcaagtgtctgatttctgtggattttttgttgcagtttttgattaatgttgaacagtatttgggtt

SEQ ID NO: 13808 - DNA, 1338 bp, Trigonella foenum-graecum
cggccgggactcaccaattccaacaatctctcttaagcattctctcaaatactttccaaacaaacactttctaaaaatttcaatttctctcacaaaagcacttttttaattttaagcacttaaagattttaattttaagcacttaaagaaatggcaccagagcttgttccaacctctacaaaatcagttaccggattcacaaagccagtgacgataccgaaacgtgcatacgtaacgtttcttgccggtaacgctgattacgtgaaaggtgtgattggtttggcgaaaggtttacgtaaggtgaaaacggcgtatccactggtggtggcggtgcttccagatgtaccggaggaacaccgtgagatgttggaagctcagggatgtattgtccgtgagattgaacccgtttacccgcccgaaaatcagacccagtttgctatggcttattacgtcatcaattattctaaactccgtatatgggagtttgtggaatacagcaagatgatatatttggacggagatattcaggtatatgaaaacatagatcatctatttgatctaccagatggccatttctatgctgtgatggattgtttttgcgagaagacttggagtcacacaccgcaatacaaaatcggttattgtcaacagtgtccagaaaaggtgcagtggccaaagaaaatgggtcaacctccttcgctttacttcaatgctggcatgtttctttttgagccaagcattgaaacttaccatgatcttttgaagacacttaaagtcactcctcctactccttttgcagaacaagatttcttgaacatgtatttcaaggatatttataagccaattccattggtttacaatcttgttcttgctatgttgtggcgtcaccctgaaaatgttgagcttcataaagtcaaagttgttcactattgtgcagcgggatcaaagccttggagatatacagggaaggaagagaatatgcagagggaggatataaaaatgttggtgaagaaatggtgggatatttacaacgattcatctcttgactacaacaaaattttgagtggaagtagtgaagtacaaacgaatggtgttgaaattgagccattcgtacaagcgttgtctgaggttggtcgtgttcaatatgtcacagcaccttcagcagcttaaactgagctgttttttggtggacatgcttgcaatggaagcaaaaaaataaagtaaggaataacaatggaaattagaagggaaaaaaaagtttaggtgcaaccgttcaagatttttttttcaagacaaggggaatggttggtgctagataggatatttcagcttttgtgt

SEQ ID NO: 13809 - DNA, 1410 bp, Fagus grandifolia
ccgctcacaactcacaatcaatagagaattacaagcctcaaacactttcactcacatacacaaaacaaattgagaaatggctcctgagctagctcctgctgctttgaaacaagctagctataacaacaagccagtgaccaaggctagccgagcatatgtgactttcttagctggtaatggtgactatgtgaaaggtgtggttgggttggctaaagggttaagaaaggttgaaacggcgtacccattagtcgttgcagttttacctgacgtaccacaagagcaccgtcggattttggagtcacagggctgtatagtccgtgagatcgaacccgtttacccgcctgagaaccagacccagttcgccatggcttattacgtcatcaactactccaagctacgtatatgggagtttgtggaatatggtaaagtgatttacttggatggagacattcaggtgtttgagaatattgaccatctctttgatttgcctgatgggcatttttatgcggtgatggattgcttctgtgaaaaaacttggagtcacaccttgcaatataagatcgggtattgccaacagtgccctgacagggtcaagtggcctgttgagatgggtcagccaccatcactttacttcaacgctggaatgtgtgtgttcgagcctagtttgtacacctatcaagatctcttgaagaccgtgaaaatcaccactcctacctcatttgctgagcaggactttttgaacatatactttagggatatttacaagcctattcctctagtttacaatcttgtccttgctatgttgtggcgtcacccagaaaatgtggaattagacaaagtcaaagttgcacactactgtgctgcgggatcaaagccatggaggtatactgggaaggaagagaacatgcaaagagaggacataaagatgcttgtgaagaagtggtgggatatatataacgatgaatcattggactacaagaagccagtagaggcagctaatggggaagcagtgaagatgcagccattcttggctgctctttcggaggttgatgctgttcagtatgtgacagcaccatcagcagcttagctagcgtgggcttctaaggataaattggacactataataactcagagttagagatgtagaagtgagagtcaagaagaatatattccttttttcctaaagacgtaaaaatgggttggtggtgggaatgggaatgagctttcccttttgcttgtctatttttatccttttgttggtgccttagtcctttccaaactttttgggggtatcggctagctgttgggtctgtttgtaatgtgtgctctctagaaatgaatacgtgtttttaacttgtcctcttttctctgtggtcttttgtgatggtattatatccatgttaagtccca

SEQ ID NO: 13810 - DNA, 1329 bp, Brassica rapa
actaaacacaacacaacaacataaacaaaacaactcttgtctcacacacttgtctaaatcctctaaaattacgtgcttctcacatggctccggagctcacacaaaccaccacagctaaatccgccgtgacgataacaaaaccgtcaccacgagtccacggtggtcgagcctacgtgacgttcctcgccggtaacggtgactacgtgaaaggtgtcgttggtttagccaaaggactaagaaaagtcaaatcagcgtatccactcgttgtggcggtactaccagacgtcccggaggagcaccgtcgtatactcgtggaacaaggttgcatcgtccgcgagatcgaaccggtttacccacccgagaaccaaactcagtttgccatggcttattacgtcatcaactattccaaactccgtatctggaagtttgtggagtacagtaaaatgatatacttagatggagacattcaagtttacgagaacatcgatcacttgttcgatctccctgaccggtacttttacgcggtgatggactgtttctgcgagaagacatggagccacacgccgcaatacaagatcgggtactgccaacagtgccctgagagagttcagtggccaaaggcggagcttggagagccaccggctctctacttcaacgctggaatgttcgtgttcgaacctggccttgatacttatgaggatctgctcaggacccttaaggttactccccctactcctttcgctgaacaggactttctgaacatgtatttcaagaaaatctacaagccgattcctttggtttacaatcttgttctggcgatgctatggcgtcacccagaaaatgtcgagctcgataaagtcaaggtggttcactactgtgcagcgggttcgaagccatggagatacacagggaaggaggcgaatatggagagagaagacatcaaaatgttagtgaacaagtggtgggacatctacaaggacggttccttggattacaagaaatctgaagctgagtcggatctagtgaatctgaagccgttcatcaacgctcttactgaagctggacgggtcaagtacgtgactgcaccgtccgctgcttgaatgtcaaaattgtcggtgaagtagattcggtttttgtggagcagcaggtggattatgagttgttgtgttgttacgacaaccacacgctctctggtttcatgtgtgatttgtggttgacgcgtgttttttgttcccttaatttctgagtgtgtttttatgattttttgtgtaatgtaagctgtatatttagttcaaattttaataacgatattgattatcgaacagtaaa

SEQ ID NO: 13811 - DNA, 1379 bp, Arabidopsis lyrata
ctcatcagcaaacacaagcacataactagataaactcttcttctctcatcacatttttcgctaaatcctctcagcaaatcacgtgctaatcacatggctccggggcttactccaaccgccgatgccgaatccaccgtgatgataacaaaaccgttactaccatcagtccaagacagcgatcgagcttacgtgacgtttcttgccggaaacggtgattacgtgaaaggagttgttggtttagccaaaggtttaaggaaagtcaaatcggcttatccactcgttgtggcgatattaccggacgtgccggaggagcaccgtcgtatacttatggaacaaggatgcattgttcgtgaaattgaacccgtttacccacccgagaaccaaactcagttcgccatggcttattacgtcatcaactactctaaactccgtatctggaagtttgtggagtatagtaaaatgatatatttagatggagacattcaagtttacgaaaacatcgatcacttgtttgatctaccagatggctatttctacgcggtgatggattgtttctgcgagaaaacatggagccacacgccgcaatacaagattggatattgccaacaatgccgcgataaagtccagtggccaaaggcggagcttggagagcctccggctctttacttcaacgccggaatgttcttgttcgagcctaaccttgagacttacgaggacctactaagaacccttaaaatcactcctccgactccttttgctgaacaggattttctaaacatgtacttcaagaaaatctacaagccgattcctttagtgtacaacctcgtccttgcgatgttatggcgtcatccagaaaatgtagagcttgggaaagtcaaggtggttcactactgtgcagcgggttcgaagccgtggagatacacagggaaagaagcgaacatggacagggaagacataaaaatgttagtgaagaaatggtgggacatttacaacgatgaatccttggattacaagaaacctgtagccgttgtgggcacagaggccgatcccgtgaatctgaagccgtttatcaccgctcttactgaagctggccgggtcaactacgtgactgcaccgtccgctgcttgaatgggagttataaatgtcggtgaattaggtagtttttttttctctgggcagtaaatcgtttcgggggttgtgtccggtcgacaaccactcatactgtctctggtttcaaatgctttggacgttgacatgtgatttgtcttacctttttataaaatttgtctataatgtgtgctttcctgaatttttgagtgtatcttcgaatctcaagtttgaatgacaaaataaataataaaaaaaaaacgggtcagctt

SEQ ID NO: 13812 - DNA, 1388 bp, Vitis vinifera
taagccacaaacgcgccatcggcatcctcaattaagaaggaaagacaacccagagtcagattctccagcctcagctctctctagaaccgtcgtctctcttccttcccatccactctagcacattctcgctcacatggctcctgaaatcatctccgcttcgggaaaaccgtccagatttttgaaaccggctagtcttccggacagagcatacgtggccttcttggccggtaacggggactacgtgaaaggtgttgttgggttagccaaggggctgcggaaggtgaaatccgcttacccgcttgtggtggcggtgttaccggacgtgccggtggagcaccgccgagaactggaatcccaggggtgcatcgtcagagagattgtgccggtttacaagaaccagacccagttcgccatggcctattacgttatcaattattcaaagatccgtatctgggagttcgtggagtacagtaagatgatatacttggatggggatattcaagtctacgataacattgaccacctctttgagctaccagacggacatttctatgcagtgatggactgtttctgtgagaaaacatggagtcacacgccacagtacaagattggatactgccaacagtgtccggaaaaggttcagtggccggcggagctgggtcagccgccttcactttacttcaacgcaggcatgtttgtgtttgagcccagcctctccacctatgaagatctcttggaaaccctcaggatcacccctgcaaccccttttgcagagcaggatttcttgaatatgtacttcagggatgtatataagcctattcctctggtctacaatcttgtccttgccatgctgtggcggcatcctgagaatgtagagcttgataaagtgaaagttgttcactactgtgcagcggggtcgaagccatggaggtacacagggaaggaggacaacatgcagagagaggacattaagatgctggtaaacaaatggtgggagatatacaatgacaagtcattggattacaagaagacgaggatgatggcgaatgattacagcagcgttttgccgggggagcaggtgaatttggagccgttcattgcagctctttccgaggtggggcatgttgaatttgtgagagccccttcagcagcctagaagaggccagtactctcgtggagaagaggatccaaggggcatgcaatcagatgaccggtgaattcccattttcgagatgaaaatgttggttatttttgtggtttgggggtttgtcacggttagtgaatttttacgttgttcacttgtaatatccttaatgattgcccactacaaggcaaattacttccagtcatacataaaatctcaaagacactctgttttatctgcggtt

SEQ ID NO: 13813 - DNA, 1412 bp, Pisum sativum
cttctaccacctccctttttattatatataccacctttacctccaccattcgactcacaatcatcaaacaaactattaaccatcctctctaaaataaacagttttcgaaactctttaaaataaacagttttcaattttcagcactcaaaaaaatggcaccggagatcgttcagacctctacgaaaccagttaccggtttcacgaaactgaaacgtgcatacgtaacgtttctcgccggcaacggcgactacgtgaaaggcgtaataggtttggcaaaaggtttacgaaaagttaaaacggcgtacccgctggttgttgccgtgcttccagacgtaccggaggagcaccgtgagatgttggaatctcagggatgtatcgtccgtgagattcaaccggtttacccaccggaaaatcaaactcagtttgctatggcctattacgtcatcaattactccaaactccgaatatgggagtttgtggaatacagcaagatgatatatttggatggagacattcaggtatatgaaaacatagatcatctttttgatctaccagacggttatttctacgctgtgatggattgtttctgtgaaaaaacatggagtcatacaccacagtataagatcgggtactgtcagcagtgtccggagaaggtgcaatggccgaaagaaatgggtgaacctccttccctttacttcaatgctggcatgtttctgtttgagccaagtgttgagacttatgatgatcttttgaaaacttgtcaagttactgctcctactccgtttgcagaacaagatttcttgaacatgtattttaaggatatttataggccaattcctttggtttataatcttgttcttgctatgttgtggcgtcatcctgagaatgttgagcttaggaaagtcaaggttgttcactattgtgcagccggttcaaagccttggaggtatactggaaaagaagagaatatgcagagggaggatataaagatgttggtgcagaaatggttggatatatacagtgattcttcacttgactacaagaagaatttgagtggaaattgtgagacacaaaggaatgatgttgaagagccgtttgtacaggcgttgtcggaggttggtcgtgttcgatatgtcacagcaccttcggcagcttaactgagctgtttttaggaataagaatgaggaggtgcaaccagactttgcggtcggtgctaatagtcaaatggaatatagatttctagttttgtgtgttttgttctaatttggggaatttgatctttggtttttgtacatatgggtctgtatcttggcttgtattttcaggtatatattgttgtgcttttatttatggtacctttttcatttagtttcttcttttgtaattgtaatatatatcaaaagctttttgat

SEQ ID NO: 13814 - DNA, 1262 bp, Glycine max
attactctctcactctcttttaggctcactcaccaacacttttttcactactttcattacgaacgtatattatatggctcctgaacttgtccccaccgttgcgttcacgaaacccgcaacccttccaaggcgtgcctacgtgacattcctcgccggaaacggtgactacgtgaaaggggtcgttggtcttgccaaagggttgcgaaaggtgaaaaccgcgtacccattggtggtggcggtcctcccagatgtgccggaggaccaccgtaagatcctggagtctcagggctgcatcgtccgcgagatcgaacccgtttacccgcccgaaaaccaaacccagttcgccatggcttattacgtcattaactactccaagctccgtatatgggagtttgtggaatacaccaagatgatatacttggacggagacattcaggtatatgagaacatagaccacctatttgacctacctggtggttacttttacgctgtgatggattgtttctgcgagaagacatggagtcacacccctcagtacaaggtggggtactgccagcaatgcccggagaaggtgcagtggcccaccgaattgggccagccaccttctctttacttcaacgccggcatgttcgtgttcgagcccagcatcgccacctaccatgacctattaaaaacagtgcaagtcaccactcccacttcgttcgcagaacaagatttcttgaacatgtacttcaaggatatttacaagccaatccctttaaattacaatcttgtccttgccatgctctggcgccacccagaaaatgttaaattagaccaagtcaaggttgttcactattgcgcagcggggtcgaaaccgtggagatatacggggaaggaagagaacatgcagagggaggacataaagatgctggtgaaaaaatggtgggatatctacaatgatgcttcgcttgactacaagccattgatgagtgcaagtgaagctccagcaccggatggtgttgacaatattgaaccattcgtgcaggctctgtcagaggttggtcatgttcaatatgtcactgcgccctcagcagcttaaaaaaacaaggaagtgaaaaaaaatatatatataaaaaaagaattgtgaaaagagaaggtagaaaacgaggaggagtaggtggaagactttgcggtcaaaacaagggaggtttctttctttcttactttttggtgtagttattgggagcagtcgtggcttgctttagaaattggacctctcc

SEQ ID NO: 13815 - DNA, 1309 bp, Brassica oleracea
caacataaacaaaacaactcttgtctcatcacacttctctaaatcctctaaaattacgtgcttctcacatggctccggagctcacacaaaccaccaccgagaaatcagccgtgacgataacaaaaccgtcgcccccagtccacggcggtcgagcctacgtgacgttcctcgccggtaacggtgactacgtgaaaggagtcgttggtttagccaaaggactaagaaaagtcaaatcagcgtatccactcgttgtggcgatactaccagacgtcccggaggagcaccgtcgtatactcgtggaacaaggttgcatcgtccgcgagatcgaaccggtttacccacccgagaaccaaactcagtttgccatggcttattacgtcatcaactattccaaactccgtatctggaagtttgtggagtacagtaaaatgatatacttagatggagacattcaagtttacgagaacatcgatcacttgttcgatctccctgaccggtacttttacgcggtgatggactgtttctgcgagaagacatggagccacacgccgcaatacaagatcgggtactgccaacagtgccctgagagagttcagtggccaaaggcggagcttggagagccaccggctctctacttcaacgctggaatgttcgtgttcgaacctggccttgatacttatgaggatctgctcaggacccttaaggttactccccctactcctttcgctgaacaggactttctgaacatgtatttcaagaaaatctacaagccgattcctttggtttacaatcttgttctggcgatgctatggcgtcacccagaaaatgtcgagctcgataaagtcaaggtggttcactactgtgcagcgggttcgaagccatggagatacacagggaaggaggcgaatatggagagagaagacatcaaaatgttagtgaacaagtggtgggacatctacaaggacggttccttggattacaagaaatctgaagctgagtcggatctagtgaatctgaagccgttcatcaacgctcttactgaagctggacgggtcaagtacgtgactgcaccgtccgctgcttgaatgtcaaaattgtcggtgaagtagattcggtttttgtggagcagcaggtggattatgagttgttgtgttgttacgacaaccacacatgctgtctctggtttcatgtgtttttgtggttgacgcgtgttttttgttcccttaatttctaagtgtgtgttttatgaatttttgtgtaaagtaagctgtatatttagttcaaaatttaataacgatattaattatcg

SEQ ID NO: 13816 - DNA, 1572 bp, Glycine max
atacacacacccaccccctcccactctccaccaacaaaacaaaacttctgcattactctctcactctcttttaggctcactcaccaacacttttttcactactttcattacgaacgtatattatatggctcctgaacttgtccccaccgttgcgttcacgaaacccgcaacccttccaaggcgtgcctacgtgacattcctcgccggaaacggtgactacgtgaaaggggtcgttggtcttgccaaagggttgcgaaaggtgaaaaccgcgtacccattggtggtggcggtcctcccagatgtgccggaggaccaccgtaagatcctggagtctcagggctgcatcgtccgcgagatcgaacccgtttacccgcccgaaaaccaaacccagttcgccatggcttattacgtcattaactactccaagctccgtatatgggagtttgtggaatacaccaagatgatatacttggacggagacattcaggtatatgagaacatagaccacctatttgacctacctggtggttacttttacgctgtgatggattgtttctgcgagaagacatggagtcacacccctcagtacaaggtggggtactgccagcaatgcccggagaaggtgcagtggcccaccgaattgggccagccaccttctctttacttcaacgccggcatgttcgtgttcgagcccagcatcgccacctaccatgacctattaaaaacagtgcaagtcaccactcccacttcgttcgcagaacaagatttcttgaacatgtacttcaaggatatttacaagccaatccctttaaattacaatcttgtccttgccatgctctggcgccacccagaaaatgttaaattagaccaagtcaaggttgttcactattgcgcagcggggtcgaaaccgtggagatatacggggaaggaagagaacatgcagagggaggacataaagatgctggtgaaaaaatggtgggatatctacaatgatgcttcgcttgactacaagccattgatgagtgcaagtgaagctccagcaccggatggtgttgacaatattgaaccattcgtgcaggctctgtcagaggttggtcatgttcaatatgtcactgcgccctcagcagcttaaaaaaacaaggaagtgaaaaaaaatatatatataaaaaaagaattgtgaaaagagaaggtagaaaacgaggaggagtaggtggaagactttgcggtcaaaacaagggaggtttctttctttcttactttttggtgtagttattgggagcagtcgtggcttgctttagaaattggacctctccagcttttatgtatatttgttttctttaattttgctcttttggaatattcttaatctttggtgggtctgttcataagagtctgtatctggtcttggtctacaagtatatgtgtttaatttatgtatatttctgttgtctccttaatttcctttggttggactttgccattgtaaaaatacttttaacttttaaggcaatgcttaatgattaagggaaatgatgtcctttttatggtgtaaagggtttcttgtctgtttcc

SEQ ID NO: 13817 - DNA, 1352 bp, Brassica oleracea
acacataaaagacaacaacaaaaactcttctctcatcacatttactctaaatcttccaaactcacgtgcttctcacatggctccggagcttatacaaaccaacaccgccaaatccgccgtgacgataactaaaccgtcgccaccagtccacagtgatcgagcatacgtgacatttctagctggaaacggtgattacgtcaaaggagtcgtaggtttagccaaaggactaaggaaagtcaaatccgcttatccactcgtcgtggcgatattaccagacgtcccggaggagcaccgtcgtatacttgtggaacaaggttgcattgtccgcgagatcgaacccgtttacccacccgagaaccaaacccagtttgccatggcttattacgtcatcaactactccaaactccgtatctggaagtttgtggagtatagtaaaatgatatatttggatggagacattcaagtttacgagaacatcgatcacttgttcgatctccctgatggctatttctacgcggtgatggactgtttctgcgagaaaacatggagccacacgccccaatacaagatcgggtactgccaacaatgccctgagaaagtccagtggccgaaggaagagcttggtgaaccaccgtctctttacttcaacgccgggatgttcgtgttcgaacctggtctagatacttacgaggatctgctaagaaccttaaagatcactcctccgactcctttcgctgaacaggactttctgaacatgtacttcgagaaaatctacaagccgattcctttagtttacaatctcgtcctagcgatgctatggcgtcatccagaaaatgtggagctcgataaggtcaaggtggttcactactgtgcagcgggttcgaagccatggagatacacagggaaggaagctaatatggagagggaagacatcaaaatgttggttaacaaatggtgggatatctacaatgatgattccttggattacaagaaatctgtcggagaccttgtggaagagtcggatgtggtgaatctgaagccgtttatctccgctcttaccgaagctggaccggtcaagtacgtgactgcaccgtctgccgcttgattatcgaaattatttagaagttaaaccgtcggtgaagtagattcggggtttgtccgggcagtaagtggatagggggctgtgttggctcgacaaccacacatgttgtctctgctttcatgggcttttgaggttgacatgtgtttttgttttcttacttgtttgattattgtgtgcgctttcatgtattttgtgtgttgtagattgtaagtttccgaagttcaaatttgaataaagaaattaatatccg

SEQ ID NO: 13818 - DNA, 1561 bp, Medicago truncatula
caccaatttattttcagcaatctctcttaagcattctcgcaaatacttctctcagaattttaatttctttcacaaaagcaacttaaaaatatggcaccagagcttgttccaaccgctgcaaaatcagttaccggattcacgaagccagtgacgataccaaaacgtgcgtatgtaacgtttcttgccggtaacggtgattacgtgaaaggtgtaataggtttggcgaaaggtttgcggaaggtgatgacggcgtatccgctggttgtggcggtgcttccagatgtaccggaggaacaccgtgagatgttggaagctcagggatgtattgtccgtgagattgaaccggttaacccacccgaaaatcagactcagtttgctatggcgtattacgtcatcaattattccaaactccgtatatgggagtttgtggaatacagcaagatgatatacttggacggagacattcaagtttatgaaaacatagaccatctctttgatctaccagatggtcatttctacgctgttatggattgtttttgcgagagaacttggagtcacacaccacaatacaaaatcggttattgtcaacaatgtccagaaaaagttcattggccaaaggaaatgggtcaacctccttcactttacttcaatgctggcatgttcctgtttgagccaagcattgatacttaccacgatcttttgaagacacttaaagttactcctcctactccttttgctgaacaagatttcttgaatatgtatttcaaggatatttataagccaatcccatttgtttacaatcttgttcttgctatgttatggcgtcaccctgaaaatgttgagcttcataaagtcaaggttgttcactattgtgcagcgggatcaaagccttggagatacacagggaaggaagaaaacatgcaaagggaggatataagaatgctagtcaagaaatggtgggatatttacaatgattcatctcttgattacaacaagaatttgagtggaagtggtgaagtacaaacgaatggttttgaaattgagccattcgtacaagcattgtctgaggtaggtcgtgttcaatatgtcacagcaccttcagcagcttaaactgagctgttttttggtgaccattcattcgtgcaatggaagcaaaaacataaaaaatgaagtaaggaataacgatggaaattattatggaagtgagtaaaaagtttaggtgcaaccgttcaagaatttttttcaagacaaggggaaatggttggtgctatatttcagcttttgtgtgtttttattttattttttaaatttgggaattttgtttgacttcagttttgtttatatgggtttggttctggcttgtaattttcaaatatgtacattatgttcttgttttttatttttgattctgttgttggtttttgtaatatatatcaagggcaattgcttcgttgtaaagggaaatgaaatatgaaatgcaaatgcaacgcaattttatcgtgtaaagggtctcttgtctatttcatgtgaaattgtgggaagttttccatgtctgtattga

SEQ ID NO: 13819 - DNA, 1419 bp, Brassica rapa
acacaaaacaagacaacaacaaaaactcttctctcatcacatttactctaaatcttccaaactcacgtgcttctcacatggctccggagcttacacaaaccaccaccgttaaatccgccgtgacgataactaaaccgtcaccaccagtccacggtgatcgagcatacgttacatttctagctggaaacggtgactacgtcaaaggagtcgtaggcttagccaaaggactaagaaaagtcaaatcggcgtatccactcgtcgtggcgatattaccagacgtcccggaggagcaccgtcgtgtacttgtggaacaaggttgcattgtccgcgagatcgaacccgtttacccacccgagaaccagacccagtttgccatggcttattacgtcatcaactactccaaactccgtatctggaagtttgtggagtatagtaaaatgatatatttggatggagacattcaagtctacgagaacatcgatcacttgtttgatctccctgatggctatttctacgcggtgatggactgtttctgcgagaaaacgtggagccacacgccgcaatacaagatcggatactgccaacaatgccctgagaaagtccagtggccgaaggaagagcttggtgaaccaccgtctctttacttcaacgccgggatgttcgtgttcgaacctggtctagatacttacgaggatctgctaagaaccttaaagatcactcctccgactcctttcgctgaacaggactttctgaacatgtacttcgagaaaatctacaagccgattcctttagtttacaatctcgtcctagcgatgctatggcgtcatccagaaaatgtggagctcgataaggtcaaggtggttcactactgtgcagcgggttcgaagccatggagatacacagggaaggaagctaatatggagagggaagacatcaaaatgttggttaacaaatggtgggatatctacaatgatgattccttggattacaagaaatctgtcggagaccttgtggaagagtcggatgtggtgaatctgaagccgtttatctccgctcttactgaagctggaccggtcaagtacgtcactgcaccgtccgctgcttgattgtcgaaattatttagaagttaaaccgtcggtgaagtagattcggggtttgtccgggcagtaagtggatagggggctgtgttggctcgacaaccacacatgttgtctctgctttcatgggcttttgaggttgacatgtgtttttgttttcttacttgtttgattaatgtgtgcgctttcatgtattttgtgtgttgtagattgtaagtttccgaagttcaaatttgaataaagaaattaatatccgaaagtaaaagaggtgagttattaaaggaaagtacaaaatgtgatatggttttgagtttgagatgcg

SEQ ID NO: 13820 - DNA, 1304 bp, Brassica napus
aacgcaacataaacaaagcaactcttgtctcatcacacttctctaaatcctccaaaatcacgtgcttctcacatggctccagagctcacacaaaccaccaccgagaaatcagccgtgacgataacaaaaccgtcgtccccagtccacggcggtcgagcctacgtgacgttcctcgccggtaacggtgactacgtgaaaggagtcgttggtttagccaaaggactaagaaaagtcaaatcagcgtatccactcgttgtggcgatactaccagacgtcccggaggagcaccgtcgtatactcgtggaacaaggttgcatcgtccgcgagatcgaaccggtttacccacccgagaaccaaactcagtttgccattgcttattacgtcatcaactattccaaactccgtatctggaagtttgtggagtacagtaaaatgatatatttagatggggacattcaagtttacgagaacattgatcacttgttcgatctccctgatgggtacttttacgcggtgatggactgtttctgtgagaagacatggaaccacacgccgcaatacaagatcgggtactgccaacagtgccctgagaaggtccagtgggcaaaggcggagcttggagagccgccggctctctacttcaacgctggaatgttcgtattcgaacctggcctagatacttacgaggatctgctcaggacccttaaagtcactccccctactcctttcgctgaacaggactttctgaacatgtatttcaagaaaatctacaggccgattcctttggtttacaatcttgtcctagcgatgctatggcgtcatccagaaaatgtagagctcgataaagtcaaggtggttcactactgtgcagcgggttcgaagccatggagatacaccgggaaggaggcgaatatggagagagaagacatcaaaatgttagtgaataaatggtgggacatctacaaggacggttccttggattacaagaaacctgaagcagagtcggatctagtgaatctgaagccgttcatcaacgctcttactgaagctggacgggtcaagtacgtgactgcaccgtccgctgcttgaatgccaaaattgtcggtgaagtagattcggtttttgtggggcagcaggtggattatgagttgtggtgttgttacgacaaccacgcatgctgtctcttggtttcatgtgcttttgagattgacgcgtgttttttgttcccttaatttctaagtgtgtgttttatgaatttttgtgtaaagtaagctgtatatttagttcaaaatttaataacgata

SEQ ID NO: 13821 - DNA, 1073 bp, Oryza sativa
ctcagctcagctgtcacggtgtcacctgtcagcgcccacaactgctcgctccgtcctccaaagcccgcgagatccaaagccgaacgccactagctagctgagagagaagcgccggccggcgagggggctagtgcgcgggaatggcggcgggcggaggcggcggctacagggcggaggacgactacgactacctgttcaagacggtgctcatcggcgactccggcgtgggcaagtccaacctgctgtcgcgtttcaccaagaacgagttctgcctcgagtccaagtccaccatcggggtcgagttcgccacccgcagcatccaggtcgacggcaaggtcgtcaaggcccagatttgggacaccgccggccaggagagataccgtgctattacaagtgcctattacagaggagcagtaggtgcactgcttgtctatgatgtcactcggcgtgctactttcgataatgtggcacgctggctaaaagagctgagagaccacactgaccctagtattgttgtcatgctagtaggcaacaaatccgatctccgccatctggtggctgtttcaactgaagatggaaaggaatatgctgaggctgagtcattgtacttcatggagacatctgcattagacgccacaaatgtagagaatgcttttgcagaagttttgactcagatataccaaactgtcagcaagaagacggttgaggcatcagatgatggatcaaatgctccaatcaaaggagagaagattaatgtgaaagatgacgtgtctgcgctgaagagaattggctgttgctcaaattagagtagagatgcatttcttgttgattttttccactaggtgtacggctgtatgttgcttctattgaaagaggtccattaattttcattttgttgtggtgatattgagagttagattgttccaactttcagttataccatttcttgaaagtcttaactcaagacagctcctttcgtcagattggttactgtattcgacataattctgcaaaacatttgtttacagtgggaacctggcaatatttcggggcattctgacagccttctgaac

SEQ ID NO: 13822 - DNA, 1068 bp, Oryza sativa
ctcagctgtcacggtgtcacctgtcagcgcccacaactgctcgctccgtcctccaaagcccgcgagatccaaagccgaacgccactagctagctgagagagaagcgccggccggcgagggggctagtgcgcgggaatggcggcgggcggaggcggcggctacagggcggaggacgactacgactacctgttcaagacggtgctcatcggcgactccggcgtgggcaagtccaacctgctgtcgcgtttcaccaagaacgagttctgcctcgagtccaagtccaccatcggggtcgagttcgccacccgcagcatccaggtcgacggcaaggtcgtcaaggcccagatttgggacaccgccggccaggagagataccgtgctattacaagtgcctattacagaggagcagtaggtgcactgcttgtctatgatgtcactcggcgtgctactttcgataatgtggcacgctggctaaaagagctgagagaccacactgaccctagtattgttgtcatgctagtaggcaacaaatccgatctccgccatctggtggctgtttcaactgaagatggaaaggaatatgctgaggctgagtcattgtacttcatggagacatctgcattagacgccacaaatgtagagaatgcttttgcagaagttttgactcagatataccaaactgtcagcaagaagacggttgaggcatcagatgatggatcaaatgctccaatcaaaggagagaagattaatgtgaaagatgacgtgtctgcgctgaagagaattggctgttgctcaaattagagtagagatgcatttcttgttgattttttccactaggtgtacggctgtatgttgcttctattgaaagaggtccattaattttcattttgttgtggtgatattgagagttagattgttccaactttcagttataccatttcttgaaagtcttaactcaagacagctcctttcgtcagattggttactgtattcgacataattctgcaaaacatttgtttacagtgggaacctggcaatatttcggggcattctgacagccttctgaac

SEQ ID NO: 13823 - DNA, 1093 bp, Hordeum vulgare
tgcaggggttttcgtgcacaagaacggcgcaccaaataaatatttcagatttattacgactgcgtagcagcagcaaggcagcaaacccagttcacacggtgtcgctgtcgcccattactgctccgtcgtcgtccacagcgacgccaacgctgcacccagccagaccccgcgagatccagagcctagcactagctggccggggaggaggaaggtccaggacccgcgagacaggcaaggggatggcgggcagcggaggcggcgcctacagggcggaggacgactacgactacctcttcaaggcggtgatcatcggcgactccggcgtcggcaagtccaacctgctctcgcgcttcaccaagaacgagttctgcctcgaatccaagtccaccatcggggtcgagttcgccacccgcagcctccaggtcgacggcaaggtcgtcaaggcccagatttgggacaccgctggccaggagagataccgtgctattacgagtgcctattatagaggagcagtaggtgcgttgctggtgtatgatgtcactcgccgtgctacattcgacaatgtggcgcgctggctaaaagagctaagagatcatactgaccctagcattgttgtcatgctagttggcaacaaatctgaccttcgccacttggtggctgtttcaactgaagatgggcaggaatatgctgaggcggagtcactgtacttcatggaaacatctgcattagacgcgacaaatgtagacaacgctttctcagaagttttgactcagatataccgtattgcgagcaggaagacggttgatgcaggagacgacggctcatctgccccaagcaaaggggagaatataaatgtgaaagacgacgtgtcttcgctgaagagagccggctgctgctcaagttagggtatagatgcattattatttgttacgttttctaccagttggtgtatcttgtattgcaacaaaacagatttactgattctctcattttgctgcggttatggtgatggttaggttggttcagctttcacctgaaactggtatgtcagattgattatgatattctgcaagtaatttgtttacagtaggat

SEQ ID NO: 13824 - DNA, 1586 bp, Hordeum vulgare
tgcgtagcagcagcaaggcagcaaacccagttcacacggtgtcgctgtcgcccattactgctccgtcgtcgtccacagcgacgccaacgctgcacccagccagaccccgcgagatccagagcctagcactagctggccggggaggaggaaggtccaggacccgcgagacaggcaaggggatggcgggcagcggaggcggcgcctacagggcggaggacgactacgactacctcttcaaggcggtgatcatcggcgactccggcgtcggcaagtccaacctgctctcgcgcttcaccaagaacgagttctgcctcgaatccaagtccaccatcggggtcgagttcgccacccgcagcctccaggtcgacggcaaggtcgtcaaggcccagatttgggacaccgctggccaggagagataccgtgctattacgagtgcctattatagaggagcagtaggtgcgttgctggtgtatgatgtcactcgccgtgctacattcgacaatgtggcgcgctggctaaaagagctaagagatcatactgaccctagcattgttgtcatgctagttggcaacaaatctgaccttcgccacttggtggctgtttcaactgaagatgggcaggaatatgctgaggcggagtcactgtacttcatggaaacatctgcattagacgcgacaaatgtagacaacgctttctcagaagttttgactcagatataccgtattgcgagcaggaagacggttgatgcaggagacgacggctcatctgccccaagcaaaggggagaatataaatgtgaaagacgacgtgtcttcgctgaagagagccggctgctgctcaagttagggtatagatgcattattatttgttacgttttctaccagttggtgtatcttgtattgcaacaaaacagatttactgattctctcattttgctgcggttatggtgatggttaggttggttcagctttcacctgaaactggtatgtcagattgattatgatattctgcaagtaatttgtttacagtaggatctgagcaatatctcactgtttatttttattggaatcatgtaggaatactgcatgttagtaagataaaaatactccctccgtttctaaatattagtctttttcgaaatttcattaggtgactacatatgaatgtatataaacatactttagagtataaatttactcattttgtttcatatgtagtcctctagagaaatctctaaaaagacttatatttagaaacggagggagtagaaagtaccagcaggctaagaatcctgcataagtacagaaaacacactaaaaaggacctcggaactgaacacgcaaaattgaacatttccatcactagcagtggcccattggtgagcatcgtcattcatttgcaattggtgtctgttcaaacttaagctgtgtttgattgagttgcagattctgtaaaagttgtgggaagctgtgagtttcagctgtggacaagttgaaagctgtttgactgatacaaccgtgaaactgtagatttgactgtgaattgtctgtaatgatcctgagttgggagtcaatatttttatgttca

SEQ ID NO: 13825 - DNA, 953 bp, Avena sativa
cgcaatccctgttagtagctcacaccgtgtcgctgtcacctactgctccgtcgtctcggtctcgcagcgacgacgccgcgcccaaaccccgcccaagatccagagccctagagcgagcaggcaggggagggaggaaggcccaggaccccgcgagcaaggcgaggaagggaaataatggcgggcagcggcgcgtacagggcggaggacgactacgactacctcttcaaggcggtgatcatcggcgactccggcgtcggcaagtccaacctgctctcgcgcttcaccaagaacgagttctgcctcgagtccaagtccaccatcggggtcgagttcgccacccgcagcctacaggtcgacggcaaggtcgtcaaggcccagatttgggacaccgcgggacaggagagataccgagctattaccagtgcctattatagaggagctgtcggtgcgttgcttgtctatgatgtcactcgccgtgttacattcgacaatgtggcgcgctggctaaaagagctgagagatcacactgatcctagcatcgttgtcatgctagttggcaacaaatctgatctccggcacttggtggctgtttctactgaagatggacaggaatatgctgagtccgagtcactgtacttcatggaaacatctgctttggacgcgacaaatgtagacagcgcttttgcagaagttttgactcagatataccaaattgcgagcaggaagacggttgatgcaggagaggatggctcatctgccccaagcaaaggggagaagataaatgtgaaagacgacgtgtctgcactgaagagagccggctgttgctccacttagggtatagatgcattgtatgttgggttttctactagttggtgctgcttctactgcaacatatttattcgttttctttttggcacggctatgtcgagggctagattgattcagctatcacc

SEQ ID NO: 13826 - DNA, 805 bp, Pseudoroegneria spicata
agaaggtccaggacccgcgaggcagggaggggatggcgggcagcggaggcggcgcgtacagggcggaggacgactacgactacctcttcaaggcggtgatcatcggcgactccggcgtcggcaagtccaacctgctgtcgcgcttcaccaagaacgagttctgcctcgaatccaagtccaccatcggggtcgagttcgccacccgcagcctccaggtcgacggcaaggtcgtcaaggcccagatttgggacaccgccggccaggagagataccgtgctatcacaagtgcctattatagaggagcagtaggcgcgttgcttgtgtatgatgtcactcgccgtgctacattcgacaatgtggcgcgctggctaaaagagctgagagatcacactgatcctagcattgttgtcatgttagttggcaacaaatctgatcttcgccacttggtggctgtttcaactgaagatgggcaggaatatgctgaggcggagtcactgtacttcatggaaacatctgcattagacgcgacaaatgtagacaacgctttctcagaagttttgactcagatataccgaattgcgagcaggaagacggttgatgcaggagacgacggctcatctgccccaagcaaaggggagaatataaatgtgaaagacgacgtgtcttcgctgaagagagctggctgctgctcgagttagggtatagatgcattattatttgttgcgttttctactggttggtgtatcttgtattgcaacaaaacagatttgttgattctctcattttgctgcggttttggtgatgg

SEQ ID NO: 13827 - DNA, 1060 bp, Secale cereale
ctgctccgtcgtcgtccccagcgacgccaacgctgcacccagaccccgcgagatccagagcctagcactagcaggtcggggaggaggaaggcccaggacccgcgaggcaggcagaggggatggcgggcagcggaggcggcgcgtacagggcggaggacgactacgactacctcttcaaggcggtgatcatcggcgactccggcgtcggcaagtccaacctgctctcgcgcttcaccaagaacgagttctgcctcgaatccaagtccaccatcggggtcgagttcgccacccgcagcctccaggtcgacggcaaggtcgtcaaggcccagatttgggacaccgccggccaggagagataccgtgctatcacaagtgcctattatagaggagcagtaggcgcattgcttgtgtatgatgtcactcgccgtgctacattcgacaatgtggcgcgctggctaaaggagctgagagatcacactgatcccagcattgttgtcatgttagttggcaacaaatctgatcttcgccacttggtggctgtttccactgaagatgggcaggaatatgctgaggcggagtcactgtacttcatggaaacatctgcactagacgcgacaaatgtagacaacgctttctcagaagttttgactcagatataccgaattgcgagcaggaagatggttgatgcaggagacgacggctcatctgccccaagcaaaggggagaatataaatgtgaaagacgacgtgtcttcgctgaagagagccggctgctgctcgagttagggtatagatgcattattatttgctgcgttttctaccggttggtgtatcttgtattgcaacaaaactgatttgtcgattctctcattttgctgcggttatggtgatggctaggttggttcagctttcacctgaaaactgttatatcagattgataatgatattctgcgagtactttgtttacagtaggatctgagcaatattgtctattttttatcagaactgtgtaggagaactgcatgtaatgtattatgacagaaatagaaagtacaagcagg

SEQ ID NO: 13828 - DNA, 930 bp, Avena sativa
gcgagcgaagcgagggacgaagggggaatggcgggcagcggcgcgtacagggcggaggacgactacgactacctcttcaaggcggtgatcatcggcgactccggcgtcggaaagtccaacctgctctcgcgcttcaccaagaacgagttctgcctcgagtccaagtccaccatcggggtcgagttcgccacgcgcagcctgcaggtcgacgggaaggtcgtcaaggcccagatttgggacaccgcggggcaggagagataccgagctattaccagtgcctattatagaggagctgtcggtgcgttgcttgtctatgatgtcactcgccgcgttacattcgacaatgtggcgcgctggctaaaagagctgagagatcacactgatcctagcatcgttgtcatgctagttggcaacaaatctgatctccggcacttggtggctgtttctactgaagatggacaggaatatgctgagtccgagtcactgtacttcatggaaacatctgctttggacgcgacaaatgtagacagcgcttttgcagaagttttgactcagatataccaaattgctagcaggaagaatgttgatgcaggagaggatggctcatctgccccaagcaaaggggagaagataaatgtgaaagacgacgtgtctgcactgaagagagccggctgttgctccacttagggtatagatgcattgtatgttgggttttctactagttggtgctgcttctactgcaacatatttattcgttttctttttggcacggctatgtcgagggctagattgattcagctatcaccggaaactgttatgtcaggttgattatgatattgtgcaagtaattttttacagtaggatctgtgcaacgtcttactatttattcttcactgtgttttcccgtcctgtcatttacaggtccacggg

SEQ ID NO: 13829 - DNA, 999 bp, Festuca arundinacea
gctccgtcgtctcccagcgacgacgccgcgcccaaaccccgcgagatccagagcctagagcaggtcggggaggaggacccgcgaggccaggaagcaaatggcgggcagcggcgcgtacagggcggaggacgactacgactacctcttcaaggcggtcatcatcggcgactccggcgtcggcaagtccaacctgctctcgcgcttcaccaagaacgagttctgcctcgagtccaagtccacaatcggggtcgagttcgcaacccgaagcctccaggtcgacggcaaggtcgtcaaggcccagatttgggacaccgcaggccaggagagataccgtgctattacgagtgcctattatagaggagcggtaggcgcgttgcttgtctatgatgtcactcgccgtgttacatttgacaatgtggcgcgctggctaaaagagctgagagatcacactgaccctagcatcgttgtcatgctagttggcaataaatctgatctccggcacttggtggctgtttctactgaagatggacaggaatatgctgaggccgagaaactgtacttcatggaaacatctgcactagatgcaacaaatgtagacaacgcttttgcagaagttttgactcagatatatcagattgcaagcaggaagacggttgacgcaggagacgatggctcatctcccccaagcaaaggggagaagataaatgtgaaagacgacgtgtctgcactgaagagagccggctgttgctcaacttaggtatagatgcattgtatgttgagttttctactagttggtgcttcttctactgcaacagatgtattcgttctctttttgctgcggttatgttgagggctaggttgattcagctatcaccggaaactgttatgtcagattgattatgatattgtgcaagtaatttatttacaagaacaaaaaaaaaaaaaaaacaaaaaaaaaaaaacaaaaaaaaaaaaacaaaaaagaaaaaacaaaacaaa

SEQ ID NO: 13830 - DNA, 1105 bp, Amorphophallus konjac
cccccaccttgctctcttccctgctggatctcctgctaccccttcgtgttcctgctgctgctctcgacgggggggggggtgttcctgtttcgatcctgctctgtctaggaggacgtggtggtgcgtgtagtggggagggggacatagaggggaagcgcagggcccatggcggcgtacagggcggaggacgactatgattacttgttcaaggttgtgctgatcggggactccggggtgggcaagtcgaacctgctctccaggttcaccagaaacgagttcaacctcgagtccaagtccaccatcggggtggagttcgccacccgcagcctcaacgttgacggcaagatcatcaaggcccagatttgggacaccgccggccaggagagataccgtgcgattactagtgcatactatcgaggggctgtcggagctctgcttgtttatgatgtcactcggcgcaccaccttcgagaatgtggagcggtggttgaaggagttgagagatcacacagatccaaacatagtcgtgatgctcatcgggaacaagtccgatctccgccaccttgtcgctgtctcaacagacgatgggaaggtcttttcagagagggaatccctgtacttcatggagacctctgccctcgaagccacgaacgtggaagccgcatttgccgaggtcttgactcagatctatcggatcgtcagcaagaaggccgttgagacgggagacgagtcatcttcatctgtgcccagcaaaggagagaaaattaacgtcaaggacgatgtatctgcaatgaagagggttggatgctgttcgaattaggttagaactcggtttggagtcccgtttcgtgtattatgccattccgtaagggcagatatatatatatttttctttggattaaaccacctcattttgtcggacgggttttctgtagggggtagcttcttgtatttgttgcttaagattgtttgcaggttgatgggagttgggagattctccccccagtgacgtttatgagcattggccacatcaatcaactactactctgatgtctaagtaggtagttgtactatcaacatatcctggagtgcatttatctattgat

SEQ ID NO: 13831 - DNA, 1081 bp, Elaeis guineensis
aaacggaaacgggaaagagagagacaagattccaccatcaccgccgtgcgaggccgaggaggagaaccacgccgcgccgttcctcttccgtaagtccatctcttcctttcttgttcttcttctgagctgagactaagatccaagaagaagaagaagaacagaggagaaagggaagagagatggccggttacagggcggaggacgactacgactatctgttcaaggtggtgctgatcggggattcgggggtggggaagtcgaatctgctgtcgaggttcaccaggaacgagttcagcctcgagtccaagtccaccatcggtgtcgagttcgccactcgcagcctcaacgtcgacggcaaggtcatcaaggcccagatttgggacaccgccggccaagaaaggtatcgtgccatcaccagtgcatactaccgaggagctgtaggtgcattgcttgtctatgatgttacccggcatgcaacttttgagaatgctgagcgctggttgcgggagttgagagaccatacagatccaaacatagtcgttatgcttgtcggaaacaagtctgatcttcgtcatcttgtagccgtttcatccgaagatgggaaagcttttgcagagagagagtcactctatttcatggaaacatctgcactagaagccaccaatgtggaagatgcctttgcagaggtcttgactcagatctatcgaattgtaagcaaaaaggcagtggaggcagctgatgactctgcctctgcagtccccagcaaaggagagaaaattaatgtcaaggatgatgtttctgcactaaagagagttggctgctgctcgtcttaagttacaaaggaccttttctgaggtaagggatctatttcagatgcttcatgtcatgtgctgtaatacatttctttttctatttagttgagacattgtttgtagctgaagggtttggttaggttctgtttttattacgtgtcatccaagaacgtgagaccttgattaggtttggtttttactagatttgttatattaagatgatggccaagtttattagaaagtcttttattggagacatgtagttcgac

SEQ ID NO: 13832 - DNA, 953 bp, Avena sativa
acaaccagatcgccgacgcgacgggagcaatggcggcggggtaccgggcggaggacgactacgactacctcttcaaggtcgtgctcatcggagactccggggtcggcaaatccaacctgctctcccgcttcacccgcaacgagttcagcctcgagtccaagtccaccatcggggtcgagttcgccacccgcagcctacaggtcgacggcaaggtcgtcaaggcccagatttgggacaccgccggccaagagcgataccgtgccatcactagtgcatactatcgtggtgctgtcggagcgttgcttgtgtatgatgtcacccggcacgcaacgtatgagaatgctgagcgctggctgaaggagttgagggaccacacggatccaaacatagttgttatgctggttggcaacaagtctgatctccgtcatcttgtagcagtccaaactgatgaagccaaggcatttgcagagagagaatcactctatttcatggagacttctgcactggagtccacaaacgtggaagatgctttttccgaggtcttgacccagatctaccgcatcgtgagcaagaggtcagttgaggcaggtgaggactcggcttctggtcctggcaagggcgagaagatcaacatgaaggacgatgtctcggcagtgaagaagggcgggtgctgctccagttgagccatgctgtattatttttgttgggcttgtgtgatgttagctcgagctatcgcctttccagcgacctggaattattattagtagttgtagcaagtattatgtcctagaggagtttgttgctgaactgagaggtttgtctagatcaggctagacctttctattgtttatcggtggtgtctgcggcaatcggcatggtatgtaattttttatgtcaatcctttgcaaccatgtctgaacttttcagtcaaattgaaatatgtttcaatcttg

SEQ ID NO: 13833 - DNA, 841 bp, Avena sativa
cgagcagagcaatggcggccggctaccgggcggaggacgactacgactacctcttcaaggtcgtcctcatcggcgactccggcgtcggcaagtccaacctgctctcccgcttcacgcgcaacgagttcagcctcgagtccaagtccaccatcggcgtcgagttcgccacccgctccctccaggtcgacggcaaggtcgtcaaggcccagatttgggacaccgccggccaagagcgataccgtgccatcactagtgcatactatcgtggtgctgtcggagcgttgcttgtgtatgatgtcacccggcacgcaacgtatgagaatgctgagcgctggctgaaggagttgagggaccacacggatccaaacatagttgttatgctggttggcaacaagtctgatctccgtcatcttgtagcagtccaaactgatgaagccaaggcatttgcagagagagaatcactctatttcatggagacttctgcactggagtccacaaacgtggaagatgctttttccgaggtcttgacccagatctaccgcatcgtgagcaagaggtcagttgaggcaggtgaggactcggcttctggtcctggcaagggcgagaagatcaacatgaaggacgatgtctcggcagtgaagaagggcgggtgctgctccagttgagccatgctgtattatttttgttgggcttgtgtgatgttagctcgagctaacgcctttccagcgacctggaattattattagtagttgtagcaagtattatgtcctagaggagtttgttgctgaactgagaggtttgtctagatcaggctagacctttctattgtttatcggtggtg

SEQ ID NO: 13834 - DNA, 980 bp, Avena sativa
ctctccttctctctcgccacccccacggaaccagatcgccgaggcgagcagagcaatggcggccggctaccgggcggaggacgactacgactacctcttcaaggtcgtcctcatcggcgactccggcgtcggcaagtccaacctgctctcccgcttcacgcgcaacgagttcagcctcgagtccaagtccaccatcggcgtcgagttcgccacacgctccctccaggtcgacggcaaggtcgtcaaggcccagatttgggacaccgccggccaagagcgataccgtgccatcactagtgcatactatcgtggtgctgtcggagcgttgcttgtgtatgatgtcacccggcacgcaacctatgagaatgctgagcgctggctgaaggagttgagggaccacacggatccaaacatagttgttatgctggttggcaacaagtctgatctccgtcatcttgtagcagtccaaactgatgaagccaaggcatttgcagagagagaatcactctacttcatggagacttccgcgctggagtccaccaatgtggaagacgctttttccgaggtcttgacccagatctaccgcatcgtgagcaagaggtcagttgaggcaggtgaggactcggcttctggtcctggcaagggtgagaagatcaacatgaaggacgatgtctcggcggtgaagaagggcggctgctgctccagttgagccacgctgtattatttttgttgggcctgtgtgatgttagctcgagctatcgcctttccagcgacctggaattattattagtagttgtagcaagtattatcgtcctagagaagtttgttgctgaactgagaggtttgtctagatcaggctagacctttctattgtttatcggtggtgtctgcggcaatcggctatggtataattttttatgtcaatcctttgcaaccatgtctgaacttttcagtcaaattgaaatatgtttcaatcttgg

SEQ ID NO: 13835 - DNA, 1055 bp, Zea mays
ttcctttcccgtttccccctccctctctctttccccacgcccgacgcccccaccactctctcgatccaaagccagatcggcacgacgagcagagggccccccggagcggcgcggagcaatggcggcgggataccgggcggaggacgactacgactacctcttcaaggtggtactgatcggcgactccggcgtcggcaagtccaatctgctctcacgcttcacgcgcaacgagttcagccttgagtccaagtccaccatcggcgtcgagttcgccacccgctctctccaggtcgacggcaaggttgtcaaggcccagatttgggacactgccggccaggaacgatatcgtgctattactagtgcgtattatcgaggtgctgttggggcgttgcttgtatatgacgtcactcgtcactcaacctttgagaacgttgagcgttggctgaaggagttgagggaccacacagatcccaatatagttgttatgctggttggcaacaaatctgatctccgccatcttgtagcagttcaaactgatgaaggaaaagcattcgcagagagggagtcattgtatttcatggagacctctgcactcgagtcgactaacgttgaaaatgcattcgcagaggtgttaactcagatctaccgtattgtgagcaagagagcagttgaagcaggcgaagatgcagcatctgggcctggcaagggcgagaagattaacataaaggatgatgtttcggcggtgaagaagggtggctgctgctctagctgagctgccctgctgtattttttggagttgtggtgatgtagcttatggtacggcatttccagcgaccgagaactggtagtggcattagcagcttctatgttacctagagagtttattgtcaaactggggaaaaaaaactgaaggttagatcggtgtagatctttctggtactgtattgtgtatccggcaataggcatggtattgtttttttttttgctgtgaatccactggtaccatgtttaaacttatgaattgttcaaaatagaaaggtgcttcatgcttgcca

SEQ ID NO: 13836 - DNA, 1000 bp, Saccharum officinarum
tcgctctcgccccccaaaaccagatcggcacgacgagagcagagagagggccccggagcggcgcggagcggagcaatggcggcgggctaccgggcggaggacgactacgactacctcttcaaggtggtcctgatcggcgactccggcgtcggcaagtccaacctgctctcccgcttcacgcgcaacgagttcagcctcgagtccaagtccaccatcggcgtcgagttcgccacccgctccctccaggtcgacggcaaggtcgtcaaggcccagatttgggacaccgccggccaggaacgatatcgtgctattactagtgcgtattaccgtggtgctgttggggcattacttgtatatgacgtcactcgtcactcaacgtttgagaatgttgagcgctggctgaaggagttgagggaccacacagatcccaatatagttgttatgctggttggcaacaaatctgatctccgccatcttgtagcagttcaaactgatgaaggaaaggctttcgcagagagggaatcgttgtatttcatggagacctctgcacttgagtccaccaacgttgagaatgcatttgcagaggtcttaacccagatctaccgcattgtgagtaagagagcagtcgaagcaggtgaagatgcagcatctgggcctggcaagggcgagaagatcaacataaaggatgatgtttcggcggtgaagaagggtggctgctgctctagctgagctgcactgctggtatttttttgggacttgtgtgatgtagcttatgttatggcatttccagcaactgagaattggtagtggcattagcagcttctatgttacctagagagtttattgtcaaactgaaaaaaaaactgaaggttagatcagtatagatctttctattattgtattgtgtatccaaggcatggtattgtttttgctgtgaatccactgcgaccatgttcaaacttatgaaatgttcgaaatagaaaggtgcttcatgcttacc

SEQ ID NO: 13837 - DNA, 960 bp, Festuca arundinacea
gaaccagatcgccgaccgcgagcgcagcaatggcggcggggtaccgggcggaggacgactacgactacctcttcaaggtcgtgctcatcggcgactccggcgtcggcaagtccaacctgctctcccgcttcacgcgcaacgagttcagcctcgagtccaagtccaccatcggcgtcgagttcgccacacgctccctccaggtcgacggcaaggtcgtcaaggcccagatttgggacaccgcaggccaagaacggtatcgtgctattactagtgcatactaccgtggtgctgttggagcgttacttgtgtatgatgtcactcggcacgcgacctatgagaatgctgagcgctggctgaaggaactgagggaccacacggacccaaatatagttgttatgctagttggcaacaagtctgatctccgtcatcttgtagcagtccaaactgatgaagcgaagggatttgcagagagagaatcactctatttcatggagacttctgcgctggagtccaccaatgtggaagatgcattttctgaggtcttaactcagatttaccgcatcgtgagcaagaggtcagttgaagcaggtgaagactcaggttctggccctggcaagggtgaaaagatcaatatgaaggatgatgtctcggcagtgaagaagggtggctgctgctccagttgagccacgtggtattcttttggttgggtttgtgtgatgttacatgttagcttgcgctatcgcctttccagcgactgggaattattattagtagcagtagcaagtatcatgtcctagagaagtttgttgctgaactgagaagtttgtctagatcaggatagacctttgtattctttgtatggtggtgtccttggcaattggcatggcatgttttttcatctcaatcctttgcaaccatgtctgaacttttcaatcaaattgaaatatgtttcactgattg

SEQ ID NO: 13838 - DNA, 979 bp, Avena sativa
ctctccttctctctcgccaccccacggaaccagatcgccgaggcgagcagagcaatggcggccggctaccgggcggaggacgactacgactacctcttcaaggtcgtcctcatcggcgactccggcgtcggcaagtccaacctgctctcccgcttcacacgcaacgagttcagcctcgagtccaagtccaccatcggcgtcgagttcgccactcgcagcatccaggtcgacgacaaggtcgtcaaggcccagatctgggacaccgccggccaagagcgataccgtgccatcactagtgcatactaccgtggtgctgtgggagcgttgcttgtgtatgatgtcactcggcacgcaacctttgagaatgccgagcgctggttgaaggagttgagggaccacacggatccaaacatagttgttatgctggttggcaacaagtctgatctccgtcatcttgtagcagtccaaactgatgaagccaaggcatttgcagagagagaatcactgtatttcatggagacttctgcgctggagtccaccaacgtggaagacgcattctccgaggtcttgactcagatctaccgcatcgtgagcaagaggtcagttgaggcaggcgaggactcggcctctggtcctggcaagggtgagaagatcaacatgaaggacgatgtctcggcagtgaagaagggcggctgctgctccagttgagccacgctgtattaattttgttgggcttgtgtgatgatgttagctcgagctatcgcctttccagcggcctggaattattattagtagtcgtagcaagtattgtgtcctagagaagtttgttgctgaactgagaggtttgtctagatcaggctagacctttctattgtttatcggtggtggtggtgtctgcggcaatcggctatggtataattttcatgtcaatcctttgcaaccatgtctgaaccttttcaatcaaattgaaatatgtttc

SEQ ID NO: 13839 - DNA, 1239 bp, Sorghum bicolor
ccgcaccgccccgcaccgcccgccgcgcgctcgctgccgtgcccgtgcccccttcctttccattcccgtttccccccctccctcttccttcctttccccacgcccccaccccaccaccactcttctctctctcgccccaaaaccagatcggcacgacgagagcaggagcagagagggccccggactcggagcggcgcggagcaactagcaatggcggcgggctaccgggcggaggacgactacgactacctcttcaaggtggtcctgatcggcgactccggcgtcggcaagtccaacctgctctcccgcttcacgcgcaacgagttcagcctcgagtccaagtccaccatcggcgtcgagttcgccacccgctccctccaggtcgacggcaaggtcgtcaaggcccagatttgggacacagccggccaggaacgatatcgtgctattactagtgcatattacagaggtgctgttggagcgttgcttgtatatgatgtcactcgtcactcaacttttgagaacgttgagcgttggctgaaggagttgagggaccacacagatcccaatatagttgttatgctggttggcaacaaatctgatctccgccatcttgtagcagttcaaactgacgagggaaaggcattcgcagagagagaatcattgtatttcatggagacctctgcacttgagtccaccaacgtcgagaatgcatttgcagaggtcttaacccagatctaccgcattgtgagtaagagagcagttgaagcgggcgaagatgcagcatctgggcctggcaagggtgagaagatcaacataaaggatgatgtttcggcagtgaagaagggtggctgctgctctagctgagctgccctgctgtattttttgggagttgtgtgatgtagcttatgttatggcattccagcgactgagaattggtagtggcattagcagcttctatgttacctagagagtttattgtcaaactgaaaaaactgaaggttagatcagtttagatctttctattattgtattgtgtatccgaggcatggtattggctttgctgtgaatccactgctaccatgctcaaacttatgaaatggtcaaaatagaaaggtgcttcatgcttaccaagttctaaattctcgaagattcaatactaagtagagtggatttgtaatttcacttctgtacatgtgttgaaaattctcgggaaatccaaggctctctctttatatcgaa

SEQ ID NO: 13840 - DNA, 1040 bp, Pseudoroegneria spicata
actggaattacaccaacttaccattaccccattcactatcccgtccttcgccacccccagaaccagatcgccgacgcgacgggagcaatggcggcggggtaccgggcggaggacgactacgactacctcttcaaggtcgtcctcatcggcgactccggcgtcggcaagtccaacctgctctcccgcttcacccgcaacgagttcagcctcgagtccaagtccaccatcggggtcgagttcgccacccgctccctccaggtcgacggcaaggtcgtcaaggcccagatttgggacaccgccggccaggaacgataccgtgctattactagcgcatactaccgtggtgctgtaggagcgttgctcgtctacgacgtcactcggcacgcaaccttcgagaatgcagagcgctggctgaaggagttgagggaccatacggatccgaacatagttgtcatgcttgttggcaacaagtctgatctccgccatctcgtggccgtcccaaccgacgaagggaaggcgtttgcagagagggagtcactctatttcatggagacctctgcgctcgagtcgaccaatgtggaggacgcgtttgcggaggtcttgaaacagatttactgcatcgtgagcaagagggcggtcgaggcaggcgaagactcggcctccggccctggcaagggtgagaagatcaacatgaaggacgatgtctcggcggtgaagaagggcgggtgctgctctagctgaggcgccatgatgtattctttttgctgggcttttgtggtgtggcctttccagcgaccgggaccgagaattattagtagcagtagtagcaagtattatgattatgaatgttacctagagaagttgaagtttgttgctgaactgagaagtttgtctagatgaggtgagaccttccttcatattgttgtatggtctttgcggcaatcggcatggtggagtattgtttttcagttcattccatcacaaccatgcttgaacttttgaacttgattgaaatttgcttcacgtttgccaaaaaaaaa

SEQ ID NO: 13841 - DNA, 1282 bp, Panicum virgatum
tcggctccgtcagaaatgcagccccccacccgccgcactccacgcgcctccccaccgcaccgcaccgcccgccgcgcccgctgccgtgcccgtgcccccttcgtccccccccccccctccctctttctttccccacgcccccagcaccaccactctctctctttcctcgctcgcccgaaaccagatcggcgcggagagcggagggggcgccggcggcgtagcgggcagaagcaatggcggcggggtaccgggcggaggacgactacgactacctcttcaaggtggtcctgatcggcgactccggcgtcggcaagtccaacctgctctcccgcttcacgcgcaacgagttcagcctcgagtccaagtccaccatcggcgtcgagttcgccacccgctccctccaggtcgacggcaaggtcgtcaaggcccagatttgggacaccgccggccaggaaagatatcgagctatcactagtgcatattaccgaggtgctgttggagcgttgcttgtttatgatgtcactcgtcactcaacctttgagaatgttgagcgctggctgaaggagttgagggaccatacagatcccaacatagttgttatgctggttggcaacaaatctgatctgcgccatctcgtagcagttcaaacagatgaaggcaaggcattcgcggagagagaatcactctacttcatggagacctctgcgctcgagtccaccaatgtggagaatgcattcgcagaggtgttgacccagatctaccgcattgtgagtaagcgagcagtcgaagcgggcgaagatgcagcctctgggcctggcaagggtgagaagataaatataaaggatgatgtttcagcggtgaagaagggtggctgctgctgaagaagggtggtgctgctgctcttagctgagcagccctggtgtattttttggagttgtgtgatgtagcttatgttatggctttttcccagtgaccgagaattattagtggcattagcaacttctatgttatctagagagtttattgccaaactggaaaactgaaggttagatcagtttagatctttctgttattgtattgtgtatccggctataggcgtggtattgattttgctgtgaatccactgctaccatgtttaagcttgtgaactgttcagaatagaaatatgcttcatgcttgccacactccattcagaatgtaagaaaattctgcacatgggatgtgcatttagcaacttcatctctgtttgactccgtgaaatctttaaagccatctttctcaa

SEQ ID NO: 13842 - DNA, 1045 bp, Coffea canephora
atactccttcctccaaaccccactacttgagcagaaaagatttgctttattaattcaaaaatatcaagaaatctcattcttaaagttctatttgattatttcaccagtagagtagtcagcgtagttctgtactagtagacctggggtagattgaggagtaatggcagggtacagagctgaagatgactatgactacctgtttaaggtggttttgattggagattcaggtgttggcaagtccaacttgctttcaagattcaccagaaatgagttcagccttgagtccaagtctacaattggtgttgagtttgctaccagaagcttgaatgttgataataaagtcatcaaggctcagatttgggatactgctggccaagaaaggtatcgggccatcaccagcgcctattaccgcggtgctgttggtgccttgcttgtgtatgatgtgacacggcattctacttttgagaatgtagaaaggtggttgagggaactgagagatcacacagatcccaatattgttgtcatgcttgttggcaacaagtccgatctccgacaccttgtggcagtctcaactgaggatggaaagtcttttgcagaaagggaatcactttatttcatggaaacttctgcacttgaagctaccaatgtggatagtgcatttgcagaggtccttacgcagatttaccatatagtgagcaagaaggccatggaggctggtgaaaatggagctaatggaacagttccatcaaagggagagaaaatcgatgtcggtaaggatgtatccgccatgaagaaaggtggctgctgttcaacatagtttttaaccaagttgatatgcagcattctgaggtgtttatttaaattgctggatgtatgtctacactgagattgtagctaaagtttctaaattaagcgcctacatagacgtggaaattgtctatctgttattatttttgttctaaatatttgagcaggactgctgttgcatctagcaagcagaatttggttagaaatgaaatgttggtcctgttgttttcatttattc

SEQ ID NO: 13843 - DNA, 1097 bp, Oryza sativa
gccgtgctcgtctcgtgctccccctctcctccgcctttagtcacctttccccctcaccctctccacgcgacccagatcgatcgccgagctgcacctgcacctgcaccccgaggagaggagaggagcaatggcggcggggtaccgggcggaggacgactacgactacctcttcaaggtggtcctcatcggcgactccggcgtcggcaagtccaacctcctctcccgcttcacccgcaacgagttcagcctcgagtccaagtccaccatcggcgtcgagttcgccacccgctccctccaggtcgacggcaaggtcgtcaaggcccagatttgggacaccgccggccaggagcgataccgtgctattactagtgcatattaccgaggtgctgttggagcgttgcttgtctatgatgtcacccggcactcaacctttgagaatgttgagcgctggttgaaggaattgagggaccatacagacccaaacatagttgtcatgctagttggcaacaagtctgatctgcgccatcttgtagcggttcaaaccgatgaagggaaggcattcgcggagagagaatcgctctatttcatggagacctctgcgctcgagtccaccaacgttgagaatgcatttgcagaggtcttgacccagatctaccgcatcgtgagcaagaggtcagtcgaagcaggtgatgatgcaggttctggtcctggcaagggtgagaagatcaatataaaggatgatgtttcggcggtgaagaagggcggctgctgctcgggctaagctcttgctgtattttttttgggacctgtgtgagcttgtgttatcgccgttccagcgactgagaaattgttagtagtattagcaacttctatgttacgtagagagtttattgctataactgaaaggtttggccagatcagtttagatcttcctattgttgtatggtctccgcggcaactggggcatggtgttggttttcatgtgaatccattgcagccatgcttgaactgttgaatcaagtagaaatatgttttacgcttgcacgctgttgatttggtaaaaggggaaatgataagcagagtgtacacttgtacta

SEQ ID NO: 13844 - DNA, 1003 bp, Oryza sativa
tagtcacctttccccctcactctctccacgcgacccagatcgatcgccgagctgcacctgcacctgcaccccgaggagaggagaggagcaatggcggcggggtaccgggcggaggacgactacgactacctcttcaaggtggtcctcatcggcgactccggcgtcggcaagtccaacctcctctcccgcttcacccgcaacgagttcagcctcgagtccaagtccaccatcggcgtcgagttcgccacccgctccctccaggtcgacggcaaggtcgtcaaggcccagatttgggacaccgccggccaggagcgataccgtgctattactagtgcatattaccgaggtgctgttggagcgttgcttgtctatgatgtcacccggcactcaacctttgagaatgttgagcgctggttgaaggaattgagggaccatacagacccaaacatagttgtcatgctagttggcaacaagtctgatctgcgccatcttgtagcggttcaaaccgatgaagggaaggcattcgcggagagagaatcgctctatttcatggagacctctgcgctcgagtccaccaacgttgagaatgcatttgcagaggtcttgacccagatctaccgcatcgtgagcaagaggtcagtcgaagcaggtgatgatgcaggttctggtcctggcaagggtgagaagatcaatataaaggatgatgtttcggcggtgaagaagggcggctgctgctcgggctaagctcttgctgtattttttttgggacctgtgtgagcttgtgttatcgccgttccagcgactgagaaattgttagtagtattagcaacttctatgttacgtagagagtttattgctataactgaaaggtttggccagatcagtttagatcttcctattgttgtatggtctccgcggcaactggggcatggtgttggttttcatgtgaatccattgcagccatgcttgaactgttgaatcaagtagaaatatgttttacgct

SEQ ID NO: 13845 - DNA, 936 bp, Pennisetum glaucum
gcgggagcaatggcggcggggtaccgggcggaggacgactacgactacctcttcaaggtggtgctgatcggcgactccggcgtcggcaagtccaacctgctctcccgcttcacgcgcaacgagttcagcctcgagtccaagtccaccatcggcgtcgagttcgccacccgttccctccaggtcgacggcaaggtcgtcaaggcccagatttgggacaccgccggccaggaacgatatcgagctatcactagtgcatattatcggggtgctgttggagcgttgctagtttatgatgtcactcgtcactcaacatttgagaatgttgagcgctggctgaaggagctgagggaccatacagatcccaacatagttgttatgctggttggcaacaaatctgatcttcgccatcttgtagcagttcaaactgatgaaggcaaggcatttgcagagagggaatcactctacttcatggagacatctgcgcttgagtccaccaacgtcgagaacgcattcgcagaggtgctaactcagatctaccgtatcgtgagtaagagagcagttgaagcgggtgaagatgcagtctctgggccaggcaagggtgagaagatcaatataaaggatgatgtttcggcggtgaagaagggtggctgctgctgagcggccctggtgtagtttttggagttgtgtgatgtagcttatgttatggctttttcccagcgactgggaattgttagtggcattagcaacttcttctatgttacctagagagtttattgtcaaactggaaaaactgaaggttagatcagcctagatcttttttgtattgtattgtattgtgtatccggcaataggcatggtattggttttgctgtgaaatccactggtaccatgtttaaacttatgaactgttcaaaatagaaatatgcttcatgctta

SEQ ID NO: 13846 - DNA, 1261 bp, Prunus mume
gtaaacgaggagctcatgttatttacatggaggtgccctcactgtacaacttcctttgtcatcaagtttctggcgctttttttaattaaaaacactttctcacttctcacttcactgtccaccgaaagctccagctctcagcaaacctctctctctctctctctctctctctctctctctctctctcttctcatttttttaacagcaaaagttaaaaactgcaacaatggctgggtacagagctgatgacgactatgattatctcttcaaggtggtcttgattggcgactcaggggtgggcaagtccaatctgctctctaggttcaccaagaacgagttcaacctcgagtccaagtccaccattggggttgagttcgctaccaggacattgaacgttgatggaaaggtcatcaaagctcagatttgggacactgctggccaagaaaggtaccgtgctatcactagtgcttactatcgcggggctgtgggtgcactccttgtgtatgatgtcactcgccatgcgacatttgagaatgttgacagatggctgaaagaattgaggaaccacacggattccaacattgttgtgatgcttgttgggaacaaatcagatcttcgccaccttgtagctgtctcaactgaagatgggaagtcctatgctgagaaggagtcactctacttcatggaaacatctgcactggaagcaaagaatgtggaaaattcctttgctgaagttctgactcaaatctaccatattgtgagcaagaaggcagtcgaaggggtagaaaatggaacagcttctgtcccagcaaaaggagagaaaataaatattaaggatgatgtgtctgctttgaagagagttgggtgctgctcaagctaggcctggtaaacaaaacttgattgaatgaatatggcttctctgtactgtgtaatatttttcagagggatacaaactagcggataccaaaacacgaaatttttccttgagtaagcttagctcatattatccacaattagcaacaatccagtggatgctgattagcacatttaaatcgcttttcagcgtcatctatgcgtttaaatctatttttacccaggatatatatttgataaatttcaatatcggaaatgattgctcagcctcgttctttaccgtatgcgattgaggggattcaagtattgttttgcaagtctagttggaagaagtgtgctataaattgatcattctatagtactgaagtgtgagtttcgggtagattcg

SEQ ID NO: 13847 - DNA, 1124 bp, Brachypodium distachyon
ctgcaccgccccgcgacacccgtgctcgttgccgtgcccgtgctcccttccttccttccttttcccccctctcctcttttacaccgcctcccccaccttctccatcccccccgtccccctccctccctccctctcgccacccccagcaccagatcgacgaggcgacgtgacgagccggagcaatggcgtcgggctaccgggcggaggacgactacgactacctcttcaaggtcgtcctgatcggcgactccggcgtcggcaagtccaacctgctctcccgcttcacgcgcaacgagttcagcctcgagtccaagtccaccatcggggtcgagttcgccacccgctccctccaggtcgacggcaaggtcgtcaaggcccagatttgggacaccgccggccaagaacgataccgtgctattactagtgcatattatcgtggtgctgttggagcgttgctcgtctatgatgtcactcggcacgcaacctttgagaatgctgagcgctggttgaaggaattgagggaccatacggatcccaacatagttgttatgcttgttggcaacaagtctgatctccgtcatcttgtagctgtccaaaccgatgaagggaaagcatttgctgagagggaatcactttatttcatggagacctctgcgctcgagtccactaatgtggaagacgcatttgccgaggtcttgactcagatttaccgaattgtgagcaagagggcagttgaagcaggtgaggactcagcttctggtcctggtaagggtgaaaagatcaatatgaaggatgatgtttcggcagtgaagaagggcggctgctgctctagctgaggcacgctgtattttttgggctcgtgtgatgttagcttgtgctatcgcctttccagcgaccggaaattattagtagcagtagcaactattatgttacctagagaagtttgttgctgaaccgagaagtttgtctagatcagtttagacgtttctattgttgtatggtctctggggcaatcggcatggtattatttttcatgtcaatcttatgcaaccatgtttgaacttctctttacctgcaaaaagaagctgaacttttcagctaaattgaaatatgctttgccaatt

SEQ ID NO: 13848 - DNA, 1225 bp, Cirsium arvense
atttttccaatatcaattagaaatcgttttgaaaagataaaccatttcctcgatccccgtgacatcggaaagttgttaggctgccattcttgattcaagatttttcgcaattcacaacttcaaaggcgacacctttcttttccccatttatcgtcgtggtgttttccatttcgaaaggggtcaaatacacacacaaaccaaaaggaaacaaaaaaagcgtgtgtgcgtgtgagagagaaaactacagaggggatctatatagtttctatacgaatctcaaattcgctttcagaagattgtgtattctactgaaagaaaatgtctgcatacagagctgaagatgactacgattaccttttcaaggtggttctgattggggattcaggtgttggaaaatcgaacttgctttcgagattcaccaggaatgagtttagcctcgagtctaaatccaccatcggtgttgaattcgctacaagaagtttgaatgttgatagcaaggtcatcaaggctcagatttgggacactgctggtcaagaaaggtatcgtgcaattactagcgcctactatcgaggagcagttggagcacttcttgtgtacgatgtcacaaggcacgctacatttgaaaacgttgaacgatggttaaaggaattaagggatcacactgatccaaatatcgtggtaatgcttattggcaataagtcagatcttcgacacttagtggctgtatcaaccgaagatggaaaatcttttgccgaaagagaatccctttatttcatggaaacatctgctttagatgctacaaatgtggaaagcgcttttgccgaagtgctgactcagatctaccggattgttagcaaaaaagccatggatgctgctgaagattcagctgttccatcgaaaggtgagaaaattgatgtgggtaaagaggtttctgctatgaaatcagttggatgttgttcatcttgaagtaattagattaaggtgtttgaaaattagactcagagatgatttgattgatgtgggtttacatctgtttttaagatgtatcttgtgtcattgtgcaacttttagcctatatttgatgggtaagggtacaaatctattgtggttttttgtaatttgatttaagattaaacaacatgcttattgactattgtttatgctatatatatatagttgtaaaaaagaaaaaagtaccgactgcgactctttattgatatacgga

SEQ ID NO: 13849 - DNA, 1090 bp, Setaria italica
ccccttccttcctttctcccctcctctctttctgtttccccacgcccccaccaccacacccctactctctctctctctctctctctcgctcgctcgccccaaaaccagatcggcgcggagagcagagggaggaggtatcgcggcggggtagcgggcgggagcaatggcggcggggtaccgggcggaggacgactacgactacctcttcaaggtggtgctgatcggcgactccggcgtcggcaagtccaacctgctctcccgcttcacgcgcaacgagttcagcctcgagtccaagtccaccatcggcgtcgagttcgccacccgctccctccaggtcgacggcaaggtcgtcaaggcccagatttgggacaccgccggccaggaaagatatcgagctatcactagtgcatattatcggggtgctgttggagcgttgcttgtttatgatgtcactcgtcactcaacctttgagaatgttgagcgctggctgaaggagctgagggaccatacagatcccaacatagttgttatgctggttggcaacaaatctgatctccgccatctcgtagctgttcaaactgatgaaggcaaggcatttgcagagagagaatcactctacttcatggagacatccgcgcttgagtccaccaatgtcgagaacgcattcgcagaggtgctaacccagatctaccgcatcgtgagtaagagagcagtggaagggggcgaagatgcagtctctgggcctggcaagggtgagaagatcaatataaaggatgatgtttcggcagtgaagaagggtggctgctgctgagcagccctggtgtattttttggagttgtgtgatgtagcttatgttatggctttttcccagcgaccgagaattgttagtggcattagcaacttcttctatgttacctagagagtttattgtcaaactggaaaaactgaaggttagatcagcttagatctttctgctattgtattgtgtaaccggcaataggcatggtattgtttttgctgtgaaatccactgctaccatgtttaaacttatgaactgttcaaaatagaaatatgcttcatgcttgccaca

SEQ ID NO: 13850 - DNA, 1099 bp, Leymus cinereus x Leymus triticoides
gctagcgcggtggactgcagcgactgccgacccggcccccaaaatgtaggcggaccggactcgaccaaaatgccccattcgccgcactccacgcggacgcgatcaccacgcaccgctccccgtgcccgctgccgtgcccgtgcccccttccttcttttcttttcccttctcctctccgtccgccctcgcttttacaccacctcccccttccccctcgctctcctccttcgccacccccagaaccagatcgccgaggcgacgagagcaatggcggcggggtaccgggcggaggacgactacgactacctcttcaaggtcgtcctcatcggcgactccggcgtcggcaagtccaacctgctctcccgcttcacccgcaacgagttcagcctcgagtccaagtccaccatcggggtcgagttcgccacccgctccctccaggtcgacggcaaggtcgtcaaggcccagatttgggacaccgccggccacgaacgctaccgtgctatcactagcgcatactaccgtggtgctgtaggagcgttgcttgtctacgacgtcactcggcacgcaaccttcgagaatgcagaccgctggctgaaggacttgagggaccatacggatccgaacatagttgtcatgcttgttggcaacaagtctgatctccgccatctcgtggccgtcccaaccgacgaagggaaggcgtttgcagagagggaatccctctatttcatggagacctctgcgctcgagtcgaccaatgtggaggacgcgtttgcggaggtcttgaaacagatttaccgcatcgtgagcaagagggtggtcgaggcgggtgaggactcggcctctggccctggcaagggtgagaagatcaacatgaaggacgatgtctcggcggtgaagaagggcgggtgctgctctagctgaggcgcgatgctgtattttttctttttgctgagcttttgtgacgtggcctttccagcgaccgggaattattagtagcagtagtaccaagtattatcattatgatgttacctagagaagctgaagtctgttgctgaaccgagaagtttgtctagatgaggccagaccttccttcaaaaaa

SEQ ID NO: 13851 - DNA, 899 bp, Zea mays
ccccccacccccactactctctctcgccccaaaaccagatcgccacgacaagggcagagggccccggaggggcgcgtagcaatggcggcaggctaccgggccgaggacgattacgattacctcttcaaggtggtcctgatcggcgactccggcgtcggcaagtccaacttgctctcacgcttcacgcgcaacgagttcagcctcgagtccaagtccaccatcggcgtcgagttcgccacccgctctctccaggtcgacggcaaggtcgtcaaggcccagatttgggacaccgccggccaggaacgataccgtgcaatcactagtgcgtattaccgaggcgctgttggggcgttgcttgtatatgacgtcactcgccactcaacctttgagaacgttgagcgttggctgaaggagctgagagaccacacagaccccaatatagttgttatgctggttggcaacaaatctgatctccgccatcttgtagcagttcaaaccgacgaaggaaaagcattcgcagagagggaatcgttgtacttcatggagacctctgcgcttgagtcgaccaacgttgagaatgcatttgcagaagtcctagctcagatctaccgtattgtggacaagagagccgttgaagcaggtgaagatgcagcatctgggcctggcaggggcgagaagataaacataaaggatgacgtctcggcagtgaagaagggtggctgctgctctagctgagctgccgtgctgtaatttttttggggagttgtgggatgtagcttatgttatggcattttcagcgactggaaattggtagtggcatttagcagcctctattacctagagaggttattgtcaaactgaaaaaaactgaaggttagatcagtttagagctctgttac

SEQ ID NO: 13852 - DNA, 895 bp, Carthamus tinctorius
aaaccaaagcgtgtgagagagaaagaggaagggaaagggaaagtgatagcagagagcccttctgaatctcaaattaaatttttgacaagaaagatgtctgcatacagggctgaggatgactacgattacctattcaaggtggttctgattggggattcaggtgttggaaaatcgaacttgctttccagattcaccaggaatgagtttagccttgagtccaaatccaccatcggtgtcgaattcgctacaagaagcttgaatgttgatagcaaggtcatcaaggctcagatttgggacactgctggtcaagaaaggtatcgtgcaattactagcgcgtactatcgaggagcagttggagcacttcttgtgtacgatgtgacaagacatgccacatttgaaaacgttgagcggtggttgaaggagttgagggatcacactgatccaaatattgtggtgatgcttatcggcaataaatcagatctccgacacttggtggccgtgtcaaccgaggatggaaaatcatttgccgaaagggaatccctttacttcatggaaacatcggctctagatgccacaaacgtggaaagcgcttttgccgaggtgctcactcagatctaccggatcgttagcaaaaaagccatggatgccgctgaagattcggctgttccatcgaaaggtgagaaaattgatgtgggtaaagaggtttctgctatgaaatcagttgggtgctgttcatcttgaagtaagattaagatgtttgaattagactcaagatatgatgtgggtttacatctgtttttaagatgtatctgtgtcattgtgcaacttttagccgatatttgatgggcaagggtacaaaatctactgtgttttttcatgaacttgattaagacta

SEQ ID NO: 13853 - DNA, 928 bp, Rosmarinus officinalis
cggccgggggaaggccggaagggttttggagagagaaaagaaacaatatacaatacaaccttcattaaccctccgaaaccccactttatttattttctgcaaaagatattagacgtactcactctacatttaaaaagctgtatatacttaaattgacagatttgctagcttgaagtagagtgtggttgcagtgtctaggagtaatggctgggtacagggctgaagatgactatgactaccttttcaaggtagtcctgattggggactctggtgttggcaaatctaacctgctttcaagattcacaagaaatgagttcagtcttgagtccaagtctacaattggtgtcgagttcgctaccagaagcttgaatgtagatggcaaagttatcaaggctcagatttgggatactgctgggcaagaaaggtaccgggccatcaccagtgcttactatagaggtgccgtgggggcattgcttgtgtatgatgtgactcgacattctacttttgagaatgttgaaaggtggttaagggagttgagggatcacactgatcccaatattgttgtcatgctcgttggcaacaaatcagacctccgtcaccttgtggcagtttcaactgaggatggaaagtcttttgccgagagggaatcactctacttcatggaaacctcggcccttgaagctactaatgttgataatgcatttgcagaggttcttacccaaatttatcgtatagtgagcaagaaggcgatggaagccggcgagaatgggaacagttcgacggttccgtcaaagggagagaaaattgatgttgggaaagatgtatctgctatcaagaaaggtggttgctgctcaacataggcttcagccgaaacaaatgcaggaattggatatggtaatttgaatagatgcatccatttatgtacacc

SEQ ID NO: 13854 - DNA, 841 bp, Vinca minor
acacaaacccactattatgtttaaaagttgtgaattgggaatttgatttgcaaaattttgaagtaaaagagagtagagtgagcgagtgagtgattgatgggtgggtatagagcagaagatgactatgactacctttttaaggttgtcttgattggggattctggtgttggaaaatccaatttgctttcaagatttactagaaatgagttcagccttgaatctaagtctacaattggtgttgaatttgctactagaagcttgaatgttgatggtaaagtcatcaaggctcagatttgggatactgctggtcaagaaaggtaccgggctatcaccagtgcttactatagaggagctgtaggggcattgctcgtgtatgatgtgactcgacattctacttttgagaatgttgaaaggtggttaagggaattgagggatcacactgatcccaacattgttgtcatgctcgtgggcaacaaatcagaccttcgacaccttgttgcagtctcaacagaggactcaaagtcttttgccgagagggaatcactctacttcatggaaacttcggcccttgaagctactaatgttgataatgcatttgccgaggttcttactcaaattcaccgcatagtgagcaagaaggcgatggaagctggcgagaatggaagtagttcgactgttccatcaaagggagagaaaatcgacgttgggaaagatgtatctgctatcaagaaaggtgggtgctgctcaacataggatgaaacaaaatgcaggaattgggggtattatggtaatttgaatagatttatccatttgtgtactacaccatgatttatgtaaaatt

SEQ ID NO: 13855 - DNA, 1175 bp, Lupinus angustifolius
catttgattttgactcgtggtgcttttcaagcgttttctcgattctcctattcaactttctttctttccttccttatctctctctcttgtttctctctctagaacacaaaattcacaacaatggcgggttacagagccgaagatgactatgactacctcttcaaggtggttctaatcggtgattcaggtgttggaaaatcgaaccttctctctaggttcaccaagaacgagttcaaccttgagtccaagtccaccattggcgttgagttcgcaactcgcactttgaacgttgattctaaagtcatcaaggctcagatctgggacactgctggccaagaaaggtatcgagccatcaccagtgcttactatcgtggggcagtaggtgcacttcttgtgtacgatgttactcgccatgcaacattcgagaatgttgacagatggctgaaagaattacgtaaccacacagatgccaacatcgttgtgatgcttgtcggtaataaatcagatcttcgccaccttgtggctgtatcaactgaagatggcaagtcttatgctgagaaagaatcactttacttcatggaaacctctgctctggagtcaactaatgtagagaattcattcgcagaagttctgactcaaatctaccacatcgttagcaagaaagcagtagaggcggccgagaatggaaatgcgtctgtgcctgccaaaggagagaaaatagatattaagaatgacgtgtctgccttgaagagagttggttgctgctcaagctaagattagtaaacataatatcgagtggtcggctggttctggtatacatgtaatattcccggagagatacgaactagacgaaaaatctcggacgaactagatgaaatgaacaatttaatttttcatagcatgttagagaattgctgtgtaagtttaaataccatgtttcatgtttcaataggagctgcaggagaatgcaaattgattgtttagcggcctaatcttattgtagtgttattgctattgtttttttatatgttttcacttacaaaggttcaagcttggtattaattgaatgtaatggtgtcacttctattttatgcaaaattttagagttataagttaggagaaggaatgattaatgcttgtagttaataaaattaattttcaggtcgaaaagccat

SEQ ID NO: 13856 - DNA, 2287 bp, Lupinus angustifolius
tttcatttactcttggagtaaggggatcactcccctaacaaaaatgatacattttccaataaaattagttacaaatctttacatatattaggtgacatgttacaagattgtattatttttattaacgatcaagatttgcagactaattttgtaattagattattactccatataaaataagggcatcgaaaactaatatgcaaaaattaagactgaattgtactttgtttgaggtagctgaacgactgaaaataaagacttttaaataggactggactacatggaagtagaagcactgaaaaaacttaataagaacaataaacttgtgaagaaactatcattttcttgcttctgaatctgtcatcaagcaaattccacctctttggggacctggtttaaatgaggcaggcaacttcatttggtgtaatattggttctcttatgtcatgtattccttattacaatgttatgggaattaattctctttttgttgttgggttcactcaatacttattacaagacaaatgcttcagatttgataaagggtgtaaaaatctcctccgtatcgaaacaggctagataaaatacctgataacttattacaagtacagctgcagcttacaatggtattatcattatacaaacaataaacttcctcttcaattcaatccttcggttaatagaatatagttcggaaggactcgaatcaataaaatatctaagtagtgatggaaggtcacgcaccagcaacataattattactgtttcaccatgaaggaacttttacaactgcaaccaccaaccgcgctcggattttcggtcactacaaaagccgaacggattagctcctcgacataatcaacagttgcgccttttacaaaatcgtaggaaatattgtcaacaaccagtttaatcccttccttctcaaaaattctgtcatcagagttaacggtattatcaagattgaaaacatactgaaatccagaacatccaccagtttccacactcaaacgaagcaattttccatccgatgatgattcacttccttctagttccttcattctccgaacgcaactttccgtcatgttaacggtttccgtcgaagtagaagaagatgaagcgtgatgaataacagaagaagaagaagaggtagttgttgtggcggttataataaacctctggttctgacgaaatcgcgatgccaaatacggtccaagccttcgaatcagtgacgtcgacatagtttatctctcttgtttctctctctagaactcaaaattcacaacaatggcgggttacagagcagaagatgactatgactacctcttcaaggtggtcctaatcggtgattcaggtgttggaaaatcgaaccttctctcaaggttcaccaagaacgagttcaaccttgagtccaagtccaccattggcgttgagttcgcaactcgaaccttgaccgttgattctaaagtcatcaaggctcagatctgggacactgctggtcaagaaaggtatcgagccatcaccagtgcttactatcgtggggcagtaggtgcacttcttgtgtatgatgttactcgccatgcaacattcgagaatgttgacagatggctgaaagaattgcgtaaccacacagatgccaacatcgttgtgatgcttgtcggtaataaatcagatcttcgccaccttgtggctgtatcaactgaagatggcaagtcttatgctgagaaagaatcactttacttcatggaaacctctgctctggagtcaactaatgtagagaattcattcgcagaagttctgactcaaatctaccacatcgttagcaagaaagcagtagaggcggccgagaatggaaatgcgtctgtgcctgccaaaggagagaaaatagatattaagaatgacgtgtctgccttgaagagagttggttgctgctcaagctaagattagtaaacataatatcgagtggtcggctggttctggtatacatgtaatattcccggagagatacgaactagacgaaaaatctcggacgaactagatgaaatgaacaatttaatttttcatagcatgttagagaattgctgtgtaagtttaaataccatgtttcatgtttcaataggagctgcaggagaatgcaaattgattgtttagcggcctaatcttattgtagtgttattgctattgtttttttgtattgttttcacttacaaaggttcaagtcttggtattatttgaatgtaatggtgtcacttctattttatgtacaaaaaaagaaaaagtaccgactg

SEQ ID NO: 13857 - DNA, 914 bp, Prunus persica
tctccctctctctctctctctcccctaattttaacagcaaaagttaaaaactgcaacaatggctgggtacagagctgatgacgactatgattatctcttcaaggtggtcttgattggcgactcaggggtgggcaagtccaatctgctctccaggttcaccaagaacgagttcaacctcgagtccaagtccaccattggggttgagttcgctaccaggaccttgaacgttgatggaaaggtcatcaaagctcagatttgggacactgctggccaagaaaggtaccgtgctatcactagtgcttactatcgcggggctgtgggtgcactccttgtgtatgatgtcactcgccatgcgacatttgagaatgttgacagatggctgaaagaattgaggaaccacacggattccaacattgttgtgatgcttgttgggaacaaatcagatcttcgccaccttgtagctgtctcaactgaagatgggaagtcctatgctgaaaaggagtctctctacttcatggaaacatctgcactggaagcaaagaatgtggaaaattcctttgctgaagttctgactcaaatctaccatattgtgagcaagaaggcagtcgaagggggagaaaatggaacagcttctgtcccagcaacaggagagaaaataaatattaaggatgatgtgtctgctttgaagagagttgggtgctgctcaagctaggcctggtaaacaaaacttgattgaatgaatatggcttctttgtactgtgtaatatttttcagagggatacaaactagcggataccaaaacacgaaatttttccttgagtaagcttagctcatattatccacaattagcaacaacccagtggatgctgattagcacatttaaatcgcctttcagcgtcatctatgcgtttaaa

SEQ ID NO: 13858 - DNA, 975 bp, Allium cepa
ctcggtttcaaatctcagctttcgaggtagtaagattagaaatggcagcttacaaagcagaagacgactatgattacttgttcaaagtggttctaatcggtgattcaggcgtggggaaatcgaatctcttgtctcgattcacgagaaatgagttcagtttggaatctaaatccacgattggagttgagtttgctacgaggagtttgaatgttgatgggaaagtcattaaagctcagatttgggatactgctggccaggaaagatatcgtgctattacaagtgcatattacagaggatcagtgggtgctttgcttgtctatgatgttacaaggcatgcaacatttgaaaatgtcgagcgttggctgaaagagttgagagatcacacagacccaaacattgttgtgatgcttattggaaacaaatccgatctgcgccatcttattgctgtttccactgaagatggcaaatcttttgctgaaagagaatctctttattttatggagacatctgctcttgaatccgtaaacgtagacaatgcattttctgaggttttgacacagatatacagaattgtgagcaggaaggctgttgatactggtgacgattctgcgtctgccgttcctagcaagggcgagaaaatcaatgttacagatgatgtgtctgcactgaaaaaaggagggtgctgcagtaactgaagtgaaaaatggatttctgcaagactggatgtactgcaactggaagtgttttcttattgccctatggagcccataccaaagtttttcccctctttgggagtaggcaatatccgtgaacttgagtgatttcaatattctaactatatgtgcactgcattcatctaaatatttgtaatctgtctgaaatttatcgcatatatgatatgtaaacggttctgttgaattaacttcatgcttcatacggcttgtatcattcgttttcttgtgtgtgaattttccc

SEQ ID NO: 13859 - DNA, 1032 bp, Allium cepa
tagttacgggggaaactcagcagatctactaagctcagtctcttcgctttttgctttcagtttttcttcttagtttcaaatctcagtcttcaactttcaagaaagcgagattagaaatggcagcttataaagcagaagacgactatgattacttgttcaaagtggttctaatcggtgattcaggcgtggggaaatcgaatctcttgtctcgattcacgagaaatgagttcagtttggaatccaaatctacgattggagttgagtttgctacgaggagtttgaatgttgatggaaaggtcattaaagctcagatttgggatactgctggccaggaaaggtatcgtgctatcacaagtgcatattacagaggatcagtaggtgcattgcttgtctatgatgttacaaggcatgcaacatttgaaaatgtcgagcgttggctgaaagagttgagagatcacacagacccaaacattgtcgtgatgcttattggaaacaaatccgatctgcgccatcttattgctgtttccactgaagatggcaaatcttttgctgaaagagaatctctttattttatggagacatctgctcttgaatccgtaaacgtagacaatgcattttctgaggttttgacacagatatacagaatagtgagcaggaaggctgttgataccggtgatgattctgcatctgctgttcctagcaaaggcgagaaaatcaatgttacagatgatgtatctgcgttgaaaaaaggagggtgctgcagtaactgaagtgcaagatggatttctacgagagtggatgaactactacaactggaattgttttcttattgccctatggagtccgtcaaagttttttacatttctttgggagtaggcaatatctgtgaacttgagtgatttcaatattctaactatatatgcactgcattcatctaaatatttgtaatctatctgaaatttgtcgcatatatcatatgtacacggttctgttgaattcagtacatgcttcataagtgattgtgattagcat

SEQ ID NO: 13860 - DNA, 1020 bp, Catharanthus roseus
attgggaattttgattcgcaaacttgattgaattgaattagagagtagtagtagttgcagcaaagtgtctagggagtgatgtctgggtacagagccgaagatgactacgattatcttttcaaggtggtcctaattggggattctggtgttggcaaatctaacttgctttcaagattcacaagaaatgagttcagccttgaatccaaatctacaattggagttgaattcgctactagaagcttgaatgtagatagcaaagttatcaaggctcagatttgggatactgctggtcaagaaaggtaccgggctatcaccagtgcttactatagaggtgctgtaggggcattgcttgtttatgatgtgactcgacattctacatttgagaatgttgaaaggtggttaagggagttgagggatcacacagatccaaatattgttgtcatgctggttgggaacaaatcagacctacgacaccttgtggcagtttcaactgaggatggaaagtcttttgccgagagggaatccctctacttcatggagacctcggcccttgaagctactaacgttgataatgcatttgcggaggttcttacacaaatttatcgagtagtgagcaagaaggcaatggaaactggcgagaatggaaacagttcgactgttccatcaaagggagagaaaattgatgttggcaaagatgtatctgctatgaagaaaggtggatgctgctcaacatagtcttggttatggtaatttaaatagaggcatctatttgtgtactgtacactgattgtgtaaagttttctaaaaggaatttgctctacacagtgaggagagagacttgggttttcatttgagtttgaaaaatttaagcagattgctactatatttactacttgtaggcaagcaagaagaatatttaattagacacagaagataccatgccactcatctgtgttgcttttttatatgacaaaatgctggtttggatgagttcatttatttacacccttcaattcattg

SEQ ID NO: 13861 - DNA, 836 bp, Glycine max
aacaacagaacaacagagcaaaaagctccaccaatggcgggttacagagccgacgacgactacgactacctcttcaaggtggtcctcatcggcgactccggcgtgggcaagtccaacctcctctcgcgcttcaccaagaacgagttcaacctggagtccaagtccaccattggcgtcgagttcgccacccgcaccttgaacgtcgattccaaagtcatcaaggcccagatctgggataccgcaggccaagaaaggtatcgtgcgatcaccagtgcttactatcgtggggcagttggtgcacttcttgtgtatgatgtcactcgccatgcaacatttgaaaatgttgacagatggctgaaagaattgcggaaccacacagacgccaacattgttgtgatgctagttggcaacaaatcagaccttcgtcacctcgtagcggtgtcaactgaagatgggaagtcctatgctgagaaagaatcactttacttcatggaaacctcagctctggaggctactaatgtagagaatgcatttgctgaagttctgactcaaatctaccgcattgttagcaagaaagcagtagagggggctgaaaatggaactgcatctgtgcctgccaaaggagagaaaattgatctgaaaaatgatgtgtctgctttgaagagagttggttgctgctcaagctaaaattggaaaacatagttcaattggttggtatcggctctgttgtatgtgtaatattctgagaaatacgaactagaagaaaagtgaaatttaatttgtcatagcatgttagactctttgtgtaaccttaaaaactaagtttggtgtttcaa

SEQ ID NO: 13862 - DNA, 1115 bp, Glycine max
aaaatcatgagtagtggcgcttttttaagcgttttcacactctccactctttctttcttcctttccttcttttcactacttgtctcttccctttttctttccagaacaacagaacaacagagcaaaaagctccaccaatggcgggttacagagccgacgacgactacgactacctcttcaaggtggtcctcatcggcgactccggcgtgggcaagtccaacctcctctcgcgcttcaccaagaacgagttcaacctggagtccaagtccaccattggcgtcgagttcgccacccgcaccttgaacgtcgattccaaagtcatcaaggcccagatctgggataccgcaggccaagaaaggtatcgtgcgatcaccagtgcttactatcgtggggcagttggtgcacttcttgtgtatgatgtcactcgccatgcaacatttgaaaatgttgacagatggctgaaagaattgcggaaccacacagacgccaacattgttgtgatgctagttggcaacaaatcagaccttcgtcacctcgtagcggtgtcaactgaagatgggaagtcctatgctgagaaagaatcactttacttcatggaaacctcagctctggaggctactaatgtagagaatgcatttgctgaagttctgactcaaatctaccgcattgttagcaagaaagcagtagagggggctgaaaatggaactgcatctgtgcctgccaaaggagagaaaattgatctgaaaaatgatgtgtctgctttgaagagagttggttgctgctcaagctaaaattggaaaacatagttcaattggttggtatcggctctgttgtatgtgtaatattctgagaaatacgaactagaagaaaagtgaaatttaatttgtcatagcatgttagactctttgtgtaaccttaaaaactaagtttggtgtttcaataggagctgctggtgaagcaagttgattgctagtcttacttgtagtgctgttattgtttttgaaatgttttcacatgcaaagtggttcaagcttggaattaattgaagctattgcttaatttaagtttttgtgtagttttctgtggtggttatggttcaacgatttagacttttt

SEQ ID NO: 13863 - DNA, 935 bp, Musa acuminata
caacaacgcagcagcgccaaaaagaggtcgcttcagcccgcgggggaaggatttagatccgagctccgcccaaaggtctcagcgagcctcttcctcttcctcttcctcttgttgttcttgtgatggcggcgtaccgggcggaggacgactacgactacctgttcaaggtggtgctcatcggcgactccggggtgggcaagtccaacctgctctcccgcttcacccgcaacgagttcagcctcgagtccaagtccaccatcggcgtcgagttcgccacccgcagcttgaccgtcgacggcaaggtcgtcaaggcccagatctgggacaccgccggccaggagaggtaccgtgccatcacaagtgcttactacaggggagctataggtgcattgctagtctatgatgttacaaggcatgctacatttgaaaatgttgaacgctggctgaaggagttgaggggccatacagatcctaacatagttgtgatgcttattgggaacaagtcggatctccgtcaccttgttgctgtaccaactgaagatggtgaggcttatgcagagagggaatcactctatttcatggagacttctgcactagaagcaacaaatgtggagaatgcatttgcagaggttttgactcaaatttaccgcatcgtgagcaagaaggctgtcgaggcaggtgatgatgcaacatctactgtccccagtaaaggagagagaataaatgtgaaagatgatgtttctgcgcttaaaagagttggctgctgctccagttaggtaactgttgtgttgccactgctactttctgttcttgatgcctgttgtacttctttccatgtaaccctggatctgttcctttctttgaaatttagactattatttttgtatcactctattgtgttgttttggaaatcaacatggaatgctttatcggat

SEQ ID NO: 13864 - DNA, 1058 bp, Cynara scolymus
agattctcgcatccacactacaagtcggtacctttttttcccgtttatcttcgtggtgttttccatttcgaagcccagagaaacgggtcaaatacacccacaaaccaaaaggaaaaaaaagcgtgtgagagagaaagagaagggggaagtgaaacaccaaaaaaaaaagtagagggatctgtaatttctaccgactctgaagttagtttttgagaagattgtgtattctactgaaaaagatgtctgcatacagagctgcggatgactacgattaccttttcaaggtagttctgattggggattccggtgttggaaaatcgaacttgctttcgagattcactaggaatgagtttagcctcgagtccaaatcaacaatcggtgttgaattcgctacgagaagcttgaatgtcgatagcaaggtcatcaaggctcagatttgggacactgctggtcaagaaaggtatcgtgcaattactagcgcctactatcgaggagcagttggagcacttcttgtgttcgatgtcacaaggcacgccacatttgagaacgttgagcggtggttaaaggaactgagggatcacactgatccaaatatcgtggtcatgcttatcggcaataaatcagatcttcgacacttggtggccgtgtcaaccgatgatggaaaatcttttgccgaaagggaatccctttacttcatggaaacgtccgctctagatgctacgaatgtggagagcgcttttgccgaagtcctgactcaaatctaccggatcgttaccaaaaaagccatggacgctgctgaagatttgaatgttccgacgaaaggtgagaaaatcgatgtgggtaaagaggtttctgctatgaaatcagttggatgctgttcatcttaaagtaagattaaggtgtttgaattagactcagagatgattgatgtggttttacatctgtttttaagatgtatctgtgtcattgtgcaactttagcctatattgatgggcaggggtacaaaatctattgtgttttttttttggatcaattaagactaaaccacttgcttaccc

SEQ ID NO: 13865 - DNA, 1163 bp, Lupinus angustifolius
acaagttgaaaactcctaatatttttccatttcattttacttgtggcacttttcaaccttttcctcgttcctattcaactttctttctcttttcttcttctttcctcgtttctctctctagaagtgaaatcacaaatcacaacatcaatggcgggttacagagcagaagatgattacgactacctcttcaaggtggttctgatcggtgactcaggtgttggaaaatcgaaccttctctccaggttcacaaagaacgagttcaacctcgagtccaagtccaccattggtgttgagttcgcaactcgcacattgaacgttgattccaaagtcatcaaagctcagatctgggacactgctggccaagaaaggtatcgagccatcaccagcgcttactatcgtggggcagtaggtgcacttcttgtgtacgatgtcactcgccatgcaacatttgagaatgttgacagatggctgaaagaattgcgaaaccacacagatgccaacattgttgtgatgcttgtcgggaataaatcagatcttcgccaccttgtggctgtatcaactgaagatgggaagtcttatgctgagaaagaatcactttacttcatggaaacctcagctctggagtctactaatgtagagaatgcattcgccgatgttctgactcaaatctaccatatcgttagcaagaaggcagtacaggcggaaaatggaaccgcgtccgcgccagccaaaggagagaaaatagatattaaaaatgatgtgtctgccatgaagagagttggttgctgctcaagctgagactagaaaacataatttcaagtggttgccattgatttctttgtacttgtaatattttgagagataccaactagaaaaaaaagcagaataattttcatagcatcttagagaattgtctctgtaattttaaataccatgtttgatgtttcaataggagcagctgtggagtgcaaaattgattgattgttaagcggacttgttttacttattgtagtattattgttgtttttgaaatgttttcacttgcaaaggttcgagcttggaattaattgaacgtatcgttttactatagcttttatattttattttgttgctgatgcctgtatagatatgtgattgatgttatacataattgattttaagtg

SEQ ID NO: 13866 - DNA, 949 bp, Pisum sativum
agtgtagcaacagagaaagagcacaaaccagattcgaagacaaaaatggcgggttacagagccgacgacgactacgactatctcttcaaggtagttctgatcggcgactccggcgtaggtaaatccaaccttctttctcggttcacgaagaacgagttcaatctcgagtccaaatccaccattggtgttgaattcgctactcgtactttaaatgttgattccaaagtcattaaggctcagatctgggatactgctggtcaagagaggtatcgtgccatcaccagtgcttactatcgcggggcagttggtgcacttcttgtatatgatgtcacccgccatgcaacatttgaaaatgtcgacagatggctgaaagaactgcgaaaccacacagattccaacattgttgtgatgcttgttggcaacaaagcagatctccgtcaccttgttgccgtatcaactgaagacgggaagtcttatgctgagaaagaatcactttactttatggaaacctcagctctcgaggctactaatgtagagaacgcatttgctgaagttctgactcaaatctaccatatcgttagcaagaaaacggtagagggtgctgaaaatggaaacgcatctgtcccggccaaaggagagaaaatagatcttaaaaatgatgtctctgccttgaagagagttggttgctgctcaagctaagattagaaaacattattcgaagtggttgctatcggctctgttgtatgtgtaatattctaagagagatacaaactagaagaaaaaacaaaaaatgtaatttaattattcatagcatgttagactctatgtgtaatcttaaaaaacaagtttgatgtttcaataggatttgcttgggaaacaagtttgttgctaagctacgtagtttgtacctgtagtgttatagttatttttgaaatgttttcatctgcaa

SEQ ID NO: 13867 - DNA, 1154 bp, Cajanus cajan
tgatgagtggcgcttttttaagcgttttcacacataccactctctctttctttctttctttcttttcactacttgtcccttctcttctcttcctttcctttgtttccttaacacaacagatagagcagcagcaatggcgggttacagagccgacgacgactacgactacctcttcaaggtggttctgatcggcgactccggcgtcggaaagtccaacctcctctcgcgtttcaccaagaacgagttcaacttggagtccaagtccaccattggcgtcgagttcgcaactcgcactttgaacgtcgattccaaagtcatcaaggcccagatctgggacactgcaggccaagaaaggtatcgtgccatcaccagcgcttactatcgtggggcggttggtgcacttcttgtgtacgacgtcactcgccatgcaacattcgagaatgttgacagatggctgaaagaattgcggaaccacacagacgccaacattgttgtgatgcttgtcggtaacaaatcagaccttcgtcaccttgtggctgtgtcaaccgaagatgggaaatcctatgctgagaaagaatcactttacttcatggaaacctcagctcttgaggccaccaatgtagagaatgcatttgctgaagttctgactcaaatctaccgaattgttagcaagaaagcagtagagggggctgaaaatggaactgcatctgtgcctgccaaaggagagaaaattgatctgaaaaatgatgtgtctgctttgaagagagttggttgctgctcgagctgaggttgggaagcatagttcaattggttggtatcggctctgttgtacgtgtaatattctgagaaatacgaactagaagaaaagtgaaatttaatttgtcatagcatgttagactctttgtgtaaccttaaaaaaactaagtttggtgtttcaatagggtgaagcaagttgattgctaagtggcctagtcttacttgttgtagtgttgttattattgtttttggaatgctttcacatgcaaagaggttcaagcttgggattaattgaagctattgtttcatttaatattttgtagtattatgtggtggacatggtttaccaaaaaatgagaacattgtagttcataacaattactatcttggcatctgcg

SEQ ID NO: 13868 - DNA, 1011 bp, Vicia sativa
gctactctctctcttgtttttgcgagtgtagcaaaagagaaagagcacacagaggaaaaaccagattcgaagaaacaaaaaatggcgggttacagagccgacgacgactacgactatctcttcaaggtagttctgatcggcgactccggcgtcggcaaatcgaatcttctttctcggttcacgaagaacgagttcaacctcgagtccaaatccaccattggcgtcgaattcgctacgcgtactttgaatgttgattccaaagtcattaaggctcagatctgggatactgcgggtcaagagaggtatcgtgccatcaccagtgcttactatcgcggggcagttggtgcacttcttgtatacgatgtcacgcgccatgcaacatttgaaaacgtcgacaggtggctgaaagaactgcgaaaccacacagattccaacatagttgtgatgcttgtgggcaacaaagcagatcttcgccaccttgttgctgtatcaactgaagatgggaagtcttatgctgagaaagaatcactttactttatggaaacctcagctctcgaggctactaatgtagagaatgcatttgctgaagttctgactcaaatctaccatattgttagcaagaaaacggtagagggtgctgaaaatggaaacgcatctgtgcctgccaaaggagagaaaatagatcttaaaaatgatgtctctgccttaaagagagttggctgctgctcaagctaagatcggaaaacataattcgaattggtttctatcggctctgttgtatgtgtaatattctaagagagatacaaactagaagaaaaaacataaaatgtaatttaattattcatagcatgttagactctatgtgtaatcttaaaaaacaagtttgatgtttcaataggagttgctggggaaacaagtttcttgctaagctacatagtctgtacttgtagtgttgtagttatttttgaaatgttttcatcaaacaatcaaataattgattcatttgtttgg

SEQ ID NO: 13869 - DNA, 1138 bp, Eutrema halophilum
cagccagaaagacacaagtcttaccctagtttttcaaaagtctctgtttttctttggaaatctgggaaaatttttgaatccaaagagaaaatttcttttcttttcatcatagtgtcttgtcgatatctgttcaattttctcggcagatctaagggcaattttttaatttttattttcattttctttgttccgtcgaagtgtgaagctttattctgtgagcagtgttaatggcgggttacagagctgatgatgattacgactaccttttcaaggttgttctaatcggtgattcgggtgttggaaagtccaatttgctttctcgattcaccaggaacgagtttagcctcgagtctaaatccacgatcggtgtcgagttcgcgactcggagcttgaatgttaacgaaaaagtcatcaaagcccagatttgggatactgctggccaagaaaggtaccgagcaatcactagtgcatactacagaggagcagttggggcgcttcttatctacgatgtaactcgacactccacattcgaaaacgttgagagatggctaaaggaacttcgtgaccataccgatccaaacatcgttgtgatgctcgtgggaaacaaatccgatcttcgtcatcttgtggctgttcaaaccgaagacgcgaagtcttttgcggagaacgaatcgctctacttcatggaaacttcggcacttgaagctactaatgttgagaacgcgttctctgaagtgctcactcagatttaccatgttgtgagcaagaaagcaatggaggctggtggtgattcgaactcgggtaatgttccttcgaaaggtgagaagatcgatgttgatgtctctgctgtgaagaagaccggttgctgctcgaactaaaagacttgtctcttgcagattgaggggtttggtcttgtgtcctcaagccaagatcggtttttttttcgttctttacattcaaaattcttttgaaggtgtttgctttttttaggaaaaaacaatctacatgttatgtatgctttgacttgcttgcttgaaatttgcttagctttgttctgtttctgtaccggttaaagagattttgtaatttaaccggttctggtctatggtttgttgttcagcttgttttctcttcaatc

SEQ ID NO: 13870 - DNA, 1167 bp, Tabernaemontana elegans
caattcaattttaaacgagtcaaaatcccacttctcactcaaccaacaaaccacaatcccaaaaagtaacaaaatttcaagagagaaagaaaaagttttagagagagaagaaaagtaacacctgacaaccttcattacaccgccaaaccccactatttgtagctgcaaaagatactattttgtagtatttaagatagtgtacatacttaatttccgatttgatttgcaaattagaagtagggagtagttgcagtgttgaggagtgatgactgggtacagagctgaagatgactatgactaccttttcaaggttgtcctgattggggattctggtgttggcaaatccaacttgctttcaagattcacaagaaatgagttcagcctcgagtccaagtctacaattggtgttgagttcgctaccagaagcttgaatgtagatggcaaggtcatcaaggctcagatttgggatactgctggtcaagaaaggtaccgggccatcaccagtgcttactatagaggtgctgtaggtgcattgcttgtgtatgatgtgactaggcattctacttttgagaatgttgaaaggtggttgagggaattgagggatcacacagatcccaatattgttgtcatgctcgttggcaacaaatcagaccttcgacaccttgtggcagtaacaacagaagatggaaagtcttttgctgagagggaatcactctacttcatggaaacctcagcacttgaggcgactaatgttgatagtgcatttgcagaggttcttacacaaatctaccgtatagtgagcaaaaaatccatggaaactggtgagaatggaaatagttcaactgttccatcgaagggagagaaaattgacattggcaaagatgtatctgatatcaagaaaggagggtgctgctcaacataggcttcacagctgaaaaaaaaaaaaaaagcagcattggatatggtaaactgaataggtgcatccatttgtgttcgccttgattatgtaaaattttctataaggaattgatttacacagaggggagagttggttttttacttgattttgaaaatttagccgactgctattacttgtaggcaaggaggggatttgattcgacacaaatgttacttatcatgttccttttatgtagcttacagacagaa

SEQ ID NO: 13871 - DNA, 1034 bp, Medicago truncatula
cttcttttctttttctcttcacatctctctctttttgtttctcatagcaacaacaaagcagattcattcatcaaagaagaagaagaagaatggcgggttacagagcagatgacgactatgactacctattcaaggtagttctgatcggcgactccggtgttggtaaatcaaatcttctctctcgtttcaccaaaaacgagttcaatcttgaatccaaatccaccattggtgttgaattcgctactcgtactttaaatgttgattctaaagttattaaggctcagatctgggatactgctggtcaagaaaggtatcgcgccatcacaagtgcttactatcgtggggcagttggtgcacttcttgtatatgatgttacacgccatgcaacatttgaaaacgttgacagatggttgaaagaactgcgaaaccacacagattccaacattgttgtgatgcttgttgggaacaaagcagatcttcgtcaccttgtagccgtatcaactgaagatgggaagtcttatgctgagaaagaatcactttatttcatggaaacctcagctctggaggctactaacgtagagaatgcatttgctgaagttctgactcaaatctaccgtattgttagcaagaaagctgtagagggtgctgaaaatggaaacgcgtctgtgccggccaaaggagagaaaatagatcttaagaatgatgtttcagctttgaagagagttggttgctgctcaagctaagattggaaacataattcatttggttgctatcggctctgttgtatgtgtaatattccgaaagtgagagagatacaaattagaagaagacgaaaaaatgtaatttaatttttcatagtatgttagactctctatgtaatcttaaaagacaagtttcatgtttcaataggagctgctggggaagcaagtttattgctactagtctgtactctgtagtgttatagttgtttttgaaatgttctgcaaattgattcaagcttggaagtaattaattcattaaggtatttatttgtg

SEQ ID NO: 13872 - DNA, 1216 bp, Glycine max
tttaagtttcatgcttaatatggtaaaaaatgaaaaataaatttcaaccctgagtccccaaactccaaagtgccagactagtctcagatgtacgtgcaaatcaatacaaagaagaaaataaaaataaaaataaaaaatcattagtagtggcgctttttaaagcgttttcatactctagtgtttcttttctttcttcctttccttgtttccactacttttcttcccttctttccagaacaacaccacaacacaaacagagcaaaaaaagctccaccaatggcgggttacagagccgacgacgactacgactacctcttcaaggtggtcctgatcggcgattccggcgtgggcaagtccaacctcctctctcgcttcaccaagaacgagttcaacttggagtccaagtccaccattggcgtcgagttcgccacccgcaccttgaacgtcgattccaaagtcatcaaggcccagatctgggacaccgcaggccaagaaaggtatcgtgccatcaccagtgcatactatcgtggggcagtcggtgcacttctcgtgtatgatgtcactcgccatgcaacatttgaaaatgttgacagatggctgaaagaattgcggaaccacacagatgccaacattgttgtgatgctcgtgggtaataaatcagaccttcgtcaccttgtagccgtgtcaactgaagatgggaagtcctatgctgagaaggaatcactttacttcatggaaacctcagctctggaggctactaatgtagagaatgcctttgccgaagttctgactcaaatctatcacattgttagcaagaaagcagtagaggtggctgaaaatggaaccacatctgtgcctgccaaaggagagaaaattgatctgaaaaatgatgtttctgctttgaagagagttggttgctgctcaagctaagattggaaaacatagttcaattggttggtatcggctctgttgtacgtgtaatattctgagaaatacgaactagaagaaaagtgaaatttaatttgtcatagcatgttagactctttgtgtaaccttaaaactaagtttggtgtttcaataggagctgctggtgaagcaagttgattgctagtcttacttgttgtagtgcttttattattgtttttgaaatgttttcacatgcaaagaggttcaagcttggaattacttcatttaagtttgtgtagtattctgcagt

SEQ ID NO: 13873 - DNA, 877 bp, Glycine max
cttgtttccactacttttcttcccttctttccagaacaacaccacaacacaaacagagcaaaaaaagctccaccaatggcgggttacagagccgacgacgactacgactacctcttcaaggtggtcctgatcggcgattccggcgtgggcaagtccaacctcctctctcgcttcaccaagaacgagttcaacttggagtccaagtccaccattggcgtcgagttcgccacccgcaccttgaacgtcgattccaaagtcatcaaggcccagatctgggacaccgcaggccaagaaaggtatcgtgccatcaccagtgcatactatcgtggggcagtcggtgcacttctcgtgtatgatgtcactcgccatgcaacatttgaaaatgttgacagatggctgaaagaattgcggaaccacacagatgccaacattgttgtgatgctcgtgggtaataaatcagaccttcgtcaccttgtagccgtgtcaactgaagatgggaagtcctatgctgagaaggaatcactttacttcatggaaacctcagctctggaggctactaatgtagagaatgcctttgccgaagttctgactcaaatctatcacattgttagcaagaaagcagtagaggtggctgaaaatggaaccacatctgtgcctgccaaaggagagaaaattgatctgaaaaatgatgtttctgctttgaagagagttggttgctgctcaagctaagattggaaaacatagttcaattggttggtatcggctctgttgtacgtgtaatattctgagaaatacgaactagaagaaaagtgaaatttaatttgtcatagcatgttagactctttgtgtaaccttaaaactaagtttggtgtttcaa

SEQ ID NO: 13874 - DNA, 1017 bp, Malus domestica
aattcgcactgcactcttcccaagttcccaccgaaagctccaccacgctgcaactctctctctctctcctaattcgaataccgaaagctagagaactgcagaaatggctggatacaaagccgacgatgactacgactacctcttcaaggtggtcttgattggggactccggtgtgggcaagtccaatctgctctccaggttcactaagaacgagttcaacctggagtccaaatccaccattggagttgaattcgccaccaggaccttaaccgttgacggcaaagtcatcaaggctcagatttgggacactgctggccaagaaaggtatcgcgccatcactagtgcgtactatcgcggggctgtgggtgcactccttgtgtacgatgtcactcgccatgcgacatttgagaatgttgacagatggctgaaagaattgaggaaccacaccgattccaacattgttgtgatgcttgttgggaacaaatcagatctgcgccaccttgtagctgtctcaactgaagatgggaagtcctatgccgagaaggaatcactgtacttcatggaaacatctgcactggaagcaaagaatgtggaaaactccttcgctgaagttctgactcaaatataccatgttgtgagcaagaaggcagttgaagggggagaaaacggaacttcatcagtcccagcacaaggagagaaaataaatataaaggatgatgtgtccgctttgaagagagtcgggtgctgctcaagctaggcctggtaaacaaaacttgattgaatgaatattgcttcgatgtactgtgtaatattttgcagagggacacaaactagagaataccggaacacgaaatttttactgagtaatctagcttatgttatcctcaattagtaaacagtacagcaccatctatgactttaaatttgttaaagttcaatatcggaattcactcagcctcgcttttggaacgagtaaaacttccttatcattgttgagagttttgagttcagaacgca

SEQ ID NO: 13875 - DNA, 1356 bp, Musa acuminata
cgctttcctttgggtgtactgctttccccctccttcccctcctcgacacttctcgaatccgcctcctcccgaatctgcatcagctaatagtacgaaggcaagagcatagagataacagaggagctcggtggtagcgatttcttgtggcgcgtgcgagcttgctcttggacaagagaagcgtgcgggagagaggaggatcaagaaaaagggaacagatggcagcgtaccgagcggaggacgactacgactacctgttcaagctggtgctgatcggggactccggggtgggcaagtccaacctcctctcccgcttcaccaagaacgagttcaacctcgagtccaagtccaccatcggcgtcgagttcgccacccgcagcatctccgtcgacggcaaggtcctcaaggcccagatttgggacactgccggccaagaaaggtaccgtgccataacaagtgcttattatcggggagcggtaggtgcattgctcgtgtatgatgtcactagacgtgctacatttgagaatgtttctcgttggctgagggagttgagggaccacacagatcctaacatagtcgtcatgctcatcgggaataaatcagacctccgtcaccttgttgctgttcctactgaagacggcaaggcttatgctgagagagaatctttatattttatggaaacatctgcactggatgcaacaaatgtggagaatgcatttgcagaggtcttgactcagatttaccgtattgtcagcaagcgagcagtcgaggcgggtgacgatgcaacatcttctattcctggtagaggtgagagaataaatgtgaaagatgatgcttcgaagaaacttgggtgctgttcaacttagccagggggggaccagatgttgtgccttggatattgttggtgtgcaggatcgattcctaaatcttatcttttgatgctgttcccagcaagccatctgcgtcgaccaccgccttttaagcctcgaaggcacatcgacatgcagaagcttgacctcaaaagctcaatttgtggaacagtttctttcattctcatgcaatacatagtagattaggtataattgcaagttgtcttggaagatgattgccttgagagagatactatgggtttggatcatgaatggatttactatgatcaacaacacagagttgagtgttcctatcgaaggtggcaaaatctcgtgttgcatttcgactatgctgcagtgagttttactgaacgagaacatgtggtgtcttcctgcttatgttcatggaagaaagaagcttttatatctgagcatataatgctttattccgatcgaaggtatatgcggcatatatcctaaagcttttatg

SEQ ID NO: 13876 - DNA, 1081 bp, Phaseolus vulgaris
gatttgatgagtgagtgagtgagtgagtgacgcttttttaagcgttttcttttcacattctctgctttttctttctttccttctttgcattcctctcttctttcctttgcttcccttttttcgcattcacagcagataacagagcacgctgcagcaccaccaccaatggcgggttacagagccgacgacgactacgactacctcttcaaggttgtcctcatcggagactccggcgtcggcaagtccaacctgctttctcgcttcaccaagaacgagtttaacttggagtccaagtccaccattggcgtcgagttcgccactcgcaccttgaacgtcgattccaaagtcatcaaggcccagatctgggacaccgcgggccaagaaaggtatcgtgccatcaccagtgcttactaccgtggcgcagttggtgcgcttctggtgtacgatgttactcgccatgcaacattcgagaatgttgacagatggctgaaagagctgcgaaatcacacagacgccaacattgtggtgatgcttgttggaaacaaatcagaccttcgccacctggtagctgttacaacagaagatgggaagtcgtatgctgagaaagaatcactttactttatggaaacctcagctctggaggccaccaatgtagagaatgcatttgctgaagttctaactcaaatctaccgcattgttagcaagaaagcagtagagggtgttgagaatggaacagcgtctgtgcctgccaaaggggagaaaattgacctgaaaaatgatgtgtctgctttgaagagagttggatgctgctcaagctgaggatggaaaacatagttgttgaattggttggtatcggctctgttgtacgtgtaatattctgagaaatacgaactagaagaaaagtgatatttaatgtcatagcatgttagactctttctgtaaccttaaaaactaagtttggtgtttcaataggagctgctgtggaagaaagttgattgctagtcttgttgtagtgctgttattattgtttttcaaatgttttcacatgcaaagaattaattgaagctattgtctcatttaa

SEQ ID NO: 13877 - DNA, 1645 bp, Cicer arietinum
gttgaaacgcaccatctagaactcgtatccaacatcaaccatatcaaacccattgttaatcttccaaagtcctttcaagcgttctctcatgataaataaactgatatccttttccaacattttcactatgatcgaatttttaaaatataaattaattatttgagttcaatacattgatttattatcggaactattatgttaactaatctattaaaataaaaaatcttaccagatagacctcaaaataaaaaaatctcaccaactaactaatcggcaacatattattttggctgactaaaaaaacaaaattatattggtcggtctctcttaacggtacaaaaaactcgttagtgactaatactcaaataaatcaaaatataattatttatccgaattatttaaaatggaaaagaataaacttgcggcgctattttgtacattctcccatttctcgactctacactttcttttcttctttctcagcactcttcgtagtttctctctcttgttttttgagtaacatcacagagcacaaagcagagtcgaataagaacagaaatggcaggttacagagcagacgatgactacgactatctattcaaggtagttctgatcggcgactccggtgtcggcaaatcgaatcttctctcgcgtttcacgaagaacgagttcaaccttgagtccaaatccaccattggtgttgagttcgctactcgtactttgaatgttgattctaaagtcatcaaggctcagatctgggatactgctggtcaagagaggtatcgtgccatcaccagtgcttactatcgcggggcagtcggtgcacttcttgtatatgacgtcacacgccatgcaacatttgagaacgtcgacagatggctgaaagaactgcgaaaccacacagattcaaacattgttgtgatgcttgttgggaacaagtcagatcttcgtcatcttgtagctgtatcaacagaagatgggaagtcttacgctgagaaagaatcactttacttcatggaaacctcagctcttgaggcttctaacgtagagaatgcatttgctgaagttctcactcagatctaccgtattgttagcaagaaagctgtagagggtgctgaaaatggaaacgcgtctgtgccagccaaaggagagaaaatagatcttaaaaatgatgtttctgccctgaagagagttggttgttgttcaagctaaagattggataatataattcaattgattgctatcggctctgttgtatgtgtaatattctaagagagagatacgaactagaagaagaagaaagaaaaatgtaatttaatttttcatagcatgttagactctgtgtgtaaccttaaaaaacaaagtttgatgtttcaataggagctgctggggaagcaagttgactgttacgcggcatagtttgtactcagtagtgtaatatagttgtttttcaaatgttttcacctgcaaagtggttccagattgaaagtaattgaatcatttgagtttgtcctgactttgatgcagaaaatttgctatcaccgagtgcggatttaggttttcctgaaactcaactcaaaatcaaggtggaagtttgaggtgttcttatccgtcgtgtccataaacctttctcactaataaaaat

SEQ ID NO: 13878 - DNA, 795 bp, Trifolium pratense
ctctctctctcgttgcagcaaaagagaaagagcacagagcagattcagagaacaacaacaatggcgggttacagagctgacgatgactacgactatctattcaaggtagttctgatcggcgactccggtgtaggtaaatcgaatcttctttctcgtttcaccaaaaacgagttcaaccttgagtccaaatccaccattggtgttgaattcgctactcgtactttaaatgttgattctaaagtcattaaggctcagatctgggatactgctggtcaagaaaggtatcgtgccatcaccagtgcttactaccgtggggcagttggtgcacttcttgtatatgatgtcacacgccatgcaacatttgagaatgtcgacaggtggttgaaggaactgcgaaaccacacagattccaacattgttgtgatgcttgttggcaacaaagcagatcttcgtcaccttgtagccgtatcaactgaagatgggaagtcttatgctgagaaagaatcactttatttcatggaaacctcggctctggaggctacaaacgtagagaatgcatttgctgaagttctgactcaaatctaccatattgttagcaagaaagcagtagagggtgttgaaaatggaaatgcgtctgtgccagccaaaggagagaaaatagatcttaaaaatgatgtttctgccttgaagagagttggttgctgctcaagttaagattggtaaacataattcaattggttgataccggctctgttgtatgtgtaatattctaagagagagatacaaactagaaga

SEQ ID NO: 13879 - DNA, 1021 bp, Vigna unguiculata
ttctctcctctttcttcgcttcgcttcgctttttattttccattcaaagcacataacagagcacgcagcagcaccaacaatggcgggttacagagccgacgacgattacgactacctcttcaaggttgtcctcatcggggactccggcgtcggcaagtccaacctcctttctcgcttcaccaagaacgagttcaacttggagtccaagtccaccattggggtcgagttcgctactcgcaccttgaacgtcgattccaaagtcatcaaggcccagatctgggacaccgcaggccaagaaaggtatcgtgcaatcaccagtgcttactaccgcggcgcagtgggtgcgcttctggtgtacgatgtgactcgccatgcaacatttgagaatgttgacagatggctgaaagaactgagaaaccacacagatgcgaacattgtggtgatgcttgttggaaacaaatcagaccttcggcacctggtagcagttacaacagaagatggaaagtcatatgctgagaaagaatcactttacttcatggaaacctcagctcttgaggccaccaatgtagagaatgcatttgctgaagttctgactcaaatctaccgcattgttagcaagaaagcagtagagggtgccgagaatggaactgcatctgtgcctgcaaaaggggagaaaattgacctcaaaaatgatgtctctgctttgaagagagttggatgctgctcaagctgagcttctgagcttggaaaacatagctcatccattggttggtatcggctctgttgtacgtgtaatattctgagaaatacgaactagaagaaaagtcaaatttaatgtcatagcatgttagactctttctgtaaccttaaaaaaactaagtttggtgtttcaataggagctgctggggaagaagaagttgattgctagtcttgttgtagtggtgctgttattattattgtttttcaaatattttcatatccaaagaggttcaagcttggaattaattgaagctattatttc

SEQ ID NO: 13880 - DNA, 1000 bp, Trigonella foenum-graecum
tctcttcacatctctctcttgttcagagcaagagcataaagcagattcgaacaagaagaagaagaatggcgggttacagagcagacgacgactatgactatctcttcaaggtagtcctgatcggcgactccggcgttggcaaatccaatcttctctcgcgtttcacaaaaaacgagttcaatctcgaatccaaatccaccattggtgttgaattcgccactcgtactttgaatgttgattctaaagttattaaggctcagatctgggatactgctggtcaagaaaggtatcgcgccatcaccagtgcttactatcgtggtgcagttggtgcacttcttgtatatgatgtcacacgccatgcaacatttgagaacgtcgacagatggctgaaagaactgcgaaaccacacagattccaacattgttgtgatgcttgttggtaacaaagcagatcttcgtcaccttgtagccgtatcaactgaagacggcaagtcttatgctgaaaaagaatcactttatttcatggaaacctcagctctggaggccactaacgtagagaatgcatttgctgaagttctgactcaaatctaccatattgttagcaagaaagccgtagagggcgctgaaaatggaaacgcgtctgtgccagccaaaggagagaaaatagatcttaaaaatgatgtttctgccttgaagagagttggttgctgctcaagctaagattgtaaaacataattcaattggtggctatcggctctgttgtatgtgtaatattctaagagagatacaaactagaagaggaagacgaaaaatgtaatttaatttttcatagcatgttagactctctgtgtaaccttaaaaaacaagtttcatgtttcaataggagctgctggtgaagcaagtttattgctaagctgcatagtctgtactctgtagtgttatagttgtttttgaaatgttttcatctgcaaattgattcaagcttggaagtaattgaatca

SEQ ID NO: 13881 - DNA, 1147 bp, Malus domestica
atttcactttccacattccctccttgcagacaggagtcttccacaggtctgacgcgcctccgaaaagccgaaaaaaaaataataacggagattgcagagagcaaaagcaaatcaccgggagagatctgaagaacgagatcaccaccttcttcccagaagccaaaaagcttcagactttttctttggggtcacagtaatggctgggtacagagctgaggacgactacgactacctcttcaagttggtgctgatcggcgactccggcgtcggcaagtccaacttgctgtcgaggttcaccagaaacgagttcagcctcgagtccaagtccacaatcggagtcgagttcgccacccgcagcttggatgtcgacggcaaagtcatcaaggcccagatttgggacactgctggccaagaaaggtaccgagcgataacaagtgcttactatcgaggggctgttggtgcactacttgtgtacgatgtcactcggaattcaacatttgaaagtgtggaaaggtggttaaaggagttaagagaccatactgatcccaacattgttgtcatgcttgttggtaacaaatcagatcttcgtcaccttgtggcagtctcaactgaggacggaaaatcctttgccgagagggagtctctctacttcatggaaacctctgcactcgaagcgaccaacgtggacaatgcattttctgaagtcctcacccagatctttcgcattgtgagcaggaaggccatggaggctggcgatggagctgcttcgaccgttcctcaaggagagaaaatcgatgtcagtaaagatgtttcagctgtgaagaaagctggatgttgctcaagctagggtccgaatctgcaccagatgtagctggtttctgttaccacatatctgttattccctctaccggggttgtgtaaaaaaaattctcggaaattctgccggcgttaggagataggcaggcggggttccgtgtttacttccattgtcgttatcattaattatcctaagacagatatgtttagcggatcaagaggagtttgtaacaagatattacatgttacttttcacataggtttttgcccgaattattcggcattccgagattatattcttgagacgaattaattgaaattgttcattcaa

SEQ ID NO: 13882 - DNA, 1361 bp, Citrus sinensis
gtggactttactataaatacagcaatatcgcttgctatctctttcattctctcaacattggtcagaaaaaaaaatcctttagaaagaaagtctcaacactaagctagttaatggccctccaagctgctgctttggttccctctgctttctcagtccccaaagagggcaaaactagtgcatctttcaaggactcaagtctttttggagtttcattctcagaacatgcaaaggctgatttcagctcttctgcattaagatgcaagagagaattcagccaaagaaatggggtggtaagagcccaaacgatggctactgcctctccagcagtcgatgtttcttccccacaagggaagaaaactctcagaaaaggcagcgttataatcaccggcgcatcgtctggattggggctggccacagctaaggctttagctgaaactgggaaatggcatataatcatggcctgcagggattttctcaaggctgaaagagccgccaagtcggctggcatggctaaggagaactacactatcatgcatttagatctggcttcccttgacagtgttcgccaatttgttgataccttcaggcgatcaggcagacctctcgatgtgctagtttgcaatgctgctgtttatttgccaactgctaaggagcctacatttacggctgagggatttgaacttagtgttggaaccaaccatcttggtcacttcctcctttcacggctgttgcttgatgacttgaagcaatctgattacccatcaaagcgtctcatcatcgttggctcaatcacaggaaacacaaataccttggctggtaatgtacctcctaaggccaaccttggggacttaaggggatttgctggaggcttaaatgggctaaacagctcatccatgattgacggtggagattttgacggtgccaaggcctacaaggacagcaaagtctgcaacatgcttaccatgcaagagtttcacaggcggttccacgaggaaactggcatcgcattcgcttccctttaccctggctgcattgccacaacaggcttgttcagggagcacattcccttgttcagacttctcttccccccattccaaaagtacatcaccaagggttatgtctctgaagatgaagctggaaaaagacttgctcaggttgtgagcgatccaagcttgacaaaatcaggtgtttactggagctggaacaaggactcagcttcatttgagaatcagttgtctcaggaagctagtgacgttgagaaggcacgtaaagtctgggagataagtgagaaacttgttggtttggcctaattcaaaacctggagattcagatctaccagtttatgttacgggagggtttta

SEQ ID NO: 13883 - DNA, 1641 bp, Citrus clementina
gtggactttactataaatacagcaatatcgcttgctatctctttcattctctcaacattggtcagaaaaaaaaatcctttagaaagaaagtctcaacactaagctagttaatggccctccaagctgctgctttggttccctctgctttctcagtccccaaagagggtaaaactagtgcatctttcaaggactcaagtctttttggagtttcattctcagaacatgcaaaggctgatttcagctcttctgcattaagatgcaagagagaattcagccaaagaaatggggtggtaagagcccaaacgatggctactgcctctccagcagtcgatgtttcttccccacaagggaagaaaactctcagaaaaggcagcgttataatcaccggcgcatcgtctggattggggctggccacagctaaggctttagctgaaactgggaaatggcatataatcatggcctgcagggattttctcaaggctgaaagagccgccaagtcggctggcatggccaaggagaactacactatcatgcatttagatctggcttcccttgacagtgttcgccaatttgttgataccttcaggcgatcaggcagacctctcgatgtgctagtttgcaatgctgctgtttatttgccaactgctaaggagcctacatttacggccgagggatttgaacttagtgttggaaccaaccatcttggtcacttcctcctttcacggctgttgcttgatgacttgaagcaatctgattacccatcaaagcgtctcatcatcgttggctcaatcacaggaaacacaaataccttggctggtaatgtacctcctaaggccaaccttggggacttaaggggatttgctggaggcttaaatgggctaaacagctcatccatgattgacggtggagattttgacggtgccaaggcctacaaggacagcaaagtctgcaacatgcttaccatgcaagagtttcacaggctgttccacgaggaaactggcatcgcattcgcttccctttaccctggctgcattgccacaacaggcttgttcagggagcacattcccttgttcagacttctcttccccccattccaaaagtacatcaccaagggttatgtctctgaagatgaagctggaaaaagacttgctcaggttgtgagcgatccaagcttgacaaaatcaggtgtttactggagctggaacaaggactcagcttcatttgagaatcagttgtctcaggaagctagtgacgttgagaaggcacgtaaagtctgggagataagtgagaaacttgttggtttggcctaattcaaaacctggagattcagatctaccagataatttatgttacgggagggttttatgagcttgaaggtttgttaggtagcggagtttggaattgtggtcagcttttcaattgtagatgtagatggcttgtggaaaaaaaatgtcaataaatcactcactcttgttgcaaagtggtagttatttcagagtctaatatgaaatgaaaagagaaacatttcggcttcatgttaattgtacttcaaggacttcttaaacatttggattttggctgagtaatcagggcttgatgtatcaagagacttccaaacttagaagaatgccagatttgtca

SEQ ID NO: 13884 - DNA, 1328 bp, Ipomoea nil
ggaagaaaccactcaagactccatttttcctcaccaaaatatcatagcatatctcccatggccctccaggctgctgcccttctccctgctttgtccattcccaaagaggggaaaaccagtgcaactctcaaggattcaagcttgtttggagtctctctgttggaccactctaaacctgatttcagctcctctgctcttaaaatcaagggggcaagaaaggtatccaatggggttgtgaaagctgagacaatggtggcaactccgggtgtcaccggagcccaagtttccggcaagaaaacgctgagaaagggcactgttgtggtcaccggcgcatcttccgggttagggctggcgacggcgaaagcgctggcggagaccggaaaatggcacgtgattatggcctgccgggacttcttgaaggcggagagagcggcaaaatcagtgggcatgcgcaaggaggatttcaccataatgcatttggaccttgcttccctcgacagcgtccggcaattcgtcgacaacttccggcgctccggccgcccccttgatgttctggtctgcaatgccgctgtctacttgcccactgctaaagaacccacttttacagctgaagggtttgagttgagtgtgggcactaaccatcttggccactttttgctttcaagattgcttcttgatgatctgaaacaatctgattacccttccaagagactcatcattgttggctcaatcacagggaatacaaatacgttggccggaaatgtaccaccgaaggcacacctgggggacatgaggggtctagccggaggactgagcgggcaccacagctcggccatgatcgacggcggggcgttcgacggcgcgaaggcgtacaaggacagcaaggtgtgcaacatgctgacaatgcaagaattccaccggcgtttccacgaggacaccggcatcaccttcgcctccctgtacccgggctgcatcgccaccacggggctgttccgggagcacatccccttgttccgcctgctcttcccgccgttccagaggttcatcacgaaaggattcgtgtcggaggacgaggccggaaagcggctggcgcaggtggtcagcgaccccagcttgaccaagtccggcgtctactggagctggaacaaagactcggcttctttcgagaaccagctgtctcaagaagccagtgatgccgacaaggctcgcaaggtgtgggacctcagcgagaaactcgtcggcttggcttaagcggctcattccatttccccccattccattttttccatatgagtgagattgtaacatgccattgcccactagcttgt

SEQ ID NO: 13885 - DNA, 1435 bp, Rosmarinus officinalis
ggccgggggctggtacaagataagaagaaacaccaatttctagcaagcaaaaatcttaggacagagccccatcaattccaacaggtaacagtaactaactatggctctgcaggctgctgctcttcttccatccacattctccatttccaaggagggcaaaactagtgcatctctgaaagactcaagtctctttggcatttcactctctgaccctctcaagtgtgaattcagctcctcccctttgaaaatcaagaggggtgtaagagcccaggcagtgcttacgactccaggtgttacccgagcaacagcggaagggaagaaaactttgaggaagggcaatgtcattgtcaccggtgcttcttctggactaggtctggccacggctaaagctctagccgaaacagggaagtggcacataattatggcctgtagggatttcctcaaggctgagagggctgcaaagtcagttggcatgtccaaggagaactacactatcatgcatttggatcttgcttcccttgacagcgtccgacagttcgcggataacttcaaacgatctgggaggcctcttgatgtgttggtttgcaatgctgctgtttacttgccaactgctacagagccgacctttacagctgaagggtttgagctcagcgtgggaacaaatcatcttgggcactttctcctttcaagattgctgcttgatgacatgaagcagtctgattacccttcaaagaggcttattattgttggttcaatcacagggaacacaaacactttggctggtaatgtacctccaaaagccaaccttggggacttgaggggtcttgcaggaggactgaacggactaaatagctcagcaatgattgatggaggagattttgatggtgccaaggcatacaaagatagcaaagtctgcaatatgctcagtatgcaagagttccaccgtcgttatcacgaggatactggaatcacatttgcttccctttacccaggctgcattgcaacaaccggtctgtttagggagcacatcccattgttcaggcttctcttcccaccattccagaaatacatcacaaagggttttgtctctgaagaagaagctggaaagagacttgcacaggttgtaagtgatccaagcttgacaaagtcaggtgtctactggagttggaacaaggactcggcttcttttgagaaccaattgtctcaagaagccagtgatgttgaaaaagcccgtaaagtatgggaactcagcgagaaactagttggtttggcctaaatcaagttctgaatcattttgtctgcggcaaatgtaattcagtgttcatgcttgagagttagaaatgagatgtcgggtggttttaattggctgttcaattgtacaaataaaattttatttagaatgttaataaaaatgctggaccccatccttcactgg

SEQ ID NO: 13886 - DNA, 1417 bp, Epimedium sagittatum
ttgctcaaccaaataaaaatctaacataaaccctcgtgttcatggctctccaagcatcttcaatccttccctctgctctttccattcacaaagagggtaagctgaatgcgtctcttaaggacaattctttcttgggagtttcactaaatgatcatcttaagtctgaatttggtacctcttgcctaaggagcaagaaggaaatcaaccaaagaatcatatccatcagagccacagcagtgacaagtccaggagtcaaccaagcaacctcacaggggaagaaaacattgagacaaggtgtttgtatagtaacaggagcttcatcaggtcttggactaaccacggccaagtctctagccgaatcaggaaaatggcacgttataatggcatgcagggatttcctcaaggccgaaagagctgcaaaatcagtcggcatgtccaagggtacctatacgatcatgcaccttgacctatcgtctcttgatagtgtgaggcagtttgcagataacttcaaaaggtccggtaggccactagacgtactagtttgcaacgccgccatttaccagccaaccgctaaggagcctagcttcactgctgatgggttcgagctaagtgtaggaactaatcacctaggacactttttgctatcgcgcttgttgattgatgaccttaagcaatctgattacccgtctaagcgtcttatcatcgttggttccatcacaggtaacacaaacactttggctggaaacgtgcctcctaaggcgaacctcggggacttgagaggaatggcaggaggcttgaacgggttgaacagttcggctatgatcgatggaggggaatttgacggtgccaaggcctacaaggacagcaaagtatgtaacatgctcacaatgcaggagttccataggcgttaccacgaggaaactgggatcacatttgcttccttatatcctggttgtattgctaccacgggcttgtttagggagcacatccccttgtttagactcttgtttcctcccttccagaagtacatcaccaagggttatgtctctgaagaagaggccggcaaaaggctcgcacaggtggtgagtgacccaagcttgaccaagtcaggtgtatactggagttggaaccagaactcggcttcttttgagaaccagctatctgaagaagctagtgatgcagagaaggcaaggaaggtgtgggaagagagtgagaagcttgtcgggttagcttgagcgaaaaagctgggcatggaattggagtttcgattaatttgcgagaattagcataagatctaggcaagatgagtgtgtgaagttatcaatgtataattaggagattttctgtggatataaatgttatgcaaatagtgtaatagcaggcatgtttgaagtagaatcaataaaacactaaaatt

SEQ ID NO: 13887 - DNA, 1454 bp, Actinidia deliciosa
cccattttctgctcatccaaacagccctctcccaggagaatttgaaagatacccccctcaaaacatggctcttcatgctgctgcaatacttccctctgctttctccattctcaaagagggcaagtccaaggactccacttttttgggaatttctctctctgatcatgtcaaatctgattccatttacacttcattaagaatcaagagggaatccaagcaaagaaaatttatcgttggaccaattcgagctcaagcagtggtggaagccccagaagtggcccaggccacaccagccggcaagaaaacactaaggcagggcagcgtagtggtcaccggagcctcctctggactaggtctggccacggccacggccctagccgagacaggcaaatggcatgtaatcatggcctgcagggacttcttaaaggcggagagggcagccaagtcagccggcatggccaaggagaactacaccatcatgcacttggacctcgcgtcgcttgacagtgtgaggcagtttgttgataactttaggcgatcgggcaggccacttgatgtgctggtctgcaatgctgctgtgtacttgcctactgccaaggagcctacttttacggcggaagggtttgagcttagtgttgggacgaatcatcttgggcactttcttttgtcgagattgttgcttgatgacttgaagcagtcggattatccatcgaagaggctcattattgtcggctcaattacaggtaacacaaataccctagctggaaatgtgcctccaaaggccaacctaggggacttgagagggcttgctggggggttgaatggtctaaacacctcatccatgatcgatggcggagaatttgacggcgccaaggcatacaaagacagcaaggtctgcaacatgctcaccatgcaagagttccaccgtcgctaccacgaggaaaccgggatcacattcgcttccctttaccctggctgcattgccacaaccggcttgttcagggaacacatccccttgttcaggctcctcttccctcccttccagaagtacatcaccaagggctttgtatccgaagaagaatccgggaagcgacttgcacaggttgtgagcgatccgagcttgacaaagtcgggtgtctactggagctggaacaaggactctgcgtccttcgagaaccaattgtctcaagaagcaagtgacgcagagaaagctcgtaaagtatgggaagtcagtgagaaacttgttggtttggcataaatgagagcttcgaggcgagattcttatttgactaatcttcttgccgagacagaggtcctgctgtgactgccgaattaggatagggtatcgtgccactgtaagcaattttcttgtgtaacatagatgaccctgagtcatagtgtttaataaaatccctcaccttcgtaactccgaacattccaactaaaaaaaaaaa

SEQ ID NO: 13888 - DNA, 1354 bp, Gossypium hirsutum
ctttggtccactacacagccatttcaaagtggtacatacatggctctacaagctgctgctttggttccatctactttctctgtaccaaaagagggaaagtctggtgcttctttcaaggattcatctctctttggagtgtcactttctgatcacatcaaagctgacttcacctcttctgctttaagatgcaagagggaattcaaccatagaattggggctgtcagagcccaaacaacagccactgcaacaccagcaatcaccagatctacagtggatggaaagaaaacactaagaaagggtagtgtgatcatcaccggtgcctcctctggattgggtttagccactgcgaaggccttggctgaaactgggaaatggcatgttataatggcttgcagggactttctcaaggctgagagagctgctaagtctgctggaatgtcaaaagaaaactacaccattatgcatttagaccttgcctccctcgacagtgtccgacaattcgtcgatagctacaagcgatcaggccgacctcttgatgtacttgtttgcaatgctgctgtttatcaaccaactgccaaggaacccactttcactgctgaaggatttgaacttagtgtggggactaatcacctcggtcacttccttctttcgcggttattgctcgatgatttgaaacaatccgattatccatcgaaacgcctcatcatcgtcggttccataacaggaaacacaaatacattggccggtaatgtacctccgaaggcaaaccttggggatctaagaggacttgcaggtggactaaatggactgaacagctctgccatgattgatggtggagattttgatggtgccaaagcatacaaggacagcaaagtctgcaatatgctcactatgcaagaattccataggcgtttccatgaggaaaccggcattacattcgcttcattgtaccctggttgcatagctaccaccggcttgttcagggagcacattcctttgttcaggctcctcttccctccattccagaagtacatcaccaaggggttcgtctccgaagaggaagccggtaaaagactcgctcaggtcgtgagcgatcctagcttgacgaaatccggtgtttactggagctggaacaaggattcggcttcattcgagaaccagttatctcaagaagctagtgatcaagataaagcacgcaaaatatgggagcttagtgagaaactcgttggcttggcctaaatttagagccttgaatgctttgcggcagagctttgataatggcttaagggtcttatctgatcccattgatgagtgtagatgactttgtgagttgcagtttgacaataaaaattta

SEQ ID NO: 13889 - DNA, 1457 bp, Gossypium raimondii
ctcacttctttctactactgagctcacccttcactttggtccactacacagccatttcaaagtggtacatacatggctctacaagctgctgctttggttccatctactttctctgtaccaaaagagggaaagtctggtgcttctttcaaggattcatctctctttggagtgtcactttctgatcacatcaaagctgacttcacctcttctgctttaagatgcaagagggaattcaaccatagaattggggctgtcagagcccaaacaacagccactgcaacaccagcaatcaccagatctacagtggatggaaagaaaacactaagaaagggtagtgtgatcatcaccggtgcctcctctggattgggtttagccactgcgaaggccttggctgaaactgggaaatggcatgttataatggcttgcagggactttctcaaggctgagagagctgctaagtctgctggaatgtcaaaagaaaactacaccattatgcatttagaccttgcctccctcgacagtgtccgacaattcgtcgatagctacaagcgatcaggccgacctcttgatgtacttgtttgcaatgctgctgtttatcaaccaactgccaaggaacccactttcactgctgaaggatttgaacttagtgtggggactaatcacctcggtcacttccttctttcgcggttattgctcgatgatttgaaacaatccgattatccatcgaaacgcctcatcatcgtcggttccataacaggaaacacaaatacattggccggtaatgtacctccgaaggcaaaccttggggatctaagaggacttgcaggtggactaaatggactgaacagctctgccatgattgatggtggagattttgatggtgccaaagcatacaaggacagcaaagtctgcaatatgctcactatgcaagaattccataggcgtttccatgaggaaaccggcattacattcgcttcattgtaccctggttgcatagctaccaccggcttgttcagggagcacattcctttgttcaggctcctcttccctccattccagaagtacatcaccaaggggttcgtctccgaagaggaagccggaaaaagactcgctcaggtcgtgagcgatcctagcttgacgaaatctggtgtttactggagctggaacaaggattcggcttcattcgagaaccagttatctcaagaagctagtgatcaagataaagcacgcaaaatatgggagcttagtgagaaactcgttggcttggcctaaatttagagccttgaatgctttgcggcagaactttgataatggcttaagggtcttatctgatcccattgatgagtgtagatgactttgtgagttgcagtttgtcaataaaaaatttactcaccccaatttgcaagaatctcaagtttctcttccattatcaaatatgaaaatgagaaaaaataacc

SEQ ID NO: 13890 - DNA, 1372 bp, Amsonia hubrichtii
aaattttagcaagcaaaaatcccaggacagccaattcaattccaagaaaaagtactaaccatggctctgcaggctgctgctcttcttccatctacattctcaattagcaaggagagcaaaattagtgcatctttgagagacactagtctgtttggcatttcactctccgaccatctcaagtgtgaattcagctcctcctctttgaaaatcaagaagggcgtaagagcccagacagtagttacaaccccagctgttacccgagcaaccggagaagggaagaaaaccttgaggaagggcacagttatcgtcaccggtgcttcttctggactaggtctggccacagctaaagctctggctgaaacaggcaaatggcacataattatggcctgcagggacttcctcaagactgagagggctgcaaagtcagtcggcatggccaaggagagctacaccatcatgcatctagatcttgcttcccttgacagtgtccgccagtttgtggataacttcaaacgatctgggcgacctcttgatgtgttggtttgcaatgcagctgtttacttgccaactgctaaagagcctacctttacagctgaagggtttgagctcagtgtgggcacaaatcaccttggacacttcctcctttcaagattgctgcttgacgacatgacgcagtctgattatccgtcaaagaggcttattattgttggttcaatcacaggaaacacaaacactttggctgggaacgtacctccaaaggccaaccttggggacttgaggggtcttgcaggaggactaaatggccttaacagctcagcaatggttgatggtggaaattttgatggtgccaaggcatacaaggacagcaaagtctgcaacatgctcacaatgcaagaattccaccgtcgttatcacgaggatactggaattacatttgcttccctttacccaggctgcattgcaacaacaggcctgttcagggagcacatcccattgttcaggtttctcttcccaccattccagaagtacatcacaaagggctttgtctctgaagaagatgctggaaagaggcttgcacaggttgtaagcgatccaagtttgacgaagtcaggtgtctactggagttggaacaaggactcagcttcttttgagaaccaattgtctcaagaagccagtgatgtcgaaaaagcccgtaaagtatgggaagtcagcgagaaactagttggtctggcctaaatcaagtcctggatcattttgtttgcggcaaatggagtctagtgttcatgcttgagagttagaattgagatgtcgggtggtcctaattccctgttcacttgtaaaatttgatttagaatgttaataaaaataccag

SEQ ID NO: 13891 - DNA, 1595 bp, Panax ginseng
aagcagtggtatcaacgcagagtacatggggatatctaacacctcccaaatagtttattttcaagaaatatcttgtggagatttaaattctaaagggtacacatggctctccaggctgcttctctccttccctctgctttctccatcaacaaagagggcaagatcagtgcttctttgaaggacactagtctatttggagtctcattctttgacaatcacaaaactgacttcacttcttcttcctctttgaagaccaagaggcatgccggagttgtacgagctcaggcagtagtcacaactccgtcagtcaaccgggctacaactgacacaaagaaaaccttaagaaagggaagtgtgattgtcacgggagcctcctccggattgggcttggctgcagccaaggcattggcagaaacagggaaatggcatgtaattatggcctgcagggactttctcaaggcagaaagagctgccaaatcggctggcattgctaaggagaattataccattatgcatttggaccttgcatcgcttgacagtgtcaggcagtttgtagacaactttaggcgatctggtagagcgcttgatgtgcttgtttgcaatgcagctgtctatttcccaactgccagggagcctacgtttactgcagaaggatttgaacttagtgttgggactaaccatttgggacatttcctcctttctagattgctgcttgatgacttgaacaagtcggattacccctcaaagcgactcattattgttggttccatcacaggcaacacaaacacattggctgggaacgtaccaccaaaggccaaccttggggacatgaggggtcttgcagggggtttgaatgggctcaacagttcagccatgattgatggtggagattttgatggggcaaaggcatacaaggacagcaagatctgcaacatgctcaccatgcaagagtttcaccggcgttaccacgaggacactgggatcacatttgcctccctttacccaggatgcattgccacaacaggcttgttcagggagcacatccccctgttcaggacccttttccctccattccaaaagtacatcactaagggatttgtatctgaagcagaatccgggaagcgacttgcacaggttgtgagtgaaccaagcttgacaaagtctggagtgtactggagctggaacaaggactcggcttcatttgaaaaccagttgtctgaggaagctagtgatgtggagaaggcgcgtaaggtttgggaagctagtgagaaacttgttggtttggcctaaatcaggatcctttagataatttctagcagatagctaatcttcaatatgagatgggaaatctgggtcctttgtgtttggattcagatacagggttggtgtaaccaattttcaattgtaatataagtgtaatttcagttgaagttgacaataaaagtgccctacctaccttaaaaaattaacaaaaaagcaaagactaatgataagtttgtatagaaggaagtaaggaacgaaacagggagcggaattattcattccattacatccggaatgagttattccccgaggaataaaattcataaatttga

SEQ ID NO: 13892 - DNA, 1327 bp, Catharanthus roseus
aggctgctgctcttcttccatccacattctccctttccaaagagggaagaacaagtgtatctttgaaagattcaagtctctttggcatttcattctctgatccactcaagggtgaattctcctcgtccgctttcaaaatcaagaagagtagtataagagggcaggcagtaattacaactccaggtgttacaagagcaacatcagaaggcaagaaaacattgagaaagggcagtgttataatcactggtgcttcatctggacttggtttggcaacagctaaagctctggctgaaacaggaaaatggcacataattatggcttgtagggattttcttaaggctgaaagggctgcaaaatctgttggaatgtctaaggaaaactatactattatgcatttagatctttcttcacttgacagtgtccgccaattcgtcgataacttcaaaagatctggcagacctcttgatgttttggtttgtaatgccgctgtttatttgcccactgccaaagaacctacatttactgctgaagggtttgaacttagtgtgggaacaaatcatcttggacattttcttctttcaagattgcttcttgatgatatgaaacaatctgattacccttcaaaaagacttatcattgttggttcaatcacagggaacacaaacactttggctggaaatgttcctccaaaggccaaccttggagacttgagggggcttgcaggaggactaaatggacttaacagttcagcaatggttgatggaggagaatttgatggtgcaaaggcatacaaagacagcaaagtctgcaacatgctcactatgcaagagttccatcgtcgttaccacgaggacactggcattacctttgcttccctttatccaggctgcattgccacgactggtctttttagggagcacattcctttgttcaggcttctgtttcctccattccagaagtacatcacaaagggctttgtttctgaagaagatgctggcaagagactagcacaggttgtgagtgatccaagcttgacaaagtcaggtgtgtactggagttggaacaaggactcagcttcttttgagaaccaattgtctcaagaagcaagtgatgttgaaaaagctcgcaaagtatgggaagtcagtgagaaactagttggcttggcctagaaccaaatcctggacacattttgtcagtgttcgtgcttgagagttagaatcgagaagattactactctgttcacttgtaaaaataaaaatttgatttagaatgttaataaaaattctagacctcatctttcaatggaaaatgttcattgattatcaag

SEQ ID NO: 13893 - DNA, 1383 bp, Medicago truncatula
attcattttcatattactaaggttcattcaatcttactttgctaagtttcaatggctcttcaagctacttcttgccttcctgcttctttctccattacaaaagagggaaagattggtgcatctctcaaggattcaacattttttggtgtttcattgtctgattctttgaaaggtgatttcagctcttctgcattgaggtgcaagagggaattgcgacaaaaagtcggtgctgtgagggcagagacagcagctacagccactccagcggttaccaaatcttcacctgatggcaagaaaacattgaggaaaggaagtgttgtgatcactggtgcttcatctggattaggcctagccactgctaaggctttggctgagacaggaaaatggcatgtaattatggcttgcagggatttcctcaaagcttcaagagctgcaaaatctgctggcatggctaaggaaaactacacaatcatgcacttagacctttcctctctcgacagcgttcgccaattcgtcgataacttcaggcgatctgaaatgccgttggatgtgcttgttaacaatgctgctatttacttgccaactgctaaggaacctacattcactgctgaaggatttgagcttagtgttgggacaaaccatcttggacactttcttctttcgcgccttttgcttgaggacctgggcaaatctgactacccttcaaagcgcttgatcattgtcggctcaatcacaggtaacacaaacacattggctggaaatgtaccgccaaaggctaaccttggtgacttgaggggacttgccggtggtttgaatgggcttaacagttccgccatgatagatggtggagattttgatggtgccaaggcatacaaggacagcaaagtgtgtaacatgctcacaatgcaagagttccatagacgataccatgaggaaactggaatcacatttgcttccctttaccctggttgcattgccacaacaggcttgtttagggagcacattcccttgttcagaactctattccctccattccagaagtacatcaccaaaggctacgtctcagaagatgaagcaggaaagagacttgctcaggttgtgagtgatccaagcctaacaaaatctggtgtttactggagctggaacaaagcttctgcttcatttgaaaaccagctatcccaggaggcaagtgatgtagagaaggctcgcaaggtgtgggaagttagtgagaaacttgttggtttggcctaagctgagagcctccaacatctatgctaagtaaaaggcagaggcattgccttgccatggaaggaaaatgatgtcctagaagagtgaaaatgatatcatgttgagtgcattaattgatgttttgttagataggaa

SEQ ID NO: 13894 - DNA, 1638 bp, Eucalyptus grandis
actaatatctcttccggggctctctccttctggtgctttgtttgtactttgagtttacaagagaggatctttacacctatccacttcagcgtaattttggaactctcaattggcaagaacctcatggctcttcaggctgctgcgttggttccatccgctttcaccatcccaaaagagggaaaatctagtgcatccttcaaagattcgagcttgtttggggtttcattctctgagcatgtcaaagctgacttcaactcctctgcattgaggtgcaagagggaatacaaccaaagaaatggcgctgtcagagcccaaacaacagcttcagctccctcagtgacccgggcctcccctgagggcaagaaaaccttgagaaagggcagtgttatagtcaccggtgcctcgtccggattgggtctggccactgccaaggctcttgctgagactggaaaatggcatgtgatcatggcctgcagggacttccttaaggccgaaagagccgccaaatcggctgggatcaccaaagagaactacacgatcatgcacttggaccttgcctcgcttgacagcgtgaggcaattcgttgataatttcaggagatcgggacagccgcttgatgttcttgtctgcaacgctgctgtttatctgccaactgctaaggagcccactttcacagctgaaggatttgagctcagcgttgggactaaccatctcgggcatttcctcctttcaaggctgttgcttgaggacctgaacaaatctgattatccatcaaggcgacacatcatagttggctcaatcacagggaacacaaacaccttggctgggaatgtacctccgaaggccaaccttggtgacttgagaggactggcaggagggctgaacgggctgaacagctcagccatgattgacggtggagattttgatggtgccaaggcctacaaggacagcaaggtgtgcaacatgcttacaatgcaggagttccacaggcgctaccacgaggatacgggaatcacgttcgcatccctatacccaggctgcattgccacaaccggcttgttcagggaacacatcccgctcttcaggttgctcttcccgcctttccagaagtacatcaccaagggctttgtatccgaagaggaagccggaaaaagacttgctcaggttgtgagtgaaccgagcttgacaaagtctggggtttactggagctggaacaaggattcagcatcgttcgagaaccagctgtcccaggaagctagcgatgtcgagaaggcccgtaaagtttgggatgtcagcgagaaacttgttggtttggcctaaatgagcattttggattgtccccaaatgggtccttggaggaagaggatgttcatcgggaagatggcagagttggttcctttttaatcaatcgtggagcttagaactggaggatgagcgattgtaaaccaaattttcatttgtagcagtaggtgtgttagtttggcttggcaataaaacagcttacgtcttcttgcaaagttactcgcagtagcagcaaaataaccaggcaatgaactatggagaacttgagacgatgtgctattctacaatggctgtctgtcatacacatgcatcaccggcatgcgaaattgttcgaaa

SEQ ID NO: 13895 - DNA, 1390 bp, Plantago ovata
actaaggtctctttctcaacaaacatcccatttcaatggctcttcaatctgctgctttgatcccctcttcattcttcaaccacaaagaggtatctttgaaggactctagcctgtttggtgtttcactctcagaccatgtaaaatctgacttcacctcttcttgcctcaaatctaagagagagttctcgtcccgaaagctatgtactgtgagagctcaagcagttactgcagcccctacatacaccccagcctcagtccaaggcaagaaaactctaagaaaaggaaccgtgattgtcaccggagcctcatccggcttggggctggcgaccgcaaagtctctagcggagagcggaaaatggcacgtcattatggcgtgcagggacttcctcaaggctgagaaggctgcgaaatcagtcggcatggataaggaaaactacaccatcatgcatttggaccttgcttcccttgaaagtgtcaggcagtttgtagatagcttcaagcgttcgggaaggcctcttgatgtgctggtttgcaatgcagctgtttatcagccaactgcaagggagccttcgtttacggctgatggattcgagcttagtgttgggactaatcatttgggacatttccttttgtcaagattgttgcttgatgacatgaagcagtctgattatccctccaagaggctcatcatcgtcggctccatcacagggaatacaaacacattggctggaaatgtaccaccaaaggcgaatctcggggacatgagggggctccaaggaggactaagtgctgtaaacagctcggccatgatcgacggtggagattttgacggcgcaaaggcgtacaaggatagcaaagtttgcaatatgctgacaatgcaggagttccacaggcgttaccatgaggacacagggatcacattcgcttctctgtaccctgggtgtatcgccacgacagggctattcagagagcacattcccctattcaggcttcttttcccaccgttccagaggttcatcacaaagggattcgtctcagaggaagaagctggaaagagactcgcacaggttgtgagtgatccaagcttgacaaagtcaggagtgtactggagctggaacaaggactcggcttcattcgagaaccagctgtcgcaagaagcaagtgatgtggaaaaggcacgtaaagtgtgggaagtaagtgagaagctcgtcggtttggcttaaaggatatatgcagtatgtatgatgttgttggccatggcagagttgtggatgagaggaacttcgtgtactttgctaacgttctagtggaagagtagtacgtaataaactgtttcggctgtaaaattaacgttagaatctctttaataaaatctctcgatcctttttct

SEQ ID NO: 13896 - DNA, 1835 bp, Populus trichocarpa
acacacacatcacatataattccaaacaagctcaagctttgcacacttctaagctgagctcttcactccagtcagtactgtatacaaaatctatagtcctaaaaacaaaggatttgaaagcccattttacgaggcacagagtttgctttgcaagcggtaatggctctccaggctgcttctttggtttcctctgcttttgttgtccccaaagagggaaaatctagtgcatctttgaaggagtcaagcttgcttggagtttcactctcagaccatgtcaaagctgactttagctcttctacattgaagtggaagagggaattcaaccaaagagttaggactgtaagagcccaatcaatggccactgctactccagcagtcaacagggcttcttcagacggcaagaaaactcttagacagggatgctgcattgtcactggtgcctcctctggattaggtctagcagcagctaaggctctagctgaaactggaaaatggcacgtaattatggcctgcagagacttccttaaggcagaaagggctgctaaatcagctggcattgccaaagagaactgcaccattatgcatctggaccttgcttcactggacagtgtccgccaatttgtggatacctttaggcgatcaggaagggcacttgatgtgctagtttgcaatgctgctgtttacctgccaactgcaaaagagcctacattcactgctgaaggatttgaacttagtgttggaactaaccatttgggtcatttcctcctttcaagattgttgcttgaggacatgaagaaatctgattacccatcgaaacgtctcataattgttggctcaattacagggaacacaaatacattggctggcaatgttcctcctaaggccaatcttggtgacttgaggggacttgcagggggcttgaatgggctaaacagctcagctatgattgatggtggtgaatttgatggtgccaaagcctataaggatagcaaagtctgcaacatgctcactatgcaagagttccacaggcgtttccatgaagaaactggcattacatttgcttccctttacccaggttgcattgccacaacaggcttgttcagggagcacattcctttgttcaggcttctattccctccattccaaaagtacatcactaagggcttcgtctccgaggaagatgctggaaaaagacttgctcaggttgtgagtgatccaagcttgacaaaatcaggggtctactggagttggaacaaggactcggcttcttttgagaatcagctatctcaagaagctagtgatgcagagaaggctcgtaaagtgtgggaggttagcgagaaactcgttggtttggcctaattgagaaaggctggagagagtttcttgtgtactaatctttgccatgggagaggatgatgttagtgcaaaaaaaaaaaaaaaatactgcgtcctttcgtgagtttggatttggatgatttgcttctgtaaacaattttcacttagtaggagtagatgactctgtatcaatcaattggcactaaaatcactcacccgtactgcaaagttcagatttctctgattaatgctggcaggttcaacacttttaaaccagaaaaagagttttattgcctatttaacagctaaatggaccattttgcaataaataagtggtgtctaactgtctgttcgttgttttgcacttatagaagccaaatggctggaagtgttgttgctggtattttgtcaaggccaatgcaaaatcgttgttgtgcaaaatcacttgttgttgccttgtatacagttttctacccctctcaatccattttccaaatttt

SEQ ID NO: 13897 - DNA, 1509 bp, Manihot esculenta
agacactcttcttcacttcaaaagaagggatcttacagcccagttcagagttctttgctggtgataatggctctccaggctgcttctttggtttcctctggctttgttgttcccaaagaggccaaatccaatgcatctttcaaggactccagtttatttggagtttcactttcagaccatctcaaagctgattttagctcttctgcactgtcgtcccagagggaacccaaccaaagagttggggctgttgtaagagcccagacaatggctacagcaagtccagcagtcaacaggtccgccggcgaaggcaagaaaacccttaggaagggcagtgttgtggtaactggtgcctcttctggactgggtctagccacagctaaggccttagctgaaactggaaaatggcacgtaattatggcctgcagggactttcttaaggcagaaagagctgccaaatctgctggaatttcaaaagaaaactacaccattatgcacttggaccttgcttcccttgaaagtgtccgccaatttgttgataacttcaggcaatcaggaagaccacttgatgttctggtctgcaatgctgctgtttaccagccaaccgccaaggaacctacttttactgcagaaggatttgaacttagtgttggaactaaccatcttggtcacttcctcctttctcgtttgctgcttgatgatctcaagaaatctgattacccatcaaagagactcataattgttggctcaatcactgggaacacaaacaccttggctgggaatgtgcctccaaaggccaaccttggagacatgaggggacttgcaggaggcttgaatgggctaaacagctcttccatgatcgatggcggtgatttcgacggagccaaagcctacaaggacagcaaagtctgcaatatgctcactatgcaagagttcgacaggcgtttccatgaagaaacaggcatcacattcgcttccctttatccaggttgcattgccacaacaggcttgttcagggaacacattcctttgttcaggcttctattccctccgttccaaaaatacatcaccaaaggttttgtctccgaagatgaagccggaaaaaggcttgctcaggtggtgagtgatccgagcttgacaaaatccggtgtatactggagctggaacaaggactctgcttcatttgagaaccagttgtcccaagaagctagtgatgcagacaaggctcgtaaaatatgggagattagcgagaaactcgttggtttggcctaaatgaagaggagcttcaagttctgacaactgatcattgacatggaagaggatgatgttagagcagagctgagtcctttatatgagaagctttgattagttttgaggtgcttgtgtaaacaattttctcttgtagtagatgacatgtttgtaacttgcttgaaaaataaaatcatccaacgttgttgcaagtacaaataaataaatattaatattcgggaagtggaattatttttaaaaact

SEQ ID NO: 13898 - DNA, 1519 bp, Arachis hypogaea
tgatacgtctaagcagtggtatcaacgcagagtacggggattcgtgcactttcaagtacacaagcacttcaacttagattttcttgggtgaggggaacattactgaaataacaataacaaccccataaagaaaagcatatacttttgttttccaaggtttcaatggctctgcaagctgcttctttggttcctgcttctttctcaattcctaaggagggaaagggtagtgtgtctctcagagactccactttgtttggtctttcattgtcagattctttcaaagctgacttcagttcttctgcattaaggtgcaagagggaattccaacaaagcattggtgttgtgagggctgagacagcggcgactgctactccggcggttagcaagtctgctccagaaggcaagaagacattgaggaagggcaatgttgtggtcaccggagcatcttctggactgggactcgccactgccaaggctttggccgagaccggaaagtggcatgtaataatggcctgcagggatttcctaaaagctgcaagggccgcaaaatcagctggcatgtctaaggagaactacagcatcatgcacttggatcttgcctcgctcgacagcgttcgccaatttgtagataacttaaggcgatccgaaatgccgctggatgtgctggtttgcaatgctgctgtttacttgccaactgccaaggagcctagattcactgctgaaggctttgaattaagtgttgggacaaaccatctcggccattttctactagctcgcttattgatggatgacttgaccaaatctgattacccctcgaagcgcttgatcattgtaggctcaatcacagggaacacaaacacactagctggaaatgtacctcccaaggctaacctcggtgacttgaggggacttgctggtggcttgaacggactaaacagctcggccatgatagatggtggagacttcgatggggccaaggcatacaaggacagcaaagtatgcaacatgctaacaatgcaagagttccaccgaagataccatgaggaaaccggaatcacattcgcttccctgtaccccggttgcattgctacaacaggcttgttcagagagcacattccattgttcagaactctgttccctccattccaaaagtacataaccaaaggctatgtctcagaagatgaagctgggaagagacttgctcaggttgtaagtgatccaagcctaacaaaatcaggtgtatattggagctggaacaaggcctcagcttcatttgagaaccagttatctcaggaagcaagtgatgttgagaaggcacgcaaggtttgggagatcagtgagaaactcgttggtttggcctaagtgggaacctccaccatccttagttgattaacaaatcttgtcttggagtaaaattgatgtttccacaagagtgaagatcccatgatggatgatgagttccttagtaaggaacctttttcgttttggcttttcatgtaggagtcaataacttttgtca

SEQ ID NO: 13899 - DNA, 1598 bp, Arachis hypogaea
aagcacttcaacttagattttcttgggtgaggggaacattactgaaataacaaaaacaaccccataaagaaaagcatatacttttgttttccaaggtttcaatggctctgcaagctgcttctttggttcctgcttctttctcaattcctaaggagggaaagggtagtgtgtctctcagagactccactttgtttggtctttcattgtcagattctttcaaagctgacttcagttcttctgcattaaggtgcaagagggaattccaacaaagcattggtgttgtgagggccgagacagcggctactgctactccggcggttagcaagtctgctccagaaggcaagaagacattgaggaagggcaatgttgtggtcaccggagcatcttctggactgggactcgccactgccaaggctttggccgagaccggaaagtggcatgtaataatggcctgcagggatttcctaaaagctgcaagggccgcgaaatcagctggcatgtctaaggagaactacagcatcatgcacttggatcttgcctcgctcgacagcgttcgccaatttgtagataacttaaggcgatccgaaatgccgctggatgtgctggtttgcaatgctgctgtttacttgccaactgccaaggagcctagattcactgctgaaggctttgaattaagtgttgggacaaaccatctcggccattttctactagctcgcttattgatggatgacttgaccaaatctgattacccctcgaagcgcttgatcattgtaggctcaatcacagggaacacaaacacactagctggaaatgtacctcccaaggccaacctcggtgacttgaggggacttgctggtggcttgaacggactaaacagctcggccatgatagatggtggagatttcgatggggccaaggcatacaaggacagcaaagtatgcaacatgctaacaatgcaagagttccaccgaagataccacgaggaaaccggaatcacattcgcttccctgtaccccggttgcattgctacaacaggcttgttcagagagcacattccattgttcagaactctattccctccattccaaaagtacataaccaaaggctatgtctcagaagatgaagctgggaagagacttgctcaggttgtaagtgatccaagcctaacaaaatcaggtgtatattggagctggaacaaggcctcagcttcatttgagaaccagttatctcaggaagcaagtgatgttgagaaggcacgcaaggtttgggagatcagtgagaaactcgttggtttggcctaagtggtggaccctccaccatccttagttgattaacaaatcttgtcttggagtaaaattgatgtttccacaagagtgaagatcccatgatggatgatgagttccttagtaaggaacctttttcgttttggcttttcatgtaggagtcaataacttttgtgaattaagattttgtcaacaaaacatcaaagtgcgggggggtgttaactgcatatcttggacatgcttctgaagtttatcttaaaacatttgtagtaatatcaacttaagaggaaatcaatatagccttagagcctaaat

SEQ ID NO: 13900 - DNA, 1578 bp, Theobroma cacao
aacttctttacggtactaagctcagctttactttggtcagcccatagcagagtttatttaagggtcttaaagaacccagttcaaagtggttgagtagctctagtttcaaagttggtaatggctctacaggctgctgctttggttccagctgctttctctgttcccaaagagggaaagtctagtgcatctttcaaggattcaagtctgtttggagtttcactctcagaccttgtcaaagctgacttcagctcctctgcattaagatgcaagagggaatttaaccaaagaactggagcagtgagggcccagactacagctactgctactccagcaatcagcagatctgcaatggatggaaagaaaactctaagaaagggtagtgttatcatcactggtgcctcctctggattgggtttagccacggctaaggccctggctgaaactgggaaatggcatgttatcatggcctgcagggactttctcaaggctgagagagctgcaaaatctgctggcatgtctaaagaaaactacacaattatgcacttagatcttgcctcgcttgacagtgtccgccaatttgtggacagttacaagcgatcaggcaggcctcttgatgttcttgtttgcaatgctgctgtttaccagccaactgctaaggaaccctcattcactgctgaaggatttgagcttagtgtgggaactaaccatcttggtcacttccttctttcccggttattgcttgatgacctgacgcaatctgattatccattgaagcgtctcattattgttggttctattacaggaaacacgaataccttggctggaaatgtacctccgaaggccaaccttggggatctaaggggacttgcagggggactaaatgggctgaacagcgctaccatgattgatggtggagattttgatggtgccaaggcctacaaggacagcaaagtctgcaatatgctcaccatgcaagaattccataggcgcttccatgaggaaaccggcatcacattcgcttccctttatccaggttgcattgctaccacaggcttgttcagggaacacattcccttgttcagacttctcttccctccattccagaagtacatcaccaagggctttgtctctgaagaggaagctgggaaaagacttgctcaggttgtgagcgatcctagcttgacaaaatctggtgtttactggagctggaacaaggattcggcttcatttgagaaccagttgtctcctgaagcgagtgatcaggagaaagcacgcaaaatatgggagcagagtgagaaacttgttggcttggcctaatttagagccttgaggtgcttgcctctaaaactttgcttgcgggagagctttgatattggcgaaaatccagcccatggatgagtttagattctggatttagatggtgtgctgttgtaaacattcttcttttgtaggtgtaggtgactttgtgagttactgttgacaataaaattactcaccccggttgcaaagctcaagtttactttggcattgtcaatatgaagagccaaaagaataaataattcaaagaactttgaaaca

SEQ ID NO: 13901 - DNA, 1361 bp, Ricinus communis
cttaatatctttttcaggaactcactcttatgcactgcagagttcagcttcactggacacaagagtactactataaacacctcgaggatttttgcaaagtaatagcatggcttcttctttggtttcctctacttttgttgtccttaaagagggaaaatctagtgcatcttttaaggactcaagtttatttggagtttcactctcagaccatctcaaagctgaccatagctcttccgcatttagattcaagagagaacccaaccaaagagttggggcagtgagagctcagacaatggcaacagcaagtccagcagtaaacagggcagccccagaaggcaagaaaactttaagaaagggaagtgtcatagtgactggtgcctcttctggtttgggtctagccacagctaaggcattagctgaaactggaaaatggcacataattatggcctgcagggacttccttaagacagaaagagctgctaaatcagctggcatctctaaggaaaactacaccatcatgcacttagaccttgcttcccttgacagtgtacgccaattcgttgataacttcaagcgatcaggaaggcctcttgatgtgcttgtttgcaatgctgctgtttacctgccaactgctaaagaacctacttttactgctgaaggatttgaacttagtgttggaactaaccatcttggtcacttcctcctttctcggttattgcttgaggatctccagaaatctgattacccatcaaagagactcataattgttggatcaattactgggaacacaaacaccttggctgggaatgtacctcctaaggccaatcttggagacatgaggggacttgcaggaggcttgaacgggctaaacagctcagcaatgattgatggtggcaactttgatggtgccaaagcctacaaggacagcaaagtctgcaacatgcttattatgcaagagtttcacaggcgtttccacgaagaaactggcataacattcgcttccctttatcctggctgcattgccacaactggcttgttcagggagcacattcctttgttcaggactctattccctcctttccaaaagtacattaccaagggctatgtttctgaagatgaagctggaaaaagacttgctcaggttgtcagcgatccgagcttgacaaaatcaggtgtatactggagctggaataaggactcagcttcatttgagaaccagttgtctcaagaagctagtgatgcagataaggctcgtaaagtatgggagattagtgagaaacttgttggtctggcttgattgagaaggcttgatgctcttctctcaactgatctttgccccgggagaggatgatgttagtgca

SEQ ID NO: 13902 - DNA, 2187 bp, Cicer arietinum
ttattattatcacaaatcctataggccatagctactaataatggggtgtatgacacataatgtctcctattggcaatattaaaaattagaaatatcttttctttatgaaatctaaaaatcaaaacctcattggttggttttaaagtacgtggcaggtgcacatactgctaattatcttatcctcttatatatttcactttatatattcattttcaaatatactcatttcatataacaccactatattaattaacattcattcattttcaaatactaagttcattcatatcttattttgcaatggctcttcaagctgcttctttgcttcctgcttctttctccattcctaaagagggtaagggtggtgtttctcttaaggattccaccctttttggtctttcattgtctgaatctttgaaaggtgatttcagctcttctgcattgaggtgcaagagggaattgcgacaaaaggtcggtgctgtgagggcagagacagcagctacagcaactccagcagttaacaaatcttcacaagatggcaagaaaacactgaggaaaggcaatgttgtgatcactggtgcttcttctggattaggccttgccactgctaaggctttggctgagacaggaaaatggcatgtaattatggcttgcagggatttcctcaaagctgcaagagcagcaaaatctgctggaatggctaaggaaaattatactatcatgcacttagacctttcctctcttgacagtgttcaccaatttgttgataacttcaggcgatccggaatgccactcgatgtgcttgttaacaatgctgctgtttacttgccaactgctaaggaacctagattcactgctgaaggctttgaacttagtgttgggacaaatcatttgggacattttcttctctcgcgccttttgcttgaggacttgcagaaatctgattacccttcaaagcgcttgatcattgttggctcaatcacaggtaacacaaacacattggccggaaatgtacctccgaaggctaaccttggtgacttgaggggacttgccggtggcttgaatgggctaaacagttcatccatgatagacggtggagatttcgatggtgcaaaggcgtacaaggacagcaaagtgtgtaatatgctgacaatgcaagagttccacagaagataccatgaggaaactggaatcacatttgcttccctctatcctggttgcattgcaacaacaggcttgtttagggaacacattcccttgttcagaacgctattccctccattccaaaagtacataaccaaaggctatgtctcagaagaagaatcaggaaagagacttgctcaggttgtaagtgatccaagcctaacaaaatctggtgtttactggagctggaacaaagcttctgcttcatttgaaaaccagctatcccaagaggccagtgatgtcgagaaggctcgcaaggtgtgggaggttagtgagaagcttgttggtttggcctaaagtcagagcatccaacattatgcagaggcattgtcatgttgagtgcattaattgttgttttgttagataggagctttttttccctttatgtaggagtcatggatcaataaaatcattcaaccatgtggcaaagtgcttataaagtttctgaaatatctgtgcatagtgactacaaattggctaactaacatgggtcagcatctgaaaattctccaattttattcaagttttgcgttgatactccagcataactgagtgtttggaaccacacccagaaatctatcgacacacctccaacagaaagcgatcgcagtaaagatgcctcgaaacacgagactaccatgcaaacaaacactagttaaagattttgcttaggtaactgtaccggcctaacacagaaaaaaccagaggtgaaggcctatgagagtttattcctttgaaaagtgacttttattatttgaatgcaaatattaccaaaactgagtgcaaaagccaggatgagttttctgtataaaattatatatttcactcttatttttaagcatttaagaaactaatctataacaaaaacaaaggtagtatacattgaatccgaattagctgcagacgcataaacacacagtcactacagtcgcccaaacaccacagtttactccttaaacgtatcatattacactaaaaaaccac

SEQ ID NO: 13903 - DNA, 1373 bp, Cicer arietinum
ttaacattcattcattttcaaatactaagttcattcatatcttattttgcaatggctcttcaagctgcttctttgcttcctgcttctttctccattcctaaagagggtaagggtggtgtttctcttaaggattccaccctttttggtctttcattgtctgaatctttgaaaggtgatttcagctcttctgcattgaggtgcaagagggaattgcgacaaaaggtcggtgctgtgagggcagagacagcagctacagcaactccagcagttaacaaatcttcacaagatggcaagaaaacactgaggaaaggcaatgttgtgatcactggtgcttcttctggattaggccttgccactgctaaggctttggctgagacaggaaaatggcatgtaattatggcttgcagggatttcctcaaagctgcaagagcagcaaaatctgctggaatggctaaggaaaattatactatcatgcacttagacctttcctctcttgacagtgttcaccaatttgttgataacttcaggcgatccggaatgccactcgatgtgcttgttaacaatgctgctgtttacttgccaactgctaaggaacctagattcactgctgaaggctttgaacttagtgttgggacaaatcatttgggacattttcttctctcgcgccttttgcttgaggacttgcagaaatctgattacccttcaaagcgcttgatcattgttggctcaatcacaggtaacacaaacacattggccggaaatgtacctccgaaggctaaccttggtgacttgaggggacttgccggtggcttgaatgggctaaacagttcatccatgatagacggtggagatttcgatggtgcaaaggcgtacaaggacagcaaagtgtgtaatatgctgacaatgcaagagttccacagaagataccatgaggaaactggaatcacatttgcttccctctatcctggttgcattgcaacaacaggcttgtttagggaacacattcccttgttcagaacgctattccctccattccaaaagtacataaccaaaggctatgtctcagaagaagaatcaggaaagagacttgctcaggttgtaagtgatccaagcctaacaaaatctggtgtttactggagctggaacaaagcttctgcttcatttgaaaaccagctatcccaagaggccagtgatgtcgagaaggctcgcaaggtgtgggaggttagtgagaagcttgttggtttggcctaaagtcagagcatccaacattatgcagaggcattgtcatgttgagtgcattaattgttgttttgttagataggagctttttccctttatgtaggagtcatggatcaataaaatcattcaaccat

SEQ ID NO: 13904 - DNA, 1404 bp, Platanus occidentalis
cgtaccctccgcctcgatcttctactcttgctaatggctctccaggcagcctctctccttccctctgctttctctgcccacaaagaaggaaagtccaatgcagctaaggacactggtttctttggggttccactcgcagaacatctcaaatctgacttcaacctcccagtgctaagaacaaagagagaattcagccaaaagaagctatcagttggagccattagagctcagacagcagttacaactccggcaatcaaccgggctgctccagaagggaagaaaaccctgagaaagggaagtgtggtaattaccggagcttcatcaggtttgggtctagcaacagctaaggccttggcagaaacagggaaatggcatgttattatggcctgcagggacttcctcaaggctgagagagctgcaaagtcagctggcatggctaaggagaactacactgtaatgcacctcgatctcgcctcccttgacagtgttcggcagtttgtagataactttaggcgatcagagaggccacttgatgtgctggtctgcaatgcagcagtctacctacccactgccaaggagcccacattcactgctgaaggttttgagctcagtgttgggactaaccacctcggacacttcctcctctctaggttgctgctggatgacctaaagcaatcagattacccatcaaagcgtctcatcatagtgggttcaatcacagggaacacaaacaccttggccggcaatgtgcctccaaaggccaaccttggcgaccttaggggacttgcaggtggcttgaatgggctgaacatctcaaccatgatcgatggaggagacttcgatggagctaaagcttacaaggacagcaaggtctgcaacatgctcacaatgcaggagttccacaggcgtttccacgaggaaactggcattacctttgcttccctctaccctggttgcattgctaccacaggcttgtttagggagcacattcccttgttcaggctcctcttccctcccttccagaagtacatcacaaagggctttgtttcggaagaagaatccggcaaaagacttgcacaggttgttagtgatccaagcttgactaagtcaggtgtctactggagctggaacaaggattccgcctccttcgaaaaccagctatcccaagaagctagtgatgcagagaaggcgcggaaagtgtgggaggtcagtgagaagcttgttggtttggcttgaatgagcacccagagagacgtttctcttgctggcatctcttcgccatgggaggggacgagaaacaatcgggttcagatgagtgcgcttatcatgtatgtggatggtgtggtgttgtatgcaattcccttgtgagagcagaaaattttgaattccattgggacaataaaa

SEQ ID NO: 13905 - DNA, 1300 bp, Utricularia gibba
ggcgggcttcagacaaagtggtaccttactgctcgaaatggctctgcaggctgctgctttgttcccttctgcaacttccattcacaaggagggaaaatgtgttgcttctctcaagagctcgagtatgtttggtgtttcattgtctgattatgttgtgaagaaggacgtgttgatctcatctgcaaacaaaaccaagactggctccaggaacttaccggtgatcaaagcggaggcagtggcaacatcaccaactttcactacagcaccggtgcaggggaagaagactctgaggaaggggactgtgattgttaccggtgcatcatccgggttgggacttgcgacggcaaaatcattggctgaaagtgggaaatggcatgtcatcatggcttgcagagactttctcaaagcagaaaaggcagcgaaatccgttggaatgtcaaaggaaaactataccattattcacttggacctcgcatctctggaaagtgtgaggcaatttgtggataatttcaggcggtcagggcggcctcttgatgttttggtatgcaatgctgctgtctatcagccaactgcaagggagccatcgttcactgctgatggattcgagctcagtgtggggactaaccatttgggccacttccttctctcaagattgctccttgatgacctgaagaattcggactacccctcaaagaggcttattattgtgggttcgatcacagggaatacaaatacattggctggaaatgtacctccaaaggctggccttggtgacttgaggggactccaaggtgggctcaatggaatcaatgtctctgcgatgatcgatggaggagactttgatggtgccaaggcatacaaggacagcaaagtctgcaacatgttgacaatgcaagaatttcacagacgtttccacgatgataccggcattacattcgcatccctctacccgggatgcattgctacaacaggcttgttcagggagcacatccccttgttcagattgcttttccctccattccagaagttcatcaccaagggctttgtgtcagaggaagaatcaggaaaaagattagctcaggttgtgagcgatcccagcttgacaaaatcaggtgtgtactggagctggaacaaggactcagcttcattcgaaaatcagttgtcaaaggaagctagtgatgttgataaggctaagaaactatgggaagttagtgaaaagcttgtaggcttgagtgagtaatcgtgcgatagagcaagaatttcagataaagcagttgcctgctttgagttctaataaaaa

SEQ ID NO: 13906 - DNA, 1428 bp, Tragopogon dubius
ggggatcatcagttccctctcaaacccacttcaaaatttcagtcgacaatggctctccaggccacctctttcaccgttcagaatcttgtaaagacgactgcatctttcaaggattcaaccctcttcggagcttcactttccgaccaccttaaagttgattccagttcatcagcatcaagaaatcacaaggaattcacgagaagaaaagtgttcagaacactagcggtggccaccacgcctcaagcgccggcggtgaaccgtgcagcaccggaggggaagaagacattgagaaaagggagtgttattatcaccggtgcttcatctgggttaggtctagcgacggctaaagctttggcggagaccgggaagtggcatgtgattatggcgtgtcgagattttctcaaagcggaaagagcagcgaaatcggctggaatgtcgaaggagaattacacagtgatgcatttggatcttgcgtctcttgacagtgttcgacaattcgttgataatttcaagcgatccgggagaccactcgatgttctggtctgcaacgcggcggtgtatcaaccgacggcgaaagaacccacctttacagccgacggaatcgagctcagcgttgggaccaatcatcttggtcacttccttctttcaagattgttgcttgatgacatgaaacaatccgattacccatcaaaaagactcataatcgtgggatcaatcaccggaaacacaaacacattggccggaaacgtacctccgaaagcaaatcttggtgacatgagaggtttagcaggcggtttgaacggcttaaacagttccaccatgattgacggcggcgagttcgacggtgcaaaggcgtataaagacagtaaagtttgtaacatgctcacgatgcaagagttccaccggcgataccatgaagaaaccggcatcacattcgcatcgttataccccgggtgcattgccaccaccggtttgttcagagaacacattcctcttttccgattgctgtttcctccattccagaagttcatcaccaaggggtatgtctccgaggaagaatccggcaagcgacttgcacaggtggtgagcgatccaagcttgacgaagtcgggtgtgtactggagctggaacaaggactccgcttcgtttgagaaccagttgtctgaagaagcaagcgatgtgagcaaggctcgtaaggtgtgggagataagcgagaagcttgtggggttggcttgaaatcgggaaaatctccattgatgaagaaaggaaggtctggttgcaaggaagtgtaggaatttcgtgaatttaacaagttttgtgttgtaaatttagtctagtttgaataaagaattcactcaccttcttttagaaaaaagacaaaaaccgtatgtgaagcgataaaacttgtgaaaaaaaaaaaaaaaaagg

SEQ ID NO: 13907 - DNA, 1513 bp, Fagus grandifolia
tacttaggctcagctccactgttgtcacccccaaactatccttagcttgcaagaactaagtacttgaaaacccaattcaaagtggttgaggagctttgctttgcaagtggtaatggctctacacgctgcttcgcttcttccctctgccttctctatcccaaaagagggaaagtccagtgcatcctccaaggactcaagtctgtttggagtttcattctcagaccatctcaaagttgacttcaactcttctggattgaggtgcaagagggaattcaaccaaagggttgggatggttacagctcagacagtgactaccactccatcagtcattacgtctgcaccagatgtgaagaaaactttaagaaagggtagtgttgtggttactggtgcctcctctggattgggtctagccacagctaaggctctagctgaaaccggaaaatggcatgtaattatggcctgcagggatttcctcaagactgaaagagctgctaaatctgctggcattgccaaggaaaattataccataatgcacttggaccttgcctcacttgacagtgtccggcaatttgtagataacttcaagcggtcaggccggccacttgatgtgttagtctgcaatgcagctgtgtatttgccaactgcgaaggagcctacatttactgctgaagggtttgagctaagtgttggcactaaccaccttggtcacttccttctctcacggttgctgctcgatgacttgcagaaatctgattacccatcaaggcgcctcatcattgtcggctcaattactgggaacacaaataccttggctggaaatgtacctcctaaggccaacctcggggacatgaggggacttgccaggggcttaaatgggctaaacagctcagccatgatcgatggaggagactttgatggtgccaaggcctacaaggacagcaaagtctgcaacatgcttaccatgcaagagttccacaggcggtaccacgaggatacaggcattgcatttgcttccctttacccaggttgcattgccacaactggcttgtttagggaacacatccccttgttcaggctcctgttccctccattccagaagtacatcactaagggctacgtctccgaagaggaatctggaaaaagactagctcaggttgtgagtgatccaagcttaacgaaatccggtgtttactggagctggaataagaattcagcttcatttgagaaccagttgtctcaagaagctagtgatgtagagaaggctaagaaggtgtgggaaatcagtgagaaacttgttgggctggcctgatcaagagccttgaggtccttttcaactactctttgccttgggagaggatgatatcagtgagtgtgtccacttgtgagtgtgggtttggacttaggtgctatgttgttgcaaacaattttctcttgtagatgtagatgacttgttacagttgtcaataaaatttcccacaccccattgcaaagtacctcggccgcgaccacgcta

SEQ ID NO: 13908 - DNA, 2079 bp, Trifolium pratense
ctttatgaaatctaaaacacaaattctcattggttggtttgaaaggatgtggcatatgcacatgctgctaattatcttatccacacatatcaagtgtaacactttcactttataaatacattttcaaatctaaatttctaaataacacaatttatcacattcattttcatatcctaaggttcattcttaccttattttgctaagttccaatggcccttcaagctgcttctttgcttcctgcttctttctccattcctaaagagggaaagattggtgttaaggattcaactctttttggtgtttcattgtctgaatctttgaaaggtgactttagctcttctgcattgaggtgcaagagggaattgcgacaaaaagctggtgttgtgagggcagagacagcggctacagctactccatcagttaccaagtcatcacctgatggcaagaaaacattgaggaaaggaaatgttgtgatcactggtgcttcatctggattaggtttggctactgctaaggctttggctgagacaggaaaatggcatgtaattatggcttgcagggatttccttaaagctgcaagagctgcaaaatctgctggaatggctaaggaaagctacacaatcatgcacttagacctttcctctcttgacagtgttcgccaatttgtcgataactttagacgatccgaaatgccactggatgtgcttgttaacaatgctgctgtttacttgccaactgctaaggaacctacattcactgctgatggctttgaacttagtgttgggacaaatcatctcgggcattttcttctttcacgccttttgctcgaggacattggcaaatctgattacccttcaaagcggttgatcattgttggctcaatcacaggtaacacaaacacattggccggaaatgtacctccgaaagctaacctcggtgacctgaggggacttgccggtggcttgaatgggcttaacagttcttccatgatagatggtggagattttgatggtgccaaggcatacaaggacagcaaagtgtgtaacatgctcacaatgcaagagttccatagaagataccatgaggaaactggaatcacatttgcttccctttaccctggttgtattgccacaacaggcttgtttagggagcacattcctttgttcagaactttgttccctccattccaaaagtacataaccaaaggatacgtctcagaagatgaagcaggaaagagactcgctcaggttgtaagtgatccaagcttaaccaaatctggtgtttactggagctggaataaagcttctgcttcatttgaaaaccagctatctcaagaggctagtgatgtagagaaggctcgcaaggtgtgggaggttagtgagaagcttgttggtttggcctaaagtgagagagcctccaacatctttgctgagtaagaggaagaagcattgccattgtcatggaatggaaggaaaatgatgtcccagaagactgaaaatgatatgttgagtgtgttcattgttgttttgttagataggaacttttatttttctttatgtaggagtcaatgtattaataaaatcattcaaccatttggcaaagtgcttataaactctctgaaataactgtgcatagtgaaatttatgttgaatctcatttaagttttccattaattatcatttcagttaactccggcttgtgtgtttgaaactatggtatgcaagcaatcaccatacttcagactcaaaactacgtgcatgtttgaatttccggtgagtttgacaaaatcaagatgagccaccatgatttagagaaagctacattttggagtttcaacaaaattacagtgccatcaatccgtcatgattttgtcaaactaattgcgattccaaacatggtaaccgcgccttgtatcaggatactacttggaaacaaacacatataatggtttagctaagattttgcttcataaaaaggcaattgtgcaggcctaacacaggtaaaaacaggaagggtgcttatgagttatgagagtttgttcctttgaaaatgtgacattcttattatttgaatgcaata

SEQ ID NO: 13909 - DNA, 1490 bp, Trifolium pratense
atactaaggttcatttttaccttattttgctaagttccaatggcccttcaagctgcttctttgcttcctgcttctttctccattcctaaagagggaaagattggtgcatctcttaaggactcaactctttttggtgtttcattgtctgaatctttgaaaggtgactttagctcttctgcattgaggtgcaagagggacttgcgacaaagggtcggtgctgtgagggcagagacagcggctacagctactccatcagttaccaagtcatcacctgatggcaagaaaacattgaggaaaggaaatgttgtgatcactggtgcttcatctggattaggtttggctactgctaaggctttggctgagacaggaaaatggcatgtaattatggcttgcagggatttccttaaagctgcaagagctgcaaaatctgctggaatggctaaggaaaactacacaatcatgcacttagacctttcctctcttgacagtgttcgccaattcgtcgataacttcagacgagctgagatgccactggatgtgcttgttaacaatgctgctgtttacttgccaactgctaaggaacctacattcactgctgatggatttgaacttagcgttgggacaaatcatctcggccattttcttctttcgcgccttttgcttgaggacatgggcaaatctgattacccttcaaagcgtttgatcattgttggctcaatcacaggtaacacaaacacattggccggaaatgtacctccaaaagctaacctcggtgacctgagaggactttctggtggcttgaatgggcttaacagttctgccatgatagatggtggagattttgatggtgccaaggcatacaaagacagcaaagtgtgtaacatgcttacaatgcaagaattccatagaagataccatgaggaaactggaatcacatttgcttccctttaccctggttgcattgccacaacaggtttgtttagggagcacattcctttgttcagaactttgttccctccattccaaaagtacattaccaaaggctacgtctcagaagatgaagcaggaaagagacttgctcaggttgtaagtgatccaagcttaaccaaatctggtgtttactggagctggaataaagcttctgcttcatttgaaaaccagctatctcaagaggccagtgatgtagagaaggctcgcaaggtgtgggaggttagtgagaagcttgttggtttggcctaaagtgagagcctccaacatctttgctgagtaagaggaataggcattgctgccatggaatggaaggaaaatgatgtcccagaagactgaaaatgatatcatgttgagtgtgttaattgttgttttgttagataggaacttattttcttctttatgtaggagtcaatgaatcaataaaatcattcaaccatttgtggcaaagtgcttataaactttctgaattaaccgtgtatagtgaaatttatgttaaatct

SEQ ID NO: 13910 - DNA, 1495 bp, Vitis vinifera
acttctccactgccaactgccactttccatctctccaaatacttgcaagtttgtaacactccagttggaaattgtttgaggggctcttcagtttggtggacatggctatgcaagctgctgctttggttccctccgctttctccatccccaaggaggggaagggcagtgcatctttcaaggaatctggtctttttggagtttcactttcagaccatgtcaaggctgacttcagctcttctgcattgaggaacaagagaaaaccatccgttggagctatcagagcccagaccgcagctacaactccggccatcacccgggctacaccagaagggaaaaaaactctaagaaagggaactgttgtgatcaccggagcctcatctggactgggtctagccacaaccaaggctctggctgaaacagggaaatggcacatcattatggcctgcagggacttcctaaaagccgaaagagctgcaaggtcagccggcctttctaaggaaaactataccgtaatgcacctagaccttgcctcacttgacagtgtccggcaatttgttgataacttcaagcgatcagaacggccccttgatgttctggtctgcaatgctgctgtctaccttccaactgctaaggagcctacattcactgctgatgggtttgagcttagcgttggaactaaccatcttgggcacttccttctcgcccggttgctgcttgatgacttgaagcaatctgattacccatcaaagcgtctcattatcgttggttcaattacagggaacacaaataccttggctggaaatgtgcctccaaaggccaaccttggggacttgaggggaatggcaggaggtctaaatgggctgaacagctcagccatgattgatggtggagcttttgacggtgccaaggcatacaaggacagcaaggtatgcaacatgctcaccatgcaagagttccaccgccgataccacgaggacactggcatcaccttcgcctccctctacccaggttgcattgctacaactggcttgtttagggagcatattcccttgttcaggcttcttttccctccattccagaagttcattaccaagggctatgtctccgaggaagaatctggaaaaagacttgcacaggttgtcagtgagccaagcttgacaaagtcaggtgtgtactggagctggaacaagaactcagcttcatttgagaaccagttgtctcaggaagctagtgatgcagacaaggctcgtaaggtttgggaacttagcgagaaacttgtcggattggcttaaacgaacgccttaaagatgaggttcttctctttgactaaatcttttgccatgggagaggaggatatcactgataatgacctgggtccatttgcaaatgtggagtttaggttcagatgttgtgaatgttgtgagcaaattccttttgtaaaagtagaggacttctgagttaacaaccataaataaaatcgatcaacccttttgca

SEQ ID NO: 13911 - DNA, 1475 bp, Cichorium intybus
cccatatccattttcaagattcaccatcattaattcttctcgaacccacttcgaacttcaagatccgcaatggcgcttcaggcaacaaccactttctccattcacaatcttgtaaagacgaatgcatcgttcaaggattcatccctcttcggagtttcactttccgatcaccgtcaagttgatttcagctcagccgcatcaacaacacgaagcaaggaatttagaagaaaagtgttgagaacgcaagctgtagccaccacgactcaggcgccggcagtgaaccgtgcagcaccggagggaaagaaaacattgagaaaaggaagtgtgatcatcaccggagcttcatctgggttaggtttagccaccgctaaagcgttagcggaaaccgggaagtggcatgtgattatggcgtgtagagattttctcaaagcagaaagagcggcgaagtcagtcggaatgacgaaggagaattacacagtgatgcatttagaccttgcatctctcgatagcgtccgacagttcgttaataacttcaaacaatccggcagaccactcgacgtccttgtctgcaatgccgccgtgtatcaaccaacagctaaagaacccagcttcaccgccgacggaatcgagcttagtgtcgggacaaatcatctgggtcactttcttctttctagactgttgcttgacgacatgaaacaatccgattacccatcaaaacgactcatcatcgttggatccatcaccggaaacacaaacacgttggccggaaatgtaccaccgaaggcaaacttaggtgacatgagaggtttagccggtggtttgaacggcttaaacagttccaccatgattgacggcggcgagttcgacggtgcaaaggcgtataaagatagcaagatctgtaacatgctcaccatgcaagagttccaccggcgattccatgaagaaaccggcatcacatttgcgtcgttatatcccggctgcattgccaccaccggattgttcagggaacacattcctcttttccggttgctgtttcctccattccagaagtacatcacgaaagggtttgtctccgaggaagaatccggcaagcgacttgcacaggttgtgagtgatccaagtttgacgaaatctggtgtgtactggagctggaacaaggattcggcttcttttgagaaccagttgtctgaagaagcaagcgatgtgagcaaggctcgtaaggtgtgggagataagtgagaagcttgtggggttggcttgaattcttcaagacttccattgatgaaggaaggaatgtctggttggaagtgagttgaaggatttggtggaatttaatgagttttgtgatgtaaatttagtgtagtttcaataagggaatcactcaacttcttttgaaaaagaaaatagaaaattataatcgaaatgatgaaacttgtgatatttagttagtgatccgatcgacaccttccttgacaa

SEQ ID NO: 13912 - DNA, 1584 bp, Carica papaya
atctaattgagattcagacactcagcttctgctttaccttcttcagtgctgtactgcgctgcactgtgacaatggctctccaggctgctgctgctgctctggttccctctgctttttccatccccaaggagggaaagtccagtgcatcattcaaggactcaagtctttttggagtttcagtctctgaaaatctcaaatctgacgttaggccttctgcattgatatccaataggaaatttagtcaaagaactagttcagtgagagcccaaacagcggctactacaaccccaggtatcagtaaatctgcattagaaggaaagaaaacactgagaaaaggaagtgttatcatcactggtgcctcttctgggttgggtctagccacggccaaggcactggcagagactggtaaatggcatgttatcatggcctgcagggattttctcaaggctcagagggcggctaaatctgccggcatgaccaaggaaaactacactgtgatgcatttggaccttgcctcactggacagtgtccggcaatttgtccagaactttaggcaatcagggaggcctcttgatgttttggtttgcaatgctgctgtttacttgccaactgctaaggatcctacctttaccgctgaagggtttgaacttagtgttgggacaaaccatctgggtcacttcctactttcaaggttactgcttgatgacttgaaacaatctgattacccttcaaagcgtctaatcattgttggctcaattacagggaacacaaataccttggctgggaatgtacctcctaaggccaaccttggggatttgaggggacttgcaggaggcttaaacgggctaaacagctcagccatgattgatggtggacattttgatggtgccaaggcctacaaggacagcaaagtatgcaacatgctcacaatgcaggagttccacaggcggtatcatgaagaaactggcatcaccttcacatctctttaccctggttgcattgccacaacaggtttgttcagggaacacattcccttgttcaggcttctcttcccgccattccagaagtatatcactaagggatttgtctctgaggaggaatctggcaaaagactagctcaggttgtaagcgatccaagcttgacgaaatccggtgtatattggagctggaataaagattcagcttcctttgagaaccagttgtctcaagaagctagtgatgcagacaaggcaaggaaagtgtgggagctgagcgagaagcttgttgggttggcctaattcagaaagcttatgaggttcttggaatgtgatcttttccaccaacatggattgatatttgctgagggactactgagtccatttgttagtgcaggttttggatttcagatgcctttgtgctggtaaacattgttctatgtaggtgtgcggatgagtttttgaaccaattgacaaataaaatagtcaacctttcacaaaatccaagatgccacaattataaaatatatattctagagaacagaacaaaagccttatgatcattgtatttcataattgccgcagtaaatgaatgattgaaaatgagcag

SEQ ID NO: 13913 - DNA, 1477 bp, Panax ginseng
tcaacgcagagtacatggggactggaagtagtagcttgaaaaatatcttgtgcaaatatcacaaatggctctccacgctgctgctctccttccctctgctttctccatcaacaaagaggtcaagaccattgcatctttcaagaacactagtctatttcaagtttcattctcggacattctcaaaattgacttgggctctacctctttgaggaccaagagggatggcaaccaaagatggaacgctggagttgtaagggcccagacggcagttacgactccgtcaatcaaccgggctgcaactgacgggaagaaaaccttgagaaagggaagtgtgatcatcaccggagcctcctctgggttgggtttggccgcggccaagtctttggcagaaacaggcaagtggcatgtaattatggcctgcagggacttcctcaaggcagaaagagccgcaaaatcagctggcatttccaaggagaattacaccatcatgcatttggaccttgcctcgcttgacagtgttaggcagtttgtggataacttcaggcaatcagcccgaccacttgatgtgcttgtttgcaatgcagctgtgtacttcccaactgccaaggagcctacatattcagcagaagggtttgaactcagtgttgggactaaccatttgggacacttcctcctttctagattgctgcttgatgacttgaacaagtctgattacccatcaaagcgactcattattgttggttccatcacaggcaacaccaacaccttggctggaaatgtacctccaaaggccaaccttggagacatgaggggtcttgcagggggtctgaatgggctcaacagctctgccatgattgatggtggagaatttgatggcgccaaggcttacaaggacagcaaggtctgcaacatgctcaccatgcaagagttccaccgccgttaccacgaggatacagggatcacatttgcttccttgtacccaggctgcattgccacaacaggtttgtttagggagcacatccccttgttcaggacccttttccctccattccagaagtacatcaccaagggctacgtgtctgaagaagaatctgggaggcgacttgcacagatcgtgagtgaaccaagcttgacaaagtcgggagtctactggagctggaacaagaactcagcttcctttgaaaaccagttgtctgaagaagctagtgatgtggagaaggcacgcaaggtatgggaagtcagtgagaaacttgttggtttggcctagataggagatccttaagattatttctggcggctccatctgtactgtgagataggaaatctgggtccttttgtgagtgcacagtttggattcagaaactgggttggtgtaataagcaattttctcttgtaaaaacactgaaattgaaagacactatgaatgacccaaaataagctttgttaaaagactcgagttttaaaattacagaataac

SEQ ID NO: 13914 - DNA, 1623 bp, Trifolium pratense
tgtggcatatgcacatgctgctaattatcttatccacacatatcaagtctaacattttcactttataaatacattttcaaatccaaatttctaaattacaccatttatcacattcattttcatatactaaggttcatttttaccttattttgctaagttccaatggcccttcaagctgcttctttgcttcctgcttctttctccattcctaaagagggaaagattggtgcatctcttaaggactcaactctttttggtgtttcattgtctgaatctttgaaaggtgactttagctcttctgcattgaggtgcaagagggacttgcgacaaaaggtcggtgctgtgagggcagagacagcggctacagccactccatcagttaccaaatcatcacctgatggcaagaaaacattgaggaaaggaaatgttgtgatcactggtgcatcatctggattaggtttggctactgctaaggctttggctgagacaggaaaatggcatgtaattatggcttgcagggatttccttaaagctgcaagagctgcaaaatctgctggaatggctaaggaaaactacacaatcatgcacttagacctttcctctcttgacagtgttcgccaattcgtcgataacttcaggagagccgagatgccacttgatgtgcttgttaacaatgctgctgtttacttgccaactgctaaggaacctacattcactgctgatggatttgaacttagcgttgggacaaatcatctcgggcattttcttctttcgcgccttttgctcgaggacatgggcaaatctgattacccttcaaagcgtttgatcattgttggctcaatcacaggtaacacaaacacattggccggaaatgtacctccaaaagctaacctcggtgacctcaggggactatctggtggcttgaatgggcttaacagttcttccatgatagatggtggcgattttgatggtgccaaggcatacaaagacagcaaagtgtgtaacatgctcacaatgcaagagttccatagaagataccatgaggaaactggaatcacatttgcttccctttaccctggttgcattgccacaacaggcttgtttagggagcacattcctttgttcagaactttgttccctccattccaaaagtacataaccaaaggctacgtctcagaagatgaagcaggaaagagacttgctcaggttgtaagtgatccaagcttaacaaaatctggtgtttactggagctggaataaagcttctgcttcatttgaaaaccagctatctcaagaggccagtgacgtagagaaggcccgcaaggtgtgggaggttagtgagaagcttgttggtttggcctaaagtgagagcctccaacatctttgctgagtaaaaaaggaagaggcattgccactgccatggaatggaaggaaaatgatgtcccagaacagaagactgaaaatgatatcatgttgagtgtgttaattgttgttttgttagataggaacttattttcttctttatgtaggagtcaatgaatcaataaaatcattcaaccatttgtggcaaagtgcttataaactttctgaattaaccgtgtatagtgaaatttatgttaaatct

SEQ ID NO: 13915 - DNA, 1539 bp, Carpinus betulus
cttcagctcagccccattttcgtgaacttgtgagaaaaaggatttgaaaacccagttcaaagtggttgaggagctttgctttgcaagtgacaatggctctccaggctgcttctctggtttcctctgccttcgccatcccaaaagagggaaagtccagtgcttcctccaaggactcaagtctatttggagtttcattctcagaccaccttaaagctgacttcagctcttctggattaaggtgtaagagagaattcaaccacagagttggggctgtcagagctcagacagcagctacaactactccagcagtcaatagggctgcaccagaggggaagaaaactttaaggaagggcagtgtggtgattactggtgcctcctctggacttggtctggccacagctaaagctctagctgaaacaggaaaatgggatgtaattatggcctgcagggatttcctcaaggctgaaagagctgccaagtcagctggcattgccaaggaaaactacaccatcatgcacttagaccttgcctcacttgacagtgtccgtcagtttgttgataacttcaggcggtcaggccgcccgctcgatgtgttagtctgcaatgcagctgtctatttgccaactgctaaggagcctacatttactgctgaagggtttgagcttagtgttggcactaaccacctgggccacttccttctctcacggctgctgcttgaagacttgcagaaatctgactacccgttaaggcgccacatcatcgtcggctcaattacaggaaatacaaataccttggctggaaatgtacctcctaaggccaacctcggggacatgagggggcttgcagggggcttaaatgggctgaacagctcggccatgattgatggtggagcctttgatggtgccaaggcctacaaggacagcaaagtctgcaacatgcttaccatgcaagagttccacaggcgctaccacgaggatacaggcataacatttgcttccctttacccgggctgcattgccacaacaggcttgttcagggagcacatccccttgttcaggatcctcttccctcccttccagaagtacatcactaagggctacgtctccgaagaagaatccgggaaaagacttgctcaggttgtgagtgatccaagcttaacaaaatctggtgtttactggagctggaacaaggattcggcttccttcgaaaaccaattgtctcaagaagcaagtgacacagataaggctcggaaggtgtgggaagtcagtgagaaacttgttggtttggcctaaagttgtctcaagagccttaaggttgtgttgtcaactgatctttgcagtgggagaggatggtatcactgagacttggtccagtcttgagtgtggagcttggactccggcgctgtgttttgtaaacaactctcttgtagatgtcgatgacttcttaaaatcgtcaataaaatcactcacccctgctgcaaagcacaaaatcacccccacaagttgtgatttttttagtgttgcgcctaaattttttaac

SEQ ID NO: 13916 - DNA, 1671 bp, Tropaeolum majus
cggccgggggattattacacacacactctaataaagacacttctttccttcatttttaactcatacaccattacaaatatctcaagggcaaagggttttaggaaaaaactagtccactttcttaattaactgctagtttgatcgagagaaatggctcttcaagctgcttcattggtctcctctgccttttccatccccaaggagggaaaatcgtgttcttctttcaaggattcctgtgtgtttggagtttcactctcggatcttcacaaatctgacttcagcgcttctgcattgcggtgcaagagggaatttacccaaagagctggggtagtgagggcccaaacagtggccactacagcaccggcgaacaacaaggctacagtagatggaaagaagacactaaggaaaggaagtgttgtggttactggtgcatcatcagggttaggtctagccacagccaaagcactagcggaaacagggaaatggcacgtaatcatggcttgcagagactttctaaaggctgaacgagcagccaaatccgctggcatgtcaaaggagaactacacagttatacatttggacctttcgtctttagaaagtgtgcgccaatttgttgataacttcagacggacagaaaggcctcttgatgtgttggtctgtaacgctgctgtctatttgccaacggctaaagaacctacatacacagctgacggctttgaacttagtgttggtacaaaccatttaggtcacttcctcctagccaggttgttgctcgaggatttgaagcaatccgattacccgtcaaagcgtttgatcattgttggatcgattacaggaaacacaaatactttggctgggaatgtacctcctaaggccaaccttggggatttgagagggcttgccggtggcttaaatggcctgaacagctctgccatgatcgacggaggcgaattcgacggtgccaaagcttacaaggacagtaaagtatgcaatatgcttacgatgcaagagttccatagacggtaccatgaggaaaccggtgttacatttgcgtctctttaccctggttgcattgccactactggtttgttcagggaacacattccattgttcaggcttctcttccctccattccaaaagtacatcactaagggctatgtctcagaggaggaatccggcaaaagacttgctcaggttgtgagtgatccaagcttgacgaaatccggtgtctactggagttggaacaaggcctctgcttcatttgagaaccaattgtctcaagaagctagtgatgtagagaaggcaaagaaagtatgggaactcagtgagaagctagtcggtttggcctaattctaatcaaggcttaacgccccctgcccctgtaaacttatgcagacggagagaacgatggtaagcaatattagttaaaggatttgagtgaagttacaggatttgtatggtgttatgtgctgaacattttgctctgtagaagtagatggctttgtgggatataattgataataccattactaagctagtcacttttgtttcaaaatggaagttaacttcccttcatcaaagtgaaaatagtgaacaaatctaaagttgacaacatgttttgccaaaaaatgttaaattttttgtattgatgataggtatttgagcaatcaa

SEQ ID NO: 13917 - DNA, 1423 bp, Pisum sativum
ataacaccaacactttttattacataaaattttcatatagtaatggctcttcaaactgcttctatgcttcctgcttctttctccattcccaaagaggggaagattggtgcgtctctcaaggactcgactctttttggtgtttcatcattgtctgattctttgaaaggtgatttcacctcttctgcattgaggtgtaagagggaattgcgacaaaaagttggtgctgtgagggcggagacagcggctccggccactccagcagttaacaagtcatcatctgaagggaagaagacgttgaggaaaggaaatgttgtgatcactggtgcttcatctggtttaggtctagctactgctaaggctttggctgaatcaggaaaatggcatgtaattatggcttgcagggactacctcaaagctgcaagagctgcaaaatcggctggattggctaaggaaaactacacgattatgcatttagaccttgcgtctcttgacagtgttcgtcaatttgttgataacttcagaagatctgaaatgccattggatgtgcttattaacaatgctgctgtttactttccaactgctaaggaacctagtttcacggcggatggctttgaaattagtgttgggacaaaccatcttgggcattttcttctttcgcgccttttgcttgaggaccttaaaaaatccgattacccttcaaagcgcttgatcattgtcggctcaatcacaggtaacacaaacacattggctggaaatgttccgccgaaggctaacctcggtgacttgagaggacttgctggtggcttgactggacttaacagttcggccatgatagacggtggagattttgatggtgccaaggcatacaaggacagcaaagtctgtaatatgctcacaatgcaagagttccatagaagatatcatgaggaaactggaatcacatttgcttccctttaccctggttgcattgccacaacaggcttgtttagagagcacattcccttgttcagaactctattccctccattccaaaagtacataaccaaaggctacgtctcagaagaagaatcgggaaagagacttgctcaggttgtaagtgatccaagcctaacaaaatctggtgtttactggagctggaataacgcttctgcttcatttgagaaccagctatcacaagaggccagtgatgccgagaaggctcgcaaggtgtgggaggttagtgagaagcttgttggtttggcctaaagtgagagcccccaacatctatgccgagttagagtctgaggcattgccatggaaggaagatgatgccccagaagagtgaaatgatgatatcatgttgagtgcattaattgttgttgtgttagataggaactttttttgtctttatgtaggagttgatgaatcaataaaatcattcaac

SEQ ID NO: 13918 - DNA, 1828 bp, Cajanus cajan
tttcaatgcacaaacttgaaccacatatttgatatttcattacaccccagtggtgacaccacttcaactgactccactacattgcataaccgaaaatcttgtttgtacttttttcttgtaatggctctccaagctgcttctttggttcctgcttctttctcccttcctaaagagggaaagaatggtgtgtctctcaaggactccgctctgttcggtctttcattgtcagaacctatcaaagctgacttcagctcttctgcattgaggtgcaagagggacttacaacaaaaaattggtgctgtgagggccgagacagtggctacaaccactccagcagttaccaaatctacaccagaaggcaagaaaacattgagaaagggcagtgttgtgataactggggcttcctctggattaggccttgccactgctaaggctttggctgagacaggaaaatggcatataataatggcctgcagggatttcctcaaagcttcaagagctgcaaaatctgctggcatggccaaggaaaactacaccatcatgcacttggacctcgcctctctcgacagcgtccgccaattcgttgataacttcagaagatcagacatgccgctggatgtgctggtctgcaatgctgctgtttacttgccaactgccaaggaacctacattcactgctgaaggctttgaacttagtgttgggacaaaccatctggggcattttctccttgcccgtttgttgcttgaggacttgaacaaatctgattacccttcaaagcgcttgatcattgttggttcaatcacagggaacacaaacacattggctggtaatgtacctcccaaagctaaccttggtgacttgaggggacttcagggtggtttgaatgggctaaacagttcagccatgattgatggtggagactttgatggtgccaaggcatacaaggacagcaaagtctgtaatatgctcacaatgcaagaattccacagaagattccacgaggaaactggaatcacattcgcttcgctataccccggatgcattgccacaacaggcttgttcagagagcacattcccttgttcagaactctattccctccattccaaaagtacataaccaaaggctttgtctcagaagatgaagcaggaaagagacttgctcaggttgtgagtgatccaagcctaacaaaatctggtgtttactggagctggaacaaaacatctgcttcatttgaaaaccagttgtcacaggaggctagtgatgcagagaaggctcgtaaggtgtgggagattagtgagaaactcgttggtttggcctaagtgggaggagcctccaacatccatgttgttctagagaccttgcacttgcatggaggaaaatgacgtttaaaaagagtggatagatatatcctatcattttgaatgcgtgaatgtgttttgttagctaggagcttctttgctttgatatcaagactcaataaaatcattcaaccctgtggtatggcgaagttgctcataaactttcttaagtaactgtgcatagtaactacaaatttgtagtgtggggtgttcttcattaaccatcacgggtctgtttctcgagtttctcgagtttttcgttaatagtcatttttaagtgaactccatatcaaatggtttaagatcttgattcatacaagagccattgcactagcaatatgctggaagaaccagataggggcttcatagagcttattcctttggagtagcaagttcattagttgaaaggaaatattaataaaattatgagtaaaaaaggataagtttttcaaatgtaatcatacaaaaa

SEQ ID NO: 13919 - DNA, 1535 bp, Aquilegia formosa
ttcacaccatctcaagttgccagatatcttacaaagataagaagaactcataacagttagctctagctctcacatttgcttgcttgttgccatggctctccaagcatactcagtccttccttctgctatttccattcataaagagggcaagttgagtatgtctctaaaggacactgctttccttggaatatcaatcaatgaccatcttaattctgaattcagttttcctggccttaagagcaagatagaactcagccaaagaaacaaatcagttggggcaatcagagcacaaacagcagctacaactccagcagtaaaccaggccactccacaagggaagaaaacactgagaaaaggcagtgtgataatcactggagcgtcatctggtcttggtctagctacagccaagtctctagctgaatcaggaaagtggcacgtaataatggcttgcagggatttcctaaaggccgaaagagcagccaaatcagctggaatgtccaaggagaactacactatcatgcaccttgatctctcatctcttgatagtgtaaggcagtttgtggataactttaagcgatcagagagaccactcgatgtgctagtatgcaatgcagctgtctaccagccaactgcaaaggagcctagctacactgccgaaggatttgaattgagtgtcggaactaatcacttagggcacttcctactagctcgtttgctcctggatgacctcaagcaatctgactacccatcaaagcgtctgatcattgttggctcaatcacaggaaacacaaataccttggctggaaatgtgcctccaaaggcaaaccttggcgacttgaggggtctggcaggaggcttgagtggattgaatagttcagccatgatcgatggaggggacttcgacggtgccaaggcctacaaggacagcaaagtctgcaacatgctaaccatgcaggagttccacaggcgttaccatgaggagaccggcattacctttgcttccctctaccctggttgcattgctacaacaggcttgtttagggaacacattcccttattcagactcctcttccctcctttccagaagtatatcaccaagggttatgtatcggaagaggagtcgggtaaaagacttgcacaggttgtaagtgatccaagcctgacaaaatcaggtgtatactggagctggaacaaaacctcagcctcattcgagaaccaattatcagaggaagctagtgatgcagaaaaggccaaaaaggtttgggagatgagtgagaagcttgttgggttggcttaaaggagaacttttgccggaggagatattaactgaacagctggctcacatgagcgtagaagtgttgaacatccctacaagcgggattctagttgtatgtgattttcacttgtgacggtaaaagtagattttttttttttttttggaaataaaactaccactcaccaatacagtgttatgtgtcatggaactatacctcataaataattacattaaaaataaactcacctcattttgatcg

SEQ ID NO: 13920 - DNA, 1325 bp, Cirsium arvense
tcatcaattccctctaaaacccccacttcgaatttcagtccatcggcggcaatggctcttcaggcgacctctttctccgttcacaacttgccggtgaagaccgccggatcttccatggattccggcctctttggggcttcacttttagaccaccggaaagttgatttcagttcatcatcttcaagaagcaagatggaatttactcgaagaaaggtgttcaaaacccaagctgtagccaccacaactccggcggtgatctggacagcaccggagggaaagaaaacattaagaaaaggaagcgttatcatcaccggagcttcctccggtctgggtctagcgacggcgaaagctttatcggaaaccggaaaatggcacgtgatcatggcgtgcagagactttctaaaagcagaaagagccgcaaaatccgccggaatgtcaaaagaaaactacacagttatgcatttagacctttcctctttcgacagcgtccgccaattcgtcggaaacttcaaacaatccggcagaccactcgacgttttagtctgcaacgctgccgtataccagccgacggccaaagaacccaccttcaccgccgacggaatagaacttagcgtcggaactaatcatcttggtcactttcttctttcaagattactacttgatgatttgaagcaatctgattacccatcaaagagactgatcatcgtcggatcgatcaccggaaacaccaacactttggccggaaatgtacctccgaaagcgaacttaggggacatgaggggtctcgccggtggtttgaacggactaaacagctccgccatgatcgacggtggagattttgatggtgcaaaagcttataaagatagtaaggtttgtaatatgcttactatgcaggagtttcaccggcgatatcatgaagaaaccggcattacttttgcttcattgtatcccggctgcattgccaccaccggtttgttccgggaacatattccacttttccggctactgtttcctccgtttcagaagttcatcactaaaggatatgtctccgaagaagaatccggcaagagacttgcacaggttgtgagtgatccgagcttgacgaagtctggtgtatactggagctggaacaaggactcggcttcattcgagaaccagttgtctgaagaagcaagtgatgtggccaaggctcgtaaggtgtgggagataagcgagaaacttgtggggttggcttgaattcagttcgccattgatgaagaagaaaggttcatttgcaactaaacgtaaaatttggtgcaattaacaagttttgtgatgtaaattag

SEQ ID NO: 13921 - DNA, 1544 bp, Cucumis melo
tctagatattctcttccaaatgcttaagataatttaagaccatcaattttttgctctctggttgttccctttttgttctaatggctctccaagctgcttctctggtttcccctgctctttctgttcctaaagaggggaaatctagtgtatgcttgaaagattctagtttgtttgggatttcattctcagaccatctcaaatctgaattcagttcatctactttgaggtgtaagagagaattgaaccagcagattggtgcaataagggctcagacaactgctaccgaaagtccagcagttaacaaagctgctccagatgggaagaaaactctaagaaagggtagtgttgtgatcactggagcctcttctgggttgggattagccacagccaaggctttggctgaaactggaaaatggcatgtcattatggcttgtagagactttctcaaggctgaaagagctgctaaatctgcgggcattgccaaggaaaactacactgttatgcatttggaccttgcctcgctcgacagcgttcgccagtttgttgacaacttcaggcagtctggcaggccgcttgatgtgttggtgtgcaatgctgctgtttacctaccaactgctaaagagcctactttcactgctgaaggttttgaacttagtgttggaactaaccatcttggtcatttcctcctttcccgtttgttgttagaggatttgaacaaatctgattacccctcaaaacgtctcatcattgtcggatcgattaccgggaacacaaataccttggccggaaatgtacctcctaaggccaaccttggtgaccttagaggacttgctggaggattaaacggcctaaacagctcttcgatgattgacggtggtgagtttgatggggccaaggcatacaaggacagcaaagtatgcaacatgctcactatgcaagagttccacaggcgatatcacgaggaaaccggcataacatttgcttccctctaccccggatgcatagctacaactggtttgttcagagagcacattcccttgttcagattacttttccctccattccagaagttcatcaccaagggctatgtttcagaagatgaagcaggaaaaagactagctcaggttgtgagtgagccgagcttgacaaaatcaggtgtttattggagctggaacaagaactcggcttcatttgagaaccagttgtctcaggaagcaagtgatgcagagaaagctcggaaagtgtgggacttgagtgagaaacttgttggtttggcttaaaatgtgaagcttgaagttcttataatggtctttcatcgctaaaactgaagctcattgtgagttgcgggagtttgtaactgtgatgttgtgttgtgtaaacaaattttctgttgtaaaagtagttggttgacttgagtttagtcgctaataaaactctcaacgttcccaactttcaggcatcttctcgctatttttttttctatctaaacttgtgcatcaaacatacacccttcataataacagatgaacttcgtcaaaaaaaaa

SEQ ID NO: 13922 - DNA, 1390 bp, Tabernaemontana elegans
aaatttctagcaagcaaaaatctcaggacagagtccacttcagtttcaagaaaaagcactaaccatggctctgcaggctgctgctcttcttccatccacattctctatttccaaggagggcaaaactagtgtatctttcaaagactctagtctgtttggcatttcaatcttcgaccatctcaaatgtgaatgcagctcctcctctttgaaaatcaagaagggtgtgagagcccaggcagtagttacaactccagatgttacccgagcaacaaccgaagggaagaaaaccttaaggaaaggtactgttatcgtcaccggtgcttcttctggactagggctggccacagccaaagctctggctgaatcaggcaaatggcacataatcatggcctgcagggatttcttgaagactgagaggtctgcaaagtcagttggcatgaccaaggagagctatactatcatgcatttagatcttgcttcccttgacagtgtccgccagttcgtggataacttcagacgatctgagcgacctcttgacgtgttggtttgcaatgcagctgtttacttgccaactgctaaagagcctacctttacagctgaagggtttgagctcagtgtggggacaaatcaccttggacacttcctcctttcaagattgctgcttgatgacatgaagcaatctgattacccttcaaagaggcttattattgttggttcgatcacagggaacacaaacactttggctgggaatgtgccaccaaaggccagccttggggacatgaggggtcttgcaggaggactcaatgggcttaacagctcagcaatgattgatggaggagattttgatggtgccaaggcatacaaggacagcaaagtctgcaacatgctcactatgcaagagttccaccgtcgttatcatgacgatactggaattacattctcttccctttatccagggtgcattgcaacaacaggcttgttcagggagcacatcccattgttcaggcttctcttccccccattccagaagtacatcacaaagggctttgtctctgaagaagaagctggaaagagacttgcacaggttgtaagcgatccaagcttgacaaagtcaggtgtctactggagttggaacaaggactcggcttcctttgagaaccaattgtctcaagaagccagtgatgtggaaaaagcccgtaaagtatgggaaatcagcgagaaactagttggtttggcctaaatgaaatcctgattcattttgtctgcggcaaatgcacttcagagttcatgcttgagagttagaatggagatgtcaggggggttgcatctggctgttcacttgtaaaatttgatttggaatgttaataaaaatgccagacccatcttcagt

SEQ ID NO: 13923 - DNA, 1436 bp, Amaranthus tuberculatus
tcacataataataccaataaatggctctacaagctacatcttttcttccttgtgcattgtccatccctaaagagggaaagtcaaatccttgcctcaaggactccggcttctttggggtgtccctttcagactatgttaaggctgacttcagttcatctgctttgaggtgcaagagagaatgcaatgcaacaaggtcaactgtaggaccaatcagagcacaagcctctgcagtggcaacaccaggagtgaccaaatcatcatcagagcaaaagaaaacattaagaaagggcagtgttatagtcaccggtgcatcctccggtctaggactcgcagccgccaaagcattagctgagaccgggaagtggcatgtaatcatggcgtgcagggacttccttaagaccgaaagggcagctaaatcggctggcatggcaaaagagaactataccataatgcatcttgaccttgcttctcttgacagtgtgaggcagtttgtcaacaactttaggcaatcgggaaggccccttgatgtgttggtttgcaatgccgctgtttaccttcctactgctcgggaacctacctacacggctgaagggtttgagctcagtgttggtactaaccatctcggtcatttcttgctctcgaggttgttgctcgaagacttgaataagtccgattatccttctaagagactaatcatagttggatctataacaggtaacacaaacacattggccggaaatgtgcctccaaaagctaacctaggagatatgaggggactagcgggtggcttgaatggcctaaacagctcagccatgatcgatggcggagattttgatggtgctaaagcatacaaagacagcaaagtctgcaacatgctcacaatgcaagaattccatcgtcgctaccatgaagaaacaggcatcacatttgcctctctatacccaggatgcattgctactacagggttgttcagggaacacattcccttgtttaggcttcttttcccgcctttccaaaagttcatcacaaagggctttgtctctgaagacgaggccggaaaaagacttgcccaagttgtgagtgaaccaagtttgacaaaatcaggtgtgtattggagctggaacaaagcttctgcctcgttcgagaatcaactttcacaagaagccagtgatcccgagaaggctaaaaaagtatgggagatcagtgaaaaactagttggtttggcttaatatcttgagaaaatgctatttcatcacatagattagtgcagatgcttaagaaggttgcatccaaatttctcgggtttagctaggcgcgaaatgatcgagaatttgtgcagtttgtaaggaaactattgtttttgtaagtagttttcacttgtttgcaaatcgcaataaaaaactactactcttttctcttggggattgaggtatttt

SEQ ID NO: 13924 - DNA, 1538 bp, Chrysanthemum coronarium
tatatatcagcaccacattattaaggttcatatccaacactctttattagatatttacagtatcccacttcatatcctaagctctaagttccaatggcccttcaagctacctcttctttctccatccacaaagaggcatgtttaaaggagtctagcatttttggagcaccactatcaactcatgttaaagttgacttcacatcctcttcaaaaagcaagaaggaattcagccaaaggggcgcactcagaacccaagcagtggccaccccaactcccactgcaaaccgtgcatcaacggatgggaagaaaactttaagaaagggtacagtcatcataaccggtgcttcatcgggtttaggtctagccacagcaaaatctctagcagaatcagggaaatggcacgtgattatggcatgcagagacttcttaaaggcagaaagagctgcaaaatcatcaggaatgacgaaagagaattattcagtgatgcatttagacctttcatcacttgatagtgttaggcagtttgttgcgaactttaaacaatcgggtcaatcacttgatgtgttggtttgcaatgctgcggtttatttaccaactgctaaagagcctacttacacagctgatggctttgagcttagtgttgggactaatcatcttggtcatttcttgcttgcaagattattgcttgatgacttgaagcagtcggattatccatcaaagagactcatcattgttggctcaatcacaggtaacacaaacactttggctgggaatgtacctccaaaggctaacctaggagacatgagaggtctagcgggtggattaaacggactcaacagctctgctatgatcgacggtggagattttgatggtgcaaaagcatataaagacagcaaggtctgcaatatgcttatgatgcaagaattccaccgtcgttaccacgaagaaactggcatcacatttgcttccttgtaccctggttgtattgcaacaacaggattatttagggaacatattcccctttttaggctcctatttcctccattccaaaagtacatcaccaagggttatgtctccgaggatgaatccggcaagagacttgctcaggttgtgagtgatccaagtttgacaaaatccggagtttactggagttggaacaacaattcggcttcatttgagaaccagttgtccgaagaagctagtgatgtctccaaggctcgtaaagtatgggaggtcagcgagaaactagtcgggttggcttaaacaagaaagatccctgggttggcttaaactagaaagatcccttcttcagttaattaatttgagtgataaatgtgagtttaggacatggctgaaggcaattttctattgtatatttaggttgtttgaataagaagcaataataaaaccactccgtgtttactttcacgttctgtgctatgtctaaatagtaattgaagcatcaacgcataagctagttttgtaaaattgatcttgttaacaaatcaggatttttacaatgaaatattatacattag

SEQ ID NO: 13925 - DNA, 1485 bp, Cucumis sativus
tcaattttttgctctcttgttgttccttctttttcttctaatggctctccaagctgcttcattggtttcccctgctctctctattcctaaagaggggaagtctagtgtatgcttgaaagattctagtttgtttgggatttcattctcagaccatctcaaatctgaattcagttcatctactttgaggtgtaagagagaattgaaccagcaaattggtgcaataagggctcagacaaccgctaccgaaagtccagcagttaacaaagctactccagatgggaagaaaactctcagaaagggtagtgttgtgatcactggagcctcttctgggttgggattagccacagccaaggctttggctgaaactggaaaatggcatgtcattatggcttgtagagactttctcaaggctgaaagagctgctaaatctgcgggcattaccaaggaaaactacactgttatgcatttggaccttgcctcgctagacagcgttcgccagtttgttgacaacttcaggcagtctggcaggccgcttgatgtgctggtgtgcaatgctgctgtttacctaccaactgctaaagagcctactttcactgctgaaggttttgaacttagtgttggaactaaccatcttggtcatttcctcctttcccgtttgttattagaggatttgaacaaatccgattacccctcaaaacggctcatcattgtcggatcaattaccgggaacacaaataccttggctggaaatgtgcctcctaaggccaaccttggtgaccttagaggactcgctggaggactaaacggcctaaacagctcttcaatgatcgacggtggtgagtttgatggggccaaggcatacaaggacagcaaagtatgcaacatgctcactatgcaagagttccacaagcgatatcacgaggaaaccggcataacatttgcttccctctaccccggatgcattgctacaactggtttgttcagagagcacattcccttgttcagaatacttttccctccattccagaagttcatcaccaagggctatgtttcagaagatgaagcaggaaagagactagctcaggttgtgagtgagccgagcttgacaaaatcaggtgtgtattggagctggaacaagaactcggcttcatttgagaaccagttgtctcaggaagcaagtgatgcagagaaagctcggaaagtgtgggagttgagtgagaaacttgttggtttggcttaaaatgtgaagcttgaagttcttatgatggtctttccattgctaaaactgaagctcattgtgagttgcgggagttcgtaactgtgatgttgtgttgtgtaaacaaattttctgttgtaaaagtagttggttgacttgagtttagtcgttaataaaactctcaacgttcccaactttctggcatcttcttgcgtacttctttccatctaaaattgtgcgttacacccttcacctagaacatagaaatg

SEQ ID NO: 13926 - DNA, 1286 bp, Ananas comosus
gcttgattagttatggctcttcaagctgctgctcttcttccttcggctttctccatccgaaaagagggaaagtcgggtgcgtctttgaaggaatctggtcttttcggaatttcgctctcggatcatgtcaactgctcttctggtttaaggattaagaaggaattcaacccacgaaagctatccgttgggtctgttagagccgaagcaatggccacaaccccaacaatcaccaaagccacggtcgaaggaaagaaaacactaagaaagggctgcgtcgtaatcacaggcgcctcctctgggttgggcctggctaccgccaaggctctaggagatacggggaagtggcatatcatcatggcctgcagagacttcttgaaggccgagagagctgcgaaatcggctgggattgcaaaggagaactacactgtcatgcacctcgacctggcctcgcttgatagtgttcgccaatttgttgacaactttaggcgatcgggcaggccccttgatgttcttgtatgcaatgctgctgtctatttgcctactgctagggagcctacttttacagctgatgggtttgagctcagtgttgggactaaccatcttgggcattttctactctcgaggttgatgctcgatgatttgaagcaatcggattatccgtcgaagaggcttatcattgttggctcgataacaggtaacaccaataccttggctggaaatgtacccccaaaagccaacctaggggaccttagaggctttgcggggggattgaatgggctaaactcctcatccatgatcgatggaggggacttcgatggtgcaaaggcttacaaagacagcaaagtctgcaacatgctgacgatgcaagagttccacaggcgttatcacgaagaaacgggcattacatttgcatctctgtaccctgggtgtattgctacgacgggcttgtttagggaacacattcccttgttcaggacccttttcccgcctttccagaagtacatcaccaagggatatgtttccgaagaggaatctggcaagcgacttgctcaggttgtggctgagccgagcttgaccaagtcgggggtatactggagctggaacaaggcttccgcttcctttgagaaccagctgtcagaagaagcaagtaatgttgagaaagctcgtaaagtgtgggagcttagcgagaaactcgtcggtttagcttaaatggctgtgagctttggaggttcgactcattcaacatttcgactagtcttcgagttgtaatttttaattatcgggat

SEQ ID NO: 13927 - DNA, 1530 bp, Citrullus lanatus
acactctctagatattctcctccaaatgcttaaggtgatttagcttctcaaaccatcgattttgtattctctggttgctccttttttgttctaatggctctccaagctgcttctctggtttcccctgctctctctgttcctaaagaggggaaatcttgtgtatgcttgaaggattctagtttttttgggatttcattctccgatcatctcaaatctgaattcacttcatctacattgaggtgtaagatagaattgaaccagcagattggtgcaatcagggctcaaacaactgctaccacaactccagcagtaaacaaagctgccccagatgggaagaaaactctcagaaaaggtagtgttgtggtcactggagcctcttctgggttgggattagccacagccaaggctctggctgaaactggaaaatggcatgtcattatggcttgtagagactttctcaaggctgaaagagctgccaaatctgctggcattgcgaaggaaaactacactgttatgcatttggaccttgcctcgctcgacagtgttcgccagtttgtcgacaacttcaggcagtcaggcaggccacttgatgttcttgtgtgcaatgctgctgtttacctaccaactgctaaagagcctaccttcactgctgaaggttttgaacttagtgttggaactaaccaccttggtcatttcctcctctcccgtttgttgttagaggatttgaacaaatctgattacccctcaagacggctcatcattgtcggatcgataactgggaacacaaataccttggctggaaatgtacctcctaaggccaaccttggagacctcaggggacttgctggtggactaaatggcctaaatagctcgtcgatgatcgacggtggtgagtttgatggtgccaaggcatacaaggacagcaaagtgtgcaacatgctcaccatgcaagagtttcacaggcggtaccacgaggaaaccggcatcacatttgcttccctctaccctggatgcattgctacaactggtttgttcagagagcacattcccttgttcagattacttttccctccattccaaaagtacatcaccaagggctatgtttcagaagaagaagcagggaaaagactggctcaggttgtgagcgagccaagcttgacaaaatcaggtgtgtattggagctggaacaagaactcggcttcgtttgagaatcagttgtctcaagaagcaagtgatgtagagaaagctcgtaaagtgtgggagctgagtgagaaacttgttggtttggcttaaaatataagcctggagtttcttatgatggtctttcattgctgaaacaaaagctcattgtgagttgcgggagtttgtaactgtgatgttttgttttgtgtaaacaaattttctgttataaaagtagttggttgacttgagtttagtcgttaataaaacttgcaaagttccgaacattcgaatcttgttacattattctctatcaattgtattttaaacattacgcccttcgtcaaatga

SEQ ID NO: 13928 - DNA, 1382 bp, Vinca minor
acaaaacacactcaatttagtgccatttccattaacagtaactatggctctgcaagctgctgctgcttcttttcttccatccacattctccatttcaaaggagggcaaaactggtgcatcattgaaagactcaatcctctttggcatttcactctctgatcatctcaagtgtgaattcagctcctcctcctctttgaaaatcaagaagggtgtaagagctgaggcagtacttacaacaccaggtgttacaaattcagcatcagaaaggaagaaaaccttgaggaaaggcactgttatcatcactggtgcttcttcaggactaggtctggccacagctaaagctttggctgaaactggaaaatggcatataattatggcctgcagggatttcctcaagacagaaagggctgcaaaatcagtcgggatgtcgaaagagaactatactataatgcatttagatctttcttcccttgacagtgtccgccagtttgtcgataacttcaaaagatctgagagaccccttgatgttctggtttgcaatgcagctgtttacttgccaactgctaaagaacctacctttacagctgatggatttgagctcagtgttggtactaatcatcttggacattttctcctttcaagattgctgcttgatgacatgaagcaatctgattacccttcaaagagactcatcattgttggttcaatcacagggaacacaaacactttggctggaaatgtacctccaaaggcgaacctaggggacttgaggggtctagcaggagggctaaatgggctaaatagctcagcaatggttgatggagcagaatttgatggtgcaaaggcttataaagacagcaaagtctgcaacatgctcactatgcaagaattccatcgtcgttataacgaggatactggaattacatttgcttccctttatccaggctgcattgcaacaacaggtctttttagggagcacattccattgttcaggactctctttccaccattccagaggttcatcacaaagggattcgtctccgaagaagatgctggaaaaagacttgcacaggttgtaagtgatccaagcttgacaaagtcaggtgtttactggagttggaacaaggactcagcttcttttgagaaccaattgtctgaagaagctagtgatatcgaaaaagcccgtaaagtatgggaagtcagtgagaaacttgttggtttggcctaaatcaaatcctggatcatttttcatgcttgagagttagaattttcaggtgttgggtggttgtaatttggcttttcacttgtaatagtaaatttttctttagaatgttaataaaaatgcaatacccatctttactttaaaacaaaaaaaaaaaaaa

SEQ ID NO: 13929 - DNA, 1540 bp, Gossypium hirsutum
agctcatttaagtgtcttaaataacccatttcaaagttggtaatggctttgcagactgctgctttggttccagctactttcaccctacctaaagagggaaaatcaagtccatctttcaaggattcaactttctttggggtctcactttctgaacatgccaaagctgatttcagctcttctgcattaagatgcaagagggaattcaacccaagaaatggagctgtgagagccgaaacaacagctactgcaactccagcaatcagcagatctgcggtggatggcaagaaaactctaagaaagggtagtgttatcatcaccggtgcctcctccggattgggtttagccactgctaaagccctggctgaaactgggaaatggcatattatcatggcttgcagggactttctcaaggctgaaagagctgcaaagtctgctggcatgtctaaacaaaactacaccatcatgcacttagatctcgcctcattggacagcgtccgccaattcgtcgaccgttacaagcgatcggggaggcctcttgatgtgcttgtttgcaatgctgctgtttaccagccaactgccaaggaaccctctttcacagctgaaggatttgagcttagtgtgggaactaaccatcttggtcactttcttctttcccggttgttgcttgatgacctgaagcagtctgattatccttcaaagcgtctcattatcgttggttcgattacaggaaacacgaataccttggccggaaacgtacctcccaaggccaaccttggggatctaaggggacttgcagggggactaaatgggcttaatagctcaaccatgattgatggtggggaatttgatggtgccaaggcatacaaggatagcaaagtctgcaatatgctcacgatgcaagagttccacaggcggttccatgaggaaagcggcatcacattcgcttccctttacccgggttgcatagctacgacaggcttgttccgggagcacattccgttgttccgactcctcttccctccattccagaagtacatcatcaagggctttgtctccgaagacgaagctggaaaaagactagctcaggttgtgagcgatccgagcttgacaaaatcgggtgtatactggagctggaaccagaattcggcttcattcgagaaccagttgtctcctgaagccagtgatgaggagaaagcacgcaaaatatgggagctcagtgagaaacttgtggggttggcctaaaaatttggaggcatgagatgagatggttgccacttgaatctttgcttatatattgcgcagggtctgatctaattgattgagtgtagagcttggatttggatggtgtgcttgctgttgttaaaatttcttcttttgtagaatgcaggtgattggccttagtcaatatggaatttgtgcaatgcaaaagtaataagttgccaaaattttaagccatttttggagttttcatcattcaagtagaaaatgatacgctttgcatgaatttaaattgtcgtcaaattctgctattaagttgtag

SEQ ID NO: 13930 - DNA, 1646 bp, Gossypium raimondii
cccaccttatatagccacagctcatttaagtgtcttaaataacccatttcaaagttggtaatggctttgcagactgctgctttggttccagctactttcaccctacccaaagagggaaaatcaagtccatctttcaaggattcaactttctttggggtctcactttctgaacatgccaaagctgatttcagctcttctgcattaagatgcaagagggaattcaacccaagaaatggagctgtgagagccgaaacaacagctactgcaactccagcaatcagcagatctgcggtggatggcaagaaaactctaagaaagggtagtgttatcatcaccggtgcctcctccggattgggtttagccactgctaaagccctggctgaaactgggaaatggcatattatcatggcttgcagggactttctcaaggctgaaagagctgcaaagtctgctggcatgtctaaacaaaactacaccatcatgcacttagatctcgcctcattggacagcgtccgccaattcgtcgaccgttacaagcgatcggggaggcctcttgatgtgcttgtttgcaatgctgctgtttaccagccaactgccaaggaaccctctttcacagctgaaggatttgagcttagtgtgggaactaaccatcttggtcactttcttctttcccggttgttgcttgatgacctgaagcagtctgattatccttcaaagcgtctcattatcgttggttcgattacaggaaacacgaataccttggccggaaacgtacctcccaaggccaaccttggggatctaaggggacttgcagggggactaaatgggcttaatagctcaaccatgattgatggtggggaatttgatggtgccaaggcatacaaggatagcaaagtctgcaatatgctcacgatgcaagagttccacaggcggttccatgaggaaagcggcatcacattcgcttccctttacccgggttgcatagctacgacaggcttgttccgggagcacattccgttgttccgactcctcttccctccattccagaagtacatcatcaagggctttgtctccgaagacgaagctggaaaaagactagctcaggttgtgagcgatccgagcttgacaaaatcgggtgtatactggagctggaaccagaattcggcttcattcgagaaccagttgtctcctgaagccagtgatgaggagaaagcacgcaaaatatgggagctcagtgagaaacttgtggggttggcctaaaaatttggaggcatgagatgagatggttgccacttgaatctttgcttatatattgcgcagggtctgatctaattgattgagtgtagagcttggatttggatggtgtgcttgctgttgttaaaatttcttcttttgtagaatgcaggtgattggccttagtcaatatggaatttgtgcaatgcaaaagtaataagttgccaaaattttaagccatttttggagttttcatcattcaagtagaaaatgatacgctttgcatgaatttaaattgtcgtcaaattctgctattaagttgtagattttgtcttatttttatttcttttacttttcaaattttaaaatttcaattgtgactgaaccgatcaattcattgagttaaattttga

SEQ ID NO: 13931 - DNA, 1638 bp, Chrysanthemum coronarium
ttcggtggcatactacaagcattgaatataacttcagattcatgggcatacataaacagtcttggagttatgccagaagagtttaaatttaccacaagaaatcataacacttgcaagtgtatatatatcagcaccacattattaaggttcatatccaacactctttattagatatttacagtatcccacttcatatcctaagctctaagttccaatggcccttcaagctacctcttctttctccatccacaaagaggcatgtttaaaggagtctagcatatttggagcaccactatcaactcatgttaaagttgacttcacatcatcttcaaaaagcaagaaggaattcagccaaaggggcgcgctcagaacccaagcagtagccaccccaactcccactgcaaaccgtgcatcaacggatggaaagaaaactttaagaaagggcacagtcatcataaccggtgcttcatcgggtttaggtctagccacagcaaaatctctagcagaatcagggaaatggcacgtgattatggcatgcagagacttcttaaaggcagaaagagctgcaaaatcatcaggaatgacgaaagagaattattcagtgatgcatttagacctttcttcacttgatagtgttaggcagtttgttgcgaactttaaacaatcgggtcaatcacttgatgtgttggtttgcaatgctgcggtttacttaccaactgctaaagagcctacttacacagctgatgggtttgaacttagtgttgggactaatcatcttggtcatttcttgcttgcaagattgttgcttgatgacttgaagcagtcggattatccatcaaagagactcatcattgttggctcaatcacaggtaacacaaacactttggctgggaatgtacctccaaaggctaacctaggagacatgagaggtctagcgggtggattaagcgggctcaacagctctgctatgatcgacggtggtgattttgatggtgcaaaagcatataaagacagcaaggtctgcaacatgcttatgatgcaagaattccaccgtcgttaccatgaagaaactggcatcacatttgcttccttgtaccctggttgtattgcaacaacaggattatttagggaacatattcccctttttaggctcctatttcctccattccaaaagtacatcaccaagggttatgtctccgaggatgaatccggcaagagacttgctcaggttgtgagtgatccaagtttgacaaaatccggagtttactggagttggaacaacaattcggcttcatttgagaaccagttgtccgaagaagctagtgatgtctccaaggctcgtaaagtatgggaggtcagcgagaaactagtcgggttggcttaaacaagaaagatccctgggttggcttaaactagaaagatcccttcttcagttaattaatttgagtgataaatgtgagtttaggacatggctgaaggcaattttctattgtatatttaggttgtttgaataagaagcaataataaaaccactccgtgtttactttcacgttctgtgctatgtctaaatagtaattgaagcatcaatgcataagcaagttttgtaaaattgatcttgttaacaaatcaggatttttc

SEQ ID NO: 13932 - DNA, 1448 bp, Coffea canephora
aaagataaaaagaagacttttagcacagaataaaaatctcgagttacaaaatttcttttctgctgtgacactaagcaaaaaccaacaagttagtatccaatggctcttcaggctgctgctctcctcccttccactttctccttctccaaagaaggaaaagttggtgcatcgctaaaagactctagtctgtttggcaaatcattgtcagaccaaatcaagtctgacatcagctcctcctcattgaagatcaagagagctgtaagagccgaggcagtcattacagcaactccggccgtcaaccgagcaacagcagaagggaaaaagaccttaagaaagggcactgttgtgataactggagcatcctccggactaggtcttgcaacagccaaagctctggctgaaactggcaaatggcacataatcatggcctgcagagattttcttaaggctgagagagctgcaaagtcggttggcatgaccaaggagaactacacaataatgcatttggatcttggctctctggacagtgttcgccaatttgtcgacaccttcagaagatctggacgctctcttgatgtcttggtctgcaacgctgctgtgtacttgccaactgctaaagagcctacttttacagctgaaggatttgagttgagtgttggggttaaccaccttggacacttcctccttgcaagatcgctgcttgatgacatgaaccagtctgactacccctcaaagagactcattattgttggctcaatcacagggaatactaatacattggctggaaatgtacctccaaaggccagtcttggtgatttgaggggtcttgctggtggtttaaatgggcttaacaccgcatccatgattgatggtggagactttgatggtgccaaggcatacaaggatagcaaagtgtgcaacatgcttactatgcaagagttccaccgccgataccacgaggatacaggcatcacctttgcttccctttacccaggctgcattgcaaccacaggcctattcagggagcacatccccttgttcaggttcctcttccctccattccaaaagtacgtcacaaaaggattcgtatccgaagaagaagctggcaagagacttgcacaggttgtaagtgatccaagtttgacaaaatcaggtgtctactggagctggaacaaggactcagcttctttcgagaaccaattgtctcaagaggccagtgatgtcgaaaaagcccgcaaagtgtgggaaatcagtgagaaacttgttggtttggcataaaaaaatcctcatcattttcttgactaacttcgccgcggcagatgaaattcaagggtgagagactctgagatttagaattgagaagttcggttgttgtaatcaatttcgcattttgtaaaatttgagttaaaatgtcaataaaatcactcaaaccctatctttgagacttc

SEQ ID NO: 13933 - DNA, 1360 bp, Cucurbita pepo
caaatcatccattttgagctctttcttctctgatggctcttcaacctgcttctctggtttcccctgctctttctctgcccaaagaggggaagtctactgtttgcttgaaggattctagtttctttggaatttcagtctcagaccatctcaaatctgaattcagttcatctgcattgaggtgtaagagagaattcaaccaccatgttggtgccattagggctcagacaactgctaccacaactccagcagttaacaaagctgctccagatgggaagaaaactcttagaaagggcagtgttgtgataactggagcttcttctggtttgggtctggccacagccaaggctctggctgaaactggaaaatggcatgtcattatggcttgcagagactttctcaaggctgaaagagctgccaaatctgctggcattaccaaggaaaactacaccgttatgcatttggacctcgcctcgctcgacagcgttcgacagtttgttgacaacttcaggcagtcaggcaggccacttgatgtgttggtgtgcaatgctgctgtttatctcccaactgctaaagagcctaccttcactgctgaaggttttgaacttagtgttgggactaaccatcttggtcacttcctcctctcccgtttgttgttagaggatttgcagaaatctgattacccctcaaagcggctcatcatcgttggatcgataaccgggaacactaataccttggctggaaatgtacctcctaaggccaaccttggagaccttaggggactttctggaggactgaccggcctaaacagctcggccatgatcgatggtggtgagttcgatggtgccaaggcttacaaggacagcaaagtgtgcaacatgcttactatgcaagagttccacaggcggtaccatgaagaaactggcatcacatttgcttccctctacccgggatgcattgctacaactggtttgttcagagagcacattcccttgttcagatggctcttccctccattccaaaagtacatcaccaagggctatgtttcagaagaagaatcaggaaaaagactggctcaggttgtgagcgacccaagcttgacgaagtcgggcgtgtattggagctggaacaagaactcagcttcatttgagaaccagttgtctcaggaagcaagtgatggagagaaggctcgcagagtgtgggagctcagtgagaagcttgttggactggcttaaaatctgaagtccgaagtttcttctgtgatggtctttggtttactacggaatctgtgatgttgttttgtgtaaacaaattttctgctgtaaaacttgagtttagtcgttaataaaaggcctcagttctt

SEQ ID NO: 13934 - DNA, 1481 bp, Primula obconica
gcatcatcttttttacatgtgtgtatatatatccatatgtatcttcattgaaacttcactcagttacttctcaaaagctcaatctttttactcacccaaacagttcttagcttgaattttgtggttatggctctccaggctgctgctcttcttccttctactttctccatccccaaagagggaaggtctggtgctttgaaggactctgcacttttcggaatctcactctctgatcatgttatcagctcttcttctttaagaattaagaaagaattcaacaccagaaagctatccaccggggccattagagcagaaacaatggtcacaacaccctcgatcaacaccgcctcatcggaaaagaaaaaaaccctaagaaagggcagtgtcataattacaggtgcctcttccgggctgggccttgccaccgccaaggccctagcagacacaggcaaatggcatataataatggcctgcagagactttctaaaggccgagagagcagcaaaatctgctggaattaacaaagagaactacaccgtaatgcacctggacctctcctcactggatagtgttcgccaatttgtcgaaaattttaggcgttcggggcgacctctagatgtgctggtttgtaatgctgctgtgtattttccgactgcgactacacctacttttactgctgaagggtttgagcttagtgttgggactaatcatcttgggcattttttgctatcgaggttgttgcttgatgatttgcagcagtcggattatccatctaagcgccttatcattgtcggttctatcacaggtaacacgaataccttggctggaaatatacccccaaaggccaacctcggagatcttcgaggtcttgcagggggattgaatggactaaacacctcagcaatgatcgatggaggagattttgatggtgcaaaagcctacaaagacagcaaagtttgtaacatgcttacgatgcaagagttccataagcgttaccacgaagaaactggcattacttttgcatctctatacccaggctgcattgctacaactggcttgtttagggaacacatacccttgtttaggacccttttcccacctttccaaaagtacatcaccaagggctatgtttccgaagaggaatctggaaatcgcctggctcaggttgtggctgagccgagcttgaccaagtcgggggtgtattggagctggaacaatgcttctgcttcctttgagaaccaactctcagaagaagcaagtgatgctgagaaagctcgtaaagtatgggatctgagtgagaagcttgttggtttggcttaaaatgatttgagctgtaagatgaataatcttcgaagtgaaatttagatatcgggatcttatttgggtttgagctgtttaaatcatttctttttttttgggtgatgaagtagatgaacttgtttctttagttgacaataaaaagattcactttccttgttttt

SEQ ID NO: 13935 - DNA, 1515 bp, Glycine max
gtgaaacattctaaaacaaaggacccagttttacatttttttttgttcctgagttccaatggctcttcaggctgcttccttggtttctgcttctttttctattgctaaagagggaaagtctggtgtatctctcagggacaccacaatgtttggtgtttcattgtcggatactctcaaatctgacttcagctctccctcatcgacttgcaaaagggaattccaacaaaaatttggccctttgagggttcagtcagtggcaacaacaactccaggagtcaccaaggcttcaccagaaggcaagaaaactttgaggaaaggcagtgttattatcactggggcttcctctggattaggcctggccactgctaaggctttggctgagacaggaaagtggcatgtgataatggcctgccgggatttcctcaaagccgaaagggctgcgaaatctgccggcattgctaaggaaaactacactattatgcatttggaccttgcatctcttgatagtgtgaggcaatttgttgataactttaggcaatcaggccggccactggatgtgcttgtttgcaatgctgcggtttacttgccaactgccagggaacctacatatactgctgatggctttgaactcagtgttggaaccaaccatctcgggcatttcctcctttcgcgccttttgcttgacgacttgaacaaatctgactacccttcgaagcggttgatcattgtaggctcaatcacaggaaacaccaacacattggctggaaatgtgccacccaaggctaaccttggtgacatgaggggactagctggaggcttgaatgggctaaacacttcagccatgatagatggaggatcctttgacggcgctaaggcatacaaggacagcaaagtctgcaacatgcttacaatgcaagaattccacagaagataccatgatgaaactgggatcacatttgcttccctttacccaggttgcatcgccacaacaggcttgttcagagagcacattcccttgttcagacttctcttccctccattccaaaagtacataaccaagggctttgtctcagaagatgaatcaggaaagagacttgcacaggttgtgagtgatccaagcctaacaaaatcaggtgtttactggagctggaacgcggcctctgcttcgtttgaaaaccaattgtcccaagaagccagcgatgcagataaggctcgcaaggtttgggagattagtgagaaacttactggtttggcttaagtggtactttggcagcttccaatatccatcttgatttagggacatttgtcatggagttcaataacatctcagaagagtttagaccctcttctgatgagtttgttagattctttttctagctgctaactcctcttggtctgataactactgtcgatgaatccttcacctgaggccaagtgcacatgaactatagagaaataataattgtgcacatgaactatagagaaataataattgtgcacattgactatgatcaa

SEQ ID NO: 13936 - DNA, 1570 bp, Phaseolus vulgaris
gaaccacacattccattaccccactcgtaacaccacttctacttacttcactaccttgtaaaacccaaaatccagtttctactctttattttttcttcaatggccctccaagctgcttctcttgttcctgcttctttctctgtccctaaagagggaaagagttgtgtttctctcaaggactccacactgttcggtctttcattgtcagaacctagcaaagctgacttcagctcctctgcattgaggtgcaagagggaattccagcaaaaaattggtgctgtgagggcggagacagtggctacagcctctccagcagtcaccaagtctacaccagaaggcaagaaaacactgaggaaaggtagtgttgtgataactggggcttcctctggattaggcctggccactgctaaggctttggctgagacaggaaaatggcatataataatggcctgcagggattacctcaaagctgcaagagctgcaaaatctgctggcatggctaaggaaaactacaccatcatgcacttggaccttgcctctcttgacagtgtccgccaatttgttgataacttcagaagatcagaaatgccactagatgtgttggtttgcaatgctgccgtttacttgccaactgctaaggaacctacattcactgctgaaggctttgaacttagtgttggaacaaaccatctaggacatttcctccttgctcgcttgttgcttgaggacttgagaaaatctgattacccttcaaagcgcatgatcattgttggttcaattactgggaacaccaacacattggctggtaatgtacctcccaaggctaaccttggtgacttgaggggacttcagggtggtttgaatgggctaaacagttcagccatgattgatggtggagactttgatggtgccaaggcatacaaggacagcaaagtatgtaatatgctcacaatgcaagaattccacagacgataccacgaggaaactggaatcacgttctcatcgctctaccccggttgcattgccacaaccggcttgttcagagagcacattcccttgttcagaactctattccctccattccagaagtacataaccaaaggctatgtctcggaagatgaagcaggaaagagacttgctcaggttgtgagtgatccaagccttacaaaatctggtgtttactggagctggaataaaacatctgcttcatttgagaaccagttgtcacaggaggccagtgatgttgaaaaggctcgtaaggtgtgggagattagtgagaagctccttggtttggcctaagggggaggaggagcctccaaaatccatgttgttctaaaagaccttgcacttgcatggaggaaaatgtcgtctcaaaagagtggatatcttaccattttgaatgcgttaatgttgttttgttagctaggtacttctttgctttggtgcagggtgttgattgtgaatcaagactcaataaaatcattcacccatgagggtgtggccaacttgctcataacctctgaaataactgtgcatagtaactaaaaatttgtagtctcgggtctttcaa

SEQ ID NO: 13937 - DNA, 1508 bp, Vitis vinifera
attccttcaaaagctcctcattagagcagtacaaaagctccaactaggacagacaattaagtgtcatggctctccaagcagcctcattacttccctcggctgtctccatccacaaagagggcaagtccaatgcttctctaaaggagacgggtttctttgaagtttcagtatcagaccatcttaaggctgaattaagccttggtttgtcaaagaacaaggaactcaaaagaaggaaactacctgttggagttattagagcccaaacagctacaactccagcaatcagccaggcctcaccagaagggaagaaaactttgagaaagggcaatgtaattatcacaggagcttcctctgggttgggtttagccacagccaaggctctagctgaaacagagaaatggcacattattatggcatgcaggaatttcctaaaggctgatagggctgctaaatcagcaggcattgctaaggaaaactacactgttatgcatcttgatcttgcctctcttgaaagtgtccgacaatttgcagacaattttcggcgttcgggtaggccacttgatgtcctggtttgtaatgctgctgtctacttgcccactgctaaggagccaactttcactgctgaagggtttgaacttagtgttggaactaaccatcttggacacttccttctctcaagattgctgcttgatgacctgaagcaaacagattacccatcaaagcggctcatcattgttggctccattacaggaaacacaaacaccttggctggaaatgtgcccccaaaggctaacctgggggatctaaggggacttgctggaggattgaatgggataaacggctcacccatgatagatggtggtgagtttgatggtgccaaggcctacaaagacagcaaagtttgcaacatgctcaccatgcaagagttccacagacgctaccatgaggagacagggataacctttgcttccctctaccctggttgcattgctacaacaggcttgttcagggagcacattcccttgttcaggcttctcttcccaccatttcagaagtatattaccaaaggatatgtttcagaagaggaagctgggaaaagacttgcacaggttgttaccgatccaagcctgacaaagtcaggagtttactggagctggaacaagaactccgcctcatttcaaaaccagctgtcacaagaagccagtgatgcagagaaggcacgtaaggtatgggaaatcagtgagaagcttgttggattggcttaatggaggatcctgagacagctgttgctcattgatgaatctctctcattgggacaccatgtcacactctagcatagagaaaaagagaattatggggaccaggagaactttaacatgagatccttacttcaagatgtggtttgaacctggaacaataatcctccattcaattttcactagggtatgttttcttagatacaacttaagatggttctcatatcaggaaatagagatctgcttgcaaaa

SEQ ID NO: 13938 - DNA, 1604 bp, Glycine max
aaccaatttagtgaaacattctaaaacaaaggacccagttttacatttttttttgttcctgagttccaatggctcttcaggctgcttccttggtttctgcttctttttctattgctaaagagggaaagtctggtgtatctctcagggacaccacaatgtttggtgtttcattgtcggatactctcaaatctgacttcagctctccctcatcgacttgcaaaagggaattccaacaaaaatttggccctttgagggttcagtcagtggcaacaacaactccaggagtcaccaaggcttcaccagaaggcaagaaaactttgaggaaaggcagtgttattatcactggggcttcctctggattaggcctggccactgctaaggctttggctgagacaggaaagtggcatgtgataatggcctgccgggatttcctcaaagccgaaagggctgcgaaatctgccggcattgctaaggaaaactacactattatgcatttggaccttgcatctcttgatagtgtgaggcaatttgttgataactttaggcaatcaggccggccactggatgtgcttgtttgcaatgctgcggtttacttgccaactgccagggaacctacatatactgctgatggctttgaactcagtgttggaaccaaccatctcgggcatttcctcctttcgcgccttttgcttgacgacttgaacaaatctgactacccttcgaagcggttgatcattgtaggctcaatcacaggaaacaccaacacattggctggaaatgtgccacccaaggctaaccttggtgacatgaggggactagctggaggcttgaatgggctaaacacttcagccatgatagatggaggatcctttgacggcgctaaggcatacaaggacagcaaagtctgcaacatgcttacaatgcaagaattccacagaagataccatgatgaaactgggatcacatttgcttccctttacccaggttgcatcgccacaacaggcttgttcagagagcacattcccttgttcagacttctcttccctccattccaaaagtacataaccaagggctttgtctcagaagatgaatcaggaaagagacttgcacaggttgtgagtgatccaagcctaacaaaatcaggtgtttactggagctggaacgcggcctctgcttcgtttgaaaaccaattgtcccaagaagccagcgatgcagataaggctcgcaaggtttgggagattagtgagaaacttactggtttggcttaagtggtactttggcagcttccaatatccatcttgatttagggacatttgtcatggagttcaataacatctcagaagagtttagaccctcttctgatgagtttgttagattctttttctagctgctaactcctcttggtctgataactactgtcgatgaatccttcacctgaggccaagtgcacatgaactatagagaaataataattgtgcacatgaactatagagaaataataattgtgcacattgactatgatcaatgccattgcctatcttatgttaatagtcatttatgtgaactccagagtgaattggctataatttaaccataatttaatt

SEQ ID NO: 13939 - DNA, 1483 bp, Chelidonium majus
acacgacgacccacaaaccaacttacttcaatcaccccaacttcatatcttttcaagaacccaagtttgagtacactctcaatccataaaacaatggctcttcaagcagcttcaattcttccatctggtctttccatccacaaagagggcaaatgcaaagagactagtttctatggtgtttctttctctgaccatctcaagtctgaccacttcaatcctctagtcataaggaacaagagggagtcgaagaaccaaaggaacttctcagctggaatcatcagagctcagacagcagcaacaagttcaggagtcaaagaagctacaccaggaaagaaaacactaagaaaaggatgtgtgataataactggagcttcatctgggctgggtctagccacagccaaatctctagctgatacaggaaaatggcacataataatggcttgcagggattttttgaaggccgaaagagcagctaagtcagtaggcatggagaaggagaattacactgttatgcacctcgacctctcctctcttgatagtgtcaggcagtttgtagataactttagacggtcggataggccgcttgatgtactggtgtgtaatgcagctgtttaccaacctactgccaaggaaccaactttcactgcagatggatttgaacttagtgtgggtaccaatcaccttggacactttctactcgcgcggttactcctcgatgatttgaacaaatctgattacccgtccagacgtctcatcattgtcggctccataacagggaacacaaataccttggctggaaatgttccaccaaaggcgaaccttggtgacctaaggggactggcaagaggattgaatgggctgaacagttcagttatgatcgatggaggggaatttgatggtgccaaggcctacaaagacagcaaagtatgcaacatgctcaccatgcaagaattccacaagcgttaccatgaagagactggaattacctttgcttccctctacccaggttgcattgccacaactggcttatttagggagcacattccattgttcagactcctcttccctcccttccagaagtacatcaccaagggttatgtctctgaagaagaagctggtaaaagacttgcacaggttgtaggtgaaccaagcttgacaaaatcaggtgtttactggagctggaataagacatcagccagtttcgagaaccagttatccgaagaagctagtgacgcagagaaggcacgaaaactgtgggaggtcagcgaaaagcttgtgggtttggcctaaaacagctcattcaaggaacttgaagtagtcttagttgaaatgtaatggaagtagagacagtaggatgttggtgggtctgttttcggatgcaattttctcttgtaaaataagaaaatttttgagttcctcaagactacaaaaggatcattaatccctcttaaatctgtagctgcctgctatgtttaatgaatct

SEQ ID NO: 13940 - DNA, 1571 bp, Humulus lupulus
tatccaaaatctgctttataaccattttctgcgagatatctttcaatgtcacactatatataaactgaactttggttagttttcagagacagtaagctcacctcacttaaacaattgaatcagtatcagaagttgttttgagtacccttaattagtgagaatggcacttcaggctgcttctttggttccctctgctttctctgttcccaaagagggaaaaactagtgcttctttcaaggactcaagcctgtttggagtttctctagaccatttcaaagctgaaatcagctcttgtgctcttcggtgcaagagaacagggccagtgaaagctcagacaacggccaccacaactccgtcagtggcaaagtcatcctcagagggaaagaaaactctaagaaagggaagtgtcatagtcacaggggcctcctctggattgggtctagccacagccaaggctcttgctgagactggaaaatggcatgtgatcatggcctgcagggactttctcaagactgaaagagcagctaaggctgcgggcattaacaaagaaaactacagcatcatacatttggacctcgcttccctcgacagcgtccgccaattcgtggataacttccgcctgtccgggcgaccactagatgttttggtctgcaatgctgccgtttatcagccaacagctaaggagccttcgtttaccgctgaagggtttgaactaagtgttgggactaaccatcttggccactttctcctcgctaggttgcttcttgaggacttgaacaaatctgattacccttcaaagcgtctcatcattgttggctccataacagggaacacaaacactttggccggaaatgtacctcctaaggccaacttaggtgatttgagggggcttgctggtggactaaatgggctaaacacgtcatccatgatcgacggtggaagctttgatggcgccaaggcttacaaagacagcaaagtctgcaacatgttgatcatgcaggaattccacaggcgcttccatgaggaaacagggatcacgttttcttccctttatcctggctgcattgccacaaccggcttgttcagagagcacattcccttgttcaagcttctcttccctccattccaaaagtacattaccaagggctttgtgtcagaagaggatgctggcaaaagacttgctcaggttgtgagcgacccgagcttgacaaagtcaggagtttactggagctggaataaggcctcagcttcgttcgagaaccaattgtcagaggaagctagtgatgctgagaaggctcgtaaagtgtgggaaatcagtgagaagcttgtgggtttggccgaataaattaccaacttgagtttgtcaactgatcttttgtgtccccaaaatatgagatggctcttttcattagcgtgcgggtttggagaatttaggaaagctttgtttgctgtagagaaaattctcttgtagatgagttggggtgtatgtaaccagttttaataaaaaaaacacactcagcgttgttgcaaagtacatttcaatttaatataaccatcaaggcctcggagag

SEQ ID NO: 13941 - DNA, 1434 bp, Platanus occidentalis
tctttatctaaacaacccaaaagtttttaaccgagtacccacaccttctgctttaatttgctcctcctggcaatggctctccaggcagcctctctccttccctctgctctctccatccacaaagaggggaagaacaatgcatctcttaaggacacgggtttctatggagtttcactctccgaccatctcaaatatgacttcaacccagtgataagaacaaagagggaattcagccagaagaagctgtctattgcagtcagagctgaagcagcagttacaactccggcaatcaaccaggccacaccagaagcaaagaaaaccctgaggaagggaagtgtggtaattactggagcctcatcaggtttgggtctagccacagccaaggctttagcagaaacagggaaatggcacattattatggcctgcagggacttccttaaggccgagagagcagcaaagtcggttggcattgctaaggagaactacaccgttatgcacctcgaccttgcctccctcgacagtgtccggcaatttgtagataacttcaagcgatcagggaggccacttgatgtgctggtctgcaatgcagccgtttacctacccactgcaaaggagcccacatacactgcggagggatttgagctgagtgttggaactaaccaccttggacacttcctcctcgctcggttgctgctggatgacctgaagcaatcagattacccttcaaagcgtctcatcattgtgggttcaattacagggaacacaaacaccttggccggaaatgtgcctccgaaggcgaacctaggggaccttaggggacttgttggaggcttgaatgggctgaacacctcaaccatgatcgatggaggagaatttgatggggccaaggcctacaaggacagcaaggtctgcaacatgctcaccatgcaggagttccacaggcgctttcacgaggagaccagcattaccttcgcctccctctaccctggttgcattgctaccacaggcttgtttagagaacacattcccttgttcagactcctcttccctcccttccagaagtacatcacaaagggctatgtctctgaagaagaagcaggcaaaagacttgcacaggttgtgagcgaaccaagcctgaccaagtcgggtgtatactggagctggaataagaactcagcttcctttgagaaccagttgtcccaagaagctagtgatgcagagaaggcacgtaagttgtgggaggtcagtgagaagcttgttggtttggcttgaatgagaacccagaaacaggtttcctcctgccgatacatccttctcttgagaggggagttttcgaaaagtttgagtccagaggaatgtggatagtgtgctgttataagcaattttctcttgtaaaatttaaaaagttgaattgtttgagacaataaaactact

SEQ ID NO: 13942 - DNA, 1275 bp, Sesamum indicum
cccctctgcatatccaattcacaaagagggaaaatccggtgcatgtttgaaggattccagtctttttggagtttcactctcagaccatgttaaggctgactttacttctgctgcattgaaatccaagagagaatttggctcgaggaagttaccggccgttagagtagaggcggtggcaacgtctccaactttcactccggccacggtccaagggaagaaaactttgaggaaaggcagtgtgatcatcaccggagcctcctccggcttaggcctggcgacggctaaagccttggcggagagcgggaaatggcatgtaattatggcctgcagggacttcctcaaggctgagagagcagcaaaatctgttgggatggccaaggaaaattataccatcatgcatttggaccttgcttcacttgatagtgtgaggcagtttgtcgataacttcaagcgatctggccgacccctcgacgtcttggtttgtaatgcagcagtctaccaaccgactgccagggaaccttcgtatacagctgatgggtttgagcttagtgttgggactaaccatcttggccacttccttctttcaagattgctgcttgatgacttgaagcagtctgattacccgtcgaagaggctcataatcgtcggctcaatcacagggaatacaaataccttggctggaaatgtacctccaaaggcaaatcttggggacttgaggggactccaaggaggactgaatgggctgaacagctcttccatgatagacggcgcagactttgatggtgccaaggcatacaaggatagcaaggtctgcaacatgctgaccatgcaagaatttcaccgacgttaccatgaggatactggcatcacatttgcttccttataccccggctgcatagccacgaccgggttgttcagggagcacattccacttttccggctgcttttccctccattccaaaagttcatcacaaagggctttgtttcagaggaagaggctggaaaaagacttgcacaggttgtgagtgacccaagcttgacaaagtcaggtgtgtactggagctggaacaaggactcagcttcatttgagaaccagttgtctgaggaagccagtgatgccgataaagcacgtaaagtgtgggaaattagtgagaagctcgttggtttgcgtgactaagctaaggatttttggattgaggaaatcttttggtgctaaacatcggtgaagaaacaaaatttctgtaaaattcttgttagaatcataataaatcactc

SEQ ID NO: 13943 - DNA, 1538 bp, Glycine max
ttcattaccgccgtgataacacactaacaccaccacttcatcaactttacttgacaacaatattgtaaaactcaaaatctagtttcatactttttttcttcttcttgaaatggctctccaggctgcttctcttgttcctgcttctttctcggttcttaaagagggaaagagtggtgtgtctctcaaggactccaccttgttcggtctttcattttcagaacctatcaaagctaacttcagctcttctgcattgaggtgcaagagggaattcgaacaaaagctctgtgctgtgagggccgaaacagtggctacagcctctccagcagttaccaagtctacaccagaagggaagaaaacattgaggaagggcagtgttgtgataactggggcttcatctggactaggcctggccactgctaaggctttggctgagacgggaaaatggcatgtaataatggcctgcagggattacctcaaagctgcaagagctgcaaaatccgctggcatggctaaggaaaactacaccatcatgcacttggaccttgcctcgctcgacagtgtccgccaatttgttgataacttcagaagatcggaaatgccgttagatgtgctggtttgcaatgctgctgtttacttgccaactgctaaggaacctaccttcactgctgagggctttgaacttagtgttgggacaaatcatctggggcatttcctcctctcgcgcctgttgcttgaggacttggaaaaatccgattacccttcaaagcgcttgatcatcgttggttcaataacagggaacacaaacacattggctggtaatgtacctcccaaggctaaccttggtgacttgaggggacttcagggtggtttgaatgggctaaacagctcagccatgattgatggtggagacttcgatggtgccaaggcgtacaaggacagcaaagtctgcaatatgctcacaatgcaagaattccacagacgattccatgaggaaactggaatcacatttgcttccctttaccccggttgcattgccacaacaggcctgttcagagagcacattcccttgttcagaactctgttccctccattccagaagtacataaccaaaggctatgtctcagaagatgaagcaggaaagagacttgctcaggttgtaagtgatccaagcctaacaaaatctggtgtttactggagctggaacaaagcatcagcttcgtttgaaaaccagttgtctcaggaggccagtgatacagagaaggctcgtaagatctgggagattagtgagaaacttgttggttttgcctaagtgggaggagcctccaacatcccatgttgttctagagaccttgcacttgcatggaggaagaaaatgatgtctcaaaagagtggatagataacatcctatcattttgaatgcattgatgttgttttgttagctaggagcttctttgctttgatgtaaggtgtcaatggctttttgtgaatcaagactcaataaaatcattcagccatgtgggtgtggtgaagttgctcat

SEQ ID NO: 13944 - DNA, 1609 bp, Cichorium intybus
agttgaagtgccaacgtggcactctttctccaataaatccttatcgtttccccaattcgaacgaagacattactgttgactgttgtacattgtggttaaatataagtacgtttttagtagcaagaaataagatcttggcttatccgctgattctccatggcgcttcgagcagcttctcttcttccttctgcaatttccgttcacaaggaggggaagttgaattcttctctcaaggagagttcattcaatggagctttcgtttcgaaaaatgtcaaatccgatttcagttcacttgtaatcggaacaaaggaccttagaaggaagtcatcatttggacccattcgagctcaaacggcaaccgtggctccatccgttaacgacgccgtgcccgacggcaaaaaaacactcagaaaaggcaacgtgataattaccggagcgtcatctggtctaggtctagccaccgcaaaagcgttagctgacaccgagaaatggcacataatcatggcttgccggaacttcctgaaagctgaaaaggccgctaaatcggtcggcattaccaaagaaaactacaccgtcatgcacctcgacctttcctccctcgatagcgtccgccaatttgttgacacatttaggcgctctggtcgacccctcgatgcccttgtctgcaacgccgccatctatttgccgacggctaaagaacccacttacaccgccgaaggattcgaactcagcgtcgggactaaccatctcggtcattttctcctctcacggttactgctcgatgaccttaagaaatccgatttcccccaaaagcgtctcatcatcgttggctccataacaggaaacacgaacactttggccggaaacgtgccaccaaaggctaacctaggggacctgagaggactagccggcggcttaaacgggctaaacagttccgccatgattgacggcggagagttcgatggtgctaaagcttacaaagatagcaaagtctgcaatatgctcacgatgcaagagttccacagacggtaccatgaagaaaccggagtcactttttcgtcactgtaccccggttgtattgccaccaccggtttattccgggaacacatcccgttgtttcgacttttattcccgccttttcagaagtacattactaaagggtatgtatcggaagaggaagcaggaaaaagactggcccaggttgtaagtgattcgagcttaacgaaatcgggtgtttactggagttggaacaagaactctgcttcatttgaaaaccagctctcgcaagaagccagtgatgaggagaaagctcggaagctgtgggaggttagtgaaaagctacttggtttggcttagattcaacgacaagaacaaagttaatggtcaaactcaagaatagtcaagtttcatggtatgaatgtgtttgttttgttaaatatggaaaacgtattttgtaaaattttggcgcacatttagctttttcggagtataatggatccaaaaggagaactacaaccaaattggttagtttgattatggttaaattaatatcaatgtaaagatttggttcacgacacttgttatatcgtataaataatacttttgtcta

SEQ ID NO: 13945 - DNA, 1679 bp, Cichorium intybus
agttgaagtgccaacgtggcactctttctccaataaatccttatcgtttccccaattcgaacgaagacattactgttgactgttgtacattgtggttaaatataagtacgtttttagtagcaagaaataagatcttggcttatccgctgattctccatggcgcttcgagcagcttctcttcttccatctgcaatttccgttcacaaggaggggaagttgaattcttctctcaaggagagttcattcaatggagctttcgtttcaaaaaatgtcaaatccgatttcagttcgcttgtaattggaacaaaggagcttagaaggaagtcgtcgtttggacccattcgagctcaaacggcaaccgtggctccatccgtcaatgacgccgtgcccgacggcaagaaaacactcagaaaaggcaacgtgataattaccggagcctcatctggtctaggtctagccaccgcaaaagctttagctgacaccgagaaatggcacataatcatggcttgccggaacttcctgaaagctgaaaaggccgctaaatcggtcggcattaccaaagaaaactacaccgtcatgcacctcgacctttcttccctcgatagcgtccgccaatttgttgacacatttaggcgctccggtcgacctctcgacgcccttgtctgcaacgccgccatctatttaccgacggctaaagaacccacttacaccgccgaaggattcgagcttagcgtcgggactaaccatctcggccattttctcctctcaaggttactgctcgacgaccttaagaaatccgatttcccccaaaagcgtctcattatcgttggctccataacaggaaacacgaacactttggccggaaacgtgccaccgaaggctaacctaggggacctgagagggctagccggcggcttaaacgggctaaacagttctgccatgattgacggcggagagttcgatggtgctaaagcttacaaagatagcaaagtctgcaatatgctcacgatgcaagagttccacagacggtaccatgaagaaaccggagttactttttcgtcgctgtaccccggttgtattgctaccaccggtttattccgggaacacatcccgttgtttcgacttttattcccgccttttcagaagtacattactaaagggtatgtatccgaagaggaagcaggaaaaagactggcccaggttgtaaatgattcgagcttaacgaaatcgggtgtttactggagttggaacaagaactctgcttcatttgaaaaccagctctcgcaagaagccagtgatgaggagaaagctcggaagctgtgggaggttagtgaaaagctagttggtttggcttagattcaacgacaataagaaagtcaatggtcaaagtcaacagtagtttcatggtatgaatgtgtttgttttgttaaatatggaaaacgtattttgtaaaattttggcgcacatttagctttgtgggagtataatggatccaaaaggagaactaaaaccgaattggttagtttgattatggttaaattaatatcaatgtaaagatttggttcacgactcttgttatatcgtataaataatacttcttgtctagaataatgcacttgtcatgtatattaaatggggtgtttaaaatttataataaaatatatatgtgaggggtaaac

SEQ ID NO: 13946 - DNA, 1674 bp, Glycine max
gaaccacacatttttcattaccgccgtgataacacactaacaccaccacttcatcaactttacttgacaacaatattgtaaaactcaaaatctagtttcatactttttttcttcttcttgaaatggctctccaggctgcttctcttgttcctgcttctttctcggttcttaaagagggaaagagtggtgtgtctctcaaggactccaccttgttcggtctttcattttcagaacctatcaaagctaacttcagctcttctgcattgaggtgcaagagggaattcgaacaaaagctctgtgctgtgagggccgaaacagtggctacagcctctccagcagttaccaagtctacaccagaagggaagaaaacattgaggaagggcagtgttgtgataactggggcttcatctggactaggcctggccactgctaaggctttggctgagacgggaaaatggcatgtaataatggcctgcagggattacctcaaagctgcaagagctgcaaaatccgctggcatggctaaggaaaactacaccatcatgcacttggaccttgcctcgctcgacagtgtccgccaatttgttgataacttcagaagatcggaaatgccgttagatgtgctggtttgcaatgctgctgtttacttgccaactgctaaggaacctaccttcactgctgagggctttgaacttagtgttgggacaaatcatctggggcatttcctcctctcgcgcctgttgcttgaggacttggaaaaatccgattacccttcaaagcgcttgatcatcgttggttcaataacagggaacacaaacacattggctggtaatgtacctcccaaggctaaccttggtgacttgaggggacttcagggtggtttgaatgggctaaacagctcagccatgattgatggtggagacttcgatggtgccaaggcgtacaaggacagcaaagtctgcaatatgctcacaatgcaagaattccacagacgattccatgaggaaactggaatcacatttgcttccctttaccccggttgcattgccacaacaggcctgttcagagagcacattcccttgttcagaactctgttccctccattccagaagtacataaccaaaggctatgtctcagaagatgaagcaggaaagagacttgctcaggttgtaagtgatccaagcctaacaaaatctggtgtttactggagctggaacaaagcatcagcttcgtttgaaaaccagttgtctcaggaggccagtgatacagagaaggctcgtaagatctgggagattagtgagaaacttgttggttttgcctaagtgggaggagcctccaacatcccatgttgttctagagaccttgcacttgcatggaggaagaaaatgatgtctcaaaagagtggatagataacatcctatcattttgaatgcattgatgttgttttgttagctaggagcttctttgctttgatgtaaggtgtcaatggctttttgtgaatcaagactcaataaaatcattcagccatgtgggtgtggtgaagttgctcataaactttctgaaacaacagtgcctagtaaactataaattgtagtgtggggctcttttttagtttttcgttaatagtcgtttttaagtgaacttcagatcaaatggttgaaccaaagatcttgc

SEQ ID NO: 13947 - DNA, 2375 bp, Olea europaea
gatatttagatttgtatcaaagaaacatctaatactatcaaattgaaattccatggctctacaggctgctgccattctcccctctgcatttgccattcaaaaagagggaaaaaatagtgcatctttcaaggactctaacctctttggaatttcaatctcagaccatgtcaaggctgacaagagagaattcatttctaggaagttgtccgtcggggctatcagagctgaggcagtggctacctatccagttttcacccctgcaacagttcaagggaagaaaacactaagaaagggcactgtggtgatcactggagcctcctcgggattaggcctggcgacggcaaaggctctggctgaaaccggaaaatggcacgtaattatggcgtgcagggacttcctcaaggctgagagggcagcaaagtcagttggaatgtctaaggaaaattacaccattatgcatttagaccttgcttcctttgacagtgcgaggcagtttgtcgaaaacttcaagcaatctggccgacccctcgacgtcttggtctgcaatgctgctgtctatcagccaactgctagggaaccttcattcacagctgatgggtttgagctgagtgttgggactaaccatcttggtcatttccttctttcaagattgttgctcgatgacatgaagcagtctgattatccatcgaagagactcataattgtcggctcaattacagggaatacaaatacactggctggaaatgtacctccaaaggcgaatcttggggatttgaggggcctccaagggggattgaatggattaaacacctcgtccatgattgacggtggagatttcgatggagcaaaggcgtacaaggatagcaaggtgtgcaatatgctaacgatgcaagagtttcaccgtcgttaccatgaagaaactgggatcacatttgcttccctgtaccctggttgcattgccacaacaggcctgtttagggagcacatccccttgtttaggctccttttccctccatttcaaaagttcatcaccaaggggttcgtctcagaggaagaagccggaaacaggcttgcacaggttgtaagtgatccaagtttaacaaagtcaggagtttactggagttggaacaaggattcggcttcattcgagaaccagttgtctcaagaagccagtaatgccgataaagctcgtaaagtatgggaaatcagtgagaaactagttggcttggcttgaagggtaatcctcacttcgttcactgatcattggtgccataaacgaagattttggtttgaatgcttgcagttgtaatggaaaaataaaactcaacttgtgacattaaagtttgaatcaataataaaatcactaatctttctcttgtttagtttgctatgattggaacataaattgcaggtaacattcgtgaacataaagattgaattaacaaattacagggactgtaagcttaaaccaaaatcaagtttcagattatttttgtacatctgtgctcatttcttggccagaaaacaaagaaagatcaaatactccaaaataacaaaacagagtggaaaagaaattgatggattagggttcatgaaaattccattctgcccaattggcttcacttccaactcgaggaatgctatcaaccctagcataatgatcaattttgaaattagccccacacaccacaccttcactgtccacccttggcattgcccttagcttattcattgggtgctcaaaactcattaatcctccctcactgtgaaatatgcaccctgctgggaatggtgcaaaagatttagcacagctttctttaatcgcctctaaatcatcagaaatcaccacagaaccatctgcagctattccccaatacaacttaactccaccatcagaacccagtgctgtaaaaacagtcccaactctgctatcatagacaacaaaggcaaagctcccatcaagatccttaataacctgatcagctgggtaaggaccacggtcccgaagtgttctataagcttcaatcacaagcatggcctcatttgcatttcttgctaatccatactgcttaatctgagcacacaaattgttcaaactccccatgaaaaggcaatatatatcatcatacccacaaaacaacctctggttctgatgaaaaagagaatggtgatcaggtcggacataagcaaggacagcagcatccccaaaactcatagaggaagtgttattagggtgagaagaaaggaattcttggagagtttcatctggtaatttaggcttctttgaacttttgagagatgcagggctgtttagctcttcaggtggatgagcaaatgcctggtgaaatatggccaacatcttttcttcgaaagcg

SEQ ID NO: 13948 - DNA, 1982 bp, Chrysanthemum coronarium
agatatttacagtatcctagttcatatcttaagctctaagctctaagctccaatggcccttcaagctacctcttctttctgcatcaacaaagaggcctctttgaaggagtctagcatatttggagcaccattatcaactcatgttaaagttggcttcacatcatcttcaaaaaccaagaaggaatttagccaaagaggcgcactcagaacccaagcagtagctacccctactcccactgcaaaccgtgcatcaacggatggaaagaaaactttaagaaagggtacagtcatcataaccggtgcttcatcgggtttaggtctagccacagcaaaatctctagcagaaagcggaaaatggcatgtgattatggcatgcagagactttttaaaggcggaaagagctgcaaaatcgtcagggatggcgaaagagaattatacagtgatgcatttagacctttcatcatttgatagtgtcaggcagtttgttggaaacttcaagcaatcgggtcaatcgcttgatgtgctggtttgcaatgctgcggtttatttaccgactgctaaagagcctacttacacggctgatgggtttgaacttagtgttgggactaatcatcttggtcatttcttgcttgcaagattgttgcttgatgacttgaagaagtcggattatccatcaaaaaggctcatcattgttggctcaatcacaggtaacacaaacactttggctgggaatgtacctccaaaggctaacctaggagacatgagaggtctagcgggtggattaaacgggctcaacagctctgccatgatcgacggtggagattttgacggtgcaaaagcatataaagacagcaaagtctgcaacatgctcatgatgcaagaattccaccgtcgttaccacgaagaaactggaatcacatttgcttccttgtaccctggttgtattgcaacaacaggattatttagggagcatattccccttttcagactcctatttcctccattccaaaagtacatcaccaagggttacgtctccgaggatgaatccggcaagagacttgctcaggttgtgagtgatccaagtttgacaaaatccggggtttactggagttggaacaacaactctgcttcatttgagaaccagttgtcagaagaagctagtgatgtctccaaggctcgtaaagtatgggagatcagcgagaaactagtcggcttggcttaaaaaagaacaattccttcttcaggttatttacatcgagtgatgatgcgagtttaggacatggctgcaggaaattttctattgtatatttaggttgttcgaatcagaatcaataataaaatcactcgatatttactttaaggccctgtgtttcttctagagtctaaagagtaactgaaggatcaatacataagcaggttatgtaaaatcaatcttgctaacagatggcgtactttatacgaatgattttgaaatggactttggagtgaacgacttcgcattttgaactttacatcattctaatggttaagatggtactttatttatttagacatctgagtgtaagactatattacaagtgtgggactcagcgtcttgacatagatcataaaaactagatacatataaaacagtgaagaaaccgaacttctgaccgtatttaaagctcgtaagcaggaaacctagcctctaatggatctatcatgtccagaaaaagatgagccattcctccaacaccttcaaatagagaaaaagggcagtcacctccatgcattttcccttctgatagaagtatcggacctctttcatgaaggaaactagcaaaagctttggctcggtacaagaacttcacgtcacctgttaatctataaagtgcaaagaaaaacatatgtgttcccacttattcctattggctattattcctaacttcgtttaagtaaaccgtcgtttccataccacctcccctgccttccaccgccgcctt

SEQ ID NO: 13949 - DNA, 1609 bp, Mimulus guttatus
aataaatatctatttatttgctacttagataaatatctcaccaaactaaagtctctttcttcttgatatttcaagaaaatggctttacatgctgctgctttgctcccttctgcattttctactcacaaagagggaaaatccagtgcatctttgaaggattcttgcttttttggagtttcactgatctcagaccatgtcaaagctgataagagagaattcagctcgagaaagtcaccggtcctccgagtgcaggcggtggccaccgctccgacggcgactccggcggcttcccaaggcaagaaaacaataagaaaaggcacggtgatcatcaccggagcttcgtccgggttaggcctagccaccgccaaggccctatcggagagcggcaagtggcacgtggtcatggcctgcagggacttcctcaaggcggagaaggcggcaaaatccgccggaatggccaaagagagctacaccatcatgcacttggacttgtcctcgctcgatagcgtgaggcaatttgtcgacaacttcaagcggtcgggacggccgctcgacgtgttggtgtgcaatgccgccatctatcaacccaccgctaaggagccctcgttcaccgccgacgggttcgagcttagtgtcgggactaaccatctcggacattttctactctcgagattgcttcctgatgacatgaaggagtccgattacccctcgaagaggctcattatcgttggctcaatcaccgggaacacaaacacattggccggaaacgtaccaccaaaggcgaacctcggcgacttgcggggcctacaaggcggtctaacgggcctcaacacctcatccatgatcgacggtggagatttcgacggggcaaaagcctacaaggacagcaaagtctgcaacatgctgacgatgcaagaattccaccgtagataccatgaggacacgggcatcacattcgcctccctgtaccctggctgcatcgccacaaccgggcttttcagagagcatattcctttgttcaggctacttttccctcccttccagaagttcatcacaaaggggttcgtttccgaggaagaatctggtaaaagactcgcacaggttgtgagtgatccgagcttgacgaagtcgggggtttactggagctggaataaggactcggcttcgtttgtgaaccagctgtcggaagaagcgagcgatgctgcaaaggcgcgtaaagtgtgggaagttagtgagaaacttgttggtttgagtgagtgatttacggatttttttgccactagaggaaggatttcggattgagaaacttttgtagacgataacgtttgttgtaagattcttgttagattgtaataaaacaactcgatccttcgttttttagttgttgagttgacaaacacaatttcgtttcgattttacattggtatcgtaattcaagattcttcgtaactttcttatccaatcaccgatttacccgattctagttgggttagaaagctaattcaaagggctacaactttgattttccgagttttcccatattcggacagctaagatggttaaaattaagtttgatgtagacatattgtgggtcgtagggcaatgttcg

SEQ ID NO: 13950 - DNA, 1600 bp, Cajanus cajan
ttgaaccaattcagtggaccattctaaaaccaaaccacccacttcacatttttcttttctaacttccaatggctctccaggctgcttccttggtttctgcttctttcaacattgctaaagagggaaagtctggggtgcctcttagggacaccacaatgtttggtctttcaatgtctgacactctcacctctccctcattgacatgcaaaagggagttccaacaaaaatttggccctgtgagggtccagtcagtggcgacaacaactccaggagtcacaaagtctgcaccagaaggcaagaaaactttgaggaaaggcagtgttgtgatcactggggcttcctctggattaggccttgccactgccaaggctttggctgagacaggaaagtggcatgtgataatggcatgcagggatttcctgaaagctgaaagggcagcaaaatctgctggcattgctaaggaaaactacaccatcatgcatttggaccttgcctctcttgacagtgtcaggcaatttgtggataacttcaggaggtctggcaggccactggatgtgcttgtttgcaatgctgcagtttacttgccaactgctagtgaacccacatacactgctgaaggctttgaactcagtgttgggacaaaccatctgggacatttcctcctttcacgcctcttgcttgaggacttgaacaaatctgattacccttcaaagcgattgatcattgttggctcaatcacaggaaacaccaacacattggctggaaatgtgccacccaaggctaacctcggtgacttgaggggactagctgggggcttgaatggactaaacacttcagccatgatagatggaggatcctttgatggtgcaaaggcctacaaggacagcaaagtctgcaacatgctcaccatgcaagaattccacagaaggtaccatgaagaaactggaatcacatttgcttccctttaccctggttgcattgccacaacagggttgttcagagaacacattcccttgttcagacttctcttccctcccttccaaaagtacataaccaaaggctttgtctcagaagatgaatcaggaaagagacttgcacaggttgtgagtgatccaagcctaacaaaatcaggtgtttactggagctggaacaaggcttctgcttcatttgaaaaccaattgtcacaagaggccagtgatgtagataaggctcgcaaggtttgggagattagtgagaaacttgttggtttggcttaagtggaagaagctttcaacactcatcttgattcagggacatttgtcatggagttcagtaacatctcagaagagtttagacccttttctgatgcgtttcttagatgctttttttttttcttctagctgctaactcctcgtgtcgatgaatctttcaactatgaggccaagtgcacatgaactatagagaaatcgaatacccatgcatgttgtctataatcaatgtcattgcctatcttgggtcagcatttggtcctgtttttttcactcttcattatctctcactcatttttatctgtcaactatataaaggaaataagttatgcagaaagcattttccttcaaaa

SEQ ID NO: 13951 - DNA, 1599 bp, Populus trichocarpa
aacacactccctttacactgctaagctaagctcttcacttcagtcagtactgtaggcagaatatactgtccttaaacaacaaaggacttggaaactcgatttaaacaagcatagagagtttgctttgcaagtgggaatggctcttcaggctgcttctttggtttcctctgcttttgttttccccaaagagggaaaatctaatgcatatttcaaggattcaagtttgttcggagtttcactttcagaacatgtcaaagctgactttagctcttgtgcattgaagtgcaagagggaattcaaccaaggagttggggctgtaagagcccaaacaatggtcgctgctactccagcactcgacagagcttcttcagaaagcaagaaaacccttgggcagggaacttgcattgtcactggtgcttcctctggattaggtctggcaacagctaaggctctagctgagactggaaaatggcacataattatggcctgcaggaacttcctgaaggcagaaagggctgcaaaatcagctggcattgcaaaagaaaactacaccattatgcatttggaccttgcttcacttgacagtgtccgccaatttgtggatacctttaggcgatcagggaggccacttgatgtgctagtttgcaatgcagctgtttacttgccaactgcgaaagagcctgcattcactgctgaaggattcgaacttagtgttggaactaaccatctgggtcatttcctcctttcaagattgttgcttgaggacatgaagaaatctgattacccatcaaaacgtctcataattgttggctcaattacagggaacacaaatacattggctggcaatgtacctcctaaggccaatctcggtgacttgaggggactttcagggggcttgaatggactaaacagatcagccatgattgatggtggcgtgtttgatggtgccaaagcctacaaggacagcaaggtctgcaacatgctcaccatgcaagagttccacaggcgtttgcatgaggaaaccggcattgcatttgcttccctttaccctggttgcattgccacaacaggcttgttcagggagcacattcccttgttcaggcttctattccctccattccaaaagtacattactaagggcttcgtctccgagcacgaagctggaaaaagacttgctcaggttgtgagtgatccaagtttgacgaaatcaggggcatactggagctggaacaaacactcagcttcatttcagaaccagttgtctcaggaagctagtgatgcagagaaggctcgtaaagtatgggagattagcgagaaacttgttggcttggcctaaatgacaagggcttgagagaatttcttgtcgaataatcttttccatgggagaggataatgttaatgcaaaaaagtcttttttgtgagtttggagtttggattcggattatttgcttttgtaaacaattttccctttttagatgtagatgactttgtagcaatcgcctataaaatcactaaaccatatcgcaaagttcatatttctctgattaatgtagcagtctccacactttcaaatcagatactaaatggaatgttttgtaa

SEQ ID NO: 13952 - DNA, 1416 bp, Triphysaria pusilla
cttgaaatggcattacaagctgctgctcttcttccctctgcattttccattcacaaagagggaaaatgcagtgcagctttaaaagattcagccctttttggattatcactctcagactatgtcaaagctgactttacctcttctgcattgataaccaagcagagacaattcagacctcaagcagtggccacctctccaaattccactccagccacctcacaagccaagaaaacgctccgaaaaggcactgtcatcatcaccggagcctcatcgggcctgggactggccactgccaaagctctgtccgatagcggcaaatggcacatcatcatggcctgccgagactttctcaaggccgaaaaagcggccaagtctgtagggatggccaaggataactacaccgtcatgcatttggacctttcgtcactcgagagcgtccgccagttcgtcgataacttcaaacaggccgggcgggccctcgacgttctggtttgcaatgcggctgtctatcagccaactgctaaggagccctcgtttacggccgacgggttcgagcttagtgttgggactaatcatttgggtcactttctcctttcgagattgcttcttgatgacatgaaagagtccgatttcccgtcgaagaggcttattatcgtcgggtcaattacggggaacacaaacacgttggccggaaacataccgccaaaggccaacctcggggacttgcgcgggctccaggccgggctgaacgggccaagcagttctcccatgatcgacggtggggattttgatggggccaaggcgtacaaggacagcaaggtctgcaacatgctgacgatgcaggaatttcacagacgttatcacgaggaaacgggcatcacattcgcgtccctttatccgggctgcattgccacaaccgggctattcagggagcacatccccttgttcaggctccttttcccgccattccagaagttcatcactaaggggtatgtatcagaggaagaagctggaaaaagacttgctcaggttgtgagtgatccaagcttgacaaagtcaggtgtttactggagctggaataagaactcagcttcatttgtgaaccagttgtctgaagaagcaagtgatgctgataaagccaagaaagtgtgggaagttagtgagaaactttgtggtttaaaggattgattaaatatttgttacagttttgaattgaggaactatttggactctagtttcattataaatcaagatttagtttaagattctctgttaggatcataataaaatgactagatccttttctttttttctttttgtaatgttcttttaatgtttttcataggtgtaacttgaattgatgtaaacatgatttttatcagtttgtttgcattttaccaaaaaaaaaaaaaaaaa

SEQ ID NO: 13953 - DNA, 1514 bp, Lupinus angustifolius
actatatttacttgtaacatacattatctactttctactcttttttgttccaatggctcttcaagctgcttctttgattcctacatctttctctgttcttaaagagggaaagtcttgtgtgaaggattctagcctatttggtctttctttgtcagataccctcagagctgatttcacctcttctgcattgaggtgcaagtttcaacaaaagattggtgctgtaagggccgagacagcggctacggcctcaccagcggtcaacaagtctgcatcagaaggcaagaaaacattgaggaagggcactgttgtgatcactggggcttcctcgggattaggcctcgcgacagcgaaagctttggctgagacaggaaaatggcatgtcataatggcctgccgagatttcctcaaaactgcaagagctgcaaaatctgctggcatagctaaggaaaattacacgatcttgcacttagacctttcctctcttgacagcgtacgccaatttgttgatagcttcaggcgattggaattgccgctagatgtgctggtttgtaatgctgctgtttacttgccaactgccaaggaacctagattcactgctgagggatttgaaattagtgttggaacaaaccatctcgggcattttctccttgcgcgcctgttgctcgatgacttgaacaaatctgactacccttcaaggcgcttgatcatcgttggctcaatcacaggaaacacaaatacattggctggaaatgtacctccaaaggctaacctcggtgacttgaggggacttgcgggtggcttgaacgggctaaacagttcggtgatgatagatggtggagactttgatggtgccaaggcatacaaagacagcaaagtctgcaatatgctcacaatgcaagagttccacagaagataccatgaggaaaccgggatcacatttgcttccctttaccccggttgcattgccactacaggcttgtttagggagcacattcccttgttcaggactctattccctccattccaaaagtacattaccaaaggttatgtctcagaagatgaagccggaaaaagacttgctcaggttgtgagtgaacctagcttaacaaagtctggtgtttactggagctggaacaaaacctctgcttcatttgaaaaccagttgtctgaggaagcgagcaatgccgagaaggctcgcaaggtctgggaggttagtgagaaacttgttggtttggtctaagtgtgagcctccaacatgcacatgcagaaaaatgaagtctcaagaagagtgaagatcttgttatgatgagttcattaatgtttgattgttaggtaggaacttctttttgccttgatgtagattgaatgaaccatatgaggaagtgcttctacattgtctatcttgggtcaccatctaaagttggtgttcaattttttaagagtcctttaacaagtgttttggttatcaaaaaatttaaaaaatcttctgattttcaaaatttatcaaataaaaa

SEQ ID NO: 13954 - DNA, 1623 bp, Papaver somniferum
attctccaacaataacaaaaataaaaatcactcaactcaataaatatcatctaaaagtttacacattttctggtacaacttaaaagtttcttcttctttttttccgtttactagaaatggctcttcaagcaacctctatccttccatccagtctttccatccacaaggagggtaaatcaaatttgtcagggaaggatttctatggagtttcttttgctgaattcagtcctctagtcataagaaacaagagagaattgaagagccaaaggttatctgttggacaaatcagagcccagacagcagcaacaactccaggggtaaatcaatctacacaaggaaagaaaactcttaggaaaggaaatgtgataataacaggagcttcatcaggactaggtttagcaacagctaaagccctggctgatacaggaaaatggcatgttattatggcttgtagagatttccttaaggctcaaagagcagctaaatcagctggaattgacaaagagaatttcactgttatgcacctcgacctctcttctcttgatagtgtcagacagtttgttgacaacttcaagcggtcaggtaaaccgcttgatgtgttagtatgtaatgctgctgtttatcagccaacagccaaggaaccatcattcactgctgacggatttgagctcagtgttggtactaaccacttagggcactttcttcttgctcggttactcctcgatgacttgaaaaattctgattacccatctaagcggctcatcatcgtaggttcaataacagggaatacaaacacattggctgggaatgtgcctccaaaggcaaaccttggtgatctaagaggtatggcaggaggactgagtgggaccaacagttcagtgatgatcgatggaggcgaatttgatggtgctaaagcctacaaggatagcaaagtatgcaacatgctcaccatgcaggagtttcacaggcgttatcacgaggagaccgggattacatttgcatcactttacccaggttgcattgccacgaccggtttgtttagggagcatattcctttgttcaggttacttttcccacccttccagaagtacatcacaaagggttatgtatctgaagaagagtctggcaaaaggcttgcacaggtggtaggagaaccaagcttgacaaaatcaggtgtatattggagctggaataagacttcagctagtttcgagaatcagctatctgaagaagctagtgatgttgagaaggcccgaaaactgtgggaggtcagtgaaaagctagtcggcttggcctaaaggaagcatgtcattaacatcaacgtcagtctttgtaatgggccaggaatcacatcatcgatctcttcgtaaacgggaataggaataacacggccaatttgtgggttttttgtatgcaatttttcacatgtaaactagaacaaatttgagttcggtcaaggcaagagaaggatagttgtggctttctaaatctaatgccgcctttctccctttagaatctaatacctcctcctctgtactgcagcaatttaacatgtgacattagtgtacatctgatgaacaatgccatcaatgctgagctgctcaaagcaatgtctgaaaaaca

SEQ ID NO: 13955 - DNA, 1309 bp, Lippia dulcis
ggtctctttccaagaatggctctacaggctgctgctctgcccccctcagcgttttccatccacaaagaggggaaagctagtgcatcattgagggagagctccaccttccttggagtttcattttcagaccatgtcaaatccagctctatcaagagagaattcaattcgaaaaaattccccgccataagagttgaggcagtggccaccacaccaacattcacccctgccaccgtccaaggcaagaaaacgctacaaaaagggaccgtgataataaccggcgcctcctccggtctgggcctcgccgcggccaaggccttagcagagaccgggaaatggcacgtgatcatggcgtgcagggactttctcaaggccgaaaaggctgcaaaatctgctggaatggctaaggagagttacaccatcatgcatttagacttggcatctcttgacagtgtgaggcagttcgtggacagcttcaaaaggtcggggcagcctctcgatgtcttggtctgcaacgctgctgtctaccagccgacggcgagggagccttctttcacggctgagggatttgaacttagtgtgggaaccaaccatttgggacactttcttctgtcaagattgcttcttgatgatatgaccaagtccgattacccatcgaaaaggcttattatcgtcggctcaatcacaggtaatacaaacacgttggctggaaatgtacctccaaaggccaatcttggagatttgaggggccttcaaggagggttaaatggtgtcaacatatcttcgatgattgacggtggacattttgatggggcgaaagcttacaaggacagtaaggtgtgcaacatgctgacaatgcaggaattccaccggcgttaccacgaggacaccggcatcacattcgcttcactttaccccggctgcattgcagaaactggtctgttcagggaacacattcctctcttcagactccttttccctcccttccaaaagttcatcacaaagggctatgtctctcaggaagaagccggaaaaagacttgcacaggttgtaagtgatccaagcttgacaaaatcaggtgtttactggagctggaacaaggactcatcctcctttgagaacaaactgtcagtagaagccagtgacgttgaaaaggcgcgaaaagtgtgggaagttagcgagaagctcgtcggtttggccgactaattttgattatggaattgtaatcgttggcttcatacattcaagaatgagaaaatcacatgtgaaaatcatgtgaaattcaacttaataaaagaatcatgctgctgaa

SEQ ID NO: 13956 - DNA, 1384 bp, Cirsium arvense
cttagatatttacagcaaacacacttcacacttatacctccaatggctctccaagctacttcatcttctttctccatccacaaagagggaaagaccggtgcctctttgaaggattccagcttatttggagcatcactatcatctcatcttaaacttgacctcaaatcatcagtatcaagaaacaggaaggagtttagccaaaggggtgcactcaaaatccaagctacatctactattacaacaccatcggtgaaccaagcttcaacagatggaaagaaaaccttaagaaaaggtacggtggttataaccggtgcttcctccggtttgggtctagccactgcaaaagctctagccgaaaccggaaaatggcatgtgattatggcttgcagagactttctaaaagcggaaagagcagccaaatcgatcggaatggtaaaagagaactataccgttatgcatttagaccttgcgtctttcgatagcgttcggcaatttgtggccaattttaagcaatcgggttacccgctagatgtgttggtttgtaatgcggctgtttattttccgacggctaaggagccgacgtttacggctgatgggttcgagcttagcgttgggactaaccatcttggtcatttcttgcttgcaagattgttgattgatgatttgaagcaatctgattacccatctaaaagactcgtcattgttggctcaattacaggcaacacgaacacattggccggaaatgtacctccgaaggctaacctaggggacatgagaggtctagccggtggactgaatgggctgaacagttcagccatgattgatggaggagattttgatggtgcaaaggcctataaagacagcaaggtctgtaacatgctcatgatgcaagaattccaccgccgtttccatgaagaaaccggcattacgtttgcatctctgtaccctggctgtatagcaacaacaggcttatttcgggagcatattccactattcagactcctcttccctccgttccaacagtacatcaccaaaggcttcgtctctgaggaggaatccggcaaaagacttgctcaggttgtgagtgatccaagcttgacaaagtcgggagtttattggagttggaacaataactcggcttcgtttgagaaccagttgtctgaagaagctagtgatgtcgccaaggctcgtaaagtatgggagataagcgagaaacttgtcggtttggcttaaaaaaagatagatctctcttcgggtttgatccatttgggtgagaatgtgagcgtagggtaatgagtgcaggccgttttctattgtaaatttaggccggggttcaatcagattcagacaatagaatcactcggcatttacttgcaggtttttg

SEQ ID NO: 13957 - DNA, 1605 bp, Vigna unguiculata
gggacacattccattaccagtggtaacaccacttatactaacttcactacgttctaaaacccaaaatccagtttctaatccttttctttttcttgcaatggctctccaagctgcttctcttgttcctgcttctttctctgtccccaaagagggaaagagtggtgtgtctctcaaggattctacactgtttggtctctcattgtcagaacctgtcaaggctgacttcagctcctctgcattgaggtgcaagagagaatccctgcgaaaaattggtgctgtgagggcagagacagtggctacagcctctccagcagtgaccaagtctgcaccagaaggcaagaaaacattgaggaaaggtagtgttgtgataactggggcctcctctggattaggcctggccactgctaaggctttggctgagacaggaaaatggcatataataatggcctgcagggattacctgaaagctgcaagagctgcaaaatctgctggcatagctaaggaaaattacactatcatgcacttggaccttgcctctcttgacagtgtgcgccaatttgttgataacttcagaagatcagaaatgccactagatgtgttggtttgcaatgctgctgtttacttgccaactgctaaggaacctacatacactgctgaaggctttgaacttagtgttggaacaaaccatctaggacatttcctccttgcacgcctgttgcttgaggacttgcaaaaatctgattacccttcaaagcgcatgatcattgttggttcaatcactgggaacaccaatacattggctggtaatgtacctcccaaggcaaaccttggtgacttgaggggacttcagggtggtttgagtgggctgaacagttcagccatgattgatggtggagactttgatggtgccaaggcatacaaggacagcaaagtctgtaatatgctcacaatgcaggaattccacagacgataccatgaggaaactggaatcactttctcatcgctctaccctggttgcattgccacaaccggtttgttcagagagcacattcccttgttcagaactctattccctccattccagaagtacataaccaaaggctatgtctcagaagaggaagcaggaaagagacttgctcaggttgtgagtgatccaagtcttacaaaatctggtgtttactggagctggaacaaaacatctgcttcatttgagaaccagttgtcacaggaggccagtgatgctgagaaggctcgtagggtgtgggatatcagtgagaagctcgttggtttggcctaagggaagagcctccaaaatccatgttctaaagaccttgcacttgcatggaggaaaatgatatctcaatagagtggataagatatatcctaccatttcgaatgccttaatgttgttttgttagctaggtacttctttgctttgatgtagggtgttgattgtgaatcaagactcaataaaatcattgacccatgagggtgtggccatcttgctcaaaacctctgaaataactgtgcatagtaactaaaaattgtaaaatgtggtgtaatctttcaagtttttcgttaattgtcatttataagtgagcttca

SEQ ID NO: 13958 - DNA, 1353 bp, Euphorbia peplus
tggtttcctctgcttttggtctcccaaaagatggaaaagcaagtagtacatccttcaaggattcaactttatttggagtttctttcactgaccatctcaaatctgactttacctcttctgatttcagatccaagagacagccaaaccaaagagttggggcagtgagagctcagacagctgctacagctagccctacagtgatcaggtctacccctgagggcaagaaaactttaagaaagggtagtgttatagtaaccggtgcttcgtctggattgggtttagccgcggctaaggcattggctgaaactgggaaatggcatgtaattatggcatgcagagatttcctcaagacagaaagagctgccaaatctgctggaatatcaaaggaaaactacaccattatgcacttagacctcgcttcccttgacagtgttcgtcaatttgtggataacttcaggcaatcaggcaggcctctcgatgtgcttgtttgcaatgctgctgtttacttgccaaccgctaaggagcctactttcactgctgaaggctttgaacttagtgttggaactaaccatcttggtcatttcctcctttcccgattgttgctcgatgatttaaacaaatctgactacccatctaagcggatgataattgtcggttccatcactggaaacacaaatacattggccggaaatgtacctcccaaggccaatctaggagacatgagggggcttgcaggaggcttgaacgggctaaacagctctgcgatgatcgatggtggaaactttgatggtgctaaagcatacaaggacagcaaagtatgcaacatgctcactatgcaagaataccatagaagattccacgaagaaactggcatcacatttgcctccctttatccaggctgcattgctacaacaggcttattcagggagcacattccattgtttcgaaccttattccctcccttccagaagtacatcaccaagggttttgtatctgaagatgatgctggaaaaaggcttgctcaggttgttagcgatccaagcttgactaaatcgggtgtatactggagctggaacaaggactctgcttcatttgagaatcagatgtctcaagaagctagcgatgcagataaagctcgtaaaatttgggaagtcagtgagaaacttgttggtttggcttaactgcaatggaagtcgttgtggactgatctttgcagcaggagattggtgtttgtgaagggttgagttgtttttggaagtttgaagttgggattcgggagatgttctttctgtaaacaattttcagttgtagaatagatgacttttgtttgaaacatttgacaataaataaaat

SEQ ID NO: 13959 - DNA, 1452 bp, Ambrosia trifida
ccactatataaacccacattacccaacatatttcctaccatcaattaaactaactaataatattccaattatttcactcagcaatggctctccaggcgacctctttctccgttcacagtcttgtaaagaccaccggaactttaaaggattccaccctcctaggagtttcgctttcagatcatcgtaaagttgattttagttcattcgcctcaaaaagcaagatggaattcaaaagaacaaaactcttcaaaactcaagcggtggtcaccaccagtactcctccggtgacacgagcagcaccggaggggaagaaaacattaagaaaaggtacagtcataatcacgggagcatcttccggtctcggcctagcaacagctaaagccttggccgagaccgaaaaatggcacgtcattatggcgtgccgcgactttctaaaagcggaaagagccgcaaaatccgcaggaatatcaaaagaaaactacacagtaatgcatctagacttagcatcactcgatagcgttcgccaattcgtcgctaactttaaacaatcaggcagaccactagacgtattagtatgcaatgcagcggtctaccaaccaacagctaaagaaccaacgttcacagctgatggaatcgagctaagtgtaggaacaaaccatcttggtcattttcttttatccagattattacttgatgacatgaaaaagtccgattatccgtcgaaaagattaataatagtaggatctattactggaaacacaaacactttagcaggaaatgtacctccaaaagctagcttaggtgacatgaggggtttagcaggcggattaaacgggttaaacagctcaaccatgattgatggaggtaaattcgacggtgcaaaggcgtataaagatagtaaaatatgtaacatgcttacaatgcaagagtttcataggaggtaccatgaggaaactggaataacatttgcttctttgtaccctggttgtattgcgacaactggattgtttagggaacatattcccctctttcggttattgtttccgccttttcagaagtttataacaaaagggtatgtgtctgaagaggaatcgggcaagcggcttgcgcaggttgtgagtgatccgagcttgacgaaatcgggggtgtattggagttggaataagggttcggcttcgtttgagaaccagttgtcggacgaggcgagtgatgtgagtaaggctaagaaggtgtgggagataagtgagaagcttgttgggttggcttgagtttgatcagttggttattgatgaagaagtgaaggaaggttgtgttgggttgggttgaatgagtgtagggatttggtgcaattagcaagtttggtgatatgtacattttgttttagtttcaataaggatattgtgcaccctcttttgttgagaaaagtatgtggaattatgaattaaaaaagaa

SEQ ID NO: 13960 - DNA, 1424 bp, Eutrema parvulum
aaacatcacatttacttgtaacgtaacaatgtcacttcaagctgcttctttggtctcctctgctctctctgtccgaaaagatggaaaatcaaatgcttcatcatcattcaaagagtctagtttttttggtgtttcactttctgaccaaatcaaaactgaattcgtctcttcttccttgagatgcaagcgtgaacaaaacttgaggactaagggagcaataatccgagctcaagcaatcgcgacttcaaccccatcagtcacacgatcttccttagaccgcaagaaaacccttagaaaaggaaacgtggtcgttacgggagcttcctcagggcttggtttagcaacggcaaaagcattagccgagacaggtaaatggcacgtgataatggcgtgcagagacttcctcaaggccgagagagcagcaaagtccgcagggatgtctaaggacagctacacggtgatgcatttggacttggcatctttggacagcgtgaggcagttcgttgataacttcaggcgagccgagatgcctctcgacgtcttggtatgcaatgctgcgatttatcagccaacggctaatcaacctactttcactgctgaagggtttgagcttagtgttgggacgaaccatttggggcattttcttctctcacgcttgttgattgatgacttgaagaactctgattatccgtcgaaacgtctcatcattgttggatccataactggaaacactaatacattggcgggtaatgtacctccaaaggcaaatctcggggatttaagaggactagctggcggattgaacggactaaacagctcggcgatgatagatggaggagatttcaacggtgcaaaggcgtataaagacagtaaagtctgcaacatgttgacaatgcaagagtttcataggcgtttccatgaagaaactgggatcactttcgcttccctttaccccggttgtatcgcgacaacaggtttgttcagagagcatattcctctcttccgttccctcttccctcctttccagaaatacatcaccaaaggttatgtctccgagatagaggctggcaaaagacttgctcaggtggtgaatgatccgagcttgacgaagtcaggagtgtactggagctggaacaagacctcggcttcattcgagaatcagttgtctcaagaagctagcaatgtcgagaaggctcgtagggtttgggaagtcagcgagaagctcgtaggcttagcctaaaagttgatctgagtcccatcctctgtgtttaaagtttttaaccttttgtttaggtttaaataagatgacaaataaacataagaggagacattaatgaagcctttaacaactttgagttagtgtgttggctaattctacttgtcgacaaaccaaataagcctctttttcattttaagttgttgtc

SEQ ID NO: 13961 - DNA, 1614 bp, Lippia dulcis
caaccctacaaaaatactgattggttttccgtatagtccaacgtagggcatggacttccataacaatgttatcttatccacattttagatttctacatcatatccaaaatcagcctattctttgctagtattatataccttaaccacctttttgctacctagtacatatcataagtatctttgctacatagatttgtgacaaccaatatttcttagtttaatatctcctgtttaaggttaaggtcttttgtttttttggctcagaaattactaaaaggcccttcaaatggctttacaggctgctgcttttctaccatcttcattttccattcacaaagagggaaaatcaggcgcgtctttgaaggattctggcttttttggagttccgctctttggccatgtcaaaagtgacttcatctcttctgcattgaaaatcaagagagaatcatgcttgagaagcttcccaggggccattagagctcagacagctgccaccgccccgactttcacaccttccactgtccaaggcaagaaaatattgaggaagggcagtgttataatcaccggggcttcgtccggcttaggcctcgccacagctaaagccttagcagcaagcgggaaatggcatgtaataatggcgtgcagggatttcctcaaggcagaaaaagcagcgaaatctgctgggatggataaggagaattacacaatcatgcatttagatcttgcatcatttgaaagcattaggcaatttgtcgacaacttcaggaggtccacaatgcccctcgatgtcttagtttgcaatgccgccgtgtaccaaccaactgcaaaggagccatctttcacggctgaggggatcgagcttagtgttgggactaatcatttgggacactttcttctttcaagattgctgctcgacgacatgaagcagtctgattgtccctcgaagaggcttataattgtcggatccatcacagggaatacaaatacattggctggaaacgtacctccaaaggccaatctaggcgacttacgtggtcttcaaggcggccttaatgggccaaacacctcatccatgattgacggtggagattttgatggagcgaaggcgtataaggatagcaaagtatgcaatatgcttacaatgcaagaattccaccgacgttaccatgaggacacaggcatcacattcgcctccctctacccgggttgtattgccacaacaggcctatttcgagaacacatccccttgttcaggctccttttccctccattccaaaagttcatcacaaaaggctatgtatcagaggaagatgccggaaaaagacttgcacaggttgtgagtgacccaagcttgacaaagtcgggtgtatattggagctggaacaaagactcagcttcattcgagaaccagttgtcagaagaagccagtgatgtggaaaaagcacgcaaagtgtgggaaattagcgagaaacttgttggtttgagcgattaatctttccttctgagaatatttttcttggatttaggtgctaagatcattaaaaacaaaagaaaagcagcaaaaatgacatgtaagattattcttagaatcataataaaaccattctgatccaa

SEQ ID NO: 13962 - DNA, 1048 bp, Triticum aestivum
tcatcgctgttccagacagccatgactcgagaaccgggcgggcgccgccccctcctcccaccctgcctcgtcgcggaacagtgctcccaccgccggcgccatgagtaagttgcagagcgacgccctgagggaggcaatcacaaacattatcaatgactgccgtgagaagaaccgcaagttcgttgaaaccattgagctgcagattggtctgaagaactatgacccgcaaaaggacaagcgtttcagtggttctgttaagcttcctcacatccctcgcccaaagatgagggtttgcatgcttggtgatgcccagcatgttgaagaggcagggaaaatgggcctagactgcatggatgtggaatcccttaagaagatgaacaaaaacaagaagctggtcaagaagcttgcaaagaagtatcatgctttccttgcatctgaggctatcattaagcagattccccgacttcttggacctggtcttaacaaggcaggaaagtttccaactttggtgtctcaccaggaatcccttgagtccaaggttaatgagaccaaggccacagtcaagttccagttgaaaaaggtgctttgcatgggtgttgccgttggccacctgggtatggaggagaagcagatcttccagaacgtgcagatgagcgtcaacttcctcgtctctctgttgaagaagaattggcaaaacgtgagatgcttgtacctgaagagcacgatgggaaaggtgtaccggttgttctaggctctagtcttctaggatttccaggagattgacaacttgggaacttttgttgctttctcaattatcaaattttcgtgcgcgacgagtgacaattattgtcttgtactgagatggtttgttctattgtctggaacttgatgacattttatccgttgtccctgtgccttcctactgctctgcctgctgtcagtcatcagcttaacgctagattcagcattggtccattggtatttacgaccgtcagaatcttattttaccgtgtgtcggacggtggaatctcggtgtatccgtgctgcc

SEQ ID NO: 13963 - DNA, 845 bp, Avena sativa
ccctgcctcgtcgcggaacagtgctcccaccgccggcgccatgagtaagttgcagagcgacgccctgagggaggcaatcacaaacattatcaatgactgccgtgagaagaaccgcaagttcgttgaaaccattgagctgcagattggtctgaagaactatgacccgcaaaaggacaagcgtttcagtggttctgttaagcttcctcacatccctcgcccaaagatgagggtttgcatgcttggtgatgcccagcatgttgaagaggcagggaaatgggcctagactgcatggatgtggaatcccttaagaagatgaacaaaaacaagaagctggtcaagaagcttgcaaagaagtatcatgctttccttgcatctgaggctattattaagcagattccccgacttcttggacctggtcttaacaaggcaggaaagtttccaactttggtgtctcaccaggaatcccttgagtccaaggttaatgagaccaaggccacagtcaagttccagttgaaaaaggtgctttgcatgggtgttgccgttggccacctgggtatggaggagaagcagatcttccagaacgtgcagatgagcgtgaacttcctcgtctctctgttgaagaagaattggcaaaacgtgagatgcttgtacctgaagagcacgatgggaaaggtgtaccggttgttctagactctagtcttctaggatttccaggagattgacaacttgggaacttttgttgctttctcaattatcaaattttcgtgcgggacgagtgacaattattgtcttgtactgagatggtttgttctattgtctggaacttgatgacattttatccgttg

SEQ ID NO: 13964 - DNA, 744 bp, Festuca arundinacea
cctgcctcgtagcggaacagcgcttcccccgccggcgccatgagtaagttgcagagcgactccttgagggaggcagtcacagctattaccaatggaagtcgggagaagaaccgcaagttcgttgaaaccattgagctgcagatcggactgaagaactatgacccgcaaaaggataagcgtttcagtggttctgttaagcttcctcacatccctcgcccaaaaatgagggtctgcatgcttggtgatgcccagcacgttgaagaggcagggaaaatgagcctagactatatggatgtggaatccctcaagaagatgaacaaaaacaagaagctagtcaagaagcttgcaaagaagtaccatgcttttcttgcatctgaggccatcattaagcagattcctagacttcttggacctggtcttaacaaggcaggaaaattcccaactctggtttctcatcaggagtctctcgaagcaaaggttaatgagaccaaggctacagtgaagttccagctgaaaaaggtgctctgcatgggtgttgccgttggccacttgggcatggacgagaagcaaatcttccagaacgtgcagatgagcgtgaatttccttgtttctctgttgaagaagaattggcaaaacgtgaggtgcttgtacctgaagagcacaatgggaaagcggcaacggttgttctagacctcatctttaggcttctagggatattcaggtgttcgggaactttgagtacca

SEQ ID NO: 13965 - DNA, 855 bp, Avena sativa
ggatcagtgctttcaccgccggcgccatgagtaagttgcagagtgactccctgagggaggcaatcacaggtattaccagtgactgtcgtgagaagaaccgcaagttcagcgaaaccattgagctgcagattggactgaagaactatgacccgcaaaaggataagcgtttcagtggctctgttaagcttcctcacatccctcgcccaaagatgagggtctgcatgcttggtgatgcccagcacgttgaagaggcagggaaaatgaacctagattatatggatgtggaatccctcaagaagatgaacaagaacaagaagctagtcaagaagcttgcaaaaaaatatcatgcttttcttgcatctgaggccatcattaagcagattccccgacttcttggacctggtcttaacaaggcaggaaaattcccaactctggtgtcccatcaggagtccctcgaagccaaggttaatgagacaaaggctacagtgaagttccagctgaagaaggtgctctgcatgggtgttgccgttggccacatgggtatggacgagaagcaaatcttccagaatgtgcagatgagcgtgaatttccttgtttctctgttgaagaagaattggcaaaacgtgaggtgcttgtacctgaagagcacaatgggaaagccgcaccggttgttctagacctgtcttatctctttaggcttctaggatatccaggaggttgacagcttgagaacttttgttgttctcagttaccaaattttcgtgaggcaagtgacgattaaacaaaacagtccgaattattccgtcttgtactgagatggtcagttctctcctgctggaacttcatgatattcta

SEQ ID NO: 13966 - DNA, 764 bp, Avena sativa
tgctttcaccgccggcgccatgagtaagttgcagagtgactccctgagggaggcaatcacaggtattaccagtgactgtcgtgagaagaaccgcaagttcagcgaaaccattgagctgcagattggactgaagaactatgacccgcaaaaggataagcgtttcagtggctctgttaagcttcctcacatccctcgcccaaagatgagggtctgcatgcttggtgatgcccagcacgttgaagaggcagggaaaatgaacctagactatatggatgtggaatccctcaagaagatgaacaagaacaagaagctagtcaagaagcttgcaaagaaatatcatgcttttcttgcatctgaggccatcattaagcagattccccgacttcttggacctggtcttaacaaggcaggaaaattcccaactctggtgtcccatcaggagtccctcgaagccaaggttaatgagacaaaggctacagtgaagttccagctgaagaaggtgctctgcatgggtgttgccgttggccacatgggtatggacgagaagcaaatcttccagaatgtgcagatgagcgtgaatttccttgtttctctgttgaagaagaattggcaaaacgtgaggtgcttgtacctgaagagcacaatgggaaagccgcaccggttgttctagacctgtcttgtctctttaggcttgtaggatatccaggaggttgacagcttgggaacttttgttgttctcagttaccaaattttcgtgaggcaag

SEQ ID NO: 13967 - DNA, 918 bp, Avena sativa
tggccgccttccctcccctcccctgcctcgtcgcgaatcagtgctttcaccgccggcgccatgagtaagttgcagagtgactccctgagggaggcaatcacaggtattaccagtgactgtcgtgagaagaaccgcaagttcagcgaaaccattgagctgcagattggactgaagaactatgacccgcaaaaggataagcgtttcagtggctctgttaagcttcctcacatccctcgcccaaagatgagggtctgcatgcttggtgatgcccagcacgttgaagaggcagggaaaatgaacctagattatatggatgtggaatccctcaagaagatgaacaagaacaagaagctagtcaagaagcttgcaaaaaaatatcatgcttttcttgcatctgaggccatcattaagcagattccccgacttcttggacctggtcttaacaaggcaggaaaattcccaactctggtgtcccatcaggagtccctcgaagccaaggttaatgagacaaaggctacagtgaagttccagctgaagaaggtgctctgcatgggtgttgccgttggccacatgggtatggacgagaagcaaatcttccagaatgtgcagatgagcgtgaatttccttgtttctctgttgaagaagaattggcaaaacgtgaggtgcttgtacctgaagagcacaatgggaaagccgcatcggttgttctagacctgtctttgtctctttaggcttctatatatctaggatatccaggagattgccaacgtgggaacttttgttgttctcagttaccaaattttcgtgaggcaagtgacgattaaacaaagagagtccgaattattccgtcttgtactgagatggtctgttatctcctgctggaacttcatgatactctatccattgagatgctctaac

SEQ ID NO: 13968 - DNA, 925 bp, Brachypodium distachyon
gtcgcgccgccttccctcccctgcctcgtcgcggaacagtgctcccaccgccggcgccatgagtaagttgcagagcgaagccctgagggaggcaatcacaagtattaccactaactctcgtgacaagcagcgcaagttcattgaaaccattgagctgcagattggactgaagaactatgacccccaaaaggataaacgtttcagtggttctgttaagctacctcacatccctcgcccaaagatgagggtttgcatgcttggtgatgcccagcacgttgaagaggcagggaaattgggcctagactgtatggatgtggaatccctcaagaagatgaacaaaaacaagaagctagtcaagaagcttgcaaagaaatatcatgctttcctcgcatctgaggccatcattaagcagattcctcgacttcttggacctggtcttaataaggcagggaaattcccaactttggtgtctcatcaggagtccctcgaatccaaggttaacgagaccaaggctactgtgaagttccagctgaaaaaggttctttgcatgggtgtggccgttggccactgtggtatggatgagaagcaaatcttccagaatgtgcaaatgagtgtgaatttccttgtctctctattgaagaagaactggcaaaatgtgagatgcttgtacctcaagagcacaatgggcaagatgcaccggttgttctaagccatcatctgtttaggtctctagaaattcgaggagtttgactacttgggagcttttttatattcagagatccaattttcgtgcatcaagtgagaattatgcagtgcgaattattctgtcttgtactgagatgtgtttatctgttctgtgggactcacgacacttagctattgagctcgctctaagacatcatggctatactcttttgtgcttctc

SEQ ID NO: 13969 - DNA, 772 bp, Setaria italica
agggtttccactctgccgcgccgcctccccctacctcgaggaacgctgctcgcaccagcaccaccggcgccatgagtaagttgcagagcgacgctctgagggaggcaattgcctcagttaccaatgactcccgtgaaaagcagcgcaagtttgtcgaaaccattgagctacagattggactgaagaactatgaccctcaaaaggacaagcgtttcagtggttctgttaagctgcctcacatccctcgccctaagatgaaggtttgcatgcttggtgatgctcagcacgttgaggaggcagggagaataggtctggacagtatggatgtggaagccctcaagaagatgaacaaaaacaagaagctagttaagaagctcgcaaagaaataccatgctttccttgcatctgaggccatcattaagcaaattcctcgtcttcttggacctggtcttaacaaggcaggaaagttccctactttggtgtctcatcaggaatcccttgaatccaaggttaatgagactaaggctacagttaagttccagctgaagaaggtgctttgcatgggtgttgctgttggcaactgcggcatggatgagaagcaaatcttccagaatgtgcaaatgagcgtcaacttccttgtgtcactcttgaagaagaattggcagaatgtgagatgcctgtacctgaagagcactatgggaaaggtgtaccggttgttctaaatctttctcttaggcttgtagaatttccaggagactttactgggggactt

SEQ ID NO: 13970 - DNA, 914 bp, Festuca arundinacea
cctgcctcgtcgcggaacagtgccctcgccgccggcgccatgagtaagttgcagagcgagtccctgcgggaggcaatcacagctatcaccaatggcagtcgtgagaagaaccgcaagttcgttgaaaccattgagctgcagattggactgaagaactatgacccgcaaaaggataagcgtttcagtggttctgttaagcttcctcacatcctcgcccaaagatgagggtctgcatgcttggtgatgccagcacgttgaagaggcagggaaaatgggcctagacaatatggatgtggaatccctcaagaagatgaacaaaaacaagaagctagtcaagaagcttgcaaagaagtaccatgcttttcttgcatccgaggccatcattaagcagattcctagacttcttggacctggtcttaacaaggcaggaaaattcccaactctggtgtctcattccgagtccctcgaagccaaggttaacgagaccaaggctacagtgaagttccagctgaaaaaggtgctctgcatgggtgttgccgttggccacttgggcatggacgagaagcaaatcttccagaacgtgcagatgagcgtgaatttccttgtttctctgttgaagaagaattggcaaaacgtgaggtgcttgtacctgaagagcacaatgggaaagcgggaacggttgttctagacctctcatctttaggcttctaggatattgaggagattaacaactttgggaacttctgttgttttctcagttactattttttcgtgaggcaagtgggttaaacaggccgaattattctgtcttgtgctgagatggtctgttctctcctgtggaagttcatgctattctattcagtgagatttttctcgagactttgtgggtttactctcgtgcttgtgcctaacta

SEQ ID NO: 13971 - DNA, 895 bp, Sorghum bicolor
cgccgccgccgctcgctcctcgcccgctgtcctcgcccgaccacagccggaaggaacgctgctagcacttccggtagcggcgacatgagtaagctgcagagtgatgctctgagggaggcgattgcctcgattaccaatgattcccgtgagaagcagcgcaagtttgttgaaaccattgagctgcagattggtcttaagaactatgaccctcaaaaggacaagcgtttcagtggttctgttaagctgcctcacatccctcgccctaagatgaaggtttgcatgcttggtgatgctcagcacgttgaggaggcagagagaataggtctagacagtatggatgtggaagccctcaagaagatgaacaaaaacaagaaactagtgaagaagctggcaaagaagtaccatgctttccttgcgtctgaggctatcattaagcaaattcctcgtcttcttggtcctggtcttaacaaggcaggaaaattccctaccctggtgacacatcaggaatccctcgagtccaaggttaatgagacaaaggctacagttaagttccagctaaagaaggtgctttgcatgggtgttgccgttggcaactgtggtatggaggagaagcaaatcttccagaatgtgcaaatgagcgtcaacttcctcgtgtcactcttgaaaaagaattggcagaatgtgagatgcctgtacctgaagagcactatgggaaaggtgtaccgggtgttctaaaatttccatttagccatagaacttccaggagacttgagtgcttgggccattttgcaattttccctacgaaccatttttttgtgcaactatcgaggattaagtagttaaaccctggtcttgtatggaatgttttgattctttatactgaactcacaggtgg

SEQ ID NO: 13972 - DNA, 1239 bp, Oryza sativa
atataaactgctctcttcctcgccgccatctagggtttcctctccgccgcgccgcctccctcgtacctcgtcgcggatctgtgctcgcaccaccggcggcgccatgagtaagttgcagagtgatgctctgagagaagcgatctctcaaattgctaatgactctcgtgagaagcagcgcaaatttgtggaaaccattgagctgcagattggactgaagaactatgaccctcaaaaggataagcgtttcagtggttctgttaagctgccccacatccctcggcctaagatgaaggtttgcatgcttggtgatgctcagcacgtcgaagaggcagagaaaatgggcctagactatatggatgtggaagccctcaagaaaatgaacaaaaacaagaagctagttaagaagcttgcaaagaaatatcatgctttccttgcttctgaggctatcatcaagcagattcctcgacttcttggtcctggtcttaacaaggcaggcaaattcccaactctggtgacgcatcaggaatcacttgagtccaaggttaatgagactaaggctacagtgaaattccagctgaagaaggttctctgcatgggtgttgctgttggcaactgtgctatggaggagaagcagatcttccaaaatgtgcagatgagcgtgaacttccttgtttcccttttgaagaagaattggcagaacgttaggtgcttgtacctgaagagcaccatgggaaaggtgtaccgagtgttctaagttattttctttaggcttctagatgttttggagactaagctacttgaaacttttgctactttcccagtcatcaaattttgtgcaacagctgaggattaaggaattcggatttaattgtcctgtactaagttgcctctctctttggttgaacatcattacattttatccatcgagatcattctgtgatgacccaaaatcctgctgtgcagaccttttattgtcctgatctttattagtcttagcagcatgagttagtgagaacattaggtgttcatatctttcttgcctgtttaaagaaaattattggatgcacacatcacaatggaattttagagataccgatacaccttactgttgttttgatggatgtagcagaatagtcagcttatctatctcggttaattatgctgatgcaattagaaagtggctaacaactggctggtcttgattcttcttcatcggctttaccaaatattgctctgaac

SEQ ID NO: 13973 - DNA, 1019 bp, Cenchrus ciliaris
ctctaccgcgccgcctcccccttgctcgaggaacgttgttctcgccaggacctccggcgccatgagtaagttgcagagtgacgctctgagggatgcgattgcctcaattaccaacgactcccgtgaaaagccgcgcaagtttgttgaaaccattgagctgcagattggactgaagaactatgaccctcaaaaggacaagcgtttcagtggttctgttaagctgcctcacatccctcgccctaagatgaaggtttgcatgcttggtgatgctcagcatgttgaggaggcagcaagaataggtctggacagtatggatgtggaagccctcaagaagatgaacaaaaacaagaagctagttaagaagcttgcaaagaaataccatgctttccttgcatctgaggccatcattaagcaaattcctcgtcttcttggacctggtcttaacaaggcaggaaagttccctactttggtgtctcatcaggaatcccttgaatccaaggttaatgagactaaggctacagttaagttccagctgaagaaggtgctttgcatgggtgttgctgttggcaactgcggcatggacgagaagcagatcttccagaatgtgcaaatgagcgtcaacttccttgtgtcactcttgaagaagaattggcagaatgtgagatgcctgtacctgaagagcactatgggaaaggtgtaccggttgttctaaatctttatcttaggcttgtagaattttcaggagacttactggggtacttttgctattttatctaccaccaattttttgtgccaaccagtgaggattaaggagttaaatccccattgtcttgtgcgagatgttttccttcttgttatcgaacctatggcaatatcttatttcaacatttttgtcgctacctaagatcaattcctgtgctgtctaatttccttttattctcttggggggcggtatgcctgtatagtttttcgctgatgtatctgtgttctattggtgtactgcattacatttggtttga

SEQ ID NO: 13974 - DNA, 995 bp, Echinochloa colona
acacgacgactctctgccgcgccgcctccccctacctcgcggaacactgctcgcaccaccggcgccatgagtaagctgcagagtgaagccctgagggaggcaattgcctcaattaccaatgactctcgtgagaagcagcgcaagtttgttgaaaccattgagctgcagattggactgaagaactatgaccctcaaaaggacaagcgtttcagtggttcagttaagctgcctcacatccctcgccctaagatgaaggtttgcatgcttggtgatgctcagcatgtcgaggaggccgagagaataggtctggacagtatggatgtggaagccctcaagaagatgaacaaaaacaagaagctagttaagaagctcgcgaagaaataccatgctttccttgcatctgaggctatcattaagcaaattcctcgtcttcttggacctggtcttaacaaggcaggaaagttccctactttggtgagtcatcaggaatcccttgattccaaggttaatgagactaaggctacagttaagttccagctgaagaaggtgctttgcatgggtgttgctgttggcaactgtggtatggaagagaagcaaatcttccagaatgtgcaaatgagcgtcaacttccttgtgtcactcctgaagaagaattggcagaatgtgagatgcctttacctgaagagcactatgggaaaggtgtaccgggtgttctaaatctttctgttaggcttgtagaagttccaggatccttgattaccgttgagacttttgcaattttctctgccaccaattttttgtgctacaatccaggattaaggagttaaacccccattgtcttgtgagatgttttcgttcttgatattgaacctatggcaacatcttatttcaacttttgtcgccacctatgctgatgcattatgtatctttcctttctccctgagccttatggccgtaatgtctcctgattgcaatcatccaatggaatggtgcgg

SEQ ID NO: 13975 - DNA, 914 bp, Oryza sativa
gggtttcctctccgccgcgccgcctccctcgtacctcgtcgcggatctgtgctcgcaccaccggcggcgccatgagtaagttgcagagtgatgctctgagagaagcgatctctcaaattgctaatgactctcgtgagaagcagcgcaaatttgtggaaaccattgagctgcagattggactgaagaactatgaccctcaaaaggataagcgtttcagtggttctgttaagctgccccacatccctcggcctaagttgaaggtttgcatgcttggtgatgctcagcacgtcgaagaggcagagaaaatgggcctagactatatggatgtggaagccctcaagaaaatgaacaaaaacaagaagctagttaagaagcttgcaaagaaatatcatgctttccttgcttctgaggctatcatcaagcagattcctcgacttcttggtcctggtcttaacaaagcaggcaaattcccaactctggtgacgcatcaggaatcacttgagtccaaggttaatgagactaaggctacagtgaaattccagctgaagaaggttctctgcatgggtgttgctgttggcaactgtgctatggaggagaagcagatcttccaaaatgtgcagatgagcgtgaacttccttgtttcccttttgaagaagaattggcagaacgttaggtgcttgtacctgaagagcaccatgggaaaggtgtaccgagtgttctaagttattttctttaggcttctagatgttttggagactaagctacttgaaacttttgctactttcccagtcatcaaattttgtgcaacagctgaggattaaggaattcggatttaattgtcctgtactaagttgcctctctctttggttgaacatcattacattttatccatcgagatcattctgtgatgaccc

SEQ ID NO: 13976 - DNA, 898 bp, Oryza sativa
cgccgccacttcgccctccgcttccgccgccgccgcgccgccgccaccttcctcgttgcggaacagtgtgctcgcaccgccggcgccatgagtaagttgcagagtgatgctcttagggaggcaatctcacaaattactagtgaatcccgcgagaagcagcgcaagttcgtggaaaccattgaactgcagattggactgaagaactatgaccctcaaaaggataagcgtttcagtggatctgttaagttgcctcacatcccccgccctaagatgaaggtgtgcatgcttggtgatgcccagcatgttgaagaggcagagaaaatgggcctagactatatggatgtggaagctctcaagaagatgaacaaaaacaagaagctggttaagaagcttgcaaagaaatatcacgctttccttgcatctgaggccatcattaagcagattcctcgacttcttggacctggtcttaacaaggcaggcaaattcccaacgttggtgactcaccaggaatcacttgagtccaaggttaacgagactaaggctacagtgaagttccaactgaaaaaggttctttgcatgggtgttgctgtaggcaactgtgctatggaggagaagcaaattttccaaaatgtgcaaatgagcgtgaacttccttgtctctcttttgaagaagaattggcagaacgtgagatgcttgtacctgaagagcactatgggaaaagtgatccgggtgttctaaatggttttcttcatgctcctcgaatttctagagacttccctgcttggaacttttattgttttctcaactatcatttttttgtgcaacaagttcagaaatcatttttgatgttatcgattaacttgacttcaaccgttgaaatctttctgtggtactccaa

SEQ ID NO: 13977 - DNA, 926 bp, Echinochloa colona
ggaacgctgctcgcaccaccggcgccatgagtaagctgcagagtgaagccctgagggaggcaattgcctcaattaccaatgactctcgtgagaagcagcgcaagtttgttgaaaccattgagctgcagattggactgaagaactatgaccctcaaaaggacaagcgtttcagtggttcagttaagctgcctcacatccctcgccctaagatgaaggtttgcatgcttggtgatgcacagcatgtcgaggaggcggagcgaatatgtctagacagtatggatgtggaagccctcaagaagatgaacaaaaacaagaagctagttaagaagctcgcgaagaaataccatgctttccttgcatctgaggctatcattaagcaaattcctcgtcttcttggacctgggcttaacaaggcaggaaagttccctactttggtgagtcatcaggaatcccttgattccaaggttaatgagactaaggctacagttaagttccagctgaagaaggtgctttgcatgggtgttgctgttggcaactgtggtatggaagagaagcaaatcttccagaatgtgcaaatgagcgtcaacttccttgtgtcactcctgaagaagaattggcagaatgtgagatgcctttacctgaagagcactatgggaaaggtgtaccgggtgttctaaatcgatctgttaggcttgtagaagttccaggatccttgattaccgttgagacttttgcaattttctctgccaccaattttttgtgctacaatccaggattaaggtgttaaacctccattgtcttgtgagatgttttatgttcttgatactgcctatggcaatatcgtatttcaacttttgtctccacctaagctgatgcctatggatctttcctttctcactgagccttatggccgtattgtctcctga

SEQ ID NO: 13978 - DNA, 920 bp, Zea mays
gccgccgttcgctgctcggcgctctcctctcccgacgacagctacacctcacaaccgtgagctcgcgaaggaacgctgttcgcaattccggcgccggcaccatgagtaagctgcagagtgattctctgagggacgcgattgcctcaattaccaatgattcccgtgagaagcagcgcaaatttgttgaaaccattgagctacaaattggactgaagaactatgaccctcaaaaggacaagcgcttcagcggttctgttaagctgcctcacatccctcgccctaagatgaaggtttgcatgcttggtgatgctcagcatgttgaggaggcagagagaatgggtatagacaatatggatgtggaagccctcaagaagatgaacaaaaacaagaagctagtgaagaagctggcaaagaagtaccatgctttccttgcatctgaggctatcattaagcaaattcctcgtcttcttggtcctggtcttaacaaggcaggaaaattccctaccttggtgacacaccaggaatcccttgagtccaaggttaatgagacaaaggctacagttaagttccagctgaagaaggtgctttgcatgggtgttgctgttggcaactgcggcatggatgagaagcagatcttccagaatgtgcaaatgagtgtcaacttcctcgtgtcgctcttgaaaaagaattggcagaatgtgagatgcttgtacctgaagagcactatgggaaaggtgtaccggctgttctaaattttccaattaggcttagaatttccaggagactcgagtgcttggacacttgccattttccctaccatccatttttttgagcaactatggattatctagttacaaacttggtcttgtacttgatgttttgttcttgataccgaacctatgacattgttaccttatttc

SEQ ID NO: 13979 - DNA, 1017 bp, Oryza sativa
accctagcgcacagccgccgccacttcgccctccgcttccgccgccgccgcgccgccgccaccttcctcgttgcggaacagtgtgctcgcaccgccggcgccatgagtaagttgcagagtgatgctcttagggaggcaatctcacaaattactagtgaatcccgcgagaagcagcgcaagttcgtggaaaccattgaactgcagattggactgaagaactatgaccctcaaaaggataagcgtttcagtggatctgttaagttgcctcacatcccccgccctaagatgaaggtgtgcatgcttggtgatgcccagcatgttgaagaggcagagaaaatgggcctagactatatggatgtggaagctctcaagaagatgaacaaaaacaagaagctggttaagaagcttgcaaagaaatatcacgctttccttgcatctgaggccatcattaagcagattcctcgacttcttggacctggtcttaacaaggcaggcaaattcccaacgttggtgactcaccaggaatcacttgagtccaaggttaacgagactaaggctacagtgaagttccaactgaaaaaggttctttgcatgggtgttgctgtaggcaactgtgctatggaggagaagcaaattttccaaaatgtgcaaatgagcgtgaacttccttgtctctcttttgaagaagaattggcagaacgtgagatgcttgtacctgaagagcactatgggaaaagtgatccgggtgttctaaatggttttcttcatgctcctcgaatttctagagacttccctgcttggaacttttactgttttctcaactatcatttttttgtgcaacaagttcagaaatcatttttgatgttatcgattaacttgacttcaaccgttgaaatctttctgtggtactccaagtggtcggtaacctgctgtgcgaattattttttcctgcaccacattattgtctgagaaccagcctgtgaatcataattctttcaagaatggcaagattgtgaca

SEQ ID NO: 13980 - DNA, 729 bp, Lolium multiflorum
cctcctcctcaatcttctcttcgtagttgacgcggttgttccttcggtctcaccctgtcttcttcttcctcgctgtctgcccaggaacagtgctttcaccgccggcgccatgagtaagttgcagagcgactccctgagggaggcaatcacagctattaccaatggaagtcgtgagaagaaccgcaagttcgttgaaaccattgagctgcagatcggactgaagaactatgacccgcaaaaggataagcgtttcagtggttctgttaagcttcctcacatccctcgcccaaaaatgagggtctgcatgcttggtgatgcccagcacgttgaagaggcagggaaaatgagcctagactatatggatgtggaatccctcaagaagatgaacaaaaacaagaagctagtcaagaagcttgcaaagaagtaccatgcttttcttgcatctgaggccatcattaagcagattcctagacttcttggacctggtcttaacaaggcaggaaaattcccaactctggtctctcatcaggagtccctcgaaggcaaggttaatgagaccaaggctacagtgaagttccagctgaaaaaggtgctctgcatgggtgttgctgttggccacttgggcatggacgagaaacaaatcttccagaacgtgcagatgagcgtgaatttccttgtttctctgttgaagaagaattggcaaaatgtgaggtgcttgtacctgaagag

SEQ ID NO: 13981 - DNA, 1264 bp, Cocos nucifera
tttagcttcaattttttacctattttcgcggagttcatcttttctgtgattttcatgattaatttgttgttttccaagcaagtttggttgttgatgtatatatatgatggacgattttcttcagttactcaagatctgatctctttgtttgaaggaaagactgagcgtagcagtggaagcaaaagaaatccgtcggaaccatgagcaagttacagagtgatgttttgagggaagcaatctctcagatcgcaaatgattctcgggagaagaagcgcaattttactgaaaccattgagctacagattggactaaaaaactatgaccctcaaaaggataagcgtttcagtggatctgtgaagttacctcacatccctcgtccaaaaatgaaggtctgcatgcttggtgatgctcagcatgttgaggaggcagagaaaatagggcttgactatatggatgttgaagcactaaaaaagatgaacaaaaacaagaagctggtcaaaaagcttgctaagaagtaccatgctttcctagcatcagaagcaatcattaagcagattcctcgtcttcttggtcctggtctcaacaaagcagggaagtttcccacattggtgacccatcaggaatccctggagtcaaaagttaatgagacaaaagcaatggtgaaatttcagctcaagaaagttttgtgcatgggtgttgctgtgggtaattgtgcaatggaggagaagcagatctttcagaatgtgcaactcagcgttaactttcttgtgtcattgttgaagaagaattggcaaaatgtgaggtgcttgtacctgaagagcacaatgggtaagccgtatcgcgtattttaagtagttctttagcttggctggtaacctgtgaaacagttgtagggaatacttgcttgtcattttatttgttcaggtcttgttgtcaacatctttgagttcttaatccaaagttttgcttcttatggtgttaaggagattttgttacttgagatctcttagaacttctgatggaatgcattattatgaatttcagttcattggttttgattcaaggagtgaaggaattcttcatctatatttactgtaatggtgtagtccgtgggaaggtgtcagaactatattgctgtgtgatttctgtccattgtttttcttagattgcctatactttctgctggagggctacccttggtccaccattttgtaataacttcaaacacgacattaatatggtaaatccctgtttggctgccaaa

SEQ ID NO: 13982 - DNA, 735 bp, Cyclamen graecum
agtttgagcaaaggaaggtgtttcagacatgagcaagcttcagagtgaggccttaagggaggcaattacccagattcgcaatgactcaattgagaaaccgcgcaagttcactgaaaccattgagcttcagatcggactgaagaactatgacccccagaaagacaagcgtttcagtgggtccgttaagctgcctcacatccctcgccctaagatgaaggtttgcatgcttggtgatgctcagcatgtcgaagaggctgagaagttagggttagagtatatggatgtggaaggtttgaagaagcttaacaagaacaagaagcttgttaagaaacttgccaaaaagtaccatgccttcttggcatcagaagctgttatcaagcagattccccgtcttctaggccctggtctgaacaaagcagggaagtttcctactctagtcagtcaccaggaatctctggagtccaaagtcaatgagactaaagcgacagttaagttccaacttaagaaggttctgtgcatgggagttgctgttgggaactgtgtgatggaagagaagcagatcttccaaaatgtgcaaatgagcgttaatttcctagtttctctgttgaagaaaaactggcaaaatgtgcgatgtttgtatttgaagagcaccatggggaagccagtgcgcgtgttttaagtacttgcattatcttagttttgcttagtaactctgcctattttggagaagtgttt

SEQ ID NO: 13983 - DNA, 1185 bp, Mimulus guttatus
attttcgttttttgtcggattttattttccattaaagcaggagtgatttccagaagataagaaggccttgaatcatgagtaagcttcagagtgaggctcttagggaagccattacccagatttctgccgattgtaaggagaagaatcgtaagtttaccgagacaatcgagctccagattggactcaagaactacgacccacagaaagacaagcgtttcagtggctcggttaagttgccacacattcccagacctaaaatgaagatttgcatgcttggagatgcccagcatgttgaagaggccacaaagatcggacttgagtccatggatgttgaggctctcaagaagctaaacaagaacaagaaattggtgaagaagcttgcgaagaaataccatgctttcttagcctccgaagctgttattaaacagattccccgtcttttgggccccggtctcaacaaggcaggtaagttcccgactctggtttctcaccaagaatctctggaagcaaaggtgaacgagacgaaagcaacagtcaagttccaattgaagaaggttctttgcatgggtgttgctgtaggaaacctttccatggaagagaagcagatcttccaaaacgtgcaaatgagcgtcaacttcttagtttcccttttgaagaagaattggcagaatgtgaggtgcctatacctcaagagtactatgggcaaacctcaacgtgtcttctaatcgattaattggagttttgtttcctgtttcacttgggggaaaggttgtaagagagcaaaagttagatttgaatattggaatctttactgtttttgttattttgacattgtgagaaatgaccttatttatggattttgttttattttgcattcatatctttgtttatggtttttgttttctttattattagttatatattaatctggaatagcacctttgctcgaaaattcaactgttttgggcttctgtttttccctattattgatttgttcccatcttttttcatatataatagaattttgataaattaatattcgtgtattaatagagtttggctggtgcaagtattaatttataggggtttaatagtagtacaagataattctacttaatttgttatcaaatgctgatgcatcaaccaaaatatttgatttaatgtaattaaagtttacctacaatt

SEQ ID NO: 13984 - DNA, 862 bp, Arachis hypogaea
attctgcttcacacagacacaggttttagcagctcttgattccacaaaaccctagcttcaaccatgagtaagcttcagagtgatgcgctgagagaagccatcacaggaattgtggctgattcgaaagagaagaataggaagtttgttgagaccattgagctccaaattggactcaaaaactatgatccacaaaaggacaagcgtttcagtggttctgtaaagttgccacacatcccaaggcccaagatgaaaatctgcatgcttggagatgctcagcatgttgaagaggctgagaaaataggattggattggatggatgttgaagcattgaaaaagcttaacaaaaataagaaattggtgaagaaacttgccaagaaatatcatgctttcttggcttctgaagcagtcattaagcagattcctcgtctcttgggtcctggtctcaacaaggcaggaaagtttcccacacttgttacccaccaagaatctctcgagtcaaaagttaacgagacaaaggctatggtcaagtttcagcttaagaaggtgctctgcatgggagtagccgttggcaatgttagtatggaagaaaagcaaatctttcaaaacgtacaactgagtgttaacttccttgtttccctgttgaaaaagaactggcagaacgttaggtgcttgtatctgaagagtaccatgggaaaatcttaccgtgtgttttaagagacttttttttatttgaaattaaaaattctgtgaaattatgatcaagattttgagtatctcaccagcatgacagatattttcatattattaaagttttgtcggatgatttttttgtttattaatattttgttcatggtttggcctc

SEQ ID NO: 13985 - DNA, 879 bp, Arachis hypogaea
ggggggattccgcctctgccagttttagctcttgatcccacaaaaccctagcttcaaccatgagtaagcttcagagtgatgcactgagagaagcaatcactgggatagtggctgattccaaagagaagaataggaagtttgttgagaccattgagctccaaattggactcaaaaactatgacccacaaaaggataagcgtttcagcggttctgtaaagttgccacacatcccgaggcccaagatgaaaatctgcatgcttggtgatgctcagcatgttgaagaggcagagaaaataggattggattggatggatgttgaagcattgaagaagcttaacaaaaataagaaattggtgaagaaacttgcgaagaaatatcatgctttcttggcttctgaagcagtcattaagcagattcctcgtctcttgggtcctggtctcaacaaggcaggaaagttccccacacttgttacccaccaagaatccctcgagtctaaagtcaatgagaccaaggctatggtgaaatttcagcttaagaaggtgctctgcatgggagtagctgtaggcaatgtaagcatggaggaaaagcaaatcttccaaaacgtacaactgagcgttaacttccttgtgtccttgttgaaaaagaactggcagaatgttaggtgcttgtatctgaagagtaccatgggaaaatcctaccgtgtgttttgaaggatcttttatattcagtgaaattgtgattttgcttaatatattaagtagcttaataccttggcagcaattttcatcttgttacagttttgttggatgaaatttttgttagtttctttagttcatggttcttaaaatgtgcttacgaacattggatcctatttttgag

SEQ ID NO: 13986 - DNA, 954 bp, Vigna unguiculata
ggagctagggtttcgcctccgctctgagatctgtagccgcctagccgttgagttggaaaaagaccaagtctcacaatgagtaagcttcagagtgatgctttaagggaggctatcactggaatcatgggtgattccaaagagaagaaccgaaagtttgtggagactattgaactccaaattgggctgaaaaactatgatccccaaaaggacaagcgtttcagtggctctgttaagttgcctcatattcctcgacccaagatgaaaatttgcatgcttggagatgcccaacacgttgaggaggcagagaagataggattggactacatggatgttgaagccttgaagaagcttaacaaaaacaagaaattggtgaaaaagctagctaaaaagtatcatgcgtttttggcctctgaagccgttatcaagcagattcctcgtctcttgggacctggtctcaacaaggcagggaagttccccacacttgtgactcaccaagaatctctggagtcaaaggttaatgagactaaggctatggttaaattccagcttaagaaggtgctctgcatgggagtagccgtggggaatgttagcatggaggaaaagcaaatcttccaaaatgtacaactgagcgttaatttccttgtgtcattgttgaaaaagaactggcagaatgttaggtgcttgtatctgaagagtaccatggggaaatcataccgtgtcttttaagtgtttgttcttaaattcagtgaatttctgatcgcacttgatatattgtcgtgataggttggacaggatttttcattgttctacagttttgttggatgagtattttttggttagtattctgtgttattgacgtgtgtttcaagtgctttgcaagatcggataatttaagcggtgctaattttaaggtacccgtgttttttatttatacaacatgcgcattggcccgtt

SEQ ID NO: 13987 - DNA, 867 bp, Arachis hypogaea
gttttagcagctcttgattccacaaaaccctagcttcaaccatgagtaagcttcagagtgatgcgctgagagaagccatcacaggaattgtggctgattcgaaagagaagaataggaagtttgttgagaccattgagctccaaattggactcaaaaactatgatccacagaaggataagcgtttcagtggttctgtaaagttgccacacatcccaaggcccaagatgaaaatctgcatgcttggtgatgctcagcatgttgaagaggctgagaaaataggattggattggatggatgttgaagcattgaaaaagcttaacaaaaataagaaattggtgaagaaacttgccaagaaatatcatgctttcttggcttctgaagcagtcattaagcagattcctcgtctcttgggtcctggtctcaacaaggcaggaaagtttcccacacttgttacccaccaagaatctctcgagtcaaaagttaatgagacaaaggctatggtcaagtttcagcttaagaaggtgctctgcatgggagtagccgttggcaatgttagtatggaagaaaagcaaatctttcaaaacgtacaactgagtgttaacttccttgtttccctgttgaaaaagaactggcagaacgttaggtgcttgtatctgaagagtaccatgggaaaatcttaccgtgtgttttgagagacttgtttttttatctttgaaattaaaattctgtgaaattatgatcaagattttgagtatctcactagcatgacagatattttcatattattaaagttttgtcggatgagtttttttgtttattaatatttcgttcatggtttggcctaaaaaaaagaaaaaaaacaaaagt

SEQ ID NO: 13988 - DNA, 1081 bp, Glycine max
gaaaagcagaaacaagattgggaatagcagagtcctaaactagtaaacatagttgcaaagcccgtttcaattatttgaaatcaagcccaggcccattctatcagtccaccctatatatttcttcctccagccgcaccaaaccctagctagggtttcagtggtactttctctaatccgaagatattgctatttgattttcctacattttcttctgcttacttcactgattccaattcttactttcttcttctctgcgattttgttcgcaggtgttagatctgtacctgcctagccattgatttggaaaagtccaagcttcaaagatgagtaagcttcagagtgatgctcttagagaagctatctcaggaatcatgactgattccaaggaaaagaacaggaaatttgtggagaccattgaactccaaattgggctgaaaaactatgatccccagaaggacaagcgttttagtggctctgttaagttgcctcacattcctcgccccaagatgaagatttgtatgcttggagatgcccaacacgttgaagaggctgagaagataggattggactacatggatgtcgaggccttgaagaagcttaacaaaaacaagaaattggtgaaaaaactagccaaaaaatatcatgcctttttggcctctgaagcagtcatcaagcagattcctcgtctcttgggacctggtctcaacaaggcagggaagttccctacgcttgtgactcaccaagaatctctcgagtcaaaggttaatgagaccaaggccatggtgaagttccagcttaagaaggtgctttgcatgggagtagccgtggggaatgttagcatggaggaaaagcaaatcttccaaaatgtacaactgagtgttaacttccttgtctctttgttgaaaaagaattggcagaacgttcgctgcctgtatctgaagagtaccatggggaaatcgtaccgtgtcttttgagttgttcttaaattcagtgaatttctgatcgcacctaatatattgtctttcgataggtttgacagaatttttcatcgttctacagttttgttggatgagtatttttt

SEQ ID NO: 13989 - DNA, 1239 bp, Glycine max
gcccattctatcagttcaccctatatacttcttcctccagccgcaccaagccctagctagggtttcagctgtctgctgttagatctgtacccgcctagccattgatttggaaaagtccaacttcaaggatgagtaagcttcagagtgatgctctaagagaagctatctcaggaatcatggctgattccaaggaaaagaacaggaaatttgtggagaccattgaactccaaattgggttgaaaaattatgatccccagaaggacaagcgtttcagtggctctgttaagttgcctcatattcctcgccccaagatgaagatttgtatgcttggagatgcccagcacgttgaggaggctgagaagataggattggactacatggatgttgaggccttgaagaagcttaacaaaaacaaaaagttggtgaaaaaactagccaaaaaatatcatgcctttttagcctctgaagcagtcatcaagcagattcctcgtctcttgggacctggtctcaacaaggcagggaagttccctacacttgtgactcaccaagaatctctcgagtcaaaggttaatgagaccaaggccatggtcaagttccagcttaagaaggttctctgcatgggagtagctgtggggaatgttagcatggaggaaaagcaaatcttccaaaatgtacaactgagtgttaacttccttgtctctttgctgaaaaagaattggcagaacgttcgctgcctatatctgaagagtaccatggggaaatcgtaccgtgtcttttgagtagtggttcttaaaattcagtgaatttctgattgcacttaatatattgtcatgataggttggacagaatttttcatcgttctacagttttgttggatgagtattttttggctagtatttcttgttattgacatttatgtttcaagtgctttgcaacatcggataattttagtggtgctaagtttaagtactcgtgttttaacttgcacaaccccttccgctatgccccttagtaacaactgttgattagggattgaatcagcccttagacccaatcgtgttaaagtaattaggatatgaatttagataagtcttagcgtaattaggatatgaatatgaatttagataaatcttaacgcttaaaaaaatcttaattatggatttaacttaatgtaaatcattccttcaaaaaactctgtaatcgtaaaacaaattcagatgtgtagtagatgaacgtttt

SEQ ID NO: 13990 - DNA, 1104 bp, Daucus carota
ctcttattagggtttattatatactcggccgcgatttatcctttcctctcttgaaccgcctcactcataccagttgcgcaaagaactcgtaattagccatgagtaagctacaaagtgatgcagttagagaagccatcacgcagattactaatgatgcaaaagaaaagggtcgcaagtttactgaaactattgaacttcagatcggacttaagaactatgatccccagaaagacaagcgtttcagtggctcggttaaattgccacacatccccaggcctaagatgaaggtttgcatgcttggtgatgctcagcacgtgggagaggctgagaaaattggtttggagtctatggatgtggaaagcttgaagaaattaaacaagaacaagaaactggtgaagaagcttgccaagaagtaccatgctttcttggcttctgaagctgttatcaaacaaattccacgtcttttgggccctggtctcaacaaggcaggaaagtttcccacactagtgtcccatcaggaatctttggagtcgaaagttaacgagacaaaagcaacagtaaagtttcaacttaagaaggttctctgtatgggagttgctgttggcaactgcagtatggaggataagcagttgttccaaaatgttcaaatgagcgttaactttctggtttctttgctgaagaagaactggcaaaacgtgaggtgcttgtacctgaagagtaccatggggaagccagtgcggatcttttaagaaattaggtttcttaatataagagcagtattcatagactttatactgttatgcttcacatctttttgttctttaagttgtgtatttttccatcaaacaattttgagcttttgatccaattgactttatttagaagttcatatcattctgttctggtgtctgttcatttcgggatccaaaagaagttgtcatattttgtttttccaaccaagttgctgtgtcacttactcatgggtgcgattcaattatattgttaaagtcagaatgaacaatattaaagtttgctgttgtaggcaatttttcttggtacaatttgttcttgatgtaatgtgttccgacagttggttgagaatgc

SEQ ID NO: 13991 - DNA, 1329 bp, Cocos nucifera
gctttcgtgtttgtgtcaacttaatctaaagtgttatatggaattattttataggattatttgggtaatgtgaccaggccgttattgagctatgcccagttgggttactgccttacggcgtccgagtaacccaaatccaacggcggtaattgagcctcaccctaacgacggcgctctggatcaggatcaatttagagatccgcccaaaccctagtatatatcggcgaggcctcgcattctgggtccggttctctcgccgtcttcttcttcccgccgagctctcgactgagcgtagcagtggaagcaaaagaaatccgtcggaaccatgagcaagttacagagtgatgttttgagggaagcaatctctcagatcgcaaatgattctcgggagaagaagcgcaattttactgaaaccattgagctacagattggactaaaaaactatgaccctcaaaaggataagcgtttcagtggatctgtgaagttacctcatatccctcgtccaaaaatgaaggtctgcatgcttggtgatgctcagcatgttgaggaggcagagaaaatagggcttgactatatggatgttgaagcactaaaaaagatgaacaaaaacaagaagctggtcaaaaagcttgctaagaagtaccatgctttcctagcatcagaggcaatcattaagcagattcctcgccttcttggtcctggtctcaacaaagcagggaagtttcccacgttggtgactcatcaagaatccctggaggcaaaagttaatgagacaaaagctatggtgaaatttcagctcaagaaggttctatgcatgggtgttgctgtgggtaactgttcaatggaggaaaagcagatttttcagaatgtgcaactcagtgtcaactttcttgtatcattgttgaaaaagaactggcaaaatgtgaggtgtttgtacctgaagagcaccatggggaagccttaccgagtattctaagctgctctttgcctacattggtaatttgcgggacaagatgtagggaatacttggttttcattttgtttactcgggtcttgttaaatccaaaaattttgttcctttcggtgctagtgacattttggtgtttgatagcttttatgactttctgatggaatgcattatcatgaatttcagttcactggttttgattcaagaacaaaatgtaagaatgttctcttactgtgatgtggtagttttgccagaaggatattagaactctattctgtgtgatttttgtccattgtttatcttacattaccaggggactggactgagggccacttcatggtccaccatttctattaaccgcg

SEQ ID NO: 13992 - DNA, 1092 bp, Cocos nucifera
ggggcctcacctctcccgccgccttctcttctctctccgagctctcggaaggagcgtggaagtgaaagcaggagaaatccaccagaacaatgagcaagttacagagtgacgttttgagggaagcaatctctcagctgacaaatgattctcgggagaagaagcgcaattttactgaaaccattgagctgcagattggtctgaagaactatgacccccaaaaggacaagcgcttcagtggatctgtgaagttacctcacatccctcgtccaaaaatgaaggtttgcatgcttggtgatgctcagcatgttgaggaggcagagaaaatagggcttgactatatggatgttgaagcactaaaaaagatgaacaaaaacaagaagctggtcaaaaagcttgctaagaagtaccatgctttcctagcatcagaagcaatcattaagcagattcctcgtcttcttggtcctggtctcaacaaagcagggaagtttcccacgttggtgactcatcaagaatccctggaggcaaaagttaatgagacaaaagctatggtgaaatttcagctcaagaaggttctatgcatgggtgttgctgtgggtaactgttcaatggaggaaaagcagatttttcagaatgtgcaactcagtgtcaactttcttgtatcattgttgaaaaagaactggcaaaatgtgaggtgtttgtacctgaagagcaccatggggaagccttaccgagtattctaagctgctctttgcctacattggtaatttgcgggacaagatgtagggaatacttggttttcattttgtttactcgggtcttgttaaatccaaaaattttgttcctttcggtgctagtgacattttggtgtttgatagcttttatgactttctgatggaatgcattatcatgaatttcagttcactggttttgattcaagaacaaaatgtaagaatgttctcttactgtgatgtggtagttttgccagaaggatattagaactctattctgtgtgatttttgtccattgtttatcttacattaccaggggactggactgaggccacttcatggtccaccatttctattaaccgcg

SEQ ID NO: 13993 - DNA, 905 bp, Echinochloa colona
tctcttcctctctcgctccgtcgcccgccgcgcgccagaccctgacaagggagttgagtgaccggttgcagccatgagtaagttgcaatccgaggttctgaaggatgccatctcccagatcgttggggatgccaaggagaagaacaggaagttcaccgagacggttgagcttcagattggtctcaagaactacgacccgcaaaaggacaagcgtttcagtggctctgttaagctgccccacatcccccgcccaaaaatgaaggtgtgcatgcttggtgatgcccagcacgttgaggaggctgagaagatgggacttgactgcatggatgttgaggcgctcaagaaaatgaacaagaacaagaagcttgtaaagaagcttgccaagaagtaccatgctttcttagcatcggaggccatcatcaagcagattccccgtctccttggtcctggtctcaacaaggcaggcaagttccctacactggtcagtcaccaggaatctcttgaatccaaggtgaacgagacgaaagctacagtcaaattccagttgaagaaggttctttgcatgggtgttgctgtgggcaacctgtcaatggaggagaagcagatccagcagaacatccagatgagcgtcaacttccttgtgtcccttctgaagaagaactggcagaatgtgaggtgcctgtacatcaagagcactatggggaagccgtacagggtgttctaagtcagtgccctgatcgttgttaagttgataattactaggcactcgaactgatcgtcttaagcttaaacatgttgcacacatcagttttgtgtcttttacattgcgaatgtccaagtatttggtccttaatcctagtgttttttccaatagaacctgtggagagatctcagcttgtgggtct

SEQ ID NO: 13994 - DNA, 934 bp, Echinochloa colona
ctcttcctctctcgctccgtcgcccgcctcgcgccagaccctgacaagggagttgagtgaccggttgcagccatgagtaagttgcaatccgaggttctgaaggatgccatctcccagatcgttggggatgccaaggagaagaacaggaagttcaccgagacggttgagcttcagattggtctcaagaactacgacccgcagaaggataagcgtttcagtggctctgttaagctgccccacatcccccgcccgaagatgaaggtgtgcatgcttggtgatgcccagcacgttgaggaggctgagaagatgggacttgactgcatggatgttgaggcgctcaagaaaatgaacaagaacaagaagcttgtaaagaagcttgccaagaagtaccatgctttcttagcatcggaggccatcatcaagcagattccccgtctccttggtcctggtctcaacaaggcaggcaagttccctacactggtcagtcaccaggaatctcttgaatccaaggtgaacgagacgaaagctacagtcaaattccagttgaagaaggttctttgcatgggtgttgctgtgggcaacctgtcaatggaggagaagcagatccagcagaacatccagatgagcgtcaacttccttgtgtctcttctgaagaagaactggcagaatgtgaggtgcctgtacatcaagagcaccatggggaagccgtacagggtgttctaagtcagtgctgtgatgggtgtgaagttgataattactaggcactcgagctgattcgtcttgagctcaaatatgttgcacacatcagttttgtgcctttacaatgcgaatatcaagtatttggtccttgatcctagtgcttttttcaatagaacctgtggagagatctcagcttgtgggtctatatgcagtctcagttaacatttgctgaact

SEQ ID NO: 13995 - DNA, 1006 bp, Echinochloa colona
ccccttctcttcctctctcgctccgtcgcccgcctcgcgccagaccctgacgagggagttgagtgaccggttgcagccatgagtaagttgcaatccgaggttctgaaggatgccatctcccagatcgttggggatgccaaggagaagaacaggaagttcaccgagacggtcgagcttcagattggtctcaagaactacgacccacagaaggacaagcgtttcagtggctctgttaagctgccccacatcccccgcccaaaaatgaaggtgtgcatgcttggtgatgcccagcacgttgaggaggctgagaagatgggacttgactgcatggatgttgaggcgctcaagaaaatgaacaagaacaagaagcttgtaaagaagcttgccaagaaataccatgctttcttagcatcggaggccatcatcaagcagattccccgtctccttggtcctggtctcaacaaggcaggcaagttccctacactggtcagtcaccaggaatctcttgaatccaaggtgaacgagacgaaagctacagtcaagttccagctgaagaaggttctatgcatgggtgttgctgtgggcaacctgtcgatggaggagaagcagatccagcagaacatccagatgagtgtcaacttcctcgtgtcccttctgaagaagaactggcagaatgtgaggtgcctgtacatcaagagcaccatggggaagccgtacagggtgttctaagtcagtgccgtgatgggtgtgaagttgataattactaggcactcgagctgattcgtcttgagctcaaatatgttgcacacatcagttttgtgcctttacaatgcgaatatcaagtatttggtccttgatcctagtgcttttttcaatagaacctgtggagagatctcagcttgtgggtctatatgcagtctcagttaacatttgctgctccttgccttgcatttacaaattctgcggttttgatgttagtgttataccaactgatatgagatcgttg

SEQ ID NO: 13996 - DNA, 692 bp, Panax ginseng
gttttgaagtctgaagggtgtagaaagtttcaatcatgagtaaacttcagagtgatgcccttagagaagccatcactcagatttctaacgaggccaaggagaaaaagcgtaatttcactgagaccattgaactccagattggtcttaaaaactatgaccctcagaaggataagcgtttcagtggttctgtgaagttgcctcacatccctcgtccgaagatgaaggtttgcatgcttggtgatgctcagcatgtggaagaggctgagaaaattggtctggaatacatggatgtggaaggcctgaagaagcttaacaagaacaagaagttagttaagaaacttgctaagaaataccatgctttccttgcttctgaggctgtcattaagcagattccccgtcttttgggtccagggcttaacaaagcaggtaagttccctacactagttacccaccaggagtccctcgagtctaaagttaatgagacaaaggcgacagtaaagttccaactgaagaaggtgctctgcatgggagttgctgttgggaacctcagtatggaggagaagcaaatcttccaaaatgtgcagatgagtgtgaatttcctggtttcattattgaagaagaattggcaaaatgtcaggtgcttgtacctaaagagcacaatgggaaagactgtccgcatcttttaaggagtt

SEQ ID NO: 13997 - DNA, 891 bp, Panax ginseng
agtggtatcaacgcagagtacatggggactccggcgttttctttcggttttgaagtctgaagggtgtagaaagtttcaatcatgagtaaacttcagagtgatgcccttagagaagccatcactcagatttctaatgaggccaaggagaaaaagcgtaatttcaccgagaccattgaactccagattggtcttaaaaactatgatcctcagaaggataagcgtttcagtggttctgtgaagttgcctcacatccctcgtccgaagatgaaggtttgcatgcttggtgatgctcagcatgtggaagaggctgagaaaattggtctggaatacatggatgtggaaggcctgaagaagcttaacaagaacaagaagttagttaagaaacttgctaagaaataccatgctttccttgcttctgaggctgtcattaagcagattccccgtcttttgggtccagggcttaacaaagcaggtaagttccctacactagttacccaccaggagtccctcgagtctaaagttaatgagacaaaggcaacagtaaagttccaactgaagaaggtgctctgcatgggagttgctgttgggaacctcagtatggaggagaagcaaatcttccaaaatgtgcagatgagtgtgaatttcctggtttcattattgaagaagaattggcaaaatgtcaggtgcttgtacctaaagagcacaatgggaaagactgtccgcatcttttaaggagttgtcttctatttggttgaagctttttagcaaagtcagtgtatgagatgatattttcccaaaaattccctacagtgggcaaattttcttttttcaagttagctgttattcttgatgctattgaacttgataaactacatagtgattgctttgttt

SEQ ID NO: 13998 - DNA, 831 bp, Panax ginseng
tcccctgtgtgccttgcctcccacgacttctttcggttttgaagtctgaagggtgcagaaagtttcaatcatgagtaaacttcagagtgatgcccttagagaagccatcactcagatttctaatgaggccaaggagaaaaagcgtaatttcactgagaccattgaactccagattggtctgaaaaactatgatcctcagaaggataagcgtttcagtggttctgtgaagttgcctcacatccctcgtcctaagatgaaggtttgcatgcttggtgatgctcagcatgtggaagaggctgagaaaattggtctggaatacatggatgtggaaggcctgaagaagcttaacaagaacaagaagttagttaagaaacttgctaagaaataccatgctttccttgcttctgaggccgtcattaagcagattccccgtcttttgggtccggggcttaacaaagcaggtaagttccctacactagttacccaccaggagtccctcgagtctaaagttaatgagacaaaggcgacagtaaagttccaactgaagaaggtgctctgcatgggagttgctgttgggaatctcagtatggaggagaagcaaatcttccaaaatgtgcagatgagtgtgaatttcctggtttcattattgaagaagaattggcaaaatgtcaggtgcttgtacctaaagagcacaatgggaaagactgtccgcatcttttaaggagttttctttttggttgaagctttttagcaaagtcagtgtatgagagatgatattttcccaaaaattccctacagtgggcaaattttctttttttcaagttagctgtt

SEQ ID NO: 13999 - DNA, 1007 bp, Panax ginseng
ggtatcaacgcagagtacatggggctactccggcgttttctttcggttttgaagtctgaagggtgtagaaagtttcaatcatgagtaaacttcagagtgatgcccttagagaagccatcactcagatttctaatgaggccaaggagaaaaagcgtaatttcactgagaccattgaactccagattggtctgaaaaactatgatcctcagaaggataagcgtttcagtggttctgtgaagttgcctcacatccctcgtcctaagatgaaggtttgcatgcttggtgatgctcagcatgtggaagaggctgagaaaattggtctggaatacatggatgtggaaggcctgaagaagcttaacaagaacaagaagttagttaagaaacttgctaagaaataccatgctttccttgcttctgaggccgtcattaagcagattccccgtcttttgggtccagggcttaacaaagcaggtaagttccctacactagttacccaccaggagtccctcgagtctaaagttaatgagacaaaggcgacagtaaagttccaactgaagaaggtgctctgcatgggagttgctgttgggaacctcagtatggaggagaagcaaatcttccaaaatgtgcagatgagtgtgaatttcctggtttcattattgaagaagaattggcaaaatgtcaggtgcttgtacctaaagagcacaatgggaaagactgtccgcatcttttaaggagttctcttctatttggttgaagctttttagcaaagtcagtgtatgagatgatatttttccaaaaattccctaccgtgggcaaattttcttttttcaagttagctgttattcttgatgctattgaacttgataaactacatagtgattgctttgttttgatgttttttgttcggagatgaaccatgatcttgcatttactttacttatgctcactagacaactgtagtcgtgtttttcccgtataatttgttaaacataggtctgattaaaatt

SEQ ID NO: 14000 - DNA, 871 bp, Panax ginseng
cccctgtgtgccttgcctcccacgacttcggttttgaagtctgaagggtgtagaaagtttcaatcatgagtaaacttcagagtgatgcccttagagaagccatcactcagatttctaacgaggccaaggagaaaaagcgtaatttcactgagaccattgaactccagattggtcttaaaaactatgaccctcagaaggataagcgtttcagtggttctgtgaagttgcctcacatccctcgtccgaagatgaaggtttgcatgcttggtgatgctcagcatgtggaagaggctgagaaaattggtctggaatacatggatgtggaaggcctgaagaagcttaacaagaacaagaagttagttaagaaacttgctaagaaataccatgctttccttgcttctgaggctgtcattaagcagattccccgtcttttgggtccagggcttaacaaagcaggtaagttccctacactagttacccaccaggagtccctcgagtctaaagttaatgagacaaaggcgacagtaaagttccaactgaagaaggtgctctgcatgggagttgctgttgggaacctcagtatggaggagaagcaaatcttccaaaatgtgcagatgagtgtgaatttcctggtttcattattgaagaagaattggcaaaatgtcaggtgcttgtacctaaagagcacaatgggaaagactgtccgcatcttttaaggagttctcttctatttggttgaagctttttagcaaagtcagtgtatgagatgatatttttccaaaaattccctaccgtgggcaaattttcttttttcaagttagctgttattcttgatgctattgaacttgataaactacatagtgattgcttt

SEQ ID NO: 14001 - DNA, 890 bp, Panax ginseng
ggttttgaagtctgaagggtgcagaaagtttcaatcatgagtaaacttcagagtgatgcccttagagaagccatcactcagatttctaatgaggccaaggagaaaaagcgtaatttcactgagaccattgaactccagattggtctgaaaaactatgatcctcagaaggataagcgtttcagtggttctgtgaagttgcctcacatccctcgtcctaagatgaaggtttgcatgcttggtgatgctcagcatgtggaagaggctgagaaaattggtctggaatacatggatgtggaaggcctgaagaagcttaacaagaacaagaagttagttaagaaacttgctaagaaataccatgctttccttgcttctgaggccgtcattaagcagattccccgtcttttgggtccggggcttaacaaagcaggtaagttccctacactagttacccaccaggagtccctcgagtctaaagttaatgagacaaaggcgacagtaaagttccaactgaagaaggtgctctgcatgggagttgctgttgggaatctcagtatggaggagaagcaaatcttccaaaatgtgcagatgagtgtgaatttcctggtttcattattgaagaagaattggcaaaatgtcaggtgcttgtacctaaagagcacaatgggaaagactgtccgcatcttttaaggagttgtcttctttttggttgaagctttttagcaaagtcagtgtatgagagatgatattttcccaaaaattccctacagtgggcaaattttcttttttcaagttagctgttattcttgatgctattgaacttgataaactacatagtgattgctttgttttgatgttttttgttggtatgagatattattaatgtctatgag

SEQ ID NO: 14002 - DNA, 941 bp, Lupinus angustifolius
atgaaaccctaactgcttggctgctacgggcgaagggatatttcaaaaccctaaccttcaaccatgagtaagctttcgagtgatgctgtgagagaagctatttctggaatcgtgactgattcaaaggagaagaaccgtaagtttgttgagactattgaactccaaatcggtctcaaaaactatgatcctcaaaaggacaagcgtttcagtggttctgttaagttgccccacatccctcgcccaaagatgaagatttgtatgcttggagatgctcaacacgttgaggaggcagagaagattggattggattatatggatgttgaagccttgaagaagctgaacaaaaataagaagttggtgaaaaagctagctaaaaaataccatgcctttttagcttctgaagcaatcattaagcagattcctcgtctcttgggtcctggtctgaacaaggcaggaaagttccccacacttgtttctcaccaagaatctctggagtccaaagttaatgagacaaaggctatggtcaaatttcagctgaagaaggtgctctgcatgggagtggctgttggtaatgttagcatggaggagaagcaaatcttccaaaatgtgcaactcagtgttaacttcctcgtatccttgttgaaaaagaactggcagaatgtaaggtgcttgtatttgaagagtaccatggggaaatcctaccgtgtcttttaagtggctgttttggtctttttcaaattagttgaaattgttgtttcgctttaatgcactttggttatcttatagctggacaaggaatgttaatcttgctacagttttgttgtttgaattattgttgctggtatttcatgttctttgtgtttcttatatagcccttgcactctctctttttaatttatggattattgatggatcatgttcggtttcactgtttcgatttt

SEQ ID NO: 14003 - DNA, 970 bp, Lupinus angustifolius
ctctctgaataaaatcagagtgtaattcgagaaaccctagcgccgcattcttcccagatttgaagacatcaagcttcaaccatgagtaagctttcgagtgatgctgtgagagaagctatctctggaatcgtggccgattccaaggagaagaaccgtaagtttgttgagactattgaactccaaattggtctcaaaaactatgatcctcaaaaggacaagcgtttcagtggctctgtcaagttgccacacatccctcgcccaaagatgaagatttgcatgcttggtgatgctcaacacgttgaagaggcagagaagataggattggactacatggatgttgaagccttgaagaaactaaataaaaataagaaattggtgaagaaactagctaagaaatatcatgcgtttttagcttctgaagcaatcattaagcagatccctcgtctcttgggtcctggtctcaacaaggcaggaaagttccctacccttgttagtcaccaagaatcactggaatccaaggttaatgaaacaaaggctatggtcaagtttcagctgaagaaagtgctctgtatgggagtagccgttggcaatgtcagtatggaggaaaagcaaatcttccaaaatgtacaactgagcgttaactttctcgtctccttgttgaaaaagaattggcaaaatgttagatgcttgtatctgaagagtaccatgggaaaatcgtaccgtgtcttttaagtggctgtttttagtttccagtgaatttatgattgcacctcatatatttaatatcttattagctagacaagaattttaatgttaacagttttgttggattcagttttggatatgtttgtggtgctattattgacttatcattgtttactttcaacaactccttgttcttcgtcgctgatcttgaaagcatttattctttagtgaatatttgcagagccttttgcttttgtttatctct

SEQ ID NO: 14004 - DNA, 761 bp, Glycine max
gtgttagatctgtacctgcctagccattgatttggaaaagtccaagcttcaaagatgagtaagcttcagagtgatgctcttagagaagctatctcaggaatcatgactgattccaaggaaaagaacaggaaatttgtggagaccattgaactccaaattgggctgaaaaactatgatccccagaaggacaagcgttttagtggctctgttaagttgcctcacattcctcgccccaagatgaagatttgtatgcttggagatgcccaacacgttgaagaggctgagaagataggattggactacatggatgtcgaggccttgaagaagcttaacaaaaacaagaaattggtgaaaaaactagccaaaaaatatcatgcctttttggcctctgaagcagtcatcaagcagattcctcgtctcttgggacctggtctcaacaaggcagggaagttccctacgcttgtgactcaccaagaatctctcgagtcaaaggttaatgagaccaaggccatggtgaagttccagcttaagaaggtgctttgcatgggagtagccgtggggaatgttagcatggaggaaaagcaaatcttccaaaatgtacaactgagtgttaacttccttgtctctttgttgaaaaagaattggcagaacgttcgctgcctgtatctgaagagtaccatggggaaatcgtaccgtgtcttttgagttgttcttaaattcagtgaatttctgatcgcacctaatatattgtctttcgatag

SEQ ID NO: 14005 - DNA, 1026 bp, Panax ginseng
tggtatcaacgcagagtacatggggactccggcgttttctttcggttttgaagtctgaagggtgtagaaagtttcaatcatgagtaaacttcagagtgatgcccttagagaagccatcactcagatttctaatgaggccaaggagaaaaagcgtaatttcactgagaccattgaactccagattggtctgaaaaactatgatcctcagaaggataagcgtttcagtggttctgtgaagttgcctcacatccctcgtcctaagatgaaggtttgcatgcttggtgatgctcagcatgtggaagaggctgagaaaattggtctggaatacatggatgtggaaggcctgaagaagcttaacaagaacaagaagttagttaagaaacttgctaagaaataccatgctttccttgcttctgaggccgtcattaagcagattccccgtcttttgggtccagggcttaacaaagcaggtaagttccctacactagttacccaccaggagtccctcgagtctaaagttaatgagacaaaggcgacagtaaagttccaactgaagaaggtgctctgcatgggagttgctgttgggaatctcagtatggaggagaagcaaatcttccaaaatgtgcagatgagtgtgaatttcctggtttcattattgaagaagaattggcaaaatgtcaggtgcttgtacctaaagagcacaatgggaaagactgtccgcatcttttaaggagttgtcttctttttggttgaagctttttagcaaagtcagtgtatgagagatgatattttcccaaaaattccctacagtgggcaaattttctttttttcaagttagctgttattcttgatgctattgaacttgataaactacatagtgattgctttgttttgatgttttttgttggtatgagatattattaatgtcataaatgggattcccttgaatgttgcaatgccctttgtcatcagtgaacagatgcggtgttattttatccaactgtttctttttggggttcaaaacat

SEQ ID NO: 14006 - DNA, 1376 bp, Glycine max
ctttgagaaagaatcttttgaaataaacaaagcttggggtggaaaagcagtaccaggttgggaatagcagagtccttaactaataaatagagcaaagcccgtttcaattatttgaaatcgggcccagcccattctatcagttcaccctatatacttcttcctccagccgcaccaagccctagctagggtttcagctgtctgctgttagatctgtacccgcctagccattgatttggaaaagtccaacttcaaggatgagtaagcttcagagtgatgctctaagagaagctatctcaggaatcatggctgattccaaggaaaagaacaggaaatttgtggagaccattgaactccaaattgggttgaaaaattatgatccccagaaggacaagcgtttcagtggctctgttaagttgcctcatattcctcgccccaagatgaagatttgtatgcttggagatgcccagcacgttgaggaggctgagaagataggattggactacatggatgttgaggccttgaagaagcttaacaaaaacaaaaagttggtgaaaaaactagccaaaaaatatcatgcctttttagcctctgaagcagtcatcaagcagattcctcgtctcttgggacctggtctcaacaaggcagggaagttccctacacttgtgactcaccaagaatctctcgagtcaaaggttaatgagaccaaggccatggtcaagttccagcttaagaaggttctctgcatgggagtagctgtggggaatgttagcatggaggaaaagcaaatcttccaaaatgtacaactgagtgttaacttccttgtctctttgctgaaaaagaattggcagaacgttcgctgcctatatctgaagagtaccatggggaaatcgtaccgtgtcttttgagtagtggttcttaaaattcagtgaatttctgattgcacttaatatattgtcatgataggttggacagaatttttcatcgttctacagttttgttggatgagtattttttggctagtatttcttgttattgacatttatgtttcaagtgctttgcaacatcggataattttagtggtgctaagtttaagtactcgtgttttaacttgcacaaccccttccgctatgccccttagtaacaactgttgattagggattgaatcagcccttagacccaatcgtgttaaagtaattaggatatgaatttagataagtcttagcgtaattaggatatgaatatgaatttagataaatcttaacgcttaaaaaaatcttaattatggatttaacttaatgtaaatcattccttcaaaaaactctgtaatcgtaaaacaaattcagatgtgtagtagatgaacgttttgataccataac

SEQ ID NO: 14007 - DNA, 1722 bp, Sorghum bicolor
tcttttcctattttacctaccaggatcacgcacatttgttgttgtgtttttacaaaccctatatttaaacatggaaaaatgtccttaagtttctaaaaattccgataaaaattataggtataaattagtatacaacaaattctaataaaatatttagaactcatatatgtagcatcttccaagaaatagatttagctctaggaaaacagaaatatataaatctaaaaatacggaaaattcccaaatcattgtaaccgatgtataaatgcatttttgaaactttccacaacaagaaacataagacaaaaccatcgcaagtgcaaagcatacatgcattcaacattaaaatatgttgcattcatgctaattacatcttatatttttgtcatataaagtttttaaagcctctttatatatcaatcataatgatgttagaatttactatattttttggataccccctcccccatttttgtagagccaagtctatattttttttaaaaacgtttattggattttattaagaaaaatagaatgaaaccacgttcaaatccacttcaacacaggaggtaatttgaatagtcttgaaagtttagaggttaaaatgtttgattttaaagttctatatgaggaaaattcgactataacacattttccttatgtcactattggaagccctgatcagtggcaaagccacaaatatggcccacatacatctggaagaggcccaatggcccaaaacgtccgaatccgcacatccgacggttccaagattaacacgcgtcatccatcgggagctcgttctagggttttgcttcgacaccgctccccgctcatatataaacacccggcgccgccgtttcaattcccttttcgcctcgctccgtcgctcgcctcgggccaaaccctaagcagggagttgtgtgatcggttgcagccatgagtaagttgcagtctgaggttctcaaggatgccatctcccaaatcgttggggatgccaaggagaagaataggaagttcaccgagactgttgaacttcagattggtctgaagaattatgatccacagaaggacaagcgtttcagtggctctgttaagttgccccacatccctcgtccaaagatgaaggtgtgcatgcttggtgatgcccagcacgttgaggaggctgagaagatgggacttgactacatggatgttgagtccctcaagaaaatgaacaagaacaagaagcttgttaagaagcttgctaagaagtaccatgctttcttggcatcagaggctatcatcaagcagattccccgtctccttggccctggtctcaacaaggcaggcaagttccctacgctggtaactcaccaggaatccctggaatccaaggtgaacgagactaaggctacagtcaagtttcagctgaagaaggtcctttgcatgggtgtcgccgtcggtaacttgtccatggaggagaagcagatccagcagaacatccaaatgagcgtcaacttccttgtgtccctcctgaagaagaattggcagaatgtgagatgcctgtacgtcaagagcaccatggggaaaccatacagggtgttctaagtctgctctttgtgaagtcgtctgctctttgtgatattaggcttttgaaccgaggttgtcttgaactgaactcttgttagagtatattttgttggctggatattggagtggtaccaccataagtatccgggc

SEQ ID NO: 14008 - DNA, 1000 bp, Amaranthus tuberculatus
acactactccagtcgcaaaaccctagctatttctctccggtttgcatcgtttctcctgtaaaagatttaatcatgagtaagcttcagagtgatgctctgagagaggcaatttctgggattaaaaatgatgctactgaaaaaggccgcaaatttaccgaaacaattgaacttcagattggtttgaagaactatgatccccaaaaggacaagcgttttagtggttcagttaagttgccacacatccctcgtcccaagatgaaggtttgcatgcttggagatgcacaacatgttgaagaggctgagaggattggtttggagtggatggatgtggaagcattgaaaaagttgaacaagaacaagaagctggtgaagaagcttgcaaagaagtaccatgctttccttgcttctgaagcagtcatcaagcagatccctcgtttgctcggccctggtcttaacaaagcaggaaaattccctactcttgtcactcaccaggagcccttagagaacaaggtgaatgagaccaaagcaacagtgaagttccagctgaagaaggttctctgcatgggtgttgctgttggtaactgcggcatggaggagaaacagatcttccagaacgtgcaaatgagtgtcaacttccttgtttcgctattgaaaaagaactggcaaaatgttcgttgcctatacctgaagagtaccatgggcaagccctaccgtattttctaagtgccttcctgccagttttgcttgatctttggtagctgcatttttgttacatgtgtactagagtattcaaagcattagtatacttggatcatgacttccgttgtaatggtgactatcttcttttttgtttcattgtccttgggcgactttaatgttatacatgatgtgctgatcctatggccatttttggctatttcatgctgagtacaagagaactagttgatcattttttgtcacattacgaaactttgttatgcatgcttgaagccagaaggta

SEQ ID NO: 14009 - DNA, 1048 bp, Musa acuminata
gctcccttcgccgccaaacctcctcttctcctctcgcagaacactcggtttgaggagggaagagaaattcgtctgaacaatgagcaagttacaaagtgatgttctgagagaagcaatctcccaggttgttggtgattctcgggaaaagaaacgcaaattcactgaaacagtagagttgcaaattgggctgaaaaattatgaccctcaaaaagacaagagattcagtgggtctgtgaagttacctcacattcctcgccccaaaatgaaggtttgcatgcttggggatgctcaacatgttgaggaggctgagaagataggactcgactacatggatgttgaaagtttaaaaaagatgaacaaaaataagaagttggttaaaaaactcgctaagaagtaccacgctttcctagcatcagaagctatcatcaaacagattcctcgtctccttggacctggtcttaacaaggcagggaagttccccacgttggttactcaccaggaatctttggaggcaaaagttaatgagacaaaagcaatggtgaaatttcaacttaagaaggttctttgcatgggtgttgcagtgggtaactgtgctatggaggagaagcagatctttcagaatgttcaactcagcgtcaattttcttgtgtctttgctgaagaagaactggcaaaatgtcaggtgcttgtacttgaagagcaccatggggaagccataccgagtattctagttggctccttgctcaggctagtgactgatgaactgaaagatctttgctctctgttacctttcatatttacatctattatcaattttttgttattgagggcaccaaacactgatggagaatttattctgtgtctaaaatcaaatttttgtttattaagaaatagcaaataggtggggatgcaaacacttacaggatattcttattctgcttctaaaagtttggatttaatgcattgttgtggactctcatgattagggcatattatgcattgcatctttgcattatttggacttcttgtcaaaagtttaacaagttgag

SEQ ID NO: 14010 - DNA, 897 bp, Panax ginseng
aagcagtggtatcaacgcagagtacatggggaggcagtcgcaactcgcaaccctaatctagggtttcattccagtatcgaagtcactgaagtcggaagaaagtttcaagcatgagtaaacttcagagtgaagccctgagagaagctatctctcagattactaatgagtccaaagagaaaaagcgtaattttacggagaccattgaactccagattggtctgaagaactatgatccccagaaggataagcgtttcagtggttctgtaaagttgcctcacatccctcgtcctaagatgaaggtttgcatgcttggtgatgctcagcacgtggaagaggcagagaaaattggtttggaatacatggatgtggaaggcctgaagaagcttaacaagaacaagaaattagttaagaaactcgcaaagaaataccatgctttcttagcttccgaagccgtcattaagcagattccccgtcttttgggcccagggctcaacaaagcaggcaagtttcctacacttgttactcaccaggagtcccttgagtctaaagttaatgagaccaaggccacagtaaaatttcaactgaagaaggtactctgcatgggagttgctgtggggaacttgagtatggaggagaaacaaatttttcaaaatgtgcagatgagcgtgaatttcctagtttcattgttgaagaagaactggcaaaatgtcagatgcttgtacctgaagagcacaatggggaagacagtccgcgtcttttagggagtttcctgcttatggttaggcagtgtatgagagtatttttctgaatatttccttgtaatggacaaattttattttccagctgtttatcttgatgctattaagaatattatgaattcaaatatggattattgtg

SEQ ID NO: 14011 - DNA, 971 bp, Panax ginseng
aagcagtggtatcaacgcagagtgcatggaaagcagtggtatcaacgcagagtacatgggaagcagtggtatcaacgcagagtacatggggtaggcagtcgcaaccctaatctagggtttcattccagtatcgaagtcactgaagtaggaagaaagtttcaagcatgagtaaacttcagagtgaagccctgagagaagctatctctcagattactaatgagtccaaagagaaaaagcgtaattttacggagaccattgaactccagattggtctgaagaactatgatccccagaaggataagcgtttcagtggttctgtaaagttgcctcacatccctcgtcctaagatgaaggtttgcatgcttggtgatgctcagcatgtggaagaggcagagaaaattggtttggaatacatggatgtggaaggcctgaagaagcttaacaagaacaagaaattagttaagaaactcgcaaagaaataccatgctttcttagcttctgaagctgtcattaagcagattccccgtcttttgggcccagggctcaacaaagcaggtaagtttcctacacttgttactcaccaggagtcccttgagtctaaagttaatgagaccaaggccacagtaaaatttcaactgaagaaggtactctgcatgggggttgctgtggggaacttgagtatggaggagaaacaaatttttcaaaatgtgcagatgagcgtgaatttcctagtttcattgttgaagaagaactggcaaaatgtcagatgcttgtacctgaagagcacaatggggaagacagtccgcatcttttagggagtttcctgcttttagtcaggcagtgtatgagagtatttttctgaatatttccttgtaatggacaaattttattttccagctagctgtttctcttgatgctattaagaatattatgaattcaaatatggattattgtgactttgtttggagaga

SEQ ID NO: 14012 - DNA, 883 bp, Panax ginseng
cagtatcgaagtcactgaagtcggaagaaagtttcaagcatgagtaaacttcagagtgaagccctgagagaagctatctctcagattactaatgagtccaaagagaaaaagcgtaattttacggagaccattgaactccagattggtctgaagaactatgatccccagaaggataagcgtttcagtggttctgtaaagttgcctcacatccctcgtcctaagatgaaggtttgcatgcttggtgatgctcagcacgtggaagaggcagagaaaattggtttggaatacatggatgtggaaggcctgaagaagcttaacaagaacaagaaattagttaagaaactcgcaaagaaataccatgctttcttagcttctgaagccgtcattaagcagattccccgtcttttgggcccagggctcaacaaagcaggcaagtttcctacacttgttactcaccaggagtcccttgagtctaaagttaatgagaccaaggccacagtaaaatttcaactgaagaaggtactctgcatgggagttgctgtggggaacttgagtatggaggagaaacaaatttttcaaaatgtgcagatgagcgtgaatttcctagtttcattgttgaagaagaactggcaaaatgtcagatgcttgtacctgaagagcacaatggggaagacagtccgcgtcttttagggagtttcctgcttatggttaggcagtgtatgagagtatttttctgaatatttccttgtaatggacaaattttattttccagctgtttatcttgatgctattaagaatattatgaattcaaatatggattattgtgactttttgtttggagagagaatcaatggttatgcacttctgcttgttaaaaaaaaac

SEQ ID NO: 14013 - DNA, 753 bp, Panax ginseng
cgcaaccctaatttagggtttcattccagtatcgaagtcactgaagtcggaagaaagtttcaagcatgagtaaacttcagagtgaagccctgagagaagctatctctcagattactaatgagtccaaagagaaaaagcgtaattttacggagaccattgaactccagattggtctgaagaactatgatccccagaaggataagcgtttcagtggttctgtaaagttgcctcacatccctcgtcctaagatgaaggtttgcatgcttggtgatgctcagcacgtggaagaggcagagaaaattggtttggaatacatggatgtggaaggcctgaagaagcttaacaagaacaagaaattagttaagaaactcgcaaagaaataccatgctttcttagcttctgaagccgtcattaagcagattccccgtcttttgggcccagggctcaacaaagcaggcaagtttcctacacttgttactcaccaggagtcccttgagtctaaagttaatgagaccaaggccacagtaaaatttcaactgaagaaggtactctgcatgggagttgctgtggggaacttgagtatggaggagaaacaaatttttcaaaatgtgcagatgagcgtgaatttcctagtttcattgttgaagaagaactggcaaaatgtcagatgcttgtacctgaagagcacaatggggaagacagtccgcgtcttttagggagtttcctgcttatggttaggcagtgtatgagagt

SEQ ID NO: 14014 - DNA, 896 bp, Panax ginseng
cagtggtatcaacgcagagtacatggggaggcagtcgcaaccctaatctagggtttcattccagtatcgaagtcactgaagtcggaagaaagtttcaagcatgagtaaacttcagagtgaagccctgagagaagctatctctcagattactaatgagtccaaagagaaaaagcgtaattttacggagaccattgaactccagattggtctgaagaactatgatccccagaaggataagcgtttcagtggttctgtaaagttgcctcacatccctcgtcctaagatgaaggtttgcatgcttggtgatgctcagcatgtggaagaggcagagaaaattggtttggaatacatggatgtggaaggcctgaagaagcttaacaagaacaagaaattagttaagaaactcgcaaagaaataccatgctttcttagcttctgaagctgtcattaagcagattccccgtcttttgggcccagggctcaacaaagcaggtaagtttcctacacttgttactcaccaggagtcccttgagtctaaagttaatgagaccaaggccacagtaaaatttcaactgaagaaggtactctgcatgggggttgctgtggggaacttgagtatggaggagaaacaaatttttcaaaatgtgcagatgagcgtgaatttcctagtttcattgttgaagaagaactggcaaaatgtcagatgcttgtacctgaagagcacaatggggaagacagtccgcgtcttttagggagtttcctgcttatggttaggcagtgtatgagagtatttttctgaatatttccttgtaatggacaaattttattttccagctagctgtttctcttgatgctattaagaatattatgaattcaaatatggattattgtgacttt

SEQ ID NO: 14015 - DNA, 806 bp, Panax ginseng
tcgcaaccctaatctagggtttcattccagtatcgaagtcactgaagtcggaagaaagtttcaagcatgagtaaacttcagagtgaagccctgagagaagctatctctcagattactaatgagtccaaagagaaaaagcgtaattttacggagaccattgaactccagattggtctgaagaactatgatccccagaaggataagcgtttcagtggttctgtaaagttgcctcacatccctcgtcctaagatgaaggtttgcatgcttggtgatgctcagcatgtggaagaggcagagaaaattggtttggaatacatggatgtggaaggcctgaagaagcttaacaagaacaagaaattagttaagaaactcgcaaagaaataccatgctttcttagcttctgaagctgtcattaagcagattccccgtcttttgggcccagggctcaacaaagcaggtaagtttcctacacttgttactcaccaggagtcccttgagtctaaagttaatgagaccaaggccacagtaaaatttcaactgaagaaggtactctgcatgggggttgctgtggggaacttgagtatggaggagaaacaaatttttcaaaatgtgcagatgagcgtgaatttcctagtttcattgttgaagaagaactggcaaaatgtcagatgcttgtacctgaagagcacaatggggaagacagtccgcatcttttagggagtttcctgcttttagcaggcagtgtatgagagtatttttctgaatatttccttgtaatggactaaattttatttccagctagctgt

SEQ ID NO: 14016 - DNA, 1029 bp, Olea europaea
cgcaggggagcccagtctaactcaagcgccttctccgctctagggtttataacagcctattttgtcttcaccaaacgacgccgtcaattccgtctaaagaactctaagacttctcgtcagaagtggattgagaagaaatagagatattgcacaatgagtaagcttcagagcgaggccttgagagaagctatctccgtaattgttaccgattctaaggagaaaaatcgtaatttcaccgagacaattgagcttcaaattgggctgaaaaactatgatccccagaaggacaagcgattcagcggctcggtgaaattgcctcacattcctcgccccaagatgaagatttgcatgcttggtgatgctcagcatgttgaggaggcagagaaaataggattggagtccatggatgtggaggctctcaagaagttgaataaaaacaagaagttggttaagaaacttgcaaagaaatatcatgctttcttagcctcggaagctgttatcaagcagattcctcgtctcttaggacctggtcttaacaaggcaggaaagttccctactcttgtgagtcaccaggaatctcttgaatccaaggtcaatgagacgaaggccacagtgaaatttcagcttaagaaggttctttgcatgggagttgctgttggaaatttgggtatggaggagaagcaagtctttcaaaatgtgcaaatgagtgtcaactttctagtttcactgctgaagaaaaattggcagaatgtgagatgcttgtacttgaaaagtactatggggaagccgcagcgtattttttaagaagatatacatctcagccacaactgttttgggagaattgtacgagttcaaataattaaatgtttccaaagaggagttttgaatgtctatcatcttgtttcgtcatgaacgttgtttcccttaatgttgctgggttgaagcttactattattaatcaactgttgctgtttgaaacaattttttccttcaaaaccatgcttagaaatttagtacttgcaatttcta

SEQ ID NO: 14017 - DNA, 1155 bp, Ananas comosus
ttaacgccgcctccctcttccccatcctgcggcttctgggtttctctttctctctcacacacttttctcatatttctcccctctatttcaggtttcggagtcagtagcggacgaataaatcgcaacaatgagcaagttgcaaagtgatgttctgaaggaagcaatctcccaagtcatgggtgactctcgggagaagaaacgcaaatttaccgaaaccatcgagcttcagattgggctgaaaaactacgaccctcaaaaggacaagcggttcagcgggtctgtgaagctgcctcatattcctcgtcccaagatgaaggtctgcatgcttggtgatgcccaacatgttgaagaggcagagaagataggacttgactatatggatgtcgaggggcttaagaaaatgaacaagaacaagaaattggtcaaaaaacttgcaaagaagtaccatgctttcctagcatcagaggctatcatcaagcagattccgcgtcttctgggacctggtctcaacaaggcagggaaattcccgaccctcgtaacacatcaggaatcattggagtccaaagtcaatgaaacaaaagcaacggtgaaattccaactgaagaaagttctctgcatgggtgttgctgtcggtaactgtgcaatggaagagaagcagattcaacagaatgtgcaactcagcgtcaatttcctcgtctccttgttgaagaagaattggcaaaatgtgaggtgcttgtatcttaagagcacaatggggaagccataccgtgtgttctgagttgctgcttgcttaggatggtactttttgtggaaggtctcgataagctaatttactgaggatctagttaaatccgttctagggcgaagttttgttcatttgtcatgcgataaaaatagagtttatttagtccccactgttgctagtgtaatattaatgagtggtgttgtgctacatgtcgaacaaatttgcactatgaacttcagattatttttgcttgttgtgttgtgtgcagtggatgaaagctctctttcttttctgtagcctctatttagtgattactgatgagatttcaagcctcatgcataaggttgctacaggtttaaattatctaaaaaatgattaataatctctgaaaattacttatgatttttaca

SEQ ID NO: 14018 - DNA, 1361 bp, Sorghum bicolor
tctcgctccgtcgctcgcctcgggccaaaccctagcagggagtcgagtgaacggttgcagccatgagtaagttgcagtccgaggttctcaaggatgccatctctcagattgttggggatgccaaggagaagaataggaagttcaccgagactgttgagcttcagattggtctgaagaattatgatccacagaaggacaagcgtttcagtggctctgttaagttgccccacatccctcgtccaaagatgaaggtgtgcatgcttggtgatgcccagcacgttgaggaggctgagaagatgggacttgactacatggatgttgagtccctcaagaaaatgaacaagaacaagaagcttgttaagaagcttgccaagaagtaccatgcgtttttggcatcagaggccatcatcaagcagattccccgtctccttggtcctggtcttaacaaggcaggcaagttccctacgcttgttactcaccaggagtccctggaatccaaggtgaatgagacgaaggctactgtcaagtttcagctgaagaaggtcctctgcatgggtgtcgccgtcggtaacttgtccatggaggagaagcagatccagcagaacatccaaatgagtgtgaacttccttgtgtccctcctgaagaagaactggcagaatgtgagatgcctttacgtcaagagcaccatggggaaaccatacagggtgttctaagcctgctcgatctttgtgaagtctgctgtttatgaattatgatgctaggattttgaaccgaggttgtcttgaactaaaactcttgttagagtatgtttggttggcaggatattggagtggtactaaagcctttgtattctctctctatatatattgcttgaggctcaatataacatgcgtcttataactcatttcttttctaatttcatggtagcatgagtttccaccatggctgctccgccctcggggagattgatcaccatttctaataattaatgcattcataaatatccatgcatacataagtttttgaagtttgatattgtagcactttcgcttgtatttgacaattattgattaactataaactaattaggcttacaagattcgtctcacaagttatagttagttattttttatctatatttattgattcgatgtgatggtaaattttataaattttttgaaccttgggtgcatctaaataataagaccttagtagcgatagttaaatgtccttggctgcataacgttgtgttcatgcattgtaaaaagaaaattaaagatatgtttttttccaaacatttttaaagagctgatacccatggcagaaagtatttttagctgattttttaagaattttttttt

SEQ ID NO: 14019 - DNA, 1524 bp, Ananas comosus
tgattgctagggttttttgctatatctttcgccgtagccgcctcgtaaaaccctcttccgtagattagggtttctctcctcccaggcaaaagagaagtaggggaaatatcttccacagaggagaagaatcatgagcaagttgcagagtgatgcgctgaaagaggccatctctcaggttgttggtgattctcgagagaagaagcgcaagttcacagagactgttgagttgcagattgggctaaaaaactatgaccctcagaaggataagcggttcagcggctctgtgaagttgcctcatatcccacgcccaaagatgaaggtttgcatgcttggcgatgctcagcacgtggaagaggctgaaaaaattgggttggactacatggatgttgaagggctcaaaaagatgaacaaaaataagaagttagtgaagaagcttgccaagaaatatcatgctttcctagcatccgaggctataattaagcagattcctcgacttcttggtcctggactcaacaaggcaggcaaattccccacattggtcacacatcaggaatccttagaggccaaagttaatgagaccaaagcaacggtgaagtttcaactgaagaaggttctttgcatgggagttgctgttgggaattgcggaatggaggagaaacagattcagcaaaatgtgcaactcagtgtcaactttctggtctctctgttgaaaaagaattggcaaaacgtgagatgcttgtacctgaagagcactatgggcaagccgtatcgcgtgttctgagaagcttttgttctgttttgacattcaggatgttggaggggaatactcaaacctctttttcaattccttcatctattcctaggattgcaatttgaagctttaatttctctttcctggatttgattatcttgtttcattctgctagtcagatgcttttgtttttcgttgacatgttgctactcaagtatcaggagtggtttttttttttatcaaaatgtttaatttaagctatgtgatcagaaattggttgtgaaacatcaaattcactagtatttggatttggatttggattgtctctgttgtttattttaaaaaacatatgggtaaaggaagtctcctaatttgtgcccatgaagtatgtgataagtgtcatactgccatgtccagtcttttatacaatatggagatgcttggtccttgggctatttaaaatggtaggacatcataggctaccgtggtgctgtaatacaagcctgttattctagctgtttgaatttgatgttgttatgtttgatgttagcagagcactttgttcaaataattctgttacttgctggtcaatcttgtgcaaattagttctggtttttacgaaatgttagacctttgactctggaaaggaataaaaacggctttcttttgtctacgtaatttgctattcatcgttgacatcatcgttaggtgctcaattttgttcaatgtctaacattaaaaatatttctcatttatctttgactcggggcaga

SEQ ID NO: 14020 - DNA, 1090 bp, Musa acuminata
aaattacaattttacgctctagggttcgaaggaagcgatctgatatcaaggtgacgcgggccaccgttcccctccgccgccgccgtagtcgttccactctcgcagaggtcctggtctgaggcaggcaagagaagctcgtctaaacaatgagcaagttgcagagtgacgtcctgagggaagcaatctcccaggttgttggtgattctcgggagaaaaagcgtaaattcactgaaacagtagagttacaaattgggctgaaaaattatgaccctcaaaaggacaagaggttcagtgggtctgtgaaattaccccatattcctcgtcccaaaatgaaggtgtgcatgcttggggatgctcaacatgtcgaggaggcagagaagataggactggactacatggatgttgaaggtttaaaaaagatgaacaagaataagaagctggttaagaaacttgctaagaagtaccatgctttcctagcatcggaggctatcatcaaacaaatccctcggctccttggacctggtcttaacaaggcagggaagtttcccacattggttactcaccaggaatcattggagtcaaaggttaatgagacaaaagcgatggtgaaatttcaactcaagaaagttctttgcatgggtgttgcagtgggaaattgcgcgatggaggagaagcagatctttcagaatgttcagctcagcgtgaattttcttgtgtccttgctgaagaagaattggcaaaacgtgaggtgcttgtacctgaagagcaccatggggaagccataccgagtgttctaactggctgctggtgatggttgatgaaatggaagttctacgctctttctcacatatttgatttatcaagcagcaatgaagaaaactgagaataccaatcaaaattttgcttatcaagcaatgcagaaagatgggagtgtttgaacaccatcaaagtgtgttcttaatgtcttgacagactttgtgcatctgatgctttcttgtggatttttctggcttctctgtgtattattattccctactgaaccattagtttgtgtgttatcccatgaaagtggaacgatattaactttaca

SEQ ID NO: 14021 - DNA, 941 bp, Musa acuminata
agtgctttggctcacccgtcctcttgctgctgccgccgccgccgtcgccgcctcgcggagttctcggtttgaaggagggacgagatacttatctgaacaatgagcaagctacagagtgatgtcttgagggaagctatttcccaggttgttggcgattctcgggagaagaagcgcaaatttacagaaactgttgagttacaaattgggctgaaaaattatgatcctcaaaaggacaaacgattcagcggatctgtgaagctacctcatattcctcgcccaaaaatgaaagtgtgcatgcttggtgatgctcaacatgttgaggaggcagagaagataggattggattatatggacgttgagagtttgaaaaagatgaacaaaaataagaagttggtaaaaaaacttgctaagaaatatcatgctttcctggcatcagaagctattatcaagcagattcctcgtctccttggccctggtcttaacaaggcagggaaatttcccacattggttacccaccaagaatctttggaggcaaaagttaacgagacaaaggccatggtgaagtttcaactcaaaaaggttctttgcatgggagtagcagtgggcaactgtgcaatggaggagaagcagatctttcagaacgtgcaactcagtgtcaatttccttgtgtctttgctgaagaagaactggcaaaacgtgaggtgcttgtacctgaagagtacaatggggaagccatacagagtattctaattgcgctacttcaaagttacgtgctagaattttgtctatgaagcaagtatggaaagatctgagggtaccaaagccattacagaactgtcttctattgagtctccaatcgaactatttgtttattaagcagtgtcttctactgtgagagacattcttgtttgacttacagtatcatgttttgacttaaattc

SEQ ID NO: 14022 - DNA, 1155 bp, Musa acuminata
atgtctgtatatttacttcaagtccgcagtgttacggcccgacccattcgagatcattatatatccatcatccgccgcccgcttcgtcgtcgtcgctcccgcaactctcggtgagtctgctgcacccgtgtcgtggtccatcttgatgttcctctctaggcttattgcaatctaatctttaatcgcgatctagttcgccgtgtaatcttttctgctgcgtgctagatctgtttgcttcgttcttggtttgaaggagggaagaggctctcgactaaagaatgagcaagttacagagtgatgtcctgagggaagcaatctcccaagttgctggtgattctagggagaagaaacgtaaattcactgaaacagtggagttgcaaattgggctgaaaaattatgatccccaaaaggacaagagattcagtggatctgtgaagctaccccatattcctcgccctaaaatgaaggtttgcatgcttggagatgctcaacatgtggaggaggcagagaagataggacttgactacatggatgtggaaggcttaaaaaagatgaacaaaaacaaaaagttggttaaaaaacttgcaaagaagtaccatgcttttcttgcatcagaggctattatcaaacagatccctcgtctccttggccctggtcttaacaaggcagggaagtttcctacattggttactcaccaggaatctttggagtctaaggttaacgagacaaaagcaatggtaaaatttcaacttaagaaagttctttgcatgggagttgctgtgggcaactgtgcgatggaggagaagcagatctttcagaatgtgcagctcagcgtgaatttccttgtgtctttgttgaagaagaactggcaaaatgtcaggtgcttgtacctgaagagcaccatgggaaagccgtatcgagtgttctaagcagctcctttgcctcggctggtgacggatgaaatagattgttgctgtcgcattcccttttcttttgtttatcaagcagtatggaaggactgagggtattaagcactttcgaagatcctatttcgtcattttaatcaaaattttgttatttgagcactgtggacggagggtgtcaacacctgcaaattagttggtttctgttgttatggaagagacggttcaccaa

SEQ ID NO: 14023 - DNA, 934 bp, Cryptomeria japonica
gagcgccgccgaacccacccccccccccccgcacgacccttgtgcatgagtaagcttcagagcgatgtgttgagggaggccataacaggtttggtgggagagagcaaagagaagaatagaaaatttgtggagacgattgaattgcaaattgggctgaagaattatgatcctcagaaggataagcgtttcagcggctcagtcaaactcccccacatccctcgtcccaagatgaagctctgtatgctcggtgatgcccaacatgttgaagaggccgagaaaataggattggactacatggatgtcgaaggattaaagaaaatgaacaaaaacaagaaattggttaagaagcttgccaagaaatatcatgcttttcttgcatcagaagcaattatcaagcagattcctagacttcttggacctggtctaaacaaggctggtaagttccccactttggtgtcacatcaagagtcattggagggaaaagtaaatgaaacaaaagccactatcaagttccaattgaagaaagttctgtgtatgggtgttgctgtgggtaactgtggcatggacgaaaagcaaatattccagaatgttcagttgagtgttaactttctggtgtccttgctcaagaaaaactggcaaaatgtacgttgtctctatctgaagagcaccatgggaaagccgtctcgggtattctaaatgaacagtttagtcagcttttgcacaatgaacattgatggaatatgttttgttttgttggtatagggtagggtgtttagacaatttattctataatgcaaaattgcatttgatttgaatataacatttttcagaggcatatgttgaccaataggcaggctcttatttatgttgtaactgagggagattctatttttgatgcacaattgctttaatgattgatgtcatgtcctttttc

SEQ ID NO: 14024 - DNA, 976 bp, Phaseolus vulgaris
agttagggttatcgacttcaggtatttacactctgaacgtttgccactgggtttttgtttctctttgttctgctccgctagataaccattttgtctgtgtgattcttttcttcacagcgctgtgagagatccttagtcgctgattgaaaaagatgagtaagcttcagagtgatgccttgcgagaagctatcactggaatcatggccgattccaaggagaagaatcgcaaatttgtggagactatcgaactccagattgggctgaaaaactacgatccacaaaaggacaagcgtttcagcggctctgtcaagttgccccacattcctcgccccaagatgaaaatttgcatgcttggtgatgcacaacatgtcgaagaggccgagaagataggtctggactggatggatgtggaagccttgaagaagcttaacaagaataagaagttggtgaagaagctagctaagaagtaccatgcctttttagcttctgaagcagttattaagcagattccacgtctgttgggtcctggtctaaacaaagcaggaaagttccctacacttgttactcaccaggaaactcttgagtctaaagtaaatgagtctaaggctatggtcaaatttcaactcaagaaggtgctctgcatgggagtagccgtgggcaatgtcagcatggaggagaaacaaatcttccaaaatgttcaactgagtgttaacttcctagtatccttgttgaaaaagaactggcaaaatgttaggtgcttgtatctgaagagtaccatggggaaatcttaccgcgtcttttgagcgatatctatttttattttggtgaatttgttatggcccataatacatttatcttaatagctagatgcaaattttcatcttgttacagttttgtgggtttgacttttattgttttcgtgttcatgttcaaacatttgataatgatatgggttatttttggctcttctttctta

SEQ ID NO: 14025 - DNA, 851 bp, Vigna unguiculata
cagcgttttgagatccttatccgctgattggaaaagatgagtaagcttcagagtgatgccttgcgagaagctatcactggaatcatggccgattccaaggagaagaatcgcaaatttgtggagactattgaactccagattgggctgaaaaactacgatccacaaaaggacaagcgtttcagtggctctgtcaagttgccccacattcctcgccccaagatgaaaatctgcatgcttggtgatgcacaacatgtcgaagaggccgagaagatcgggctggactggatggatgtggaagccttgaagaagctaaacaagaataagaagttggtgaagaaactagctaaaaagtaccatgcctttttagcttctgaagcagttatcaagcagattccacgtctgttgggtcctggtctaaacaaggcaggaaaattccctacacttgttactcaccaggaaactcttgagtcaaaggtaaacgagtctaaggctatggtcaaatttcaactcaagaaggtgctctgcatgggagtagccgtgggcaatgtcagtatggaggaaaaacaaattttccaaaatgttcaactcagtgttaacttcctggtatccttattgaaaaagaactggcaaaatgttaggtgcttgtatctgaagagtaccatgggaaaatcttaccgcgtcttttgagggatatctattttttatttggttaatgttatggcgcatgatacatttatctcaatagctagatgcaaattttcatcttgatacagttttgcgagttggacctttgttgttagtgttttgtgttcatgttcagacatttgataatgatatgcgttaaattttgc

SEQ ID NO: 14026 - DNA, 991 bp, Solanum lycopersicum
agcaagacccaacaagcccattgagaacttagctttaaccctcaacttctttgccaccactccgccgctcactcaatttgcagagacgattcttcccattctactttgagccatgagtaagcttcagagtgatgccttaagagaagccatcaccgtgattaagaatgattcaagtgagaagaaaaggaagttcaccgaaaccattgagcttcagattggtttgaaaaactatgatcctcaaaaggacaagcgtttcagtggttcagttaagttgccacacattcctcgccccaagatgaagatttgcatgcttggagatgctcagcacgtgggagaggcagaaaagattggtttggagtacatggacgtggaaggtctgaagaagcttaataaaaacaagaagttggttaagaagctcgcaaagaagtaccatgctttcttggcatcagaagctgttatcaagcagatcccccgtctcttggggcctggtttgaacaaggcaggtaagtttcctacccttgtttcccaccaggaatcactcgagtctaaggtaaacgagaccaaggccactatcaaattccagttgaagaaggttctttgcatgggagttgccgtaggtaatatggatatggaggagaaacaaatcttccagaacgtgcagatgagtgtcaactttctcgtgtccttgctaaagaagaattggcaaaatgtgagatgcttgtacttgaagagtaccatgggaaagactcaacgcatcttctaaggacattgtattacaatctttgcagtttcaggcgttttgacttgtacgcgttatagatactattgcattttttgtttagttgtgctccttggatactgagttgaaaactttatatcagttttgttatgattttactttttcttttctcctttctgttgattttcttgaatattgtcaactttcatatctaaaggaaaactcaaattttgtggtttaactgctattaaa

SEQ ID NO: 14027 - DNA, 765 bp, Musa acuminata
cggtagggctttcctccacccggaaccctcgcggaggctggtggtcagtcttctacacttcgcttcctgatccgcttctggtggatcgaaggaagaaagagagacatctgagcaatgagcaaattacagagtgatgtcctgagggaagcaatctcccaggttgttggtgattctcgggagaagaaacggaaattcaccgagacagtcgagttgcaaattggtctgaaaaattatgatcctcagaaggacaagcgttttagtgggtctgtaaagcttcctcatattcctcgccctaaaatgaaagtatgcatgttgggagatgctcaacatgtcgaggaggcagagaagatagggctagattatatggatgttgaaagtttgaaaaagatgaacaaaaataagaagctggttaagaaacttgctaaaaagcaccacgctttcctggcatcagaggctatcatcaaacagattcctcgtcttcttggccctggtctgaacaaggcagggaaatttcccactttggtcactcaccaagaatctttagagtcaaaagttaatgagacaaaagcaatggtaaagtttcaactcaagaaagttctttgcatgggtgttgcagtgggtaactgtgcaatggaggagaagcagatctttcagaatgtgcaactcagcgtgaatttccttgtctctttgctgaaaaagaactggcaaaatgtgagatgcttgtacctgaagagcaccatggggaagccataccgagtgttctaa

SEQ ID NO: 14028 - DNA, 934 bp, Olea europaea
tttcactcattttgccccgaaaataaaccagcaacgccgctgtccgtctggcgaaccctgattctcctctttagaagtggactgagaagaaatagagatattgaacaatgagtaagcttcagagcgaggccctgagagaagcgatctctgtaattgttaccgattctaaggagaaaaaacgtaatttcactgagacgattgagcttcaaattgggctgaaaaattatgatccccagaaggataagcgattcagtggctcggtgaagttgcctcacatccctcgccccaagatgaagatttgcatgcttggtgatgctcagcacgttgaggaggcagaaaaaataggattggagtccatggatgtggaggctctcaagaagttgaacaaaaacaagaagttggttaagaaacttgcaaagaaatatcatgctttcttggcctcagaagctgttatcaagcagattccacgtcttttaggacctggtcttaacaaggcaggaaagttccccacccttgtgtcacaccaggaatctcttgaatctaaggtcaatgagacgaaggccacagtgaaatttcaattgaagaaggttctttgcatgggagttgctgttggaaatttgggtatggaggagaagcagatctttcaaaatgtgcaaatgagtgtcaactttctagtttcactgctgaagaaaaattggcagaatgtcagatgcttgtacttgaagagtacaatggggaagcctcagcggatcttttaagatgtatgtttctacgccgctgtttagggaagaattttgcgagcgtaaacaataaaatatttccagagaatcggagttttgaatttctatcgtcctgtttttatcatgaacattgctttccatactcttgtcaggtcgaagcttactgctcttaatcaactatttctgttagaaac

SEQ ID NO: 14029 - DNA, 1517 bp, Cicer arietinum
tgttgggcttgtccagtacagaaaaatactggcccatccaaaatcgtccatcttataagtactttgctctgccgcctgaaaaccctctctagggtttctcagatcgattggcgtttccagaggccaactatccaatatgagtaagcttcagagtgatgctttgagagaagccatctcaggaatcacggctgattccaaggagaaaaacaggaaatttgtggagactattgaactccagattggtcttaaaaactatgatccacaaaaggataagcgtttcagtggttctgttaaattgcctcacattcctcgtcccaagatgaaaatctgtatgcttggagacgctcagcatgttgaggaggcagagaaaataggattggactggatggatgttgaagctttgaagaagctaaacaaaaataagaaattggtgaagaaacttgcaaagaagtaccatgcctttttagcttctgaagctgtcatcaagcagattcctcgtctcctgggtcctggtctcaacaaggcaggaaagttccctgcccttgtttcccaccaagaatctctcgagtctaaggtcaatgagactaaggctatggtcaaattccagcttaaaaaagtgctctgcatgggagtagctgttggcaatgtcagtatggatgaaaaacaaattttccaaaatgtacaactgagtgttaacttccttgtctccttgttgaaaaagaactggcaaaatgttaggtgtttgtatctgaagagttccatgggcaaatcttaccgtgtcttttaaagggtttcgaaatcgagtgaatttgggattgctcttggtattttggtcattttagtaactgagacaggagttctcttctatctacagttttgttggactatattttgtcgttagtatttgtgttatttactgtattgcttagcaacttcgggcccttgtttttacatatacagctttttgactacttctctcatgatgcatattttttatgactacttctctatatctaagtctatagaaagcacttcccgattgtccaattagcagcttattacatgtcaatgtataatctgcatttcgtagagctttaacttgggaggaaaatagtgttttataataatttaaggtatcatagattctattgagatacttgtctacttcgacttggaaaagcttcaaaatgcgtctaatttgaacccagtgtgttatcgtaatgtttcatcaaaaaaagttatccttcattaaatggtccttcccttgtttcatcaaaaaaattgatactacctactttttcctatacgcccccagtcactcaaaatggcttatgatttttgtgagttgataattggatccttgaatttatatcatgaaagttaataattttcatctcttaatttttattgttaaaagattattatgttgacaggattctctctctttgaacttacattattatcatcacacgtgagactgttttgattaaaaaattaaaatctctgtaagacaaatt

SEQ ID NO: 14030 - DNA, 1233 bp, Cicer arietinum
aaataagcccattaagagggagtattgggcctgaaatctcaacccattaattcaatattggctatctcatacattgcactgtcagccgcaaaaaatcctgtctagggtttttttctcatttcggtaatttgtcaactcagaattgttatatttggattttctcatactaatttgtgtttttgttacatcaaattttattcaccgtttgaagaggcaatgagtaagcttcagagtgatgctttgagggaagcaatctcaggaatcacggctgattccaaggagaaaaaccgtaaatttgtggagactattgaactccagattggtcttaaaaactatgatccacaaaaggataagcgtttcagtggttctgttaaattgcctcacatccctcgacccaagatgaaaatctgcatgcttggtgatgctcagcatgttgaggaggcagagaaaatcggactggactggatggatgtagaagccttaaagaagctcaacaaaaataagaaactggtgaagaaacttgcaaagaaataccatgcctttttagcttctgaagctgtcatcaagcagattcctcgtcttttgggtcctggtctcaacaaggcaggaaagttccctgcacttgtttcccaccaagaatctcttgagtctaaggtaaatgagaccaaggctatggtcaaattccaacttaagaaagtgctctgcatgggagtagctgtcggcaatatcagtatggatgaaaaacaaatcttccaaaatgtacaactgagtgttaacttcctcgtctctttgttgaaaaagaactggcaaaatgttaggtgcttgtatctgaagagttccatgggcaaatcttaccgtgtcttttaaagggttgtttttaattatgcgaatttggtattgcgcctaatatattggatattttaacagctgggacaagagttctcttctttttacagttttgttggttgagattatgtcgttagtattctgtgtttttgactggtgtttaattgcttagcaactttgcataatgttagggatgctaaatttaattccccagtttatttatacagctttttacccacttctcctgtgatgcatattatgacgatttctatctatgtctatggtaaaaatatcatgattgtacaatcagcaattaattacatttcaatttataggtctacttctacttgagttagctttcaaaatgaatatagtttgaccaaaaat

SEQ ID NO: 14031 - DNA, 922 bp, Panax ginseng
ttttgctgcagcctcaaatcctactccggcgttttctttcggttttgaagtctgaagggtgtagaaagtttcaatcatgagtaaacttcagagtgatgcccttagagaagccatcactcagatttctaacgaggccaaggagaaaaagcgtaatttcactgagaccattgaactccagattggtcttaaaaactatgaccctcagaaggataagcgtttcagtggttctgtgaagttgcctcacatccctcgtccgaagatgaaggtttgcatgcttggtgatgctcagcatgtggaagaggctgagaaaattggtctggaatacatggatgtggaaggcctgaagaagcttaacaagaacaagaagttagttaagaaacttgctaagaaataccatgctttccttgcttctgaggctgtcattaagcagacttccccgtcttttgggtccagggcttaacaaagcaggtaagttccctacactacgttacccaccaggagtccctcgagtcctaaagttaatgagacaaaggcgacagtaaagttccaactgaagaaggtgctctgcatgggagttgctgttgggaacctcagtatggaggagaagcaaatccttccaaaatgtgcagatgagtgtgaatttcctggtttcattattgaagaagaattggcaaaatgtcaggtgcttgtacctaaagagcacaatgggaaagactgtccgcatcttttaaggagttgtcttctttttggttgaagctttttagcaaagtcagtgtatgagagatgatattttcccaaaaattccctacagtgggcaaattttctttttttcaagttagctgttattcttgatgctattgaacttgataaactacatagtgattgctttgttttgatgttttttgttggtatgagatattat

SEQ ID NO: 14032 - DNA, 892 bp, Rosmarinus officinalis
cggccggggatccatgcatttggcataaacatcgccgcggccaccagtcccccgccctcccatccgctggtactctactggagcagaattcaggggtgaagagcttcggagattttaaatcatgagtaagcttcagagtgatgcccttcgggaagccatttctcagattaagaatgatgctgctgttaaaaagcgcaactttaccgagacagttgagcttcagattggactgaaaaattatgatccccagaaggacaaacgtttcagtggctctgtgaagttacctcacattcctcgcccaaagatgaaagtttgcatgctcggagatgctcagcacgttgaggaggctgaaaagattggtctggaatacatggatgtggaaagtttgaagaagcttaacaaaaacaagaaattggtgaagaagcttgcaaaaaagtatcatgctttcttggcttcagaagctgtgatcaagcagattccccgtctcttagggcctggtcttaacaaagcaggcaaattccctacccttgtcacgcaccaggaatcacttgaatctaaagttaatgagaccaaggctacagtgaagtttcaattgaagaaagtgctttgcatgggagttgcagtcgggaattgcgccatggaggaaaagcagatctttcaaaatgtgcagatgagtgtgaatttccttgtttccttgttgaagaagaattggcagaatgttcggtgcttgtacctgaagagtacaatggggaagccacagcgcatcttctaaggggagagcttcctccttgttgctaccgtgttgatgagttttataatgagctatgcatctaatgtaccatctttcggtatgatggcaattttgctacgttagggagtatctggtgattgt

SEQ ID NO: 14033 - DNA, 830 bp, Glycine max
tttttttttctttgttcacagctctgcgagatcttcattcgccgattttaaaagatgagtaagcttcagagtgatgctttgcgtgaagccatttcaggaatcatggccgattccaaggagaagaatcgcaaatttgtggagaccatcgaactccaaatcgggttgaaaaactacgatccacagaaggacaagcgtttcagtggctctgtcaagctgccccacatccctcgccccaagatgaaaatttgcatgcttggtgatgctcagcatgttgaagaggcggagaagataggactggactggatggatgtggaagccctgaagaagctaaacaaaaataagaagttggtgaagaaactagctaaaaagtaccatgcctttttagcttctgaagcagtcattaagcagattcctcgtcttttgggtcctggtctcaacaaggcaggaaagttccctacacttgttactcaccaggaaactcttgagtcaaaggttaacgagtccaaggccatggttaaatttcaacttaagaaggtgctctgcatgggagtagctgtggggaatgttagtatggaggaaaagcaaatcttccaaaatgttcaactgagtgttaatttccttgtctctttgttgaaaaagaactggcaaaatgtcaggtgcttgtatctgaagagtacaatggggaaatcttaccgtgtcttttgaggaattttttttttaatccggtgaatttgtgatcgcgcttgatacattgattatcttaatagctagatacaaactatcatcttgttacagttttgttggctggatttttatgttagtgtttcgtg

SEQ ID NO: 14034 - DNA, 940 bp, Vaccinium corymbosum
cagtcataagtctgaagaagagacaaagttcgagccatgagtaagcttcagagtgatgccttgagggaagccatcactcagattgctaaagacgcgagggagaagaaacgcaatttcactgaatcaattgagctccaaattgggctgaagaactatgatccccaaaaggataagcgtttcagtggttcggtgaagttgcctcacattccacgtcccagaatgaaagtttgcatgcttggtgatgctcagcacgtggaagaggctgagaagataggtttggagtatatggatgtggaaggtctgaagaaacttaacaaaaacaagaaactggtgaagaaactcgcaaagaaataccatgccttcttagcctcggaagctgtcattaagcagattccccgtctactgggccctggtctcaacaaagcagggaagtttcctacccttgttagtcaccaggaatccctggagtctaaagttaatgagaccaaagctactgtgaagttccaactgaagaaggttctctgcatgggagttgctgttgggaactgcagtatggaggaaaagcagatgtttcaaaatgtgcaaatgagtgtcaatttcctagtttcattgttgaagaagaactggcaaaatgtgaggtgcttgtacctgaagagtaccatggggaagagggttcgcatcttttaaagagtttctttgcttgggctctttagtgaaggatttattggtgatcaaatgcttgaaaaagattttccaggatttagcaattcaccctttttggtagtcgttgacatacacttttttcttgaatttcataaacctaagaatgttttcgatgttatttcaaggagatgtttaactataaatccttaatttgcttgttttactagtttggatgaatgatctcttttgatgtgatacaaatgcaaccgtaatattt

SEQ ID NO: 14035 - DNA, 993 bp, Vaccinium corymbosum
ggtctctctcagctcaatcgtcggccattacaaaccctaatctagggttttctcctcagttagtaagtttgaagcaagggaaatttttcagctatgagtaagcttcagagcgaagtcttgagggaagcaatcactcagattggcaatgatgtcaaggagaaaaaacgcaacttcactgaaaccattgagctccagattgggctgaaaaattatgatcctcagaaggataagcgtttcagtggttccgttaagttgcctcacattcctcgtcccaaaatgaaggtttgcatgcttggtgatgctcagcacgtggaagaggctgaaaagataggcttggagtatatggatgtggaagggctgaaaaagcttaacaaaaacaagaaactggttaagaaacttgctaagaaataccatgccttcttagcttcagaagctgtcatcaagcagattccccgtctattaggacctggtctcaacaaagcagggaagtttcccacccttgtctctcaccaagagtccctcgagtctaaagtcaatgagactaaagccacagtgaagtttcaactgaagaaggttctctgcatgggggtagctgttggcaactgcagtatggaggataagcagatctttcaaaatgttcaaatgagtgtgaactttctagtttcgttgttgaagaagaactggcaaaatgttaggtgcttgtatctcaagagtaccatggggaagccaatccgcatcttctaagaaggcaattatttgagctgttctactgaggaattttgtttgatcaaattcaagaagttattcctgtatcgatctccagtttggattcttcttttcttttttgttctccagtttggattcttcttgaataccatcaaaactttgtaatgctttgttttctagtatattttttgacggcgaaaaatcttatatcatctatttgtgacagttaaacatcttcacctttgatagttaaatggttgaactgca

SEQ ID NO: 14036 - DNA, 918 bp, Setaria italica
ctcgctcgctcggtcgcccgccgcgcgccagaccctaacaagggagctgagtgaccggttgcagccatgagtaagttgcaatctgaggttctcaaggaggccatctcccagatcgttggggattccaaggagaagaataggaagttcaccgagacagttgagcttcagattggtctgaagaactatgacccgcagaaggacaagcgtttcagtggctccgttaagctgccccacatcccccgccccaagatgaaggtgtgcatgcttggtgatgcccagcatgttgaggaggctgagaagattggacttgactacatggatgttgaggctctgaagaagatgaacaagaacaagaagcttgtcaagaagcttgccaagaagtaccatgctttcttagcatcagaggccatcatcaagcagattccccgtctccttggtcctggtctcaacaaggcaggcaagttccctacactggttacccaccaggagtctcttgaatccaaggtgaacgagacgaaagctacagtcaagttccagctgaagaaggttctttgcatgggtgttgctgttggtaacctgtcgatggaggagaagcagatccagcagaacatccagatgagcgtcaacttccttgtgtcccttctgaagaagaattggcagaatgtgaggtgcctgtacatcaagagcactatggggaagccgtacagggtgttctaagtcttgccgtgatccttgtgaagttgataaaaaatactaggacgtcgaactgggcttgtcttaaacttagatatgtacccatcagttttgtgcctgtcaatgagaatgtcgaagtatctggtccaatctagtgtttcctttaatagaacatgtggaggaatgccttttgggattatgcagtcgcagcttgtgttatggttc

SEQ ID NO: 14037 - DNA, 906 bp, Lupinus angustifolius
aaacaaaccctacctcccttctattgctgcttcttctccaactatgagtaagctttcgagtgatgctgttagagaagctatctctggaatcgttactgattccaaggagaataatcgtaagtttgttgaaactattgaactccaaattggtctcaaaaactacgatcctcaaaaggataagcgtttcagcggttctgttaagttacctcatattcctcgtccaaagatgaagatttgtatgcttggtgatgctcaacatgttgaagaggcagagaagataggattagactacatggatgttgaagcgttgaagaagctgaacaagaataagaagttggtgaagaagcttgctaagaaataccatgcctttttagcttctgaagctgtcattaagcagatcccacgtctcttgggccctggtctcaacaaggcaggaaagttccccacacttgtttctcaccaagaatctctggagtcaaaagtgaatgagacaaaggctatggtgaagtttcagcttaagaaggtgctatgcatgggagttgctgtcggcaatgtcagtatggaggagaagcaaatcttccaaaacgtacaactcagtgttaacttcctagtatccttgttgaaaaagaactggcagaatgtcaggtgtttgtatttgaagagtaccatggggaaatcctaccgtgtcttttgagggattatttttcatttcaaatcactgaaactgtggtctctcttttatttgctggacaagtaatcttaatcttgctacagttttgtatgaatttttgttgcctgttatttcatgttcttggtttttggttgacaattagctacacatgtttacctcaaccccgtactcttctttgcccttttatgtattggattgatgaatgatgttataag

SEQ ID NO: 14038 - DNA, 1749 bp, Ananas comosus
aacccggctcgagtcagggccatctagggtttcaatcgcctctcactctccgcgcgcgaccactctctccttaacgccgcctccctcttccccatcctgcggcttctgggtttctctttctctctcacacacttttctcatatttctcccctctatttcaggtttcggagtcagtagaggacgaatatctcgcaacaatgagcaagttgcaaagtgatgttctgaaggaagcaatctcccaagtcatgggtgactctcgggagaagaaacgcaaatttaccgaaaccatcgagcttcagattgggctgaaaaactacgaccctcaaaaggacaagcggttcagcgggtctgtgaagctgcctcatattcctcgtcccaagatgaaggtctgcatgcttggtgatgcccaacatgttgaagaggcagagaagattgggcttgattatatggatgttgaggggctaaagaagatgaacaagaacaagaagttggtcaaaaagctcgcaaagaagtaccatgctttcttagcatcagaggccatcatcaagcagattccgcgtcttctgggacctggtctcaacaaggcagggaaatttccgaccctcgtaactcatcaggaatctctagagtccaaagtcaatgaaacaaaagcaacggtgaaattccaactcaagaaagttctctgcataggtgttgctgtcggtaactgcgcaatggaggagaagcagattcaacagaatgtgcaactcagcgtcaatttccttgtctccttgttgaagaagaattggcaaaatgtgaggtgtttgtatcttaagagcacaatggggaagccttaccgggtgttctaagttgttgcttgcttaagctggtacttcttgtgagggtcttgaaaaactgatctggtgaggatttaagttaaatccatttctatattgaattcttgttcatttattatgtgagacctcctgcaattttgcactatgaactcgagactatttttcgatgttatgtctcatgtgatgtggagaaatgcttctttctctttgtgttgttactagtttagatgggatttttgcctcttatatctgtataaggttgctacaggttttaatgttaccctcctcctggggcttttttccctgtctcaagtcacgtgaatggttatgtttgtggtgggaatcatcaaaatatcgaggaatgaataactgacctatccactctaccgttgggaccaatgagtctattgtcaggttcaaaaattatatgccctataggtctctgaatgaaaataatagttgatgcagttgttttgggacagtggaactttagcgcaagtacttttgagtagcagttattggagaatcaaattctagcttcttggcacaatagctaagcatgcttggtcaaaattgtttctgatgctaattagaaaacttgcggagaacaatgtatatcatgttaatttagtttgaatgtttatgcattatttgttgccaaatgaatctgtagttatgtttctaatttttgttataaattgtgattgatggattacttgtgagaattttcgtactttatttgtgattaaacaaagttttgtttgacagctgataatttttaaaatttttggctgaactattgaacttttgctgaaccatgcagaaatgtaccaaaatgtaccatattatttattatcagccaatcatatttctaattttgaaagaaacgtataataagtatatttttaaaaaa

SEQ ID NO: 14039 - DNA, 1174 bp, Panicum virgatum
cgcctggacacgcggcgtccatcgggagctcgctctagggttttctgtcgtctcgctcccaccgctgctcatataactcccgccgccgccgcctcccatccgcttctctttctcgccagccccgcgccgaaccctaaccaaagggtgttgagttgagtcaccggttgcagccatgagtaagttgcaatctgaggctctcaaggatgccatctcccagatagttggggatgccaaggagaagaataggaagttcaccgagaccgttgagcttcagattggcctgaagaactacgacccacagaaggacaagcgtttcagcggctctgttaagctgcctcacatccctcgcccaaagatgaaggtgtgcatgcttggtgatgcccagcatgttgaggaggctgagaagattggacttgactacatggatgtcgaggcgctcaagaaaatgaacaagaacaagaagcttgtcaagaagcttgccaagaagtaccatgctttcttggcatcagaggccatcatcaagcagattccccgtctccttggtcctggtctcaacaaggcaggcaagttccctacactggttacccaccaggagtctcttgaatccaaagtgaacgagacaaaagctacagtcaagttccagttgaagaaagttctttgcatgggtgttgctgtgggtaacctgtccatggaggagaagcagatccagcagaacatccagatgagcgtcaacttccttgtgtcccttctgaagaagaactggcagaatgtgaggtgcctgtacatcaagagcaccatgggaaagccatacagggtgttctaagtcttgccgtgatccttgtgatgttgatttactatgcctctccagctgggcttgtcttaaaacttagatatgtacccatcagttttgtgcctgtcaaagagaatgttgaagtatttggtctttaatctagtgtttcctgtggaggaattctttttgggattatgcagttgcagcttgcgttacgattctttctctgctccttgtctcttatttgcagctccgcagtttcgatgatattgtcatcctgactggtatgagaatgagatcgttgtcatgaactgcattcctctgcatggttttatctgaaaacaggacactagttatgaaattgtcggtgccacacgtagccac

SEQ ID NO: 14040 - DNA, 864 bp, Eutrema parvulum
ttttgtttttccgtctattcgtccaggatcagatctttgagacaagctcaaaatgagtaagcttcagagtgaggccgttagagaagccattactgttatcagagcgaaatccgatgaaaagaaacgcaactttgtggagactcttgagctccagatcggtctgaagaattatgacccacaaaaggacaagcgtttcagtggatctgtcaagttgccacacataccccgtcctaagatgaagatctgcatgctcggagatgcccagcatgtcgaggaggctgacaaaatggggctagactatatggatgtggagtctctaaaaaagcttaacaaaaacaagaagctcgtcaaaaagcttgcgaagaaataccatgctttcttggcctctgaatctgttattaagcagattcctcgtcttcttggtcctggtctcaacaaagcaggaaagttcccaacgcttgtgagccaccaagaatcgttagagtccaaggtaaatgaaacaaaggccacagtcaaatttcagctgaagaaggttctctgcatgggagttgcagttggtaacctttccatggaagagaagcagatctttcagaacgtccagatgagtgttaacttcctcgtctctctattgaagaagaactggcaaaatgtgaggtgtttgtacctgaagagcaccatgggaccaccacaaagaatcttctgagctctcggagctgctttaatggtggctataagccctttgtttttgtttcagacatctttgaaagagtgtaagaattgtgttgctcttctttagattttgtttgaatgattaaaagaaactgcagtgattttggttagtggattttgaagcttatataatct

SEQ ID NO: 14041 - DNA, 927 bp, Oryza sativa
cttcgcctctcctccgccggcgccgcccctgcccaaaccctagagtgttgttgagttatcggccgcaaacatgagtaagttacaaaccgaggctctcaaggaagccatctcccaggttgttgctgattgcaaggaaaagaacaggaagttcaccgagaccgttgagcttcaaattggtctcaagaactatgacccacaaaaggacaagcgtttcagcggctccgttaagctgccccatatcccccgccccaagatgaaggtctgcatgcttggtgatgcccagcatgtcgaggaggctgagaagattgggctcgactacatggatgttgaggcccttaagaagatgaacaagaacaagaagcttgtgaagaagcttgccaagaagtaccatgctttcttagcatcagaggccatcatcaagcagatcccccgtctccttggtcctggtctaaacaaggcaggcaagttccctacattggttactcaccaggagtctcttgaatccaaggtcaatgagacgaaagctacagtcaagttccagctgaagaaggttctgtgcatgggtgttgctgtgggtaacttgtcgatggaggagaagcagatccagcaaaacatccaaatgagcgtcaacttcctcgtgtcccttttgaagaagaactggcagaatgtgaggtgcctgtacatcaaaagcacaatggggaaaccgtacagggtgttctaagctggtttgctccacattgaagctgataagatgctgggcggttgaactgagcttgtccttacattagatctgcttgcactgatatcagttttgtgcttacccaagagaacatcgagatatgttatcatattttgtagtagtttattcagtgcacttcggatttatgcaaatgaggcttgtgttatttatgaatagtttcgttcatg

SEQ ID NO: 14042 - DNA, 1447 bp, Panicum virgatum
cggtggcgatgcgagatggaacaacgtgcggtgtgagccagaggaggaagaaagagatcgcatggcccagcggatcgcacaaatctcaacgagtggtaagtggaataaaaaaacttcaatatgccagcctgtagtcgtaggcccaaaagcaggaaggccgtcttcttaccttttcttcttgtgggtgtgagactgtgagcagagcagagcagggcccgcccgcggtgtggcaaaagaagccacatggtggcccatgttctccggccgcggcccatagcgagcgagcgagcgtcctcggggcccgcccgcatccgacggttgggcgtccatcgggagctcgctctagtctagggttttctttcgtatataatatataataactcccgccgccgccgccgcttctctttccccgcgccgaaccctaaccaagggagtcgagttgagttgagtcaccggttgcagccatgagtaagttgcaatccgaggctctcaaggatgccatctcccagatcgttggggatgccaaggagaagaataggaagttcaccgagaccgttgagcttcagattggtctgaagaactacgacccgcagaaggacaagcgtttcagcggctctgttaagctgcctcacatcccccgcccaaagatgaaagtgtgcatgcttggtgatgcccagcacgttgaggaggctgagaagattggacttgactacatggatgtcgaggcgctcaagaaaatgaacaagaacaagaagcttgtcaagaagcttgccaagaagtaccatgctttcttagcatcagaggctatcatcaagcagattccccgtctccttggtcctggtctcaacaaggcaggcaagttccctacactggttacccaccaggagtctcttgaatccaaagtgaacgagacaaaagctacagtcaagttccagttgaagaaagttctttgcatgggtgttgctgtgggtaacctgtccatggaggagaagcagatccagcagaacatccagatgagcgtcaacttccttgtgtcccttctgaagaaaaactggcagaatgtgagatgcctatacatcaagagcaccatggggaagccatacagggtgttctaagtcttgccgcgattcttgtgaagttgataaaatactaaggcctctccagctgggcttgtcttaaaacttagatatgtacccatcaattctgtacctgttactgagaatgttgaagtatttggtccttaatctagtgtttcctttaatagaacttttggaggaatgcttttgggattacacagttgcaacttttgttaaggttctttggccgctccgcagttttgatattattgtcattccgactggtatgagaatgagaacgttggttatgaactgcattcatatgcatgtttttatctgaagacggggcgttagttatgatattggctgta

SEQ ID NO: 14043 - DNA, 1201 bp, Panicum virgatum
cgcatccgacggttcggcgcctggacacgcggcgtccatcgggagctcgctctagggttttccttcgtctcgctcccaccgctgctcatataactcccggcgccgccacctccgtcagcttctccttctcgctcgctccgtcgccctccccgagccgaaccctaaccaagggagttgagttgagtcaccggttgcagccatgagtaagttgcaatcagaggccctcaaggatgccatctcccagatcgttggggatgccaaggagaagaataggaagttcaccgagaccgttgagcttcagattggtctgaagaactacgacccgcagaaggacaagcgtttcagtggctctgttaagctgcctcacatcccccgcccaaagatgaaggtgtgcatgcttggtgatgcccagcacgttgaggaggctgagaagattggacttgactacatggatgttgaggcgctcaagaaaatgaacaagaacaagaagcttgtcaagaagcttgccaagaagtaccatgctttcttagcatcagaggccatcatcaagcagattccccgtctccttggtcctggtctcaacaaggcaggcaagttccctacactggttacccaccaggagtctcttgaatccaaagtgaatgagacaaaagctacagtcaagttccagttgaagaaagttctttgcatgggtgttgctgtgggtaacctgtccatggaggagaagcagatccagcagaacatccagatgagcgtcaacttccttgtgtcccttctgaagaagaactggcagaatgtgagatgcctgtacatcaagagcaccatggggaagccatacagggtgttctaagtcttgccgcgatcctagtgaagttactaggcctctccagctgggcttgtcttaaaacttagatatgtacccatcagttttgtgcctgtcaatgagaatgttgaagtatttggtccttgatctagtgtttcctttaatagaacctgaggagcaatgtttttgggattatgcagttgcatcttatgttaaggttctttcgatgctccttgtcacttacttgcagctccgcagtttcgatgatattgtcatcctgactggtatgagaatgagatcgttggttattcagggttttattttatctgaaaacaggacattagctatgaaattgtcagtattaattggctttgttga

SEQ ID NO: 14044 - DNA, 1210 bp, Cycas rumphii
cggaggggcaaaaccctaaattttcctcctctttgttctttttcattgttgtagggtttgtctttgggaggctgtgcggaggaggtgaaggggagagcggaggagctgaggttgatatcatcataggagatgagtaagcttcagggtgatgtgctgagagaagccatcgcacaggtgatggcagacagcaaggagaagaagcggaagttcagcgagaccatagagttgcagataggtctgaagaactatgacccacagaaggacaagcgtttcagtggatctgtcaaattgcctcacattcctcgccccaagatgaaggtttgcatgcttggggatgcccagcatgttgaagaggctgagaagataggtttggattacatggatgttgaggggctgaagaagatgaacaagaacaagaaactggttaaaaaacttgccaagaaatatcatgcatttcttgcttcagaagcaattattaaacagattcctcgccttcttggtcctggtctcaacaaggccggtaaatttcctaccctggtatcgcaccaagaatctttggaggcaaaagtgaatgaaacaaaggcaatggtcaagtttcaattgaagaaagtgctttgcatgggtgttgctgtgggtaactgtggaatggaggagaagcagatttttcagaatgtgcagttgagcgtaaactttctggtgtcactcctaaaaaagaattggcaaaatgtaaggtgtttgtatctgaagagtaccatgggcaaaccgaaccgcatattttgaatgtgtaatattgctttagtgctgctttgtgggtaaacagtttttctgttgcttgtttgggtatagttataatggattgaagcagtcaattttgaattaaattttccactagaggcagatgtcggccgagagctgacatatatcaccattcagaggaaaagcctagtattggaatgctaccttttttatttatttttataacttggcatgttttattgttctgtttctggaaagctagttggtggattggtttggcattcatgtagttgcacctatttccagttttccctatcaagaaactaattaaagctaattattagtcgtagatattgtacacagtttggaagtttgtttacatgagcaagtgcttttatttgtggttttgtgtttgacatttcatcgttagaggcatttattgtatgtggaaggc

SEQ ID NO: 14045 - DNA, 1060 bp, Cycas rumphii
tggatccaaagaattcggacgcgcttgtctttgagaggtggagaaggggagagcagaggagctgaggttgatatcatcataggagatgagtaagcttcagggtgatgtgctgagagaagccatcgcacaggtgatggcagacagcaaggagaagaagcggaagttcagcgagaccatagagttgcagataggtctgaagaactatgacccacagaaggacaagcgtttcagtggatctgtcaaattgcctcacattcctcgccccaagatgaaggtttgcatgcttggggatgcccagcatgttgaagaggctgagaagataggtttggattacatggatgttgaggggctgaagaagatgaacaagaacaagaaactggttaaaaaacttgccaagaaatatcatgcatttcttgcttcagaagcaattattaaacagattcctcgccttcttggtcctggtctcaacaaggccggtaaatttcctaccctggtatcgcaccaagaatctttggaggcaaaagtgaatgaaacaaaggcaatggtcaagtttcaattgaagaaagtgctttgcatgggtgttgctgtgggtaactgtggaatggaggagaagcagatttttcagaatgtgcagttgagcgtaaactttctggtgtcactcctaaaaaagaattggcaaaatgtaaggtgtttgtatctgaagagtaccatgggcaaaccgaaccgcatattttgaatgtgtaatattgctttagtgctgctttgtgggtaaacagtttttctgttgcttgtttgggtatagttataaaggattgaagcaatcaattttgaattaaattttccactagaggcagatgtcggccgagagctgacatatatcaccattcagaggaaaagcctagtattggaaagctaccttttttatttatttttataacttggcatgttttactgttctgtttctggaaagctagttggtggattggtttggcattcatgtacttgcacctatttccagttttccctatcaagaaactaattaaagctaattattagtcgt

SEQ ID NO: 14046 - DNA, 719 bp, Nuphar advena
tccgggctcgagctgaagttattgtgcaaaagccagcaagatgagcaagctccagagtgatgcattaagggaagctattactcaggtggttggtgaatcaagagataaaaaacgcaagttcactgaaacaattgaacttcagattggtttgaaaaactatgatccacaaaaagacaaacgtttcagtggatctgtaaagctacctcatattccccgtccaaaaatgaaagtttgcatgctaggtgatgctcagcatgtggaggaggctgagaagataggactggattacatggatgttgaaggtttaaagaagatgaacaagaacaagaagttggttaagaagcttgccaagaagtatcatgcttttcttgcatcagaagctattatcaaacagattcctaggctccttggtccaggtcttaacaaggctgggaagtttccaacccttgtttcacaccaggagtctctcgaatcaaaggtgaatgaaaccaaagcaatggttaagttccaacttaagaaggtcctctgcatgggagttgctgttgggaattgtgccatggaggacaagcagatcttccagaatgtgcaacttagtgtcaacttccttgtttcactattaaagaagaactggcaaaatgtgaggtgcttgtacctgaagagtaccatgggaagggcaattagggtattctaagtggtgcatctggtctccacacaatttg

SEQ ID NO: 14047 - DNA, 960 bp, Phaseolus vulgaris
ctagctagggtttcgcctccgctctgagatctgtagccgcctagccgttaagttggaaaagcccaagtttcaaaatgagtaagcttcagagtgatgctctaagggaagctatctctggtatcatgggtgattccaaagagaagaaccggaattttgtggagactattgaactccaaattgggctgaaaaactatgatccccaaaaggacaagcgtttcagtggctctgttaagttgcctcatattcctcgccccaagatgaagatttgcatgcttggagatgcccaacacgttgaggaggcagagaagataggattggactacatggatgttgaggcgttgaagaagcttaacaaaaataagaaattggtgaaaaagttagctaaaaagtatcatgcgtttttagcctctgaagccgttattaagcagattcctcgtctcctaggacctggtctcaacaaggcagggaagttcccgacccttgtgactcaccaagaatctctagagtcaaaggttaatgagactaaggctatggtcaaattccagcttaagaaggtgctatgtatgggagtagctgtggggaatgttagcatggatgaaaaacaaatctttcaaaatgtacaactgagcgttaacttccttgtctcactgctgaaaaagaactggcagaatgttaggtgcttgtatctgaagagcaccatggggaaatcgtaccgtgtcttttaagtgtttgttcttaaattcagtgaatttctgatcacttaatatattgtcgtaataggttggacagaatctttcattgttctacagttttgttggatgagtattttttggttagtatttcatgttattgacatgtgtttcaagtgctttgcaacatcggatattttaagcggtgctaattttaaggtacccttgtttttttatttatatacaacatgcgcaatgctccttcgatgca

SEQ ID NO: 14048 - DNA, 797 bp, Antirrhinum majus
ggggcaggttaaaccctaatccagaagttgaatttgggaggacagaagatattgaagcatgagtaaacttcagagtgaggccctgagggaagcgatcagcgtgatatctggtgatgtaaaggagaagaagcgcaacttcacggagacaattgagcttcagattgggctcaagaactatgatccccagaaagataagcgtttcagtgggtccgtcaagttgccccacatccctagacccaagatgaagatctgcatgcttggtgatgcccagcacgtcgaagaggctgcaaaaattggtcttgaatccatggacgtggaggctctcaagaagttgaacaaaaacaagaaattggtaaagaagcttgcaaagaagtatcatgctttcctagcctcagaagcagttattaagcagattccccgcctcttgggtcctggtctcaacaaggcaggaaagtttcccacacttgtatctcatcaggaatcactcgagtccaaggtgaatgagaccaaggctactgtgaagttccagttgaagaaggtgctgtgcatgggagttgctgttggcaactgcggtatggaggagaagcaaattttccaaaatgtgcaaatgagtgtcaactttctcgtctcccttttgaagaagaattggcagaatgtgaggtgtttgtacttgaagagtaccatggggaagccacagcgcatcttctgagagcgtatcttattttggttttggagtcgttagaaacagacattgtaagagagtggacacaattaaatatttccctggttttgggatt

SEQ ID NO: 14049 - DNA, 949 bp, Actinidia deliciosa
ctaatctcgtttcccttgattgtgtgaacaggtgatctatagattagctgtcgaaagcgaaaatcgttcgccatgagtaagctccaaagtgacgctgtcagggaagccatctcccagattgctggagattccaaggaaaaaaagcggaagtttgtggagaccattgagctccaaattggtttgaagaactatgatccccagaaggataagcgtttcagtggttctgtgaaactgccacacattccccgtcctaagatgaaggtttgcatgcttggtgatgctcagcatgttgaagaggcagagaagataggaatggattatatggatgtggaaggactaaagaagcttaacaagaacaagaaattggtgaagaagctagcgaaaaagtaccatgcatttctagcatctgaagctgtcatcaagcagatccctcgcctcttgggccctggcctgaacaaggcaggaaagtttccaacactagtgactcatcaagagtccctcgagtcaaaagttaatgaaacaaaagcaacagtgaagtttcaacttaagaaggttctttgcatgggtgttgctgtgggcaattgcggtatggaggataagcagatcttccagaatgttcaaatgagtgtaaactttcttgtttcattgctgaagaagaattggcaaaatgtgcggtgcttgtaccttaagagtactatgggaaggccggtccgcatcttttaagaagatatatatacttgttgggagctccgtagcgtgagaccaagcgcggacaagactgcattacatttttgtttgttttctgagattagctttcttgtctggactagtgaatgctgcgccttaagaattcttatggtggttgcgaactataagattcgttgtttttgttttctttacttggtcctcgccccaactacttattcatttgttttcaatctaaaaaaaa

SEQ ID NO: 14050 - DNA, 1366 bp, Glycine max
ttttctttaaaaattttaatgttcagggaggtgtagttagcaaaacatgggtccaagaagcaacggccgaaagataattatacaaaacccatttcaatggcccggaccggcccatcccatttcctgctatccatggtatatactgattctttcagccacataacctaactagggttttcgcttgagctctgcgagatcttgagtcgccgatttgaaaagatgagtaagcttcagagtgatgctttgcgtgaagccatctcaggaatcatggccgattccaaggagaagaatcgcaaatttgtggagaccatcgaactccaaatcggtttgaagaactacgatccacagaaggacaagcgtttcagtggctccgtcaagttgccccacatccctcgccccaagatgaaaatttgcatgcttggtgatgctcagcatgttgaagaggcagagaagataggactggactggatggatgtagaagccttgaaaaagctaaacaaaaataagaagttggtgaagaagctagctaaaaaataccatgcttttttagcatctgaagcagtcattaagcagattcctcgtcttttgggtcctggtctcaacaaagcaggaaagttccctacacttgttactcaccaggaaactcttgagtcaaaggttaatgagtctaaggccatggttaaatttcaacttaagaaagtgctctgcatgggagtagctgtgggcaatgttagtatggaggaaaagcaaatcttccaaaatgttcaactgagtgttaacttccttgtctctttgttgaaaaagaactggcaaaatgttaggtgcttgtatctgaagagtacaatggggaaatgttaccgtgtcttttgaggaatttctttttttatttcggtgaaattgtgatcgcgcatgatatgttgattaatcttaatagctagatacaaattatcatcttgttacagttttgtgggatggatttttatgttaaagtgtttcgttttcatgttcaaaaacatttgataatgatatgcgctgtttttggtgctgcttttgtttttactcaattgcgtgttctattttggcctcaattttagctgaacatcctgtgaaccatgatataaattatgtagaaaaataattttgaattgtgaatttaaaaaatgatagttaattgtgcataattaacactgagcttgacaattatggaagagaattctcaaatgagaaatttgtgatgctaattacctttaaattaatactattcaaatttagctgaacagactgaacaatgcatttgatttgaagtttcatattttcattttatttaagaggtgttttttagaagatattgttaactgtgtgtaat

SEQ ID NO: 14051 - DNA, 1047 bp, Glycine max
ctcgaggtattttttctaccccgaacatctgctgttgggttttatccctccattgctttgcactgccgccgataacaattttctgtatcgtgtattttttttttctttgttcacagctctgcgagatcttcattcgccgattttaaaagatgagtaagcttcagagtgatgctttgcgtgaagccatttcaggaatcatggccgattccaaggagaagaatcgcaaatttgtggagaccatcgaactccaaatcgggttgaaaaactacgatccacagaaggacaagcgtttcagtggctctgtcaagctgccccacatccctcgccccaagatgaaaatttgcatgcttggtgatgctcagcatgttgaagaggcggagaagataggactggactggatggatgtggaagccctgaagaagctaaacaaaaataagaagttggtgaagaaactagctaaaaagtaccatgcctttttagcttctgaagcagtcattaagcagattcctcgtcttttgggtcctggtctcaacaaggcaggaaagttccctacacttgttactcaccaggaaactcttgagtcaaaggttaacgagtccaaggccatggttaaatttcaacttaagaaggtgctctgcatgggagtagctgtggggaatgttagtatggaggaaaagcaaatcttccaaaatgttcaactgagtgttaatttccttgtctctttgttgaaaaagaactggcaaaatgtcaggtgcttgtatctgaagagtacaatggggaaatcttaccgtgtcttttgaggaattttttttttaatccggtgaatttgtgatcgcgcttgatacattgattatcttaatagcgatacaaactatcatcttgttacagttttgttggctggatttttatgttagtgtttcgtgttcgtgttcatgttcaaacatttgataatgatatgcgctgtttttggtgctgcttttgtttttactcatgaatgcgtgttctattttggcctcaatttaaagatcctgtacgtagcgtttgatt

SEQ ID NO: 14052 - DNA, 1077 bp, Arabidopsis thaliana
ctccaagacggtagtcggatgttagatcgctcaagtaatttttggttttgttggtctcacgttttcagctgcccatttgatttcagtttgggcttttccttatctctaaaggcccaatttcatttaggtttagtttatttgatcattatccttactataaaggcttcgcctttcgagaaatttagggtttcttctgtctgtctcgtcactcaggatcagatcttagctaaattgagacaagctcaaaatgagtaagcttcagagtgaggccgttcgtgaagccatcactactatcacagggaaatccgaggcaaagaaacgtaactttgtcgagactattgagctccagatcggtctgaagaactatgaccctcaaaaggacaagcgtttcagtggatctgtcaagttaccacatatcccccgtcctaaaatgaagatctgcatgctcggagatgcccagcatgttgaagaggctgagaagatggggttggaaaacatggatgttgagtctctaaaaaagcttaacaagaacaagaaactcgtcaagaagcttgcaaagaaataccatgctttcttggcctctgagtctgtcattaagcagattcctcgtcttcttggtcctggtcttaacaaggcaggaaaattcccaactcttgtgagccaccaggaatccttggagtcaaaggtgaatgaaacaaaggcaacagtgaagttccagctgaagaaggttctgtgcatgggagttgcagttggtaacctttcaatggaagagaagcagatctttcagaatgtgcagatgagcgtcaacttcctcgtctcgctattgaagaagaactggcaaaatgtcaggtgtttgtacctcaagagcacaatgggaccaccacaaagaatcttctgagctttcacctacttaaaattggtggctataagacacttcttcttaccctttcgtttttgtttcagacatatctgttaaacagtgtaagagttgtgctgctactctcctctttagcttttggtttggataatttgaaataactgcagtgattttggttaatggattttgtagcttatatt

SEQ ID NO: 14053 - DNA, 921 bp, Olea europaea
agtccgtctggcaaaccctaattcttctctttagaagtggactgagaagaaatagagatattgaacaatgagtaagcttcagagcgaggccctgagagaagcgatctctgtaattgttaccgattctaaggagaaaaaacgtaatttcactgagacgattgagcttcaaattgggctgaaaaattatgatccccagaaggataagcgattcagtggctcggtgaagttgcctcacatccctcgccccaagatgaagatttgcatgcttggcgatgctcagcacgttgaggaggcagaaaaaataggattggagtccatggatgtggaggctctcaagaagttgaacaaaaacaagaagttggttaagaaacttgcaaagaaatatcatgctttcttggcctcagaagctgttataaagcagattccacgtctcttaggacctggtcttaacaaggcaggaaagttccccacccttgtgtcacaccaggaatctcttgaatctaaggtcaatgagacgaaggccacagtaaaatttcaattgaagaaggttctttgcatgggaattgctgttggaaatttgggtatggaggagaagcagatctttcaaaatgtgcaaatgagtgtcaactttctagtttcactgctgaagaaaaattggcagaatgtcagatgcttgtacttgaagagtacaatggggaagcctcagcggatcttttaagatgtatgtttcttcaccgctgtttagtgaagaaatttacgagcttaaacaattaaataattccagagaattggagttttgaatttctatcgtcatgttttatcatgaacattgctttacatactcttgtcaggtcgaagcttactgctattaatcaactatttctgttagaaacattatttttctccgaattacatgcttag

SEQ ID NO: 14054 - DNA, 1219 bp, Cicer arietinum
gatgaaattgtgggcgtagtggtatagttaatggggtgtgtgaattaaaaagaaaaaagaaaaaagaaaaaaggaaaggaatagtttgtgaagcccatttgaagtcggacccagcccatgacatattcagtccatactataataaagcttcccttagagacgccgaccacacctagtgttttgcttggtaccatctcgtttgtttcgcagctctgagatctagcttgttagtcaccgattctagatcaaaatgagtaagcttcagagtgaagctctgagagaagctatctctggaatcactgctgattccaaggagaagaaccgtaaatttgttgagactattgaacttcaaattgggctgaagaactacgacccacaaaaggacaagcgtttcagtggctctgtcaagttgccccacatccctcgccctaagatgaaaatttgcatgcttggagatgcccaacatgttgaagaggcagagaagataggattggattggatggatgttgaagccttgaaaaagcttaacaaaaataagaaattggtgaagaaactagccaagaagtaccatgctttcttagcttctgaggcagtcattaagcagattcctcggcttttgggtcctggtctcaacaaagcagggaagttcccagcacttgtctctcaccaagaatctcttgaatcaaaggtgaacgagacaaaagctatggtgaaatttcagcttaagaaggtgctctgcatgggagttgccgtgggcaacattagcatggatgaaaagcaaatttttcagaatgttcaacttagtgttaacttccttgtctcattgttgaaaaagaactggcagaatgtcaggtgcttgtatctgaagagttccatgggaaaatcttaccgagtattttaaggggattcattttgttttttttgttttcaatattcagtgagtttgtcatcttcatctatacattatttatcctaatagctggattgaaattttcatcttattacagttttgttggattatttgaggttattttgtttcatgttcaaacaattgataatgttaggcaatctatttttggtgctctcatttctgattgagttaaactagttgatttgagatatccaataaggtgagcaaatcttgtagggaatcatgaaaacttccatgtttgacagctgaaaagagttagataatcacgcttcaggggtgaattaacac

SEQ ID NO: 14055 - DNA, 1011 bp, Eutrema halophilum
tcttttttccgtctattcgtccaggatcagatctttgagacaagctcaaaatgagtaagcttcagagtgaggccgttagagaagccattactgttatcagagcgaaatccgatgaaaagaaacgcaactttgtggagactcttgagctccagatcggtctgaagaattatgacccacaaaaggacaagcgtttcagtggatctgtcaagttgccacacataccccgtcctaagatgaagatctgcatgctcggagatgcccagcatgtcgaggaggctgacaaaatggggctagactatatggatgtggagtctactaaaaaagcttaacaaaaacaagaagctcgtcaaaaagcttgcgaagaaataccatgctttcttggcctctgaatctgttattaagcagattcctcgtcttcttggtcctggtctcaacaaagcaggaaagttcccaacgcttgtgagccaccaagaatcgttagagtccaaggtaaatgaaacaaaggccacagtcaaatttcagctgaagaaggttctctgcatgggagttgcagttggtaacctttccatggaagagaagcagatctttcagaacgtccagatgagtgttaacttcctcgtctctctattgaagaagaactggcaaaatgtgaggtgtttgtacctgaagagcaccatgggaccaccacaaagaatcttctgagctctcggagctgctttaatggtggctataagccctttgtttttgtttcagacatctttgaaagagtgtaagaattgtgttgctcttctttagattttgtttgaatgattaaaagaaactgcagtgattttggttagtggattttgtagcttatgtgatcttgaattagatgtgtgcatcttcagtagaagaaccaacccgcagataattctcttcgtgaacaaaaaaaaaacttacttcggcattgtgctctgtattctcttgagatatatttagagaagaagggaaataaattcgattctgtctaaa

SEQ ID NO: 14056 - DNA, 1012 bp, Rosmarinus officinalis
cggccggggatccatgcatttggcataaacatcgccgcggccaccagtcccccgccctcccatccgctggtactctactggagcagaattcaggggtgaagagcttcggagattttaaatcatgagtaagcttcagagtgatgcccttcgggaagccatttctcagattaagaatgatgctgctgtgaaaaagcgcaacttcaccgagacaattgagctccaaattggactgaaaaattatgatccccagaaggacaaacgtttcagtggctctgtgaggttaccacacattcctcgtccaaagatgaaagtttgcatgcttggagatgctcagcacgttgaggaggccgaaaagattggtctggagtacatggatgtggaaggcctgaagaagctgaacaaaaacaagaaattggtcaagaagcttgctaagaaatatcatgctttcttggcttcagaagctgtgatcaagcagattccccgtctcttagggcctggtcttaacaaggctggcaaattccctacccttgttacacaccaggaatcacttgaatctaaagttaacgagaccaaggctacagtaaagtttcaattgaagaaagtgctttgcatgggagttgcagttgggaattgtgctatggaggaaaagcaaatctttcaaaatgtgcagatgagtgtgaatttccttgtttccttgttgaagaagaattggcagaatgtgaggtgcttgtacctgaagagtacaatggggaagccacagcgcatcttctgaggagtgtgtcctctttgttgctgctgtgtcgatgtgctctacgatgagatatgcatctaatgtattgtgttttagaacgagagcaattttgttacgttaggattgtttgttgaatgtctcagcttgaaacagctagaccattaactcctctgttttattagttttatgtattactatgatctcaaatatcctgttccttagggcttgaaaataacataaaatttggttgcaaccttatcc

SEQ ID NO: 14057 - DNA, 1012 bp, Spinacia oleracea
atttaaccttaattcgccattttctgtgttaattattgtcaggttgctccattaagctataatcatgagtaagcttcagagtgaagctgtgagagaagccataactggaatcgcaaatgacgccaaagagaagaatcgcaagtttaccgagacaattgaactccagattggactgaagaattacgacccacaaaaggacaagcgtttcagtggctctgttaagttgccacacatccctcgtcccaagatgaaggtttgcatgcttggagatgcacagcatgtggaagaggctgagaggataggattgcaatggatggatgtagaagctttgaagaaactcaacaagaacaagaagttggttaagaagcttgcaaagaagtatcacgctttccttgcatctgaagctgttattaagcagattccccgtttgctcggtcctggtcttaacaaggcaggtaaattcccaacacttgtcacccaccaagagccccttgagaacaaagttaatgagatcaaggcaaccgtgaagtttcagcttaagaaagttctgtgcatgggagttgctgttggtaacttgagtatggaagagaagcagattttccaaaatgtgcaaatgagtgttaactttctggtttcactgctcaagaagaactggcaaaatgttcggtgcttatacctgaagagttccatgggaaagccataccgtatcttctaaatcagtccatatcaccatttttggctgaatcgcatttaagagttgaagtttgttggctaccgtgtactattagtacaatcgtaattggtgagagctttaatataccaggataattatcttgaacgaaatggcgacaaagtttctagttagttttattgttatcgacgacttcattatcatatacttgtatggcattttatccctatggggtaattttgaatttttgagaatgatatccttagagaagattttagccattttgggagtaatttgcgaatatgatatgcttgtggcggc

SEQ ID NO: 14058 - DNA, 821 bp, Spinacia oleracea
ctctctcctcctctcaataatttctgcgttcacttgaatctctcgaatttatttaaccttaattcgccattttctgtgttaattattgtcaggttgctccattaagctataatcatgagtaagcttcagagtgaagctgtgagagaagctatatctgggatcgcaaatgattccaaggagaagaatcgcaagtttactgagacaattgaactccagattggactgaagaattacgacccacaaaaggacaagcgtttcagtggctctgttaagttgccacacatccctcgccccaagatgaaagtctgcatgcttggagatgcacaacatgtcgaagaggctgagaggattggtttgcaatggatggatgtagaagcattgaagaaactgaacaagaacaagaagttggttaagaagcttgcaaagaaataccatgcgttccttgcatctgaagcagttattaagcagattccgcgtttgctcggtcccggtcttaacaaggctggtaagttccctactctagtcacccaccaagaacccctagagaacaaagttaacgagatcaaggcaactgtgaagtttcagcttaagaaagttctctgcatgggagttgctgttggtaatcttagtatggaggagaagcagatattccaaaatgtgcaaatgagcgtcaacttccttgtctcattattgaagaagaattggcaaaatgttcgatgcttgtacctgaagagcaccatgggcaagccataccgcatcttctaaatcagtctcttgaccgtttttggttgatggtttaggagttgaagttttgtttgttg

SEQ ID NO: 14059 - DNA, 1350 bp, Panicum virgatum
tgacgaggtgacgagtgagagccttctgtccctccggtgtaacggcaggttcctccaacgaaaatccatccgcggattcggcccatctcattcttagcccactaaaggcccatgccgcaaccggccgatcggatccgacggctagccatgccgcaaccggcaggcgaggatgcatcggcatccgttaaatatccaggtctttgccatatctcctccctgtcctcctctacgccctcgctcgcgccgccgccgcacttcccgtctggtctcgtctgcgcagcaaaccctagcagcaggtgggtcggttatcgacggacagtagccatgagtaagttgcaaactgaggccctcaaggaggccatctccctggtcgtgtcggaggcaagggagaagaacaggaagttcacagagaccatcgagctccagattggactgaagaactacgatccgcaaaaggacaagcgtttcagtggctccgtcaagctgccccacatccctcgccccaagatgaaggtctgcatgcttggtgatgcccagcacgtggaggaggctgagaagatcggtcttgattacatggatgttgaagctcttaagaagatgaacaagaacaagaagcttgtcaagaagcttgctaagaagtaccatgctttcttagcttctgaggctattatcaagcagattccccgtctccttggtcctggtctcaacaaggcaggcaagttcccaactttggttactcaccaggagtctctggaatcaaaggtgaatgagacgaaagctacagtcaagttccagctcaagaaggttctttgcatgggtgtggctgtgggtaacctgtcgatggaggagaagcagatccagcaaaacatccagatgagcgtcaacttcctggtttcattgctgaagaagaattggcagaacgtgaggtgcctgtacatcaagagcaccatggggaagccaaacagggtgttctaagttgctgcgctcatgcccttttaaaaccaactctagtccgtagtggagtttgttatgggatatatgcttatgcagtaatctattgtactgttttgcaaattttgtgcctaatttgaacaagagtggcattatgatccactagtttcaccttgcacttgagctactagacagtgtgcttcaggttacgctgctgctagtggcatagttcttgtgaattcctctttacgatatgctgcgttcatgcacgttgcacgtctgatagctggccgttgtttacggatctatttcaaccggcaaatcctacacaaaatacatgcattaaggtggaataatattagaatagggtgtttgtttgatgaattctacaggctgatc

SEQ ID NO: 14060 - DNA, 1322 bp, Triticum aestivum
ccgaacatataagaggagcctccgtgcccgtccgcgtcctcttcgttactccctctctctggaccgccgccgccgcctcgccaaaatccggcgtcaactgatcggcggcagccatgagtaagctccaaagtgacgctgttaaggatgccatcacccagattgttggggaggcgagagaaaagaagcgcaagttcactgagactgtggagcttcagatcggtctcaaaaactacgacccacaaaaggacaaacgtttcagcggctcagtgaagctgccccatatcccccgcccaaagatgagggtgtgcatgcttggtgatgcccagcatgtcgaccaggctgagaaaatgggacttgactacatggatgttgaaagtctcaagaagatgaacaagaacaagaagcttgttaagaagctagccaagaagtaccatgctttcttggcatcagaggccataatcaagcagatccctcgtctccttggccctggtcttaacaaggcaggcaagtttcccactctggttagtcaccaggaatctcttgaagccaaggtcaacgagacaaaagctacagtcaagttccagctaaagaaggttctttgcatgggtgttgctgtgggcaacttgtcgatggacgagaagcagatccaacaaaacatccaaatgagtgtcaacttccttgtgtccctcctgaagaagaattggcagaatgtgaggtgcctgtacgtgaagagcaccatggggaagcgtgtacgggtgttctaagtgtgtgcgctgcagtgaatttgataagatactgggctgtcctgccgacccctgcttgtctttggattagatctgtttcactgataccaattttgtgtttgcctaagcgaatatcaacaagtattttatcgtactagtcttatcttgaacagaaatcatgggagcaatggaactgcattttctgtcatgattctgcgttgtgcctgttatcagagatctatatgcgatcttgattgtcatctgaatgtagattttacttggaagtgtttcctataagtgtgtttaaatggataacttatttggttagcctagcaaatctcaggaaaatagaagtttgttatctgtaaaaccggagaagtgggattttgtaaaaacgactgtcagtactatatgcttttggattttcagtgatcggttgatgtggttcagcttcttcagaatccaagccaaatagtcagacctcatataatgcaagcaaggcgttaagagagatgcttagtaaaattagttgtacttaattgactttgatttaagcgatcatcgatcgatgtggttcaa

SEQ ID NO: 14061 - DNA, 1103 bp, Triticum aestivum
aacatataagaggagcctccgtgcccgtccgcgtcctcttcgttactccctctctctggaccgccgccgccgcctcgccaaaatccggcgtcaactgatcggcggcagccatgagtaagctccaaagtgacgctgtcaaggatgccatcacccagattgttggggaggccagagaaaagaagcgcaagttcactgagactgtggagcttcagatcggtctcaaaaactacgacccacaaaaggacaaacgcttcagcggctcagtgaagctgccccatatcccccgcccaaagatgagggtgtgcatgcttggtgatgcccagcatgtcgaccaggctgagaaaatgggacttgactacatggatgttgaaagtctcaagaagatgaacaagaacaagaagcttgttaagaagctagccaagaagtaccatgctttcttggcatcagaggccataatcaagcagatccctcgtctccttggccctggtcttaacaaggcaggcaagtttcccactctggttagtcaccaggaatctcttgaagccaaggtcaacgagacaaaagctacagtcaagttccagctaaagaaggttctttgcatgggtgttgctgtgggcaacttgtcgatggacgagaagcagatccaacaaaacatccaaatgagtgttaacttccttgtgtccctcctgaagaagaattggcagaatgtgaggtgcctgtacgtgaagagcaccatggggaagcgtgtacgggtgttctaagtgtgtgcgctgcagtgaatttgataagatactgggctgtcctgccgacccctgcttgtctttggattagatctgtttcactgataccaattttgtgcttgcctaagcgaatatcaacaagtattttatctttctagtcttgtcttgaacagaaatcatgggagcaatggaactgcattttctgttatgattctgcgttgtgcttgttatcagagatctatatgcgatcttgatattcatctgaatgtagtttttacttgaaatgtttcctataagcgtgtttaaatggataacttatttggttagcctagcaaatctcaggaaaatagaagtttgttatct

SEQ ID NO: 14062 - DNA, 887 bp, Theobroma cacao
ggctgcggctagggtttctcacatctctggtaaatattatagttttattcgtggaaataacagagattccgggatgagtaagcttcagagtgatgcccttagagaagctatttccaccattgtggctcagtccaaggaaaaaaaccgtaagttcactgagaccattgaactccagattgggctgaaaaactatgatccccaaaaggacaagcgtttcagtggatctgtgaagctgccacacattcctcgccctaagatgaagatctgcatgcttggagatgctcaacatgttgaagaggcagagaagataggcttggattatatggatgttgaagcactgaagaagcttaacaagaacaagaagttggtcaagaagcttgccaagaagtatcaggcctttttggcatctgaagctatcatcaagcagatccctcgtctcttgggtcctggtctcaacaaagcagggaaattcccaacccttgttactcaccaggaatccctagagtccaaggtgaatgagaccaaggcaatggtgaagttccaactgaagaaggttctttgcatgggagttgctgttgggaatgtagctatggaggagaagcagatcttccaaaatgtgcaaatgagtgtcaatttccttgtttcattgttgaagaaaaactggcaaaatgtgaggtgcctctacctgaagagtaccatgggcccttcaaacaggatcttttgagatgatatttactttctattagtgttatgtacggagtgaaagtagttgttgggattaatagtaaatcagttttttactcagaatgttcaaattttgtgttatgttttgttgctggaatccgtagaaatattatgaatttgagaccttggaagttttgttttgc

SEQ ID NO: 14063 - DNA, 970 bp, Daucus carota
gcaccaaaattagggtttcatttcaagatcccaacgctcactttatcttcaaccatgagtaagctgcagagcgaggcgctgagggaggcgattgcgcagattgtgaaggaagcggttgagaagaagaggaacttcacggagacgattgagctccagattggtttgaagaattatgatcctcaaaaggataagcgtttcagtggctcggttaagttgccgcacattccgcgtcctaagatgaaggtgtgcatgcttggtgatgctcagcatgtgggagaggcggagaaaattggtctggaatccatggatgttgaaggcttgaagaagcttaataagaacaagaagctagtgaagaaacttgcaaagaagtaccatgcttttttggcttctgaagctgtcatcaagcaaattccccgtcttttgggtccagggctcaacaaagcaggcaagtttccgacacttgtttcacaccaggagtcccttgagtctaaagttaatgagaccaaggcaactgtaaaattccagttgaagaaggtactttgcatgggagttgctgttgggaacctcagtatggaggaaaagcagatctttcagaatgtgcagatgagtgtgaacttcctagtctccttgttgaagaagaactggcaaaatgttaggtgcttgtacctgaagagcaccatgggaaagactgtccgcatcttttagagtaattttttcttattattgggcacaagatgctattccttcaaatgataggcgaatgttttaagctacctgtttattttagtgctatctcatgtaacagttgtattgtttttgcacttaaaattggagccatgactctgccatctgctttgcttagacagcgggtatgtctattgttttttgaaagttacagagagcgtgtttatgtcaattctttccctaaaaagatcggattttgttccctaagatcggatttgaaacagaa

SEQ ID NO: 14064 - DNA, 1121 bp, Daucus carota
atctagcagtcgcagcaccaaaattagggtttcatttcaagatcccaacgctcactccatcttcaaccatgagtaagctgcagagcgaggcgctgagggaggcgattgcgcagattgtgaaggaagcggttgagaagaagaggaactttacggagacgattgagctccagattggtttgaagaattatgatcctcaaaaggataagcgtttcagtggctcggttaagttgccgcacattccgcgtcctaagatgaaggtgtgcatgcttggtgatgctcagcatgtgggagaggcggagaaaattggtctggaatccatggatgttgaaggcttgaagaagcttaataagaacaaaaagctagtgaagaaattggcaaagaagtaccatgctttcttggcttctgaagctgtcatcaagcaaattccccgtcttttgggtccagggctcaacaaagcaggcaagtttccgacacttgtttcacaccaggagtcccttgagtctaaagttaatgagaccaaggcaactgtaaaattccagttgaagaaggtactttgcatgggagttgctgttgggaacctcagtatggaggaaaagcagatctttcagaatgtgcagatgagtgtgaacttcctagtctccttgttgaagaagaactggcaaaatgttaggtgcttgtacctgaagagcaccatgggaaagactgtccgcatcttttagagtaattttttcttattattgggcacaagatgctattccttcaaatgataggcgaatgttttaagctacctgtttattttagtgctatctcatgtaacagttgtattgtttttgcacttaaaattggagccatgactctgccatctgctttgcttagacagcgggtatgtctattgttttttgaaagttacagagagcgtgtttatgtcaattctttccctaaaaagatcggattttgttccctaagatcggatttgaaacagaatgagagtggtcattggacataatatatataaagtcaattgtttccctaagatcagaccagatacaggagattgatcattagtacatggtaaataaaattgtattttcgcctaatccaaaattttagttatttgttgg

SEQ ID NO: 14065 - DNA, 926 bp, Daucus carota
cgcagcaccaaaattagggtttcatttcaagatcccaacactcacccaatcttcaaccatgagtaagctgcagagcgaggcgctgagggaggcgattgcgcagattgtgaaggaagcggttgagaagaagaggaactttacggagacgattgagctccagattggtttgaagaattatgatcctcaaaaggataagcgtttcagtggctcggttaagttgccgcacattccacgtcctaagatgaaggtttgcatgcttggtgatgctcagcatgtgggagaggcggagaaaattggtctggaatccatggatgttgaaggcttgaagaagcttaataagaacaagaagctagtgaagaaacttgcaaagaagtaccatgctttcttggcttctgaagctgtcatcaagcaaattccccgtcttttgggtccagggctcaacaaagcaggcaagtttccgacacttgtttcacaccaggagtcccttgagtctaaagtcaatgagaccaaggcaactgtaaaattccagttgaagaaggtactttgcatgggagttgctgttgggaacctcagtatggaggaaaagcagatctttcagaatgtgcagatgagtgtgaacttcctagtctccttgttgaagaagaactggcaaaatgttaggtgcttgtacctgaagagcaccatgggaaagactgtccgcatcttttagagtaattttttcttattattgggcacaagatgctattccttcaaatgataggcgaatgttttaagctacctgtttattttagtgctatctcatgtaacagttgtattgtttttggacttaaaattggagccatgactctgccatctgctttgcttagacagcgggtatgtctatcgttttttgaaagttacagagagcgtgtttatgtcaattcttt

SEQ ID NO: 14066 - DNA, 961 bp, Daucus carota
cgcagcaccaaaattagggtttcatttcaagatcccaacactcacccaatcttcaaccatgagtaagctgcagagcgaggcgctgagggaggcgattgcgcagattgtgaaggaagcggttgagaagaagaggaactttacggagacgattgagctccagattggtttgaagaattatgatcctcaaaaggataagcgtttcagtggctcggttaagttgccgcacattccacgtcctaagatgaaggtttgcatgcttggtgatgctcagcatgtgggagaggcggagaaaattggtctggaatccatggatgttgaaggcttgaagaagcttaataagaacaagaagctagtgaagaaactggcaaagaagtaccatgctttcttggcttctgaagctgtcatcaagcaaattccccgtcttttgggtccagggctcaacaaagcaggcaagtttccgacacttgtttcacaccaggagtcccttgagtctaaagttaatgagaccaaggcaactgtaaaattccagttgaagaaggtactttgcatgggagttgctgttgggaacctcagtatggaggaaaagcagatctttcagaatgtgcagatgagtgtgaacttcctggtctccttgttgaagaagaactggcaaaatgtcaggtgcttgtacctgaagagcacgatgggaaagactgtccgcatcttttagaacagttttcttatattgggcacaagatgctattccttcaaatgataggtgaatgtttttatgctaccggtttattttagtgtcatctcatgtgacagttgtattgttttggagttaaaattggagccttgactctgccatctactttgcttagacatgatgggcatgtttatcttttttggaaggttacagagagcatgtttatgtcaattgttttcctaagatgggatttgaaacagaatgggagtggtc

SEQ ID NO: 14067 - DNA, 931 bp, Daucus carota
ggccgtcgcagcaccaaaattagggtttcatttcaagatcccaacgctcactccatcttcaaccatgagtaagctgcagagcgaggcgctgagggaggcgattgcgcagattgtgaaggaagcggttgagaagaagaggaactttacggagacgattgagctccagattggtttgaagaattatgatcctcaaaaggataagcgtttcagtggctcggttaagttgccgcacattcctcgtcctaagatgaaggtgtgcatgcttggtgatgctcagcatgtgggagaggcggagaaaattggtctggaatccatggatgttgaaggcttgaagaagcttaataagaacaaaaagctagtgaagaaattggcaaagaagtaccatgctttcttggcttctgaagctgtcatcaagcaaattccccgtcttttgggtccagggctcaacaaagcaggcaagtttccgacacttgtttcacaccaggagtcccttgagtctaaagtcaatgagaccaaggcaactgttaaattccagttgaagaaggtactttgcatgggagttgctgttgggaacctcagtatggaggaaaagcagatctttcagaatgtgcagatgagtgtgaacttcctagtctccttgttgaagaagaactggcaaaatgtcaggtgcttgtacctgaagagcacgatgggaaagactgtccgcatcttttagaacaattttttcttatattgggcacaagatgttatttcttcaaatgataggcggatgttttaagctacctgtttattttagtgctatctcatgtaacagttgtattgtttttggacttaaaattggagccatgactctgccatctgctttgcttagacagcgggtatgtctatcgttttttgaaagttacagagagcgtgtttatgtcaattcttt

SEQ ID NO: 14068 - DNA, 961 bp, Daucus carota
gcagcaccaaaattagggtttcatttcaagatcccaacgctcactccatcttcaaccatgagtaagctgcagagcgaggcgctgagggaggcgattgcgcagattgtgaaggaagcggttgagaagaagaggaactttacggagacaattgaactccagattggtttgaagaattatgatcctcaaaaggataagcgtttcagtggctcggttaagttgccgcatattccgcgccctaagatgaaggtgtgcatgcttggtgatgctcagcatgtgggagaggcggagaaaattggtctggaatccatggatgttgaaggcttgaagaagcttaataagaacaaaaagctagtgaagaaattggcaaagaagtaccatgctttcttggcttctgaagctgtcatcaagcaaattccccgtcttttgggtccagggctcaacaaagcaggcaagtttccgacccttgtttcacaccaggagtcccttgagtctaaagtcaatgagaccaaggcaactgttaaattccagttgaagaaggtactttgcatgggagttgctgttgggaacctcagtatggaggaaaagcagatctttcagaatgtgcagatgagtgtgaacttcctagtctccttgttgaagaagaactggcaaaatgtcaggtgcttgtacctgaagagcacgatgggaaagactgtccgcatcttttagaacagttttcttatattgggcacaagatgctattccttcaaatgataggtgaatgtttttatgctaccggtttattttagtgtcatctcatgtgacagttgtattgttttggagttaaaattggagccttgactctgccatctactttgcttagacacggtgggcatgtttatcttttttggaaggttacagagagcatgtttatgtcaattgttttcctaagatgggatttgaaacagaatgggagtggtcg

SEQ ID NO: 14069 - DNA, 975 bp, Daucus carota
gcagcaccaaaattagggtttcatttcaagatcccaacactcacccaatcttcaaccatgagtaagctgcagagcgaggcactgagggaggcgattgcgcagattgtgaaggaagcggttgagaagaagaggaactttacggagacaattgaactccagattggtttgaagaattatgatcctcaaaaggataagcgtttcagtggctcggttaagttgccgcacattccacgtcctaagatgaaggtttgcatgcttggtgatgctcagcatgtgggagaggcggagaaaattggtttggaatccatggatgttgaaggcttgaagaagcttaataagaacaagaagctagtgaagaaacttgcaaagaagtaccatgctttcttggcttctgaagctgtcatcaagcaaattccccgtcttttgggtccagggctcaacaaagcaggcaagtttccgacacttgtttcacaccaggagtcccttgagtctaaagttaatgagaccaaggcaactgtaaaattccagttgaagaaggtactttgcatgggagttgctgttgggaacctcagtatggaggaaaagcagatctttcagaatgtgcagatgagtgtgaacttcctagtctccttgttgaagaagaactggcaaaatgttaggtgcttgtacctgaagagcacaatgggaaagactgtccgcatcttttagaacaattttttcttatattgggcacaagatgttatttcttcaaatgataggcggatgttttaagctacctgtttattttagtgctatctcatgtaccagttgtatcgtttttggacttaaaattggagccatgactctgccatctcctttgcttagacagtgggtatgtctatcgttttttgaaagttacagagtgtgtttatgtcaatcgtttccctaagattggattttgttccctaagattggatttgaaacagaatgagagtg

SEQ ID NO: 14070 - DNA, 983 bp, Cenchrus ciliaris
aagggagctgagtgaccggttgcagccatgagtaagttgcaaactgaggttctcaaagaagccatctctcagatcgttgtggcttccaaggagaagaataggaagttcactgagacagttgagcttcagattggcctgaagaactatgacccacagaaggacaagcgtttcagtggctctgttaagctgccccacatcccccgccccaagatgaaggtgtgcatgcttggtgatgcccagcacgttgaggaggctgagaagcttggacttgactacatggatgtcgagtctctgaagaaaatgaacaagaacaagaagcttgtcaagaagcttgccaagaagtaccatgctttcttggcgtcagaggccatcatcaagcagatcccccgtctccttggtcctggtctcaacaaggcaggcaagtttcccacactggtttctcaccaggagtctcttgaagccaaggtgaacgagacgaaagctacagtcaagttccagctaaagaaggttctttgcatgggtgttgctgttggtaacctgtccatggaggagaagcagatccagcagaacatccagatgagcgtcaacttccttgtgtcccttctgaagaagaattggcagaacgtgaggtgcctgtacgtcaagagcactatggggaagccgtacagggtgttctaagtcttgccgctatccttgtgaaggacctcgaactgggcttgccataaacttagattgtacccatcagttttgtgcctgtcaatgagactgttgaaatatcttgtccttaaatttagtgtttcgcttaatagaacctgtggagggatgcttttggaattatggagttgcatcttgtgttatggttcttttgctgccccttgtctcttgtttgctgcaccgcagtttcggtattgttggcatacagactggtgtgaattggttggtttgtgggcatggttttatctgaaaacaagccattggttctg

SEQ ID NO: 14071 - DNA, 1416 bp, Cocos nucifera
ctaaagtatacttcttctctttcgcctctcccgcttttaattttttccccccttctctaaaggccttcgaaaccctctaattctgcattttttcatataatttttgatggatctttaccagatctatgcgtcaatctgatatcaaagaaggatagaagctgatagggcaattcctttgaggagttgttaaacaaaggagaagaaccatgagcaagctgcagggcgatgtgttgagagaggctatctctcagattatgaatgatactagtgagaaaaagcgcaacttcactgagaccattgagctgcagattggactaaaaaattatgacccacaaaaggataagcggtttagcggttctgtgaagttgccacatattccgcgtccaaagatgaaggtttgcatgcttggtgatgctcaacatgtggaagaggctgagaaaattggactggactatatggatgttgaagggctaaagaagatgaacaagaataagaagttggtcaagaagctcgcaaagaaatatcatgcatttttagcatctgaggctattatcaagcagattcctcgacttttgggccctggtcttaacaaggcaggtaaatttcctacattggttacacatcaggaatctttagaggccaaagtcaatgagaccaaagcaatggtgaagtttcagctgaagaaagttctttgcatgggagttgctgtcgggaattgtgcaatggaggagaagcaggtttttcaaaatgtgcaactcagtgtcaacttcctggtgtctttgttgaagaagaattggcagaatgtgagatgcttgtacttgaagagcaccatgggaaaaccttatcgcgtgttctaagaaaagatgtgcaaaatctaatgcttgcttaccaatacttgggttgaactgctcgagctcctccttttatcattaagtcttctctttgctttctctctgtgtgcttggttttgcagtttgaactttctttgacgtgtttaagctgcctgttgagattagagttgttgggtaaacatttcttattatctggaagttttgttttggaccatatatgtgagaacctagttgatggggtatggttcaaattcagatattgttatactagtttggtttgctgccatctttaaacgataagcattaatagacttgacttccagaatggagattcaccatggagtgtgccattgttttctaaatgcatctaactttaattggaattttcatgttacaatctgttgagagaagcttatattgctatgctcatgagattctaagccatgtagaagccaaaaaatctggaactgaggaagagggggtcgtgagatttgatctttcacagaaaatgcgagatttgatacgtacgcatatgatgtgttgtgggtggtatattgatcggcag

SEQ ID NO: 14072 - DNA, 997 bp, Cyclamen graecum
tgaacaccaccatctctccactggttggttgtggaagcttctgtaaattctaaaccatgagtaagctacaaagtgaggctgtcagggaagccatctctcagatttctggagaagcaaaggataagaaacgtaactttgtggagactatcgagctccagattggtttgaagaactatgatccccaaaaagataagcgtttcagcggctctgtgaaactgccacacattcctcgtcctaagatgaaggtttgcatgcttggtgatgctcagcatgttgaggaggcagagaagatcggattggactacatggatgttgaagggctgaagaagctgaataaaaacaagaagttggtgaagaagctggctaaaaagtaccatgcttttctcgcatctgaagctgtaatcaagcagatccctcgtctcttaggccctggtcttaacaaggcagggaagtttccaacccttgtctctcatcaggagtccttggagtcaaaagttaatgaaacaaaagcaaccgtcaagtttcagctaaagaaggttttgtgcatgggtgttgcggtcggaaattgcggcatggaagagaagcagatcttccaaaatgttcaaatgagtgtgaactttcttgtttcgctgctgaaaaagaactggcaaaatgtgaggtgcttgtacctgaagagcaccatggggaggccagtccgtgtattctgaggtgttagttgcgtgtcgtcggttttgggtgttcttcacattacccttttgttgttcctttttcttggatctttctccctcattaatatcagttggtacttgagtcaaaaaatttatgcgccttcatttgacgatcagagaagacaagattaagctctttggagttgttctccggtttcacttggatttgtgtattttttgcatgttgcctgcatcctttatttactactgccttttccatgtctgttttgaacttcgcatcttcagcacactaagattagtttctggcc

SEQ ID NO: 14073 - DNA, 769 bp, Cyclamen graecum
ctccttgatttgtggtttctctctatctgctaaaccctaatttagttcggaaccctatagaggttactgtcagttcttcattatgagtaagctacaaagtgatgctgttagggaagccatttctcaaatttctggagaagcaaaggataagaaacgtaatttcgtagagactatcgagctccagattggtttgaagaactatgatccccaaaaagataagcgtttcagcggctctgtgaaactgccacacattcctcgtcctaagatgaaggtttgcatgcttggtgatgctcaacatgttgaggaggcagagaagataggattggactacatggatgtcgaagggctgaagaaactgaacaagaacaagaaattggtgaagaagctggctaaaaaatatcacgcctttctcgcatctgaggctgtcattaagcagatccctcgtctactggggcccggtcttaacaaggcaggaaaatttccaacccttgtctctcatcaggaatccctggagtcaaaagttaatgaaacaaaagcaactgtcaagtttcagctgaagaaggttctgtgcatgggtgttgctgtcgggaattgcggcatggaagataaacagatcttccaaaatgttcaaatgagtgtgaactttcttgtttcgctgctgaagaagaattggcaaaatgtgagatgcttgtatctgaagagcactatgggaaggccagtccgtgtcttctaaggtgttgtttacttggtgggcgaattgggagcgagg

SEQ ID NO: 14074 - DNA, 895 bp, Echinochloa colona
ctgctctcctcgcgcaggcgccgcacttcccttctcgtctcgtctggtctgccctagcagcaggtggatcagtgatcgacggactgcagccatgagtaagttgcaaaccgaggtcctcaaggatgccatctcccaggttgtctcggaggccaaggagaagaacaggaagttcacagagaccattgagctccagattggactgaagaactacgatccgcaaaaggacaagcgtttcagtggctctgttaagctgccccacatcccccgcccgaagatgaaggtgtgcatgcttggtgatgcccagcacgttgaggaggctgagaagatgggacttgactgcatggatgttgaggcgctcaagaaaatgaacaagaacaagaagcttgtaaagaagcttgccaagaagtaccatgctttcttagcatccgaggccatcatcaagcagattccccgtctccttggtcctggtctcaacaaggcaggcaagttccctacactggtcactcaccaggaatctcttgaatccaaggtgaacgagacgaaagctacagtcaaattccagctgaagaaggttctttgcatgggtgttgctgtgggcaacctgtcgatggaggagaagcagatccagcagaacatccagatgagtgtcaacttcctcgtgtcccttctgaagaagaactggcagaatgtgaggtgcctgtacatcaagagcaccatggggaagccgtacagggtgttctaagtcagtgccgtgatgggtgtgaagttgataattattaggcacttgaactgatcgtcttgagatcaaatatgttgcacacaccagttttgtgcctttacattgcgattatccaagtatttggtccttaatcctagtgcttttttcaatagaacc

SEQ ID NO: 14075 - DNA, 1079 bp, Lupinus angustifolius
aaacccaacccaacccaacttaatccattcattcattttgctggtgcacatagggtttttattaacacctgcgtgctcacgctattgttctttctttccgccgttcaggtaggtcttcgctcgcgtcggcgaatcgattaacctctactcaccatgagtaagctacaaagtgaagcgctaagagaggcgatatctcagatcgttacgaattcaaaggagaaaaatcgtaagttcactgagactattgagcttcagattggattgaagaattatgatcctcagaaagacaagcgtttcagtggttctgttaagcttcctcacattcctcgacccaaaatgaggatctgcatgcttggtgatgctcagcatgtcgaagaggcagaaaaaattggattggattacatggatgtggaagcactgaaaaagcttaataaaaacaagaaacttgtcaagaagcttgccaagaagtaccatgcttttcttgcatctgaagctatcatcaagcaaattcctcgtcttctgggccctggtttaaacaaggcaggtaaatttccaacattggtcagtcatcaggaatccttggagtcaaaagttaatgaaaccaaagcaatggtgaagtttcaacttaagaaagttctttgtatgggagttgctgttggaaattgcgcaatggaggagaagcaaattttccagaacgttcaactcagtgtcaatttccttgtctccttattgaagaaaaactggcaaaatgtgagatgcttatacgtgaagagtactatgggcagcgctgtccgcgtattttagatccatatatatcatctgttccggataccgtggagttgctagttagcgtttatgaagaggcctctttctcttttgtttgatgttgacaattttgtttgatgtgattcattgctcactgattttaaagattttgaagtacatctgactttgtcagagtttactatttatgcataatgttttttacgagtgagtatagtaaataattattaatacatgaatggtaatggataccccacgttgtaaaaagagtaaattacactgacactccctgagtt

SEQ ID NO: 14076 - DNA, 960 bp, Olea europaea
cttcagtcatcgacctccttccaaacccccgacacagaagtgaagcgggaaggaaaacaaatctctggccatgagtaagctgcagagtgaggctcttagggaagctatctcagtaattactactgatgtcaaggagaagaagcgtaacttcgttgagacaattgagctccagattgggctgaaaaactatgatccacagaaggataaacgtttcagtggctccgtgaagttgcctcacattcctcgtcccaagatgaagatttgcatgcttggtgatgctcagcatgttgaggaggccgaaaaaattggtcttgaatccatggatgtggaggctttaaagaagttgaacaaaaacaagaaactggttaagaagcttgctaaaagatatcatgctttcttagcctccgaagctgttatcaagcagattccccgtctcttaggacctggtcttaacaaggcaggtaagttcccaactctcgttagccaccaggaatctcttgaatctaaggtcaatgaagccaaggccacagtgaaattccagctgaagaaggtgctttgcatgggagttgctgttggaaactgtgctatggaggagaagcagatctttcagaatgtgcaaatgagtgtcaactttctagtttcgctgttgaagaaaaactggcagaatgtgaggtgcttgtacttaaaaagtacaatggggaagcctcagcgcatcttttaaggagataatattttgtttctgtcgatccagttttagggatagtagtgtggagctaaagcaatggaatccttccctgcaatagcaagtttttggttgtcaatggtctcgatactgtttcagatgacactgtgattgttttgctttgtttttctactgagatgggattgatttttccttactgtaccctcaacatttttatcagggatagccagtttactgttgctctattattatttgca

SEQ ID NO: 14077 - DNA, 1629 bp, Petroselinum crispum
aatctcgataagtgaatattcgaatcgagtgatatatattctggtatcgatgtaatagagacggtgcatttttgagttgatataaatgaataacttgagaattgaatagtattttacggtcctgagggtgattgtttatcgaggtttaaatgtgtttgtatttatgtgtgttgaactgttttgggttgggtgagtaatttggtcaatttctgattgttttcacttgtaaatggggttttaatgactgcttaaagtaccgtttagttttgttaattttgaattttacggagtcttttaaattactaattaggtcctcccccccccccccccccccccccccaccatctctttctctccctcgcatttgctcagcagccgcaccaaaattagggtttcattaccaggtcccaacacacccaatcttcaccatgagtaagctgcagagtgaagcattaagggaagcaatagcgcagattgttaaggaagctggtgagaagaagaggaactttacggagacaattgagctccagattggtttgaagaattatgatcctcaaaaggataagcgtttcagtgggtcagtgaaattgcctcacattccacgtcccaagatgaaggtttgcatgcttggtgatgctcagcatgtcggagaggcagagaaaattggtttggaatccatggatgttgaaggcttgaagaagcttaataagaataagaaactagtgaagaaacttgcaaagaagtaccatgctttcttggcttctgaagctgtcatcaagcaaattccccgtcttttgggtccagggctcaacaaagcaggcaagtttcctacacttgtttcacaccaggagtcccttgagtctaaagtgaatgagaccaaggccacggtaaaatttcaattgaagaaggtactttgcatgggagttgctgttgggaacctcagtatggaggaaaagcagatcttccagaatgtgcagatgagtgtgaacttcctagtttctctgttgaagaaaaattggcaaaatgtcagatgcttgtacctgaagagcacaatgggaaagactgtccgcatcttttagaacaattttcatatatttggttgaagttagttaatgaatgaaatgtatgcaccagacgttatacctttaaattcttgtgatagacgaatgttcttaagcttacctgtttgttttagtgcgcaattgcatatgactattgtattgttttggagatttaagccttatgattctgcatatctactttgcttatagatacagtgagctttttccatctgctcaatatatctagtcatttgtttccctttaatacctgagacagaatgggagcgatccttgagaacactcaggataagaaattcttattttcgttaaagaaatgttttttaagatcttcggtagggaatatcgattgaattattagtacaaagaaatttaattgagattatattgatttgcggcacagctaaaaccacattgaaatcattcaaatcatcacttgccccaaaaattacagtcatagcatatgatgtccaagctgctaagcacagtaaaaagtgaaattctacacctagaggggatgggggttaataggcgtttagtgaaattctac

SEQ ID NO: 14078 - DNA, 817 bp, Capsicum annuum
aaaaacatcctacatctcatatcagaacttcttttaaccctcaaatttccagccaccactccgccgctcgctcagtctctctcatctcccttccctttccatttgcaagagaaaattttcctccgtttcgactttcagccatgagtaagcttcagagtgaagccctaagagaagccatctccgtgattaagaatgatgcaaatgagaagaaaaggaagttcactgaaaccattgagcttcagattgggctgaaaaactatgatcctcaaaaggacaagcgtttcagtggttcagttaagttgccacacattcctcgccctaagatgaagatttgcatgcttggagatgctcagcatgtgggagaggcagaaaagattggcttggagtacatggacgtggaaggcctgaagaagcttaacaagaacaagaagttggttaagaagcttgcaaagaaataccatgctttccttgcatcagaagctgtaatcaagcagatcccccgtctcttggggcctggtttgaacaaggcaggtaagtttcctacccttgtttcccaccaggaatcacttgagtctaaagttaacgagaccaaggccactattaaattccagttgaagaaggtgctttgcatgggagttgccgtaggtaatatggatatggaggagaaacaaatcttccagaacgtgcagatgagtgtcaactttctagtgtccctgctaaagaagaattggcaaaatgtcagatgcttgtacttgaagagtaccatgggaaagactcaacgcatattctaaggatattgtagtacaatcttggcagt

SEQ ID NO: 14079 - DNA, 882 bp, Ananas comosus
atctgctaaaccctaatttagttcggaaccctatagaggttgctgtcagttcttcattatgagtaagctacaaagtgatgctgttagggaagccatttctcaaatttctggagaagcaaaggataagaaacgtaatttcgtagagactatcgagctccagattggtttgaagaactatgatccccaaaaagataagcgtttcagtggttctgttaaattgcctcacattcctcgtcctaagatgaaggtttgcatgcttggtgatgctcaacatgttgaggaggcagagaagataggattggactacatggatgtcgaagggctgaagaaactgaacaagaacaagaagttggtgaagaagctggctaaaaagtaccatgcttttctcgcatctgaagctgtaatcaagcagatccctcgtctactggggcccggtcttaacaaggcaggaaaatttccaacccttgtctctcatcaggaatccctggagtcaaaagttaatgaaacaaaagcaactgtcaagtttcagctgaagaaggttctgtgcatgggtgttgctgtcgggaattgcggcatggaagataaacagatcttccaaaatgttcaaatgagtgtgaactttcttgtttcgctgctgaagaagaattggcaaaatgtgagatgcttgtatctgaagagcactatgggaaggccagtccgtgtcttctaaggtgttgtttacttggtgggcgaattgtgagcgagggtgtaggcaggactttgctacagttttggttcttcttcacattattttcaaatttgatttcttcttcttggatattctcggccttttaactgtcatatctcaaatttgaaatttggttgcactttattttactgaaa

SEQ ID NO: 14080 - DNA, 844 bp, Sesamum indicum
ggggaactccacttcatttctgctctagccacttcttcgaccgtctcgcgaaccctaattcagggttttctcatcagaagtgagtttgggaagatataagatcttgaaccatgagtaagcttcagagtgacgccctgagggaagctatctctgtgattgcagcagattctaaggagaagaagcggaatttcactgagacagtcgagctccagattggactcaaaaactatgatccacagaaggataagcgtttcagtgggtctgtgaagttgccccacattccaagaccaaaaatgaaaatctgtatgcttggtgatgcccagcatgttgaagaggcagaaaagattggcctcgagtccatggatgtggaggctttgaagaagttgaacaaaaacaagaagttggtgaagaagcttgcgaagaagtatcatgctttcttagcctcagaggcagttatcaagcaaattccccgtctcttagggcccggtcttaacaaggcaggcaagttcccaactcttgtgactcaccaggaatcgcttgaatccaaggtgaatgagaccaaggcgacagtgaagttccaattgaaaaaggtgctttgcatgggtgttgccgttgggaatcttgacatggaagaaaagcaaatctttcagaatgtgcaaatgagtgtgaacttcctagtttctcttttgaagaagaactggcagaatgttaggtgcttgtacttgaagagtacaatggggaagccacagcgcattttctaaggagtttgatttttgtttgcaagtggtagggtgagaagttgtaagagaggaaaaacaattgatgattcccaagagatggggtt

SEQ ID NO: 14081 - DNA, 1188 bp, Triticum aestivum
tcgttactccctctctctggaccgccgccgccgcctcgccaaaatccggcgtcaactgatcggcggcagccatgagtaagctccaaagtgacgctgttaaggatgccatcacccagattgttggggaggcgagagaaaagaagcgcaagttcactgagactgtggagcttcagatcggtctcaaaaactacgacccacaaaaggacaaacgtttcagcggctcagtgaagctgccccatatcccccgcccaaagatgagggtgtgcatgcttggtgatgcccagcatgtcgaccaggctgagaaaatgggacttgactacatggatgttgaaagtctcaagaagatgaacaagaacaagaagcttgttaagaagctagccaagaagtaccatgctttcttggcatcagaggccataatcaagcagatccctcgtctccttggccctggtcttaacaaggcaggcaagtttcccactctggttagtcaccaggaatctcttgaagccaaggtcaacgagacaaaagctacagtcaagttccagctaaagaaggttctttgcatgggtgttgctgtgggcaacttgtcgatggacgagaagcagatccaacaaaacatccaaatgagtgtcaacttccttgtgtccctcctgaagaagaattggcagaatgtgaggtgcctgtacgtgaagagcaccatggggaagcgtgtacgtgtgttctaagtgtgtgcgctccagtgaagttgataagataccgggctttcctgccgacccctgcttgtctttggattagatctgtttcactgataccaattttctgtttgcctaagcgaatatcaacaagtattttatcgtactagtcttatcttgaacagaaatcatgggagcaatggaactgcattttctgtcatgattctgcgttgtgcctgttatcagagatctatatgcgatcttgattgtcatctgaatgtagattttacttggaagtgtttcctataagtgtgtttaaatggataacttatttggttagcctagcaaatctcaggaaaatagaagtttgttatctgtaaaaccggagaagtgggattttgtaaaaacgactgtcagtactatatgcttttggattttcagtgatcggttgatgtggttcagcttcttcagaatccaagccaaatagtcagacctcata

SEQ ID NO: 14082 - DNA, 1035 bp, Triticum aestivum
gaacatataagaggagcctccgtgcccgtccgcgtcctcttcgttactccctctctctggaccgccgccgccgcctcgccaaaatccggcgtcaactgatcggcggcagccatgagtaagctccaaagtgacgctgtcaaggatgctatcacccagattgttggggaggccagagaaaagaagcgcaagttcactgagactgtggagcttcagatcggtctcaaaaactatgacccacaaaaggacaaacgtttcagcggctcagtgaagctgccccatatcccccgcccaaagatgagggtgtgcatgcttggtgatgcccagcatgtcgaccaggctgagaaaatgggacttgactacatggatgttgaaagtctcaagaagatgaacaagaacaagaagcttgttaagaagctagccaagaagtaccatgctttcttggcatcagaggccataatcaagcagatccctcgtctccttggccctggtcttaacaaggcaggcaagtttcccactctggttagtcaccaggaatctcttgaagccaaggtcaacgagacaaaagctacagtcaagttccagctaaagaaggttctttgcatgggtgttgctgtgggcaacttgtcgatggacgagaagcagatccaacaaaacatccaaatgagtgtcaacttccttgtgtccctcctgaagaagaattggcagaatgtgaggtgcctgtacgtgaagagcaccatggggaagcgtgtacgggtgttctaagtgtgtgcgctccagtgaagttgataagataccgggctttcctgccgacccctgcttgtctttggattagatctgtttcactgataccaattttgtgtttgcctaagcgaatatcaacaagtatttaatcgtactagtcttatcttgaacagaaatcatgggagcaatggaactgcattttctgttatgattctgcgttgtgcctgttatcagagatctatatgcgatcttgattgtcatctgaatgtagtttttacttgaaatgtttcctat

SEQ ID NO: 14083 - DNA, 1489 bp, Panicum virgatum
cacatggatctcgcatttgcatcaaggatcatcaggccgaaacttgttgcttaacaatcatcagtccttgatgatcatcaaggatcatcacacgacgcagactcttgttgcttaacaacaaggatcatcaggccgcctactgcatgccggcctgcagtcagtcgtaggcccagaagcaggaaggccgtcttcttcttctggcaaaagccacaaagaaggatggcccatgttcgtccgcccgcggcccaaacagcccatagcgagctctcgcatccgacggttgggcgcctggccacgcggcgtccatcgggagctcgctcgctctagggttttccttcccaccgctgctcatataactcccgcggccaccgccgccgccgcttttctttctcgctcgctccgtcgcccgcccgaagcaaagcaagggagttgagttgagttgagtcaccggttgcaaccatgagtaagttgcaatccgaggttctcaaggatgccatctcccagattgttggggatgccaaagagaagaataggaagttcaccgagaccgttgagcttcagattggtctgaagaactatgacccgcagaaggacaagcgtttcagcggctctgttaagctccctcacatcccccgcccaaagatgaaggtgtgcatgcttggtgatgcccagcacgttgaggaggctgagaagattggacttgactacatggatgtcgaggcgctcaagaagatgaacaagaacaagaagcttgtcaagaagcttgccaagaagtaccatgctttcttagcatcagaggccatcatcaagcagattccccgtctccttggtcctggtctcaacaaggcaggcaagttccctacactggttacccaccaggagtctcttgaatccaaagtgaacgagacaaaagctacagtcaagttccagttgaagaaagttctttgcatgggtgttgctgtgggtaacctgtccatggaggagaagcagatccagcagaacatccagatgagcgtcaacttccttgtgtcccttctgaagaaaaactggcagaatgtgagatgcctgtacatcaagagcaccatggggaagccatacagggtgttctaagtcttgccgcgatccttgtgaagttgataaaaatactaggccacaccagctgggctggtcttgaaacttagatttgtgcctaaaaatactccgcagtttcgatgatattgtcatcctgactggtatgagaatgagatcgttggttatgaactgcattcatcattccttctctagtttctttgtttagacaatcacgtagatttgcaatcatgattttgatggaactgttttcccggagaaaggacggagctagtaggagaaccaagggggcaatggccccattatactttatgtgcactcttatgctggcgtgcaaaatgtcaaacacagaggaagcaagctacagtgttgtactgaataaaatatctcattctcttaa

SEQ ID NO: 14084 - DNA, 1114 bp, Oryza sativa
ccatttctgcctcgtcccctcttcgcctctcctccgccggcgccgcccctgcccaaaccctagagtgttgttgagttatcggccgcaaacatgagtaagttacaaaccgaggctctcaaggaagccatctcccaggttgttgctgattgcaaggaaaagaacaggaagttcaccgagaccgttgagcttcaaattggtctcaagaactatgacccacaaaaggacaagcgtttcagcggctccgttaagctgtcccatatcccccgccccaagatgaaggtctgcatgcttggtgatgcccagcatgtcgaggaggctgagaagattgggctcgactacatggatgttgaggcccttaagaagatgaacaagaacaagaagcttgtgaagaagcttgccaagaagtaccatgctttcttagcatcagaggccatcatcaagcagatcccccgtctccttggtcctggtctaaacaaggcaggcaagttccctacattggttactcaccaggagtctcttgaatccaaggtcaatgagacgaaagctacagtcaagttccagctgaagaaggttctgtgcatgggtgttgctgtgggtaacttgtcgatggaggagaagcagatccagcaaaacatccaaatgagcgtcaacttcctcgtgtcccttttgaagaagaactggcagaatgtgaggtgcctgtacatcaaaagcacaatggggaaaccgtacagggtgttctaagctggtttgctccacattgaagctgataagatgctgggcggttgaactgagcttgtccttacattagatctgcttgcactgatatcagttttgtgcttacccaagagaacatcgagatatgttatcatattttgtagtagtttattcagtgcacttcggatttatgcaaatgaggcttgtgttatttatgaatagtttcgttcatggggagaattggtgtgccaactaccgttcgttctggtttgaccttgaatcgatagcaaatgttgccgctgctcgcaagaatcgtgcagcatcgaaatcatgatgcggcgccgtttgaccccatttttgaagatacagaaacagtataattcaagtagacttttaagaa

SEQ ID NO: 14085 - DNA, 1078 bp, Hordeum vulgare
cgtccgtttcctcttcgttactccctctctctcgaccgacgccgccgccgcgtcgacaaagtccgtaagggcgtcaactgatcggcggcagccatgagtaagctccaaagtgatgctgtcaaggatgccatcacccagattgttggggaggccagagaaaagaaacgcaagttcactgagactgtggagcttcagattggtctcaagaactacgacccacaaaaggataaacgtttcagtggctctgtgaagctgccccatatcccccgcccaaagatgagggtgtgcatgcttggtgatgcccagcacgttgaccaggctgagaaaatgggacttgactacatggatgttgaaagtcttaagaagatgaacaagaacaagaagcttgttaagaagctagccaagaagtaccatgctttcctggcatcagaggccataatcaagcagatccctcgtctccttggccctggtcttaacaaggcaggcaagtttcccactctggtaagtcaccaggaatctcttgaagccaaggtgaacgagacaaaagctacagtcaagttccagctaaagaaggttctttgcatgggtgttgctgtgggcaacttgtcgatggacgagaagcagatccaacaaaacatccaaatgagcgtcaacttccttgtgtccctcctgaagaagaactggcagaatgtgaggtgcctgtacgtgaagagcaccatggggaagcgtgtacgggtgttctaagttggtgttctccagtggctgtcctgtcgacccgagcttgtctttggattagatctgtttcactgataccaattttgtgtttacctaagcgaacatcaacaagtattttatcttgttagtcttttgttgaacagaaatcatgggagcaatagaactgcattttctgttaagattctccgttgtgccttttatatcaaagatctatgcgatcttgattttcatctctggggttgtttggataaggattttttcctaaaaccgtttcctataagagcatctcaaacagttatggtttcctctagtttgtaggtcaaactcatgtaaaatgatccag

SEQ ID NO: 14086 - DNA, 1055 bp, Hordeum vulgare
gttactccctctctctcgaccgacgccgccgccgcgtcgacaaagtccgtaagggcgtcaactgatcggcggcagccatgagtaagctccaaagtgatgctgtcaaggatgccatcacccagattgttggggaggccagagaaaagaaacgcaagttcactgagactgtggagcttcagattggtctcaagaactacgacccacaaaaggataaacgtttcagtggctctgtgaagctgccccatatcccccgcccaaagatgagggtgtgcatgcttggtgatgcccagcacgttgaccaggctgagaaaatgggacttgactacatggatgttgaaagtcttaagaagatgaacaagaacaagaagcttgttaagaagctagccaagaagtaccatgctttcctggcatcagaggccataatcaagcagatccctcgtctccttggccctggtcttaacaaggcaggcaagtttcccactctggtaagtcaccaggaatctcttgaagccaaggtgaacgagacaaaagctacagtcaagttccagctaaagaaggttctttgcatgggtgttgctgtgggcaacttgtcgatggacgagaagcagatccaacaaaacatccaaatgagcgtcaacttccttgtgtccctcctgaagaagaactggcagaatgtgaggtgcctgtacgtgaagagcaccatggggaagcgtgtacgggtgttctaagttggtgttctccagtggctgtcctgtcgacccgagcttgtctttggattagatctgtttcactgataccaattttgtgtttacctaagcgaacatcaacaagtattttatcttgttagtcttttgttgaacagaaatcatgggagcaatagaactgcattttctgttaagattctccgttgtgccttttatatcaaagatctatgcgatcttgattttcatctctggggttgtttggataaggattttttcctaaaaccgtttcctataagagcatctcaaacagttgtggtttcctctagtttgtaggtcaaactcatgtaaaat

SEQ ID NO: 14087 - DNA, 949 bp, Vitis vinifera
gggctcattgaaaaaaccctagcagccactgctagggttttcttcatctcctctggttcggaaagaaacctgtagtggatccattggaaggaagaggcttcaagcatgagtaagctccagagtgatgctcttagagaagccatcacaaacattgttaatgaatccaaggagaaaaagcgtaattttactgagaccattgagctccaaatcgggctgaaaaactatgatccccagaaggacaagcgtttcagtggttctgtgaagttgccccacatccctcgccccaagatgaaggtctgcatgcttggtgatgctcaacacgtggaagaggcagaaaagataggcttggaatacatggatgtggaagggctaaaaaagctgaacaagaacaagaaactggtcaagaaacttgccaagaaataccatgcctttttagcatcagaggctgttattaagcagatcccccgtcttttaggccctgggctcaacaaggcaggtaagttcccaacacttgttactcaccaggaatcccttgagtctaaagttaatgagaccaaggcaatggtaaagttccaattgaagaaggtcctttgcatgggagttgctgtgggtaactgcagtatggaggagaagcagatctttcaaaatgtgcaactgagcgttaatttccttgtctccttgttgaagaagaactggcaaaatgtgaggtgcttgtacctgaagagcaccatggggagatcaaaccgcgtcttctaaggagttaaatcttttacctgttatggttggtgtgtagggagagtcctattttgagcaaacagttttaaaaatgttttttttttccttcatatcaaactgaatggtcaaattttcttcatgcttggctgtctacttttgggatttcattgcactcagaagcaaccatataacatcaggttttattttaaatttt

SEQ ID NO: 14088 - DNA, 1029 bp, Triphysaria pusilla
cgcgaggtcggcgttctcctcgatccttaatattagtctactaaaagcccaattccgggagcccaattgctactttgttctagggtttgcggactaatatttaaaagttttcacttcactgaaaccctagtcgtggtcttcctttcagccatcgaagcagaaacgagttcgggaagataagtgctcttgaatcatgagtaaacttcagagtgatgccctgagggaagccattactcagattgtctctgattgcaaggagaagaagaggaactttgttgagacagtcgagctccagataggactcaagaactatgatcctcagaaagataagcgtttcagtggttctgttaagcttccacacattccgagacccaaaatgaagatctgcatgcttggtgatgctcagcatgttgaagaggcaacaaagattggccttgagtccatggatgtggaggctctgaagaagctgaataaaaacaagaagctagtgaaaaaacttgctaagaagtatcatgctttcttagcctcagaatctgttatcaaacagattccccgtctcttgggtcccggtcttaacaaagcaggcaagttccccaccctcgtgtcacaccaagagtcactagaggcgaaggtcaatgagaccaaggctaccattaagtttcagttgaagaaggtgctttgcatgggtgttgctgttgggaaccttgacatggaggagaagcaaatcttccaaaacgtgcagatgagcatcaacttccttgtttcacttctcaagaagaattggcagaatgtgaggtgcttgtacttgaagagtaccatgggaaagacacaacgtatcttctaattagttttcaaacttgtagttcgattttgtgatggatagatatgcgtgagaggtgaagtcaagaacaatttgatatttcccagaaatgggtttgttttttattttctattatttttataattctcagattggtggcgttatcatattcaagcagaaattatttatgtcgattcatatatgaccta

SEQ ID NO: 14089 - DNA, 893 bp, Arabidopsis lyrata
ttcttctgtctcatcactcaggatcagatcttagctaaattgagacaagctcaaaatgagtaagcttcagagtgaggccgtgagagaagccatcactattatcacagggaaatccgatgcaaagaaacgtaactttgtggagactgttgagctccagatcggtctgaagaactatgatcctcagaaggacaagcgtttcagtggatctgtcaagttaccacatatcccccgtcctaaaatgaagatctgcatgctcggagatgcccagcatgttgaagaggctgagaaaatgggactggaaaatatggatgttgagtctctaaaaaagcttaacaaaaacaagaaactcgtcaagaagcttgcgaagaaataccatgctttcttggcctctgaatctgtcattaagcagattccacgtcttcttggtcctggtctcaacaaggcaggaaagttcccaactcttgtgagccaccaggaatccttagagtcaaaggtgaatgaaacaaaggcaacagtgaaattccagctgaagaaggttctgtgcatgggagttgcagttggtaacctttccatggaagagaagcagatctttcagaatgttcagatgagtgtcaacttcctcgtctcgctattgaagaagaactggcaaaatgtcaggtgtttgtacctcaagagcacaatgggaccaccacaaagaatcttctgagctctcgccaacttgaatcgtgcctataagacacttcttcttgccctttgtttttgtttcagacacatctgtgaaacagtgtaagagttgtgctactctcctctttagcttttggtttggataatttaaattttaaaagaactgcaatgagatttgggttgatagcttttgtagcttatattatctt

SEQ ID NO: 14090 - DNA, 903 bp, Medicago truncatula
gttcttactacaccagtgttagtgttgttcgcagctcttcttcgcatcgtagtagtacacttcgcacctcttcttctctatcgaagatgagtaagcttcagagtgatgctgtgagagaagctattacaggaatcatgggtgattccaaagaaaaaaaccgtaaatttgtggagactattgaactccagattggtttgaaaaactatgatcctcaaaaggataagcgtttcagtggttctgttaaattgcctcacattccgagaccaaagatgaaaatttgcatgcttggtgatgcccaacatgttgaggaggctgagaaaataggattggaatcgatggatgttgaagctttgaagaagctaaacaaaaataagaaactggtgaagaaattagcaaagaagtaccatgcctttttagcttctgaagctgttatcaagcagattcctcgtcttttgggtcctggtctcaacaaggcaggtaagttccctacacttgtttcccaccaagaatctcttgaggccaaggttaatgagactaaggctatggtcaaattccagcttaagaaagtgttgtgcatgggagtagctgttggcaatgtcagtatggatgaaaagcaaatattccaaaatgtacaactcagtgttaacttccttgtgtccttgttgaaaaagaactggcaaaatgttaggtgcttgtatctgaagagctccatgggcaaatcttaccgagtcttttaaaggcttgattttgaatacaatgaatttgggattgtgcgtaatattttgttattgtaatagctgggacaagaagagtttttatcatctttctacaattttgttggttgagattttgttgttacaattttgtgttcttgaatgttgtttaattggttacaaacgttgg

SEQ ID NO: 14091 - DNA, 891 bp, Trifolium pratense
cacaaggccacgcttttcgatctcaccctggtttgctaacaagtatcaaagatgagtaagcttcaaagtgatgctgtgagagaagctatcacatcaatcgtcggtgcttgcaaggagaaaaaccgtaattttgtggagactattgaactccagattgggcttaagaactacgatccacaaaaggacaagcgtttcagtggttctgtcaaattgcctcacatccctcgacccaagatgaaaatttgcatgcttggtgatgcccagcatgttgaggaggcagagaaaataggattggaatcgatggatgttgaagctttgaagaagctaaacaaaaataagaaactggtgaagaaattggcaaagaagtaccatgcctttttagcttctgaagctgttatcaagcagattcctcgtcttttgggtcctggtctcaacaaggcaggaaagttccctacacttgtgtcccaccaagaatctcttgaggctaaggttaatgaaactaaggctatggtaaaattccagcttaagaaagtgttgtgcatgggagtagctgttggcattgtcagtatggatgaaaaacaaatattccaaaacgtacaactgagtgttaacttcctcgtgtccttgttgaaaaagaactggcaaaatgttaggtgcttgtatctcaagagttcaatgggcaaatcataccgtgtcttttaattttaagggggtgttttcaaattcagtgaatctgagatttcgattaatattttgttattttaatagctgggacatgagttttcatatttcaacaattttgttggttgagattttgtcgttactattttgtgttcttgaatgttgtttaattggttcctatgctatgatcgtatgttatagtttattaat

SEQ ID NO: 14092 - DNA, 890 bp, Trifolium pratense
gctgtaagatctgattctaaatcacaatgagtaagcttcagagtgatgcagtgcgagaagctatcactggaatcatgactgattccaaggataagaaccgtaagtttgtggagactattgaacttcaaattggacttaagaactatgacccacaaaaagataagcgtttcagtggctctgttaagttgccccatatccctcgtcctaagatgaagatttgtatgcttggagatgctcaacatgttgaagaggctgagaagataggtttggaatccatggatgttgaagccttgaagaagcttaacaaaaacaagaagttggtgaagaagctagccaagaagtatcatgccttcttagcttctgaggctgtcattaagcagattcctcgtcttttgggtcctggtctcaacaaggcaggaaagttcccaacacttgtctctcaccaagaatctcttgaggcaaaggttaatgagacaaaggctatggtgaagtttcagcttaagaaggtgctctgcatgggagtagccgtgggaaatgttagcatggatgaaaagcaaatcttccaaaatgttcaactgagcgttaacttccttgtctccttgttgaaaaagaactggcagaatgttcggtgcttgtatctgaagagttccatggggaaatcctaccgtgtcttttagggaaattgtcttttattcaatattcagtggcttgttatctccatcaatacattaattgtgctgatagctggatagaaaatttctttttgtcacatttttgttggattatttatggttaatttttgttatgttcgaatatttgataatagtcttgcttttgttggttctacccatttctgctggcgttaatttttaaattcagatatccaataa

SEQ ID NO: 14093 - DNA, 875 bp, Cyclamen graecum
ctccactggttggttgtggaagcttctgtaaattctaaaccatgagtaagctacaaagtgaggctgtcagggaagccatctctcagatttctggagaagcaaaggataagaaacgtaatttcgtagagactatcgagctccagattggtttgaagaactatgatccccaaaaagataagcgtttcagtggttctgttaaattgcctcacattcctcgtcctaagatgaaggtttgcatgcttggtgatgctcaacatgttgaggaggcagagaagataggattggactacatggatgtcgaagggctgaagaaactgaacaagaacaagaaattggtgaagaagctggctaaaaaatatcacgcctttctcgcatctgaggctgtcattaagcagatccctcgtctactggggcccggtcttaacaaggcaggaaaatttccaacccttgtctctcatcaggaatccctggagtcaaaagttaatgaaacaaaagcaactgtcaagtttcagctgaagaaggttctgtgcatgggtgttgctgtcgggaattgcggcatggaagataagcagatcttccaaaatgttcaaatgagtgtgaactttcttgtttcgctgctgaagaagaattggcaaaatgtgagatgcttgtatctgaagagcactatgggaaggccagtccgtgtcttctaaggtgttgtttacttggtgggcgaattgtgagcgagggtgtaggcaggactttgctacagttttggttcttcttcacattattttcaaatttgatttctttttcttggatattctcggccttttaactgtcatatctcaaatttgaaatttggttgcactttattttactgaaaagacaaggca

SEQ ID NO: 14094 - DNA, 913 bp, Zea mays
ttcctctcgctccgttgctcgcctcgggtcaaaccctaagcagggagttgatttatccgctgcagccatgagtaagttgcagtctgagtctgtcaaggatgccatctcccagattgttggggatgccaaggagaagaataggaagttcactgagactgtggaacttcagattggtctgaagaattatgatccacagaaggacaagcgtttcagtggctctgttaagttgccccatatccctcgtcccaagatgaaggtgtgcatgcttggtgatgcccagcatgttgaggaggccgagaagatgggacttgactacatggatgttgaggctctcaagaaaatgaacaagaacaagaagcttgttaagaggcttgccaagaagtaccatgctttcttggcatcagaggccatcatcaagcagattccccgtctccttggtcctggtctcaacaaggcaggcaagttcccgaccctggttactcaccaggaatccctcgagtccaaggtgaacgagactaaggcaaccgtcaagttccagctcaagaaggttctttgcatgggtgttgccgttggcaacttggcgatggaggagaagcagatccagcagaacatccagatgagcgtcaacttccttgtttcccttctgaagaagaactggcagaatgtgagatgcctctacgtcaagagcaccatggggaagccatacagggtgttctaagtatgctcttttgtgaagtctgctaggttctggcaccgaggttttattgaattaaactcttgttaagagtatgtttttggacgatcctatatttcgtcctggcgctactatgtttcagaatggtggtactactataagtatcctggcgctttaagtattgcttgaaaggatcaatataatttgcgtgtcataccc

SEQ ID NO: 14095 - DNA, 880 bp, Medicago truncatula
ctcatttctttcgtgcggcttcatcctcttcctccctccactctaaggtataagatccaattgctgcaagactctgattcaagatgagtaagcttcagagtgaagctgtgagagaagctattacaggaatcatggctgattccaaggaaaaaaaccgaaaatttgttgagactattgaactccagattggtcttaagaactacgacccacaaaaggataaacgtttcagtggttctgtcaaattgcctcacattcctcgacctaagatgaagatttgcatgcttggagatgctcagcatgttgaggaggctgagaaaataggattggaatcgatggatgttgaagctttgaagaagctaaacaaaaacaagaaactggtgaagaaattggcaaagaagtaccatgcctttttagcttctgaagctgttattaagcagattccccgtcttttgggtcctggtctcaacaaggcaggaaagttccctacacttgtttcccaccaagaatctctcgaggctaaggttaatgagactaaggctatggtcaagttccagcttaagaaagtgctgtgcatgggagtagctgttggcaatgtcagtatggatgagaaacaaatcttccaaaatgtacaactgagtgttaacttcctcgtgtccttgttgaaaaagaattggcaaaatgttaggtgcttgtatctgaaaagttcgatgggcaaatcttaccgtgtcttttaaacggtctttacatccaatgtttttgaaattgagcttaatattttggttactgtaatagctgagacagcaggtttcccttttctacagttttgtttgatgagattttgttgtcagtattgtgttcttgaagattatgtcagaagtgc

SEQ ID NO: 14096 - DNA, 883 bp, Chenopodium quinoa
ggttctttaatttggccccttttaaggtttaatcatgagtaagcttcaaagtgaagcggtgagggaagctatatctggtattgcaaatgatgccaaggagaagaatcgcaagtttactgagacagttgagctccagattgggctgaagaattatgacccacaaaaggataagcgtttcagtggctctgttaagttgccacacatccctcgtcccaagatgaaggtttgcatgcttggagacgcacagcacgtggaagaggctgagaggataggtttggaatggatggatgttgaagcgttgaagaagctcaacaagaacaagaaattggttaagaagcttgcaaagaagtaccatgctttccttgcttctgaagcagtcattaagcagattccgcgtttgcttggtcccggtcttaacaaggctggtaaattccctacacttgtcacccaccaggaacccttggagaacaaagtgaacgagatcaaggcaacagtaaagtttcagcttaagaaagttctctgcatgggagttgctgttggtaaccttagtatggaagagaagcagattttccaaaatgttcaaatgagtgtcaactttcttgtttcattgctgaagaagaattggcaaaatgtccggtgcctatacttaaagagtaccatgggcaagccataccgcatcttctaaaacagcccctttaccgttggttgaatggcgtaggagttggaagttttgtttattgcctttttgttattttcttcattgttcatttaaaccttgtgccttatgtgagttgatattttattcctcaggaagaattttggagatacatgtttattgtattgttagtctcattacacatctatgtttgcaaaaaatatatat

SEQ ID NO: 14097 - DNA, 1089 bp, Chenopodium quinoa
gtaaaccctagctatttctctccggttttcgaccttgctcgatttaagctgtaataatgagtaagcttcagagtgaagctgtgagagaagcaatctctgggattgcaaacgatgccaaagagaagaaccgcaagtttacagaaacagttgagctccagattggtttgaagaattatgatccccaaaaggacaagcgtttcagtggctctgttaagttaccacacatccctcgtcccaagatgaaagtctgcatgcttggagatgcccaacatgtggaagaggctgagaggattggtttggagtggatggatgtagaagcattgaagaaactaaacaagaacaagaagttggtgaagaagcttgcaaagaagtaccatgctttccttgcatctgaagcagtcatcaagcagattccccgtttgctgggacctggtcttaacaaggcaggtaagttcccaacacttgttacccaccaggagcccctagagaacaaagtcaacgagatcaaggcaactgtgaagtttcagcttaagaaagttctctgcatgggagttgctgttggcaacttgagtatggaagagaagcaaattttccaaaatgtgcaaatgagcgtcaactttcttgtttcactgttgaagaagaattggcaaaacgttcgatgcctatacctgaagagtaccatgggcaagccataccgcatcttctaaatcagtctgtatcaccatttttggctgagttgcgttgtaggatttgaattttgttgactgccctctactagtagtacaatcttaattgttgtgagctttagtatactgggatatttttctcaaatgaaatggctaaaaattttctgcttaattttatcatcagtgatatctttcatatttgatgtttttgacccaccctatgggcagtttgaattttttggggttgatctccttgtagaagattaaggttagtttcttatattgcttgcttgtggcagttagagcaattgtctcgtgataagatgcaaaactaaagtgacttttactccatgtcaattaaagctttttgcttgttagtatgatagaagaagttcgttactgc

SEQ ID NO: 14098 - DNA, 1050 bp, Chenopodium quinoa
agtccaaaagaaaaggcccaggtccacatatcaattaaaaaccttactcattcagtcactctgctctactatttgctgaaattgcaggcagcagcctaatcataaaccctagcaatttctctggttctcaaatttggccccgtcttagctttaatcatgagtaagcttcagagtgaagcggtgagggaagctatatctggtattgcaaatgatgccaaggagaagaatcgcaagttcactgagacagttgagctccagattgggctgaagaattatgacccacaaaaggataagcgtttcagtggctccgttaagttgccacacatccctcgtcccaagatgaaggtttgcatgcttggagatgcacagcacgtggaagaggctgagaggataggtttggaatggatggatgttgaagcgttgaagaagctcaacaagaacaagaaattggttaagaagcttgcaaagaagtaccatgctttccttgcttctgaagcagtcattaagcagattccgcgtttgcttggtcccggtcttaataaggctggtaagttccctacacttgtcacccatcaggaacccctggagaacaaagtgaacgagatcaaggcaaccgtcaagtttcagcttaagaaagttctctgcatgggagttgctgttggtaaccttagtatggaagagaagcagattttccaaaacgttcaaatgagtgtcaactttcttgtttcattgctgaagaagaattggcaaaatgtccggtgcctatacttgaagagtaccatgggcaagccataccgcatcttctgaaacagccccttttaccgttggttgaatggcgtaggagttggaagttttgtttattgcctttttgttattttcttcattgttcatttaaaccctgttccttgtgtgagttgatatgttattcctcaggaagaattttgaagatacatgtttattgtattgttagtctttttacacatgtatgtttgcaaaaaaattatattggtctactagtctttgatggctatattggctcagtatttcagt

SEQ ID NO: 14099 - DNA, 748 bp, Chenopodium quinoa
ccttgctcgatttaagctgtaattatgagtaagcttcagagtgaagctgtgagagaagcgatctctgggattgcaaacgatgccaaagagaagaatcgcaagtttacagagacagttgagctgcagattggtttgaagaattatgatccccaaaaggacaagcgtttcagtggttctgttaagttgccacacatccctcgtcccaagatgaaagtctgcatgcttggagatgcacaacatgtggaagaggctgcgagaattggtttggagtggatggatgtagaagcattgaagaaattaaacaagaacaagaagttggtgaagaagcttgcaaaaaagtaccatgctttccttgcatctgaagcagtcattaagcagattccccgtttgctaggacctggtcttaacaaggcaggtaagttccctacacttgttacccaccaggagcccctagagaacaaagttaacgagatcaaggcaactgttaagtttcagcttaagaaagttctctgcatgggagttgctgttggtaacttgagtatggaagagaagcaaattttccaaaatgtgcaaatgagcgtcaactttcttgtttcactgttgaagaagaactggcaaaacgttcgatgcctatacctgaagagtaccatggggaagccataccgcatcttctaaatcagtctgtatcaccatttttggctgagttgcgttgtaggatttgaattttgttgactgccctctactagta

SEQ ID NO: 14100 - DNA, 895 bp, Vicia sativa
gcctctccttccttcgccgttccgtctcttctcactcttccctctttgcagctatcgaagatgagtaagctttcaagcgaggctgtcagagaggctattaccggaatcatggctgattccaaggagaaaaaccgtaaatttgttgagactattgaactccagattggccttaagaactacgatccccaaaaggataagcgtttcagtggctctgtgaaattgcctcacattcctagacccaagatgagaatttgcatgctcggagatgctcagcatgttgaagaggctgagaaaattggattggactcgatggatgttgaagctttgaagaagctaaacaaaaacaagaaactggtgaagaaattggcaaagaagcaccatgcttttttagcttctgaagctgttatcaagcagattccacgtttgttgggtcctggtctaaacaaggcaggaaagtttcctacacttgtttcccaccaagaatctcttgaagccaaggttaatgagactaaggctatggtcaaattccagcttaagaaagtgctttgcatgggagtagctgttggtaatgtcagtatggatgaaaaacagatcttccaaaatgtacaattgagcgtcaacttcctcgtctccttgttgaagaagaactggcaaaatgttaggtgcttgtatctgaagagctcgatgggcaaatcttaccgcgtcttctaaatgttttggccatttcaaaggttcttaaatttggtgtacttgaatttgggattaatattttggtcgctgtaatagctgagacaagagttttcctctttctaaaattttgtttttgataagattgagtatttctattttgtattattgaatggtatttaattgcttagcaaggttgaacttcctt

SEQ ID NO: 14101 - DNA, 783 bp, Vicia sativa
cgccgcttcatctctttgcagctatcgaagatgagtaagctttcaagcgaggctgtcagagaggccattaccggaatcatggctgattccaaggagaaaaaccgtaaatttgttgagactattgaactccagatcggccttaagaactacgatcctcaaaaggacaagcgtttcagtggctccgtcaagttgcctcacatccccagacctaagatgagaatttgcatgcttggagatgcccagcatgttgaggaggctgagaaaattggactggactccatggatgttgaagctttgaagaagcttaacaaaaacaagaaactggtgaagaaattggcaaagaagcaccatgcttttttagcttcagaagctgttatcaaacagattcctaggttgttgggtcctggtctcaacaaggcaggaaagtttcctacacttgtttcccaccaagaatctcttgaagccaaggttaatgagactaaggctatggtcaaattccagctcaagaaagtgctttgcatgggagtagctgttggtaatgtcagtatggatgaaaaacagatcttccaaaatgtacaacttagcgtcaactttctcgtctccttgttgaagaagaactggcaaaatgttaggtgcttgtatctgaagagctctatgggcaaatcttaccgtgtcttctaaagggtttggtcatttataaggtttttaaatttggtgtatttgaatttgggattgatcttttggttgctgtaatagctgagacaggagttttcctcttttcta

SEQ ID NO: 14102 - DNA, 888 bp, Pseudoroegneria spicata
ccgcccccgccccgtcgacaaaatccggcgtcaactgatcggcggcagccatgagtaagctccaaagtgacgctgtcaaggatgccatcacccagattgctggcgaggccagagaaaagaagcgcaagttcactgagactgtggagcttcagatcggtctcaagaactacgacccacaaaaggacaaacgtttcagcggttcagtgaagctgccccatatcccccgcccaaagatgagggtgtgcatgcttggtgatgcccagcatgtcgaccaggctgagaaaatgggacttgactacatgtatgttgaaagtctcaagaagatgaacaagaacaagaagcttgttaagaagctagccaagaagtaccatgctttcttggcatcagaggccataatcaagcagatccctcgtctccttggccctggtcttaacaaggcaggcaagtttcccactctggttagtcaccaggaatctcttgaagccaaggtcaacgagacgaaagctacagtcaagttccagctaaagaaggttctttgcatgggtgttgctgtgggcaacttatcgatggacgagaagcagatccaacaaaacatccaaatgagcgtcaacttccttgtgtccctcctgaagaagaattggcagaatgtgaggtgcctatacgtgaagagcaccatggggaagcgtgtacgggtgttctaagtgggtgcgctccagagaagttgataagatactgggctgtcctgccgacccctgctcgtctttggattagctctgtttctctgataccaattttgtgtttgcctaagcgaatatcaacaagtctttcatcgtactagtcttttcttgaacaaacatcatgggagcaatggaactgcattttctgtca

SEQ ID NO: 14103 - DNA, 859 bp, Nicotiana tabacum
ctgctttctgtttgcagcaattcttgaagtgctcctttgagccatgagtaagcttcagagtgatgccctaagagaagccatcactgtgattaagagtgcttcaaatgagaagaaaaggaagttcactgaaaccattgagcttcagattgggctgaaaaactatgatccccaaaaggacaagcgtttcagtggttcagtcaagttgcctcacattcctcgccctaagatgaagatttgcatgcttggagatgctcagcatgttgaagaggcagaaaagatcgggttggagtacatggatgtggaaggcctgaagaagcttaacaaaaacaagaagttggttaagaagctcgcaaagaaataccatgcttttttggcatcagaagctgttataaagcaaattccccgtctcttggggcctggcttgaacaaagccggtaaatttcctagccttgttacccaccaggaatcgctcgagtctaaggttaacgagaccaaggccactataaaattccaattgaagaaggtgctttgcatgggagttgctgtcggtaatatggatatggaggagaaacaaatcttccagaatgtgcagatgagtgtcaactttctagtgtctttgctaaaaaagaactggcaaaatgtgagatgcctgtacttgaagagtaccatgggaaagactcaacgcgtcttctaaggaaattgtattacaatcttggcagttctggcgttttgctttgtatccgctatagatcctattgatcctggatagtatttttggctagttgtgatcctcgatcttgtcttgaacttgatatcagttttgtgatgattttattttctccttttaagatggtaccac

SEQ ID NO: 14104 - DNA, 868 bp, Raphanus sativus
aaggctttcctctgcttcacctttcaggttcagagattcgtcaactgagagaaactcaagatgagtaagcttcagagcgaggctcttagagaagccatcacgaccatcaagggcaaatccgaggagaagaagcgtaactttactgagactattgagcttcagattggtctgaagaactatgacccacaaaaggacaagcgtttcagtggatccgtcaagctccctcacattcctcgtcctaagatgaaggtctgcatgcttggagatgctcagcatgttgaggaggctgagaagatgggactagactctatggatgttgaggctttgaaaaagctcaacaagaacaagaagcttgttaagaagcttgccaagaagtaccatgctttcttggcttctgagtccgtcatcaagcagattccccgtcttcttggtcctggtcttaacaaagcaggaaagttcccaacactggtgagtcaccaagagtccttggaagggaaggtgaacgagaccaaggctacggtgaagttccagctgaagaaggttctgtgtatgggtgttgctgttggtaacctttccatggaagagaagcagctcttccagaatgttcagatgagcatcaacttccttgtctcgctcttgaagaagaattggcaaaacgtgaggtgtttgtacttgaagagcaccatgggaccaccacagagaatcttttgagttctcgactcttgtcatcttggaacttttgctttgtggtttttgtttgcttcagagatcttgagttatggttttgtttgatattagcagaactgaggtgttagtttgctttttgttaagacattataatatgcaatgttggattttacaatatcga

SEQ ID NO: 14105 - DNA, 963 bp, Solanum lycopersicum
gagccacccttcgtctctcttacggcgctcacaaaccctaattagggtttcctcatacagaattgaagttttgaaggagaaaggagaagtatttgagccatgagtaagcttcagagcgaggcccttagagaagccatctctgtaattaagaatgattcggctgagaaaaagaggaagttctctgagactattgagctccagattgggcttaagaactatgatccccaaaaggacaaacgtttcagtggatctgtgaggttgcctcacattccacgtcctaagatgaagatttgcatgcttggagatgctcagcacgtgggggaggcagagaagatcggtttggagtacatggatgtcgagagcctcaagaagcttaataagaacaagaagttagttaagaagcttgcaaagaaataccatgctttcttggcttcagaatccgtcatcaagcagattcctcgtctcttgggtcctggtctgaacaaggcaggtaagtttccaacccttgtttcccaccaagagtcactcgagtctaaggttaatgaaaccaaggctaccatcaagttccagttgaagaaggtgctttgcatgggtgttgctgttggtaattgtgatatggaagagaaacaaatcttccagaatgtgcaaatgagcgtgaacttcttagtttctcttctaaagaagaattggcagaacgtaaggtgcttgtacttgaagagcaccatggggaagactcaacgtgtcttttaagacgacaagtctcgttattggagcctttcgtgcattcttcttgtaagagatagatattaatgaaaattttggatagtattcatccttgattatgtttttgaatgttatatcactataaggatcgatcatattgttgagacatttcaagagctctgttctttcttctcttagatgatgatttcatttgaatgatatgcagtatttctgttctta

SEQ ID NO: 14106 - DNA, 1041 bp, Solanum lycopersicum
atcatcggcttacaaaccctaaatcgagggttttctcttacaggtgagtttgaaggaggagagatttttgagccatgagtaagcttcagagtgaggccctcagagaagccatctctgtgattaagaatgattcagcggagaagaaaaggaagttcagcgagaccattgagctccagattggattgaagaactatgatccccaaaaggacaagcgtttcagtggatccgtgaagttaccacacattcctcgccctaagatgaagatctgtatgcttggagatgctcagcatgtcggagaggcagaaaagattggtttggagtacatggatgttgaaggcttgaagaagctcaacaagaacaagaaactggtcaagaaacttgcaaagaaataccatgctttcttggcttcagaatctgtcatcaagcagattccccgtttgttggggcctggtctgaacaaggcaggtaagtttcccacccttgtttcccaccaagagtctcttgaatccaaggttaatgagaccaaggccacaatcaagtttcaattgaaaaaggtgctctgcatgggtgttgctgttggaaacatggatatggaggagaagcagatcttccagaatgtgcaaatgagtgtcaactttcttgtttcattgctgaagaagaattggcaaaatgttaggtgcttgtacttgaagagcaccatgggaaaaacacaacgtatcttttaagaagatttctgtttctgttgttggaaatttttcaggctttctggttgtgagctgtagacactttgaaaattttgggtagttgtgatttttgtcatcttgttttgaatatctataaaacttttagggctatgtctgctttctcttcgttaatgatgttttcactgatcccagtaacaatccgagatgccaattgcagtacattactttattctgtagtttttgacactgaaacataaaactgtgttggtttttataacaatctcacagtacatcataaaaagcttctttggtgtaatattctctaagagacttgaaa

SEQ ID NO: 14107 - DNA, 889 bp, Triphysaria pusilla
gagtcgaggtcttcctaccagaaacgagtttaggaagataataacactcgaaccatgagtaagcttcagagtgaggccctgagggaagcaattacccagattgtctcggattgcaaggagaagaagaggaactttgttgagacaattgagctccagattggactcaagaactatgatccccagaaagataagcgtttcagtggatctgttaagcttccccacatcccgaggcccaaaatgaagatctgcatgcttggtgatgcccagcatgtagaagaggctgcgaagattggccttgagtcgatggatgtcgaggctcttaagaagctgaacaaaaacaagaaattagtgaaaaagcttgctaagaattatcatgctttcttagcctcagaatctgttatcaagcagattccccgtctcttgggtccgggccttaacaaggcaggcaagttccccactctcgtgtctcaccaagagtcactagaggctaaggtcaatgaaaccaaagctacaattaagttccaattgaagaaggtgctttgcatgggtgttgctgttgggaatctcgacatggaggagaagcagatcttccaaaatgtgcaaatgagcatcaatttccttgtttctcttctcaagaagaattggcagaatgtgaggtgcttgtacttgaagagtaccatgggaaagacgcagcgtattttctaagtcgtcaaacgagttgttcgatttttgtttgatgaatagatacattagaggcctgatgggaagaacaattggatatttcttagaaattgggttgttttttatttcatattgttgtgatagtgctcgtatcgactatgacctactgtttttgtttaatttctatgcaacttactttttgtttaaa

SEQ ID NO: 14108 - DNA, 938 bp, Eutrema halophilum
cgatcccttccctcgccgtcctttctctgttcccgatcttccacaggaggcaagagtatttgagggagtgccaaaatgagtaagctccagagtgaagccctgagagaggcgatatccgccattgtcactcactgcaaggagacaaagccgcgcaagttcactgagactatcgagctccagattggtcttaagaactatgacccacaaaaagacaagaggtttagcggatccgttaaattgcctcacattcccaggccaaagatgaagatttgcatgctcggagacgcccagcacgttgaagaggctgaaaagattggattagactctatggatgtcgaagctcttaagaagttgaacaagaacaagaaacttgttaagaagctcgccaagaaattccaggctttccttgcttctgaatctgtcattaagcagattccccgtcttcttggtcccggtctcaacaaggcgggaaagttcccaacacttgttagccaccaagagtctttggaatccaaagtgaatgagacaaaggcaacagtgaagttccagctcaagaaggttctctgtatgggagttgccgtcgggaaccttggcatggaagagaaacagatctttcagaatgttcagatgagcgttaacttcctcgtttcactcttgaagaaaaactggcaaaatgtgaggtgcttgtacttgaagagtacaatgggtccaccaaatcgggttttctaagaattttatctcaaagtttctctaagttatcatcagaaaaaggaaatttgattttcttttctgtctcatgattcttcttgggttaattccagaatccttacttggtaggatgaagattttgattttgttgaaagaccattttgtttctactattgctatattatttcaagtttcgcgatttcattatcaagatcggttaagttttcgtc

SEQ ID NO: 14109 - DNA, 883 bp, Eutrema parvulum
gaattttgatggagtgccaaaatgagtaagctccagagtgaagccctgagagaggcgatatccgccattgtcactcactgcaaggagacaaagccgcgcaagttcactgagactatcgagctccagattggtcttaagaactatgacccacaaaaagacaagaggtttagcggatccgttaaattgcctcacattcccaggccaaagatgaagatttgcatgctcggagacgcccagcacgttgaagaggctgaaaagattggattagactctatggatgtcgaagctcttaagaagttgaacaagaacaagaaacttgttaagaagctcgccaagaaattccaggctttccttgcttctgaatctgtcattaagcagattccccgtcttcttggtcccggtctcaacaaggcaggaaagttcccaacacttgttagccaccaagagtctttggaatccaaagtgaatgagacaaaggcaacagtgaagttccagctcaagaaggttctctgtatgggagttgccgtcgggaaccttggcatggaagagaaacagatctttcagaatgttcagatgagcgttaacttcctcgtttcactcttgaagaaaaactggcaaaatgtgaggtgcttgtacttgaagagtacaatgggtccaccaaatcgggttttctaagaattttatctcaaagtttctctaagttatcatcagaaaaggaaatttggattttcttttctgtcatgattcttcttgggttaattccagaatccttacttggtaggatgaagattttgttaaaagacaattttgtttctactattgctattatcattagtggtttttctccatttaagttatcaatatcattttagttttcgtcttt

SEQ ID NO: 14110 - DNA, 858 bp, Eutrema parvulum
gttcagagattcgtgaactgagagaaacccaagatgagtaagcttcagagtgaggctcttagagaagccatcacaactgtcaagagcaaatctgaggataagaaacgtaactttgtggagacagtggagcttcagattggtctgaagaactatgacccacaaaaggacaagcgtttcagtggttctgtcaagctcccacacattcctcgcccgaaaatgaagatctgtatgcttggagatgcccagcatgttgaagaggctgagaagatgggactagactatatggatgttgaggctttgaagaagctcaacaaaaacaagaagcttgttaagaagcttgctaagaagtaccatgctttcttggcttctgaatccgtcattaagcagattccccgtcttcttggtcctggtcttaacaaggcaggaaagttcccaactctggtgagccatcaagagtcgttggaatcaaaggtgaatgagacgaaagcaacagtgaagtttcagctgaagaaggttctctgcatgggagttgcagttggtaacctttccatggaagagaagcagatctttcagaacgtccagatgagtgttaacttcctcgtctctctattgaagaagaactggcaaaacgtaaggtgtttgtacttgaagagcaccatgggaccaccacaaaggatcttctgagctctctgctctttcatcttcgcgttttacttcgtgtttttttgtttcagagatcttgtgcttcttgagatatggtttggaatgatattattagcagaattcaagtgctagtttgctttttggtagacgatatatgcaatgtcctactatatttactctccatttcaattttat

SEQ ID NO: 14111 - DNA, 2422 bp, Brassica oleracea
caacatatagcttgttggaatcaaatgagatagaaactttcaaattcatacaagaatgaggcgtattggatttcacaacttaaatcaacaaagaacaaggaggatacttacttcttcttcttcttcaaccgttcttcctcatcttgcaccatcatgtcaagaaaccattctctcaccccaagatccaaaacccaaaacagatcttccaagcagtttcagcttcttgcgagaaacaaagccatgcatttcttgcccgaggaatcaagttacagattcagtgaacagagttaagctccgagatgggagattcctagcttataaagagagaggtgttccaaagaacgaagccaaatacaagatcattcttattcatgggtttggaagctccaaagagatgaacttctctgcttcaaaagagttgatagaagagctaggcgtatattttctactctacgaccgagctggatatggagattctgatccaaacccggaacgttcgttgcaaagcgaagcacttgacatagaagaacttgctcataagttgcagataggacccaagttttacttaattggagtttccatgggatcatatcctacgtggagttgtcttaaacacatacctcacaggctagctggagtggcgtttgtagctccggtcgtaaactatgggtggccgtcgctttctaagaagcttataaagaaagactacaggagggggcttataaaatggtgttttcggatatcgaaatatgcacctggcctgttacattggtggatcagtcagaaactcttcccatcaactacttcagtccttgaaagcaatcaactctatttcaacagcagtgacattgaggtactcaagagaattaccggttttccgatgcttactaaggataaactacgggaaaggagtgtatttgatactctaaaagacgatttcttggcggggttcgggcattgggactttgatccatctgatgtaagaatgagtggagagaactctgttcatatatggcatggaaaggaagacaaggtggttccgtttcaacttcatagatgcatcttgaagaagctgccttggatcaaatatcatgagatacctcatggaggacatttgatcgtacactatgatgtagtaagacccattgctctggcacgtaccttccgcatacttcaatgggtgctgaaactatgcaaagcactttatattgatcatgaagaggatcatgtccgatatatatgccgcctcaaacgcagagcaagggtttcctctgcttcacctctcaggttcagagattcgttcaactgcgagaaactcaagatgagtaagcttcagagtgaggctcttagagaagccatcacaaccatcaagggcaaatctgaggacaagaagcgtaactttgtggagacgattgagcttcagattggtctgaagaactacgacccgcaaaaggacaagcgtttcagtggatctgtcaagctcccgcacattcctcgccctaagatgaaggtctgcatgcttggagatgctcagcacgttgaggaggctgagaagatggggctagactctatggatgttgaggctttgaagaagctcaacaagaacaagaagcttgttaagaagcttgcgaagaagtaccatgctttcttggcttctgagtcagtcatcaagcagattccccgtcttcttggtcctggtcttaacaaagctggaaagttcccaacgctagtgagtcaccaagagtcgttggaagggaaggtgaatgagaccaaagcgactgtgaagttccagttgaagaaggttctgtgtatgggtgttgctgttggtaacctttccatggaagagaagcagctctttcagaatgttcagatgagcatcaacttccttgtctccctcttgaagaagaattggcaaaacgtgaggtgtttgtacttgaagagcaccatgggaccaccacaaaggatcttttgagttctctactatttcatcttcgaacttttgcgttgtggtttttgtttgtttcagagatcttgagttatggttttgtttggtattagcagaactgaagtgttagtttgctttttgtcaagacattataatatgcattgttggattctaccatatcgactctccagttcaattttatctttatcaattatcgccgtgaaatgcttactagtccgaaaacatcatttgagatttcccaatcttttgacgtgtggctggacatataagatggtgcatgatccttggttgcattaggatgtttcgtggagatgataaagaggcaagagtttcattgtgtggctactatttctcatttgatgtaactgattaggctttaggcgagttgtttccgcaattggaatttacagaagatgacttcgtgagaggtaaatctgagtttgtctgaatagagat

SEQ ID NO: 14112 - DNA, 1000 bp, Raphanus sativus
ttttttttctctgttcccgatcttccacagggggaatagtatctgagaaactgccaaaatgagtaagctccagagtgaagccgtgagagaggcgatatcctccatcatcactcattgcaaggagacaaagccacgcaagttcactgagaccatcgaactccagattggtcttaagaactatgacccacaaaaggacaagcggtttagcggatccgttaagttgcctcacattccgaggcccaacatgaagatttgcatgctcggtgacgctcagcacgttgaagaggctgagaagattgggttagactctatggatgttgaagctcttaagaagttgaacaagaacaagaaacttgttaagaagctcgccaagaagttccatgctttccttgcttctgaatctgtcattaagcagattcctcgtcttcttggtcctggtctcaacaaggcaggaaaattcccaactcttgttagccaccaagagtctttggaatccaaggtgaatgagacaaaggcaacagttaagttccagctgaagaaggttctgtgcatgggtgtcgctgttgggaatctcggcatggaagagaagcagatctttcagaacgttcagatgagcgtcaacttccttgtttcgctcttgaagaagaactggcaaaacgtgaggtgcttgtacttgaagagcacaatgggtccaccaaaccgtgttttctaagatgttcttattctctgaaaggtgtcgtcagcagacggatagaaaagttgattttctttccagtcatgagccttcttcttcttggattagttcctgaatctttactttgtaggatcaagattttgttgaaagacagttttgtttctgttattattagtgggattttctctattttaattatttcgtgacgacacatcatttaaagggttagtcttgggtgaatgtgacaaattaaacggtcttcttgtcatgacattcttcaatatcaaccaaacatgattattaccc

SEQ ID NO: 14113 - DNA, 1124 bp, Triticum aestivum
tcctcctccccgcgccgccgctccgcaaaccctaggccgcaccaggtgaaccggcgaccggcgaatcagtccgtccccgcggcgagccatgagtaagctgcagaccgacgccctcaaggaggccatcacccaggtggtggcggacgccaaggagaagaacaggaagttcaccgagaccgttgagctccagatcggcctcaagaactacgacccgcaaaaggacaagcgtttcagcggctccgtcaagctgccccatgtccctcgccccaagatgagggtctgcatgctcggtgacgcccagcatgtgggagaggctgaaaagattggtcttgattccatggatgttgaagctcttaagaagatgaacaagaacaagaagcttgtcaagaggcttgccaagaagtaccatgctttcttggcctcggaggctatcatcaagcagattccacgtctccttggtcctggtctcaacaaggcaggaaagttcccgaccctggtttctcaccaggagtctctggaagccaaggtgaacgagacgaaagccacaatcaagttccagctcaagaaggtgctgtgcatgggcgtcgcggtgggcaacctgtcgatggaggagaagcagatccagcagaacatccagatgagcgtcaacttcctggtttccctgctcaagaagaactggcagaacgtgaggtgcctgtacatcaagagcaccatggggaagccggtccgggtgttctaagctcgtgcccctgccgcccacctatatcaatgctacctacagtactggacctccttactatgtttcaagcttaaatatgtctacttgtcgtagtttttatcgaattttgcgcgtgtcctggttaatgaagatgatgaaagaccactactgtttcccctgagttgtgattctgatggaacattatgtttcatcaagatcattccagtacctgttatatataatgttgtggttgcatgttttgtacccttgtatgtttgtcgggtctctgatgcatctgtttgccgtcgtgcctttctatatgacctgtacccgcatatagggttagcataacttgttggatacactcgatccgttggtgcagagttggcaaatcctgatgctttcg

SEQ ID NO: 14114 - DNA, 1083 bp, Brassica juncea
aagggtttcctctgcttcacctctcaggttcagagattcgttcaaccgagagaaactcaagatgagtaagcttcagagtgaggctcttagagaggccatcacaaccatcaagggcaaatctgaggacaagaagcgtaactttgtggagacgattgagcttcagattggtctgaagaactacgacccgcaaaaggacaagcgtttcagtggatctgtcaagctcccgcacattcctcgccctaagatgaaggtctgcatgcttggagatgctcagcacgttgaggaggctgagaagatggggctagactctatggatgttgaggctttgaaaaagcttaacaagaacaagaagcttgttaagaagcttgccaagaagtaccatgctttcttggcttctgagtcagtcatcaagcagattccccgtcttcttggtcctggtcttaacaaagctggaaagttcccaactctagtgagtcaccaggagtccttggaagggaaggtgaatgagacaaaagcgactgtgaagttccagttgaagaaggttctgtgtatgggtgttgctgttggtaacctttccatggaggagaagcagctcttccagaatgttcagatgagcatcaacttccttgtctccctcttgaagaagaattggcaaaacgtgaggtgcttgtacttgaagagcacaatgagtccacccacccgtgttttctaagtttcttacatctcaaaagtttatctttaaggtatcattaaactgagaggaaatttgattttcttttatgtcatgagccttcttcttcttgttcttggattacttccagaacccttactctctaggatgatcaagattttgttgaaagacatttttatttctacttttgttatcactttttgttggtgttctctatttaagtactttagttagattggattaatccaatcttattattattatcacatacttggcacaaaacaacggattataaactacaagaaaacaataaacaacgttttattatcacatacacataacattacatctcacaaatcaaaagaaaaactttataatttgctagtttttgt

SEQ ID NO: 14115 - DNA, 713 bp, Brassica juncea
tttcctctgctgcacctttcaggttccgagattcgtcagccgagagaaactcaagatgagtaagcttcagagtgaggctcttagagaagccattacaactatcaagggcaaatctgaggagaagaagcgtaactttacggagacggttgagcttcagattggtctgaagaactatgacccgcaaaaggacaagcgtttcagtggatctgtcaagctcccacacatccctcgccctaaaatgaaggtctgcatgcttggagatgctcagcacgttgaggaggctgagaagatgggactagactctatggatgttgaggctttgaaaaagctcaacaagaacaagaagcttgttaagaagcttgcaaagaagtaccatgctttcttggcttctgaatcagtcatcaagcagattccccgtcttcttggtcctggtcttaacaaagctggaaagttccctaccctagtgagtcaccaagagtcgttggaagggaaggtgaacgagaccaaagcgacagtgaagttccagttgaagaaggttctttgtatgggtgttgctgttggtaacctgtccatggaagagaagcagctgttccagaatgttcagatgagcatcaacttccttgtctcactcttgaagaagaattggcaaaacgtgaggtgtttgtacttgaagagcaccatgggaccaccacaaaggatcttctgagttctct

SEQ ID NO: 14116 - DNA, 910 bp, Brachypodium distachyon
ctctcttcgctactccctctccgccgccgcaccgaaacacggcgtgagactcatcggcggcaaccatgagtaagctccagagtgaggcggtcaaggacgccatcacccagattgtgggtgacgccagagagaagaaaaggaagttcaccgagactgttgagctccagattggtctcaagaactacgacccgcaaaaggacaagcgtttcagcggctccgtgaagctgccccatatcccccgccccaagatgagggtgtgcatgcttggtgatgcccagcacgttgaccaggctgagaagttggggcttgcctgcatggatgttgaaagcctaaagaaaatgaacaagaacaagaagcttgttaagaagcttgccaagaagtaccatgctttcttagcatcagaggccatcatcaagcagatcccccgtctccttggtcccggtctcaacaaggcaggcaagttccccacactggttagtcaccaggaatcccttgaagctaaggtcaatgagacgaaagctaccatcaagttccagctaaagaaggttctgtgcatgggtgttgctgtgggtaacttgtcgatggatgagaagcagatccagcaaaacatccaaatgagcgtcaacttcctcgtgtccctcttgaagaagaactggcagaatgtgaggtgcctgtacgtgaagagcaccatggggaagcgcgtgagggtgttctaagtgggtgtgatcaagcgaagttgataagataccggactgtcgacctgagcttgtctttaaattagatcttttgcactgatatcaattttgtgtttgcctaagcgaatatcaaagaagtatttgagctcttgtgttagtcttttcttgaacagaaatttatgggagaaatcgaactgtgttttgagttatcgttt

SEQ ID NO: 14117 - DNA, 850 bp, Trifolium pratense
ttcctcacaaggccacactcttcgatctcaccctggttgctaacaagtatcgaagatgagtaagcttcaaagtgacgccgttagagaggctatcacaagtattgtgggtgcttgcaaggagaaaaaccggaattttgtggagactattgagctccaaattgggttgaagaactatgatccgcaaaaggacaagcgtttcagcggcagcgttaagcttccacatatccctcgtcctaagatgaagatttgtatgcttggagatgcccagcatgttgaggaggctgagaaaataggactggactctatggatgttgaagctttgaagaagctcaacaaaaataagaaactagtgaagaaattggctaagaagtaccattcctttttagcttctgaagctgttatcaagcagattccgcgtcttttgggacctggactcaacaaggcaggaaagttccctacccttgtttcccatcaagaatctcttgaggctaaggttaatgagaccaaggctatggtcaaattccagcttaagaaagtgttgtgcatgggagtagctgttggcaatgtcagtatggatgaaaagcaaatcttccagaatgtgcaactgagtgttaacttcctcgtgtccttattgaaaaagaactggcaaaatgttaggtgcttgtatctgaagagttcgatgggcaaatcacaccgtgtcttttaaaggattgtttttaaattcaatgtatttgaaattgcgctttatatttcggtttactgtaatagctgagacaggaacttttgctctttctacaattttgtttgatgagattttgttagtattttgtgttcttgaatggtgtttaat

SEQ ID NO: 14118 - DNA, 854 bp, Echinochloa colona
ccttctcgtctcgtctcgtctgccctagcagcaggtggatcggtgatcgacggactgcagccatgagtaagttgcaaaccgaggtcctcaaggatgccatctcccaggttgtctcggaggccaaggagaagaacaggaagttcacagagaccatcgagctccagattggactgaagaactacgatccgcaaaaggacaaacgtttcagtggctctgttaagctgcctcacatccctcgccccaagatgaaggtttgcatgcttggtgatgcgcagcacgtggaagaggctgagaagatcggtcttgattgcatggatgttgaagctcttaagaagatgaacaagaacaagaagcttgtcaagaggcttgccaagaagtatcatgctttcttagcctctgaggctattatcaagcagattccccgtctccttggtcctggtctcaacaaggcaggcaagttcccaactttggttagtcaccaggagtctctggaatcaaaggtgaatgagacaaaagctacagtcaagttccagcttaagaaggttctttgcatgggtgtggctgtgggcaacctgtcaatggaggagaagcaaatccagcaaaacatccagatgagcgtcaacttcctggtttcgttgctgaagaagaattggcagaacgtgaggtgcctgtacatcaagagcaccatggggaagccaaacagagtgttctaagttgctatttcagtgccgtttaaatccaatgccatattctgtagtggagttcaagagatatatgtttatgcagtaatctatcgtacttttatgtcaaattttctgtcttaagtcaactaagtgtaggaactttaaaaggtt

SEQ ID NO: 14119 - DNA, 885 bp, Gossypium raimondii
cagctgcattagggtttctctcttcaggtaaattcttggttgtttcgttcgttttaagaacagagattcgaagatgagtaagcttcagagtgatgcccttagagaagctatttcaaccattgtggctaattccaaggagaaaagtcgcaagttcaccgagaccattgaactccagattgggctgaaaaactatgatccccaaaaagacaagcgtttcagtggttccgtgaagctgccacacattcctcgtcccaagatgaagatttgcatgcttggagatgctcaacatgttgaagaggctgagaagattggtttggattatatggatgttgaagcattgaagaagctaaacaagaacaagaagttggtcaagaagcttgctaagaaatatcatgcatttttggcctctgaatctgtcatcaagcagatcccccgtctcttgggtcctggtctcaacaaagcagggaaattcccaacccttgttactcaccaggaatctttggagtccaaagtgaatgagacaaaggcaatggtgaagttccaattgaagaaagttctttgcatgggagtcgccgttgggaatgtagcaatggaggagaagcagatcttccaaaacgtgcaaatgagcgtcaatttccttgtttcattgttgaagaaaaactggcaaaatgtgaggtgcctttacttgaagagtaccatgggaccttcaaacaggatcttttgagttatgcatggagtgaaatcatttttttaattgagaatgtttcaaaaattatgttatttgatgttggaaatcatgaatttttgagacattgaaaagtttttgttttgcatttcaactgaactttccatgaatgtcaaatttccattttttttccttttaaa

SEQ ID NO: 14120 - DNA, 936 bp, Gossypium raimondii
acaaaattcatagtgcggctagggttttctcttctctggtaaattttatagttttgttcgtggaaagaacagagattcagagatgagtaagcttcagagtgatgcccttagagaagctatttcaaccattgtagctcagtccaaggagaagcagcgtaagtttactgagactattgaactccagattgggttgaaaaactatgatccccaaaaagacaagcgtttcagtggttctgtgaagttgccacacattcctcgccctaaaatgaagatctgcatgcttggagatgcccagcatgttgaagaggcagagaagataggtttggattatatggatgttgaagcactgaagaagctaaacaagaacaaaaagttggtcaaaaagcttgccaagaagtatcatgcttttttggcttctgaatctgtcatcaagcagatccctcgtctcctgggtcctggtctcaacaaagcagggaaattcccaacccttgttactcaccaggaatcgctagagtccaaagtgaatgagaccaaggcgatggttaagttccagctgaagaaggttctttgcatgggagttgccgttgggaatgttgcgatggaggagaagcagatcttccaaaatgtgcaaatgagtgtcaatttcctggtttcattgttgaagaaaaactggcaaaatgtgaggtgcctctacttgaagagtaccatgggcccatcaaacaggatcttttgagttatttacccatgtgttaagagttttgtatgtggacaaattttctgctatgttttgtcgttggaatcttagagttgtgattttgagacattggaagttttgttttgcatatcaacataaaatgttaatttccatcttatttttaatcgttaaaaaaggccctaatgaatggtggcatattggattggctcattggacatgct

SEQ ID NO: 14121 - DNA, 926 bp, Gossypium raimondii
ctcttgttggcggtaaaattttattgtttgtggaaagaacaaagattcaaagatgagtaagcttcagagtgatgcgcttagagaagctatatcaaccattgtaactcagtcaaaggagaaacagcgcaaatttactgagaccattgaactccagattggtctgaaaaactatgatcctcaaaaagacaagcgattcagtggatctgtgaagctgccacatattcctcgccccaagatgaagatttgcatgcttggagatgctcaacacgttgaagaggcagagaagataggtttggattatatggatgtggaagcattgaagaaactgaacaagaataagaaattggtgaagaagcttgcgaagaagtatcatgcctttttggcttctgaatctgtcatcaagcaaatcccacgtcttctgggtcctggtctcaacaaagcaggtaaattcccaacccttgtcactcaccaggaatcactagagtcgaaggtgaatgagacaaaggcaatggttaagttccagctgaagaaggttctatgcatgggagttgctgttgggaatgttgcaatggaggagaagcagatcttccaaaatgtgcaaatgagcgtcaatttccttgtttccttgttgaagaaaaattggcaaaatgtgaggtgcctctacttgaagagcacaatgggtccttcaaacaggatcttttgagtttatatgtttaccttctgttatgtacggactgaaagtagtagtggggatttaatactaaaatcagtttttttcttctcttttacttagaatgttcaagtttatgttttgttctgttgttccctagaaatgttatgaatacgagacattggaattttgatttgcttatcaactttggttttacattatttgcttaatccacacgaaaatttcccttaacaaa

SEQ ID NO: 14122 - DNA, 1026 bp, Gossypium raimondii
aggtttttctcatctcttgttggcggtgccggggtaaaagtttattgtttgtggaaagagcagagattcggagatgagtaagcttcagagtgatgcgcttagagaagctatttcaaccattgtagctcagtcaaaggagaaacagcgcaaatttactgagaccattgaactccagattggtctgaaaaactatgatccccaaaaagacaagcgtttcagtgggtctgtgaagcttccacatattcctcgccccaaaatgaagatttgcatgcttggagatgctcaacacgttgaagaggcagagaagataggtttggattatatggatgtggaagcattgaagaaactaaacaagaataagaagttagttaagaagcttgccaagaagtatcatgcctttctggcttctgaatctgtcatcaagcaaatccctcgtcttttgggtcctggtctcaacaaagcaggtaaattcccaacccttgtcactcaccaggaatccctagagtcgaaggtgaatgaaacaaaggcaatggttaagttccagctgaaaaaggttctatgcatgggagttgctgttgggaatgttgcaatggaggagaagcagatcttccaaaatgtgcaaatgagcgtcaatttccttgtttctttgttgaagaaaaattggcaaaatgtgaggtgcctctacttgaagagcaccatgggtccttcaaacaggatcttttgagtttatgttttaccttctgttatgtacggactgaaagtagtagtggggatttaatactaaaagcagtttttttcttctcttttacttagaatgttcaagtttatgttatgttctgttgttccctagaaatgttatgaatatgagacattgaagttttgatttgcttatcagcttgagttttatgttagtgttaaattgccatctaatatttgcttagtccacacgaaaatcttccttagcaaatggttggcaattggcatccttgttaggcgtatggattttgactgctgattgtaaccatg

SEQ ID NO: 14123 - DNA, 895 bp, Vitis vinifera
ctcggctgcagtcgccaaacccgttctagggttttcttctcctagagttatcaaactgtagagaaacagaaagcagtagccatgagcaagcttcagagtgaggcattgagagaggccatcacccagattgttggagatgcaaaggagaaaaagcgtaacttcattgagaccattgaactccaaattggactgaagaactatgatccccaaaaggacaagcgttttagtgggtctgtgaagctgccacacatccctcgtcctaagatgaagatctgcatgcttggtgatgctcagcatgtggaagaggcagagaagataggattagagtacatggatgtggaagggctgaaaaagctcaataagaacaagaaactggtcaagaagcttgccaagaagtaccatgcttttcttgcatctgaagctgtcatcaagcagatccctcgtcttttaggccctggtctcaacaaggcagggaagtttccaacactggtgactcatcaggaatcccttgagtcaaaagttaatgaaacaaaagcaatggtgaagttccaacttaagaaggttctctgcatgggtgttgctgtgggcaactgcagcatggaggagaagcagatcttccagaatgtgcaacttagtgtcaacttccttgtctcattattgaagaaaaattggcaaaatgtgaggtgcctgtacctgaagagtaccatggggaaatccaatcgcatcttttagaaatttgcttattatgagagttttgtagtgagtggtagtactgcacaagactgttaaaacatttatctgaaaatgcctaagatcttatatttgttcttctttattggatccttctgttttgaacctgagattttaatttttaagcattgatgttagtccgaag

SEQ ID NO: 14124 - DNA, 780 bp, Medicago truncatula
attttgctttgtagcagaagccaccgattcaaccaaaatgagtaagcttcaaagtgaggcagtgagagaagcaatctcaggaatcatggctgattccaaagagaagaatcgcaagtttgttgagaccattgaacttcaaattggtctcaagaactacgacccgcaaaaagataagcgtttcagtggctccgtcaagttgcctcatatccctcgtcctaagatgaagctttgtatgctcggagatgcccaacacgttgaagaggcagagaagataggtttggaatcaatggatgttgaagccttgaagaagctcaacaaaaataagaagttggtgaaaaagctagccaagaagtaccatgctttcttagcttctgaggcagtcattaagcagattcctcgtcttttgggtcctggtctcaacaaggcagggaagttcccaacacttgtctctcaccaagaatctctcgagggaaaggtcaatgagacaaaagctatggtgaaatttcagcttaagaaggtgctctgtatgggagtagctgtgggtaatgttagcatggatgaaaagcaaatctttcaaaatgttcaactcagtgttaacttccttgtctccttgttgaaaaagaactggcagaatgttcggtgcttgtatctgaagagttcaatgggaaaatcttaccgtgtcttttaagggaacttatttcctatcttttttcaatatttaagtcagtcatctccttcaatacatttgtccgaatagcttgatagaaacttcgtcttgtt

SEQ ID NO: 14125 - DNA, 919 bp, Avena sativa
ggcctctccctcccttcgaccgccgccgcaccatcgacgaaatccttcgtcgactgatcggaggcaaccatgagtaagctttcaagtgatgcggtcaaggaggccatcacccagattgttggggaggccagagagaagaagcgcaagttcactgagactgttgagcttcagattggtctcaagaactatgacccgcaaaaggacaagcgtttcagtggctctgttaagctgccccatatcccccgcccgaagatgagggtgtgcatgcttggtgatgcccagcatgttgaccaggctgagaaattgggacttgactccatggatgttgaaagtctcaaaaagatgaacaagaataagaagcttgttaagaagttagccaagaagtaccatgctttcttagcatctgaggccatcatcaagcagatcccccgtctccttggtcctggtctcaacaaggcaggaaagttccccacactggttagtcactctgagtctcttgaagccaaggtcaatgagacaaaagctacagtcaagttccagctaaagaaggttctctgcatgggtgttgctgtgggtaacttgtcgatggatgagaagcagatccaacagaaccttcaaatgagcgtcaacttccttgtgtcccttctgaagaagaactggcagaatgtgaggtgcctgtacgtgaagagcaccatggggaagcgtatccgggtgttctaagtggtcttgctccagtgaagttgataagatactctgtactgtcaacccgagtttgtcttcgatttagatctgtttcactgatgccaattttgtgtttatctaagcgaatatcagcaaagtattctgtctctggtagtcattttgaacttgttgagaaatggatctgcgtttctattgtgattcttaagtttcgcgttgt

SEQ ID NO: 14126 - DNA, 973 bp, Ocimum basilicum
gacccccatagagcactcgctcacaaaccctaagcattttctcatcagaaattagctgtgattttcgaatatttgaacgatgagtaagctttcgggtgatgccacaagagaagccatctctcagatagtatctgaatgtaaggagaagaagagaaatttcactgagacaattgaactacagattggactgaaaaactatgatccacaaaaggataagcgttttagtggctccgttaagttgccccatattccccgcccaaaaatgaagatttgcatgcttggtgatgctcagcatgtggaagaggctgaaaaaattggtatggaatccatggatgtggaggctctcaaaaagttgaacaaaaacaagaaattggtgaagaagcttgccaagaagtatcatgctttcttagcctctgaggctgttatcaagcagattccccgtctcttgggacccggtcttaacaaagcagggaagttccctactcttgtgtcccaccaagaatctctcgagtccaaggtgaatgagacgaaggctacagtcaagttccaattgaaaaaggtgctctgcatgggcgtcgctgttgggaacttggacatggaagagaagcaaatcttccagaacgttcagatgagcgtgaatttcctcgtttctctcctgaaaaagaactggcaaaacgtgaggtgcttgtacttgaagagtaccatgggcaagccacaacgcatcttctaagatggttatcatatgcatgtttggagttttagggaagagttttcagttgtcatgtacttttctcagcttatattttcttgacataagaattttgtctttgtttcttgttcaaaaaggtctgtctgactttgttattatgttttggtacatctcctttaagaatatcatcaagggtgtgttgttatgttaggagcagttttattatataatacttatatttactagaacatttgataacgtagt

SEQ ID NO: 14127 - DNA, 1158 bp, Amaranthus tuberculatus
tagcatcagccgcagcaaaaccctagccatttccttcggttttcgtttttgctccatttcaagccgcaatcatgagtaagcttcagagtgaagctgtcagagaggctattactgggattaaaactgactccgcagagaaaggtcgtaagttcactgagacaattgagctccaaattgggctcaaaaactatgacccccaaaaggataagcgtttcagtggttccgttaagttgccacacatcccccgtcccaagatgaaagtttgcatgctgggagatgcacagcatgtggaagaggctgagagaataggattggagtggatggatgtagaggcattgaagaagctgaacaagaacaaaaagttggtgaagaaactggcaaagaaatatcatgctttccttgcctcagaagcagtcatcaagcagattcctcgattgcttggtcctggtcttaacaaggcaggtaagttccccacccttgtcacccatcaagagcccttggagaacaaggtgaatgagatcaaggcaacagttaagttccagctgaagaaagttctctgcatgggtgtggctgtcggtaactgtggtatggaagagaagcaggtgttccagaacgtgcaaatgagcgtcaatttccttgtttcattgttgaagaaaaattggcaaaatgtccgatgcttgtacctgaagagtaccatgggcaagccataccgcatcttctaagtgtcgttacgattttgcttgctttctaggagctgaggttttgttggttttgtagagtactttatttaagcgctagtatactcaaatatcacttttgaatttgaatttaatgtcggagtattttctgcgtagtttcattgttatttgctacttggatactatatttggaaggtttatttgctgtcaatgcttgcttttaaattttaatacagcctatgttgtgttttggcaatctcatgtgaaacaagtgttggacagactactagaagttttaccgattttcctatgggttagggacgtcgggttgcttaatgggacaggttgtaattaggctttgttttagtagtttaattagagttgtccatttgggtgttttgaggtggatttcaggttaaacatttcgagttgatttacttttggttcttgaataatgtag

SEQ ID NO: 14128 - DNA, 975 bp, Amborella trichopoda
aatgcacgctacgcgtttatgagggggacttagggttttgcataacatctgtactctcagttgaagaggcgccggtcctgagagagagagacagggagagcctagcttgagagagaaatttagagaggcgccacaatgagtaagttgcagagtgatactttgagggaagtcatcggcaaggtgatgggtgatgcaaagaagaagaaccgtaaattcacagaaacaattgagcttcaaatcgggttgaagaactatgatccacagaaagataagcgtttcagtggctcagttaaattaccccatgttcctaggccgaagatgaaagtctgcatgcttggagatgctcagcatgttgaagaggcagagaagatgggattagactatatggatgttgaggggctaaagaagcttaataaaaacaagaagctggtgaagaaactcgcgaagaaatatcatgcttttctcgcatctgaagcagtcatcaagcaaattccaaggcttcttggacctggtctcaacaaggcggggaagttcccaactctggtttctcaccaagagtcattggaatccaaggtgaatgaaacaaaggccattgtcaaatttcaactaaagaaggtcctctgcatgggagttgctgtaggaaattgcgccatggaggagaagcaagtgttccaaaatgttcaaatgagtgttaactttttggtgtctctcttgaagaagaactggcaaaatgtcaggtctttgtatctcaagagtactatggggaaggctcatccgctattttaagtgggttttttttttggagcttcgttttttggattcattcagagtcaaaaggaaaggaaacattacatgtttgttgaagtcgttaccatgttctctcttttcatcttcttagtaacaatgagattggacttgcttgctccgaagctttaacatttttgattctagggtttattgccatgttggacaatg

SEQ ID NO: 14129 - DNA, 899 bp, Eutrema halophilum
agggcttcagctgcttcacctttcagggtcagagattcgtgaactgagagaaacccaagatgagtaagcttcagagtgaggctcttagagaagccatcacaactgtcaagagcaaatctgaggataagaaacgtaactttgtggagacagtggagcttcagattggtctgaagaactatgacccacaaaaggacaagcgtttcagtggttctgtcaagctcccacacattcctcgcccgaaaatgaagatctgtatgcttggagatgcccagcatgttgaagaggctgagaagatgggactagactatatggatgttgaggctttgaagaagctcaacaaaaacaagaagcttgttaagaagcttgctaagaagtaccatgctttcttggcttctgaatccgtcattaagcagattccccgtcttcttggtcctggtcttaacaaggcaggaaagttcccaactctggtgagccatcaagagtcgttggaatcaaaggtgaatgagacgaaagcaactgtgaagttccagttgaagaaagttctgtgtatgggtgttgctgttggtaacctttccatggaagagaagcagctctttcagaacgtgcagatgagcgtcaactttcttgtctcgctattgaagaagaattggcaaaacgtaaggtgtttgtacttgaagagcaccatgggaccaccacaaaggatcttttgagctatctactccatcagtccaacttcgagttttgctttgtgtttttttttttcagagatcttgtgcttcttgagatatggtttggaatgatattattagcagaattcaagtgctagtttgctttttggtagacgatatatgcaatgtcctacaatatttacaattcaattttatccatctactatctca

SEQ ID NO: 14130 - DNA, 975 bp, Nicotiana benthamiana
ttgatactattcctttacagtaagcttcagagcgatgcccttagagaagccatctctgtgattaagaatgattgtgcagagaagaaaagaaaattcactgagactattgagctccagatcgggctgaagaactatgatccccaaaaggacaaacgtttcagtgggtccgttaaattgccccacattcctcgccctaaaatgaagatttgtatgcttggagatgctcagcacgttgaggaggcagaaaagataggtttggagtacatggatgtggaaagcttgaaaaagcttaacaaaaataagaaattggttaagaagcttgcaaagaaataccatgctttcttggcttcagagtctgtcatcaagcagattcctcgtttgttggggcccggcctgaacaaggcgggcaagtttccgagtcttgtttcacaccaagagtcacttgaatccaaggttaatgaaaccaaagctactatcaagtttcaattgaaaaaggtgctttgcatgggagttgctgttggaaacttggatatggaggagaaacagatcttccagaatgtgcaaatgagcgttaattttctagtgtcgttgctgaaaaagaattggcaaaatgtaaggtgcctgtacctgaagagcaccatgggaaagccacatcgtgtcttttaaggagatttttgtttcgctaatggaagttttcagcattttgggtgtgagctatagatactcgtgaaatttttgggtattagttctggttatctgtttgaatactataacattgttcggtattgttttacttcaactttgtcttctttaaagatgttagcagtgattgccatagcttcctaggtgccattttgtctaaatttcttatttaatcttttcagccgagtagtttgcacttttacgtgtaggctgaaagtaaaataaaaacaatcagtgctttcagtattatatgcgtttggcatataaataaac

SEQ ID NO: 14131 - DNA, 857 bp, Nicotiana benthamiana
tttaatacgattctttacagtaagcttcagagcgatgcccttagagaagccatctctgtgattaagaatgattgtgcagagaagaaaagaaaattcactgagactattgagctccagatcgggctgaagaactatgatccccaaaaggacaaacgtttcagtgggtccgttaaattgccccacattcctcgccctaaaatgaagatttgtatgcttggagatgctcagcacgttgaggaggcagaaaagataggtttggagtacatggatgtggaaagcttgaaaaagcttaacaaaaataagaaattggttaagaagcttgcaaagaaataccatgctttcttggcttcagagtctgtcatcaagcagattcctcgtttgttggggcccggcctgaacaaggcgggcaagtttccgagtcttgtttcacaccaggagtcacttgaatccaaggttaatgagaccaaagctactatcaagtttcaattgaaaaaggtgctctgcatgggagttgctgttggaaacttggatatggaggagaaacagatcttccagaatgtgcaaatgagtgttaattttctagtgtcgttgttgaaaaagaattggcaaaatgtaaggtgcctgtacttgaagagcaccatgggaaagccacagcgtatcttttaaggagatttttgtttcgctgttggaagttttcagcattttgggtgtgtgagctatagatacccttgaaattttgggtagtagttctggttatctgcttgaatactcacattgttccgtattgttttgcttcaactttgtcttctttaaagatgttagcagtgattgccatagcatcctaggtgccattttct

SEQ ID NO: 14132 - DNA, 1167 bp, Brassica juncea
ttctttctgtctccgatccttgacaaggagagaatcttagctctgaggatttgccaaaatgagtaagctacagagtgaagctgttagggaggcgatatcaaccatcatcactcactgcaaggagacaaagcctcgcaagttcaccgagaccatcgagctccagattggtcttaagaactatgaccctcaaaaggacaagaggtttagcggttccgttaagttgcctcacattcctaggcccaagatgaagatttgcatgctcggtgatgcccagcacgttgaagaggctgagaaaattgggttagagtctatggatgtggaagctcttaagaagttgaacaagaacaagaagctggtgaagaagctcgccaagaagttccatgctttccttgcttctgaatcggtcatcaaacagattccccgtcttcttggtcctggtctcaacaaggcaggaaagtttccaactcttgttagccaccaagagtctttggagtccaaagtgaacgagacaaaggcaacagtgaagttccagctcaagaaggttctttgcatgggtgttgctgttgggaatctcggcatggaagagaagcagatcttccagaatgttcagatgagcgtcaacttccttgtctccctcttgaagaaaaactggcaaaacgtgaggtgcttgtacttgaagagcacaatgagtccacccaaccgtgtgttctaagattattattattatctcaaagtttctcttaaggtatcatcaaaggctgagaagagatttgattttcatttctgtcgtgagccttttacttgttggattaattcgagaatccttcctttgtaggatcaatattttcttgaaagacaattttgtttctattattgcaattattattagtgggtttttcaatatcgttctttaagaaaataggaaaatatataacatgcaagtccgtagccgatcgtaaatttagtaccatctgtgtggatttgacttcgtttagtagtataattgtatgtgaagtttatctcttgagtacgtgtgtaatgaggccacggatatgtatattcataaagtagtcttcccaatcaatgcatttgatggagtcgattaatttgtctatccctgtgccttcattcttgattcgtaatctttccaggtttctatcatcgaat

SEQ ID NO: 14133 - DNA, 1308 bp, Oryza sativa
cggcacagagcatgcagccacaaaaaccctaggtcgggagcacgcatcctcactcgccgccttctctcctctcgcgccgtttcgctccctgaccctccgccgccgccgccgatcatcatgagtaagttgcagagcgaggttctcaaggaagccatctcccaggttgttggggaatccaaggagaagggcaggaagttcaccgagaccgttgagcttcagattggtctcaagaactatgacccgcaaaaggacaagcgtttcagcggctccgtcaagctgccccatatcccccgccccaagatgaaggtctgcatgcttggtgatgcccagcatgtcgaggaggctgagaagattgggcttgactacatggatgttgaggctcttaagaaaatgaacaagaacaagaagctggttaagaagcttgccaagaagtaccatgctttcttagcatcagaggccatcatcaagcagattcctcgtctccttggtcctggtctcaacaaggcaggcaagttccctacattggttactcaccaggagtctcttgaatccaaggtcaacgagacgaaagctacagtcaagttccagctgaagaaggttctgtgcatgggtgttgctgtgggtaacttgtcaatggaggagaagcagatccagcaaaacatccaaatgagcgtcaacttcctcgtgtcccttttgaaaaagaactggcagaatgtgaggtgcctttacatcaagagcaccatggggaaaccaatcagggtgttctaagttggtgtgttccacctagaagtgaaaaggatcagttgaaaccaagcttttcctcttaaaatagacctgtcgctctgggaccggcttttgtctgtcagtgcaagagaatatatcaaagaaatatctggaccttatttttgtagcgtgtttatttgggagtaacttattctacgtaagcttctaatgtggaaattctatgtgtgttatgctgctcctacatactccctccgtttcgaaatgttcgacgccgttgactttttattacatgtttgaccgttcgtcttattcaaaaaattttgacacttaataattcttttcctatcatttgattcattgttaaatatattttcatgtaggcatataattttacatatttcataaaagtttttgaataagacgaacagtcaaacatgtgctaaaaagtcaacggtgtcaaatatttcgaaacggagggagtataagcctttttaccttgcaagattcaagattggtgcaatttgtttcactgccacaggtagtgttgatgatcatacttggata

SEQ ID NO: 14134 - DNA, 1364 bp, Oryza sativa
gaccgccatatgtggaatgggccctttatgtttcggcccacgacgaaaggaagcccaccggcgtcaatctccaccgtccgatccgatcggacggtcgaaacggcacagagcatgcagccacaaaaaccctaggtcgggagcacgcatcctcactcgccgccttctctcctctcgcgccgtttcgctccctgaccctccgccgccgccgccgccgatcatcatgagtaagttgcagagcgaggttctcaaggaagccatctcccaggttgttggggaatccaaggagaagggcaggaagttcaccgagaccgttgagcttcagattggtctcaagaactatgacccgcaaaaggacaagcgtttcagcggctccgtcaagctgccccatatcccccgccccaagatgaaggtctgcatgcttggtgatgcccagcatgtcgaggaggctgagaagattgggcttgactacatggatgttgaggctcttaagaaaatgaacaagaacaagaagctggttaagaagcttgccaagaagtaccatgctttcttagcatcagaggccatcatcaagcagattcctcgtctccttggtcctggtctcaacaaggcaggcaagttccctacattggttactcaccaggagtctcttgaatccaaggtcaacgagacgaaagctacagtcaagttccagctgaagaaggttctgtgcatgggtgttgctgtgggtaacttgtcaatggaggagaagcagatccagcaaaacatccaaatgagcgtcaacttcctcgtgtcccttttgaaaaagaactggcagaatgtgaggtgcctttacatcaagagcaccatggggaaaccaatcagggtgttctaagttggtgtgttccacctagaagtgaaaaggatcagttgaaaccaagcttttcctcttaaaatagacctgtcgctctgggaccggcttttgtctgtcagtgcaagagaatatatcaaagaaatatctggaccttatttttgtagcgtgtttatttgggagtaacttattctacgtaagcttctaatgtggaaattctatgtgtgttatgctgctcctacatactccctccgtttcggaatgtttgacgccgttgactttttattacatgtttgaccgttcgtcttattcaaaaaattttgacacttaataattcttttcctatcatttgattcattgttaaatatattttcatgtaggcatataattttacatatttcataaaagtttttgaataagacgaacagtcaaacatgtgctaaaaagtcaacggtgtcaaatatttcgaaacggagggagtataagcctttttaccttgcaagattcaagattggtg

SEQ ID NO: 14135 - DNA, 818 bp, Amaranthus tuberculatus
ttttcgtttttgctccatttcaagccgcaatcatgagtaagcttcagagtgaagctgtcagagaggctattactgggattaaaactgactccgcagagaaaggtcgtaagttcactgagacaattgagctccaaattgggctcaagaactatgacccccaaaaggataagcgtttcagtggttctgttaagttgccacacatcccccgtcccaagatgaaagtttgcatgctgggagatgcacagcatgtggaagaggctgagagaataggtttggagtggatggatgtagaggcattgaaaaagctgaacaagaacaaaaagttggtgaagaaactggcaaagaagtatcatgctttccttgcctcagaagcagtcatcaagcagattcctcgattgcttggtcctggtcttaacaaggcaggtaagttccccacccttgtcacccatcaagagcccttggagaacaaggtgaatgagatcaaggcgacagtcaagttccagctgaaaaaggttctctgcatgggtgtggctgttggtaactgcagtatggaagagaagcaagttttccagaacgtgcaaatgagcgtcaatttcctcgtttcattgttgaagaaaaattggcaaaatgtccgatgcttgtacctgaagagtaccatgggcaagccataccgcattttctaagtgtcgttacgattttgcttgctttctaggagctgaggttttgttggttttgtagagtactttatttaagcgctagtatactcaaattatcacttttgaatttgaatttaatgtcggaatattttctgcctagtt

SEQ ID NO: 14136 - DNA, 885 bp, Trifolium pratense
tcgcaggttgctaacaagtatcgaagatgagtaagcttcaaagtgacgccgttagagaggctatcacaagtattgtgggtgcttgcaaggagaaaaaccggaattttgtggagactattgagctccaaattgggttgaagaactatgatccgcaaaaggacaagcgtttcagcggcagcgttaagcttccacatatccctcgtcctaagatgaagatttgtatgcttggagatgcccagcatgttgaggaggctgagaaaataggactggactctatggatgttgaagctttgaagaagctcaacaaaaataagaaactagtgaagaaattggctaagaagtaccattcatttttagcttcagaagttgttatcaagcaaattccgcgtcttttgggtcctggactcaacaaggcaggaaagttccctacccttgtttcccatcaagaatctcttgaggctaaggttaatgagaccaaggctatggtcaaattccagcttaagaaagtgttgtgcatgggagtagctgttggcaatgtcagtatggatgaaaagcaaatcttccagaatgtgcaactgagtgttaacttcctcgtgtccttattgaaaaagaactggcaaaatgtcaggtgcttgtatctgaagagttcgatgggcaaatcacaccgtgtcttttaaacaattgtttttcaattcaatgtatctgaaattgcgcttaatattttggtttactgtaatagttgagacaggagttttcgatctttctacaattttgtttgatgagattttgttagtattttgtgttcttgaatggtgtttaattgcttttttttttaggagtgcttattttattcccggtgttttacatatacaatattttgcttgc

SEQ ID NO: 14137 - DNA, 924 bp, Trifolium pratense
tttcttcttacactacaccagtactttatttcacagctcttcttctccttcgcaactcgttcgcagagtgacggaatatcgaagatgagtaagcttcagagtgatgctgtgagagaagcaattacaggaatcatgggtgcttctaaggacaaaggccgtaaatttgtggagactattgaactccagattggtctgaaaaactatgatcctcaaaaggataagcgtttcagtggttctgttaaattgcctcatattcctcgacccaagatgaaaatttgcatgcttggtgatgcccaacatgttgaggaggcagagaaaataggattggaatcgatggatgttgaagctttgaagaagctaaacaaaaataagaaactggtgaagaaattggcaaagaagtaccatgcctttttagcttctgaagctgttatcaagcagattcctcgtcttttgggtcctggtctcaacaaggcaggaaagttcccaacacttgtctctcaccaagaatctcttgaagcaaaggttaatgagacaaaggctatggtgaagtttcagcttaagaaggtgctctgcatgggagtagctgttggcaatgtcagtatggatgaaaaacaaatcttccaaaacgtgcaactcagtgttaacttcctcgtgtccttgttgaaaaagaactggcaaaatgttaggtgcttgtatctcaagagttcaatgggcaaatcataccgtgtcttttaattttaagggggtgttttcaaattcagtgaatctgagatttcgattaatattttgttattttaatagctgggacatgagttttcatatttcaacaattttgttggttgagattttgtcgttactattttgtgttcttgaatgttgtttaattggttcctatgctatgatcgtatgttatagtttattaat

SEQ ID NO: 14138 - DNA, 1193 bp, Trifolium pratense
tcaattagtaatagatttctactttttaggatgattttaacttatttaatcacacaataattttattaacaaaaacaactgaagacaaaaaataaagtatagtgggcttggatcacaaagcagcccaaaacaaaactccaaaattcctagggtttttcacagcagatttcacaactacaccagatttcacagctcctcttctccatcgcaactcggagtatcgaagatgagtaagcttcagagtgatgctgttagagaagcaattacaggaatcatgggtgcttccaaggacaaaggtcgtaaatttgtggaaactattgaacttcagattggtctgaaaaactatgatcctcaaaaggataagcgtttcagtggttctgttaaattgcctcatattcctcgacccaagatgaaaatttgcatgcttggtgatgcccaacatgttgaggaggcagagaaaataggattggaatcgatggatgttgaagctttgaagaagctaaacaaaaataagaaactggtgaagaaattggcaaagaagtaccatgcctttttagcttctgaagctgttatcaaacagattcctcgtcttttgggtcctggtctcaacaaggcaggaaagttccctacccttgtttcccaccaagaatcccttgaggctaaggtcaacgagactaaggctatggtcaaattccaacttaagaaagtgttgtgcatgggagtagctgttggcaatgtcagtatggacgagaaacaaatattccaaaatgtacaactgagtgttaacttcctcgtgtccttgttaaaaaagaattggcagaatgtgaggtgcttgtatctgaagagttcaatgggcaaatcataccgcgtcttttaattttaaaggggtgttttcaatttcagtgaatttgggattgcatttaatattttgttattgtaatagcctggatatgaattttcctatgtctacaattttgttcgttgatattttgtcgttagtatttgtgttattgaatgctgtttaatccccgtggtttacttttacttcttttttccctcttctcctttcaattctaagtatctttcccgcagaatcttcatatttctaattgtagaacaattgtattgtattgctaagaaatgcttgagatatccttattcaatgatgttaaacaatcacattctttaggatt

SEQ ID NO: 14139 - DNA, 921 bp, Trifolium pratense
ttcgcctctgctgtaagatctgattctaatccaaaatgagtaagcttcagagcgaagcagtcagagaagccatctcaggaatcatgaccgattcgaaggataagaatcgtaagtttgtggagactattgaacttcaaattggtttgaagaactatgacccacaaaaagacaagcgttttagtggctctgttaagttgccccatatccctcgtcctaagatgaagatttgtatgcttggagatgctcaacatgttgaagaggctgagaagataggtttggaatccatggatgttgaagccttgaagaagcttaacaaaaacaagaagttggtgaagaagctagccaagaagtatcatgccttcttagcttctgaggctgtcattaagcagattcctcggcttttgggtcctggactcaataaggcaggaaagttcccaactcttgtttctcaccaggaatctcttgaaggaaaggttaatgagaccaaggctatggtcaagttccagcttaagaaggtgctctgcatgggagtagctgttggtaatgttagcatggacgaaaaacaaatctttcaaaatgttcaactcagtgttaatttccttgtctccctattgaaaaagaattggcagaatgttcggtgtttgtacctaaagagttccatggggaaatcataccgtgtcttttaggggatttactcttctatttctcgatattcattcagtggcttgtcatctacatcattacattaattgtgctaatagcgagctggatagaaaatttcgttttgttacagttttgctggattgtttatggttaattattatttttatgttcgaatatttgataatagtcttttgttggtcccatttctgctggtgttcaaacttttaacttttttcagaaatccgataaattgaacaa

SEQ ID NO: 14140 - DNA, 926 bp, Trifolium pratense
tcgcaggttgctaacaagtatcgaagatgagtaagcttcaaagtgacgccgttagagaggctatcacaagtattgtgggtgcttgcaaggagaaaaaccggaattttgtggagactattgagctccaaattgggttgaagaactatgattctcaaaaggacaagcgtttcagcggcagcgttaagcttccgcatatccctcgtcctaagatgaagatttgtatgcttggagatgcccagcatgttgaggaggctgagaagattggattggaatccatggatgtagaagccttgaagaagctcaacaaaaacaagaagttggtgaagaaacttgccaaaaaatatcaggctttcttagcttctgaggctgtcattaagcagattcctcggcttttgggtcctggactcaataaggcaggaaagttcccaactcttgtttctcaccaggaatctcttgaaggaaaggttaatgagaccaaggctatggtcaagttccagcttaagaaggtgctctgcatgggagtagctgttggtaatgttagcatggacgaaaaacaaatctttcaaaatgttcaactcagtgttaatttccttgtctccctattgaaaaagaattggcagaatgttcggtgtttgtacctaaagagttccatggggaaatcataccgtgtcttttaggggatttactcttctatttctcgatattcattcagtggcttgtcatctacatcattacattaattgtgctaatagcgagctggatagaaaatttcgttttgttacagttttgctggattgtttatggttaatttttatttttatgttcgaatatttgataatagtcttttgttggtcccttttctgctggtgttcaaacttttaaattttttcagaaatccgataaattgaacaaatattttagcaaat

SEQ ID NO: 14141 - DNA, 934 bp, Echinochloa colona
ccttctcgtctcgtctggtctgccctagcagcaggtggatcggtgatcgacggactgcagccatgagtaagttgcaaaccgaggtcctcaaggatgccatctcccaggttgtctcggaggccaaggagaagaacaggaagttcacagagaccatcgagctccagattggactgaagaactacgatccgcaaaaggacaagcgtttcagtggctctgttaagctgccccacatccctcgccccaagatgaaggtttgcatgcttggtgatgcgcagcacgtggaagaggctgagaagatcggtcttgattgcatggatgttgaagctcttaagaagatgaacaagaacaagaagcttgtcaagaggcttgccaagaagtatcatgctttcttagcctctgaggctatcatcaagcagattccccgtctccttggtcctggtctcaacaaggcagggaagttcccaactttggttactcaccaggagtctctggagtcaaaggtgaatgagacgaaagctacagtcaagttccagcttaagaaggttctttgcatgggtgtggctgtgggcaacctttcaatggaggagaagcaaatccagcaaaacatccagatgagcgtcaacttcctggtttcgttgctgaagaagaattggcagaacgtgaggtgcctgtacatcaagagcaccatggggaagccaaacagagtgttctaagttgctgtttcagtgccgtttaaatccaatgccatagtctgtagtggagtttatgagatatatgtttccgcagtaatctatcgtacttttatgcaaatttcgtgtcttgagtgaacaagtgtggctttgttatacactagtgtttttcaccttgcacttgagctgattgaactatgtgctcttggatacctgcgtttatgcatataaaagggcattgaacg

SEQ ID NO: 14142 - DNA, 897 bp, Festuca arundinacea
agtggtatcaacgcagagtacggggggcctctccctcccttcgaccgccgccgcaccctcgaccaaatccggcgtcgactgatcggcagcaaccatgagtaagctttcaagtgatgcggtcaaggaggccatcgccctcatcgttggggaggccagagaaaagaagcgcaagttcactgagactgttgagcttcagatcggtctcaagaactacgacccgcaaaaggacaagcgtttcagcggctctgttaagctgccccatatcccccgcccgaagatgagggtgtgcatgcttggtgatgcccagcatgttgaccaggctgagaaattggggcttgactccatggatgttgaaagtctcaaaaagatgaacaagaacaagaagcttgttaagaagctagccaagaagtaccatgctttcttagcatcagaggctatcatcaagcagatcccccgtctccttggtcctggtctcaacaaggcaggcaagttccccacactggttagtcactcagagtctctcgaggccaaggtcaatgagacaaaggctacagtcaagttccagcttaagaaggttctttgcatgggtgttgctgtgggtaacttgtcaatggacgagaagcagatccagcagaacctccaaatgagcgtcaacttccttgtgtcccttctgaagaagaactggcagaatgtgaggtgcctgtacgtgaagagcaccatggggaagcgccaacgggtgttctaagtgggtcttgctccagtgaagttgataagatactgggctgtactgtcgagattgtctttgaatttagatctgtttcactgataccaattttgttttatctaagcgaatatgaaccaagtatttctctggtggtagtcttttgaacggagaat

SEQ ID NO: 14143 - DNA, 878 bp, Setaria italica
ctctcttctcgcgccggcgccgcacttgccgtctctcctcgtctgatctgcccaccaggtggatcggtgatcgacggacagcagccatgagtaagttgcaaacggaggtcctcaaggatgccatctcccaggtcgtctcagaggccagggagaagaacaggaagttcacagagaccgtcgagctccagatcggcctcaagaactacgacccgcaaaaggacaagcgtttcagtggctccgtgaagctgccccacatccctcgccccaagatgaaggtctgcatgcttggcgatgcgcagcacgtggaggaggctgagaagatcggtcttgattacatggatgttgaagctcttaaaaagatgaacaagaacaagaagcttgtcaagaagcttgccaagaagtaccatgctttcttagcctccgaggctattatcaagcagattcctcgtctccttggtcctggtctcaacaaggcaggcaagttcccaactttggttactcaccaggagtctctggaatcaaaagtgaatgagacgaaagctacagtcaagttccagctgaagaaggttctttgcatgggtgtggctgtgggcaacctgtcgatggaggagaagcagatccagcaaaacatccagatgagcgtcaacttcctggtttcgttgctgaagaagaattggcagaacgtgaggtgcctgtacatcaagagcaccatggggaagccaaacagagtgttctaagtcgctgtgtccattgcgtctaaaaccagtgccgtagacagtattgaagtttgttatggaatatatgtttatgcagtactctgtcgtactgttatgcaaattttgtgtctgaagtgaacaagagtggttttgtgatgcact

SEQ ID NO: 14144 - DNA, 1145 bp, Panax ginseng
attcaccgcataactgtagtggcgcgactaaccctagcaccgtctctattagggtttatagttcggccgtgaaattgcatctctcgtccacattctacagaactcctttttcgtgcgttatctccttctctcgtttactttctcatctgtctccccctatcaattatccgatttctaatttgtgtaaacagtggatagttgacacagtataatccttcataatgagtaagctacaaagtgatgctgtcagagaagccatcactcagatcggtaaggaagcaaaagaaaataatcgaaagtttacagagaccattgagcttcaaataggtctgaagaattatgatccccagaaagacaagcgtttcagtggttcggtgaaattgccaaacattcctcggccaaagatgaaggtgtgcatgcttggtgatgcacaacatgtagaagaggctgagaggattggtttggagtatatggatgtggaagggttgaagaagcttaacaaaaacaagaaattggtgaagaagcttgccaagaagtaccatgctttcctagcatctgaagctgtcatcaaacaaattccccgtctcttaggccctggtctcaacaaggcaggaaagtttccaacactggtgacccatcaggaatcattggagttaaaagtcaatgaaacaaaagcgaccgtgaagtttcagcttaagaaggttctctgtatgggtgttgctgtgggaaactgcagcatggaggataagcagatattccagaatgttcaaatgagcgtaaactttctggtttctttactgaagaagaactggcaaaatgtaaggtgcttgtacctgaagagtaccatggggaagcctattcgggtattctaaaaagttaggttacatatcctgagagcggcaaagctatctatagtggcaagaccgatactgttatctatggctgtctttttgtttcagtattttctgggatctctttgttttgaccaattaattttgaggtatttaaactccaactggatggcattttttggtagatgaatgtgggttattttgtcgcttgtattgttttctccttgatttaaaggtgaagatgtgtatctgtggtttccactattttgatattgttttgcttgattctacaaa

SEQ ID NO: 14145 - DNA, 922 bp, Allium cepa
gctccaccactagccgtcatccagacacgaactatttgtgtatattggagttgggcaagctaacgaaaaatgagtaagttgcagagtgatgttttgcgagaagcaatcacccagatcaaaactggtgcaacagagaagaaaaggaattttactgaaacaatagagctgcaaattgggcttaagaattacgaccctcaaaaggacaagcgtttcagtggttcagtgaaactgccgcacatacctcgtccaaaaatgaaggtttgcatgcttggtgatgctcaacactgtgaagaggcagaaaaaatggatctgccctttatggatgtagagagtctgaagaagttcaacaagaacaagaagctggtgaaaaagatggccaaaaaataccatgtttttctcgcatctgaagcgattattaagcagattccacgtcttcttggtcctggtctgaacaaggcaggtaaattccctacactggttagtcaccaggagtccttggaggcaaaagtaaacgagaccaaagctatggttaagtttcagctgaagaaagttctctgcatgggagttgcagttggtaactgtggtatggatgagaagcaaatcttccagaatgtgcaacttagcgtcaactttcttgtttctctcctgaaaaagaattggcagaatgtgagatgcttgtacctgaagagtaccatggggaagccagttcgagtgttttaagcgattcatagttcaacatgagtaatgttgtaaaagaattttcttgttgcttccgttgcttattttgttttgtaattcgattttgtttttcagttatcagacttctggttatgagttagttctaaaaaacatgcatatgaatatgatgcaatttgagtcaattttatcgtattctggaccttctggttatttgtttcattca

SEQ ID NO: 14146 - DNA, 1646 bp, Petroselinum crispum
tttgttgtagatgtttcatttttgatttttcaaaacctgttagtccactatttatttgtatgtgtagatctgtttatatgtgctgaattgttaatgttgtggctgattagttattgtataatcttaaaaaactaattaattgtgtactgtaaaattgtataatattccatgatacatgattatctgcatattaagatttgcaatttttgaaaattttgatcgtaagtgctcattagaatctttaattaactgttttaaaaatgttaaatgaaattgaataaaaatagttgttgagagttgcactatatgtttgagcttgcaaaatgttgttgatgtcgtttattttaaggttatgatatatgtagttggatggacaatatgtaatgtttatctcggtttgatatagaattagttattttgtattgatattacatatttggtgtttgtaagatgtttaaattgttctattgcagtaagctatttttctcctctcttgagctgactccctcataatttttgtaaaaacatactaattcgccatgagtaagctacagagcgaggctgttaaagaaacaattacgcagattactaccgattcaaaagaaaagagtcgcaagtttacagaaaccattgaacttcagattggacttaagaactatgatccccagaaagacaagcgtttcagtggttcggttagattgcctcacatttccaggcctaagatgaaggtttgcatgcttggtgatgctcaacatgttggagaggctgagaagattggtctagagtatatggatgttgagggcttgaagaaattaaacaagaacaagaaattggtgaagaagcttgccaagaagtaccatgctttcttagcatctgaagctgttatcaaacaaattccacgtcttttgggccctggtctcaacaaggcaggaaaatttcctacactggtgtcccatcaggaatcattggagtcaaaagtcaatgagacaaaagcaacagtgaagtttcaacttaagaaggtcctctgtatgggagttgctgttggcaactgcagtatggaggagaagcagatattccaaaatgttcaaatgagcgttaactttctggtttctctactgaagaagaattggcagaacgtgaggtgtttgtacctgaagactaccatggggaagccagtgcgaatcttttaagaaattaggtttttatctaaaagcgatatagctatccatagactttatattgttgtctctttgatgcttcacatctttttgttctctgggttatggatgtttacatcaaacaattttgagcttctaatccatttggacttcatctttgttaaaagtttattctaatatatttcgttctctatttaaaccaaaccaaaccaaacatacccattataaaccgcttagagcagtgtccgggcaggcatgtccctatcctaaaaagaataaggaggctgtttccgtgaaaacccccagcttagatagtgtgatatatttgagatcgtaacttaacccatgatattattcatacgggacttacccgaaagatgcgatcttggctggaagacaacgattaccaatcttaatttccagataataaatctgagtccccgctccttccaaatgaccctccatctg

SEQ ID NO: 14147 - DNA, 920 bp, Vicia sativa
tgagatccgtagcttgttagcctttgaagctatatcaaaatgagtaagcttcaaagtgaagcagttagagaagccatcacaggaatcatgggtgattccaaggacaaaggaaggaagtttgtggagactattgagcttcaaattggcctcaagaattacgatccacaaaaggataaacgtttcagcggttccgtcaagttgccacacatcccccgccccaagatgaagatttgtatgcttggagatgcccaacacgttgaagaggcagagaaaattggtttggagtcgatggatgttgaggctttgaagaagctcaacaagaataagaagttggtgaagaaacttgccaagaagtaccatgccttcttagcttctgaggcagtcattaagcaaattcctcgtctcttgggtcctggtctcaacaaggcaggcaagtttccaacacttgtctcccaccaagaatctcttgaggcaaaggttaatgagaccaaagctatggtcaaatttcagctcaaaaaggtgctctgcatgggagtagccgtgggaaatgttagcatggatgagaagcaaatctttcaaaatgttcaactcagtgttaactttcttgtctctttattgaaaaagaactggcagaatgttcgttgcttgtacctcaagagttccatggggaagtcttaccgtgtcttttaaggagtttattttatccaattttcaaatattctgcggcttgttatccctctctccctctcaaaacattagttatcctaatacttggatataatgtttcatcttgtcacaattttgctggattatttatggttgattttttttttctgttcaaatacttgactattttaagcttgctgtttttggtgctctaagcatttatggttgattttttttttatgttcaaatactgg

SEQ ID NO: 14148 - DNA, 997 bp, Vicia sativa
ctgaaaagaagctagggtttcgtatctgctctgagatccgtagctcgttagcctctgaatctttatcaaaatgagtaagcttcaaagtgaagcagtgagagaagccatcacaggaatcatgggtgattccaaggacaaaggaaggaagtttgttgaaaccattgagcttcaaattggcctcaagaattacgatccacaaaaggataaacgtttcagcggctccgtcaagttgccacacattccccgccccaagatgaagatttgtatgcttggagatgcccaacacgttgaagaggcagagaaaattggtttggagtcgatggatgttgaagctttgaagaagctcaacaagaataagaagttggtgaagaaacttgccaagaagtaccatgccttcttagcttctgaggcagtcattaaacaaatccctcgtctattgggtcctggtctcaacaaggcaggcaagtttccaacacttgtctcccaccaagaatctcttgaggcaaaggttaatgagaccaaagctatggtcaaatttcagctcaaaaaggtgctctgcatgggagtagccgtgggaaatgttagcatggatgagaagcaaatctttcaaaatgttcaactcagtgttaactttcttgtctctttattgaaaaagaactggcagaatgttcgttgcttgtacctcaagagttccatggggaagtcttaccgtgtcttttaaggagtttattttatccaattttcaaatattctgcggcttgttatccctctctccctctcaaaacattagttatcctaatacttggatataatgtttcatcttgtcacaattttgctggattatttatggttgattttttttttctgttcaaatacttgactattttaagcttgctgtttttggtgctctaagcatttatggttgattttttttttatgttcaaatactggactattttaacagggctgtttttggtgctataagcatttctgatgt

SEQ ID NO: 14149 - DNA, 1105 bp, Glycine max
aagttattttaaattttatggagatgtttagggtttttatgaaccccgtcgctcagtaattgtacccggataggcggctaagaataataatctgagacgaccaacctcagcctcttaccatgagtaagctacaaagtgatgcactgagagaggcaatttcccaggtggtgagtaattcaaaggagaaaaatcgtaaattcaccgagactattgagctgcaaattggattgaagaactatgatcctcagaaagataagcgtttcagtggttctgttaagcttccgcatattcctcgccctaagatgaaaatctgcatgctcggtgatgctcagcacgttgaagaggcggaaaaaattgggctggactacatggatgtggaagcactgaagaaactcaataaaaacaaaaaacttgtgaagaagcttgccaagaaatatcatgtttttctagcttctgaagcagtcatcaagcaaattcctcgtcttttggggcctggtttaaataaggcaggtaaatttccaacattagtgactcatcaggagtccttggagtcaaaagttaatgaaacaaaggcaatggtgaagtttcaacttaagaaagttctttgtatgggtgttgccgttggaaattgcacaatggaggagaaacagatattccagaatgtacaactcagtgtcaatttccttgtttcattattgaagaaaaactggcaaaacgtgaggtgcttatacctgaagagtactatggggagcgcaatccgcgtattttaaattcatatatatcttccatttaaatataatcatgggcgaagcctcttatgttatggacatgtaagcgagacattattggtgactgtcgatgccttttctttggctttttttcatattcttttgacgtcaattttgatgtcttgaaaaaaattaccagtaccttgttcatttggtttttatttggtgtgcttgctttgctattaacatttgataggacacgtgggtggctttatgaattgctttgcaatgttcataccaagtagccaccacttatactcattcaattttatttattggacgctaaacctggaaactaaggtaaaaaagccgagttt

SEQ ID NO: 14150 - DNA, 993 bp, Pinus taeda
atatttgttatctttgcagtgtcaattggacgagggcagcacgagaacgaccaagaggcacaggcagaggaagcaaggcgccccttacctgtaaacaatgagtaagcttcagagcgacgtgttgagggagggaataagtcaggtaatgggtgaaagcaaggacaaaaagcgaaaatttacagagacgatagagttacagatcgggctgaagaattatgacccccaaaaggacaagcgtttcagtgggtccgtaaaattgccccacattccccgccccaagatgaaggtctgcatgctcggagatgcccaacacgttgaagaggctgagaagatcagtctggactacatggatgttgagggtctgaagaaaatgaacaagaataagaaacttgttaagaagcttgctaagaagtaccatgcatttcttgcttcagaagcaattattaaacaaattccaagactccttggacctggtctgaacaaggcaggtaaatttcccactcttgtttcacaccaagagtccttggaggccaaagtgaatgagacaaaggcaatggttaagtttcaattgaaaaaagttctatgtatgggggttgctgtggggaactgtggaatggaggagaagcaggtgtttcagaatgttcaattgagtgtgaacttcctggtatccttgctgaagaaaaactggcaaaatgttcgatgcttgtatctgaagagtaccatgggcaagccagcacgtgtattctgagtagtgcaattttggtgccagcttgtgttggttgcatatggagaggacttttccttgtttttttgttacgttggtcaggacattacatttttgtttgtgtttaggggtatgttagccaagtggctttaatttcgggcattttggagtaaaagggaaatttaattattattttactattctgttattgtaacttcggcatgcttctctttctttattcaagtaatcagaattgagtagatactaaa

SEQ ID NO: 14151 - DNA, 1119 bp, Cichorium intybus
ccgtagaagggtgtgaataggacatctttatcactgcggggtttaaacggaattcagagttgtgctttgggctcagataagcccctgaaaccctagctcaagtattgggtatttagggttttgcgattcggccaatcacccttcttggtctgttagcggctgcaatcgaattgctacaggcggaggagccgtgcagaggggaaatccttcaccatgagtaagttagcaagtgaagctgtcagagaagccatcacccagattacaaccgatgccaaggagaagaaccgtaagtttacagagaccattgagctccaaattggtttgaagaactatgatccccaaaaagacaaacgtttcagtggcacagtgaagcttccacacattcctcgccctaaactcaaggtctgcatgcttggtgatgctcaacatgttgaagaggcacagaagataggattggaatacatggatgttgaaggattgaagaagcttaacaaaaacaagaaattggtaaaaaagcttgccaagaaacaccaagcttttctagcatctgaatctgtcatcaagcaaattccccgtctcttaggccctggtctcaacaaagcaggaaagtttcctacacttgtgtcacatcaggagtcattggagtcaaaagttaatgaaacaaaggcaacagtgaagtttcagcttaagaaggttctttgcatgggtgttgctgtgggaaattgcagcatggaagagaagcaaatcttccagaatgttcaaatgagtgtcaattttctcgtttcgttattgaagaaaaactggcaaaatgtgaggtgtttgtacttgaagactaccatggggaagcctgtacgtgtcttttagtaagatgagatttatgattcttgatatctgtctacaaatgcttcagtatttgggctttgaacaatttaattgtcgtgtttcttatcatcaaatggaaacagtaattttgttagtctttagatttggaatgtactgcgagaatatgaaaattcattccatgcttgtgaaatgttgagtttttgtgtttttctttccatatgaatgttttgttagtgcaagaactcaaagttgtgggaaaatgatgtttttaagggt

SEQ ID NO: 14152 - DNA, 1006 bp, Cichorium intybus
ttttggtgcgtaccaacatcggcactttgaaaccctactctcagggttcttacgggagaagtgaagcttaaggaaaagaaaagtttccgaatatgagtaaacttcaaagcgatgccctcagagaggcaattactcaaatcacaactgatgccaaagaaaagaagcgtaatttcaccgaaaccattgagcttcagattggcttgaagaattatgatccacaaaaggacaagcgtttcagtggtaccgtgaaattgccccacattccaaggcctaagttgaaagtttgcatgcttggagatgcccaacacgttgaagaggctcaaaagattggtcttgaatacatggatgttgaaggtcttaagaagctgaacaagaacaagaaattggtgaagaaacttgctaagaaacaccaagctttcttggcttctgaatctgttatcaagcagattcctcgtttgttgggccctggtctaaacaaggctggtaagtttcctactcttgttagccaccaggaatcccttgaggctaaagttaatgagaccaaagcaactgtgaagtttcaactgaaaaaggtgctttgtatgggagttgctgttggaaactgcagcatggaagagaaacagatcttccagaatgttcaaatgagtgttaactttcttgtttctttgttgaagaagaattggcaaaatgtgaggtgcttatacttgaaaacaacaatgggaaagccagttcgcatcttttaagtggtttacttgttttttgtgttttaattttggattaatgttaaggtcagtacttgagaaaaaatgtatttcccttgaacaggaaatagttctttttgacttgttacatgtttgtttggtacttctcattattattagtagccctactttaagacatgaagttgttatttttcttgatctgtctattagcttttttagacggtagtttgctttatgttttagcattaatgtggacaagcacatatgaggttgctgtcgagatg

SEQ ID NO: 14153 - DNA, 1092 bp, Lactuca sativa
atatcagctgtttttgatgcctaactacatcggcactttcaaaccctactatcagggttcttccgagaggagcgaagcttaacgaaaagtcaagtttccgaatatgagtaaacttcaaagcgaagccttgagagaggctattactcaaatcactactgatgctaaagaaaagaaacggaatttcaccgagaccattgagctccaaattgggttgaagaattatgatccacaaaaggacaagcgtttcagtggcactgtgaaattgcctcacattccaagacctaagctcaaggtctgcatgcttggagatgcccagcatgttgaagaggctcaaaagattgggcttgaatacatggatgtcgagggtctgaagaaactgaacaaaaacaagaagttggtgaagaagcttgcaaagaaacatcaagcttttttggcttctgaatctgtcatcaagcagattcctcgtttgttgggccctggtctaaacaaggctggtaagtttccaactcttgtttcacaccaggaatctcttgaggcaaaggtcaatgaaaccaaagcaactgtcaagttccaactgaagaaggttctttgtatgggagttgctgttggaaactgcagcatggaagaaaagcagatctttcagaatgtgcaaatgagtgtcaacttcttggtttctttgctcaagaagaattggcaaaacgtgaggtgcttatacttgaaaacaacaatgggaaagcctgttcgcatcttttaaggagtttttatttgttcttgtgttttgattttgggttaatgttaaacaaggtcagtcagcacttgagaaaaaaatgtatttcccttcaacaggaaatagttatttttggtttgttacatgtttgtttggtaatgttctttataatattagactttcttctttagacattatatcgagatgtttgtcttctattttgtctcgaatgatatttaaatgtcaaatgtgacatcttaaaaatgtcttgttttttattttttttattatgagttgttctttgttcaacttctaggtgtatgaaaatgatcattgatcatcttcataataataggcataaagca

SEQ ID NO: 14154 - DNA, 956 bp, Lactuca sativa
attaagttcatttggatagctcggccgctgtttccctttgaacttcttcggcactgctgctaccctgatagggttctaacagaagaagtgaagtttaaggcagcaacagttaacaaccatgagtaagcttcagagtgaagccctaagagaagccattactcaaatcaccacagatgcaaaagagaagaagcgtaatttcactgaaaccattgaactccaaatcggactcaagaactacgacccacaaaaggacaaacgtttcagtggaacagtgaaattgcctcacattcctaggcctaaattgaaagtttgcatgcttggagatgcccaacatgttgaagaggcacaaaagattggacttgaatacatggatgttgaagggctcaagaagctgaacaagaacaagaagcttgtgaaaaagcttgcaaaaaagcaccaagcttttttggcttctgaatctgtcattaagcagattcctcgtttgttaggccctggtcttaacaaagcaggaaaattcccaacacttgtttctcatcaagaatcccttgaagcaaaagtgaatgaaacaaaagcaactgtgaaatttcaattgaagaaggttttgtgtatgggagttgctgttggaaactgcagcatggaagagaagcagattttccagaatgttcaaatgagtgttaactttcttgtttcattgttgaagaaaaattggcaaaatgtgaggtgtttgtatttgaagacaacaatgggaaagccagtgcgtattttttaggttgttttttttttgggatttgtttttgtttggagacaaagattagtgtattgagtacttggaagcaatttttgctttatgtttttttggttttgttggatgtttaatttttaaatgtattggattttggtaatgagcattatgttttaatatggtctacttattgataaagttaacatgaagtagc

SEQ ID NO: 14155 - DNA, 865 bp, Arabidopsis thaliana
cataactagggcttccgctttcttcaccattcaggatcagagattcgtgacctgagaagacactcaatatgagtaagcttcagagtgaggctgttagagaagccataacgactatcaagggaaaatctgaggagaagaagcgtaactttgttgagacagtggagcttcagattggtctgaagaactatgacccacaaaaggataagcgtttcagtggatctgtgaagctcccacatattcctcgcccaaaaatgaagatctgtatgcttggagatgctcagcatgttgaggaggcagagaaaatgggacttagtaacatggatgttgaggctttgaaaaagcttaacaagaacaagaagcttgttaagaagcttgctaagtcttaccatgctttcttggcttctgagtctgtcattaagcagattcctcgtcttcttggtcctggtcttaacaaggcaggaaagttcccaacacttgtgagtcaccaagagtcattggaagcaaaggtgaatgagaccaaagcaacagtgaagttccagttgaagaaagttctgtgtatgggtgttgctgttggtaacctttccatggaagagaagcagctcttccagaatgtgcagatgagtgttaacttcctcgtctcgctcttgaagaagaattggcaaaacgtaaggtgtttgtacttgaagagcaccatgggaccaccacaaagaatcttttgagctctctcttcttatccttcttccatctcagaattttgcattctgtttttgtttcagagatctgtgcttgttgggatatggtttggatttatattagcagttgttttttgttgacaatatattatgcaatattcgttttaattatc

SEQ ID NO: 14156 - DNA, 792 bp, Brassica juncea
aaaatgagtaagctccagagtgaagccgtgagagaggcgatatccgccatgatcactcactgcaaggagacaaagccccgcaagttcactgagacaatcgaactccagattggtcttaagaactacgaccctcaaaaggacaaacgtttcagcggttctgtcaagttgcctcacattccaaggccaaagatgaagatttgcatgcttggtgatgcccagcacgttgaagaggctgagaagattggattagagtctatggatgtggaagcacttaagaagctgaacaagaacaagaagcttgttaagaagctggcaaagaagttccatgctttccttgcttctgaatcagtcatcaaacagattccacgtcttcttggtcctggtctcaacaaggcaggaaagttcccaactcttgttagccaccaagagtctttggaatccaaagtgaatgagacaaaggcaacagtgaagttccagctcaagaaggttctttgcatgggtgtcgctgttgggaaccttgacatggaggagaagcagatctttcagaatgttcagatgagcgtcaacttccttgtttcacttctgaagaagaactggcaaaacgtgaggtgcttgtacttgaagagcacaatgggtccaccaaaccgtgtgttctaagattattattattatctcaaagtttctcttaaggtatcatcaaaggctgagaagagatttgattttcatttctgtcgtgagccttttacttgttggattaattcgagaatccttcctttgtaggatcaatatttt

SEQ ID NO: 14157 - DNA, 916 bp, Chrysanthemum coronarium
agcggcactttgaaaccctaatagcagggttcttaccacagaagtgaagtttaaccaaaggaaaagtcagcaaacatgagtaagctatcaagtgatgctcttagggaggcaattactcagatcaccaccgatgccaaggagaagaaggtccgtaactttgttgagactattgagcttcagattggtttgaagaattacgacccacaaaaggacaaacgtttcagtggtaccgtcagattgccccacattcctcgtcccaagttgaaggtttgcatgcttggagatgctcagcatgttgaagaggcccagaagattggtcttgagtatatggatgttgagagcttgaagaagctgaacaagaacaagaagttggtgaagaagcttgctaagaaacaccaagcttttttggcttctgagtctgtcatcaagcagattccccgtttgttgggtcctggtcttaacaaggctggtaagttccctacccttgtttcccaccaggaatctcttgaggcaaaggttaacgagaccaaagccaccgtgaagtttcaacttaagaaggttctttgcatgggagtcgctgttggaaactgcagcatggaggagaaacagatcttccagaatgtgcaaatgagtgtcaacttcttggtttctttgttgaagaagaattggcaaaatgtgagatgcttgtacttgaagacaaccatgggaaagccagttcgcatcttttaagaagtttatgggttgctatgttttcattttggttaatgttgaggatggtactggaaagttttccaatgaacaggaaatagtcctttttggcttgttacatgtttgtttggtactatattttggaacaccttactttagatgttatattcttaagttacttttgcttaatggtatcagtatttagata

SEQ ID NO: 14158 - DNA, 874 bp, Chrysanthemum coronarium
aaaccctaatagcagggttcttaccacagaagtgaagtttaaccaaaggaaaagtcagcaaacatgagtaagctatcaagtgatgctcttagggaggcaattactcagatcaccaccgatgccaaggagaagaaggtccgtaactttgttgagactattgagcttcagattggtttgaagaattacgatccacaaaaggacaagcgtttcagtggtaccgtcagattgccccacattcctcgtcctaagttgaaggtttgcatgcttggagatgctcagcatgttgaagaggcccagaagattggtcttgagtatatggatgttgagagcttgaagaagctgaacaagaacaagaagttggtgaagaagcttgctaagaaacaccaagcttttttggcttctgagtctgtcatcaagcagattccccgtttgttgggtcctggtcttaacaaggctggtaagttccctacccttgtttcccaccaggaatctcttgaggcaaaagttaatgagaccaaagccactgtgaagtttcaacttaagaaggttctttgcatgggagtcgctgttggaaactgcagcatggaggagaaacagatcttccagaatgtgcaaatgagcgtcaatttcttggtctctttgttgaagaagaactggcaaaatgttcgatgcctatacttgaagacaaccatgggaaagccagttcgcatcttttaagaagtttatggattgtcatgttttcattttggttaatgttgaggatggtactggaaagttttccaatgaacaggaaatagtccgttttggcttgttacatgtttgtttggtactactatatttttggacaccttactttagatgttatattatctag

SEQ ID NO: 14159 - DNA, 965 bp, Cichorium intybus
cacgatccaggcccaatagggtttcgccttcatattaaagatgtgttcaatatatcggccgctgttttccctcgaacttcatcggcagtgctgctagggttctcacagaaggagtgaagtttaaggcagcaaaacttaacaaccatgagtaagcttcaaagtgaagccctccgagaggccattactcaaatcaccaccgatgccaaagaaaagaaacgtaacttcactgaaaccatcgaactccaaattggtctcaagaactacgacccacaaaaggacaaacgtttcagtggtaccgtgaagttgcctcacattcctcgccccaaattaaaagtttgcatgcttggagatgcccaacatgtagaagaggctcagaaaatcggccttgaatacatggatgttgaaggactcaagaagctcaacaagaacaagaagcttgtaaagaagcttgcaaaaaaacatcaagcttttttggcttctgaatctgtcatcaagcagattccccgtttgttaggccctggtttaaacaaagcaggaaaattcccaacacttgtttctcaccaggaatcacttgaagctaaagtgaatgaaacaaaggcaactgtgaagtttcaattgaaaaaagtgttgtgtatgggagttgctgttggaaactgtagcatggaggaaaaacagatttttcaaaatgttcaaatgagtgtcaactttttggtttcgttgttgaagaagaattggcaaaacgtgaggtgtttgtatttgaagacgacaatgggaaagccggtgcgtattttttagatgtttactttgttttttttttaaagatttgttatgtttaagggtgatacttggaagcatttggtgctttatcgtttttggcttgttggatgtttaatttataatttgtattggattggattttttagaagttatgttttaatgggctcaaacgattatatttatatttg

SEQ ID NO: 14160 - DNA, 953 bp, Cichorium intybus
agctgtttttggtgcgtaactacatcggcactttgaaaccctactctcagggttcttacgaagtgaagcttaaggaaaagaaaagtttccgaatatgagtaaacttcaaagcgaagccctcagagaggcaattactcaaatcacaactgatgccaaagaaaagaagcgtaatttcactgaaaccattgagctccagattggcttgaagaattatgatccacaaaaggacaagcgtttcagtggtaccgtgaaattgccccacattccaaggcccaagttgaaagtttgcatgcttggagatgcccaacacgttgaagaggctcaaaagattggtcttgaatacatggatgttgaaggtcttaagaagctgaacaagaacaagaaattggtgaagaaacttgctaagaaacaccaagcttttttggcttctgaatctgttatcaagcagattcctcgtttgttgggccctggtctaaacaaggctggtaagtttcctacccttgtttcccaccaggaatcccttgaggccaaggttaatgagaccaaagcaactgtgaagtttcaactgaaaaaggtgctttgtatgggagttgctgttggaaactgcagcatggaagagaaacagatcttccagaatgttcaaatgagtgttaactttcttgtttctttgttgaagaagaattggcaaaatgtgaggtgcttatacttgaaaacaacaatgggaaagccagttcgcatcttttaagtggtttacttgttttttgtgttttcattttggattaatgttaagttcagtacttgagaaaaaatgtatttcccttgaacaggaaatagttctttttgacttgttacatgtttgtttggtacttctcattattattagtagccctactttgagacatgaaattgctatttttcttgttctatccattagtttttttagacggaagttt

SEQ ID NO: 14161 - DNA, 973 bp, Cichorium intybus
ccctaaagaataatttgacccgaccaatctgtttcccggttacgatttgcacgatccaggcccaatagggtttcgccttcatattaaagatgtgttcaatatatcggccgctgttttccctcgaacttcatcggcagtgctgctagggttctcacagaaggagtgaagtttaaggcagcaaaacttaacaaccatgagtaagcttcaaagtgaagccctccgagaggccattactcaaatcaccaccgatgccaaagaaaagaaacgtaacttcactgaaaccatcgaactccaaattggtctcaagaactacgacccacaaaaggacaaacgtttcagtggtaccgtgaagttgcctcacattcctcgccccaaattaaaagtttgcatgcttggagatgcccaacatgtagaagaggctcagaaaatcggccttgaatacatggatgttgaaggactcaagaagctcaacaagaacaagaagcttgtaaagaagcttgcaaaaaaacatcaagcttttttggcttctgaatctgtcatcaagcagattccccgtttgttgggccctggtttaaacaaagcaggaaaattcccaacacttgtttctcaccaggaatcacttgaagctaaagtgaatgaaacaaaggcaactgtgaagtttcaattgaaaaaagtgttgtgtatgggagttgctgttggaaactgtagcatggaggaaaaacagatttttcaaaatgttcaaatgagtgtcaactttttggtttcgttgttgaagaagaattggcaaaatgtgaggtgtttgtatttgaagacgacaatgggcaagccggtgcgtattttttagatgtttacttagttttttttaaagatttgttatgttttgagggtgatacttggaagcaattggtgctttatcgtttttggctttttggatgtttaatttataatttgtattggattttctagaaattat

SEQ ID NO: 14162 - DNA, 1011 bp, Cichorium intybus
ccctaaagaataatttgacccgaccaatctgtttcccggttacgatttgcacgatccaggcccaatagggtttcgccttcatattaaagatgtgttcaatatatcggccgctgttttccctcgaacttcatcggcagtcctgctagggttctcacagaagaagtgaagtttaaggcagcaaaacttattaaccatgagtaagcttcaaagtgaagccctccgagaggccattactcaaatcaccaccgatgccaaagaaaagaaacgtaacttcactgaaaccatcgaactccaaattggtctcaagaactacgacccacaaaaggacaaacgtttcagtggtaccgtgaagttgcctcacattcctcgccccaaattaaaagtttgcatgcttggagatgcccaacatgtagaagaggctcagaaaatcggccttgaatacatggatgttgaaggactcaagaagctcaacaagaacaagaagcttgtaaagaagcttgcaaaaaaacatcaagcttttttggcttctgaatctgtcatcaagcagattccccgtttgttgggccccggtttaaacaaagcaggaaaattcccaacacttgtttctcaccaggaatcacttgaagctaaagtgaatgaaacaaaggcaactgtgaagtttcaattgaaaaaagtgttgtgtatgggagttgctgttggaaactgtagcatggaggaaaaacagattttccaaaatgttcaaatgagtgtcaactttttggtttcgttgttgaagaagaattggcaaaacgtgaggtgtttgtatttgaagacgacaatgggaaagccggtgcgtattttttagatgtttactttgttttttatttttattttaaagagttgttatgtttgagggtgatacttggaagcatttggtgcttaatcgtttttggcttgttggatgtttaatttataatttgtattggattggattttttagaagttatgttttaatgggctcaaacgattata

SEQ ID NO: 14163 - DNA, 1054 bp, Cichorium intybus
ccctaaagaataatttgacccgaccaatctgtttcccggttacgatttgcacgatccaggcccaatagggtttcgccttcatattaaagatgtgttcaatatatcggccgctgttttccctcgaacttcattggcagtgctgctagggttctcacagaaggagtgaagtttaaggcagcaaaacttattaaccatgagtaagcttcaaagtgaagccctccgagaggccattactcaaatcaccaccgatgccaaagaaaagaaacgtaacttcactgaaaccatcgaactccaaattggtctcaagaactacgacccacaaaaggacaaacgtttcagtggtaccgtgaagttgcctcacattcctcgccccaaattaaaagtttgcatgcttggagatgcccaacatgtagaagaggctcaaaaaattggccttgaatacatggatgttgaaggactcaagaagctcaacaagaacaagaagcttgtaaagaagcttgcaaaaaaacatcaagcttttttggcttctgaatctgtcatcaagcagattccccgtttgttgggccccggtttaaacaaagcaggaaaattcccaacacttgtttctcaccaggaatcacttgaagctaaagtgaatgaaacaaaggcaactgtgaagtttcaattgaaaaaagtgttgtgtatgggagttgctgttggaaactgtagcatggaggaaaaacagattttccaaaatgttcaaatgagtgttaactttttggtttcgttgttgaagaagaattggcaaaacgtgaggtgtttgtatttgaagacgacaatgggaaagccggtgcgtattttttagatgtttactttgttttttttttttaaagatttgttatgtttgagggtgatacttggaagcatttggtgctttatcgtttttggcttgttggatgtttaatttataatttgtattggattttctagaaattatgttttaatgggctcaaacgattatatttatatttattgtgctcaattaattgattaggccagtcaatctgtcgggtag

SEQ ID NO: 14164 - DNA, 827 bp, Cichorium intybus
ggcagtgctgctagggttctcacagaagaagtgaagtttaaggcagcaaaacttaacaaccatgagtaagcttcaaagtgaagccctccgagaagccattactcaaatcaccaccgatgccaaagaaaagaaacgtaacttcactgaaaccattgaactccaaattggtctcaagaactacgacccacaaaaggacaaacgtttcagtggaacagtgaagttgcctcacattcctcgccccaaattgaaagtttgtatgcttggagatgcccaacatgtagaagaggctcaaaaaatcggccttgaatacatggatgttgaaggactcaagaagctcaacaagaacaagaagcttgtgaaaaagcttgcaaaaaagcatcaagcttttttggcttccgaatctgtcatcaagcagattccccgtttgttgggccccggtttaaacaaagcaggaaaattcccaacacttgtttctcaccaggaatcacttgaagctaaagtgaatgaaacaaaagcaactgtgaagtttcaattgaaaaaagtgttgtgtatgggagttgctgttggaaactgtagcatggaggaaaaacagattttccaaaatgttcaaatgagtgtcaactttttggtttcgttgttgaagaagaattggcaaaacgtgaggtgtttgtatttgaagacgacaatgggaaagccggtgcgtattttttagatgtttactttgttttttatttttattttaaagagttgttatgtttgagggtgatacttggaagcatttggtgctttatcgtttttggcttgttggatgtttaatttataatttg

SEQ ID NO: 14165 - DNA, 1008 bp, Cichorium intybus
cagctgtttttggtgcgtaactacatcggcactttgaaaccctactctcagggttcttacgaagtgaagcttaggaaaagaaaagtttccgaatatgagtaaacttcaaagcgaagccctcagagaggcaattactcaaatcacaactgatgccaaagaaaagaagcgtaatttcactgaaaccattgagctccagattggcttgaagaattatgatccacaaaaggacaagcgtttcagtggtaccgtgaaattgccccacattccaaggcccaagttgaaagtttgcatgcttggagatgcccaacacgttgaagaggctcaaaagattggtcttgaatacatggatgttgaaggtcttaagaagctgaacaagaacaagaaattggtgaagaaacttgctaagaaacatcaagcttttttggcttctgaatctgttatcaagcagattcctcgtttgttgggccctggtctaaacaaggctggtaagtttcctacccttgtttcccaccaggaatcccttgaggccaaggttaatgagaccaaagcaactgtgaagtttcaactgaaaaaggtgctttgtatgggagttgctgttggaaactgcagcatggaagagaaacagatcttccagaatgttcaaatgagtgttaactttcttgtttctttgttgaagaagaattggcaaaatgtgaggtgcttatacttgaaaacaacaatgggaaagccagttcgcatcttttaagtggtttacttgttttttgtgttttcattttggattaatgttaagttcagtacttgagaaaaaatgtatttcccttgaacaggaaatagttctttttgacttgttacatgtttgtttggtacttctcattattattagtagccctactttaagacatgaaattgttatttttcttgatctgtctattagcttttttagacggtagtttgctttatgttttagcattaatgtggacaagcacatatgaggttgctgtcgagatg

SEQ ID NO: 14166 - DNA, 859 bp, Cichorium intybus
tttccctcgaacttcatcggcagtgctgctagggttctcacagaagaagtgaagtttaaggcagcaaaacttaacaaccatgagtaagcttcaaagtgaagccctccgagaagccattactcaaatcaccactgacgccaaagaaaagaaacgtaacttcactgaaactatcgaactccaaattggtctcaagaactacgacccacaaaaggacaaacgtttcagtggtacagtgaagttgcctcacatccctcgccccaaattaaaagtttgcatgcttggagatgcccaacatgtagaagaggcccagaaaatcggccttgaatacatggatgttgaaggactcaagaagctcaacaagaacaagaagcttgtgaaaaagcttgcaaaaaagcatcaagcttttttggcttctgaatctgtcatcaagcagattccccgtttgttgggccctggtttaaacaaagcaggaaaattcccaacactagtttctcaccaggaatcacttgaagctaaagtgaatgaaacaaaagcaactgtgaagtttcaattgaaaaaagtgttgtgtatgggagttgctgttggaaattgtagcatggaggaaaagcagattttccaaaatgttcaaatgagtgtcaactttttggtttcgttgttgaagaagaattggcaaaatgtgaggtgtttgtatttgaagacgacaatgggcaagccggtgcgtattttttagatgtttacttagttttttttaaagatttgttatgttttgagggtgatacttggaagcaattggtgctttatcgtttttggctttttggatgtttaatttataatttgtattggattttctagaaattat

SEQ ID NO: 14167 - DNA, 878 bp, Trifolium pratense
aaattctccgaattgaaattagggtttcgcctctgctgtaagatctgattctaatccaaaatgagtaagcttcagagcgaagcagtcagagaagccatctcaggaatcatgaccgattcgaaggataagaatcgtaagtttgtggagactattgaacttcaaattggtctgaagaactatgacccacaaaaagacaagcgttttagtggctctgttaagttgccccatatccctcgtcctaagatgaagatttgtatgcttggagatgcccagcatgttgaggaggctgagaaaataggactggactctatggatgttgaagctttgaagaagctcaacaaaaataagaaactagtgaagaaattggctaagaagtaccattcctttttagcttctgaagctgttatcaagcagattccgcgtcttttgggacctggactcaacaaggcaggaaagttccctacccttgtttcccatcaagaatctcttgaggctaaggttaatgagaccaaggctatggtcaaattccagcttaagaaagtgttgtgcatgggagtagctgttggcaatgtcagtatggatgaaaagcaaatattccaaaacgtacaactgagtgttaacttcctcgtgtccttattgaaaaagaactggcaaaatgttaggtgcttgtatctgaagagttcgatgggcaaatcacaccgtgtcttttaaacaattgtttttaaattcaatgtatctgaaattgcgcttaatattttggtttactgtaatagttgagacaggagttttcgatctttctacaattttgtttgatgagattttgttagtattttgtgttcttgaatggtgtttaattgctttttttttaggagtgctta

SEQ ID NO: 14168 - DNA, 754 bp, Echinacea purpurea
gcgtaaacatatcggcactttgaaaccctaatctcagggttcttacaaagagatttgaagttaacgagaggaaatatttctgaaaatgagtaagcttcaaagtgacgcccttagagaggcaattactcagatcactactgatgcgaaggaaaagaagcgtaacttcactgaaaccattgagctccaaattggtttgaagaattacgatccacaaaaggacaagcgtttcagtggtactgtgaaattgcctcacattcctcgcccaaaactgaaagtttgcatgcttggggatgctcagcatgtagaagaggctcaaaagattggccttgaatatatggatgttgagggtctgaagaagctgaacaagaacaagaagctggtgaagaagcttgccaagaaacatcaggcgtttttggcttctgaatctgttatcaagcaaattcctcgtttgttaggacctggtctaaacaaggcaggaaagttcccgacacttgttactcaccaggaatccctcgaggctaaggtgaatgaaacaaaagcgacagttaagtttcaactgaaaaaggtgctgtgcatgggagttgctgttggtaactgcagcatggaggagaaacagattttccaaaacgtgcagatgagcgttaatttccttgtttcattgttgaagaagaactggcagaatgtgagatgtttgtacttgaagacaacaatgggaaagcccgttcgcatcttttaggcattttgtttgtttttt

SEQ ID NO: 14169 - DNA, 752 bp, Echinacea purpurea
gctgtcttcctccaacttcatcggtgctgcttctaggactcataccgaagaagtgacggttaacgaaggaaaaccaaacaaaaatgagtaagctgcagagtgatgccctgcgtgaagccattactcaaattaccactgatgccaaggaaaagaaacgtaatttcactgagacaattgagcttcagatcggactcaagaactacgacccacaaaaggacaagcgttttagcggtactgtaaagttgcctcacattcctcgtcccaaattgaaggtttgcatgcttggagatgcacagcatgtggaagaggctcaaaagattggtcttgaatacatggatgttgaaggactcaagaagctcaacaagaacaagaagctggtgaagaagcttgccaagaagcaccaggcgtttttggcttctgaatctgttatcaagcaaattcctcgtttgttgggtcctggtctaaacaaggcaggaaagttcccgacacttgttactcaccaggaatccctcgaggctaaggtgaatgaaacaaaagcgacagttaagtttcaactgaaaaaggtgctgtgcatgggagttgctgttggtaactgcagcatggaggagaaacagattttccaaaacgtgcagatgagcgttaatttccttgtttcattgttgaagaagaactggcagaatgtgagatgtttgtacttgaagacaacaatgggaaagcccgttcgcatcttttaggcattttgtttgtttttt

SEQ ID NO: 14170 - DNA, 858 bp, Echinacea purpurea
tgttagggttctaccagagaatagaggtttcaggaaggaaaacctaacaaaaaatgagtaagcttcagagtgacgcccttagggaagccattactcaaatcaccactgatgctaaagaaaagaagcgtaacttcactgagactattgagcttcagatcgggctcaagaactacgacccacaaaaggacaagcgttttagcggtactgtaaagttgcctcacattcctcgtcccaaattgaaggtttgcatgcttggagatgcacagcacgtggaagaggctcaaaagattggtcttgaatacatggatgttgaaggactcaagaagctcaacaagaacaagaagttggtgaagaagcttgctaagaaacaccaggcttttttggcttctgaatctgttatcaagcagattccccgtttgttgggtccaggtctaaacaaggcaggtaaattcccaacccttgttactcaccaggaatctcttgaggccaaggtgaatgaaacaaaggctactgtcaagtttcaactcaagaaagtgttgtgcatgggagttgctgttgggaactgcagcatggaggaaaaacagatttttcaaaacgtgcagatgagcgttaactttcttgtttcattgctgaagaaaaattggcaaaatgttcgatgcttgtacttgaagacaacgatgggaaagccagttcgcattttttaggtgttttatcttgtttttgttgaggccagttcttggaagcatttcactttaatgggtgctattgtttttgacttgttggatgtttgttttcttactgtattagatcctgctattaacattatgtttaatggttacagaccttttattcttaaaa

SEQ ID NO: 14171 - DNA, 688 bp, Festuca arundinacea
caggtggatcttcgaccagcgaccggccgcaaccatgagtaagctgtcgaccgaggccctcaaggaggccatcacccaggtcgtgaccgacgccaaggagaagaacaggaagttcaccgagaccatcgagctccagatcggcctcaagaactacgacccccaaaaggacaagcgtttcagcggctccgtcaagctgccacacgtcccgcgccccaagatgagggtctgcatgctcggtgacgcgcagcatgtcggagaggctgagaagattggtcttgattccatggatgttgaagctcttaagaagatgaacaagaacaagaagcttgtcaagaggctcgccaagaagtatcatgctttcttggcctcggaggctattatcaagcagattccccgtctccttggccctggcctcaacaaggcaggcaagttcccgaccctggtttctcactcagagtctctggaagccaaggtgaacgagacgaaggccaccatcaagttccagctgaagaaggtgctgtgcatgggtgtggcggtgggcaacctgtcgatggaggagaagcagatccagcagaacatccagatgagtgtcaacttcttggtgtccctgctcaagaagaactggcagaacgtgaggtgcctgtacatcaagagcaccatggggaagcctgcacgggtgttctaagcc

SEQ ID NO: 14172 - DNA, 850 bp, Festuca arundinacea
ggcgtcgactgatcggcggcaaccatgagtaagctttcaagtgacgcggtcaaggaggccatcgccctgattgttggggaggccagagagaagaagcgcaagttcactgagactgttgagcttcagattggtctcaagaactacgacccgcaaaaggacaagcgtttcagtggctctgttaagctgccccacatcccccgcccgaagatgagggtgtgcatgcttggtgatgcctcacatgtcgaccaggctgagaaattgggccttgactccatggatgttgaaagtctcaaaaagatgaacaagaacaagaagcttgttaagaagctagccaagaagtaccatgctttcttagcatctgaggccatcatcaagcagatcccccgtctcctcggacctggtctcaacaaggcaggcaagttcccaacactggttagtcactcagagtctcttgaagccaaggtcaacgagacaaaagctacagtcaagttccagctgaagaaggttctttgcatgggtgttgctgtgggtaacttgtcgatggacgagaagcagatccaacagaacctccaaatgagcgtcaacttccttgtgtcccttctgaagaagaactggcagaatgtgaggtgcctgtacgtgaagagtaccatggggaagcgccagcgggtgttttaagtggtctccagtgaagttgataagatagtgggctgtactgtcgagcttgtctttgaagttagatctgtttcactgataccaattttgtgtttatcttaatcgaatatgaaccaactattttatctggtggtactcttttcgaacttatgggagaaatggaactgcctttctgttc

SEQ ID NO: 14173 - DNA, 580 bp, Lolium multiflorum
gaagcaatcacagctattaccaatggaagtcgggagaagaaccgcaagttcgttgaaaccattgagctgcagatcggactgaagaactatgacccacaaaaggataagcgtttcagtggttctgttaagcttcctcacatccctcgcccaaagatgagggtctgcatgcttggtgatgcccagcacgttgaagaggcagggaaaatgggcctagactatatggatgtggaatccctcaagaagatgaacaaaaacaagaagctagtcaagaagcttgcaaagaagtaccatgcttttcttgcatctgaggccatcattaagcagattcctagacttcttggacctggtcttaacaaggcaggaaaattcccaactctggtttctcatcaggagtctctcgaagcgaaggttaatgagaccaaggctacagtgaagttccagctgaaaaaggtgctctgcatgggtgttgctgttggccacttgggcatggacgagaagcaaatcttccagaacgtgcagatgagcgtgaatttccttgtttctctgttgaagaagaattggcaaaatgtgaggtgcttgt

SEQ ID NO: 14174 - DNA, 878 bp, Lolium multiflorum
gtccgccgccgccgccgcaccctcgacagaatccggcgtcgactgatcggcggcaaccatgagtaagctttcaagtgatgcggtcaaggaggccatcgccctgattgttggggaggccagggagaagaagcgcaagttcactgagactgttgagcttcagatcggtctcaagaactatgacccgcaaaaggacaagcgtttcagcggctctgttaagctgccccatatcccccgccccaagatgagggtgtgcatgcttggtgatgcctcacacgtcgaccaggctgagaaattgggcctcgactccatggatgttgaaagtctcaaaaagatgaacaagaacaagaagcttgttaagaagctagccaagaagtaccacgctttcttagcatctgaggccatcatcaagcagatcccccgtctccttggtcctggtctcaacaaggcaggcaagttcccgactctggtttctcactcagagtctctggaagccaaggtgaacgagacgaaggccacgatcaagttccagctgaagaaggtgctgtgcatgggtgttgcggtgggcaacctgtcgatggaggagaagcagatccaacagaacatccagatgagcgtcaacttcctggtgtccctgctcaagaagaactggcagaacgtgaggtgcctgtacatcaagagcaccatggggaagccggcccgggtgttctaagcccagtgcatctgccatctatataatcaacactagctaccgtagtttccttgccgtacgtgtttgggcttagaaatgccgtggtttttgttaatgtttctgtgtcgtggtgaacatgatgaaaagaacctgttaccaatatattgattgtctatgctgtgtaccctaa

SEQ ID NO: 14175 - DNA, 954 bp, Avena sativa
cagccgctgtgcccgtcccctctctctttgcccctccctcccttcgaccgccgccgcaccatcgccgaaatccgtcgtcgactgaccggcggcaaccatgagtaagctttcaagtgaggcggtcaaggatgccatcacccagattgttggggaggccagagaaaagaagcgcaagttcactgagactgttgagcttcagattggtctcaagaactatgacccgcaaaaggacaagcgtttcagcggctctgttaagctgccccatatcccccgcccgaagatgagggtgtgcatgcttggtgatgcccagcatgttgaccaggctgagaaattgggacttgactccatggatgtggagagtctcaaaaagatgaacaagaataagaagcttgtcaagaagctagccaagaagtaccatgctttcttagcatctgaagccatcatcaagcagatcccccgtctccttggtcctggtctcaacaaggcaggaaagttccccacactggttagtcactctgagtctcttgaagccaaggtcaatgagacaaaagctacagtcaagttccagctaaagaaggttctctgcatgggtgttgctgtgggtaacttgtcgatggatgagaagcagatccaacagaacctccaaatgagcgttaacttccttgtgtcccttctgaagaagaactggcagaatgtgaggtgcctgtacgtgaagagcaccatggggaagcgtgtccgggtgttctaagtggtcttgctccagtgaagttgataagatactctgtactgtcaacctgagtttgtctttgttttagatctgtttcactgatgccaattttgtgtctatctaagcgaatatcagcaaagcattctgtctctggtagtccttttgaacttgttgagaaatggaactgtatttcttttatgattttgaatgctcacgttgtgcctact

SEQ ID NO: 14176 - DNA, 939 bp, Avena sativa
gcccctccctcccttcgaccgccgccgcaccatcgacgaaatccgtcgtcgactgaccggcggcaaccatgagtaagctttcaagtgaggcggtcaaggatgccatcacccagattgttggggaggccagagaaaagaagcgcaagttcactgagactgttgagcttcagattggtctcaagaactatgacccgcaaaaggacaagcgtttcagcggctctgttaagctgccccatatcccccgcccgaagatgagggtgtgcatgcttggtgatgcccagcatgttgaccaggctgagaaattgggacttgactccatggatgtggagagtctcaaaaagatgaacaagaataagaagcttgtcaagaagctagccaagaagtaccatgctttcctagcatctgaagccatcatcaagcagatcccccgtctccttggtcctggtctcaacaaggcaggcaagttccccacactggtgagtcactccgagtctcttgaagccaaggtcaatgagactaaagctacagtcaagttccagctgaagaaggttctgtgcatgggggttgctgtgggtaacttgtcgatggatgagaagcagatccaacagaacctccaaatgagcgttaacttccttgtgtcccttctgaagaagaactggcagaatgtgaggtgcctgtacgtgaagagcaccatggggaagcgtgtccgggtgttctaagtggtcttactccagtgaagttgataagatactctgtactgtcaacctgagtttgtctttgttttagatctgtttcactgatgccaattttgtgtctatctaagcgaatatcagcaaagcattctgtctctgttagtctttttgaacttgttgagaaatggaactgtatttctgttatgattttgattgttcacgttgtgcctctccccatagttttgcc

SEQ ID NO: 14177 - DNA, 853 bp, Vicia sativa
ttagcctttgaatctatatcaaaatgagtaagcttcaaagtgaagcagttagggaagccgtcacaggaatcatgggtgattccaaggacaaaggaaggaagtttgtggagactattgagcttcaaattggcctcaagaattacgatccacaaaaggataaacgtttcagcggctccgtcaagttgccacacatcccccgccccaagatgaagatttgtatgcttggagatgcccaacacgttgaagaggcagagaaaattggtttggagtcgatggacgttgaagctttgaagaagctcaacaaaaataagaagttggtgaagaaactcgccaagaagtaccatgctttcttagcttctgaggctgttattaagcagattccccgtctcttgggtcctggtctcaacaaggcagggaagtttccaacacttgtctcccatcaagaatctcttgaggcaaaggttaatgaaaccaaggctatggtcaagtttcagcttaagaaggtgctctgtatgggagtagccgtgggcaatgtaagcatggatgagaagcaaatctttcaaaatgttcaactaagtgttaacttccttgtctctttgttgaagaagaattggcagaatgttcgatgcttgtatctcaagagttcaatggggaagtcttaccgtgtcttttagggagtttattttcttgtcattattcaatattcagcggcttgttgttatcctctcattagttatcccaatagttgcatagaatatcccatcttcttgcagttttgcgggattatttatggttaatttttattttaatgttcaaatatttgacaattttaagagtgctgattttggtgcct

SEQ ID NO: 14178 - DNA, 1861 bp, Brachypodium distachyon
atctaacagaagagccgacgagagccactcctcgcgccgccctcccttcgtcctcacccctccccaaaccctagaccagcaggcggatagtcgatcgatcggcgaccatgagtaagttgcagactgaggcccttaaggaggccatcacccaggttgtcacggaggccaaggagaagaatagaaagtttacggagaccgttgaactccagatcggtctcaagaactatgacccgcaaaaggacaagcgtttcagcggctctgttaagctgccccatgtccctcgcccaaagatgagggtctgcatgcttggtgatgcacagcatgtgggggaggctgagaagattggtcttgattccatggatgttgaagctcttaagaagatgaacaagaacaagaagcttgtcaagaggcttgccaagaagtatcatgctttcttagcttcagaggctatcatcaagcagattccccgtctccttggtcctggtctcaacaaggcaggcaagttccctactctggtttctcaccaggaatctctggaagccaaggtaaacgagacgaaagctacaatcaagttccagctgaagaaggtgctttgcatgggtgtcgcagtgggtaacctttccatggaggagaagcagatccagcaaaacatccagatgagcgtcaacttcctggtttccctgcttaagaagaattggcaaaacgtcaggtgcctgtacatcaagagcaccatggggaagccggttcgggtgttctaagtccttgcctctgcctagaatcaatattaccatagtggactttcttactatgtctgtgcttaaatatgtcgcagttttatcaaatgtgtgcgtgccctgatgaacatgatggaataaactagcagtattacttttttggcagtgtttttgtttttcgtcgaccagatattatcgaacaatgtgctcaagattatactctaccggtacctgatatatacgtcgtggatgctgtgtcgcttgtgctgtttatctacggtgcaatctgtctgatcgagtgattgtgatactggcttagtgcctatgttgggtcgatgcatcggaatatacagatgatatctgcatggcaagcactcacttcgggcttgtttggaaccttcaatgatatttcgttttggattagttcatatttagtgctacacgtaaggatccaaacaaggccttcgtgtcacaaccggtgtcacgtcgtatcagaagttgtttgcgaacacaatttttttgaaaaaattactctaatttaaccatcgtttaataaagttgcctggaatttaaaagataaacctgatgacggagaagccctaatcttgcgaggggacacaattgctagagagcagggctggctcagtagccgaattgccagaaagccaccatagccatgcccatgtcgcttgggcctccgcctcctcggctcggtgccttccgccgcgacgccgccctcttctccgccggccagtcccgtgctctctctggatgcgctattctcgggaggacgaatcttggcgccgggcgcgcctactgcctcttctccggcggcggcgaccgcagaaagcaggaggaggctaggggagcactggagagcgccttgggacagaagaagacaggttttgagaaatggggcatgggagttgaaaagaggcagcaaagggaccggcgtggtggtcctggtcctgctgccggtggtggcggaggaaggtctggaggaggtggtgcttggttgaggtggttcagcagtggaggtttttgggatgcagcgaaacaaactgttcttacgatccttggcattatagccgcgttctttctgatcgcaaacttcaatgtcttggtag

SEQ ID NO: 14179 - DNA, 1019 bp, Arachis hypogaea
aacgcagagtacggggggagctgctgactaggtttgtggcggccacggtaactcgcgctctctctcaatgcgttagctacaacacattacacattatccgcattttcgttataatagcagcttgttctatttgcagaataatcttttgtggcggcacctcaaacaccaaacctctgctccttacaatgagtaagctacagagtgatgcactgagagaggccatatctcagctcgttgcgaatgcgaacgagaagaagcgcaaattcactgagacagttgaacttcagattggtttgaagaactatgacccccagaaagacaagcgtttcagcggttccgttaagcttcctcatattcctcgccccaagatgaagatctgcatgcttggtgacgctcagcacgtcgaagaggctgaaaaaattgggctggattggatggatgtcgaggcactgaaaaagcttaataagaacaagaaacttgtgaagaagcttgctaagaagtatcatgcttttctagcttctgaagctgtcatcaagcaaattcctcgcctcttaggccctggtttgaacaaggcaggtaagtttccaacattagtgacacatcaggaatccttagagtcaaaagttaatgaaacaaaagcaatggtgaagtttcaacttaagaaagttctttgcatgggtgttgctgttggaaattgctcaatggaggagaaacagatattccagaatgtacaactcagtgtcaatttccttgtttcattattgaagaaaaactggcaaaatgtgagatgcttgtacctcaagagtacaatggggagtgcaatccgcgtattttagattgtttagatatgggtagtttgcattggctaaacctcatgagttgtggacatgttaacgggatgttattgctgacagttaatgcccccatttttttttctgacattcttaagattctttgatatcaattgttttatgataatccttgttttctgtgtcattaatgactggccacaaaagatt

SEQ ID NO: 14180 - DNA, 830 bp, Lolium multiflorum
ccgccgccgccgcaccctcgacagaatccgtaagggcgtcgactgatcggcggcaaccatgagtaagctttcaagtgacgcggtcaaggaggccatcgccctgattgtcggggaggccagggagaagaagcgcaagttcactgagactgttgagcttcagatcggactcaagaactacgacccgcaaaaggacaagcgtttcagtggctctgttaagctgccccatatcccccgcccaaagatgagggtgtgcatgcttggtgatgcctcacatgttgaccaggctgagaaattgggccttgactccatggatgttgaaagtctcaaaaagatgaacaagaacaagaagcttgttaagaagctagccaagaagtaccacgctttcttagcatctgaggccatcatcaagcagatcccccgtctccttggtcctggtctgaacaaggcaggcaagttccccacacttgttagtcactcagagtctcttgaagccaaggtcaacgagacaaaagctactgtcaagttccagctgaagaaggttctttgcatgggtgttgctgtgggtaacttgtcgatggacgagaagcagatccagcagaacctccaaatgagcgtcaacttccttgtgtcccttctgaagaagaactggcagaatgtgaggtgcctgtacgtgaagagcaccatggggaagcgccagcgggtgttctaagtggtctccagtgaagttgataagatagtgggctgtattgtcgagcttgtctttgaagttagatctgtttcactgataccaattttgtgttttatcttaagcgaatatgaaccaactattt

SEQ ID NO: 14181 - DNA, 978 bp, Brassica juncea
ggtctctgtttctgaggaagtgccaaaatgagtaagctccagagtgaagccgtgagagaggcgatatcagccatgatcactcactgcaaggagacaaagccacgtaagttcactgagactatcgaactccagattggtcttaagaactatgaccctcaaaaggacaaacggttcagcggttcggtcaagttgcctcacattccaaggcctaagatgaagatttgcatgctcggtgatgcccagcacgttgaagaggctgagaagattggattagagtctatggatgttgaagcacttaagaagttgaacaagaacaagaaacttgttaagaagcttgccaagaagttccatgctttccttgcttctgagtctgtcattaagcagattcctcgtcttcttggtcctggtctcaacaaggcaggaaagttcccaactcttgttagtcaccaagagtctttggaggccaaggtgaatgagactaaggcaacagtgaagttccagctcaagaaggttctgtgcatgggtgtcgctgttgggaatctcggcatggaggagaagcagatttttcagaatgttcagatgagcgtcaacttccttgtttcactcttgaagaaaaactggcaaaacgtgaggtgcttgtacttgaagagtacaatgggtccaccaaaccgtgttttctaagatgttttttatctcaaagtttctctcaaggtgtcatcagactcgaaggaaaattgattttcttttcagtcatcagcctttttcttcgattacttcccgaatctttactttgtaggatcaagatattgttgaaagacaattttgtttcttttattattagtgggattttctctattttaagttatcaagatttgcgttatgtgacaacaacacatcgtttgaagtttagtctggtttgattatgagtcaaaacagatgaaaatgtgtgttgccctttaattttacagttacccccgc

SEQ ID NO: 14182 - DNA, 904 bp, Brassica oleracea
ctaaattagtaatgggccttgatatgataatgggctagggtttcatccccacttatcttgctcatataaagttacgcaaacacttgtctggccgttctttctctgtctccgttctatccaaaaggagagaatagtagctgaggaagtgccaaaatgagtaagctccagagtgaagccgtgaaagaggcgatatcaaccattatcactcactgcaaggagacgaagcctcgcaagttcaccgagactatcgagctccagattggtctcaagaactatgaccctcaaaaggacaagaggtttagcggttccgttaagttgcctcacattcctaggcccaagatgaagatttgcatgctcggtgacgcccagcacgttgaagaggctgagaagattgggttagagtctatggatgtggaagctcttaagaagctgaacaagaacaagaagcttgtcaagaagctagctaagaagttccatgctttccttgcttctgaatccgtcatcaagcagattccacgtcttcttggtcctggtctcaacaaggcaggaaagttcccaactcttgttagtcaccaagagtctttggagtccaaagtgaatgagacaaaggcaacagtgaagttccagctcaagaaggttctttgcatgggtgtcgccgttgggaatctcggcatggaagagaagcagatcttccagaatgttcagatgagcgtcaacttccttgtttccctcttgaagaaaaactggcaaaacgttaggtgcttgtacttgaagagcacaatgagtccacccacccgtgttttctaagattattttatctcaaagtttctctcaaggtgtcatctggctgagaggagatttcattttcatttctgtcatgattaagattttgtttaaagacgga

SEQ ID NO: 14183 - DNA, 979 bp, Cichorium intybus
tattaaagatgttttcaatgtatcggccgctgttttccctcgaacttcatcggcagtgctgctagggttctcacagaagaagtgaagtttaaggcagcaaaacttaacaaccatgagtaagcttcaaagtgaagccctccgagaagccattactcaaatcaccactgacgccaaagaaaagaaacgtaacttcactgaaactatcgaactccaaattggtctcaagaactacgacccacaaaaggacaaacgtttcagtggtacagtgaagttgcctcacatccctcgccccaaattaaaagtttgcatgcttggagatgcccaacatgtagaagaggcccagaaaatcggccttgaatacatggatgttgaaggactcaagaagctcaacaagaacaagaagcttgtaaagaagcttgcaaaaaagcatcaagcttttttggcttctgaatctgtcatcaagcagattccccgtttgttgggccctggtttaaacaaagcaggaaaattcccaacactagtttctcaccaggaatcacttgaagctaaagtgaatgaaacaaaggcaactgtgaagtttcaattgaaaaaagtgttgtgtatgggagttgctgttggaaattgtagcatggaggaaaaacagattttccaaaatgttcaaatgagtgttaactttttggtttcgttgttgaagaagaattggcaaaacgtgaggtgtttgtatttgaagacgacaatgggaaagccggtgcgtattttttagatgtttactttgttttttatttttattttaaagagttgttatgtttgagggtgatacttggaagcatttggtgcttaatcgtttttggcttgttggatgtttaatttataatttgtattggattttctagaaattatgttttaatgggctcaaaacggttatatttatattcattgtgctcaattaattgattaggccagtcaatctgtcgggtag

SEQ ID NO: 14184 - DNA, 945 bp, Trifolium pratense
aaattagggtttcgcctctgctgtaagatctgattctaatccaaaatgagtaagcttcagagcgaagcagtcagagaagccatctcaggaatcatgaccgattcgaaggataagaatcgtaagtttgtggagactattgaacttcaaattggtctgaagaactatgacccacaaaaagacaagcgttttagtggctctgttaagttgccccatatccctcgtcctaagatgaagatttgtatgcttggagatgcccagcatgttgaggaggctgagaagattggattggaatccatggatgtagaagccttgaagaagctcaacaaaaacaagaagttggtgaagaaacttgccaaaaaatatcaggctttcttagcttctgaggctgtcattaagcagattcctcggcttttgggtcctggactcaataaggcaggaaagttcccaactcttgtttctcaccaggaatctcttgaaggaaaggttaatgagaccaaggctatggtcaagttccagcttaagaaggtgctctgcatgggagtagctgttggtaatgttagcatggacgaaaaacaaatctttcaaaatgttcaactcagtgttaatttccttgtctccctattgaaaaagaattggcagaatgttcggtgtttgtacctaaagagttccatggggaaatcataccgtgtcttttaggggatttactcttctatttctcgatattcattcagtggcttgtcatctacatcattacattaattgtgctaatagcgagctggatagaaaatttcgttttgttacagttttgctggattgtttatggttaatttttatttttatgttcgaatatttgataatagtcttttgttggtcccttttctgctggtgttcaaacttttaacttttttcagaaatccgataaattgaacaaatattttagcaaat

SEQ ID NO: 14185 - DNA, 972 bp, Brassica juncea
ggtctctgtttctgaggaagtgccaaaatgagtaagctccagagtgaagctgtgagagaggcgatatccgccatgatcactcactgcaaggagacaaagccacgcaagttcaccgagactatcgagctccagattggtctcaagaactatgaccctcaaaaggacaaacggttcagcggttccgtcaagttgccacacattcctaggcccaagatgaagatttgcatgctcggtgatgcccagcacgttgaagaggctgagaagattggattagagtctatggatgtggaagcacttaagaagttgaacaagaacaagaaacttgttaagaagctagcaaagaagttccatgctttccttgcttctgaatctgtcatcaagcagattccccgtcttcttggtcctggtctcaacaaggcaggaaagttcccaactcttgttagccaccaagagtctttggaatccaaagtgaatgagacaaaggcaacagtgaagttccagctcaagaaggttctttgcatgggtgtcgccgttgggaatctcggcatggaagagaagcagatctttcagaatgttcagatgagcgtcaacttccttgtttccctcttgaagaaaaactggcaaaacgtgaggtgcttgtacttgaagagcactatgagtccacctacccgtgttttctaagattattttatctctaaagtttctctcaaggtatcatcagggctgagaggagatttcattttcatttctgtcatgattaagattttgtttaaagacagttttatttatattattcctattactcttggtgaattttctctatttatgttagattaacccaatcttattacaaaataacggtataaaatcacaagaaaccaataaacagtgttttattatcattaatatgaacaaaacattagatttcacaaagcgaaacaaatttcgtaatttgctagtacagtataattt

SEQ ID NO: 14186 - DNA, 898 bp, Avena sativa
ggcccctccctcccttcgaccgccgccgcaccatcgacgaaatccgtcgtcgactgaccggcggcaaccatgagtaagctttcaagtgaggcggtcaaggatgccatcacccagattgttggggaggccagagaaaagaagcgaaagttcactgagactgttgagcttcagattggtctcaagaactatgacccgcaaaaggacaagcgtttcagcggctctgttaagctgccccatatcccccgcccgaagatgagggtgtgcatgcttggtgatgcccagcatgttgaccaggctgagaaattgggacttgactccatggatgtggagagtctcaaaaagatgaacaagaataagaagcttgttaagaagctagccaagaagtaccatgctttcttagcatctgaagccatcatcaagcagatcccccgtctccttggtcctggtctcaacaaggcaggcaagttccccacactggtgagtcactctgagtctcttgaagccaaggtcaatgagactaaagctacagtcaagttccagctgaagaaggttctgtgcatgggtgttgctgtgggtaacttgtcgatggatgagaagcagatccaacagaacctccaaatgagcgttaacttccttgtgtcccttctgaagaagaactggcagaatgtgaggtgcctgtacgtgaagagcaccatggggaagcgtgtccgggtgttctaagcggtcttgataggatactctgtactgtcgacccgagtttgtcttcgatttagatctgtttcactgatgccaattttgtgtttatctaagcgaatatcagcaaagtattctgtctctggtagtctttttgaacttgttgagaaatggaactgtatttctgttatgattttgattgtgc

SEQ ID NO: 14187 - DNA, 924 bp, Nicotiana benthamiana
attcgtcgttcgaacggcgctcacaaaccctaattggggttttctcctccagtgaatttagaaggcaaaagagaattgcttgagctatgagtaagcttcagagtgaagccctaagggaagacatatctgtaattaagaatgactgcaatgagaagaagaggaagttcacagagacaattgagctccagattgggcttaagaactatgatccccaaaaggacaagcgtttcagtggatctgtgaaactgcctcatattcctcgccctaagatgaagatttgtatgctcggagatgctcagcacgttgaggaggcagaaaagatcgggttggagtacatggatgtggaaagcctcataataagaacaagaagctagttaagaagcttgccaagaagtaccatgctttcttggcttctgaatctgtcatcaagcagattcctcgtctcttgggtcccggtctgaacaaagctggtaaatttcctagtcttgtttcccacaaggagtcactcgagtccaaggttaatgaaaccaaggctacaatcaagttccaattgaagaaggtgctttgcatgggtgttgccgttggaaatattgatatggaggagaaacaaatctttcagaatgtgcaaatgagtgtgaaattccttgtctcattgctaaagaagaattggcaaaatgtgaggtgcttgtacttgaagagcacaatggggaagacacaacgtgtcttttaagatgattgtctcgatgctgcaacttttttggtattctgcttgtgtaagagatgctgatgaaaattttgaatagtttatcatcctggataatgattttaatgtagtatcattataggggttgttttgccagacgttcattttaggagatattagtaaagactaaaatatatttttatcaacgagggttcctcttt

SEQ ID NO: 14188 - DNA, 908 bp, Avena sativa
gctgcctctccctcccttcgaccgccgccgcaccatcgacgaaatccttcgtcgactgatcggaggcaaccatgagtaagctttcaagtgatgcggtcaaggaggccatcacccagattgttggggaggccagagagaagaagcgcaagttcactgagactgttgagcttcagattggtctcaagaactatgacccgcaaaaggacaagcgtttcagcggctctgttaagctgccccatatcccccgcccgaagatgagggtgtgcatgcttggtgatgcccagcatgttgaccaggctgagaaattgggacttgactccatggatgtggagagtctcaaaaagatgaacaagaataagaagcttgtcaagaagctagccaagaagtaccatgctttcctagcatctgaagccatcatcaagcagatcccccgtctccttggtcctggtctcaacaaggcaggcaagttccccacactggtgagtcactccgagtctcttgaagccaaggtcaatgagactaaagctacagtcaagttccagctgaagaaggttctgtgcatgggggttgctgtgggtaacttgtcgatggatgagaagcagatccaacagaacctccaatgagcgttaacttccttgtgtccctctgaagaagaactggcagaatgtgaggtgcctgtacgtgaagagcaccatggggaagcgtgtccgggtgttctaagttgtcttgctccagtgaagttgataagatactctgtactgtcaacctgagttcgtctttgttttagaatctgtttcactgatgccaattttgtgtctatctaagcgaatatcagcaaagcattctgtctctggtagtccttttgaacttgttgagaaatggaactgtatttcttttatgattttgaa

SEQ ID NO: 14189 - DNA, 857 bp, Avena sativa
cgcaccatcgacgaaatccgtcgtcgactgaccggcggcaaccatgagtaagctttcaagtgaggcggtcaaggatgccatcacccagattgttggggaggccagagaaaagaagcgcaagttcactgagactgttgagcttcagattggtctcaagaactatgacccgcaaaaggacaagcgtttcagcggctctgttaagctgccccatatcccccgcccgaagatgagggtgtgcatgcttggtgatgctcagcatgttgaccaggctgagaaattgggacttgactccatggatgtggagagtctacaaaaagatgaacaagaataagaagcttgtcaagaagctagccaagaagtaccatgctttcttagcatctgaagccatcatcaagcagatcccccgtctccttggtcctggtctcaacaaggcaggcaagttccccacactggtgagtcactccgagtctcttgaagccaaggtcaatgagactaaagctacagtcaagttccagctgaagaaggttctgtgcatgggggttgctgtgggtaacttgtcgatggatgagaagcagatccaacagaacctccaaatgagcgttaacttccttgtgtcccttctgaagaagaactggcagaatgtgaggtgcctgtacgtgaagagcaccatggggaagcgtgtccgggtgttctaagttgtcttgctccagtgaagttgataagatactctgtactgtcaacctgagttcgtctttgttttagaatctgtttcactgatgccaattttgtgtctatctaagcgaatatcagcaaagcattctgtctctggtagtccttttgaacttgttgagaaatgg

SEQ ID NO: 14190 - DNA, 917 bp, Nicotiana benthamiana
aattaccttaacaattacagtaagcttcagagtgatgccctaagagaagccatcactgtgattaagagtgcgtcgaatgagaagaaaaggaagttcactgaaaccattgagctccagattggactgaaaaactatgatccccaaaaggacaagcgtttcagtggttcagtcaagttgcctcacattcctcgccctaagatgaagatttgcatgcttggagatgctcagcatgttgaagaggctgaaaagattgggttggagtacatggacgtggaaagcctgaagaagcttaacaaaaacaagaagttggttaagaagcttgcaaagaaatatcatgcttttttggcatcagaagctgttataaagcaaatcccccgtctcttggggcccggcttgaacaaagccggtaaatttcctagccttgttagccaccaagaatcgcttgagtctaaggttaatgagaccaaggccactataaaattccaattgaagaaggtgctttgcatgggagttgctgtcggtaatatggatatggaggagaaacaaatcttccagaatgtgcagatgagtgtcaactttctagtgtccttgcttaaaaagaactggcaaaatgtgagatgcctgtacttgaagagtaccatgggaaagactcaacgcatcttctaaaggaaaattgtattacaatcttggtggtttctgcgttttgctttgtatgctctatagatactattgaaatttttggttagttgtgatcctggattttgtcttgaacttgatatcagttttgtgatcattttattttctccttttaagatggtaccacaatcctttgtgttttatcatggtttagatttcttgaagattgtcaaattattatcctgaaggagaaaatatctgccagaacttttttgctctta

SEQ ID NO: 14191 - DNA, 911 bp, Arabidopsis thaliana
ctttctctgtttccgaccttcccacaggaagcaaatttgtttcagggagtaccaaaatgagtaagcttcagagtgaagccgtgagagaggcaataagctccattatcactcactgtaaggagacaaagccacgcaacttcactgagactattgaactccagattggtctcaagaactatgaccctcaaaaggacaagagatttagcggttctgtgaaattgcctcacgttcctaggccaaagatgaagatttgcatgcttggtgatgcccagcacgtcgaagaggctgagaagattggattggaatctatggatgttgaagctcttaagaagttgaacaagaacaagaaacttgttaagaagcttgctaagaaattccatgctttccttgcttctgaatctgtcattaagcagattcctcgtcttcttggtcctggtctcaacaaggcaggaaaattcccaactcttgttagccaccaagagtctttggaatccaaagtgaatgagacaaaggcaacagtgaagttccagctcaagaaggttctatgtatgggagttgctgtcggtaatctttccatggaggagaagcagatctttcaaaatgttcagatgagtgttaacttcctcgtttctctcttgaagaaaaactggcaaaatgtgaggtgcttgtacttgaagagcacaatgggtccaccaaaccgagttttctaaggttattattattacaaagtttctctaaggtatcatcactctttaggaaatttgattttcttttgctgtcatgagccttcttcttgttgggttaaacttcaaattccagtatcccgacttttgtaggatcaagattttttttaaagacaattttgtttcttttgttgctattattattagtggattttttctccatttaag

SEQ ID NO: 14192 - DNA, 990 bp, Brassica juncea
ccaaaatgagtaagctccagagtgaagccgtgagagaggcgatatcctccatgatcactcactgcaaggagacaaagccacgcaagttcactgagaccatcgaactccagattggtctcaagaactacgaccctcaaaaggacaagcggttcagcggttccgtcaagttgcctcacattccaaggcctaagatgaagatctgcatgctcggtgatgcccagcacgttgaagaggctgagaagattgggttggagtctatggatgtggaagcgcttaagaagctgaacaagaacaagaagcttgtgaagaagctagcaaagaagtttcacgctttccttgcttctgaatctgttattaaacagattcctcgtcttcttggtcctggtctcaacaaggcaggaaagttccctactcttgtgagccaccaagagtctttggaagccaaagtgaatgagactaaggcaacagtgaagttccagctcaagaaggttctttgcatgggagttgctgttgggaaccttgacatggaagagaagcagatctttcagaatgttcagatgagtgtcaacttccttgtttcgcttctgaagaaaaactggcaaaacgtgaggtgtttgtacttgaagagtacaatgggtccaccaaaccgtgtgttctaagaagattatctcgaagtttcgcttaagatatcatctttaaggctgagagagatttgattttcatttctgttgtgagccttctacttcttggattaatttcagaatcctttttttggtaggttcaagattttctttataaagacaattttatttctattttgctattatgattagtgttttttgccttaagtttttcaagatttgcgatttcgttatcattatcgttatatagtgcagtacgtcaaatgatcttatatcacaacaaaaataatgtataatttgattttgttggcgaccaaaccaaacttgggtttcactttcagttcatccc

SEQ ID NO: 14193 - DNA, 817 bp, Brassica oleracea
gtccttacagcatccgaggaagtttgccaaaatgagtaagctccagagtgaagccgtgagagaggcgatctcctccatgatcactcactgcaaggagacaaagccacgcaagttcaccgagaccatcgagctccagattggtctcaagaactacgaccctcaaaaggacaaacggttcagcggttccgtcaagttgcctcacatcccaaggcctaagatgaagatctgcatgctcggtgatgcccagcacgttgaagaggctgagaagattgggttggagtctatggatgtggaagcgcttaagaagctgaacaagaacaagaaacttgtgaagaagctagcgaagaagtttcacgctttccttgcttctgaatctgttattaagcagattcctcgtcttcttggtcctggtctcaacaaggcaggaaagttcccaactcttgtgagccaccaagagtctttggaagccaaagtgaatgagaccaaggcaacagtgaagttccagctcaagaaggttctttgcatgggtgtcgctgttggtaaccttgacatggaggagaagcagatctttcagaatgttcagatgagtgtcaacttccttgtttcgcttctgaagaaaaactggcaaaacgtgaggtgtttgtacttgaagagtacaatgggtccaccaaaccgtgtgttctaagaagattatctcggagtttcgcttaagatatcatctttaaggctgagagagatttgattttcatttctgttgtgagccttctacttcttggattaatttcagaatccttttttggtaggttcaagattttct

SEQ ID NO: 14194 - DNA, 929 bp, Arabidopsis lyrata
tataagttacagacgattgcaacactcgccgttctttctctgtttccgaccttccaacaggaagcaaatttgtctgagcaagtgccaaaatgagtaagcttcagagtgaagccgtaagagaggcaatatcctccattatcactcactgcaaggagactaagccacgcaacttcactgagactattgaactccagattggtcttaagaactatgaccctcaaaaggacaagagatttagcggttctgttaaattgcctcacgttcctaggccaaagatgaagatttgcatgcttggagatgcccaacacgtcgaagaggctgagaagattggattggaatctatggatgttgaagctcttaagaagttgaacaagaacaagaaacttgttaagaagcttgctaagaaattccatgctttccttgcttcggaatctgtcattaagcagattcctcgtcttcttggtcccggtctcaacaaggcaggaaagttcccaactcttgtcagccaccaagagtctttggaatccaaagtgaatgagacaaaggcaacagtgaagttccagctcaagaaggttctttgtatgggagtcgctgtcgggaatctttccatggaagagaagcagatctttcagaatgttcagatgagtgttaacttccttgtttcacttctgaagaaaaactggcaaaatgtgaggtgcttgtacttgaagagcacaatgggtccaccgaaccgagttttctaaggtttttattacaaagtttctctaaggtatcatcacactttgagagccttcttcttcttcatgggttaaacttgaaattccagtatcctgacttttgtaggatcgagattttgtttaaagacaattttgtttcttttgttgctattattatcattattagtggattctttctccatttaagcactc

SEQ ID NO: 14195 - DNA, 923 bp, Avena sativa
ctccctcccttcgaccgccgccgcaccatcgacgaaatccgtcgtcgactgaccggcggcaaccatgagtaagctttcaagtgaggcggtcaaggatgccatcacccagattgttggggaggccagagaaaagaagcgcaagttcactgagactgttgagcttcagattggtctcaagaactatgacccgcaaaaggacaagcgtttcagcggctctgttaagctgccccatatcccccgcccgaagatgagggtgtgcatgcttggtgatgctcagcatgttgaccaggctgagaaattgggacttgactccatggatgtggagagtctacaaaaagatagaacaagaataagaagcttgtcaagaagctagccaagaagtaccatgctttcttagcatctgaagccatcatcaagcagatcccccgtctccttggtcctggtctcaacaaggcaggcaagttccccacactggtgagtcactccgagtctcttgaagccaaggtcaatgagactaaagctacagtcaagttccagctgaagaaggttctgtgcatgggggttgctgtgggtaacttgtcgatggatgagaagcagatccaacagaacctccaaatgagcgttaacttccttgtgtcccttctgaagaagaactggcagaatgtgaggtgcctgtacgtgaagagcaccatggggaagcgtgtccgggtgttctaagtggtcttgctccagtgaagttgataagatactctgtactgtcaacctgagtttgtcttcgttttagatctgtttcactgatgccaattttgtgtctatctaagcgaatatcagcaaagcattctgtctctggtagtcattttgaacttgttgagaaatggaactgtatttctgttatgattttgaatgctcacgttgtgcctcta

SEQ ID NO: 14196 - DNA, 1083 bp, Rosmarinus officinalis
cggccgggggagggtttgcgcgtcaatatttatgcttctgaatctgcgccactctccctcacctacagtcattccagccaccgtctcacaacccctggtctagggtttttcttcagtgattcgggaagctaatcgaccgtgaacgatgagtaagcttcagagtgaggcgctgagggaggccatcactgttattgtttcagatgcgaaggagaagaagcgcaacttcacagagactgttgagctccagataggactcaagaactatgacccccaaaaggacaagcgtttcagcggctctgtgaggttgccacatattcccagacccaaaatgaaaatctgcatgcttggagatgcccagcatgttgaggaggcagagaagattggccttgagtccatggatgtggaagcactgaaaaagttgaataaaaacaagaaattggtaaagaagctagcgaagaggtaccatgctttcttggcctctgaagcagttattaagcagattccgcgtctcttgggtcctggtcttaacaaggcaggtaagttccctactcttgtgactcaccaggagtcgcttgaagccaaggtgaacgagacaaaggccaccattaagttccaattgaagaaggtcctctgcatgggtgttgctgtgggtaaccttgacatggaggagaagcagatcttccaaaatgtgcaaatgagtgtcaacttcctcgtttcccttttgaaaaagaattggcaaaatgtgaggtgcttgttcttgaagagcaccatgggaaagccacaacgcatcttctgaaaagtttataaacttattgaagtcgtagaatgacaaaagttgtgagggagcataaactattctaaatttcccagaaatgggaattttttggttctctttttcttgacgttgacctcggatttattatggatactcttttttatttcattatctccagattattgcccataatatgtacttttggtttattagtttcatcgtttgcataattagcagttacatctatctatttctgtacactattttgctacagatctttttcaacaagtattttaaattaaaaattg

SEQ ID NO: 14197 - DNA, 892 bp, Centaurea maculosa
gggtttctcttctaaagaagtgaagtttaaggaaggaaaatctatcaatcatgagtaagcttcagagtgaagccctccgtgaagccattacccagattactactgatgctaaggaaaagaagaggaattttaccgagaccattgagctccagattgggctcaagaactacgacccacaaaaggataagcgtttcagtggtaccgtgaagttgcctcacatccctcgtcccaaattgaaagtttgcatgcttggagatgcccagcatgtggaagaggctcaaaagatcggcctcgagtatatggatgttgaaggtctcaagaagctcaacaagaacaaaaagctggtgaagaagcttgctaagaagcaccaggcttttttggcttctgaatctgtcatcaagcagatccctcgtttgttgggacctggtctaaacaaggccggaaaattccctacccttgttacccaccaggaatccctcgaggctaaggtgaatgagaccaaggcaaccgttaagtttcagctgaagaaggttctctgcatgggagttgctgttggaaactgcagcatggaggagaagcagatcttccaaaacgtgcaaatgagcgtcaatttcctcgtttcgttactgaagaagaattggcaaaatgtgaggtgtctgtacttgaagacaacaatgggaaagccggttcgcatcttttaaccggttcgcatcttttaggagttatcgttgtttctcagatttgttctgtttgaggtctggtacttggaagcatatgcctatatcggggtgcttatcgtttttgacttgttggattgttgggtttttatttttgttttagtatactgctgttgctttgaacaattattacatctgaaatctacccatccata

SEQ ID NO: 14198 - DNA, 858 bp, Centaurea maculosa
gaagtttaaggaaggaaaatctatcaatcatgagtaagcttcagagtgaagccctccgtgaagccattacccagattactaccgatgctaaggaaaagaagaggaattttaccgagaccattgagctccagattggtctcaagaactacgacccacaaaaggataagcgtttcagtggtactgttaagttgcctcacatccctcgtcctaaattgaaagtttgcatgcttggagatgcccagcatgtggaagaggctcaaaagatcggccttgaatatatggatgtggaaggtctcaagaagcttaacaaaaacaagaagctggtgaagaagcttgcaaagaagcaccaggctttcttagcatctgaatctgtcatcaagcagatccctcgtttgttgggccctggtctaaacaaggctggaaaattccctacccttgttacccaccaggaatccctcgaggctaaggtgaatgagaccaaggcaaccgttaagtttcagctgaagaaggttctctgcatgggagttgctgttggaaactgcagcatggaggagaagcagatcttccaaaacgtgcaaatgagcgtcaatttcctcgtttcgttactgaagaagaattggcaaaatgtgaggtgtctgtacttgaagacaacaatgggaaagccggttcgcatcttttaggagttatcgttgtttctcagatttgttctgtttgaggtctagtacttggaagcatatgcctatatcggggtgcttattcgtttttgacttgttggatgttggtttttatttttgttttagatactgctgttgccttgaacaattattacatctgaaatctacccatccatatttctat

SEQ ID NO: 14199 - DNA, 1103 bp, Trifolium pratense
tcaattagtaatagatttctactttttaggatgattttaacttatttaatcacacaataattttattaacaaaaacaactgaagacaaaaaataaagtatagtgggcttggatcacaaagcagcccaaaacaaaactccaaaattcctagggtttttcacagcagatttcacaactacaccagatttcacagctcctcttctccatcgcaactcggagtatcgaagatgagtaagcttcagagtgatgctgttagagaagcaattacaggaatcatgggtgcttcaaaggataaagaacgtaaatttgtggagactattgagctccagattggtctaaaaaactatgatcctcagaaagataagcgttttagtgggtctgttaagttaccacatattcctcgacccaagatgaaaatttgcatgcttggtgatgcccaacatgttgaggaggcagagaaaataggattggaatcgatggatgttgaagctttgaagaagttaaacaaaaataagaaactggtgaagaaattggcaaagaggtaccaagcctttttagcttctgaagctgttatcaagcagattcctcgtctgttgggtcctggtctcaacaaggcaggaaagttccctacacttgtttcccaccaagaatctcttgaggctaaggtcaatgagactaaggctatggttaaattccagcttaagaaagtgttgtgcatgggagtagctgttggcaatgtcagtatggacgagaaacaaatattccaaaatgtacaactgagtgttaacttcctcgtgtccttgttaaaaaagaattggcagaatgtgaggtgcttgtatctgaagagttcaatgggcaaatcataccgcgtcttttaattttaaaggggtgttttcaatttcagtgaatttgggattgcatttaatgttttgttattgtaatagtctgaatataaattttcctatttctacaattttgttcgttgagattttgtcgttagtattttgtgttattgaatgctgtttaatacccgtcccgtggtttacttttacttttacatcttttttccctcttctcctttcaattctaagtatctttcccgca

SEQ ID NO: 14200 - DNA, 891 bp, Festuca arundinacea
ccgccgccgcaccctcgacagaatccggcgtcgactgatcggcggcagccatgagtaagctttcaagtggcgcggtcaaggaggccattgccctgattgtcggggaggccagggagaagaagcgcaagttcactgagactgttgagcttcagatcggtctcaagaactacgacccgcaaaaggacaagcgtttcagcggctctgttaagttgccccatattccccgccctaagatgagggtgtgcatgcttggtgatgcctcacatgtcgaccaggctgagaaattgggccttgactccatggatgttgaaagtctcaaaaagatgaacaagaacaagaagcttgttaagaagctagccaagaagtaccacgctttcttagcatctgaggccatcatcaagcagatccctcgtctcctcggacctggtctcaacaaggcaggcaagttccccacactggttagtcactctgagtctcttgaggccaaggtcaatgagacaaaagctacagtcaagttccagctgaagaaggttctttgcatgggtgttgctgtgggtaacttgtcgatggacgagaagcagatccaacagaacctccaaatgagcgtcaactttcttgtgtcccttctgaagaagaactggcagaatgtgaggtgcctgtacgtgaagagcaccatggggaagcgccagcgggtcttctaagtggtctccagtgaagttgataagatagtgggctgtactgtcgagcttgtctttgaagttagatctgtttcactgataccaattttgtgtttatcttaagcgaacatgaaccaactattttatctggtggtactcttttcgaacatatgggagaaatggaactgcctttctgttctaaaaaaaaaaaaaa

SEQ ID NO: 14201 - DNA, 1093 bp, Lolium multiflorum
gtccgccgccgccgccgcaccctcgacagaatccggcgtcgactgatcggcggcaaccatgagtaagctttcaagtgacgcggtcaaggaggccatcgccctgattgtcggggaggccagggagaagaagcgcaagttcactgagactgttgagcttcagatcggtctcaagaactacgacccgcaaaaggacaagcgtttcagcggctctgttaagctgccccatatcccccgcccgaagatgagggtgtgcatgcttggtgatgcctcacacgtcgaccaggctgagaaattgggcctcgactccatggatgttgaaagtctcaaaaagatgaacaagaacaagaagcttgtcaagaggctcgccaagaaataccatgctttcttggcctcagaggctattatcaagcagattccccgtctccttggtcctggtctcaacaaggcaggcaagttcccgaccctggtttctcactcagagtctctggaagccaaggtgaacgagacgaaggccaccatcaagttccagctgaagaaggtgctgtgcatgggtgtggcggtgggcaacctgtcgatggaggagaagcagatccagcagaacatccagatgagtgtcaacttcttggtgtccctgctcaagaagaactggcagaacgtgaggtgcctgtacatcaagagcaccatggggaagcctgcacgggtgttctaagcctgttcccttgccgtctatatcgataatatcttagcggacttccttgcttgtttatgcatgttgtggtttatcatcatcataattttgagtgtgtactggtcctgctgaatctagtagcctttttcattgtacaaggtgtcgtgaactttgtgctcgctaatgatagaaccggctatatatgtcgtgtatgcagttgtacccggagccatttgtgcacgatgctgctcgtttctctggttttgtgttaccctactatatttttggctgttgcatttaagaatgcagctgatatttacatggacagttctgacggattttttgcatagcgctgaggatgcaaccactacccttgcgtacagatcaactgtttttaaagtcggt

SEQ ID NO: 14202 - DNA, 790 bp, Lolium multiflorum
ccctcgacagaatccgtaaggtcgtcgactgatcggcggcaaccatgagtaagctttcaagtgatgcggtcaaggaggccatcgccctgattgtcggggaggccagggagaagaagcgcaagttcactgagactgttgagcttcagatcggtctcaagaactacgacccacaaaaggacaagcgtttcagcggctccgtcaagctgccccacgtcccgcgccccaagatgagggtctgcatgcttggtgatgcctcccatgttgaccaggctgagaaattgggccttgactccatggatgttgaaagtctcaaaaagatgaacaagaacaagaagcttgttaagaagctagccaagaagtaccacgctttcttagcatctgaggccatcatcaagcagatcccccgtctccttggtcctggtctcaacaaggcagggaagttcccaacactggttagtcactcagagtctcttgaagccaaggtcaacgagacaaaagccactgtcaagttccagctgaagaaggttctttgcatgggtgttgctgtgggtaacttgtcgatggacgagaagcagatccaacagaacctccaaatgagcgtcaacttccttgtgtcccttctgaagaagaactggcagaatgtgaggtgcctgtacgtgaagagcaccatggggaagcgccagcgggtgttctaagtggtctccagtgaagttgataagatagtgggctgtactgtcgagcttgtctttgaagttagatctgtttcactgatatcaattttgtgtttatc

SEQ ID NO: 14203 - DNA, 745 bp, Avena sativa
ggccgccctccattcctcctccccaaaaccctaagccaggtggatcgtcgttcatcgatcggaagcagccatgagtaagctgtcgaccgaggccctcaaggaggccatcacccaggtcgtgaccgaggccaaggagaagaacaggaagttcaccgagaccatcgagctccagatcggcctcaagaactacgacccgcaaaaggacaagcgtttcagcggctccgtcaagctgccccatgtcccgcgccccaagatgagggtctgcatgctcggtgacgcccagcatgttggggaggctgagaagattggtcttgattccatggacgttgaagctcttaagaagatgaacaagaacaagaagcttgtcaagaggcttgccaagaagtatcatgctttcttggcctcagaggctattatcaagcagattccccgtctccttggtcctggtctcaacaaggcaggcaagttcccgaccctggtttctcactcagagtctctggaagccaaggtgaacgagacgaaggccaccatcaagttccagctgaagaaggtgctgtgcatgggtgtggcggtgggcaacctgtcgatggaggagaagcagatccagcagaacatccagatgagcgtcaacttcctggtttccctgctcaagaagaactggcagaacgtgaggtgcctatacatcaagagcaccatggggaagccggcgcgggtgttctaagcttgtgctgctgccatctatcta

SEQ ID NO: 14204 - DNA, 905 bp, Avena sativa
caggtggatcgtcgttcatcgatcggaatcaaccatgagtaagctgtcgaccgaggccctcaaggaggccatcacccaggtcgtgaccgaagccaaggagaagaacaggaagttcaccgagaccattgagctccagattgggctcaagaactacgacccgcaaaaggacaagcgtttcagcggctctgtcaagctgccccatgtcccgcgccccaagatgagggtctgcatgctcggtgacgcccagcatgttggggaggctgagaagattggtcttgattccatggatgttgaagctcttaagaagatgaacaagaacaagaagcttgtcaagaggcttgccaagaagtatcatgctttcttggcctcagaggctattatcaagcagattccccgtctccttggccctggtctcaacaaggcaggcaagtttccgactctggtttctcactcagagtctctggaagccaaggtgaacgagacgaaggccaccatcaagttccagctgaagaaggtgctgtgcatgggtgtggcggtgggcaacctgtcgatggaggagaagcagatccagcagaacatccagatgagcgtcaacttcctggtctccctgctcaagaagaactggcagaacgtgaggtgcctatacatcaagagcaccatggggaagccggcccgggtgttctaagcccgtgctgctgccgtctatctatcatcagcagtagcttaccatagtttccttccttgctgtgttgacgcttaaatatgccgtggtttttgtcagctttgtctttgtgtgtcctggtcctggtgatggagatgaaagaatctggcagtagtgtttttgcttggacaagaacctgttacaaatatatttatgtattctatgtaccctaagctgtttgtcc

SEQ ID NO: 14205 - DNA, 925 bp, Avena sativa
caaaccctaaaccaggtggatcgtcgttcatcgatcggaagcagccatgagtaagctgtcgaccgaggccctcaaggaggccatcacccaggtcgtgtccgaagccaaggagaagaacaggaagtttaccgagaccatcgagctccagatcggcctcaagaactacgacccgcaaaaggacaagcgtttcagcggctccgtcaagctaccccatgtcccgcgccccaagatgagggtctgcatgctcggtgatgcccagcatgtgggggaggctgagaagattggacttgactccatggatgttgaagctcttaagaagatgaataagaataagaagcttgtcaagaggcttgccaagaagtatcatgctttcttggcctcagaggctattatcaagcagattccccgtcttcttggccctggtctcaacaaggcaggcaagttcccgactcttgtttctcactcggagtctctggaagccaaggtgaacgagacgaaggccaccatcaagttccagctgaagaaggtgctgtgcatgggtgtggcggtgggcaacctgtcgatggaggagaagcagatccagcagaacatccagatgagcgtcaacttcctggtttccctgctcaagaagaactggcagaacgtgaggtgcctatacatcaagagcaccatggggaagccggcccgggtgttctaagcccgtgctgctgccatctatctatcatcagctgtagcttaccatagttccttccttccttgccgtgtttacgcttaaatatgccgtggtttttgtcagctttgtctttgtgtgtcctggtcctagtgatggagatgaaagaatctggcagtagtgtttttgtttggacaagatccgatggctctgctcctcaagatatcgtgttagaacctgttacaaatatattta

SEQ ID NO: 14206 - DNA, 988 bp, Avena sativa
ctccctcctcgcgccgccgccctcctccattcctcctcccccaaaccctaaaccaggtggatcggtgatcgtccgtcgtcggcaaccatgagtaagctgtcgaccgaggccctcaaggaggccatcacccaggtcgtgtccgaagccaaggagaagaacaggaagtttaccgagaccatcgagctccagatcggcctcaagaactacgacccgcaaaaggacaagcgtttcagcggctccgtcaagctgccccatgtcccgcgccccaagatgagggtctgcatgcttggtgacgcccagcatgtgggggaggctgagaagattggtcttgattccatggatgttgaagctcttaagaagatgaacaagaacaagaaacttgtcaagaggcttgccaagaagtatcatgctttcttggcctcagaggctattatcaagcagattccccgtctccttggtcctggtctcaacaaggcaggcaagttcccgactctggtttctcactcagagtctctggaagccaaggttaacgagacaaaggccactatcaagttccagctgaagaaggtgctgtgcatgggtgtggcggtgggcaacctgtcgatggaggagaagcagatccagcagaacatccagatgagcgtcaacttcctggtttccctgctcaagaagaactggcagaacgtgaggtgcctatacatcaagagcaccatggggaagccggcgcgggtgttctaagcttgtgctgctgccatctatctatcatcagcagtagcttaccatagtttctttccgtgccgtgtttacgcttaaatatgtcgtggtttttgtcagctttgtgcgtgtgtgtcctggtccttgtcctggtgaaggagatgaaagaatctggcagtagtgtttttgcttggacaagatccgttggctctgcttctcaagatatcgtgttagaacctgttacaaatatatttatgtatgctatgtaccctat

SEQ ID NO: 14207 - DNA, 756 bp, Allium cepa
cttctcgccgagcactctgtaggttgcagaaaggaagtctcaaggaaaatgagcaagttgcagagtgatgttctgagagaagcaatcacacagattaaaactggtgcaactgagaaaaaacgaaatttcactgaaacaatagagttgcagattgggcttaagaactatgaccctcaaaaggacaagcgtttcagtggttctgtgaagttgccccacattcctcgacccaaaatgaaggtttgcatgcttggtgatgctcaacattgtgaggaggcagagaagatgaaccttccgttcatggatgttgagagtttgaagaaattcaataagaacaaaaagttggtaaagaagatggcaaagaaataccatgttttccttgcttccgaagcagtcattaaacagattccacgtcttcttgggcctggtctcaacaaggcaggtaaatttcctactctagtcagtcaccaagaatccttggaagctaaagtgaacgagactaaggcaatggttaagtttcagttgaagaaggtactctgcatgggtgttgctgtcggtaactgcggtatggatgaaaagcagatcttccaaaacgtgcaacttagtgttaactttcttgtttctctgctgaagaagaattggcagaatgtaaggtgcttgtatctgaagagcaccatgggaaggccagtcaggattttttaagctttgcaattcaacattggaatttacaagagatgttcattttggccttgttgctta

SEQ ID NO: 14208 - DNA, 1033 bp, Allium cepa
tagttacggggggtaaattcacaactataaaagcccttcactcgaaactagggtttcagttcctctagcagccgtcatcgtactctcgccgagcgttctgtaggttgcaggaaggaagacttaaaagaaaatgagtaagttgcagagtgatgttctgagagaagcaatcacacagattaaaactggagcagctgagaaaaagcgaaattttaccgagacaatagagttgcagattgggcttaagaactatgaccctcaaaaggacaagcgtttcagtggttcagtgaagttgccacacattcctcgacccaaaatgaaggtttgcatgcttggtgatgctcaacattgtgaggaggcggagaaaatggaccttccattcatggatgttgagagtttgaagaagttcaataagaacaaaaagttagtgaagaagatggcaaagaaataccatgttttccttgcatccgaagccgtcattaagcagattccacgtcttcttggaccaggtctcaacaaggcaggcaagtttcccactctagtcagtcaccaggaatccttggaagccaaagtgaacgagaccaaagcaatggttaagtttcagttgaagaaggtactttgcatgggtgttgctgttggtaactgtggtatggacgaaaaacagatctttcaaaatgtgcaactcagcgtcaactttcttgtttctctgctgaagaagaattggcagaatgttaggtgcttgtatctgaagagcaccatgggaaggccagttagaattttttaagctttgcaatgcaacattggatttacaagatctttatttggccttattgcttattttttgaactttgttgcgtccttttgcaaatggtattatgaatgcgagttggttttgaagaagaattgatgttagaactatttttgtttctggttttgatgtaaaaataccatccgtatgctgttattttatgttgaatttactgttgcttgttttgcatgtaatggatctttgattttcgggggcctattcgtttta

SEQ ID NO: 14209 - DNA, 876 bp, Allium cepa
tcagcttgcaggattagggtttcagctcaactcgggtttcagctcaactcgtagccgtcatctcctggctaagttcctactgggagaagagatttagcaaaaaatgagtaagttgcagagtgacgttttgagggaagcaattacacagattaaaattaatgcagaggagaaaaagcgtaattttacggaaacaattgaattgcaaattggattgaagaattatgatcctcagaaggacaagcgtttcagtggttcagtcaagctgccgcacattcctcgaccaaaaatgaaggtctgcatgcttggtgatgctcaacattgtgaggaggcagaaaaaatggacctcccattcatggatgttgagagtctgaagaagtttaacaagaacaaaaagttagttaaaaagatggccaagaaataccatgtctttcttgcgtcagaagcagttattaaacagattcctcgccttttgggccctggtcttaacaaagcaggtaaatttccaactctggttagtcaccaggagtcgttagaggccaaagtgaacgagactaaagccatggttaagttccagctcaagaaagttctttgtatgggtgttgctgtaggcaattgtggcatggatgaaaagcagattttccaaaatgtgcaactcagtgtcaatttccttgtttctctcttgaagaagaattggcaaaatgttaggtgcttatatctaaagagcactatgggaaggccagtcagagtattttgagtgctgcctgcactatttttcatcatgttttatatgaaattttcttgtggcttcttttacttgttttgtttgtgttatcatactttatcatgtatccaattttttaatgagtagattttgaa

SEQ ID NO: 14210 - DNA, 901 bp, Allium cepa
tagttacgggggccattacggcctagatacgggggagttcctctagcagccgtcatcgtcctctcgccgagcgttctgtaggttgcaggaaggaagacttaaaagaaaatgagtaagttgcagagtgatgttctgagagaagcaatcacacagattaaaactggagcagctgagaaaaagcgaaattttaccgagacaatagagttgcagattgggcttaagaactatgaccctcaaaaggacaagcgtttcagtggttcagtgaagttgccacacattcctcgacccaaaatgaaggtttgcatgcttggtgatgctcaacattgtgaggaggcagagaaaatggaccttccgttcatggatgttgagagtttgaagaagttcaataagaacaaaaagttagtgaagaagatggcaaagaaataccatgttttccttgcatccgaagccgtcattaagcagattccacgtcttcttggaccaggtctcaacaaggcaggcaagtttcccactctagtcagtcaccaggaatccttggaagccaaagtgaatgagaccaaggcaatggttaagtttcagttgaagaaggtactttgcatgggtgttgctgttggtaactgtggtatggacgaaaaacagatctttcaaaatgtgcaactcagcgtcaactttcttgtttctctgctgaagaagaattggcagaatgttaggtgcttgtatctgaagagcaccatgggaaggccagttagaattttttaagctttgcaatgcaacattggatttacaagatctttatttggccttattgcttattttttgaactttgttgcgtccttttgcaaatggtattatgaatgcgagttggttttgaagcagaattgatgttagaactatttttgtt

SEQ ID NO: 14211 - DNA, 839 bp, Allium cepa
gcaggattagggtttcagctcaactcgggtttcagctcaactcgtagccgtcatctcctggctaagttcctactgggagaagagatttagcaaaaaatgagtaagttgcagagcgacgttttgagggaagcaataacacagattaaaactaacgcagaggagaaaaagcgtaattttactgaaacaattgaattgcaaattggactgaagaattatgatcctcaaaaggacaagcgtttcagtggttcagtcaagctgccgcacattcctcgaccaaaaatgaaggtctgcatgcttggtgatgctcaacactgtgaggaggcagaaaaaatggatctcccattcatggatgttgagagtttgaagaagttcaacaagaacaaaaagttggttaaaaagatggctaagaagtaccatgtctttcttgcatcagaagcagttattaaacagattcctcgtcttttgggacctggtctgaacaaagcaggtaaatttccaactctggttagccaccaggagtcgttagaggccaaagttaacgaggtcaaagctatggttaagttccagctcaaaaaagttctttgcatgggcgttgctgtcggtaattgtggcatggatgaaaagcaaattttccaaaatgtgcaacttagtgtcaatttccttgtttctctcttgaagaagaattggcaaaatgttaggtgcttatatctaaagagcactatgggaaagccggtcagggtattttgagtgctgcctgcgctgtttgatatgatattttgtatgaaattttcttgttgcttctgttacttgttttgtttgtgttaatcatactgtttttt

SEQ ID NO: 14212 - DNA, 1187 bp, Prunus mume
tcttgccctggcaaatgggcctgcgctggacatgctctaactaaacgtagcagctagggtttttataaagcgccaaagttcccttccgcctttgcctcactcagcagcagcagccctgcaaatcctgttctagggtttcgctctctttcttaaggaagtatttgcacaggaattgcagcgaggacaaggctgtaaccatgagtaagctctcaagtgacgggctgagagaggccatcgctcagattaagacaaactcagaaacgaaaaagagaaatttcaccgagacagttgagcttcaaattgggttgaagaactatgacccacaaaaggataagcgtttcagtggctctgtcaggcttccacatattcctcgtcctaagatgagggtttgcatgcttggggatgctcagcatgttgaagaggcagagaagatgggtttggactacatggatgtggaaagcttgaaaaagcttaacaaaaacaagaaactggtcaagaagcttgccaagaaataccatgcatttttagcttctgaagctgtcattaagcaaattcctcgtcttctaggccctggtcttaataaggcaggtaagtttccaacattggtgagtcaccaggaatctttggaggcaaaagtgaatgaaaccaaagcaatggtgaagttccaacttaagaaggttctttgcatgggtgttgctgtgggaaatttggctatggaggagaaacagatttttcagaatgtacaactcagtgtcaatttcttagtttcattattgaagaagaattggcagaatgtgaggtccttgaacctgaaaagtaccatggggaaagcaatccgtatctactaagttcttaagctctatcagagacttttttagcggaggaagcattagcagaactttaattaagacattttttgcagatgattttatgttcccttttgtttttgttgactttgatttctttgtttaaattataatgagtactgtatttttggtttgaacgaatgttggaagattttgaaagaaattttcttcacccccgatgcctgtttatgatttggttctttcagtttgggatgctgtggtagaattgtgataaaaggattagtaggttttgaagcgaaattcgaaagtcgcaattgcaggatttttacttttgttaaataatctgctcttgggttggag

SEQ ID NO: 14213 - DNA, 1042 bp, Leymus cinereus x Leymus triticoides
ctccactcctccccaaaccctagaccaggcaggtcctcgctccccgccctctagcctcgtcgccccggcgagacccctctcgagttcccgctccccgccgccggtcatctcaccgtgtttctccctttctccgcaggtgaatcggcgaccggcgatccatctccgcggcgagccatgagtaagctgcagaccgaggccctcaaggaggccatcacccaggtggtggcagaggccaaggagaagaacaggaagttcaccgagaccgtcgagctccagatcggcctcaagaactatgacccgcaaaaggacaaccgtttcagcggctccgtcaagctgccccacgtccctcgccccaagatgagggtctgcatgctcggtgatgcccagcatgtgggagaggctgataagattggtcttgattccatggatgttgaagctcttaagaagatgaacaagaacaagaagcttgtcaagaggcttgccaagaagtaccatgctttcttggcctcagaggctatcatcaagcagattccacgtctccttggtcctggtctcaacaaggcaggcaagttcccgactctggtttctcaccaggagtctctggaagccaaggtgaacgagacgaaagcgacaatcaagttccagctcaagaaggtgctgtgcatgggcgtcgcggtgggcaacctgtcgatggaggagaagcagatccagcagaacatccagatgagcgtcaacttcctggtttccctgctcaagaagaactggcagaacgtgaggtgtctgtacatcaagagcaccatggggaagccggtccgggtgttctaagcccgtgctcctgccgtcgtctatatcaatgctacctacaatactggacttcattactatgtttaagcttaaatatgtcggtgtcgtgtcggtagtttttcttgaattttgcgtgtttcctggtgaagatgacgaaagaccactactgtttctcctgagttgtgattgtgatgcaacaaatatgctcatcaagatcatgccagaccccggttatata

SEQ ID NO: 14214 - DNA, 916 bp, Avena sativa
cctccattcctcctccccaaaaccctaagccaggtggatcggcgttcatcgatcggaagcagccatgagtaagctgtcgaccgaggccctcaaggaggccatcacccaggtcgtgaccgaggccaaggagaagaacaggaagttcaccgagaccatcgagctccagatcggcctcaagaactacgacccgcaaaaggacaagcgtttcagcggatccgtcaagctgccccatgtcccgcgccccaagatgagggtctgcatgctcggtgacgcccagcatgttggggaggctgagaagattggtcttgattccatggacgttgaagctcttaagaagatgaacaagaacaagaagcttgtcaagaggcttgccaagaagtatcatgctttcttggcctcagaggctattatcaagcagattccccgtctccttggtcctggtctcaacaaggcaggcaagttcccgaccctggtttctcactcagagtctctggaagccaaggtgaacgagacgaaggccaccatcaagttccagctgaagaaggtgctgtgcatgggtgtggcggtgggcaacctgtcgatggaggagaagcagatccagcagaacatccagatgagcgtcaacttcctggtttccctgctcaagaagaactggcagaacgtgaggtgcctatacatcaagagcaccatggggaagccggcccgggtgttctaagcccgtgctgctgccgtccatctatcatcagcagtagcttaccatagtttccttccttgctgtgtttacgcttaaatatgccgtggtttttgtcagctttgtctttgtgtgtcctggtcctggtgatggagatgaaagaatctggcagtagtgtttttgcttggacaagaacctgttacaaatatatttatgtattctatg

SEQ ID NO: 14215 - DNA, 927 bp, Festuca arundinacea
cgcaccctcgacaaaatccggcgtcgactgatcggcggcaaccatgagtaagctttcaagtgatgcggtcaaggaggccatcgccctgattgttggggaggccagagaaaagaagcgcaagttcactgagactgttgagcttcagattggtcttaagaactacgacccgcaaaaggacaagcgtttcagcggctctgttaagctgccccatataccccgcccgaagatgagggtgtgcatgcttggtgatgcccagcatgtcgaccaggctgagaaattggggcttgactccatggatgttgaaagtctcaaaaagatgaacaagaacaagaagcttgttaagaagctagccaagaagtaccatgctttcttagcatcagaggccatcatcaagcagatcccccgtctccttggtcctggtctcaacaaggcaggcaagttccccacactggttagtcactccgagtctcttgaagccaaggtgaacgagacaaaagcaacagtcaagttccagctgaagaaggttctttgcatgggtgttgctgtgggtaacttgtccatggatgagaagcagatccaacagaacctccaaatgagcgtcaacttccttgtgtcccttttgaagaagaactggcagaatgtgaggtgcctgtacgtgaagagccccctggggaagcgacaaagggtgttttaagtggtctttctccagtgaagttgttactgggctgtattgtcgagctagtctttgaagttagatctgataccaattttgtgtttatttaagcgaatatgaaccaagtattttatctggtggtactccttttcaacttatggtagaaatggaactgcgtttctgttttgaaaaaaaaaaaaaaaaaaaaaaaaaaaaaaaaaaaaaaactcgagactagttcttcccctcgtgcc

SEQ ID NO: 14216 - DNA, 874 bp, Theobroma cacao
aattccttgccaaggagccaaacaaggaacaagtaaccatgagtaagcttcagagtgatgcagttagggaagccatttccactatcgttggtgactcgaaggagaagcagcgtaagtttgtcgagacaattgagttgcagattgggttgaagaactatgatccccaaaaggataagcgtttcagtggtgccgttaagcttcctcacattcctcgtcctaagatgaaaatttgtatgcttggtgatgctctccacgtcgaagaggcagagaaaatagggttggactggatggatgtggaagcattgaagaagcttaacaagaacaagaaacttgttaagaagctagccaagaaataccatgcctttttggcttctgaagctgtcatcaaacagattcctcgtcttttaggacctggtctcaacaaggcagggaagttcccaacacttgtcacacatcaggaatctctggagtcaaaagttaatgagacaaaagctatggttaaattccagcttaagaaggttctctgtatgggtgttgctgtggggaattgcagtatggaggagaagcagatcttccagaatgtgcaactcagtgtcaatttccttgtttcattgttgaagaagaattggcaaaatgtgaggtgcttgcatctgaagagcacaatggggaggccacaacgtatctattaggaaagttcatttactttctggggatcgttttttgagcaagcatgagcaagaaacttttgtactccagacagagacattctctggaatggtgctggattttgtggttctgttttattggattcttttgtttccaacttgatcaattacagacttcttgattaatttggtagattatttggtatcaa

SEQ ID NO: 14217 - DNA, 913 bp, Mesembryanthemum crystallinum
cctacatagtgctagatgcatcggcacgaggccaaaccctagcgtcctctctctctcctctccggttttttcgagtttcctccatttaactattactcatgagtaagcttcagagtgacgcagtgagggaagccatctctggtattcaaaatgatgcccgagagaaaaatcgcaagtttacagagacaattgagctccagattgggctgaaaaactatgatcctcaaaaggacaagcgtttcagtggtactgttaagttgcctaacattccccgcccaaagatgaaggtttgcatgctgggtgatgcacaacacgtcgaagaggctgagaggattggtttggagtggatggatgtggaagcattgaagaaacttaacaagaacaagaaactggttaagaagcttgctaagaagtaccatgctttccttgcatctgaatcagttatcaagcagatccctcgtttgctgggtcctggtcttaacaaggcaggtaagttccctgctcttgtcactcaccaggaaccccttgagaacaaggtaaacgaggccaaggcaactgttaagttccagcttaagaaggttctttgcatgggagtcgctgttgggaattgcggcatggacgacaagcagattttccagaatgtgcaaatgagtgtcaactttctagtttcactattgaagaagaattggcagaatgttcgatgcttgtacctgaagagtaccatggggcagccataccgcattttctaagaatgtgttaatccttcttttttatttgggtggaaactttgtaggagctcttggaatttggttaacttggtggggaagtaaacccaggggttaaacattgggaagctaagataactggaaagaaggccctggatgacaagaccccttaggtttttctttaactc

SEQ ID NO: 14218 - DNA, 879 bp, Triphysaria pusilla
gttcgtggttttctcagttgctgcctctcgcaacctatcatcctcctctgaacaagtgagctgggaagatacgaacatattgaaccatgagtaaggtttcgcctgatgctatcagagaggcaattgctactattgctacagagtctaaagagaaaaaccggaagttcactgagacaatagagcttcagattgggctgaaaaactatgacccacaaaaggataaacgtttcagtggttctgttaagctgccccacattccccgtcccaaaatgcagatttgcatgctcggtgacgcccagcacgctgatgaggctgaaaagattgggttggcttccatggatgtggaggctctgaagaaactgaataagaacaagaagttggtcaagaagctggccaagaagtaccatgctttcttagcttctgaagctgttattaagcagattcctcgtcttctcggacctggtctaaacaaagcaggtaagtttccaacacttgtgagtcaccaggaatctctggagggaaaggtgaatgagaccaaggctactattaagttccagctgaagaaggtgctttgcatgggagtagctgttggtaacttgggtatggaagagaagcagatattccagaatgtgcaaatgagcattaatttccttgtttctcttcttaagaagaattggcaaaatgtgaggtgcttgtacttgaagagtaccatggggaagccacaacgcatcttttaaaagacttgttttcgctctttggaattttaggaaattgaagttttattatgctttttgtatccgttaaatttcttgttgacattggaatcttttggttttctatctttttgatactatatgctgagatgaattttgcttagtg

SEQ ID NO: 14219 - DNA, 984 bp, Arabidopsis lyrata
atttttcctcttccttgatataaaatcttcagccgcctctgtaacacaattagggcttccgctttcttcacctttcaggatcagagattcgtgacctgagaagaaactcaatatgagtaagcttcaaagtgaggctcttagagaagccattacgacaatcaagggcaaatccgaggagaaaaaacgtaactttgttgagacagtggaacttcagattggtctgaagaactatgacccacaaaaggataagcgtttcagtggatctgtgaagctaccgcatattcctcgcccgaaaatgaagatctgtatgcttggagatgctcagcatgttgaggaggcagagaaaatgggacttagtaacatggatgttgaggctttgaaaaagcttaacaagaacaagaagcttgttaagaagcttgctaagtcttaccatgctttcttggcttctgaatctgtcattaagcagattcctcgtcttcttggtcctggtcttaacaaggcaggaaagttcccaactcttgtgagtcaccaagagtctttggaagcaaaggtgaatgagaccaaagcgacagtgaagttccagttgaagaaagttctgtgtatgggtgttgctgttggttctgtgtatgaacctttcaatggaagagaagcagcttttccagaatgtgcagatgagcgttaacttcctcgtctcgctcttgaagaagaattggcaaaacgtaaggtgtttgtacttgaagagcaccatgggaccaccacaaagaatcttttgagctctctcttcttctccttcttccatctcagaattttgcattctgtttttgtttcagagatctgtgcttgttgggatatggtttggatttatattagcagttgtttttggttgacaatatatgatgcactatctattcagttcaattatcgtttacctatattatctcctaaaacatgcatttgattaatttgaagcttttttcttacaaa

SEQ ID NO: 14220 - DNA, 682 bp, Brassica juncea
gtttccgatcttccacaggtggaaaagtatctgagaaactgccaaaatgagtaagctccagagtgaagccgtgagagaggcgatctcctcaatgatcactcactgcaaggacacaaagccacgcaagttcactgagaccatcgaactccagattggtctcaagaactatgacccacaaaaggacaaacggtttagcggatcggttaagttgcctcacattccaaggcccaagatgaagatctgcatgcccggtgacgcccagcacgttgaagaggctgagaagattgggttagactctatggatgttgaagcgctgaagaagttgaacaagaacaagaaacttgttaagaagctagccaagaagtttcatgctttccttgcttctgagtctgtcattaagcagattcctcgtcttcttggtcctggtctcaacaaggcaggaaagttcccaactcttgttagccaccaagagtctttggaatccaaggtgaatgagacaaaggcaacagtgaagttccagctcaagaaggttctctgcatgggtgtcgctgttgggaatctcggcatggaagagaagcagatctttcagaatgttcagatgagcgttaacttccttgtttcactcttgaagaaaaactggcaaaatgtgcggtgcttgtacttgaagagcacaatgggtcca

SEQ ID NO: 14221 - DNA, 901 bp, Chrysanthemum coronarium
aacactttgctctttaggcattcatcaaagtagtgaagtctaaagaaggaaaactttacaatcatgagtaagctttcaagtgaagccctcagagaggcgattacaagcatcactaccgatgccaaggaaaagaaagtccgcaacttcactgagaccattgaacttcagattggtctcaagaactacgacccacaaaaggacaagcgtttcagtggtaccgtcagattgccccacattcctcgtcctaagttgaaggtttgcatgcttggagatgcccaacatgttgaagaggctcagaaaattggtcttgagtatatggatgttgagagcttgaagaagctgaacaagaacaagaagttggtgaagaagcttgctaagaaacaccaagcttttttggcttctgagtctgtcatcaagcagattccccgtttgttgggtcctggtcttaacaaggctggtaagtttcctacccttgtttcccaccaggaatctcttgaggcaaaggttaacgagaccaaagccaccgtcaagtttcaacttaagaaggttctttgcatgggagtcgctgttggaaactgcagcatggaggagaaacagatcttccagaatgtgcaaatgagtgtcaacttcttggtttctttgttgaagaagaactggcaaaatgtgagatgcttgtacttgaagacaaccatgggaaagccagttcgcatcttttaagaagtttatgggttgctatgttttcattttggttaatgttgaggatggtactggaaagttttccaatgaacaggaaatagtcctttttggcttgttacatgtttgtttggtactatattttggaacaccttactttagatgttatattattaagttacttttgcttaatggtatcagtatttag

SEQ ID NO: 14222 - DNA, 885 bp, Chrysanthemum coronarium
actctacaatcatgagtaagctttcaagtgaagccctcagagaggcgattactagcatcacgactgatgctaaggaaaagaaagtccgtaacttcactgagaccattgaacttcagattggtctcaagaactacgacccacaaaaggacaagcgtttttctggtaccgtgaggttgcctcacattccacgtcctaagttgaaggtttgcatgcttggagatgctcagcatgttgaagaggctcaaaagattggtcttgagtacatggatgtggaatcactcaagaagcttaacaagaacaagaagcttgtgaagaagcttgccaagaagcaccaggcttttttggcttctgagtctgttatcaagcagattcctcgtttgttgggacccggtctaaacaaggctggtaagtttcctactcttgtcagtcaccaggaatctcttgaggctaaggtgaatgaaaccaaggcaactgtcaagtttcagttgaagaaggtgttgtgtatgggagttgctgttggtaactgcagcatggaggagaagcagatcttccagaacgttcaaatgagtgtcaactttcttgtttcgttgttgaaaaagaattggcaaaacgtaaggtgtttgtacttgaagacaacaatgggaaagccagttcgtatcttttaggtgctttctttggtttttgattttgttgttgggagattagtacttgaaagcttttgccgataatgggggctgtcgtttttgaatttttggatgtttgtttttctattgtattagatgatgccatagacaatatgtttaatggttgccaagctattatctttactatctgtcttcttatcataacgtttggcttagcgacccatgatcatatatatgcctg

SEQ ID NO: 14223 - DNA, 887 bp, Chrysanthemum coronarium
tcttcaacactttgctctttaggcattcatcaaagtagtgaagtctaaagaaggaaaactttacaatcatgagtaagctttcaagtgaagccctcagagaggcaattactagcatcactactgatgccaaggaaaagaaagtccgtaacttcactgagaccattgaacttcagattggtctcaagaactacgacccacaaaaggacaagcgtttttctggtaccgtgaggttgcctcacattccacgccctaagttgaaggtttgcatgcttggagatgctcagcatgttgaagaggcccagaagattggtcttgagtatatggatgttgagagcttgaagaagctgaacaagaacaagaagttggtgaagaagcttgctaagaaacaccaagcttttttggcttctgagtctgtcatcaagcagattccccgtttgttgggtcctggtcttaacaaggctggtaagttccctacccttgtttcccaccaggaatctcttgaggcaaaggttaacgagaccaaagccaccgtcaagtttcaacttaagaaggttctttgcatgggagtcgctgttggaaactgcagcatggaggagaaacagatcttccagaatgtgcaaatgagtgtcaacttcttggtttctttgttgaagaagaattggcaaaatgtgagatgcttgtacttgaagactaccatgggaaagccagttcgcatcttttaagaagtttatgggttgctatgttttcattttggttaatgttgaggatggtactggaaagttttccaatgaacaggaaatagtcctttttggcttgttacatgtttgtttggtactatattttggaacaccttactttagatgttatattcttaagttacttttgct

SEQ ID NO: 14224 - DNA, 769 bp, Nicotiana benthamiana
cagctttaaccctcaaattcttaccacctctccgccgctcactcactcactcattctccctttctgtttgcagccgacttctcatcttctcctttgagccatgagtaagcttcagagtgatgccctaagagaagccatcactgtgattaagagtgcttcaaatgagaagaaaaggaagttcactgaaaccattgagctccagattgggctgaaaaactatgatccgcaaaaggacaagcgtttcagtggttcagtcaagttgcctcacattcctcgccctaagatgaagatttgcatgcttggagatgctcagcatgttgaagaggctgaaaagattgggttggagtacatggacgtggaaagtctgaagaagcttaacaaaaacaagaagttggttaagaagctcgcaaagaaataccatgcttttttggcatcagaagctgttataaagcaaatcccccgtctcttggggcccggcttgaacaaagccggtaaatttcctagccttgttagccaccaagaatcgctcgaatctaaggttaacgagaccaaggccactataaaattccaattgaagaaggtgctttgcatgggagttgctgttggtaatatggatatggaggagaaacaaatcttccagaatgtgcagatgagtgtcaactttcttgtgtccttgcttaaaaagaactggcaaaatgtgagatgcctgtacttgaagagtaccatgggaaagactcaacggcgtcttctaaaggaaattgcattacaa

SEQ ID NO: 14225 - DNA, 898 bp, Conyza canadensis
gcacttccaaaccctatttgcagggttcttaccacactagaagtcaagtctttaagtgcaggaaaatttctcaaaatgagtaagctctcgagtgaggcccttagagaggcgattacccaagttacgactgaggccaaggaaaagaaacgtaacttcactgaaaccattgagcttcagattggtttgaagaactacgatccccaaaaggacaagcgttttagtggtaccgtcaagttgccacacattcctcgtcccaagttgaaggtttgcatgctcggagatgcccagcatgttgaagaggcacaaaagattggcctcgaatacatggatgttgagagcctgaagaagctgaacaagaacaagaagttggtgaagaagcttgctaagaaacaccaagcttttttggcttctgagtctgtcatcaagcagattcctcgtctgttgggacctggcttgaacaaagcaggcaagttccctactcttgtttcccaccaggagtctcttgaggctaaggttaacgagaccaaggcaactgtgaagtttcaactgaagaaggttctctgcatgggagttgctgttggtaactgcagtatggaggagaagcagatattccagaatgtgcaaatgagtgttaactttctagtttcattgctgaagaagaattggcaaaatgtgaggtgcttatacttgaagacaacaatgggaaagccagtccgcatcttttaaggagttatttttatgttttcatttgtgttaatgttaagctcagagcttgaagaaaatatttgtcaggaacatgaaatagtcttttttggcttcttgcatggttgtttggtactaaattttgagacatatctttgttatccatcttatttatctattagtgcttctagtccca

SEQ ID NO: 14226 - DNA, 1102 bp, Rosmarinus officinalis
cggccgggggagagctaagttatctttatcccgcaacccgctctccgtcacaaaccctaccagttctctcatcagaagttagctacgatccacgaattgttgaaggatgagtaagcttcagagtgaagccttgagggaagctatcactcagatagtatcggacagtaaggagaaaaagagaaatttcaccgagacagttgagctacagattggtctgaaaaactatgacccgcaaaaggacaagcgtttcagcggttctgttaggttaccccatattccccggccaaaaatgaagatttgcatgctcggtgatgctcagcatgtggaagaggctgaaaaaattggtctggagtccatggatgtggaggctctgaaaaagttgaacaaaaacaagaaattggtgaagaagctcgccaagaggtatcatgctttcgtagcctcagaggctgttatcaagcagattcctcgtcttttgggacctggtctgaacaaagcaggcaagttccctactctcgtgactcaccaagagtctcttgagtccaaggtgaatgagaccaaggctaccatcaagttccaattgaagaaggtgctctgcatgggagtagctgttgggaacttggacatggaagaaaagcaactctttcagaacattcaaatgagtgtcaatttcctggtctctcttctgaaaaagaactggcaaaacgtcaggtgtttgtacttgaagagtaccatgggcaagccgcaacgcatcttttgagagagtcgttatctgtttgaagttttaggaagaatctgcagtttgtatgtgttttttaaccttttgtctttacatgggaatttgtcttcgatggaggtggtttgattttgtttatgttgagatgctttggcttatactggaatagcaactttatcgtttaaaattatcatgatttgtgtctggactgctagtatatgctttataagtagcaattgcatttccatattaatggttcgtgtagtttactatggaaatggcaaattttgtgtttcttcacaaatatttgacattactgtcaacagtttggatctttattccaaaataaaatttcaacatttcgaacgg

SEQ ID NO: 14227 - DNA, 797 bp, Centaurea maculosa
ttctcttcttcgaagaagtgaagtttaaggaaggaaaatctatcaatcatgagtaaacttcagagtgaagccctccgtgaagccattacccagatcactactgatgctaaggaaaagaagcggaattttaccgagaccattgagctccagattgggctcaagaactacgacccacaaaaggataagcgtttcagtggaaccgtgaagttgcctcacattcctcgcccgaaattgaaagtttgcatgcttggagatgcccagcatgtggaagaggctcaaaagataggccttgaatatatggatgtggaaggtctcaagaagctaaacaagaacaagaaactggtgaagaagcttgctaagaagcaccaggctttcttggcttctgaatctgtcatcaagcagatccctcgtttgttgggccctggtcttaacaaggctggaaaattccctacccttgttacccaccaggaatcccttgaggctaaggtgaatgagaccaaggcaaccgttaagtttcagctgaagaaggtgctctgcatgggagttgctgttggaaactgcagcatggaggataagcagatctttcaaaacgtgcaaatgagcgtcaactttcttgtttcgttactcaagaagaattggcaaaatgtgaggtgtttgtacttgaagacaacaatgggaaagccggttcgcatcttttagccggttggcatcttttaggagttatctttgtttatcagatttgtgctgtttgaggtccagtacttggaagcatttgcctttatcggggtgcttatcgt

SEQ ID NO: 14228 - DNA, 864 bp, Centaurea maculosa
aaggaaaatctatcaatcatgagtaaacttcagagtgaagccctccgtgaagccattacccagattactactgatgctaaggaaaagaagcggaattttaccgagaccattgagctccagattggtctcaagaactacgacccacaaaaggataagcgtttcagtggaaccgttaaattgcctcacatccctcgtcccaaattgaaagtttgcatgcttggagatgcccagcatgtggaagaggctcaaaagatcggccttgagtatatggatgtggaaggtctcaagaagctaaacaagaacaaaaagctggtgaagaagcttgctaagaagcaccaggcttttttggcttctgaatctgtcatcaagcagatccctcgtttgttgggccctggtcttaacaaggctggaaaattccctacccttgttacccaccaggaatccctcgaggctaaggtgaatgagaccaaggcaaccgttaagtttcagctgaagaaggttctctgcatgggagttgctgttggaaactgcagcatggaggacaagcaaatctttcaaaacgtgcaaatgagcgtcaatttcctcgtctcattactgaagaaaaattggcaaaacgtgaggtgtctgtacttgaagacaacaatgggaaagccggttcgcatcttttagccggttggcatcttttaggagttacctttgtttatcagatttgttctgtttgaggtccagtacttggaagcatttgcctttatcggggtgcttatcgtttttgacttgttggatgttgggttttttatttcgtattagatactgcggttacattaaacgattattacatctaaaatctacccatcgatatttcta

SEQ ID NO: 14229 - DNA, 955 bp, Arachis hypogaea
agggtttgtggcggctacggtaacttgcgcgctctctcaatgcgttagctacaacacattacacaatatccgcattttcgttataatagcaacttgttctatttgcagaataatcttttgtggcggcacctcaaacaccaaacctctgcggctctgctccttacaatgagtaagctacagagtgatgcactgagagaggccatatctcagctcgttgcgaatgcgaacgagaagaagcgcaaattcactgagacagttgaacttcagatcggtttgaagaactatgaccctcagaaagacaagcgtttcagcggttccgttaagctgcctcatattcctcgccccaagatgaagatctgcatgcttggtgacgctcagcacgtcgaagaggctgaaaaaattgggctggattggatggatgtcgaggcactgaaaaagcttaataagaacaagaaacttgtgaagaagcttgctaagaagtatcatgcttttctagcttctgaagctgtcatcaagcaaattcctcgcctcttaggccctggtttgaacaaggcaggtaagtttccaacattagtgacacatcaggaatccttagagtcaaaagttaatgaaacaaaagcaatggtgaagtttcaacttaagaaagttctttgcatgggtattgctgttggaaattgctcaatggatgagaaacagatattccagaatgtacaactcagcgtcaatttccttgtttcattattgaagaaaaactggcaaaatgtgagatgcttgtacctcaagagtacaatggggagtgcaatccgcgtattttagattgtttagatgggtagtttgcattggctaagcctcatgagttctggacatgttaacatgttaacgggatgttattgctgacagttaatgcccccattttttttggcattcttaagattctttgatatcaattgtttta

SEQ ID NO: 14230 - DNA, 1274 bp, Prunus mume
cccaaatggaggagcttggttccaggggaatccaagatccaagttgagcaaactttgacacggcccaacccatccacaaatcagacacgtcaacaatcatttctttagggtttatcagtcaccacctcacaatcttctgttccatatattaagctcccttagccgccagaaaccctaacgagggcgtcctctactctcagattctttgtttggtcagacaccttaagattcaaccatgagtaaacttcaaagtgatactctcagggagggtatttccaccatcatggctgcgtccaaggaaaaaaaccgcaagttcactgagaccatcgaacttcagattgggctgaaaaattatgatccccaaaaagacaaacgtttcagtggttctgttaggttgccacacatccctcgtccaaagatgaaggtttgcatgcttggagatgctcagcatgttgaagaggctgagaagatagggttggattatatggatgttgaagggctgaagaagctaaacaagaacaagaaattggttaagaaactggccaagaaataccatgcctttttggcatcagaagctgttattaagcagattccccgtcttttgggtcctggtctcaacaaggcaggaaaatttccaaccctggttactcaccaagaatcgcttgagtctaaggttgccgagacaaaagcaaccattaagttccaactgaagaaggttctttgcatgggagttgctgtagggaatgcctccatggaggagaaacagatcttccaaaatgtgcaattgagtgttaacttccttgtttcacttttgaagaaaaattggcaaaatgtgaagtgcttgaacctgaagactactatggggaagccatatcgcatctattaagaaatcatttacttatttttggatgtaggggcaggttatggaaagcctgatacttaataggaattgtgtttttatctgaatggtcaagttttcgtgtttgttggctgtattactttgtttgatggttatcgacattgttatggtagacttgatatcaaaatcttgttggagaggaagcctggttttcattctttcggcatgagcctatcttttgcatcagcatgtcttaagtgggaaatgagtgcaaatgtaccgctttgctgatcgtaacatatcttgcttctgatagccattggtccggaaaaagagggctttcggtagtagtgttttagagcataaaaagtttggaggtggtaaagctataatacttggtgatgcccgaaccctt

SEQ ID NO: 14231 - DNA, 751 bp, Secale cereale
ggaggcaatcacaaacattatcaatgactgccgtgagaagaaccgcaagttcgtcgaaaccattgagctgcagattggtctgaagaactatgacccgcaaaaggacaagcgtttcagtggttctgttaagcttcctcacatccctcgcccaaagatgagggtttgcatgcttggtgatgcccagcatgttgaagaggcagggaaaatgggcctagactgcatggatgtggaatctcttaagaagatgaacaaaaacaagaagctggtcaagaagcttgcgaagaagtatcatgctttccttgcatctgaggctatcattaagcagattccccgacttcttggacctggtcttaacaaggcaggaaagtttccaactttggtgtctcaccaggaatcgctcgagtccaaggttaatgagaccaaggcacacgggatcggtgagagtgtggtggttgctgcactggatgagaagcagatcttccagaacgtgcagatgagcgtgaacttcctcgtctctctgttgaagaagaattggcaaaacgtgagatgcttgtacctgaagagcacgatgggaaaggtgtaccggttgttctagactctagtcttctaggatttccaggagattgacaacttgggaacttttgttgctttctcaattattatcaaattttcgtgcgtgccagtgacagttaaacagttgcactattgtcttgtactgagatggtttgttctattgtctggaatttcatga

SEQ ID NO: 14232 - DNA, 929 bp, Zea mays
gtttccatcccattttctctcctctctccgtcgccgcctcgggccaaaccctacgcagggagttgattgatcgattgcagccatgagtaagttgcattccgagcttctcaaggattgcatctcccagatagttcaggatgccaagaagaataggaagttcactgagactgttgagcttcagattagtctgaagaattatgatccacaaaaggacaagcgtttcagtggctctgttaagttgcctcacatccctcgtccaaagatgaaggtgtgcatgcttggtgatgcccagcacgttgaggaggctgagaagatgggacttgactacatggatgttgaggccctcaagaaaatgaacaagaacaagaagcttgttaagaagcttgccaagaagtaccatgcttttttggcatcagagaccatcatcaagcaaattccccgtctccttggtcctggtctcaacaaggcaggcaagttccccactctggtcactcaccaggaatccctggaatccaaggtgaatgagacgaaggctacagtcaagtttcaactgaagaaagtcctttgcatgggtgtcgcggtcggtaacctgtctatggaggagaagcagatccaacagaacatccagatgagcatcaacttcctcgtgtctcttctgaagaagaactggcagaatgtaagatgtctctacatcaagagcaccatggggaaaccattcaggattttctaagtctgtttttttgtgaagtctgctctttatgatatttggtttttgaaccgaggttgtcttgaactaaaactcttgttagatcatgtttggttggtaggatatttgagtctgggcaggtgtcttactcttgcgccatgtctttgtaatctctctatataagttttttgagaggctcagtataatatgcgtattatacgtt

SEQ ID NO: 14233 - DNA, 989 bp, Cynara scolymus
ctcgcggggccatttataccatttactttctagctacaagcacattcttaccctacataggcggaggagctgcgcaaaggggaaatctttcaccatgagtaagttaggaagtgaggctgtcagagaagccattacccaaattacaactgaggccaaggagaaaaaccgtaagtttacggagaccattgagcttcagattgggttgaagaactatgacccccaaaaagacaaacgtttcagtggcacggtaaagttgccacacattcctcgtcctaagttgaaggtctgcatgctcggtgatgctcaacatgttgaagaggcacagaagataggattggaatacatggatgttgaagggttgaagaagcttaacaaaaacaagaagttggtcaagaagcttgctaagaagcaccaagcctttctggcatccgagtccgtcattaagcagattccgcgtctcttgggccctggtctcaacaaagcaggaaaattcccgacacttgtgacacatcaggagtccttggagtcaaaagttaatgaaataaaggcaacagtgaagtttcagcttaagaaggttctctgtatgggggttgctgtgggaaattgcagcatggaagagaagcagatcttccagaatgttcaaatgagcgtaaactttctcgtttcattattgaagaaaaactggcaaaacgtgaggtgcttgtacctgaagactaccatggggaaaccagtacgtgtcttttagtaaaagccaagattgatgattttagacgacagttgtaggacgacgcatacattcgatatcatctgctacgagtggtttgatattttggctttaaaccaagtcatcattcttatcttaaatctgtatttttggtagtcattagatttgcaatttaatggaagagaatctgaagatcttccatgcttgtaaaatgtttaaatttttgtgcaaatttctaccatatgaatgttgatgttttgttggc

SEQ ID NO: 14234 - DNA, 856 bp, Centaurea maculosa
aacgcagggttcttcttcttcttcacacagaagtgcaagttagcgaaaggaatagtttgcgaacatgagtaagctacaaagtgaagcccttagggaggctattactcagatcactactgatgcgaaggaaaagaaacgtaacttcactgagaccattgagctccagatcggtttgaagaattacgacccccaaaaggacaagcgtttcagtggtaccgtgaaattgcctcacattccccgtcccaaattgaaagtttgtatgcttggagatgcgcagcatgttgaagaggctcaaaagattggccttgaatatatggatgttgaggctctgaagaagttgaacaaaaacaagaagttggtgaagaaacttgcaaagaaacaccaagctttcttggcttctgagtctgtcatcaagcagattcctcgtttgttgggacctggtctaaacaaggcaggtaagttccctactcttgttacccaccaagaatcccttgaggctaaggtaaacgagaccaaagcaactgtgaagttccaactgaagaaggtgctctgcatgggagttgctgttggaaactgcagcatggaggacaaacagatattccagaacgtgcaaatgagcgtcaacttccttgtttcgttgctgaagaagaattggcaaaacgtgaggtgcttatacttgaagacaacaatgggaaagccggttcgcatcttttgaagagtttatttatgttttcattttgtaatgttgaggttgctactttaagaggttgttttctatcaaaaggaaatactccattttgttttggttgctactatatttttagatggctcacttcagacatttctataaaaagaa

SEQ ID NO: 14235 - DNA, 1087 bp, Centaurea maculosa
actcgcagggttcttcttaacacagcagaagtgcaggctagcgaaaggaatagtttccgaacatgagtaagctacaaagtgaagccctccgagaggcaattactcagatcaccactgatgccaaggaaaagaaacgtaacttcaccgagaccattgagctccagatcggtttgaagaattacgacccccaaaaggacaagcgtttcagtggtaccgtgaaattgcctcacattccccgtcccaaattgaaagtttgtatgcttggagatgcccagcatgttgaagaggctcagaagattggtcttgaatatatggatgttgagggtctgaagaagttgaacaagaacaagaagttggtgaagaaactggcaaagaagcaccaagctttcttggcttctgagtctgtcatcaagcagattcctcgtttgttgggacccggtctaaacaaagcaggtaagttccctactcttgttacccaccaagaatccctcgaggctaaggtgaacgagaccaaggcaaccgtgaagttccagctgaagaaggtgctctgcatgggagttgctgttggtaactgcagcatggaggacaaacagatattccagaacgtgcaaatgagcgttaactttcttgtttctttgctgaagaagaattggcaaaacgtgaggtgcttatacttgaagacaacaatgggaaagccagtgcggatcttttgaagagtttatttatgttttcagtttgggttgtttttgaggttgttgctactgtaagaggttgttttctatcaacaggaaatacttcattttgttttggttgctgctatatatttagacagctcttcagacatttctataaattgttcttttttctaggatttcttcagaagcacgaattgaagagagagagagagagaaccaccggaagaccaccaccaacaactacaaaattcgagaagctttttacacaggagaaagaagaaatctgctttataataatgtgatctttttcctctttttctttctgtgttcaatcgtatcctttggcctcatacatacaaagcatgtgttatcatgcttatatatatatatat

SEQ ID NO: 14236 - DNA, 969 bp, Centaurea maculosa
cacttccataattaaagatcaccttgatataactcagccgtctgtttttcttctccaattagggtttctcttcttcgaagaagtgaagttgaaggaaggaaaatctatcaatcatgagtaaacttcagagtgaagccctccgtgaagccattacccagattactactgatgctaaggaaaagaagaggaattttaccgagaccattgagctccagattggtctcaagaactacgacccacaaaaggacaagcgtttcagtggaaccgtgaagttgcctcacatccctcgaccgaaattgaaagtttgcatgcttggagatgcccagcatgtggaagaggctcaaaagatcggccttgaatatatggatgtggaaggtctcaagaagctaaacaagaacaagaaactggtgaagaagcttgctaagaagcaccaggcttttttggcttctgaatctgtcatcaagcagatccctcgtttgttgggccctggtcttaacaaggctggtaaatttcctacccttgttacccaccaggaatccctcgaggctaaggtgaatgagaccaaggcaaccgttaagtttcagctgaaaaaggttctctgcatgggagttgctgttggaaactgcagcatggaggataagcagatctttcaaaacgtgcaaatgagcgtcaactttcttgtttcgttactcaagaagaattggcaaaatgtgaggtgtctgtacctgaagacaacaatgggaaagccggttcgcatcttttagccagttcgcatcttttaggagctatctttgtttatcagatttgttctgtttgaggtccaccagtacttggaagcatttgcctttattggggtgcttatcgtttttgacttgttggatgttgggtttttattttcgtattagatactgcggttactttaaacgattattacatctgaaatctacccatcgatatttctataaaaaa

SEQ ID NO: 14237 - DNA, 898 bp, Cynara scolymus
cggggctttttctcaacttcatcggcactgccacttcctactcttagggttcttttcgaagaagtgaagtttaaggaaggaaaacctaacagccatgagtaagcttcagagtgaagctctccgagaagccattacccagattactaccgatgctaaggaaaagaagcggaattttactgagactattgagctccagattgggctcaagaactacgacccacaaaaggataagcgtttcagtggtaccgtgaagttgcctcacattcctcgtccgaaattgaaagtttgcatgcttggagatgcccagcatgtggaagaggctcaaaagataggccttgaatatatggatgtggaagggctcaagaagctcaacaagaacaagaagctggtgaagaagcttgctaagaagcaccaggcttttttggcttctgaatctgtgatcaagcagatccctcgtttgttgggccctggtctaaacaaggcaggaaaattccctacgcttgttactcaccaggaatccctcgaggctaaggtgaacgagaccaaggcaactgtgaagtttcaactgaaaaaggtgctgtgcatgggagttgctgttggaaactgcagcatggaggataagcagattttccagaacgtgcaaatgagcgtcaatttccttgtttcgttactgaagaagaattggcaaaatgtgaggtgtttgtacttgaagacgacaatgggaaagccagttcgcatcttttaggtgttttctttgtttttatctgagtttgtcggtttgaggtcagtacttggaagcatttgcccttaatgggtgcttatcgtttttgacttgtcgaatgttgggtttttattactgtattagatgctgctttcgccatgaacgatcattacttcc

SEQ ID NO: 14238 - DNA, 890 bp, Carthamus tinctorius
ttcggcgggggttttcttctccagcttcatcccctagggtttctcttccaagaagtgaagtttaaggcaggaaaatctatcaatcatgagtaagcttcagagtgaagccctccgtgaagccattacccagatcactactgatgctaaggaaaagaagcgaaattttaccgagaccattgagctccagattgggctcaagaactacgacccacaaaaggataagcgtttcagtggtaccgtgaagttgcctcacatccctcgcccaaaattgaaagtttgcatgcttggagatgcccagcatgtggaagaggctcaaaagatcggccttgaatatatggatgttgaaggtctcaagaagctaaataagaacaagaagcttgttaagaagcttgctaagaagcaccaggcttttttggcttctgaatctgtcatcaagcagatccctcgtttgttgggccctggtctaaacaaggctggaaaattccctacccttgttactcaccaggaatccctcgaggctaaggtgaacgagaccaaggcaaccgtgaagtttcagctgaaaaaggttctctgcatgggagttgctgtcggaaactgcagcatggaggacaagcagatcttccaaaacgtgcaaatgagcgtcaatttccttgtttctttactgaagaagaattggcaaaatgtgaggtgtttgtacctgaagacaacaatgggaaagccggtccgcatcttttaggcgttatctttgtttctccgatttgttctgtttgaggtccagtacttggaagcatttgccttttatcggggtgcttatcgtttttgacttgttggcatgtgggtttttatttttgttttagatactgcaacgattattacatctgaaatctata

SEQ ID NO: 14239 - DNA, 930 bp, Avena sativa
gcgccgccgccctcctccattcctcctcccccaaaccctaaaccaggtggatcggtgatcgtccgtcgtcggcaaccatgagtaagctgtcgaccgaggccctcaaggaggccaccacccaggtcgtgtccgaagccaaggagaagaacaggaagtttaccgagaccatcgagctccagatcggcctcaagaactacgacccgcaaaaggacaagcgtttcagcggctccgtcaagctaccccatgtcccgcgccccaagatgagggtctgcatgctcggtgatgcccagcatgtgggggaggctgagaagattggacttgactccatggatgttgaagctcttaagaagatgaataagaataagaagcttgtcaagaggcttgccaagaagtatcatgctttcttggcctcagaggctattatcaagcagattccccgtcttcttggccctggtctcaacaaggcaggcaagttcccgactcttgtttctcactcggagtctctggaagccaaggtgaacgagacgaaggccaccatcaagttccagctgaagaaggtgctgtgcatgggcgtcgcggtgggcaacctgtcgatggaggagaagcagatccagcagaacatccagatgagcgtcaacttcctggtctccctgctcaagaagaactggcagaacgtgaggtgcctgtacatcaagagcaccatggggaagccgtcccgggtgttctaagcccgtgcttgtgaaagtctttcatcagcagtagcttaccatagttcccttgctgtgttttacgcttaaatatgccgtgtgtcctggtcctagtgaaggagatgaaagaatctggcagtagtgtttttttttttgcttggacaagatccggtggctctgctcctcaagatcgtgttagaacctgttacaaatatattttatg

SEQ ID NO: 14240 - DNA, 898 bp, Chrysanthemum coronarium
ttgaaaccctaatagcagtagggttcttaccacagaagtgaagattaacaaaaggaaaacatgagtaagctatcaagtgatgctgttagggaggcaattactcagattaccactgatgccaaggagaagaaggtccgtaactttgttgagactattgaactccagattggtttgaagaattacgacccgcaaaaggacaagcgtttcagtggtaccgtgagattgcctaacattcctcgtcccaagttgaaggtttgcatgcttggagatgctcagcatgttgaagaggctcaaaaaattggtctagagtatatggatgttgaaagcttgaaaaagctgaacaagaacaagaagttggtgaagaagcttgctaagaaacaccaagcttttttggcttcggagtctgttatcaagcagattcctcgtttgttgggacctggtcttaacaaggctggtaagttccctacccttgtttcccaccaggaatctcttgaggcaaaggttaacgagaccaaagccactattaagtttcaacttaagaaggttctttgcatgggagtcgctgttggaaactgcagcatggaggagaaacagatcttccagaatgtgcaaatgagtgtcaacttcttggtttctttgttgaagaagaactggcaaaatgtgcgatgcctatacttgaagacaaccatgggaaagcctgttcgcatcttttaagaagtttatggattgttatgttttcattttggttaatgttatgattggtactggaaagtattccaatgaacaggaaatagtccttttggctggttacatgtttgtttggtactatatttttggacctcttactttagatgctatattatcgagatacttctgcttaagcgtatcagtatttttc

SEQ ID NO: 14241 - DNA, 941 bp, Chrysanthemum coronarium
acactactcgttgaaaccctaatagcagtagggttcttaccacagaagtcaaaggaaaagtcaacaaacatgagtaagctatcaagtgatgctgttagggaggcaattactcagattaccactgatgccaaggagaagaaggtccgtaactttgttgagactattgaactccagattggtttgaagaattacgacccacaaaaggacaagcgtttcagtggtaccgtgagattgcccaacattcctcgtcctaagttgaaggtttgcatgcttggagatgctcagcatgttgaagaggctcaaaaaattggtctagagtatatggatgttgagagcttgaagaagctgaacaagaacaagaagttggtgaagaagcttgctaagaaacaccaagcttttttggcttcagagtctgttatcaagcagattcctcgtttgttgggacctggtcttaacaaggctggtaagttccctacccttgtttctcaccaggaatctcttgaggcaaaggttaacgagacaaaagctactattaagtttcaacttaagaaggttctttgcatgggagtcgctgttggaaactgcagcatggaggagaaacagatcttccagaatgtgcaaatgagtgtcaacttcttggtttctttgttgaagaagaactggcaaaatgtgcgatgcctatacttgaagaccaccatgggaaagcctgttcgcatcttttaagaagtttatggattgttatgttttcattttggttaatgttatggttggtactgggaagtattccaatgaacaggaaatagtccttttggctggttacatgtttgtttggtactatatttttggacctcttactttagatgctatattatcgagttacttctgcttaagcgtatcagtatttttctgatattgtgttgtcttgaatattattgagttac

SEQ ID NO: 14242 - DNA, 1005 bp, Chrysanthemum coronarium
acactactcgtgggttcttaccacaggtacaccaaaaccattttctttcattaaaaacatctagcttcatttctcaatccatttgttgatttgaaacaagtttgtatattgttgttaactcagttttgtatgtttgtttacagaagtcaaaggaaaagtcaacaaacatgagtaagctatcaagtgatgctgttagggaggcaattactcagattaccactgatgccaaggaaaagaaggtccgtaactttgttgagactattgaactccagattggtttgaagaattacgacccacaaaaggacaagcgtttcagtggtaccgtgagattgcccaacattcctcgtcctaagttgaaggtttgcatgcttggagatgctcagcatgttgaagaggctcaaaaaattggtcttgagtatatggatgttgagagcttgaagaagctgaacaagaacaagaagttggtgaagaagcttgctaagaaacaccaagcttttttggcttcagagtctgttatcaagcagattcctcgtttgttgggacctggtcttaacaaggctggtaagttccctacccttgtttctcaccaggaatctcttgaggcaaaggttaacgagacaaaagctactattaagtttcaacttaagaaggttctttgcatgggagtcgctgttggaaactgcagcatggaggagaaacagatcttccagaatgtgcaaatgagtgtcaacttcttggtttctttgttgaagaagaactggcaaaatgtgagatgcttgtacttgaagacaaccatgggaaagccagttcgcatcttttaagaagtttatgggttgctatgttttcattttggttaatgttgaggatggtactggaaagttttccaatgaacaggaaatagtcctttttggcttgttacatgtttgtttggtactatattttggaacaccttactttagatgttatattcttaagttacttttgcttaatggtatcagtatttag

SEQ ID NO: 14243 - DNA, 840 bp, Chrysanthemum coronarium
aaggaaaactctacaatcatgagtaagctttcaagtgaagccgtcagagaggcgattaccagcatcaccactgatgctaaggaaaagaaagtccgtaacttcactgagaccattgaactccagattggtctcaagaactacgacccacaaaaggacaagcgtttttctggaaccgtgaggttgcctcacattccacgtcccaagttgaaggtttgcatgcttggagatgcccagcatgttgaagaggctcaaaagattggtcttgagtacatggatgttgagtcactcaagaagcttaacaagaacaagaagcttgtgaagaagcttgctaagaagcaccaggcttttttggcttccgagtctgttatcaagcagattcctcgtttgttgggacctggtcttaacaaggctggtaagttccctacccttgtttctcaccaggaatctcttgaggcaaaggttaacgagaccaaagccaccgttaagtttcaactgaagaaggttctttgtcatgggtggtcgctgttggaaactgcagcatggaggagaagcagatcttccagaatgtgcaaatgagcgtcaacttcttggtctctttgttgaagaagaactggcaaaatgttcgatgcctatacttgaagacaaccatgggaaagccagttcgcatcttttaagaagtttatggattgtcatgttttcattttggttaatgttgaggatggtactggaaagttttccaatgaacaggaaatagtccgttttggcttgttacatgtttgtttggtactatatttttggacctcttaatttagatgttatattatcgagttacttctgctt

SEQ ID NO: 14244 - DNA, 1248 bp, Rosmarinus officinalis
aggtgaggagtccatcgcaagaaaccctaaccgtagcaattctgtggttgtcaaactctttctgcatcgtttctctctctactttccctttctctttcctgttacgctcttgccagctagtttagcatttcattttgttgattttgtgctgacatttccctgtgttgttttgtgttgatttgcaaaggttagcttcgatccacgaattgctgaaggatgagtaagcttcagagtgaagccttgagggaagctatcactcagatagtatcggactgtaaggagaaaaagagaaatttcaccgagacagttgagctacagattggtctgaagaactatgacccacaaaaggataaacgtttcagtggttctgttaggctgccccatattccccggccaaagatgaagatttgcatgctcggtgatgctcagcatgtggatcaggctgaaaagattggtttggagtccatggatgtggaggctctgaaaaagttgaacaaaaacaagaaattggtgaagaagctcgccaagaggtatcatgctttcgtagcctcagaggctgttatcaagcagattcctcgtcttttgggacctggtctgaacaaagcaggcaagttccctactctcgtgactcaccaagagtctcttgagtccaaggtgaatgagaccaaggctaccatcaagttccaattgaagaaggtgctctgcatgggagtagctgttgggaacttggacatggaagaaaagcaactctttcagaacattcaaatgagtgtcaatttcctggtctctcttctgaaaaagaactggcaaaacgtcaggtgtttgtacttgaagagtaccatgggcaagccgcaacgcatcttttgagagagtcgttatctgtttgaagttttaggaagaatctgcagtttgtatgtgttttttaaccttttgtctttacatgggaatttgtcttcgatggaggtggtttaattttgtttatgtggagatgctttggcctatactggaatagcaacatttctcgtttaaaaatccgatttgtgtctggatgatgatctcctagtatgcttgataggtagcaattgcatttccatcttaatggttcttgtagtttattatggaaaattgaaaattttctgtactaaacaaaatatttgacatctcgagatgtaatgttgaagtcatatttaacatttcgagacgtaatattgaagtcatattttgaatatatctagtaattttgaatgc

SEQ ID NO: 14245 - DNA, 892 bp, Cynara scolymus
ggcgggggattcggcactttcaaccctactcgcagggttctcaacagagaagtgaaggttagcgaaaggaaaatttccgaacatgagtaagcttcaaagcgaagccctcagagaggcaattactcagattactaccgatgcaaaggaaaagaaacgtaacttcactgagaccattgagctccagatcggcttgaagaactacgaccctcaaaaagacaaacgtttcagtggtaccgtgaaattgcctcacattccacgtcccaaattgaaagtttgtatgcttggagatgcccagcatgttgaagaggctcaaaagattggtcttgaatatatggatgttgagggtctgaaaaagttgaacaagaacaagaagttggtgaagaaacttgctaagaaacaccaagctttcttggcttctgagtctgtcatcaagcagattcctcgtttgttgggccctggtctaaacaaggcaggtaagttccctactcttgttacccaccaggaatcccttgaggccaaggtaaatgagaccaaagcaactgtaaagttccaactgaaaaaggtgctctgcatgggagttgctgttggaaactgcagcatggaggataaacagatcttccagaatgtgcaaatgagcgttaactttcttgtttctttgctgaagaagaattggcaaaacgtgaggtgcttatacttgaagacaacaatgggaaagccgggtcgcatctcttaagcagtttatttatgttttcattttgggttatgttgaggttggtacttgaaaaggttgtttcccatccacaggagacgttccattttgatttgttaccttttggttgctactatatttttagacggttctcttcagaacattataataattgttttttaa

SEQ ID NO: 14246 - DNA, 827 bp, Physcomitrella patens
gctctgcagcgccgttgtgtttctcccggtacagttagttctactccagccatgagtaagctccagagcgatgtcctccgggaggccattacgcagatcaccactgcggccaaggagaagaaccggaagttcactgaaactgtagagcttcagattggtctgaagaactacgacccccagaaagacaaacgtttcagcggctctgtgaagctgccacacattcctcgtcctaagatgagagtgtgcatgcttggagatgctcagcacgtcgaggaggcaaacaaaatcggtatggaatacatggatgttgagagcttgaagaagatgaacaagaataagaagctcgtcaagaagctggctaagaagtaccatgctttcttggcttccgagtctgttattaagcagattccccgtctgttgggacctggtttgaacaaagccggaaagtttcccacccttgtgtcccaccaagagtctttggagtccaagggtcaggagttaaaggccatggttaagttccaactgaagaaggtgttgtgcatgggagtcgccatcggtaactgtgatatggaggaaaagcaaatcttccagaacacacaaatgggtgttaacttcctcgtgtccctgttgaagaagaactggcagaatgtccgagtgttgtacttaaagacaaccatgggcactccggttcgtatttactaggttccagcgtatacgagttgagcattccaatgggtctgaaagaccagaatttgagattgtgaaagtctattcttaatacggacgcaactatctatcaattttgcacaatgatgctttcatatttt

SEQ ID NO: 14247 - DNA, 856 bp, Physcomitrella patens
tctttcaacttcacaccgtcgtgaggactccctggttcgtgcgtaatttgctgcaaccatgagtaagcttcagagcgatgtcctcagggaggccatcactcagattaccactgccgctaaggagaagaataggaagttcacagagactgtggagcttcagatcggtctgaagaactatgatccccagaaagacaagcgtttcagtggttccgtgaagctgccacacattcctcgccctaagatgcgcgtgtgcatgctcggagatgcccagcacgttgaggaggccaacaagatgggcatggaatacatggacgtcgagagcttgaagaaaatgaacaagaacaagaagctcgtgaagaaactggcgaagaagtaccacgctttcttggcctccgagtctgtcattaagcagattcctcgtctgttgggacctggtttgaacaaggccggaaagtttcccactttggtgtctcaccaggaatcgcttgacgccaagtgccaggagaccaaggccatggtcaagttccagctgaagaaggtgttgtgcatgggagttgccattggaaattgtgacatggaggagaagcagatcttccaaaacactcagatgggtgtcaacttccttgtatccctgctgaagaagaactggcagaatgtccgcgttctgtacttgaagactaccatgggcacccctgtccgtatctattagttgtgtagaacgtggattgtaaggcatctttcagtcaatgccaatgaaaattatggaggtttctatttctgttccagcttcctttcattgctgcaaatcgaattctgtacccttccatgtttcaattcagagctgttttttggcatc

SEQ ID NO: 14248 - DNA, 925 bp, Zostera marina
agggatttcattagaggggatctctaaagatgagtaagttgcagagtgatgttttaagagaggctattggacaaatcactgctgcttgcagtgataagaagcgcaattttacagaaaccattgaacttcagattggattgaagaattatgatccccaaaaggataaacgtttcagtggttcagtcaagctcccacatattcctcgtcccaaaatgaaagtttgcatgcttggggatgcccaacatgttgaggaggcttctaagatttcattgtcctcaatgagtgttgaagatctgaagaagtttaacaagaacaagaagttggttaagaagatgtcaaagaagtatcatgcctttcttgcctcagaagctgtgatcaagcagattccacgtcttttgggtcctggactaaacaaggcaggaaaattcccaacccttgtatcccaccaggagagtctagaggcaaaagtaaacgagatcaaagccacagtgaaattccaactgaagaaagtgctttgcatgggtgttgctgtaggtaatgttggaatggacgaaaagcaaatattccagaacgtccagctttctgtcaactttttggtttccttactgaagaaaaactggcagaatgtgaagtgtttgcacttaaagagcaccatgggaaagccgtttcgcttgttctgatctatttatgttcttaattccttaaaatgtcagacaattttcttatttatttattgttgagaattgagatcaacatttttctgtttttgcacaacctttactattttgtttgttaaacaattcaagaacaattccttatgagttatgatagtgtctttaatattttgtcttgagagtgaaattgtgaaaataagaatttaaaatggaaaattccggaataggttatttattatgtattatttgac

SEQ ID NO: 14249 - DNA, 939 bp, Brassica oleracea
tagggtttttatacttgttcctcgagctatcttatttcagatttttcattatttacgttgtttgtgtctgtttgtaggatcagatctttgaggcaagctcaaaatgagtaagcttcagagtgaggccgtcaaagaagccataactgtaatcagaggcaaatccgaagataagaaacgcaactagactctcgagctccagattggtctcaagaactataaccctcaaaaggacaagcgtttcagcggctctgtcaaattacctcacattccccgtcctgagatgaagatctgcatgctcggagacgcccagcacgtcgaggaggctgagaagatggggctggactacatggatgtggagtctctcaaaaagctcaacaagaacaagaagctcgtcaaaaagcttgccaagaagtaccacgccttcttggcctctgaatccgtcattaagcagattccacgtcttcttggtcctggtctcaacaaggcaggcaagttcccaacgcttgttagccatcaggagtcgctggaggggaaggtgaatgaaactaaggctacagtcaagtttcagctgaagaaggttctgtgcatgggtgttgctgttggtaacctctccatggaggagaagcagatttttcagaatgttcagatgagtgtcaacttcctcgtctctctcttgaagaagaactggcaaaatgtgaggtgtttgtacctcaagagcacaatgggaccacctcaaagaatcttctgagctctcgcagctgcttcaatggtggctagatacacctgcacttctgtttttaaatttcagacatagtaagaagtgtgttggggtgactttgttttgtacgtagcttatattatttgttcatgaatattcaacaaacaaagaattttctaaactaaaaaaactatatgccaaagcataacatatctctccag

SEQ ID NO: 14250 - DNA, 859 bp, Brassica juncea
taagctccagagtgaagccgtgaaggaggcgatatcaaccatcatcacccactgcaaggagacaaagcctcgcaagttcaccgagaccatcgagctccagattggtcttaagaactatgaccctcaaaaggacaagaggtttagcggttccgttaagttgcctcacattcctaggcccaagatgaagatttgcatgctcggtgatgcccagcacgttgaagaggctgagaagattgggttagagtctatggatgtggaagctcttaagaagctgaacaagaacaagaagcttgttaagaagcttgcaaagaagtaccatgctttcttggcttctgagtcagtcatcaagcagattccccgtcttcttggtcctggtcttaacaaagctggaaagttccctaccctagtgagtcaccaagagtcgttggaagggaaggtgaacgagaccaaagcgacagtgaagttccagttgaagaaggttctttgtatgggtgttgctgttggtaacctttccatggaggagaagcagctcttccagaatgttcagatgagcatcaacttccttgtctccctcttgaagaagaattggcaaaacgtgaggtgtttgtacttgaagagcaccatgggcccaccacaaaggatcttttgagttctatactctttcatcttcaaacttttgcgttgtggtttttgtttgtttcagagaacttaagttatggttttgtttggtattagcagaactgaagtgttagtttgctttttgtcaagacattataatatgcactgtttgattctacaatgtcgactctccagttcaattttatctttatcaattatcgaaaacatcatttgagatttc

SEQ ID NO: 14251 - DNA, 902 bp, Chrysanthemum coronarium
agctttcatcaagtagtgaagtctaaaggaaaactctacaatcatgagtaagctttcaagtgaagccgtcagagaggcgattaccagcatcaccactgatgctaaggaaaagaaagtccgtaacttcactgagaccattgaactccagattggtctcaagaactacgacccacaaaaggacaagcgtttttctggaaccgtgaggttgcctcacattccacgtcccaagttgaaggtttgcatgcttggagatgcccagcatgttgaagaggctcaaaagattggtcttgagtacatggatgtggaatcactcaagaagcttaacaagaacaagaagcttgtgaagaagcttgctaagaagcaccaggcttttttggcttccgagtctgttatcaagcagattcctcgtttgttgggacctggtctaaacaaggctggtaagtttcctactcttgtcagtcaccaggaatctcttgaggccaaggtgaatgagaccaaggcaaccatcaagtttcagctgaaaaaggtgttgtgtatgggagttgctgttggtaactgcagcatggaggagaagcagattttccagaacgttcaaatgagtgtcaacttccttgtttcattgttgaaaaagaattggcaaaacgtaaggtgtttgtacttgaagacaacaatgggaaagccggttcgtatcttttaggtgctttctttggtttttgattttgttgggagattagtacttaaaagctttttccgataatggtggctgtcgtttttgaatttttggatgtttgtttttctattgtattagatgatgattccatagacaatatgtttaatggttgccgagctattatcattactatctgtgttcctatcgttatgttggctcagttatatttgat

SEQ ID NO: 14252 - DNA, 878 bp, Chrysanthemum coronarium
agctttcatcaagtagtgaagtctaaaggaaaactctacaatcatgagtaagctttcaagtgaagccgtcagagaggcgattaccagcatcaccactgatgctaaggaaaagaaagtccgtaacttcactgagaccattgaactccagattggtctcaagaactacgacccacaaaaggacaagcgtttttctggaaccgtgaggttgcctcacattccacgtcccaagttgaaggtttgcatgcttggagatgcccagcatgttgaagaggctcaaaagattggtcttgagtacatggatgttgagtcactcaagaagcttaacaagaacaagaagcttgtgaagaagcttgctaagaagcaccaggcttttttggcttccgagtctgttatcaagcagattcctcgtttgttgggacctggtctaaacaaggctggtaagtttcctactcttgtcagtcaccaggaatctcttgaggctaaggtgaatgagaccaaggcaaccatcaagtttcagctgaagaaggtgttgtgtatgggagttgctgttggtaactgcagcatggaggagaagcagattttccagaacgttcaaatgagtgtcaactttcttgtttccttgttgaaaaagaattggcaaaacgtaaggtgtttgtacttgaagacaacaatgggaaagccagttcgtatcttttaggtgctttctttggtttttgattttgttgttgggagattagtacttaaaagctttttccgataatggtggctgtcgtttttgaatttttggatgtttgtttttctattgtattagatgatgatgctatagacaatatgtttaatggttgccgagttattatcattactatctgtcttcctat

SEQ ID NO: 14253 - DNA, 806 bp, Bupleurum chinense
cgtttcaaggtctatagacgaaaccagatttcagccatgagtaagttgcagagtgaagccttaagggaagctatctctcagattacgaaagaagccgttgagaaaaagaggaactttaccgagactattgaactccagattggtctgaagaacatgatccacaaaggataagcgtttcatgggctgtgaagttgcctcacattctcgtctaagatgaaggtgtgcatgcttggtgatgctcagcatgtgggagaggcagggaaaattggtttagaatacatggatgttgaagggttgaagaagctgaacaagaacaagaaacttgttagaaacttgcaaagaagtaccatgctcttctagcttctgaagctgtcatcaagcagatccctcgtcttttgggaccagggctcaacaaagcaggcaagtttcctacacttgtttcacatcaggagtcccttgaggctaaagtgaatgagaccaaggctacagtaaaattccagttgaagaaggtactttgcatgggggttgctgttggtaactgcagtatggaggagaagcagatcttccagaatgtccagatgagtgtgaatttccttagtttcgctgttgaagaagaactggcaaaatgttagatgtttgtacctgaagagtacaatgggaaagactgtccgctttttttaaaacagttttatattttcggttgaaggtagttggtgacggaatgtatgaatgagatgtgttttttcccaaatactgttgttgggcatgttctcataagatagctgatcattttatcgtcatgtggt

SEQ ID NO: 14254 - DNA, 988 bp, Avena sativa
ctccctcctcgcgccgccgccctcctccattcctcctccccaaaccctaaaccaggtggatcgtcgttcatcgatcggaagcagccatgagtaagctgtcgaccgaggccctcaaggaggccatcacccaggtcgtgaccgaagccaaggagaagaacaggaagttcaccgagaccatcgagctccagatcggcctcaagaactacgacccgcaaaaggacaagcgtttcagcggctccgtcaagctgccccatgtcccgcgccccaagatgagggtctgcatgctcggtgacgcccagcatggtgggggagctgagaagattggtcttgattccatggatgttgaagctcttaagaagatgaacaagaacaagaagcttgtcaagaggctcgccaagaagtatcatgctttcttggcctcagaggctattatcaagcagacttccccgtctccttggtcctggtctcaacaaggcaggcaagttcccgactctggtttctcactcagagtctctggaagccaaggtgaacgagacgaaggccaccatcaagttccagctgaagaaggtgctgtgcatgggtgtggcggtgggcaacctgtcgatggaggagaagcagatccagcagaacatccagatgagcgtcaacttcctggtttccctgctcaagaagaactggcagaacgtgaggtgcctatacatcaagagcaccatggggaagccggcgcgggttttctaagcttgtgctgctgccatctatctatcatcagcagtagcttaccatagttccttccttccttgccgtgtttacgcttaaatatgccgtggtttttgtcagctttgtctttgtgtgtcctggtcctagtgatggagatgaaagaatctggcagtagtgtttttgtttggacaagatccgatggctctgctcctcaagatatcgtgttagaacctgttacaaatatatttatgtatgctatgtaccctaagct

SEQ ID NO: 14255 - DNA, 667 bp, Rosmarinus officinalis
agagaagctatctctgtgattaagaatgattcagcagagaagaaaaggaagttcagtgagaccattgagctccagattgggctgaaaaactatgatccacaaaaggacaagcgtttcagtggttctgtgaagttgcctcacatccctcgtcccaagatgaaggtttgcatgcttggtgatgctcaacatgtggaagaggcagagaagataggtttggagtatatggatgtggaagggctgaagaagctcaacaagaacaagaaactggttaagaaacttgcaaagaaataccataccttcttagcatcagaagccgtcatcaagcaaattccccgtcttcttggacctggcctcaacaaggcagggaagttccctacacttgttactcaccaggagtcccttgaatctaaagttaatgagaccaaggccacaataaagttccaactgaagaaggtgctctgcatgggggttgctgttgggaattgcagcatggaagagaaacagatcttccaaaatgtacaaatgagcgttaatttcctggtctcattattgaagaaaaattggcaaaatgtgaggtgcttgtatctgaagagtaccatggggaagccagtccgcatcttttaagaagtttctttgtatttttatcttaagctggttcttgagggaa

SEQ ID NO: 14256 - DNA, 958 bp, Ricinus communis
aaaaggagaaagctagggtttattggagcaccgcctatataaatagataggcttagccgcaccgtttccttgttgctagggttttgggctataaacttctcaagactgtttctttcaagcttcaagtcatgagtaagcttcagagtgaggcgttgagagaggcaatcactactattatggctgcttccaaggagaagaagcgtaagtttactgagactattgagctccagattgggctcaagaactatgatcctcaaaaggacaaacgtttcagtggttctgtgaagttgccacatatcccccgccctaaaatgaaaatttgtatgcttggagatgctcagcacgttgaggaggccgaggcaataggtctccaatggatggatgtcgaagctttgaagaaattgaataagaataagaagcttgttaagaagcttgcaaagcagtaccatgctttcttggcttcggaatctgtcatcaagcagattcctcgccttttgggccctggtttgaacaaggcaggaaaattccctacccttgtgactcaccaagaatctctggagtccaaagtgaatgaaaccaaagcaacagtgaagttccaattgaagaaagtgctttgcatgggagtggctgttggcaactgctctatggaggagaagcaggtgttccaaaacgttcagatgtctgtcaactttcttgtcagtttgttaaaaaagaactggcaaaatgtgaaatgtctcaacctcaagaccaccatgggaactccgcagagaatcttttaaggagattctcagtttgcttttgtacttgtttttcttgatacttatataacggttttgttttttgtattgaatgttcaagctatcagttcagatccgttttgttttatttttgaatttgctagtaacattagttgtaatgttaaacatgagtttctttttaatgccacctcatattgcac

SEQ ID NO: 14257 - DNA, 829 bp, Ricinus communis
aatcggcctagccggaccatttctagggtttcttttgagcaataaacctctaaagactgtttctttaaagcttccagtcatgagtaagcttcagagtgaggcgttgagagaggcaatcactactattatgacggcttccaaggagaagaagcgtaagtttactgagactattgagctccagattgggctcaagaattatgatccgcaaaaggacaaacgtttcagtggttctgtgaagttgccacatatcccccgccctaagatgaagatttgtatgcttggagatgctcagcacgttgaggaggctgaggcaataggtctccaatggatggatgtcgaagctttgaagaagctgaataagaataagaagcttgttaagaagcttgcgaagcagtaccatgccttcttggcgtcggaatctgtcatcaagcagattcctcgtcttttgggccctgggctgaacaaggcagggaaattccctacccttgtgaatcaccaagaatcgctggagtctaaagtgaatgaaaccaaagcaacagtgaagttccaattgaagaaagtgctttgcatgggagtggctgttggcaactgctctatggaggagaagcaggtgttccaaaacgttcagatgtctgtcaactttcttgtcagtttgctaaaaaagaactggcaaaatgtgaagtgtcttaacctgaagaccaccatgggaagcccacagcgcgtattttaaggagatcttcagttcgtcttttggacttgtttttcttgaatacttatataacagttttgtttttatataacagatcgtacaaaatttatagaatttttc

SEQ ID NO: 14258 - DNA, 1150 bp, Lupinus angustifolius
acttttttgttaccagctgttgacacatctagggtttttattaagacctccttgctgacgctattgttcttagtttccgccgttcagatacatctttgctgaatcgagaaaccacttttctacgatgagtaagctacagagtgaagcattgagagaggcaatatctcagattgttacgaattcaaaggagaaaaatcggaaattcactgagactattgaacttcagattggattgaagaactacgatcctcagaaagataagcgtttcagtggttctgttaagcttcctcacattcctcgacctaagatgaagatttgtatgcttggtgatgctcaacatgtcgaagaggcagaaaaaatagggctggattacatggatgtggaggctctgaaaaagcttaataaaaacaagaaacttgtcaagaagcttgccaagaagtaccatgcttttctagcatctgaagctatcatcaagcaaattcctcgtcttttgggccctggtttaaacaaggcaggtaaatttccaacattggtgtctcaccaggaatcattggagtcaaaagttaatgagacaaaagcaatggtgaagtttcaactgaagaaagttctctgtatgggtgttgctgttggaaatttggcaatggaggagaagcagattttccagaatgtacaactcagtgtcaatttccttgtctcattattgaagaaaaactggcaaaatgtaagttcagatttgaagtccttgcattagtgttacatgtctaaatgtttgagtaccaatgcaatgcttgtggctgtaaagagaatcttgttgaaacttccatgaaattgattgtctttgccctatttcccttgctattcatctttttacacctctcttgttttaatgttaaacaggtgagatgcttatacgtgaagagtacaatggggagtgcagtccgtatattctagagatccatatatcttgtgttccagatacagggatagttactagttatcattggagaagaagtctcttttccctctatttttggagtaagacataattattttatgttcttttaacttcagatcattttgatataaatttttgtttggtgttagacaattttgttcaatctgattaattggtgactgattttaaattatt

SEQ ID NO: 14259 - DNA, 802 bp, Leymus cinereus x Leymus triticoides
tgtcaaggatgccatcacccagattgttggggaggccagagaaaagaaacgcaagttcactgagactgtggagcttcagatcggtctcaagaactacgacccacaaaaggacaagcgtttcagcggctcagtgaagctgccccatatcccccgcccaaagatgagggtgtgcatgcttggtgatgcccagcatgtcgaccaggctgagaaaatggggcttgactacatggatgttgaaagtcttaagaagatgaacaagaacaagaagcttgttaagaagctagccaagaagtaccatgctttcttggcatcagaggccataatcaagcagatccctcgtctccttggccctggtcttaacaaggcaggcaagtttcccactctggttagtcaccaggaatctcttgaagccaaggtcaatgagacaaaagctacagtcaagttccagctaaagaaggttctttgcatgggtgttgctgtgggcaacttatcgatggacgagaagcagatccaacaaaacatccaaatgagcgtcaacttccttgtgtccctcctgaagaagaactggcagaatgtgagatgcctgtacgtgaagagcaccatggggaagcgtgtacgggtgttctaagtgggtgcgctccagtgaagttgataagatactgggctgtcctgtcgacccctgcttgtctttggattagatctgtttcactgattccaattttgtgtttacctaatcgaatatcaaaagtattttatcgtactagtcgaaatcatgggagcaatggcactgcattttctgtta

SEQ ID NO: 14260 - DNA, 903 bp, Castanea mollissima
tcactccctgtaccgcctcccaaaacccttctctacagaagcagttgaaaaaggtgtatagcgatgagtaagcttcagagcgatacgttgagggaggtgatctcacaggtggtgaacaatgcgaaggagaagaagcgcaacttcacggagaccattgagctccaaatcgggttgaagaactatgaccctcagaaggacaagcgtttcagtggctccgtcaagctccctcacatccctcgccctaagatgaagatttgtatgcttggtgatgctcagcacgttgaagaggcagagaaggtgggattggagtatatggatgtggaagggctgaagaagctcaacaagaataagaaactggtgaagaagctcgccaagaagtaccatgcctttttagcatctgagtctgtgattaagctaattcctcgtctcttgggtcctggtcttaacaaggcaggtaagtttccaacactggtgactcatcaagaatccttggagtcaaaggttaatgaaacaaaagcaatggtgaagtttcaactcaagaaggttctttgtatgggggttgctgttggaaattgcagtatggaggaaaagcagatcttccagaatgtgcaaatgagtgtcaacttccttgtttcattgttgaagaaaaattggcaaaatgtgaggtgcttgaatctgaagagtaccatggggagtgccgtacgcctctattaattccattttgctgtttgtgagagttatttaggagaagtagcatgagtgaaatgttttttgagcattatgtacgcaagacagtccttggggaattttcctgaggtcctttttgttttccttgttttggattctttagcttcaaagtttagttaatgatgatatttttgtttaaatttgatgttattggtt

SEQ ID NO: 14261 - DNA, 776 bp, Euphorbia esula
ggcacgagggctccctcctctctccgcccccttcaggaacaccttcaaaattcaatcatcatgagtaagcttcagagtgaagcattgagggaggctatcaccactatcatgactgcctccaaggaaaagaagcggaatttcacagagacaattgaactccagatagggcttaagaactacgatccccaaaaggataaacggttcagtggctctgtgaaattgcctcacatccctcgccctaagatgaaggtttgcatgcttggagatgctcagcatgttgaggaggctacagcaattggcctccaatggatggacgtggaggctcttaagaagctcaacaagaacaagaagcttgtgaagaagctggccaagcagtaccatgcctttttggcttctgaatctgtcattaaacagattccccgtcttcttggccctggtctcaacaaggcaggtaagttcccaactcttgtgacccaccaagagtccttggagtctaaggtcaacgagacaaaagccacggttaagtttcagttgaaaaaggtgctttgcatgggtgttgctgttggaaactgtgccatggaggagaagcaagttttccagaacgttcaaatgagcgtgaacttccttgtctctctacttaagaagaactggcaaaacgtgaagtgcctaaacctgaagactacaatgggttctcctcaacgtgtcttttaaggagtttgatttcgaattgcagttgaacttttgagagacagtttcttgataattatagaattttt

SEQ ID NO: 14262 - DNA, 1147 bp, Physcomitrella patens
cttctctcggtttgtcttctccagctttgttcttcctccgtgtgggcttgggccgtcaccggtagttatcaatcatgagtaagcttcagagtgatgttctgagggaggcgatcactcagatcgtggctgcagccaaggagaagaataggaagttcacagagactgttgaacttcagatcggcctcaagaactatgacccccagaaagacaagcgtttcagtggctccgtgaagcttccccacattcctcgtcctaagatgaggatttgtatgcttggagatgcccaacatattgaagaggcgaccaagaatggtatcgagtgcatggatgtcgagagcttgaagaagatgaacaagaacaagaaacttgtgaagaagctggctaagaagtaccacgctttcttggcttccgagtcggtcattaagcagatccctcgtttgttgggacctggtttgaacaaggccggaaaattccctgcgcttgtatctcaccaagaatcgcttgagtccaaggtgctagagtccaaggctatggtcaaattccagttgaaaaaggtgctgtgcatgggagttgctattggtaactgcggaatggaggagaagcagatcttccagaacacccagatgggtgttaacttccttgtgtctttgctcaagaagaactggcagaacgtgagggtgttgtacttgaaaaccaccatgggtgcccccgtacgcatttattaattacggaacttggctagtaaagcgtatacctggttcgtattttcttaagaaagttcagtctggcctccttttcaaaacactgaatgttctttccttcacatatttgtcagtttgtaggtatatgagttcgtctagcgacggtactttttcaatactgtcgataatatataacgtattggtataccgtatatctctgaaacggttcagctctccaccgttcgtcacaacgctatacaaatgtctgcgtatttgaaatacaacttggaattacatgtgctattgcaacgtcacagcttccaactgcatggaagatcggtgtagaccaggtagtagtttaaaaattgcagccaatcatcgtcaatgtcattgtgacaatgagcgttgtcatttctagtgcggcgacgatgtcgtttgcatgctcc

SEQ ID NO: 14263 - DNA, 709 bp, Brassica juncea
gttcacagattcgtcaattgagagaggatcaagatgagtaagcttcagagcgaggttcttagagaaggaatcacagctgttaagggcaaagctgatgagaagaaacgtaactttgtcgagacagttgagcttcagattggtctcaagaactatgacccacaaaaggacaagcgtttcagtggttctgtcaagctacctcacattcctcgccccaaaatgaagatctgtatgctcggagatgctcagcatgttgaggaggctgagaagattggactagactatatggatgttgaggctttgaaaaagctcaacaagaacaagaagcttgttaagaaacttgccaagaagtaccatgctttcctggcttctgagtcagtcattaagcagattcctcgtcttcttggtcctggtcttaacaaggcaggaaagttccctactctagtgagtcaccaagagtcgttggaaggaaaggtgaatgagaccaaagccacagtgaagttccagttgaagaaggttctgtgtatgggtgttgccgttggtaacctttccatggaagagaagcagctctttcagaatgttcagatgagcgttaacttccttgtctccctgttgaagaagaattggcaaaatgtgaggtgtttgtacttgaagagcacaatgggaccaccaaacaaaaaggaatacttttgagctctctgctcttttcttc

SEQ ID NO: 14264 - DNA, 912 bp, Vigna unguiculata
gccgccaagccgttgagttggaaaaagaccaagtctcacaatgagagtgatgctttaagggaggctatcactggaatcatgggtgattccaaagagaagaaccgaaagtttgtggagactattgaactccaaattgggctgaaaaactatgatccccaaaaggacaagcgtttcagtggctctgttaagttgcctcatattcctcgccccaagatgaaaatttgcatgcttggagatgcccaacacgttgaggaggcagagaagataggattggactacatggatgttgaagccttgaagaagcttaacaaaaacaagaaattggtgaaaaagctagctaaaaagtatcatgcgtttttggcctctgaagccgttatcaagcagattcctcgtctcttgggacctggtctcaacaaggcagggaagttccccacacttgtgactcaccaagaatctttggagtcaaaggttaatgagactaaggctatggttaaattccagcttaagaaggtgctctgcatgggagtagccgtggggaatgttagcatggaggaaaagcaaatcttccaaaatgtacaactgagcgttaatttccttgtgtcattgttgaaaaagaactggcagaatgttaggtgcttatatttgaagagtaccatggggaaatcataccgtgtcttttaagtgtttgtttttaaattcagggaatttctgatcgcacttgatatattgtcgtgataggttggacaggatttttcattgttttacagttttgttggatgagtattttttggttagtattttgtgttattgacgtgtgtttcaagtgctttgcaagatcggataatttaagcggtgctaattttaaggtacccgtgttttttatttatacaacatgcgcattggcccgttgat

SEQ ID NO: 14265 - DNA, 1391 bp, Pinus taeda
accttgacttgagacccgttgagctgacacctattgttgctgatctcattaccttatttttttcaggcttttgcctttcaccttttgattttactgatgttttccctcagaaaatgtctttacaactacatcaagtcttgtaggtcctttctttgcaggaaaatgtttagtttaaagttaactgtaaatatctggtatttctatgttgttgatggattgatcaatattatttgtctattgatgcagtaagcttcagagtgatgcgttgagggaggccatctcccagatcatgggagatactaaggagaaacaacgtaaattcacagagacaattgagttacagattggcctcaagaattatgatcctcaaaaggacaagcggttcagtggctctgttaagttacctcacattcctcgccctaagatgaaggtttgcatgcttggagatgctcagcatgtggaagaggctgaaaaattaggcttggattatatggatgttgaaggactaaagaaaatgaacaaaaacaagaaattggttaagaaacttgcaaagaaatatcatgcctttcttgcttcagaagcaatcattaaacagatacctcggcttcttgggcctggtctcaacaaggctggcaaatttcctacccttgtatctcaccaagagtccctggagggaaaagtgaatgaaaccaaagcaactgtcaaatttcaattaaaaaaggttctatgcatgggggttgctgtggggaactgtggaatggaagaaaaacagatttttcagaatgtgcaattgagtgttaacttccttgtatcactactgaagaagaactggcagaatgttaggtgcctatatttgaagagtaccatgggaaagcctaaccgtgttttctgagtgtggatcagagttgagatattataatgacagtttatttttgtgtaactattaaacataggttatttttacttaatttctaccaaactaattgattttgatgcaaattttgaggaattgagaaatgtaagtgctggtaaattgctgttttgaacaacagaatttgtttttctattggaatagctcgggtcatggttttagactttaagcctgacattcaatgttctaaaatcatgttgtggtattgaagtctatctagattttttaatagtgacattattgttagagagccttttgttcaattggaaattatctcatgtaaggggattgtttcttgtgttcctgatatgcctatcttgtggcatcttggaattgtttctacaactataaaatctcaattttttttgaatgtaacttgtggcatcttggaattgtttctacaactataaaatctcaatttttttttgattgtaaagcaaattctgctgttctaacagaa

SEQ ID NO: 14266 - DNA, 857 bp, Chrysanthemum coronarium
ggaaaactctacagtcatgagtaagctttcaagtgaagccgtcagagaggcgattaccagcatcaccactgatgctaaggaaaagaaagtccgtaacttcactgagactattgaactccagattggtttgaagaattacgacccgcaaaaggacaagcgtttcagtggtaccgtgagattgcctaacattcctcgtcccaagttgaaggtttgcatgcttggagatgctcagcatgttgaagaggctcaaaaaattggtctagagtatatggatgttgaaagcttgaaaaagctgaacaagaacaagaagttggtgaagaagcttgctaagaaacaccaagcttttttggcttctgagtctgttatcaagcagattcctcgtttgttgggacctggtcttaacaaggctggtaagttccctacccttgtttcccaccaggaatctcttgaggcaaaggttaacgagaccaaagccactattaagtttcaacttaagaaggttctttgcatgggagtcgctgttggaaactgcagcatggaggagaaacagatcttccagaatgtgcaaatgagtgtcaacttcttggtttctttgttgaagaagaactggcaaaatgtgcgatgcctatacttgaagacaaccatgggaaagcctgttcgcatcttttaagaagtttatggattgttatgttttcattttggttaatgttatgattggtactggaaagtattccaatgaacaggaaatagtccttttggctggttacatgtttgtttggtactatatttttggacctcttactttagatgctatattatcgagttacttctgcttaagcgtatcagtatttttctga

SEQ ID NO: 14267 - DNA, 688 bp, Cyclamen graecum
tacccagattcgcaatgactccattgagaaagcgcgcaagttcaccgaaaccattgaacttcagatcggactgaagaactatgaccctcagaaagacaagcgtttcagtggttccgtgaagctgcctcacattcctcgccctaagatgaaggtttgcatgcttggtgatgctcagcacgtcgaagaggctgagaagatagggttggagtatatggatgtggaaggtttgaagaagcttaacaagaacaagaagcttgttaagaaacttgccaaaaagtaccatgccttcttggcatcagaagctgttatcaagcagattccccgtcttctaggccctggtctgaacaaagcagggaagtttcctactctagtcagtcaccaggaatctctggagtccaaagtcaatgagactaaagcgacagttaagttccaacttaagaaggttctgtgcatgggagttgctgtgggaaactgcagtatggaggaaaagcagatcttccaaaatgtgcaaatgagcgtcaatttcctagtttctctgttgaagaaaaactggcaaaatgtgcgatgcttgtatttgaagagtaccatggggagaccagtacgtgtgttttaaggaattccattatctttggtttttgcttagcgcctctttgagtattccgtagaagtgctgtcgtaactgagtaat

SEQ ID NO: 14268 - DNA, 780 bp, Avena sativa
ttcagcgaaaccattgagctgcagattggactgaagaactatgacccgcaaaaggataagcgtttcagtggctctgttaagcttcctcacatccctcgcccaaagatgagggtctgcatgcttggtgatgcccagcacgttgaagaggcagggaaaatgaacctagactatatggatgtggaatccctcaagaagatgaacaagaacaagaagctagtcaagaagcttgcaaagaaatatcatgcttttcttgcatctgaggccatcattaagcagattccccgacttcttggacctggtcttaacaaggcaggaaaattcccaactctggtgtcccatcaggagtccctcgaagccaaggttaatgagacaaaggctacagtgaagttccagctgaagaaggtgctctgcatgggtgttgccgttggccacatgggtatggacgagaagcaaatcttccagaatgtgcagatgagcgtgaatttccttgtttctctgttgaagaagaattggcaaaacgtgaggtgcttgtacctgaagagcacaatgggaaagccgcaccggttgttctagacctgtcttatctctttaggcttctaggatatccaggaggttgacagcttgagaacttttgttgttctcagttaccaaattttcgtgaggcaagtgacgattaaagaaaacagtctgaaatattccttcttgtactgagatggtcagttctctcctgctggaacttcatgatattctatccattgagatgctctcaaggtctttact

SEQ ID NO: 14269 - DNA, 880 bp, Panicum virgatum
gacacctgccctctgcttttttgcagtaagttgcaaactgaggtcctcaaggatgccatctcccaggtcgtgtcggaggcaagggagaagaacaggaagttcacagagaccatcgagctccagattggactgaagaactacgatccgcaaaaggacaagcgtttcagtggctccgtcaagctgccccacatccctcgccccaagatgaaggtctgcatgcttggtgatgcccagcacgtggaggaggctgagaagatcggtcttgattacatggatgttgaagctcttaagaagatgaacaagaacaagaagcttgtcaagaagcttgctaagaagtaccatgctttcttagcttctgaggctattatcaagcagattccccggctccttggtcctggtctcaacaaggcaggcaagttcccaactttggttactcaccaggaatctctggaatcaaaggtgaatgagacgaaagctacagtcaagttccagctcaagaaggttctttgcatgggtgtggcggtgggcaacctgtcgatggaggagaagcagatccagcaaaacatccagatgagcgtcaacttcctggtttcattgcttaagaagaattggcagaacgtgaggtgcctgtacatcaagagcaccatggggaagccaaatagggtgttctaagttgctgcatccatgcccgtttaaaacgactccgtagtctgtagtggagtttgctatgggattatttgtttatgcagtaatctatcgtaccgttttgcaaattttgtgcctgaagtaagagtggatttgtgatacactgtttttcaccttgccccttgagctgacgggacaatgtgcatcaagctacgctgctgctgttggcatagtt

SEQ ID NO: 14270 - DNA, 669 bp, Cyclamen graecum
tacccagattcgcaatgactccattgagaaagcgcgcaagttcaccgaaaccattgaacttcagatcggactgaagaactatgaccctcagaaagacaagcgtttcagtggttccgtgaagctgcctcacattcctcgccctaagatgaaggtttgcatgcttggtgatgctcagcacgtcgaagaggctgagaagatagggttggagtatatggatgtggaaggtttgaaaaagcttaacaagaacaagaagcttgttaagaaactcgccaagaagtaccatgcctttttggcatcagaagctgttatcaaacagattccccgtcttctaggccctggtctcaacaaagcagggaagtttcccaccctcgtcactcaccaggaatctatggagtctaaagtcaatgagactaaagcgactgttaagttccaactgaagaaggttctgtgcatgggagttgctgtgggaaactgcagtatggaggaaaagcagatcttccaaaatgtgcaaatgagcgtcaatttcctagtttctctgttgaagaaaaactggcaaaatgtgcgatgcttgtatttgaagagtaccatggggaagccagtgcgcgtgttttaagtacttgcattatcttagttttgcttagtaactctgcctattttggagaagtgttt

SEQ ID NO: 14271 - DNA, 655 bp, Brassica juncea
cgcaaggagagaatcgtagctgaggaagtgccaaaatgagtaagctccagagtgaagccgtgaaagaggcgatatcatccatcatcactcactgcaaggagacaaagcctcgcaagttcaccgagactatcgagctccagattggtctcaagaactatgaccctcaaaaggacaagaggtttagcggttccgttaagttgcctcacattcctaggcccaagatgaagatttgcatgctcggtgacgcccagcacgttgaagaggctgagaagattgggttagagtctatggatgtggaagctcttaagaagctgaacaagaacaagaagcttgttaagaagctcgccaagaagttccatgctttccttgcttctgaatccgtcatcaagcagattccacgtcttcttggtcctggtctcaacaaggcaggaaagttcccaactcttgtgagccaccaagagtctttggaggccaaagtgaatgagacaaaggcgacagtgaagttccagctcaagaaggttctctgcatgggtgtcgctgttgggaatctcggcatggaagagaagcagatcttccagaatgttcagatgagcgtcaacttccttgtttcactcttgaagaaaaactggcaaaatgtgcggtgcttgtacctgaa

SEQ ID NO: 14272 - DNA, 979 bp, Juglans hindsii x Juglans regia
ggggaggtagagttcctctttcttttggacctctggtcctatctccacccgcaaccgcaacagtaggaaaagctgttagtgggtctgtgaaagtaggccttcaaaattcgaacatgagtaagcttcacagtgatgccgtacgagaggccatctctactctctttactggatccagagagaagaagcgtaatttcactgagactgttgagctccagattgggctaaaaaattatgatccccaaaaggataagcgattcagtggttctgttaagttgccacatattcctcgtccaaagatgaaagtttgcatgcttggagatgcacaacatgttgaagaggcagacaagattggcttagattatatggatgttgaagcattgaaaaagcttaacaaaaacaagaaattggttaagaagcttgccaagaaataccatgcctttctagcatccgaagctgtcattaagcagattccccgacttttgggccctggactcaataaggcagggaagttcccaactcttgttacgcatcaagaaacgatcgagtctaaagtaaatgagacgaaagctatggttaagtttcaattgaagaaggtgctttgcatgggagtggctgttgggaatgttgccatggaggagaagcaggtcttccaaaatgttcaaatgagtgttaatttccttgtttccttgttgaagaagaactggcaaaatgtgaggagcttgtctcttaagacaaccatggggagaccggtgcgcatatactgaggagttattggccaagggagttctgtaatactttcaagtttattttttttcccttccaattgtcacattttcttgctgtttagaggctgttttaccttttgttggttaaatgcgtagatgtcacacttcgttggagaagtgaggcctattttttcgttttcacttgcgccatgatgcgttgttgaatatcaagtccaaacgttttggcacttccg

SEQ ID NO: 14273 - DNA, 1115 bp, Populus trichocarpa
agaagttctcttccataaacctcacactccctagcagcgtctttctatttgccaggttccttcatttttgttctctggacaggactctgaagagggttgcttttagaggtttcagtcatgagtaagcttgcgggtgatacaattcgtgaagctgttacaactatcaaaaatggtgtgaacgataaaccacgcaagttcgtacagactattgagctacagattggtttgaaaaactatgacccccagaaggacaagaggttcagtggctctgttaagctgccacacataccccgccccaaaatgaaggtctgcatgcttggagatgctcagcatgtggaggaggcagagtcaataggcttgcaatggatggatgttgaagcactgaagaagctgaacaaaaacaagaaattggtgaagaagctttcaaaacagtaccatgcctttttggcatcagagtccgtaatcaagcagattccccgtcttttaggccctggcctcaacaaggcaggaaagttcccaacccttgtgactcatcaagagtcgctagagtctaaggtcaacgagatcaaggcaaccgtcaagtttcaattgaagaaagtgctgtgcatgggtgttgctgttggtaactgcggtatggaggacaagcagatcttccagaatgtgcagatgagtgtcaatttccttgtctcacttttgaagaagaattggcaaaatgtgaagtccctgcacctaaagagtaccatgggaacaccagtccgcctctactaagcgagttctactatacagcgttatagttctggaatgctttctgaacagagcttatgattgttttcggaaatatgaaatttatgtcgttggatttttccttgcatttttcttgaatgcttagcatttttgtgaagtctgatttgtccatagatcatcacagccttaatgatctcattgcctggtttgtgacttggcttatcttggtggctactgttagcctagttttgacgtaattagcataatgttatatttctcggttcgaatgtcttcgatccttcatcatcaactgataataggtttttttgattttttttttaatgaaaactctacattcgaagttaccttgt

SEQ ID NO: 14274 - DNA, 1026 bp, Castanea mollissima
aaatctgctagtgggtgtttggaaacaagagagtttcaaagatgagtaagcttcagagtgatactctaagagaggctatctccactctttttactggatccaaagataagaagagaaatttcactgagaccattgaactacagattggattgaaaaattatgatccccagaaggataagcgtttcagtggttctgttaagttgccacacatccctcgcccaaagatgaaggtttgcatgcttggtgatgctcagcatgttgaagaggctgagaagatgggtttagattacatggatgttgaagcattgaagaagcttaacaaaaacaagaaattggtcaagaaacttgccaagaaataccatgcttttttggcatcagaatctgtcattaagctgatcccccgtcttttgggccctggtctcaacaaggcaggaaagtttccaactcttgtcacacatcaagaatccatcgattctaaagttaatgagacaaaggctatggttaagttccaactgaaaaaggtgctttgcatgggagttgcagtgggcaatgttgctatggaagagaagcaggtcttccaaaatgttcaaatgagtgttaatttcctcgtttcgctgttgaagaagaactggcagaatgtgaggagcttgtcgctgaagactaccatggggaggccagtgcgcgtatactaaaatcttttggcaagggaattttgtaggcgagctgtaattcttataagggtgctttgaatggtcaagttttcttgttggttggctattttacctttttactgttctctgaattcttagatgtcatggccctagaattgttttggaatgtttgactgagagttgaaccaagttttcattttcactggccctataatacattgatgaatattaggtcttatatatgttgcgatccaagctggagtgaaatcgatggtaaatttaattatgtggatgataaattgctctcattaaatacttgaagtctggcagggtgtgaaaatgtggactagaatta

SEQ ID NO: 14275 - DNA, 1110 bp, Populus trichocarpa
ttttcctatacagacagttccagtccattaaaagtggctagctagggttttattagctccaaagatctctccaagacattttgcacactctctagccgttaccttctcttctccaagttcctccatttttgttctttggacaaaactctgaagagggttgctttaagaggtttcaatcatgagtaagcttgcaggggatacaattcgcgaagctgttacaactataaaaaatggtgtgaatgagaagccccgcaagttcgtccagaccatcgaactacagattggattgaaaaactatgacccccagaaggacaagaggttcagcggctctgttaagttgccgcacataccgcgtcccaaaatgaaggtctgcatgcttggagatgctcagcatgtggaggaggcaacttctataggtttgcaatggatggatgttgaagcattgaagaagctgaacaagaacaagaaattggttaagaagctttccaagcagtaccatgcctttttggcatcagagtctgtcatcaagcagattcctcgtcttttaggccctggtctcaacaaggcaggaaagtttcctaccctcgtgactcaccaagagtcactggagtctaaagttaatgagatcaaggcaaccgtgaagtttcaattaaagaaagtcctttgcatgggtgttgctgttggtaactgcgacatggaggataagcagatcttccagaatgttcaaatgtctgtgaacttcctggtctccttgttgaagaaaaactggcaaaatgtgaagtcgctgcacctaaagagtaccatgggtaccccagtccgcctctattaagctagttctaaactaccgctatgtttttggaatgcttagaaatgtcacccctttccttaaataactatattgttttttgagagatgaaattatgttcatggatttgttcttaattttttttttaatgcttaacccttaaatcagacctgttatgttgatagcattgcttcccttgaaatgtttaatgcctgtgggaaagccaactgcagaaagaaaaacgcaagtgtcaaacttgcctgagatgaatctgcctttgctttatatatagatggtaaaatagg

SEQ ID NO: 14276 - DNA, 798 bp, Chrysanthemum coronarium
cagagaggcgattaccagcatcaccactgatgctaaggaaaagaaagtccgtaacttcactgagactattgaactccagattggtctcaagaactacgacccacaaaaggacaagcgtttttctggtaccgtcaggttgcctcacattccacgtcctaagttgaaggtttgcatgcttggagatgcgcagcatgttgaagaggctcaaaagattggtcttgagtacatggatgttgagtcactcaagaagcttaacaagaacaagaagcttgttaagaagcttgcaaagaagcaccaggcttttttggcctctgagtctgtcatcaagcagattcctcgtttgttgggacccggtctaaacaaggctggtaagtttcctactcttgtcagtcaccaggaatctcttgaggctaaggtgaatgaaaccaaggcaactgtcaagtttcagttgaagaaggtgttgtgtatgggagttgctgttggtaactgcagcatggaggagaagcagatcttccagaacgtgcaaatgagtgtcaactttcttgtttcgttgttgaaaaagaattggcaaaacgtaaggtgtttgtacttgaagacaacaatgggaaagccagttcgtatcttttaggtgctttctttggtttttgattttgttgttgggagattagtacttgaaagcttttgccgataatgggggctgtcgtttttgaatttttggatgtttgtttttctattgtattagatgatgccatagacaatatgtttaatggttgccaagctattatctttactatctgt

SEQ ID NO: 14277 - DNA, 730 bp, Panax ginseng
agtaaacttcagagtgatgcccttagagaagcccattcactcagatttctaatgaggccaaggagaaaaagcgtaatttcactgagaccattgaactccagattggtactgaaaaactatgatcctcagaaggataagcgtttcagtggttctgtgaagttgcctcacatccctcgtcctaagatgaaggtttgcatgcttggtgatgctcagcatgtggaagaggctgagaaaattggtctggaatacatggatgtggaaggcctgaagaagcttaacaagaacaagaagttagttaagaaacttgctaagaaataccatgctttccttgcttctgaggccgtcattaagcagattccccgtcttttgggtccagggcttaacaaagcaggtaagttccctacactagttacccaccaggagtccctcgagtctaaagttaatgagacaaaggcgacagtaaagttccaactgaagaaggtgctctgcatgggagttgctgttgggaacctcagtatggaggagaagcaaatcttccaaaatgtgcagatgagtgtgaatttcctggtttcattattgaagaagaattggcaaaatgtcaggtgcttgtacctaaagagcacaatgggaaagactgtccgcatcttttaaggagttgtcttctttttggttgaagctttttagcaaagtcagtgtatgaggatgatattttcccaaaaattccctacag

SEQ ID NO: 14278 - DNA, 664 bp, Lolium multiflorum
ccgccgccgccgcaccctcgacagaatccggcgtcgactgatcggcggcaaccatgagtaagctttcaagtgatgcggtcaaggaggccatcgccctgattgttggggaggccagggagaagaagcgcaagttcactgagactgttgagcttcagatcggtctcaagaactacgacccgcaaaaggacaagcgtttcagtggctctgttaagctgccccatatcccccgcccgaagatgagggtgtgcatgcttggtgatgcctcgcatgtcgaccaggctgagaaattgggccttgactccatggatgttgaaagtctcaaaagatgaacaagaacaagaagcttgttaagaagctagccaagaagtaccatgctttcttagcatctgaggccatcatcaagcagatcccccgtctccttggacctggtctcaacaaggcaggcaagttccccacactggttagtcactctgagtctcttgaggccaaggtcaacgagacaaaagctacagtcaagttccagctgaagaaggttctttgcatgggtgttgctgtgggtaacttgtccatggacgagaagcagattcaacagaacctccaaatgagcgtcaacttccttgtgtcccttctgaagaagaactggcagaatgtgaggtgcctgtac

SEQ ID NO: 14279 - DNA, 749 bp, Musa acuminata
atgaaattgaaagacttcaaaccgaaccaacccacccaaaccttcctgcaaactgttgaaagcatatatcgtgtccccgccgccgcgtctgcccttcccctcactctcgctgtctcggatcggaggaggggaccgatacacatccgaacaatgagcaaattgcagagtgatgttttgagggaagcaatctcccaggttgttggtgattctcgggagaagaaacgaaaattcactgaaacagttgagttgcaaattgggctgaaaaactatgatcctcaaaaggacaagcgattcagtggatccgtgaaactacctcacattccacgtccgaaaatgaaggtctgcatgcttggagatgctcaacatgttgaggaggcagagaaaattggccttgattatatggatgttgaaagtttgaaaaagatgaacaaaaacaagaagctggttaaaaagcttgcaaagaaataccatgctttcctagcatcagaggccatcatcaaacagatccctcgtcttcttggccctggtcttaacaaggcagggaaatttcccacattggttactcaccaagaatctctagaggctaaagttaacgagacaaaagcaatggtgaaatttcaactcaagaaagttctttgcatgggcgtggcagtgggtaactgtgccatggaggagaagcagatctttcagaacgttcaactcagcgtaaatttcctcgtgtctttgctgaagaagaattggcaaaatgt

SEQ ID NO: 14280 - DNA, 1263 bp, Populus trichocarpa
attacttccaatgctctctcaacaaatataaatccacactccatagccgctttcttctcatcgccaggttccttcatctttgttctctgggaaaaactctgaagagagttcctttaagaggtttccaacatgagtaagctttcaggggatacaattcgtgaagcggttactactatcaaaactggtgtgaatgagaagcctcgcaagtttgttcagaccattgagctacagattggattgaaaaattatgacccccagaaggacaagaggttcagtggctctgttaagttgcctcacattccccgtcccaaaatgaaggtctgcatgcttggagatgctcaacatgtggaggaggcaacatctataggcttgcaatggatggacgttgaagcattgaagaagctaaacaagaataagaaattggtcaaaaagctttccaagcagtaccatgcctttttggcatcagagtctgtcatcaagcagattcctcgtcttttaggccctggtctcaacaaggcaggaaagtttcccaccctcgtgaatcaccaagagtcattggagtctaaagttaatgagatcaaggcaacagtgaagttccaattgaagaaagtcctttgcatgggggttgctgttggtaactgcgacatggaggataagcagattttccagaatgttcaaatgtccgtgaacttccttgtttctttgttgaagaaaaattggcaaaatgtcaagtccctgcacctaaagagtaccatgggcacaccagtccgcctctactaagcgagttctatattacgacattttagttttggaatgctgagaaatgtcatcccttttctgagcagagcttataattgttttctgaaagatgaaattatgtccttggattttatcatttcatttctttcttgttttgaatgcttagcctttaatccagacctgttatgcttgatagatgtgaaccttttttcccttgaaatctttagtgttgtgggatgtatcttggtattgattgtcctggtcaggcttctttttcacgctgcagtttgctttgccagtgtctttagggacgatgcttcttgtgctcaattcagaagataaaagtgaggtgattgagatagtgcaagatgttttttaaaataatatttttttttaattagtatatatttaaaacaaaaaaatttaaattttttaagaaacactgttgaactgtactatcaaacatctttaaaatagatacttaaaaaaaatatcggtttatat

SEQ ID NO: 14281 - DNA, 963 bp, Zostera marina
gtgtaactgattggattgcatttgataggttgattctagttttcgaaacatgagtaagttgcagagtgatgttttaagggaagcaatctccacaatcgttgctggttgtcgtgaaaaacagcgaaattttcaggagaccattgagcttcagattggtttgaagaactatgatcctcaaaaagataagcgtttcagtggatcggttaaattaccacatattcctcgtccaaaaatgaaagtgtgcatgcttggagatgcccagcatgttgatgcgtcgtcaaaaattgatttgccttctatgagtgttgaagatctcaagaaattcaacaaaaataagaagttggtcaaaaagctctcaaagaagtatcaggcatttctagcttctgaatctgtcattaaacagattcctaggcttcttggtcctggactcaacaaggcaggaaagtttccaactcttgtttctcatcaagaatcacttgagggaaaactcaatgagatcaaagcaactgtgaagtttcagctgaagaaggttctttgcatgggtgttgctgtgggcaatgttggtatggatgagaaacaaatcttccagaatgttcagctatccatcaatttcttggtttctttactgaagaaaaattggcaaaatgttaagtgtttgcatctaaagagcacgatgggaagtcctgtgcgtctgttttaatttaaaaaccagtgttctacattatcatctccttccctccttttaaattttattttaagaacagtgaattgttaatcaaattttggctgtcgttttcagtgaaaccttgttgaatggattttttgcttgttttgcattccttgttaacactttaagtttaatcaaattcataatctattagcaatttttagttattcttgccaatgttaatatttttaggaaaaataatgtatttgagtttcacaacttgtttcggtaaaagt

SEQ ID NO: 14282 - DNA, 1086 bp, Populus trichocarpa
atatttatacaccttccttcagccaactgctctctggctagggtttcttcgtctttcggaaagaaaggaataaagaaagaaatcctgagagcccttgttgaaatcttggaacatgagtaagcttgcgggggataccatcagagaagctgtgacaaccataaagaatggtgtgaatgagaagccacgcaagttcacccagaccattgagcttcagattggcttgaaaaattatgacccacaaaaggataagcggtttagtggctctgttaagttgccccacattcctcgtcccaaaatgaaggtttgcatgcttggagatgctcagcatgtggaggaggcagtgtcaataggcttgcaatggatggatgttgaagcactgaagaagctgaacaaaaacaagaaattggtcaagaagctttcaaagcagtatcatgcctttttggcctcagagtctgtcatcaagcagattccccgtctcttgggccctggcctcaacaaggcaggaaagttcccaacccttgtgactcaccaagagtcgctagagtcaaaggttaatgaaatcaaggcaactgtgaagtttcagttgaagaaagtgttgtgcatgggtgttgctgttggtaactgcgatatggaggacaagcagatcttccagaatgtgcagatgagcgtcaatttccttgtctcacttttgaagaagaattggcaaaatgtcaagtccctgcaccttaagagtaccatgggaactcctgtccgcctttactaaggagttctaagcaaccatagttttgtaagaagagaagagtctaccatgagcagaactgagaaatgttatctttgaacattaggattttatgtttctggattttattttttttaatgcttcttatttttatgattaccagaattgtatgaagtttttgctgaatagatgtgaactttgttttcttttgaatgattcatgttttgcctgacatatcttggagatgtccctggcatacacagaattaaacgtttggtttgactacacagccatttggccactattgtatgttcttacctgagtttctttcactcgaaatttctcta

SEQ ID NO: 14283 - DNA, 810 bp, Chrysanthemum coronarium
cagagaggcgattaccagcatcaccactgatgctaaggaaaagaaagtccgtaacttcactgagactattgaactccagattggtctcaagaactacgacccacaaaaggacaagcgtttttctggtaccgtcaggttgcctcacattccacgtcctaagttgaaggtttgcatgcttggagatgcgcagcatgttgaagaggctcaaaagattggtcttgagtacatggatgttgagtcactcaagaagcttaacaagaacaagaagcttgtgaagaagcttgccaagaagcaccaagcgtttttggcctctgagtctgtcatcaagcagattcctcgtttgttgggacccggtctaaacaaggctggtaagtttcctacccttgtcagtcaccaggaatctcttgaggctaaggtgaatgagaccaaggcaaccatcaagtttcagctgaagaaggtgttgtgtatgggagttgctgttggtaactgcagcatggaggagaagcagattttccagaacgttcaaatgagtgtcaactttcttgtttcattgttgaaaaagaattggcaaaacgtaaggtgtttgtacttgaagacaacaatgggaaagccagttcgtatcttttaggtgctttctttggttttcgattttgttgttgggagattagtacttaaaagctttttccgataatggtggctgtcgtttttgaattttgggatgtttgtttttctattgtgttagatgatgatgctatagacaatatgtttaatggttggcaagttattatcattactatccgtcttcctatc

SEQ ID NO: 14284 - DNA, 812 bp, Chrysanthemum coronarium
gcaattactcagatcaccaccgatgccaaggagaagaaggttcgtaactttgttgagactattgaacttcagattggtttgaagaattatgacccacaaaaggacaagcgtttcagtggtaccgtcagattgccccacattcctcgtcccaagttgaaggtttgcatgcttggagatgctcagcatgttgaagaggctcaaaaaattggtcttgagtacatggatgttgaatcactcaagaagcttaacaagaacaagaagcttgtgaagaagcttgccaagaagcaccaagcctttttggcatctgagtctgttatcaagcagattcctcgtttgttgggacccggtctaaacaaggctggtaagtttcctactcttgtcagtcaccaggaatctcttgaggctaaggtgaacgaaaccaaggcaactgtcaagtttcagttgaagaaggtgttgtgtatgggagttgctgttggtaactgcagcatggaggagaagcagattttccagaacgtgcaaatgagtgtcaactttcttgtttcgttgttgaaaaagaattggcaaaacgtaaggtgtttgtacttgaagacaacaatgggaaagccagttcgtatcttttaggtgctttctttggtttttgattttgttgttgggagattagtacttgaaagcttttgccgataatgggggctgtcgtttttgaatttttggatgtttgtttttctattgtattagatgatgccatagacaatatgtttaatggttgccaagctattatctttactatctgtcttcttatcataacgtttggc

SEQ ID NO: 14285 - DNA, 631 bp, Brassica juncea
ccaatcaagggcaaatctgaggacaagaagcgtaactttgtggagacggttgagcttcagattggtctgaagaactacgacccgcaaaaggacaagcgcttcagtggatctgtcaagctcccgcacattcctcgccctaagatgaaggtctgcatgcttggagatgctcagcatgttgaagaggctgagaagatggggctagactctatggatgttgaggctttgaagaagctcaacaagaacaagaagcttgttaagaagcttgcaaagaagtaccatgctttcttggcttctgaatctgttatcaagcagattccccgtcttcttggtcctggtcttaacaaagcaggaaagttcccaacactagtgagtcaccaagagtcgttggaagggaaggtgaatgagaccaaagcgacagtgaagttccagttgaagaaggttttgtgtatgggtgttgctgttggtaacctttccatggaggagaagcagctctttcagaatgttcagatgagtgttaacttccttgtctcgctgttgaagaagaattggcaaaacgtaaggtgtttgtacttgaagagcaccatgggaccaccacaaaggatcttttgagctctctgctccaacatttgca

SEQ ID NO: 14286 - DNA, 688 bp, Leymus cinereus x Leymus triticoides
gacccgcaaaaggacaagcgtttcagtggttctgttaagcttcctcacatccctcgcccaaagatgagggtttgcatgcttggtgatgcccagcatgttgaagaggcagggaaaatgggcctagactgtatggatgtggaatcccttaagaagatgaacaaaaacaagaagctagtgaagaagcttgcaaagaagtatcatgccttccttgcatctgaggctatcattaagcagattccccgacttcttggacctggtcttaacaaggcaggaaagtttccaactttggtgtctcatcaggagtcccttgagtccaaggttaatgagaccaaggcaacagtgaagttccagttgaaaaaggtgctatgcatgggtgttgccgttggccacctgggtatggaggagaagcagatcttccagaatgtgcagatgagcgtgaacttccttgtctctctgttgaagaagaattggcaaaacgtgagatgcttgtacctgaagagcacgatgggaaaggtgtaccggttgttctagactctaggcttctaggatttccaggagattgacaacttgggaacttttgttgttttctcaattatcaaattttcgtgcgtgacgagtgacaattaagcagttggaattattgtcttgtactgagaatgtttgttctattgtctggaatttcatgcca

SEQ ID NO: 14287 - DNA, 937 bp, Avena sativa
cctcgcgccgccgccctcctccattcctcctcccccaaaccctaaaccaggtggatcggtgatcgtccgtcgtcggcaaccatgagtaagctgtcgaccgaggccctcaaggaggccatcacccaggtcgtgtccgaagccaaggagaagaacaggaagtttaccgagaccatcgagctccagatcggcctcaagaactacgacccgcaaaaggacaagcgtttcagcggctccgtcaagctgccccatgtcccgcgccccaagatgagggtctgcatgcttggtgacgcccagcatgtgggggaggctgagaagattggtcttgattccatggatgttgaagctcttaagaagatgaataagaataagaagcttgtcaagaggcttgccaagaagtatcatgctttcttggcctcagaggctattctgaagccactcatcaagcacgattccccgtcctcctcggtcctcggtctcaacaaggcaggcaagttcccaccactggtgagtcactccgagtctcttgaagccaaggtcaatgagactaaagactacagtcaagttccagctgaagaaggttctgtgcatgggggttggctgtgggtaacttgtcgatggatgagaagcagatccaacagaacctccaaatgagcgttaacttccttgtgtcccttctgaagaagaactggcagaatgtgaggtgcctgtacgtgaagagcaccatggggaagcgtgtccgggtgttctaagttgtcttgctccagtgaagttgataagatactctgtactgtcaacctgagttcgtctttgttttagaatctgtttcactgatgccaattttgtgtctatctaagcgaatatcagcaaagcattctgtctctggtagtccttttgaacttgttgagaaatggaactgtatttctgttatgattttgaa

SEQ ID NO: 14288 - DNA, 735 bp, Guizotia abyssinica
atcggtgctgctgttagggtttctaccggagaattgaagtttaacgaaggaaaacctaacaaaaaatgagtaagcttcagagtgaagccctccgtgaagcgattactcaaattaccaccgatgccaaggaaaagaaacgtaacttcactgagaccattgagctccagattgggctcaagaactacgacccacaaaaggataagcgtttcagtggtaccgtgaaattgcctcacattcctcgtcctaaactgaaagtttgcatgctcggggatgctcagcatgttgaagaggctcaaaagatcggtcttgagtacatggatgtagagggactcaagaagctcaacaagaacaaaaagctggtgaagaagcttgctaagaaacaccaggcgtttttggcttctgaatctgttatcaagcagattccccgtttgttgggtcctggtttaaacaaggcaggtaaattcccgacacttgtttctcaccaggagtccctcgaggctaaggtgaatgaaacgaaggcaactgtcaagtttcagctgaagaaagtgttgtgcatgggagttgctgttgggaactgcagcatggaagaaaaacagattttccaaaacgtgcagatgagtgttaatttccctgttcgttgttgaagaaaactggcagatgtgcgatgttgtactgaagaacacatgggaaagcagtgcgctctttaggtgtcatctttgttttgctgagtcagtc

SEQ ID NO: 14289 - DNA, 628 bp, Euphorbia peplus
ttcagtctcttccgctgaaacactcatccaatcatgagtaagcttcagagtgatgcattgagagaggcaatcactacaatcacaacttcttctaaagagaagaagcgcaatttcactgagacaattgagctccagattgggctgaagaactatgatccccaaaaggacaagcgtttcagtggctctgtgaaattaccacacattccccgcccaaagatgaaaatttgcatgcttggagatgctcagcatgttgaggaggctgaagcaattggcttgcaatggatggatgtggaagcactcaaaaagcttaacaagaacaaaaaacttgttaagaaacttgctaagcagtaccatgcctttttggcttcagaatctgtcatcaagcagattccacgtcttttgggccctggtctgaacaaggcaggaaagttccccacacttgtgactcatcaggagtccttggagtcaaaggtcaatgaaacaaaagccacagtgaagtttcaattgaagaaggtgctatgcatgggagttgctgttggaaactgtgccatggaggagaagcaaattttccagaacgttcaaatgagcgtgaactttctcgtctccttactgaagaagaactggcaaa

SEQ ID NO: 14290 - DNA, 671 bp, Centaurea maculosa
agtgaagccctccgtgaagccattacccagattactactgatgctaaggaaaagaagcggaattttaccgagaccattgagctccagattggtctcaagaactacgacccacaaaaggataagcgtttcagtggaaccgttaaattgcctcacatccctcgtcccaaattgaaagtttgtatgcttggagatgcccagcatgttgaagaggctcagaagattggtcttgaatatatggatgttgagggtctgaagaagttgaacaagaacaagaagttggtgaagaaactggcaaagaagcaccaagctttcttggcttctgagtctgtcatcaagcagattcctcgtttgttgggacccggtctaaacaaagcaggtaagttccctactcttgttacccaccaagaatccctcgaggctaaggtgaacgagaccaaggcaaccgtgaagtttcagctgaagaaggtgctctgcatgggagttgctgttggtaactgcagcatggaggacaaacagatattccagaacgtgcaaatgagcgttaactttcttgtttctttgctgaagaagaattggcaaaacgtgaggtgcttatacttgaagacaacaatgggaaagccgagtgcggatcgttttagaagtagtttatttgttgttttctagtttgggtt

SEQ ID NO: 14291 - DNA, 1423 bp, Cenchrus ciliaris
actagttctctctcatagagggagggccggcggcgccaggccggcccggtggatgaggcggctatttgcaagcatttcttatcttgttctttgcacgatttatctcactgtctgaaccccttattagatcgtacatttgctatccatatttttgttattagttgtcatgtgcgtccttgctgcaagatttcaatggaagttttcccattggcagtagctaatagttatggtgtatgttgatctatcgtagaatttcacgtgccaaattaggtgtgccttgtgctttgtatgttacaagtccaacaataaaagcgacggacgcacaacacaactataaatctgtaactgagggcaaatgtctatgtataccacctcgtctgatgtgttcagggatgagcttcctatgcatcatctttttaaccaacctatcctgatgtttcgttaatctggaccttgggtatagatagtttgtctatttcaatcctttgtattccatggaattgatgtgttcagaaatgctattccaagattttgttgatccaatcaaaatacctaagaattccagtatgcaattaaatgtatcttgtttttatttcagtaagttgcagagtgacgttctgagggaggcgatcgcctcagttaccaacgatgcccgtgaaaagcagcgcaagtttgttgaaaccattgagctgcagattggactgaagaactatgatcctcaaaaggacaagcgtttcagtggttctgttaagctgcctcacatccctcgacccaagatgaaggtttgcatgcttggtgatgctcagcatgttgaggaggcagcgagaataggtctggacagtatggatgtggaagccctcaagaagatgaacaaaaacaagaagctagtcaagaagcttgcaaagaaataccatgctttccttgcatctgaggccatcattaagcaaattcctcgtcttcttggacctggtcttaacaaggcaggaaagttccctactttggtgtctcatcaggaatcccttgaatccaaggttaacgagactaaggctacagttaagttccagctgaagaaggtgctttgcatgggtgttgctgttggcaactgtggcatggacgagaagcaaatcttccagaatgtgcaaatgagcgtcaacttccttgtgtcactcttgaagaagaattggcagaatgttagatgcctgtacctgaagagcactatgggaaaggtgtacaggttgttctaaatctttatcttaggcttgtagaatttccagaagactttactggggtgcttcgatattttctcaaccaccaatcttttgtgcaactttattgaggattaaggagttaaatccctattctcttgagatgttttcgttcttgttatcgaacctatggcaatatcttatatcaacatttttgt

SEQ ID NO: 14292 - DNA, 889 bp, Nicotiana benthamiana
atcctctaattagtttgcagccgacttctcatcttctcctttgagccatgagtaagcttcagagtgatgccctaagagaagccatcactgtaattaagagtgcttcaaatgagaagaaaaggaagttcactgaaaccattgagctccagattgggctgaaaaactatgatccgcaaaaggacaagcgtttcagtggttcagtcaagttgcctcacattcctcgccctaagatgaagatttgcatgcttggagatgctcagcatgttgaagaggctgaaaagattgggttggagtacatggacgtggaaagcctgaagaagcttaacaaaaacaagaagttggttaagaagctagcaaagaaataccatgcttttttggcatcagaagctgttataaagcaaatcccccgtctcttgaggcccggcttgaacgaagccggtaaatttcgtagccttgttagccaccaagaatcgctcgaatctaaggttaacgagaccaaggccactataaaattccaattgaagaaggtgctttgcatgggagttgctgttggtaatatggatatggaggagaaacaaatcttccagaatgtgcagatgagtgtcaactttcttgtgtccttgcttaaaaagaactggcaaaatgtgagatgcctgtacttgaagagtaccatgggaaagactcaacggcgtcttctaaaggaaattgcattacaatcttggcggtttctgcgttttgctttgtatgctctatagatactattgaaatttttggttagttgtgaacctggatattgtcttgaacttgatattagttttgtgatgattttattttctccttttaagatggtaccaccactctttctgttatatcatggtttgaatttctt

SEQ ID NO: 14293 - DNA, 1316 bp, Sorghum bicolor
gcttcgcatttggcatccacacccacatcgcctctcaactcccacgctttctctcgatctcgaagcgcagcagcggcaaccggcggccatggacgtgagcggtgccggagcgggcgggaaggcgaagaagggcgcggcggggcgcaaggctggcgggccgaggaagaagtcggtgtcgcgttccgtcaaggccgggctgcagttccccgtcggccgtatcgggcggtacctcaagaagggccggtacgcgcagcgcgtcggcacgggcgcccccgtctacctcgccgccgtcctcgagtacctcgccgccgaggtgctggagctcgccggcaacgcggccagggacaacaagaagacgcgcatcatcccgcgccacgtgctcctggccatccgcaacgacgaggagctcggcaagttgctggccggcgtcaccatcgcccacggcggcgtcctccccaacattcacagcgtgcttctccccaagaaggtggccgagaaggcggccaaggagcccaagtcgcccaagaaggccgccaagtcccccaagaaggcatagagtgctctccagtctcctctcttaagagggaggtccctacattaccattagcgccgtgctggtagattagatcatgtttagtgttactacctctgtaacgttcttgttcttgctgctaattggaatggtttgtctagtactagtacatctgtgcattttcgttggttggaacaagatttcaaaaacaaaagtttgcgacgggaatcttgttttacagaggtagagattgtcaatacagtttggattactgttgaaccactttaactttaaacaacatgagcagagacaatatcttccattcatgcttagaatgattctgagtttttccgtcttgtaatgttccttgcaccaactataaaactgaatcatattgatgttccatgctaagtaaggagctgaagataaggaacgccatgctgtatggataggatatatggtaaaagttgatttcttgactagttagttactagctaggagtgagccatctgaccctccaggttatttatgaactcctgtaataacattgacggctaaaaacatataataatagcttgagcatatcggattttagttgctctatgcttgaactggactgtactggatttttctaacctctatttgttgattaaacccaggagaagaatagaaaacgtagaacctggatttagtaactgagtctcatatctgaactgagaagaaactagatactttggtaggccagcatactcatgagtcatgactacacaaaagaagaagcttc

SEQ ID NO: 14294 - DNA, 828 bp, Sorghum bicolor
cggcatcaccagtcaccaccattcccaccactcaacttctcgcgcccagagcccccaaatttttctccactcgaccgcagcagcagcaagcagccatggacgccagcggagccggtggcaaggcgaagaagggggcggccgggcgcaaggctggcggccccaggaagaagtcggtgtcgcggtccgtcaaggccgggctgcagttccccgtcggccgcatcggtcggtacctcaagaagggccggtacgcgcagcgcgtgggcaccggcgcccccgtctacctcgcagccgtcctggagtacctcgccgccgaggtgctggagctggccgggaacgcggcgagggacaacaagaagacgcgcatcatcccgcgccacgtgctcctggccatccgcaacgacgaggagctcgggaagctgctggccggcgtcaccatcgcgcacggcggcgtcctccccaacatcaacccggtgctcctgcccaagaaggtggccgagaaggcggccagcggcggcagcaaggaggccaagtccccaaagaaggccgccaagtcccccaagaaggcttagaaagtagggagttcattagcgctgtgtaacatgttcgtgtttagatctgtggatgggatgtgttgtggtctagtttcctccctgtggcttatggtatgttcattttcattgagaagatcttcagaaatcagagctcgttgcatagtaatgttcacccacgaagttctgtttcctgctctgattttgcaattcgtcagtttgttgaatcagtaaatagatacgggaagtcatatctgaaatgaagcataacgtagcaaaa

SEQ ID NO: 14295 - DNA, 544 bp, Saccharum officinarum
atctcccaagacctcctctgaccgccatggattccaccggcgccggagcgggagggaaggtgaagaaaggagcgggcgggcgcaaggccggcgggccgaggaagaagtcggtgtcgaggtctgtgaaggccggcctccagttccccgtcggccgcatcgggcgctacctgaagaagggccgctacgcgcagcgcgtcggcaccggcgcccccgtctacctcgccgccgtcctcgagtacctcgccgctgaggttctggagctcgccgggaacgctgccagggacaacaagaagacgcgcatcatcccgcgccacgtgctgctcgcgatccgcaacgacgaggagctcgggaagctgctggccggcgtgaccatcgcccacggcggcgtgctgcctcaacccggttctgctgcccaagaagacggcggagaaggcgtccaaagtcgcccaagaagggcgccaagtcccccaagaaggcatagactgtccagccagatccaatgtttagcactaccttgtaccagtgatgcgtaggttgatgaatg

SEQ ID NO: 14296 - DNA, 898 bp, Sorghum bicolor
gtcatcacacgctctctcctgctccctcgcatccacagcctctcgagctcgaagcgccgcagcagcaccagcccagcagccatggacgtgagcggagccggatccggcgggaaggcgaagaagggcgcgggcgggcggaagaccggcggcgggccgaggaagaagtcggtgacgcggtccgtcaaggccgggctgcagttccccgtcggccgcatcgggcggtacctgaagaaggggcggtacgcgcagcgcgtgggcacgggcgccccggtctacctcgccgccgtcctcgagtacctcgccgccgaggtgctggagctggccgggaacgcggccagggacaacaagaagacccgcatcatcccgcgccacgtgctcctggccatccgcaacgacgaggagctcggcaagctgctggccggcgtcaccatcgcccacggcggcgtcctccccaacatccacagtgtgctcctgcccaagaaggtcgccgagaaggccgcggccgcggccaaggagcccaagtcgcccaagaaggccgccaagtcccccaagaaggcatagaggggcctccatggagatgttcagtagatctgtagtaggtctgtagatggcacggtctctgagctctagtgtcgtcgttgttgttggaactgcttagaaggtctgtgcattttggttggaaggtgatttcagaaatcagagagttttgtacttgcaaaatgttcttcgatttcagaaaccagatttacaatttgggtgcataaatcttcttgtagtagtctgacatacaaagcagtcacaaattgtgttcatttttgacagctaatggtcgaccaaattataggggatagcttagcacaagctcaagaacggttccctcaaaaaaaaaagaatggat

SEQ ID NO: 14297 - DNA, 791 bp, Setaria italica
gtcagcatctctcatccgcaggcctctcgtctccaactcacgcagcgcagcagcagccagccagccatggacgtcagcggagctggagccaccggcaaggtgaagaagggagcggccgggcgcaaggccggcggacccaggaagaagtcggtgtcgcggtccgtgaaggccggactccagttccccgtcggccgcatcgggcgctacctcaagaagggtcggtacgcgcagcgcgtcggcaccggcgctcccgtgtacctcgccgccgtcctcgagtacctcgccgccgaggtgcttgagctcgccggaaacgcggcgagggacaacaagaagacgcgcatcatcccgcgccacgtgctcctggcgatccgcaacgacgaggagcttgggaagctgctggccggcgtcaccatcgcccacggcggcgttctccccaacatcaacccggtgctgctgcccaagaaggtggcggagaaggcggccagcggcggcgccaaggaggccaagtcgcccaagaagggcgccaagtcccccaagaaggcctagagaggctctccattagtgctatgctgttggatgttcctgtttggtagatctgtagatgggatggcttctgatgtagtgtacttactgtggctttgtgatctgtgcatctagctggaagaagaattcagaaaccagagtttgttacttgcagagtgttatttgatgtttcgtttcgtgccccagatttgcaatcagggtccacataaatctgcttactgtagattagagtataaatgtgtaattgc

SEQ ID NO: 14298 - DNA, 770 bp, Setaria italica
ccactcaaactctcgcgcccagattccccaatttttctctcctccgaagctttcccgaagcgcagaagcgagcagccatggacgccagcggagccacggggaaggtgaagaagggagcggccgggcgcaaggccggcggacccaggaagaagtcggtgtcgcggtccgtgaaggctgggctgcagttccccgtcggccgcatcgggcgctacctcaagaagggccggtacgcgcagcgcgtcggcactggcgcccccgtgtacctcgccgccgtcctcgagtacctcgccgccgaggtgctggagctggccgggaacgcggcgagggacaacaagaagacgcgcatcatcccgcgccacgtgctcctggcgatccgcaacgacgaggagctcggcaagctgctggctggcgtcaccatcgcccacggcggcgtcctccccaacatcaacccggtgctgctgcccaagaaggcggccgagaaggcggccagcggtggcgcaaaggaggccaagtcgccgaagaaggccgccaagtcccccaagaaagcttagagagactccattagtggagccatgctgtaaaatgtttgtgtggtactagatctgtagatggggtggctcctgatgtggtgtcgttgtgtgtggctttgtgatctgtgtattcaactggaagaaattagaaattggagttccttacttgcttagtggtctttgatctgtgcatttttgttggaagattttcagaaatcagagctcgttacttgctatgtg

SEQ ID NO: 14299 - DNA, 728 bp, Zea mays
atcacacactcgactctcctctctcgcatccgcagcctttcgagctctactccaccccctcgatctcgaagcgcagcagcagcagtcaggcggccatggacgcgagcgcagccggagccggcgggaaggcgaagaagggcgcggccgggcgcaaggccggcgggccgaggaagaagtcggtgacgaggtccgtcaaggccgggctgcagtttcccgtcggccgcatcgggcggtacctgaagaagggccggtacgcgcagcgcgtcggcacgggcgcccccgtctacctggccgccgtcctcgagtacctggccgccgaggtgctggagctggccggcaacgctgccaaggacaacaagaagacccgcatcatcccgcgccacgtgctccttgccatccgcaacgacgaggagctcggcaagctgctgtccggcgtcaccatcgcccacggcggcgtcctccccaacatcaacccggtgctcctgcccaagaagaccgctgagaaggcggcggccaaggaggccaagtcgcccaagaaggccgccaagtcccccaagaaggcatagaggggcgggcgcctttaccgctgtgatgttgaatgctcgtgttcagtagatctttacgtctgtagtgtcgtcgttgttattggaactggttagtagatctgtgcattgtggttgaaacgtgattccctgatttcagaaatctaatttgcaatttgggtgcac

SEQ ID NO: 14300 - DNA, 756 bp, Beta vulgaris
atcacactcaaaattcttacacatacatacatacaatttttccagaaatataaacttcatttaggagagagaaaaaaacaacaatggatacagcaggtggtaaaggaaagaagggtgcagcaggaagaaagggtggaggtccaaagaagaaaccagtttcaaggtcagttaaagctggtttacaatttccagttggaagaattggtcgttatttgaagaaaggtcgttatgctcaacgtgttggtactggtgctcctgtttatttggctgctgttcttgagtaccttgctgctgaggtgttagaattggctggaaatgctgcaagagataacaagaagaacagaatcatcccaagacatgtgttacttgctgttcgaaacgatgacgagctcggaaagcttctagctggagttaccattgctcatggaggtgttcttccaaacataaatccagtgttgttgcctaagaaaactgcagagaaggcggcgaaagagcctaaatctcccaaggctgctaaatcccctaagaaagcttagagatgattaattttgtgtttattttagtttgtgtttttaatcaaatctttgtatgtaatgtcactagatgtttttaattaggcttttctctaaaacaaggataattcctgcctgattctttgggtggggtttctagttcagggttatattctgtgaattcaatcacaattactttgattgatttcactttctctgtaatgttgttaatcttaatcaaact

SEQ ID NO: 14301 - DNA, 490 bp, Cenchrus ciliaris
tcttctctccaactctcgcagcgcagcagcaaccagccagccggccatggacgttagcggagctggagccaccggcaaggtgaagaagggagcggcgggtcgcaaggccggcggacccaggaagaagtcggtgacccggtccgtgaaggccgggctccagttccccgtcggccgtatcgggcgctacctcaagaagggccggtacgcgcagcgcgtcggcagcggcgcccccgtctacctcgccgccgtcctcgagtacctcgccgccgaggtgcttgagctcgccggcaacgcagcgagggacaacaagaagacgcgcatcgtcccgcgccacgtgctcctggcgatccgcaacgacgaggagctcggcaagctgctggccggcgtcaccatcgcccacggcggcgtcctccccaacatcaacccggtgctcctgcccaagaaggtggcggagaaggcggccgccaaggaggccaagtcgcccaagaag

SEQ ID NO: 14302 - DNA, 1076 bp, Panicum virgatum
actcccacctgattggctgtgctgtccctctcgcggatcgcccctcagaaactcatccctgccgtccaaacccctcccgagctggccgtccatttcctcacccacggatcaccgggcccaccacctctccccatccccgccactccctttaaacacaacccctctaggcatttgggcggcatcacaccactcgaattctcgcgctcagattccccaattttccctcctccaaagctctcccgaagcgcggcagcggcgaccatggacgccagcggagccaccgggaaggtgaagaagggggcggccgggcgcaaggcgggtggccccaggaagaagtcggtgtcgcggtccgtgaaggccgggctccagttccccgtaggccgcatcgggcgctacctcaagaagggccggtacgcgcagcgcgtcggcaccggcgcccccatctacctcgcggccgtcctcgagtacctcgccgccgaggtgctggagctggccggcaacgcggcgagggacaacaagaagacgcgcatcatcccgcgccacgtgctccttgcgatccgtaacgacgaggagctcgggaagctgctggccggcgtcaccatcgcccacggcggcgtcctccccaacatcaacccggtgctgctgcccaagaaggtcgcggagaaggcggccagcggcggcgccaaggaggccaagtcgcccaagaagggcgccaaatccccgaagaaggcttagacagtagagactccagtagcactgtggtgtaacatgttggtgtttagatttgtggatgggttgtgttctggtctaatttcgtcgtggcttgtgatctgtgttcatcagtgagagattttcagaaatctgggctcgttagttactatatatgacctgtttcttgtccacatttgcaattcgggtggatatgtttgcggttcagtttagagtagtacggaatgagcagtgacaacaaccctgcgtcaaaagagggcaagaggctagaagtggcaagaaacatatagttcgattctgaaatcactgcctggtatctgattctgcacacagtataaggtcaagtt

SEQ ID NO: 14303 - DNA, 551 bp, Echinochloa colona
aacctcacaacgctcaaagttatcgcgcccagactccccaattttttcccctctccaaagctctctcgaagcgcggaagcagcagccatggacgccaccggagccggcgggaaggcgaagaagggagctgccgggcgcaaggcgggtggcccgaggaagaagtcggtgtcgcggtccgtgaaggccgggctgcagttccccgtcggccgcatcgggcgctacctgaagaagggccggtacgcgcagcgcgtcggcaccggcgcccccgtctacctcgccgccgtcctcgagtacctcgccgccgaggtgctcgagcttgccggcaacgcggcgagggacaacaagaagacgcgcatcatcccgcgccacgtgctcctggcgatccgcaacgacgaggagctcgggaagctgctggccggcgtcaccatcgcccacggcggcgtcctgcccaacatcaacccagtgctgctgcccaagaaggtggcggagaaggcggccagcggtgccaaggaggccaagtcgtccaagaagggcgccaagtcccccaagaa

SEQ ID NO: 14304 - DNA, 652 bp, Cenchrus ciliaris
gaagctttcgagcggagaatcagcagccatggacgccagcggagccactggcaaggtgaagaagggagcggccgggcgcaagacaggcgggcccaggaagaagtccgtgacgcggtccgtgaaggccgggctgcagttccccgtcggccgcatcgggcgctacctcaagaagggccggtacgcgcagcgcgtcggcagcggcgcccccgtgtacctcgccgccgtcctcgagtacctcgccgccgaggtgcttgagctcgccggcaacgcggcaagggacaacaagaagacgcgcatcgtcccgcgccacgtgctccttgcgatccgcaacgacgaggagcttggcaagctgctgtccggggtcaccatcgcccacggcggcgtcctccccaacatcaaccaggtgctcctgcccaagaaggtggcggagaaggcggctgccaaggaggccaagtcgcccaagaaggctgctaagtctcccaagaaggcctagagaggctctccatttagtgctttactgtatgctgtattgctgttcgatgttcctgtctggtagatctgtagttgggatggcttcttatctagtatagttactgtggctttgtgatctgcgcatgttgctggaagtctgaaatcagagtttgttactcca

SEQ ID NO: 14305 - DNA, 732 bp, Zea mays
atcacaattcactccactcatcttttctcgtttagaacctctaaaatttcccccactcgccagtcgcagcagcacctgtagcagtcatggacgccagcggagccggtagcaaggggaagaagggggcggccgggcgcaaggcaggcggccccaggaagaagtcggtgacgcggtccgtcaaggccgggctgcagttccccgtcggccggatcgggcgctacctcaagaagggccggtacgcgcagcgcgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatccgcaacgacgaggagctcgggaagctgctggccggcgtcaccatcgcgcacggcggcgtcctccccaacatccactccgtgctcctgcccaagaaggcggcggagaaggcggccagcggcggcagcaaggagcccaagtcccccaagaagggcgccaagtcccccaagaaggcttagaaagtagggtcttcatttgcgctgtgtgctgtagcatgttcgtgtctagatctgtggatgggatgtgtcctgctctagtatcgtccttgtgtcttattgtatgttcgtcttcatcgagaagatcttcagcagtcagagctcgttgtgtactaatgttcccccatgttctgtt

SEQ ID NO: 14306 - DNA, 658 bp, Cenchrus ciliaris
tctctcgagcccttccccctcgtcccgagaagccactcgaagcgcagccgctgccatggacgccaccggtaccggagctggcggcaaggtgaagaagggagcggccgggcgcaaggccggcggcccgaggaagaagtcggtgtccaggtccgtgaaggccgggcttcagttccccgtcggccgcatcgggcgctacctcaagaagggccggtacgcgcagcgcgtcggcagcggcgcccccgtctacctcgccgcagtcctcgagtacctcgccgccgaggtgcttgagctcgccggcaacgcagcgagggacaacaagaagacgcgcatcgtcccgcgccacgtgctcctggcggtccgcaacgacgaggagctcggcaagctgctggccggcgtcaccatcgcccacggcggcgtcctccccaacatcaacccggtgctcctgcccaagaaggtggcggagagggcggccgccaaggaggccaagtcgcccaagaaggctgccaagtctcccaagaaggcctagagaggatctccattagtgcttatgctgttcgatgttcctgtctggtagtagatctgtagatgggagggcttctgatgtatgtagtagtagtgtacttactgtggctgtgatctgtgcattttgctggaagaa

SEQ ID NO: 14307 - DNA, 694 bp, Cenchrus ciliaris
ctcttgagcccttcctcctcgtcccgagaagccactcgaagcgcagccgctgccatggacgccaccggtaccggagcgggcggcaaggtgaagaagggagcggccgggcgcaaggctggtggcccgaggaagaagtcggtgtccaggtccgtgaaggccgggctccagttccccgtcggccgcatcgggcgctacctcaagaagggccgctacgcgcagcgcgtcggcaccggcgcccccgtctacctcgccgccgtcctcgagtacctggccgctgaggttcttgagctcgccgggaacgctgccagggacaacaagaagagccgcatcatcccccgccacgtgctcctggcgatccgcaacgacgaggagctcgggaagctgctcgccggagtcaccatcgcccacggcggcgtcctccccaacatcaacccggtgctgctgcccaagaagacggcagagaaggcgtccagcggcgggagcaaggaggctaagtcgccgaagaaggccgccaagtcccccaagaaggcttagatggtggactcagatccgatgtctggcgccgtttcctgttacccgtggtgtttaggttgtagatgcgaggaagttggtgcatcgagatgaaccagtattgtaacttatgatctgtggttttcaatggaacaaatggctagtttaagttaaaaaaaaaaaa

SEQ ID NO: 14308 - DNA, 885 bp, Echinochloa colona
aagcccaaatttctcgcgcccagactccccattttttccccctctccaaagctcactcgaagagcggcagcagcagccatggacgccaccggagccggcgggaaggcgaagaagggagctgccgggcgcaaggccggtggcccgaggaagaagtcggtgtcgcggtccgtgaaggccgggctgcagttccccgtcggccgcatcgggcgctacctgaagaagggccggtacgcgcagcgcgtcggcaccggcgcccccgtctacctcgccgccgtcctcgagtacctcgccgccgaggtgctcgagcttgccggcaacgcggcgagggacaacaagaagacgcgcatcatcccgcgccacgtgctgctggcgatccgcaacgacgaggagctcgggaagctgctggccggcgtcaccatcgcccacggcggcgtcctgcccaacatcaaccccgtgctgctgcccaagaagaccgcctctgctgctgccaaggaaggcaaggagaagaagtcgccgaagaaggccgccaccaagtcgcccaagaaggcggctgctgcgtaggctccgggcaaatggtggtgtcctgtctctcgctctctccctgtccgctctgaactgaaatgttcctaattgtcatcatcgtcatgatcgttgctgcttgtcgtgtcgtggttatttgtgtgtaattgcgtgcctttcgcccaatcagcatgcactgtgtaggttgacactggtctagggttcgatctaaaagacactggtgtaggttcaatggagtgtgaaatgggatggggcagtggaggggtgggaactgtgaatcattaggtgctgtttgtaataagtttgtgaaggtgtgtaaaattatgggcctctattctgtgcttg

SEQ ID NO: 14309 - DNA, 699 bp, Setaria italica
cgcaatctcgcattcctccgatctctcgagcctttcctactcccgataagtcactcgaagcgcagccgctgccatggacgccaccggtaccggagcgggcggcaaggtgaagaagggagcggccgggcgcaaggccggcggcccgaggaagaagtcggtgtcgaggtccgtgaaggccgggctccagttccccgtcggccgcatcgggcgctacctcaagaagggtcgctacgcgcagcgcgtcggcacaggcgctcccgtctatctcgccgccgtcctcgagtacctggccgctgaggttcttgagctcgccgggaacgctgccagggacaacaagaagacccgcatcatcccccgccacgtgctcctggcgatccgcaacgacgaggagctcgggaggctgctcgccggagtcaccatcgcccacggcggcgtcctccccaacatcaacccggtcctgctgcccaagaagacggcagagaaggcgtccagcggcgggagcaaggaggccaagtcgccgaagaaggctgccaagtcccccaagaaggcttagagggtggactcagatccgatgtctggcgccgtttcctgttacctgaggtgtttaggttgtagatgcggggaaagtggtgcttggagatgaaccagtcttgtaacttatgatctgtgtttttcaatggaagaaatgcctagtttaag

SEQ ID NO: 14310 - DNA, 687 bp, Avena sativa
gaccaactcactttgcaattcccaatctttcccaatctgcaaactcctctgtcctctgaatctcagcagcccggcatggacgtctcaagcacagcaaccggcgggaaggcgaagaagggagcggcaggtcgcaaggccggcggccccaggaagaagtcggttactcgctctgtcaaggcggggcttcagttccccgtcggtcgcgtcggtcgctacctcaagaagggcaggtacgcccagcgcgtcggcaccggcgcccccgtctacctcgccgccgtcctcgagtacctcgccgccgagctgctggagctggcaggtaacgccgccaaggacaacaagaagtcgcgcatcatcccgaggcacctgctgctcgctgtcaggaacgacgaggagctcggcaagctgctcgccggagtcaccattgctcacggcggcgtgctgcccaagatcaacccggtgctcctccccaagaagacggccgagaaggcggccaaggagcccaagtcaccgaagaagacagccaagtccccgaagaaggcatagagattactagttgaattcctttgtttgtagtagctgggattgatgggtgtccttcagagtagaatgttgttgtttgaaagttctctggtggtgccgctgtaccttcagatctgtaatttcaatggaacaatgagatgcttagat

SEQ ID NO: 14311 - DNA, 677 bp, Avena sativa
gaccacacttcctcatcccaatctcgcactacccacttctcatctcttcggcggcccgagtaccagcagcagcaccaagtcatggacgtctcaagcacagcagctggagccaaggggaagaagggagcggccgggcggaaggccggcggtcccaggaagaagtctgtcactcgatccgtcaaggccggcctccagttcccggtcggtcgcgtcggccggtacctgaagaagggccggtacgcccagcgcgtcggcaccggcgcccccgtttacctcgccgcagtcctcgagtacctcgccgccgaggtgctagagctcgccggaaacgccgccaaggacaacaagaagagccgcatcatcccacgtcacctgctgctcgccgtcaggaacgacgaggagctcgggaagctgctcgctggcgtcaccatcgcccacggcggcgtgcttcccaagatcaacccagtgctgctgcccaagaagacggccgagaaggccgccaaggagcccaagtcgccgaagaagactgccaagtccccgaagaaggcctagaggggctcgttgggttgcacaggttgggtatctgggaacgatctgtgttcttcagagtagaatgtgaatgaccgtactgtggtgtgtcgttgtactgccttttgatttgtaatttaatggagcaatga

SEQ ID NO: 14312 - DNA, 651 bp, Avena sativa
cccaatcttccccaatctgcaaactcctctgtcctctgaatctcagcagcccggcatggacgtctcaagcacagcaaccggcgggaaggcgaagaagggagcggccggtcgcaaggccggcggccccaggaagaagtcggtgacccggtcggtcaaggcggggcttcagttccccgtcggccgcgtcggccgctacctcaagaagggcaggtacgcccagcgcgtcggcaccggcgcccccgtctacctcgcggccgtactcgagtatctcgccgctgaactgctggagctggccgggaacgccgccaaggacaacaagaagtcgcgcatcatcccgaggcacctgctgctcgctgtcaggaacgacgaggagctcggcaagctgctcgccggagtcaccattgcgcacggcggcgtgctgcccaagatcaacccggtgctgcttcccaagaagacggccgagaaggccgccaaggagcccaagtcgccgaagaaaaccgccaagtccccgaagaaggcgtagagattagtttgcgttcctttgtttgtagctgcattcttcatagtagattgttgttgtttgtctggtggtgtcgctgtaccttctgatctgtaatttcaatggaacaatgagatgtttagatattgtcc

SEQ ID NO: 14313 - DNA, 1075 bp, Panicum virgatum
tataaaaccagcggcgcgttcgaaacagcgaaaccacccaaaaagcattgtcgaatcccgtttccctcgcttccccccaaacccaaaaccgaattccctccaaatccacccacaccctccgaaatggacgccggcgccccgaaggtgaagaaggcggcggcgggccgcaagctcggcgggccgaagaagaagccggtgtcgcgctccgtcaaggccgggctccagttccccgtcggccgcatcgggcgctacctcaagaagggccggtacgcgcagcgcgtgggcacgggcgcccccgtctacctcgccgccgtcctcgagtacctcgccgccgaggtcctggagctggcgggcaacgcggcgcgcgacaacaagaagaaccgcatcatcccgcgccacgtcctcctcgccatccgcaacgacgaggagctgggcaagctgctggccggggtcaccatcgcgcacggcggcgtcctccccaacatccactcggtgctcctccccaagaaggccgccgagaaggcggagaaggcggccaagtcgcccaagaaggccgccgccaaatcccccaagaagtaggctgctcctggtcatgcgcgcgctgatctctcatcggatccgatcctagcagtcttgcttcccctgtgttgcttgcttttgtgtgtatgtagtgccgcatctctatgtaccgtgccctccgtgcttcggatcctaagtcgtaggtctaggtctagccgtagttgttggtgatggggttatctatgttaccaaaatttaatttgtgaattctggatctggtttactttgtgaattctggatctggtttttgcgcttggttcctcccagggcgcaagtgggttgtaggatggtacattgccaaatggggacgaatttcagatgattctgatcatttctgatgacaaggcacgaacattttcattttagcggaacgagatgtagattcagattggtgaatcctaatgatttcagtgaaattccttagaaacttgatttgtttcgcgtgttggggagcaacgagattggaatggcgaacggattcaatgaggtgagcgtc

SEQ ID NO: 14314 - DNA, 895 bp, Panicum virgatum
cccccctcgccgagatccaacggcgctcaccttacatcacgcggatcgctcccccctgcccaccccgtcgtggtcaccccgctcgcagctataaaaccagcgccgcgttcgaaacagcgaaaccacccaaaaaaattatcgaatcccgcctccctcgtttcgccccaacccaaaaccgagtttccctgcaattccccccgcctccgctccgagatggacgccggcgcaccgaaggtgaagaaggcggcggcgggccgcaagcttggcgggccgaagaagaagccggtgtcgcgctccgtcaaggccgggctccagttccccgtcggccgcatcgggcgctacctcaagaagggccggtacgcgcagcgcgtgggcacgggcgcccccgtctacctcgccgccgtcctcgagtacctcgcggccgaggtcctggagctggcgggcaacgcggcgcgcgacaacaagaagaaccgcatcatcccgcgccacgtcctcctcgccatccgcaacgacgaggagctgggcaagctgctggccggggtcaccatcgcgcacggcggcgtcctccccaacatccactcggtgctcctccccaagaaggccgccgagaaggcagagaaggcggccaagtcgcccaagaaggccgccgcgaagtcccccaagaagtaggctgctcatgatgatgcgcgcgcggatctcacctcatctcaccttgctttgtgtgtatgtagtgccgcatctcaatgtatcgtgtcctccgagcttcggatcctatgtcgtaggtctaggctttagctgtagtggttggtgatggggatatgtatgtttccaaaatttaatgagaagtgggagcggtttgctttcctttatgaattctggatctggtatttgcgct

SEQ ID NO: 14315 - DNA, 628 bp, Cenchrus ciliaris
ctggagccaccggcaaggtgaagaagggagcggccggtcgcaaggccggcggacccaggaagaagtcggtgacccggtccgtgaaggctgggctgcagttccccgtcggccgtatcgggcgctacctcaagaagggccggtacgcgcagcgcgtcggcagcggcgcccccgtgtacctcgccgccgtccttgagtacctcgccgccgaggtgcttgagctcgccggcaacgcggcaagggacaacaagaagacgcgcatcgtcccgcgccacgtgctcctggcggtccgcaacgacgaggagctcggcaagctgctggccggcgtcaccatcgcccacggcggcgtcctccccaacatcaacccggtgctcctgcccaagaaggtggcggagaaggcggccgccaaggaggccaagtcgccaaagaaggctgccaagtctcccaagaaggcctagagagactctccattagtgctttatgctgttcgatgttcctgtctggtagatctgtagatgggatggcttctgatgtagtgtacttactgtggctttgtgatctctgcattatgctggaagaattcagaaatcagagtttgttactcgcaatttgcaaagtgtttttgatgttt

SEQ ID NO: 14316 - DNA, 702 bp, Silene vulgaris
cccattctctctacacaatccctctcattactcatccaaaacattcccaacccaaacctgatatcggaaaatggatactgctggtggaaagaagaagggagcagcaggaaggaaagctggcggtccaaagaagaagtcagttacccggtccatcaaagccggtcttcagttcccggttggtcgtattggaaggtatttgaagaaaggtcgctatgctcagcgtgttggttctggtgctccggtttacttggctgctgttcttgagtaccttgctgctgaggttttggaattggccggaaatgcggcccgagacaacaagaagaacagaattatcccaaggcatgtgttgcttgcaataaggaacgatgaagagctcggaaagctgctagctggagtgacaattgctcatggaggagtgctgccgaacattaacccgattctgttgccaaagaagactgctgagaagtctcccaaggaacctaagtctccatccaaggctgcaaaatcgccaaagaaagctgcttaagtttgatttctaagtgatttgtgtatgtaagctaattaggttttcggaataggtagtatggttcgtaagttgatggttatcttatttcagagttgatttctgatcgattcttgtcttttgtattcgctgaagtgttatgaatgaaaacgtttatgataatataaacttcagttatc

SEQ ID NO: 14317 - DNA, 722 bp, Zea mays
atcaactcgcaattccgcattcgttccaactcctgagcactttctcctcgtccccgacaagccaatcgaagccgagatacggccatggactccaccggcaccggagcagggggtaaggggaagaagggagcggccgggcgcaaggtcggcgggccaaggaagaagtcggtgtcgaggtccgtgaaggccgggctccagttccccgtcggccgcatcgggcgctacttgaagaagggccgctacgcgcagcgtgtcggcaccggcgcccccgtctacctcgccgctgtcctcgaatacctcgccgctgaggttctggagctcgccggtaatgctgccagggacaacaagaagactcgcattattccgcgccacgtgcttctggcgatccggaacgacgaggagcttgggaagctgttgggcggcgtgaccatcgctcacggcggtgtgctccccaatatcaaccctgttctgctgcccaagaagacggcggagaaggcgtccagtgtggggagcaaggaggcaaagtcgcccaagaaggccgccaagtcccccaagaaggcatagactgactgtctggagtgatctgatgtttagcaggaccttgataccagtatgcggtgatgcgtaggctgtagatgggtcgaatgtgcttgtgtgtgtatgtgccctgctgcaagttgccctttgctatttaaaatggaagaagaaatgccttgtttctc

SEQ ID NO: 14318 - DNA, 761 bp, Pennisetum glaucum
acctcgcaatctcgcattcctccgatctctcgagcccttccttcctcctcgtcccgagaagcccactcgaagcgcagccgctgccatggacgccaccggtaccggagcggccggcaaggtgaagaagggagcggccgggcgcaaggccggcggccctaggaagaagtcggtgtccaggtccgtgaaggccgggctccagttccccgtcggccgcatcgggcgctacctcaagaagggccgctacgcgcagcgcgtcggcaccggcgcccctgtctacctcgccgccgtcctcgagtacctggccgctgaggttctggagctcgctgggaacgctgccagggacaacaagaagagtcgcatcatcccccgccacgtcctcctggcgatccgcaacgacgaggagctcgggaagctgctcgctggagtcaccatcgcccacggtggcgtcctccccaacatcaacccggtgctgctgcccaagaagacggcagagaaggcgtccagcggcgggagcaaggaggccaagtccccgaagaaggccgccaagtcgcccaagaaggcatagacggtagactcagatctgatgtcgcgccatttcctgttacctgtggtgtttaggttgtagatgtgaggaaattggtgcttggtgatgaaccagtattgtaacttgtgatctgtggttttcaatggaagaaatggctagtttaagttaattaatatggtgtgcccgatttatctcaattcgtcctgtgattttgcaa

SEQ ID NO: 14319 - DNA, 669 bp, Avena sativa
caccagcagtccagcacacatcgcaatccccaaacgccaatctgcgaactcctctctgaagccaagcagctagccatggacgtcccaagcgcagcaaccggcgggaaggcgaagaagggaggagcagggcgcaaggccggcggcccgaggaagaagtcggtgacgaggtcagtgaaggccgggctccagttccccgtcggccgtattggtcggtacctcaagaagggccggtacgcccagcgcgtcggcaccggcgcccccgtctacctcgccgccgtcctggagtacctcgcggccgagcttctagagcttgccggaaacgccgccaaggacaacaagaagtcgcgcatcatcccgcgccacctgctgctcgccatcaggaacgatgaggagctcgggaagctgctggccggcgtcaccattgcgcatggtggtgtgctgcccaagatccactccgtgctgctccccaagaaggcggccgagaaggcggagaaggctgccaagtcgccgaagaaggccaccaagtcccccaagaaggcttagagaactcgttgtgttacataggttgtactagctgggattggtgggtgtgcttcagaatagattgttgttgtttgtccggtcgcgtccttctgatctgtaatttcaatggaacaacgggttacttca

SEQ ID NO: 14320 - DNA, 647 bp, Secale cereale
gagctcgcaatcccaatctctcagcaccaaacatcttctcttccgcgcctcgacgagcatcagcggctagccatggacgtctcagccaccggggccggcgcgaaggcgaagaagggcgccgcagggcgcaaggcgggcggccccaggaagaagtccgtgtcgaggtccgtcaaggccgggctccagttcccggtcggccgcatcggacggtacctcaagaagggccgctacgcgcagcgcgtcggcacgggcgcccccgtctacctctcggccgtcctcgagtacctcgccgccgaggtgctggagctcgccggcaacgctgccaaggacaacaagaagagccgcatcatcccgaggcacctgctgctcgccgtcaggaacgacgaggagctcgggaagctgctggccggcgtcaccatcgcgcacggcggcgtcgtgcccaagatcaacccggtgctgctccccaagcggacggcggagaaggcgcccaaggagggcaagtcgcccaagaaggccgccaagtcccccaagaaggcttagggaggcccgctgatttgtgtccgtatgtaataagctgttcgcctagcggcgtcgatgtaatttttgttgttaatgaaaaaatgtcagaaatctctctgactttgaat

SEQ ID NO: 14321 - DNA, 681 bp, Triticum aestivum
aatctctcagcaccaaacatcttctcttacgcgcctcgacgagcatcagcggctagccatggacgtctcagccaccggagcaggcgcgaaggccaagaagggagccgcagggcgcaaggcaggcggccccaggaagaagtcggtgtcgaggtccgtcaaggccgggctccagttcccggttggccgcatcgggcggtacctcaagaagggccgctacgcgcagcgcgtcggcacgggcgcccccgtctacctcgcggccgtcctcgagtacctcgccgccgaggtgctggagctcgccggcaacgccgccaaggacaacaagaagagccgcatcatcccgaggcacctgctgctcgccgtcaggaacgacgaggagctcgggaagctgctggccggcgtcaccatcgcgcacggcggcgtcgtgcccaagatcaacccggtgctgctccccaagcggacggcggagaaggtgcccaaggagggcaagtcgcccaagaaggccgccaagtcccccaagaaggcttagggaggcccgctgatttgcgtcagtatgtaataagctgttcgcctagcggcatcgatgtaatttttgttgttaatggaaacatgtcagacatctctctgactttgttatattttgtgctttgttatctgttcttggtgctagtactatggaggaat

SEQ ID NO: 14322 - DNA, 798 bp, Vigna unguiculata
acaacacactcctaccctctctcatatcttgctccctctttcaatttttaagcgcatctaatttctagggttccgacatggacgccggtggaaagatcaagaagggtgccggtggaagaaagggtggtgggccaaagaagaagccggtcaccaggtccgtgagggcgggtctccaattccctgtcggaagaattggtcgttacttgaaaaagggaagatacgctcagcgtgtgggaactggtgctcctgtttatcttgctgctgttcttgaatacctagctgctgaggtgcttgaattggctggaaatgctgcccgtgacaacaagaagaacaggattattcccagacatgtgcttcttgccgtgaggaacgacgaggaattggggaaattgctcgccggagtcacaattgctcacggtggtgtgttgcccaacattaaccctgttttgttgcctaagaagactgagaaagcttctaaggaacccaagtctccttccaaagctaccaagtctcccaaaaaggcttagaccatgttttaatttagttatgtatatcggtgtttagggttctttggttgtgacaagaagggaatttgatgttttagctataagtttcgtcttattgtgtttgtgaattttgttcattaatgtgaaaaccctcttgttttcgcccaattatgttctatgtccactcctttttcaatctttgtgtgctttatcgatttgttacacagaaatgaattccaagtttaatatgttggtaaataagtaaattttgtaaatgctaatttcgtggcgc

SEQ ID NO: 14323 - DNA, 713 bp, Glycine max
atccaactctctaaacaacacattaacctttctcattccccatctcctcaccttattcagccactgctaatttctagggttccgaaatggacgctggcggaaagatcaagaagggcgccggaggaagaaagggcggcggccctaagaagaagccggtttcaaggtccgtcaaggccggtctccaattccccgtcggaagaattggccgttatttgaagaaaggaaggtacgcccagcgtgtcggtaccggtgctcccgtttacttggccgcagttctcgagtacctagctgctgaggtgcttgagttggctgggaatgctgcacgtgacaacaagaagaacaggattattccgagacatgtgctattggctgtgaggaacgatgaggagttggggaaattgcttgctggtgtcaccattgcacatggtggtgtgcttccaaacattaaccctgttttgttgcctaagaagacggagagggctgccaaggagcctaagtctccatccaaggctactaaatctcctaagaaggcctagattatcctttttttttttttttttttaaatctagtgttgtatatcggtgcttagatgcttttggtgtaacaggaaatttgatgtgtttcttaaacattgtaattcttgtcccattgtgttgcttgtaggagtgagtttgctttattaatgaaaagtggaaacctcttgttttcaatc

SEQ ID NO: 14324 - DNA, 609 bp, Glycine max
aaacaacacattaacctttctcattccccatctcctcaccttattcagccactgctaatttctagggttccgaaatggacgctggcggaaagatcaagaagggcgccggaggaagaaagggcggcggccctaagaagaagccggtttcaaggtccgtcaaggccggtctccaattccccgtcggaagaattggccgttatttgaagaaaggaaggtacgcccagcgtgtcggtaccggtgctcccgtttacttggccgcagttctcgagtacctagctgctgaggtgcttgagttggctgggaatgctgcacgtgacaacaagaagaacaggattattccgagacatgtgctattggctgtgaggaacgatgaggagttggggaaattgcttgctggtgtcaccattgcacatggtggtgtgcttccaaacattaaccctgttttgttgcctaagaagacggagagggctgccaaggagcctaagtctccatccaaggctactaaatctcctaagaaggcctagattatcctttttttttttttttttttaaatctagtgttgtatatcggtgcttagatgcttttggtgtaacaggaaatttgatgtg

SEQ ID NO: 14325 - DNA, 693 bp, Amaranthus tuberculatus
aaaagctttaaacagcatatcaatggataccgctggaggaaagggaaagaaaggagccgctggaaggaaaggaggaggccctaagaagaagccagtttctagatctgttaaagctggattgcaatttccagttggaagaattggaaggtacttgaagaaaggaagatatgctcaacgtgttggtaccggtgcccctgtttatcttgctgctgttcttgaataccttgccgctgaggtgttggagttggcaggaaatgcagcaagagacaacaagaagaacagaatcatcccgaggcacgttctccttgcagtgaggaatgatgatgaacttggaaagttgttagccggagtaacaattgctcatggaggtgttcttccaaacattaacccagtcttgttgcccaagaagaccgcagacaaggctcccaaagagcccaagtctccatccaaagctaccaaatctccaaagaaagcttagatagatgatgacgataaagatggacttgttggttctagtttagagtcatgatttctctattgcactttgtaactacctagttagttggagaagtttaaacaagaatatgaaagaatagggttttagtatattgtaatgatgatgagctaatgtttgttctatgggaattggatcaataatttattgattttccttctctcttgtatgaaattaaa

SEQ ID NO: 14326 - DNA, 660 bp, Musa acuminata
agacgaatcattccgctttgcttcaccgactttatcttttttccgagcagtcgaatggacgctggcggtggtggtggcaaggtgaagaggggagccgccggccggaagggtggtggccccaggaaaaagcccgtctcccgctccgtcaaggccggcctccagttccccgttggccggatcgggcgatacctcaagaagggccgctatgctcagcgcgtcggtaccggtgctcccgtctaccttgccgccgtcctggagtacctagctgccgaggtgctggagttggctgggaacgcggcgcgcgacaacaagaagaaccggatcattcccaggcacgtgctgctggccataaggaacgacgaggagctggggaagctgcttgcgggggtgaccatcgcgcacggcggcgtgctccccaacatcaacccggtgttactgccgaagaagagcaacaatgccgccaaggagcccaagtcgccgtcgaaggccaccaaatcgcccaagaaagcttaggatctgatgccctcgacgcctttgctttcctctttcgctcctacttttgtatctaacttgcaatccctttgttgagtggcaatcgccaatacgtttgattggctttcaatggaatgttggtggaattgagactaatatgatccttac

SEQ ID NO: 14327 - DNA, 616 bp, Zingiber officinale
cgccgccttctcttcgcattctctcgcgcacgactcgagatctcgcctgaaggggatggacgccagtggagcaaccgccgggaaggcgaagaagggagcagctgggcgccgagccggagggcccaagaagaaggcagtctctaggtccaccaaggccggcctccagttccccgttggtcgcattggccgtttcctcaagaaagggcggtacgcccagcgcgtgggctcgggtgcccccgtctacctcgccgccgtcctggagtacctggcggcggaggtgctggaactggccgggaatgcggcgcgcgacaacaagaagaaccggatcatcccgcgccacgtgcttctggcgatacggaacgacgaggagttagggaagctgctcgccggcgtgacgattgcccacggcggcgtgctgcctaacatcaatccggtgctgctaccgaagaagacggctgccaaggagcccaaatcgccttccaaggcgaccaaatcccccaagaaggctgcctgattagtagtgtatacctttcgcatctttgtaatctcgtttagttgtgtgccagtgtcagggtgtaggaaatgttaaatcttgaacgcgatgcatttctggtgc

SEQ ID NO: 14328 - DNA, 747 bp, Oryza sativa
gcgcactcgcattcgacgacccaagaaaaggaaaaaaaaaagaaaaacaatcctccacgccttcgagcgcagcaggaaccagcttagctaggctagccatggacgccgccggagccggagcgggtgggaagctgaagaagggagccgccgggaggaaggccggtgggccgaggaagaaggcggtgtcgcgctccgtcaaggccgggctccagttccccgtcggccgtatcggccgctacctcaagaagggccgctacgcgcagcgcatcggcaccggcgcccccgtctacctcgccgccgtcctcgagtacctcgccgccgaggtgctggagctcgccgggaacgcggccagggacaacaagaagaacaggatcatcccgcgccacgtgctgctggcgatcaggaacgacgaggagctcggcaagctgctggccggcgtgaccatcgcgcacggaggcgtgctgcccaacatcaacccggtgctgctgcccaagaagacggcggagaaggccgccgccgccggcaaggaggccaagtcgcccaagaaggcggccggcaagtcccccaagaaggcctagacgtcggcgcctcgctttgcttgtttagctggagtagattggacgggatgtgtgtctgttagtagtctgctgatgctgttgatctaatctatagtggtgtcgttgaaccttgtgtctgttcaagaagataaatctaagatatgttaaatttttcttcagagatgtttcc

SEQ ID NO: 14329 - DNA, 754 bp, Oryza sativa
atcgccatatcgcattcgactaaagaaaagggaaaaaaaaaatcctcctcgccttcgacagcagcagcaaccagcttagctaggctagccatggacgccgccggagccggagcgggtgggaagttgaagaagggagccgccgggaggaaggccggcgggccgaggaagaaggcggtgtcgcgctccgtcaaggccgggctccagttccccgtcggccgtatcggccgctacctcaagaagggccgctacgcccagcgcatcggcaccggcgcccccgtctacctcgccgccgtcctcgagtacctcgctgccgaggtgctggagctcgccgggaacgcggccagggacaacaagaagaacaggatcatcccgcgccacgtgctgctggcgatcaggaacgacgaggagctcggcaagctgctggccggcgtgaccatcgcgcacggaggcgtgctgcccaacatcaacccggtgctgctgcccaagaagacggcggagaaggccgccgccgccggcaaggaggccaagtcgcccaagaaggccgccgggaagtcccccaagaaggcctaggcgtcggcgcctcgctttgcttgtttagctggagtagattggacgggatgtgtgtctgttagtagtctaatgctgttgatttaatctatggtggtgtcgttgaaccttgtgatctgtgcttgtgtctgttcaagaagataaatttaagagatgttaaatttttcttcagagatgtttccattct

SEQ ID NO: 14330 - DNA, 667 bp, Oryza sativa
aaaaatcctcctcgccttcgacagcagcagcaaccagcttagctaggctagccatggacgccgccggagccggagcgggtgggaagttgaagaagggagccgccgggaggaaggccggcgggccgaggaagaaggcggtgtcgcgctccgtcaaggccgggctccagttccccgtcggccgtatcggccgctacctcaagaagggccgctacgcccagcgcatcggcaccggcgcccccgtctacctcgccgccgtcctcgagtacctcgctgccgaggtgctggagctcgccgggaacgcggccagggacaacaagaagaacaggatcatcccgcgccacgtgctgctggcgatcaggaacgacgaggagctcggcaagctgctggccggcgtgaccatcgcgcacggaggcgtgctgcccaacatcaacccggtgctgctgcccaagaagacggcggagaaggccgccgccgccggcaaggaggccaagtcgcccaagaaggccgccgggaagtcccccaagaaggcctaggcgtcggcgcctcgctttgcttgtttagctggagtagattggacgggatgtgtgtctgttagtagtctaatgctgttgatttaatctatggtggtgtcgttgaaccttgtgatctgtgcttgtgtctgttcaag

SEQ ID NO: 14331 - DNA, 1065 bp, Panicum virgatum
cggattcagttcagacttgtctggctcttcactaattcctatttttagctgctaaaaattttcaccggctagctggcgcgtgttgccgaaaatccctattcccgtgggcgggagactggaggcacaatttttcggcgctcccgaaatctgctcgcacctgattggcggagccacccctcccacggatcgcgctccgttagctccatcgcggccgtcggacagcctccagatctgaccgttcgttgcccccgcacgcggatcgacgggcccacctcttcctccatcgcgccgtttaaatacccggcatcgccttccattctaggtcaccttgcaatctcgcattcctccgatctctcgagcctttcttcctcgtcccgagaagccccacgaagagcagcggcggcaatggactccaccggcaccggagctggcggcaaggtgaagaagggagcagctgggcgcaagaccggcgggccgaggaagaaggcggtgtcgaggtccgtgaaggccgggctccagttccccgtcggccgtatcgggcgctacctcaagaagggccgctacgcgcagcgcgtcggcactggcgcccccgtctacctcgccgccgtcctcgagtatctcgccgctgaggttctggagctcgccggcaacgcggccagggacaacaagaagacccgcatcatcccccgccacgtgctcctggcgatccgcaacgacgaggagctcgggaagctgctctccggcgtcaccatcgcccacggcggcgttctccccaacatcaacccggtcctgctgcccaagaagacggcggagaaggcgtccagcggcggcagcaaggaggccaagtcgcccaagaaggccgccaagtcccccaagaaggcatagagggtgggcttagatccaatgtctagcgccgtttcgtgttttcatgtgatgcgatgtttaggttgtagatgtggaaaagttgtggtcggagatgaaccagtggtgtcgtgacttgtgatctgtggttttcaatgaagaaattactagttaaacttaacacgatgtgcctgatttctcttt

SEQ ID NO: 14332 - DNA, 699 bp, Echinochloa colona
ggtgtgctcttccgacctcgcaatctcgcattcctccgatctcctcgagccctttcctcctcgtcccgagaaccctctcgaagcgcagcggcggccatggactccaccggcaccggagcgaccggcaaggtgaagaagggagcggccgggcgcaaggccggcggcccgaggaagaagtcggtgtcgaggtccgtgaaggccgggctccagttccccgtcggccgcatcgggcgctacctcaagaagggccgctacgcgcagcgcgtcggcaccggcgcccccgtctacctcgccgccgtcctcgagtacctggccgctgaggttctggagctcgccggcaacgccgccagggacaacaagaagtctcgcatcatcccccgccacgtgctcctggccatccgcaacgacgaggagctcgggaggctgctcgccggcgtcaccatcgcccacggcggcgtgctccccaacatcaacccggtgcttctgcccaagaagacggcggagaaggcgtccagcggcgggagcaaggaggccaagtctcccaagaaggccgccaagtccccgaagaaggcatagagagtcgaaacagatctgatgtctagtgccgtatcgcgttacctttgttgtttagtatgtagattgggggaggtcgtttggagatgaaccagtcttgtagcaacttgtgatctgtgctcatca

SEQ ID NO: 14333 - DNA, 706 bp, Pennisetum glaucum
ggcagagcaccagtcacagccctctctccccgctgcctcttctctccagctctcgcagcgcagcagtagccagccagtcggccatggacgtcagcggagctggagccaccggcaaggtgaagaagggagcggccggtcgcaaggccggcggacccaggaagaagtcggtgacccggtccgtgaaggctgggctgcagttccccgtcggccgtatcgggcgctacctcaagaagggccggtacgcgcagcgcgtcggcagcggcgcccccgtgtacctcgccgccgtccttgagtacctcgccgccgaggtgcttgagctcgccggcaacgcggcaagggacaacaagaagacgcgcatcgtcccgcgccacgtgctcctggcggtccgcaacgacgaggagctcggcaagctgctggccggcgtcaccatcgcccacggcggcgtcctccccaacatcaacccggtgctcctgcccaagaaggtggcggagaaggtggccagcggcggcgcaaaggagcccaagtcaccgaagaagggcgccaagtcccccaagaaagcttagaaaagcttagaggaactccattaaaatgtttatgtgtggtactagttctagatctgtagatggggtggcttctgatgtggtgtcgttgttgtgtgtggctttgtgatctgctcattcaaccagaagaaattagaaatcggagt

SEQ ID NO: 14334 - DNA, 554 bp, Chenopodium quinoa
aaattaggagagagaaagtaagagagagaaaatggatacaggaggaaaagcgaagaagggagcaggaggaaggaaaggaggtgggccgaagaagaagccagttacaaggtcagttagagctgggttacaatttccagttggtagaattggaaggtatttgaagaaaggaaggtatgctcaacgtgttggtactggtgctcctgtttacttggctgctgttcttgagtaccttgctgctgaggtgttggaattggctggaaatgctgcaagagacaacaagaagaacagaatcatcccaaggcatgttctactcgctgtgaggaacgacgatgagctcggaaagcttcttgccggagtcaccattgcacacggaggagttcttccaaacataaacccagtattgttgccaaagaagactgcagagaagtctccaaaggagccgaaatctcccaaggctaccaaatcccccaagaaggcttagatttttagtgggtttgggctttcccatctctagtttgtgttttctggaatctctgtatgtaatgtcagtagat

SEQ ID NO: 14335 - DNA, 772 bp, Chenopodium quinoa
ttgttcatcttcataaattaggagagaaaaagtaagacagagaaaatggatacaggaggaaaagcgaagaagggagccggaggaaggaaaggaggtgggccgaagaagaagccagttacaagatcggttagagctgggttacaatttccagttggtagaattggaaggtatttgaagaaaggaaggtatgctcaacgtgttggtactggtgcccctgtttacttggctgctgttcttgagtaccttgctgctgaggtgttggaattggccggaaatgctgcaagagacaacaagaagaacagaatcatcccaaggcatgttctacttgctgtgaggaacgacgatgagctcggaaagcttcttgccggagtcaccattgcacatggaggagttcttccgaacataaacccagtattgttgccaaagaagactgctgagaagtctccaaaggagccgaaatctcccaaggctaccaaatcccccaagaaggcttagaatttttagtgggtttgggctttcccatctctagtttgtgttttctggaatctctgtatgtaatgtcagtagatgtttttaattaggttttctttctttttatttgaaaaaaatgggatgatgggagggttgtagttgagggtttcatctgtgaattaaatcaggataatttgattagattcactgttctttgtaatgttgttggtatcaatgacaatattctaaatttcatatccttttgtctctaatttgcaagtttgtgcaatccaaatcttac

SEQ ID NO: 14336 - DNA, 791 bp, Echinacea purpurea
cggccgggggatacatcaaacaacttcttcacactctacacacaaacaaacacatacaaaaatcgaaatggatgctagtggaaaagctaagaagggtgccgcaggacgcaaagccggcggtccaaggaagaagtcggtcactcgatccgtcaaagccggtctccagtttccagtcggaagaattggccggtacctgaagcacggtcgctatgccaagcgtgtaggaactggagctccagtttatcttgctgctgttatggaataccttgcagcagaagtgttggagttggcgggaaatgctgctagagataacaagaagactagaatcataccgaggcatgtgctgctggcgataaggaatgacgatgagctgggaaagctgttggctggagtgaccattgctcacggtggtgttctacctaacattaacccggtcttgttgccgaagaagacagcggcaaaggagccaaaatcacctgcgaaagccaccaaatccccgaagaaagcttaaactggtttagtttggttggtgttttgtgttgttattgtagttacattggaaattgatggtagtttgttaattgttatattaatgaatgaaagaaactccttgtttcacttatattggatgttgtttaatttgctgcttatttcactttcatgttcagacaatcttacaacatgtcatcttatgggagtttttgtatacgacactttttaattgtttttgacaaactgttttggtttgctaaacacattacatattaatcaaggttacatgatttgttgtt

SEQ ID NO: 14337 - DNA, 830 bp, Hordeum vulgare
atcccaccgcccaacgaccgtgcccacggatcgacatgccaaaccacgggcgccgtccgcgccgtttaaatactccggctgtctcgccgcatatcccaccagtccagagctcgcaatcccaatcccaatcccaatcgcccaccaaatccctccgctcccgcgtcccgacgagcaccagccaccagccatggacgcctcagccaccggagccggcgcgaaggggaagaagggcgcggccgggcgcaaggccggcggcccgaggaagaagtcggtgtcgcggtccgtcaaggccgggctccagttccccgtcggccgcatcgggcggtacctcaagaagggccgctacgcgcagcgcgtcggcacgggcgcccccgtctacctcgcggccgtcctcgagtacctcgccgccgagctgctggagctcgccggcaacgccgccaaggacaacaagaagagccgcatcatccccaggcacctgctgctcgccgtcaggaacgacgaggagctcgggaagctgctggccggcgtcaccatcgcgcacggcggcgtcatgcccaacatcaacccggtgctgctccccaagaggaccgcggagaaggcgcccaaggagggcaagtcgcccaagaaggccgccaagtcccccaagaaggcttagggaggcgcgccgatttgtgttagtatgttgtaataagctgttcgcctagcggcgtcgatgtagtatttgctgttaatggaaaaatcgttagaaatctctctgactttgttatattttgtactctgtcatctgttcatggtgctactatggaggatatttacatttgtgcggtagg

SEQ ID NO: 14338 - DNA, 645 bp, Hordeum vulgare
caatcccaatcccaatctcccagtcccaaacctcttctctccggcgacccgacgagcgtcagcggctagccatggacgtctcggccaccggagcaggcgcgaaggggaagaagggcgcggcagggcgcaaggccggcggcccgaggaagaagtcggtgtcgcggtccgtcaaggccgggctccagttccccgtcggccgcatcgggcggtacctcaagaagggccgctacgcgcagcgcgtcggcacgggcgcccccgtctacctcgcggccgtcctcgagtacctcgccgccgagctgctggagctcgccggcaacgccgccaaggacaacaagaagagccgcatcatccccaggcacctgctgctcgccgtcaggaacgacgaggagctcgggaagctgctggccggcgtcaccatcgcgcacggcggcgtgatgcccaagatcaacccggtgctgctccccaagaggaccgcggagaaggcgcccaaggagggcaagtcgcccaagaaggccgccaagtcccccaagaaggcttagggaggcgcgccgatttgtgttagtatgttgtaataagctgttcgcctagcggcgtcgatgtagtatttgctgttaatggaaaaatcgttagaaatctctctgactt

SEQ ID NO: 14339 - DNA, 903 bp, Sorghum bicolor
cgtgctcgacgagtccatcgcagccgtccgcgccccttcagatccgaccgctcgttccctcgcacgcggatcgacgggcccactagtctccacgtttaactacccggcaccgcctgctgtcgccgatcatctcgcactctcacattcctccgatctcccaagacctcctctgacccgagaagctactcgtagcgcagccgtggccatggactccacaggcgccggagcgggagggaaggtgaagaagggagcgggcgggcgcaaggccggcggcgggccgaggaagaagtcggtgtcgaggtccgttaaggccgggctccagttccccgtcggccgcatcgggcgctaccttaagaagggccggtacgcgcagcgcgtcggcaccggcgctcccgtctacctcgccgccgtcctcgagtacctcgccgctgaggttctggagctcgccgggaacgccgccagggacaacaagaagacgcgcatcatcccccgccacgtgctgctcgcgatccgcaacgacgaggagctcgggaagctgctgtccggtgtcaccatcgcccacggcggtgtgttgcccaacatcaacccggttctgctgcccaagaagacggcggagaaggcgtccagcggcgggagcaaggagcccaagtcgcccaagaaggccgccaagtcccccaagaaggcatagattgtccagacagcttagcactaccttgttaccagtgatgcgttaagttgtagatgggatgaatgtggttggatgtgtacctgtgtttgcaagttctgatttataatggaaagaaatgccgtgtttcttaagtcgcaatgtctaatgcctgatttcatttctgcactgctgcgatgtgtggttttcaacctggtcagtatggggtttttgagatc

SEQ ID NO: 14340 - DNA, 4264 bp, Sorghum bicolor
cccaccaccctccgtcgccgcgctgtttaaatacccggcgtcgcctgccagtttcccatcacctcgcaatctcgcactcctccaatctccagagccctttgtcctctgtcccgagaagcaactcgcagcacagccgcggccatggactccaccgcagccggagcgggagggaaggcgaagaagggagcggccggacgcaaggccggcgggccgaggaagaagtcagtgtcgaggtcggtgaaggccgggctccagttccccgtcggccgcatcgggcgctacctgaagaagggccgctacgcgcagcgcgtcggcaccggcgctcccgtctacctcgccgccgtcctcgagtacctcgccgctgaggttctggagctcgccgggaacgccgccagggacaacaagaagacgcgcatcatcccccgccacgtgctgctcgcgatccgcaacgacgaggagctcgggaagctgctgtccggtgtcaccattgcccacggcggtgtgttgcccaacatcaacccggttctgctgcccaagaagacggcggagaaggcgtccaccggtgggagcaaggaggccaagtcgcccaagaaggccgctaagtcccccaagaaggcatagaagggtgtctatgcttatctgatgtttaccgtcgtattaccagtgatgtgttgtagatgggtgtggatggagattaaccggtcttgtagtatgttatctttaattcccagtacaagaaattcctagtttcttgaaagttgaaaacgtcttcttattttcatgtctgtattcctgttctgccgtgtgctctgcattgtatcttgctaaaaatcggggcaatgggcagtaacttagatgtggaaatttgaattatgtttttggctctaatggggatcgaagtgaaactgttgcacgggtctcttaacaagatgtgaaatagcagaagcatatggctgttgcatgctggacaattatgtggcgcttcatcctattgttgaatttgttccctgcgcatttggttttctacgtacttggcagcatttttagagtttaaaaacttaactagagagtaacagcaattccgtaggtgaacagatttttttttttaaaaaataacaccccgtagctgtactttgcaatggactcataactgaatcgacagtgagtttgttggtctcgggctcttgcagtcttgctgcatggagatcttcacgccctttgtttcacgacatcgatgagtgttttatgtgttttatcagttgccatgtactcctactccgtaaccacataatgacaattgggtctgacgtttaatctgaactcagcaacaagtgcttgtggagaaaacgagccttgtaaattgtaacatgtgaatcgggtaataaggccttgtttagttccccaaaaattttgcaaattttttcagattccctgtcacatcgaatctttagaggtatgcattaagtattaaatatagataaaaataaaaactaatcgcacagtttggtcggaattgacgagacgaatcttttgagcctagttagtcaaatatttgtcaaatataaacgaaaatgttattattcatattttgcaaaattttttagaactaaacaaagcctaagagtagtttttgcatgtggaaagagtacaccgtcaaatggaaatctcatgttgtgaccttctaattccactcgtcagcttctcttctattctccggattagccagaaatctgaaagaatagatttctaggatatatggtccccactgctcgcctcgtattcatcgtggcatccaagacgcacacgcctcgtctctctctccttaatttagtggtggacagttggctggatgagtaaatgacgtgaacagctcgtagcccaaagcagtgattcctgtgcatcttaatggtgaaactcatattaattaagggtaacttggtcatttggcagctatgctaatctgtcttaaacttgctataaatctattatttcagggacggagggagtaattgcaactttattcccacaataatcaccaattcagcttcgcccaatgacgaataatttcagcagtttttcagtaaaatttgtgttcgcttgagcgtatcagctaagcaaacatatattgtttggcgtggttttcgaactcaacagatggtccacttgtgatttcttacagctatcgttcggcgcttgcagtgtgatctgtgatggttctaacttctaactacgttcggcgctggaatttgacggttccgtttttcatagctgtccttaactaggccatctggcatttgccagacttggttacctggctgctaaggccttgtttagtttgcaactcaaaattttttcatccatcacatcgaatgtttggacatatgtatgaaacattaaatgtacataaaaaaaataaactaattacacagtttggttgaaaatcgcgagacgaatctttttagcctagttacttcaatgattagccttaaatgctacagtaacccacatatgctaatgacagattaattatgcttaatagatttatcttacagtttgctgacgaggtatgtaatttgtttttttattcgtttctaaaacctctcccgacatccttccgacacatccaatataacatccaaaatttttttatcagcaatctaaacagggccagttagccttgccgcaattttttgtggtaaggaaatatctaacctcgtagacaattaagtagggaaactgaccaacaagttagactagccttgtttagatgcctttaaaatttcaaaagtttacaagatttttcgtcacatcgaatctttagactcatacatgaatattaaatataaataaaaaagtaactaattacactaatcttttgagcctagttagttcataattaaacactaattgacaaatacaaacgaaaatactatagtacccaaatccaaaaagtttttttttatctaaacaaggtctaagttatgccaacaactaagcgctaccacaaaaacagtggttatctaaaattagctacggtgaacttaggttgcaatccaaacaatctatccctcttgctgtaaaatgatgatgtttgataaccatggggttggcagtaggccggaaaaacatgcggtgaaaactacctatttagtggaaacatgtaaagtattttttttcaaaaaataaaatttcataactaaaaaactttacaagttggtattaacaattatttcatagaaaaagtttgcaaaaaagggctattctacattttggattttgactcaaaaggtaaaaaaaagaaagctcaaaagagacttaaaggccctaatgatgatgataaattctgcattttaaatagaactaaacataactttaaaaatttaacattttatattttattatttcgaagtacttgacattttgtgttatatattttatagaaaactaaacacactggatgaaaaagaaataatcccatctgctttcagccatgggcgggagatcggaggcgcaagttttcggcgctcccaaagtctgctcgtatctgattggcggcgcgacccctcccacggatcgtgctcgacgagtccatcgcagccgtccgcgccccttcagatccgaccgctcgttccctcgcacgcggatcgacgggcccactagtctccacgtttaactacccggcaccgcctgctgtcgccgatcatctcgcactctcacattcctccgatctcccaagacctcctctgacccgagaagctactcgtagcgcagccgtggccatggactccacaggcgccggagcgggagggaaggtgaagaagggagcgggcgggcgcaaggccggcggcgggccgaggaagaagtcggtgtcgaggtccgttaaggccgggctccagttccccgtcggccgcatcgggcgctaccttaagaagggccggtacgcgcagcgcgtcggcaccggcgctcccgtctacctcgccgccgtcctcgagtacctcgccgctgaggttctggagctcgccgggaacgccgccagggacaacaagaagacgcgcatcatcccccgccacgtgctgctcgcgatccgcaacgacgaggagctcgggaagctgctgtccggtgtcaccatcgcccacggcggtgtgttgcccaacatcaacccggttctgctgcccaagaagacggcggagaaggcgtccagcggcgggagcaaggagcccaagtcgcccaagaaggccgccaagtcccccaagaaggcatagat

SEQ ID NO: 14341 - DNA, 641 bp, Daucus carota
ttttcatactatttcattcatattcacagaaatggagagcccagctgccggaaaagtgaagaaaggagccgccgggaggaaagccggcgggcccaagaagaagtcagtgactcgttccgtccgagctggacttcagttcccagtaggaagaatcgggaggtaccttaagaaaggccgttatgctcagcgtgttggtactggtgctcctgtttacctcgcagccgttctcgagtaccttgctgctgaagtactggagctggcaggaaatgcagcgagagacaacaagaagagtcggatcattccgaggcatttgctgttggcaatcaggaatgatgaggagcttggaaagctgttgggaggagtgaccattgctcatgggggagtgttgcctaatattaacccggtattgttgccaaagaagacaactgaaaaggcggggaaagagccgactgctaaggtggctggaaagtctccaaagaaggctgccaagtgatgatgtttctcaggctgatgttattgtgttggaatagttagtgttagtaaatggatttaagtgatagcgttaggttggattagttatggttcttttgtgattaggttggatgttgaaatatgattagagttaaagagagttatggaga

SEQ ID NO: 14342 - DNA, 696 bp, Daucus carota
tcacacacattttcatactatttcattcatattcacagaaatggagagcccagctgccggaaaagtgaagaaaggagccgccgggaggaaagctggtggacctaaaaagaagtcagtgactcgttccgttagagctggacttcagttcccagtaggaagaatcgggaggtaccttaagaaaggccgttatgctcagcgtgttggtactggtgctcctgtttacctcgcggccgttcttgagtaccttgctgctgaagtactggagctggcaggaaatgcagcgagagacaacaagaagagtcggatcattccgaggcatttgctgttggcaatcaggaacgatgaggagcttggaaagctgttgggaggagtgaccattgctcatggcggagtgctgcctaatattaacccggttttgttgcccaagaagacaactgaaaaggcggggaaagagccgactgctaaggtagctggaaagtctccgaagaaggctgccaagtgatgatgtttctcaggctgatgttattgtgttggaatagttagtgttagtaaatggatttaagtgatagtgttaggttggattagttatggttcttttgtgattaggttggatgttgaaatatgattagagttaaagagagttatggagattgtaatgtttattcttatgagtagtgctaggtgcacataattgtg

SEQ ID NO: 14343 - DNA, 593 bp, Cenchrus ciliaris
cgaaggtgaagaaggcggcggccggccgcaagctcggcggcccgaagaagaagccggtgtcgcgctccgtcaaggccgggctccagttccccgtcggccgcatcgggcgctacctgaagaaaggccggtacgcgcagcgcgtgggcacgggcgcccccgtctacctcgccgccgtcctcgagtacctcgccgccgaggtcctggagctcgccggcaacgcggcgcgcgacaacaagaagacgcgcatcatcccgcgccacgtcctgctcgccatccgcaacgacgaggagctcggcaagctgctggccggcgtcaccatcgcccacggcggcgtcctccccaacatcaacccggtgctcctgcccaagaaggtggcggagaaggcggccgccaaggaggccaagtcgcccaagaaggctgccaagtctcccaagaaggcctagagagactctccattagtgctttatgctgttcgatgttcctgtctggtagatctgtagatgggatggcttctgatgtagtgtacttactgtggctttgtgatctctgcattatgttggaagaattcagaaatcagagttcgttactcgcaa

SEQ ID NO: 14344 - DNA, 1074 bp, Glycine max
aaaaaaataaaaataaaaaatcacgttgagaatttgggtccgagagacgcgaattctcaacggattttgcaaaaaaaaaatttaaaaacagtgcaaatttagactcccaacccgaatttaccccatgaaagtaaacatgtatatgtattgataaataacaggacatgtatatgtattgataaataacaggggagtatcatgttttggtaaaaaaaaaaaattatgtgaaaaaaaaatcaaagtgtgtgccctacagtggcatcttattggctggtgccgaaggacacggattgccaagcaaacaatcgttagccgtggataagttctgatcaaagcgtccacgtttttctgcgctggatcctcgtgaaggtgtccaaagctttataacatagaaccgtgccaacgcgtcttcccatcgctctcacacctgtgattattcctcttttaacaatccacacccaaattctagggttccgaaatggacgctggcggaaagatcaagaagggcgccggaggtagaaagggcggcggcccaaagaagaagccggtttcaaggtccgtcaaagccggtctccaattccccgtcggaagaattggccgttatttgaagaaaggaaggtacgctcagcgtgtcggtaccggtgctcccgtatacttggctgcagttctcgaatacctagctgccgaggtgcttgagttggctgggaatgccgcacgtgacaacaagaagaacaggattattccaagacacgtgcttttggcagtgaggaacgatgaggagttggggaaattgcttgctggagtgacaattgcacatggtggcgtgcttccaaacattaaccctgttttgttgcctaagaagaccgagagggcttccaaggaacctaaatctccatccaaggctaccaaatctcctaagaaagcttaagtgtttttattttattttatttgaatatgtaaatcagtctttagatgctttttatgtgaaagaaaaaattatctattgcaaacactgtaattcctatcgtctcgcatgtaggagtttgctacattaatgaaatcttctttattttt

SEQ ID NO: 14345 - DNA, 838 bp, Spinacia oleracea
tctctctcctctataactctcaactttctctcactagaagtttctcaaaaatctccaaatctagaaaatggattcagcagcaggaggaaagggtaagaagggagcagcaggaaggaagggcggaggccccaagaagaagtcggttactcgctctgtcaaagctgggttacagtttccagtcggaagaattgggcgtttcttaaagaagggtcgttatgctcagcgtgttggttctggtgctcctgtttacctagccgctgttcttgagtaccttgctgctgaggtattggaattggctggaaatgctgcaagggacaacaagaagtcaaggataatcccaaggcacgttcttctagcagtaaggaacgacgatgagctcggaaaattgctagcaggagttacaattgctcatggaggagtcctaccaaacatcaacccaatattgttgccaaagaagacagcagaaaaggctcccaaggaagccaagccttcgaccaaggctgccaaatcccctaagaaagcataggatgttttttctggtccaagttagaaagatggatggtttgttgggttttgatttactgcattttgtatctactgttagtacgagttctagttagggtttttaatgaaataggaaggttgtattagtaatgggttgaataggaattggatcaatatctgattggtctattttctgtaatcatatgcttattaatctaaaatatttatttctcctacttacgtttgttatctattgcttctttagccctgtcaattgaaattgaattttacttgaagtttcacctttgtaataaactaaatttcaattaatcaa

SEQ ID NO: 14346 - DNA, 675 bp, Vigna unguiculata
ctttctcgttcctctctccccacttatttttcaagcgcagctaatttctagggttccgacatggacaccggtggaaagattaagaagggtgccggcggaagaaagggtggcgggccaaagaagaagccagtcactagatccgtcagggctggtctccaattccctgtcggaagaattggccgttacttgaaaaagggaagatacgctcagcgtgtgggaaccggtgctcctgtttatctggctgctgttcttgaatacctagctgctgaggtgcttgaattggctggaaatgctgctcgtgacaacaagaagaataggattattcctagacatgtgcttctggccgtgaggaacgatgaggaattggggaaattgcttgctggagtcacaattgctcacggtggtgtgctacctaacattaaccctgttttgttgcctaagaagaccgagaaggcttccaaggaacccaaatctccatccaaggccaccaagtctcccaagaaggcttagactacattttaatttagttttgtatatcagtctttagggtactctggttgtatcaagaaaggattttttcctttgaaacactaaagtgtggtttagttgtgtacttgttgaagtttgttcattaattgaaaaccatcttgttttcgcccaaaaaaaaaaaaaaaa

SEQ ID NO: 14347 - DNA, 656 bp, Vigna unguiculata
tttcattcctcattccgtctctcaaattttaagctcagctcatttctagggtccgacatggacgccggtggaaagattaagaagggcgctggaggaagaaagggtggtgggccaaagaagaaaccggtggcaaggtccgtgagggctggtctccaattccccgttggaagaattgggcgttatttgaaaaaaggaaggtactcgcagcgtgttggaaccggtgctccagtatatttggctgctgtacttgaatacctagctgctgaggtgcttgaattggctggaaatgctgctcgcgacaacaagaagaacagaattattcccagacatgtgcttctggccgtgaggaacgatgaggagttggggaaattgcttgcgggagtcacaattgctcacggtggtgtgcttcccaacattaaccctgttttgttgcctaagaagactgagaaagcttccaaggaacccaaatctccatccaaggccacgaagtcccctaagaaggcttagattatattctaatttagttatgtatactagtctttagggttcttttttgttgtaacaggaatatttgatgtttgaaacactgtaagtttcgtctaattgcgttgtgaaaaggagtttatgaattaatggaaaaaccatcttgttttcgg

SEQ ID NO: 14348 - DNA, 951 bp, Glycine max
cgaaggacacggattgccaagcaaacaatcgttagccgtggataagttctgatcaaagcgtccacgtttttctgcgctggatcctcgtgaaggtgtccaaagctttataacatagaaccgtgccaacgcgtcttcccatcgctctcacacctgtgattattcctcttttaacaatccacacccaaattctagggttccgaaatggacgctggcggaaagatcaagaagggcgccggaggtagaaagggcggcggcccaaagaagaagccggtttcaaggtccgtcaaagccggtctccaattccccgtcggaagaattggccgttatttgaagaaaggaaggtacgctcagcgtgtcggtaccggtgctcccgtatacttggctgcagttctcgaatacctagctgccgaggtgcttgagttggctgggaatgccgcacgtgacaacaagaagaacaggattattccaagacacgtgcttttggcagtgaggaacgatgaggagttggggaaattgcttgctggagtgacaattgcacatggtggcgtgcttccaaacattaaccctgttttgttgcctaagaagaccgagagggcttccaaggaacctaaatctccatccaaggctaccaaatctcctaagaaagcttaagtgtttttattttattttatttgaatatgtaaatcagtctttagatgctttttatgtgaaagaaaaaattatctattgcaaacactgtaattcctatcgtctcgcatgtaggagtttgctacattaatgaaatcttctttatttttttttgggggtcagaatgtcttcctatggtgctttttgttatggtgcatgtctcagttgctgggaagtgaaatgttttttatttttctaacttcgttgatcctttttctgtaataaatttcatttgtttgagatcaaacttgttttgttattatt

SEQ ID NO: 14349 - DNA, 744 bp, Glycine max
ataaaacggtgccaacgccaatttcttctctcatccatttctcgcaacaacgcttaatctctctcattccccatttcctcacctccttcaaccgctgctaaattctagggttccgaaatggacgctggcggaaagatcaagaagggcgccggaggtagaaagggcggcggcccaaagaagaagccggtttcaaggtccgtcaaagccggtctccaattccccgtcggaagaattggccgttatttgaagaaaggaaggtacgctcagcgtgtcggtaccggtgctcccgtatacttggctgcagttctcgaatacctagctgccgaggtgcttgagttggctgggaatgccgcacgtgacaacaagaagaacaggattattccaagacacgtgcttttggcagtgaggaacgatgaagagttggggaaattgcttgctggagtgacaattgcacatggtggcgtgcttccaaacatcaaccctgttttgttgcctaagaagactgagagggcttccaaggaacctaaatctccatccaaggctaccaaatctcctaagaaagcttagattacttttttattttccatatttaatttagtgttgtatatcggtgtttaggtgcttttggtgtaacaggatattttatgtgtttcgaaaacactgtaattcttgtcccaatttgttgcttgtaggagtgagtttgcttcgttaatgaaaagtggaaacccccttgttttcaatcaa

SEQ ID NO: 14350 - DNA, 678 bp, Glycine max
gcttaacctctctcattccccatttcctcacctccttcaaccgctgctaaattctagggttccgaaatggacgctggcggaaagatcaagaagggcgccggaggtagaaagggcggcggcccaaagaagaagccggtttcaaggtccgtcaaagccggtctccaattccccgtcggaagaattggccgttatttgaagaaaggaaggtacgctcagcgtgtcggtaccggtgctcccgtatacttggctgcagttctcgaatacctagctgccgaggtgcttgagttggctgggaatgccgcacgtgacaacaagaagaacaggattattccaagacacgtgcttttggcagtgaggaacgatgaagagttggggaaattgcttgctggagtgacaattgcacatggtggcgtgcttccaaacatcaaccctgttttgttgcctaagaagactgagagggcttccaaggaacctaaatctccatccaaggctaccaaatctcctaagaaagcttagattacttttttattttccatatttaatttagtgttgtatatcggtgtttaggtgcttttggtgtaacaggatattttatgtgtttcgaaaacactgtaattcttgtcccaatttgttgcttgtaggagtgagtttgcttcgttaatgaaaagtggaaacccc

SEQ ID NO: 14351 - DNA, 758 bp, Cenchrus ciliaris
ttctcactctcgatctcttcgaagcccttccttcctcctagtcccgagaagcccactcgaagcgcagccgctgccatggacgccaccggtaccggagcggccggcaaggtgaagaagggagcggccgggcgcaaggccggcggcccgaggaagaagtcggtctccaggtccgtgaaggccgggctccagttccccgtcggtcgcatcgggcgctacctcaagaagggccgctacgcgcagcgcgtcggcaccggcgcccctgtctacctcgccgccgtcctcgagtacctggccgctgaggttcttgagctcgccgggaacgctgccagggacaacaagaagagccgcatcgtcccccgccacgtgctcctggcgatccgcaacgacgaggagctcggaaggctgctcgctggagtcaccatcgcccacggcggcgtcctccccaacatcaacccggtgctgctgcccaagaagacggcagagaaggcgtccagcggcgggagcaaggaggccaagtccccgaagaaggccgccaagtcgcccaagaaggcttagaggactcagatccgatgtcgcgccgtttcctgttacctgtggtgttttaggttgtagatgtgaggaaattggtgcttggtgatgaaccagtattgtaacttgtgatctgtggttttcaatggaagaaatggctagtttaagttaattaatatggtgtgtccgatttctctcaattcgtcctgattttgcaatctggatgtttt

SEQ ID NO: 14352 - DNA, 724 bp, Humulus lupulus
aaatttcccattttcttcccctgcaatttccaatttcaatttccgatctctagctctacctaagaaactagagtttcagccatggacgccggcggaaagatcaagaagggtgctgcaggaagaaagggaggtggtcccaagaagaagcccgtttcccggtctgtgaaagccggtcttcaattcccagtcgggagaattggccggtacttgaagaaagggagatactctcagcgtgttggaaccggagctccggtctacttggcagccgttcttgagtacctagctgctgaggttctggagttggctggaaatgcagctcgcgataacaagaagaatcgaattatcccaaggcatgttttgctggctgtcaggaacgatgaggagctcggcaaattgttggctggtgttaccattgctcatggtggtgtcctacctaacatcaacccaattcttttgcccaagaagactgagaaggctaccaaagagccaaagtctccatccaaagccaccaagtcccctaagaaggcttaatcgttcccaaccgtttccagtttagcttggcccatctttctttctctttatcttttgtatgtatttccgtaggatctagtttttgcttgtgtagaacaaacttggaaaaaacgatttgatgaatttgtaacctcgtagacgtctctgttcattgtgtggagacttatttaatgaagggaatttcttttgcgaa

SEQ ID NO: 14353 - DNA, 672 bp, Zea mays
atcttgctctgaacgcattcctcccatctcccaagacctcctcagacccgagaagcgcagctgcggccatggacgccaccggcactggagctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgacgaggagctcgggaagctgctgaccggcgtgaccatcgcccacggcggcgtgttgcccaacatcaacccggtcctgctgcccaagaagacggcggagaaggcgtccagcggcgggagcaaggaggccaagtcgcccaagaaggccgccaagtcccccaagaaggcatagggtttggaggcggatccgatgttgtcatgtgtaggttgtaagcgggcaatgtgattggctgtgtatctgcttcgctcaagttgctttatgtcattcctaatggaataggaaatgccgtgtttct

SEQ ID NO: 14354 - DNA, 619 bp, Avena sativa
tcgcaatccttccccatctcacaatatctctccggccacacgcccaaatctttccttccgaagcatcgtcgccagccatggacgtctcaggcaccggagctgcagcgaagggcaagaagggcgccgcagggcgcaaggccggcggcccgaggaagaagtccgtgacgcggtcggtcaaggccgggctccagttccccgtcggccgcatcgggcggtatctcaagaagggccggtacgcccagcgcgtcggcaccggcgcccccgtctacctcgccgccgtcctcgagtacctcgcagcagagctgctggagctcgccgggaatgcggccaaggacaacaagaagtcccgcatcatcccgaggcacctcctgctcgccgtcaggaacgacgaggagctcgggaagcttctcgccggagtcaccatcgcccatggcggagtggtgcccaagatcaacccggttctgctccccaagaagacggccgagaaggaggccaagtcgcccaagaaggctgctgccaagtcccccaagaaggcttagaaacaggccttgattgtctttaggctgtgtagtgctccgtgttgttgtcgatgtaatggtcagatccgtgtttctataag

SEQ ID NO: 14355 - DNA, 972 bp, Cajanus cajan
acgcaatatcttctctcatccaattctcgtgttcaactctctcaattcccaattcctcttcttcgctgctaaattctagggttccgatatggacactggtggaaagatcaagaagggcgccggaggaaggaagggtggcggcccaaagaagaagccggtgacaaggtcagtgagggccggtctccagttcccggtgggtagaattgggcgttacttgaagaaaggaaggtacgcgcagcgcgtgggtaccggcgctcccgtttaccttgccgcagttctcgaataccttgctgctgaggtgcttgagttggctgggaatgctgcacgtgacaacaagaagaacaggataatccccaggcacgtgcttttggctgtgaggaacgatgaggagttggggaaattgcttgctggtgttaccattgctcatggtggtgttcttcccaacattaatcctgtgcttttgcctaagaagactgagagggctgctaaggagcctaaatccccctccaaagctaccaagtctcccaagaaggcttagattatgtatatgtattagtgtttgggtgttttttgtgtaaaaggaaaattggtgtgtctcaaacactctaattcttagtgcattgtcttgtgtgtaggtgtttgcttcattaatagaaatcctcttgttttaaatcattttttttatggcggtgttgtttatggtttatactctgaggataaacatcttgagatattaacacgggcaaataattcagattttataatgctgcgttgttgatgggtctttctgatgcttaattgaggtggtctttgcattgactttggtctagttaatgaaggtcaaagttgggacttgtattcacatgggtataactattgtgttgtttgagtgtgcgagtttgcgttttgagatatttactcagtctcctgtttgctatgtgcatagcctttaaatttccaggtttaataaat

SEQ ID NO: 14356 - DNA, 1024 bp, Cajanus cajan
tcatttcttgccatcactttcgcactcgtgattattccctttctaccatcacaccgaaatctagggtttccatggacaccaccggaaagatcaagaagggcgccggaggaaggaaaggcggtggcccaaagaagaagccggtgacaaggtccgtgagggccggtctccagttcccggtgggtagaattgggcgttacttgaagaaaggaaggtacgcgcagcgcgtgggtaccggcgctcccgtttaccttgctgcagttcttgaataccttgctgctgaggtgcttgagttggccgggaatgctgcacgtgacaacaagaagaacaggataatccccaggcacgtgcttttggctgtgaggaacgatgaggagttggggaaattgcttgctggtgttaccattgctcatggtggtgtgcttcccaacatcaaccctgtgcttttgcctaagaagactgagaaggctgctaaggagcctaagtctccatccaaggcaaagaagtcccccaagaaggcataaaaggattagtttattgtctttttacttagcctgcacaatgtacatttgtgtttaggttttttttaatccttttcccagtcacatccctcatatgttttctttttctttctctttctcagtcggtgtaaacaccaggccctcccctcagtaatgaatgaatttatttttataatatttatataatttcttctctgtggaaataattctttgatgtatgccactgcaacgaaagtgggtggacgaattgagatcgagaaagaatgagttgtcgagtgattttgatttcgtcatgatttggtttagtgtgcgtggaatcatgtaaagaagtaaattttacttgatgtcatgttttgtgcggtattaatttttgtttattctcggatgcgctactgaggacagtggcgtgagggaaatggtgtcaaatttgtacttggtggcttgacttggttttgaattttctttcttatttactacaagtctataataagatatgctaatttgtg

SEQ ID NO: 14357 - DNA, 740 bp, Centaurea maculosa
cggggattgctactaccttcaaacaaatccattagccatttctgcaaatagcctttcagaaattatcagagagagatggacaccaccggaaaagtgaagaaaggagctgccggaaggaaggccggaggtccgaggaagaagtcggtcactcgttcggtcaaagccggtcttcagtttccggtcggtagaatcggccgttacctgaagaaaggacgttatgctcagcgtgttggaaccggtgctccggtgtacctcgccgccgttctcgagtaccttgctgcagaagtgttggaattggctggaaatgcagcaagagacaacaagaagaacagaatcatcccaaggcatgtgttgttggccatcaggaatgatgaggagcttggaaaattgttggctggtgtaacaattgctcatggaggtgttcttccaaacatcaacccaattctcttgcctaagaagactgccaccaaggagcctaaatctccatccaaagctgcaaaatcaccaaagaaagctgctgcctagatgaatgaatgtctgattagattatagtgctttggtatctgtaattgttttgggtaatttgaaatagagtagttggttataaacttaatcctaatgttgataagttgttgtcttgtcagttagctgttttagcataaaacaggactcagttgtgtttcttttgcgcaattgttttggagatgatatttttaagcaaatacagttttatgtttctc

SEQ ID NO: 14358 - DNA, 672 bp, Centaurea maculosa
gccatttctgcaaatagcctttgagaaattaagagagagatggacaccaccggaaaagtgaagaaaggagctgccggaaggaaggccggaggtccgaggaagaagtcggtcactcgttcggtcaaagccggtctccagtttccggtaggtagaatcggccgttacctgaagaaaggacgttatgctcagcgtgttggaaccggtgctccggtgtacctcgccgccgttctcgagtaccttgccgcagaagtgttggaattggctggaaatgcagctagagacaacaagaagaacagaatcatcccaaggcatgtgttgttagccatcaggaacgatgaggagcttggaaagttgttggctggtgtaacaattgcccatggaggtgttcttccaaacatcaacccaattctgttgccaaagaagactgccaccaaggagcctaaatctccatccaaagctgcaaaatcaccaaagaaagctgctgcctagatgaatgaatgtctgattagattatagtgctttggtatctgtaattgttttgggtaatttgaaatagagtagttggttataaacttaatcctaatgttgataagttgttgtttgtcagttagctgttttagcctaaaacaggactcagttgtgtttcttttgcacaattgttttggagatgat

SEQ ID NO: 14359 - DNA, 552 bp, Centaurea maculosa
tttctgcaattagcctttcagaaactaagagagagagagatggacgctagcacaaaagtgaagaaaggagctgccggaaggaaggccggaggtccgaggaagaagtcggtcactcgttcggtcaaagccggtcttcagtttccggtcggtaggattgggcgttacctgaagaaaggacgttatgctcagagagttggaaccggagctccggtgtacctcgccgccgttctcgagtaccttgccgcagaagtgttggagttggctggaaatgcagcaagagacaacaagaagaacagaatcattccaaggcatgtgttgttagccatcaggaatgatgaggagcttggaaaattgttggctggtgtaactattgctcatggaggtgttcttccaaacatcaaccctattctgttgcccaagaagactgccaccaaggagcctaaatctccatccaaagctgctaaatctccaaagaaagctgctgcctagatagatgtctctgattagattattctccttttgtatctgtaattgtatgcttctctttcttat

SEQ ID NO: 14360 - DNA, 652 bp, Centaurea maculosa
tttgccatttctgcaattagcctttcagaaactaagagagagagatggacgctagcacaaaagtgaagaaaggagctgccggaaggaaggccggaggtccgaggaagaagtcggtcacacgttcggtcaaagccggtctacagtttccggtcggtaggattgggcgttacctgaagaaaggacgatacgctcagagagttggaaccggagctccggtgtacctcgccgccgttctggaataccttgccgcagaagtgctggaattggctggaaatgcagctagagacaacaagaagaacagaatcatcccaaggcatgtgttgttagccatcaggaacgatgaggagctcggaaaattgttggctggagtaacaattgctcatggaggcgttcttccaaacatcaaccctattttgttgcccaagaagactgctaccaaggagcctaaatctccatccaaagctgcaaaatctccaaagaaagctgctgcctagatgaatgactctgattagattattcttcttttgtatctgtaattgtatgcttctctttcttatagcccttcatggctgtttgaaatagagtagtagaaatagtttatatcatcatggatatttttggatcaaaaagaaaaagtaccgactgcgtggcc

SEQ ID NO: 14361 - DNA, 649 bp, Avena sativa
ccccaaatctctccctcctcttctcacttctagctcttctccacgaccgccgctagcaatggacgcctcaaccaccgtagctgaatcgaaggcgaagaagggctccgccgggcgcaaggctggcggccccaggaagaagtcggtgacgcgttcctctaaggccggcctgcagttccctgtaggccgcatcgggcgatacctgaagaagggccggtacgcccagcgcgtcggcaccggcgcccccgtctacctcgccgccgtccttgagtacctcgccgctgagctgttggagctcgcggggaacgccgccaaggacaacaagaagagccgcatcatcccgaggcacctgttgctcgccatcaggaacgacgaggagctcggcaagctgttggccggcgtcaccattgcgcatggtggtgtactgcccaagatcaacccggttctgctccccaagaagacggcggaaaaggccgccaaggagcccaagtcgcccaagaagacgaccaagtcacccaagaaggcttagatcttagcctttgtggccttctgtaatggtgctctctgtttggctaatgttgttcgatgtaatgttcttatctgttctgctaagaaaaatgaatgtcggaatcaaatctctccctcctcttct

SEQ ID NO: 14362 - DNA, 1266 bp, Beta vulgaris
aaattcttcaaacttttccctctctctctcatattcacaccaaaaacacacaaaaaactccattgttgttttagagagagaaagcttgaaaataatggattcaactgctggaggaaaggcaaagaaaggagcaggaggaaggaaaggtggaggtccaaagaagaagccagtttctcgttcagttaaagctggattacaatttccagttggaagaattggaagatacttgaagaaaggtcgttatgctcaacgtgttggtactggtgctcctgtttatttggctgctgttcttgagtaccttgctgctgaggtattagagttggctggaaatgctgcaagagacaacaagaagaacagaatcatcccaagacatgttctccttgctgtgaggaacgacgacgagctcggaaagcttctttcaggagtgacaattgcacatggaggtgttcttccgaacataaacccggtgttgttgccgaagaaggctggaggagataaggctactaaggagccaaaatctccttcaaaggctactaaatctccaaagaaggcttagaaagttattgatttggtttcgaggtaggaagaattgggagttgttcttgagttattgcgttgtgtatgtaatgtcaagtagtttaattagggttttcgaaaagaatagggatttagtatattgtaatggaggttgtagttggaaggttttatggaaattgagtcaatagctgattgattcagtttctgttatgatataaatgaaaatcattttatttttcctccaaaaaaaaaaaaaaaactcagggggggcccggataccaattcccccatgggaatcgattaaaattcctgggcgcgtttcacacttcagaatgggaaaacctggcgttcccactttaacgcattgcccattcccccttccccagtggggaatataaaaggccgacaatccccttcaaattggcccccttaggcaaaggaaattaacctaaatttgaaaatcccgaaattttttaaacctcttttaacaaagcaatcggaatcttttataaaaattccaaaggtgaagttttccttgaaaccccttaaacggatcccctaggcaaacttaaggggagccaggacccccaaatttggggggccaacaaagcccaggccattcttggaacttattgaaaaaaaaaggccggggatatccaaaccccttgctggggggtttaggccttttttatccacaaataaaaaaaatttttgttccccaaaaggcgc

SEQ ID NO: 14363 - DNA, 686 bp, Silene vulgaris
atttctctcactactcacaaaataaaccgaaccaaccaaacacactaaaccaaccgaagaaaatggattcaactggaggaaagaagaagggagctgcaggaaggaaagccggcggtccaaagaagaagtcagttacccggtccatcaaagccggtcttcagttcccggtcggtcgtattggaaggtacctgaagaagggccggtatgctcagcgagtcggatctggagctccggtttacttggctgctgttcttgagtaccttgctgctgaggttttggaattggcgggaaatgctgcacgtgacaacaagaagaacaggataatcccaaggcacgtgctactggcaattaggaacgatgaagagctcggaaagctgttggccggagtcaccattgctcatggaggagtgttgccaaacattaacccgattctgttgcctaagaagactgctgagaagtcacccaaggagccgaaatctcccaaggccgccaaatcgccaaagaaagctgctgcttaagtgtgatttcgtatgatttgtgtatgtaagctaattagaaggtttcagtttagttagtatcgttggttgtttagtggtatggttgttttggagtcgatttctgatcgattcttgacttatgtaatgcggaagtgttgtgattgctacttaagttatgatatatgaatt

SEQ ID NO: 14364 - DNA, 628 bp, Silene vulgaris
ttcaaccggaggaaagaagaagggagctgcaggaaggaaagccggcggtccaaagaagaagtcagttacccggtccatcaaagccggtcttcagttcccggtcggtcgtattggaaggtacctgaagaagggccggtatgctcagcgagtcggatctggagctccggtttacttggctgctgttcttgagtaccttgctgctgaggttttggaattggcgggaaatgctgcacgtgacaacaagaagaacaggataatcccaaggcacgtgctactggcaataaggaacgatgaagagctcggaaagctgttggccggagtgaccattgctcatggaggagtgttgccaaacattaacccgattctgttgccaaagaagaccgctgagaagtcacccaaggagccgaaatctcccaaggctgccaaatcgccaaagaaagctgctgcttaagtactgtgatttcgtatgatttgtgtatgtaagctaattagggtttcggattagttagtatcgtatggacgtatggttgtttagtggtatggttttggagtcgatttctgatcgattctcggcttttgtattgctcaagtgttatgattgcagcttaatgatatatgaatttcagtt

SEQ ID NO: 14365 - DNA, 1090 bp, Glycine max
tcactctcgctcttgcaattattcctcttctcgcaatccgcactaaaattctagggttccgaaatggacgctgacggaaagatcaagaagggcgccggcggaagaaagggcggcggcccaaagaagaagccggtttcaaggtccgtcaaagccggtctccaattccccgtcggaagaattggccgttatttgaagaaaggaaggtacgctcagcgtgtcggtaccggtgctcccgtatacttggctgcagttctcgaatacctagctgccgaggtgcttgagttggctgggaatgcagcacgtgacaacaagaagaacaggattattccaagacacgtgcttttggcagtgaggaacgatgaggagttggggaaattgcttgctggagtgacaattgcacatggtggcgtgcttccaaacattaaccctgttttgttgcctaagaagtctgagagggcttccaaggaacctaaatctccatccaaggctactaaatctcctaagaaggcttaattgacttattagtttattgttctctatttagtgtgcacaatgtaaatctgtgtttaggttcttttttctatcaccataattgtagttctcaaatcgttgtttattttttgcattttcactcaattagtcgaaacagcaagttctcagtaagggattaatttaattttcttatattcgtataattgtatcctttctcattctctctctcaatcgagatgttgtgaaatgttacattgttgaatgcctttgcaatcgtttttttttttttttactcctgtttgaaaactatttagatgagagtttctcagaatttgattttaatttcatcatacttcttgtttggagtttggactggtgtatgtgtgatgcaataaagaaatggacgtagagagtatgttaccttaatgcactattgaaggcagtggcaagagtgtaatgtcaggtttgaatgtcaaattgagtctcagttctagtgcaggctctccccgtcttgctatcctatagactttagatcgactgaaagtcaatttgaatggactgtttcgttgctactgtgtttgacgtggatgtaatcagc

SEQ ID NO: 14366 - DNA, 788 bp, Spinacia oleracea
aaatccccagtgtttagagagagagatttgtaagagaaaaaatggattcagcaggaaaggggaagaagggagctggaggaaggaaaggaggtggtccgaagaagaagccagttacaaggtcggtaagagctggattgcagtttccagttggtaggattggaaggtttttgaagaaagggaggtatgctcaacgtgttggtactggtgcccccgtttacttggctgctgttcttgagtaccttgctgctgaggtgttggaattggctggaaatgctgcaagggacaacaagaagaccagaatcatcccaaggcatgttttactagctgtgagaaacgatgatgagctcggaaagcttcttgccggagtcaccattgcacacggaggggttcttccaaacataaacccagtgttgttgccaaagaaggttgcagagaagtctccaaaggagcccaaatctccttctaaggctaccaagtcccccaagaaagcatagaatttgttagtggatctggggttttccccatttcttgtttctggtttcattttctttgtatctattgtcagtagatgttcgtaattagtttctttttctttgataagggatggtgttggatgttgtagttgagggtttcatcatgtgaattaaatcgtgatagtttggttaattcactttgtaatgttgctatcaatgacaaatattttaaatttctcatcttagtcatctattctcaccctcctaatttgtaaaattgagcagtcagaatcttgcttatttctttaatttgca

SEQ ID NO: 14367 - DNA, 784 bp, Amaranthus tuberculatus
cttacttcgaagtccatctcttcgctatagttctattcctttattgcacaacaaaactccaattttttaagagacagaaagtatctaaaatccaaaaatggattccactggaggaaaggcaaagaaaggagcagccggaaggaaaggaggaggcccaaagaagaagccagtttcaaggtcagttaaagctggtctgcagtttccagttggaagaattggaaggtatttgaagaaaggaagatatgctcaacgtgttggtactggtgctccagtttacttggctgccgttcttgagtaccttgccgctgaggtgttggagttggctggaaatgcagcaagagacaacaagaagaacagaatcatcccaaggcacgttcttcttgcagtgaggaacgatgatgagcttggaaaattgttagccggagtaacaattgctcatggaggtgttcttccaaacattaaccctgttttgttgccaaagaagactgcagagaagactcctaaagagcctaaatctccatccaaagctaccaaatctccaaagaaagcttagatctgttgatgttagtgatgatttgttggtgaaatttagcggaaaatcaaatgaatttggaactgtattaatgttttttgtatgtaatgttagatgttaaaattaggttttatgagacgatagggttttagtatcttgcgctggtaaggttgtagttatagagtataggaatcgaatcaatagtttattgatttgatttctctagtgttattggatttactcatttataat

SEQ ID NO: 14368 - DNA, 1115 bp, Daucus carota
aaacaatctttcttcttaaacatacatatttattttaggaatggagactggtggaaaagcgaagaaaggatttggaggaaggaaaggcggcggtccaaggaagaaggccgtgactcggtctgtccgggccggtttgcagtttccggttggaagaattggccgttacttgaagaaaggacggtatgctcagcgtgttggaaccggagctccggtttatcttgctgcagtccttgaataccttgctgctgaggttttggaattggctggaaacgcagcaagggacaataagaagaccagaatcattccccgacatgtgctcttggcagtgaggaacgacgaagagcttggaaaactattggccggagtcacattcgctcacggtggagttttaccaaacatcaacccagtcttgttgcccaagaagaccgcggagaaggctcccaaggagccaaagtcgccagcgaaggccggaaagtcacccaagaaggcttaatttgttcgctcttttagtagttaatagtttccagaactttgttttgtgcctaatagtcaagaagtgtattgctctatcagatctgtttagttggttgatctacatggcaaattgatcttgtattctgttaagtttgagttaatgaaatgtttagatctgttttgcaatggctatgtaaattctgataaagatgaaatcaaacaaggaacataaaattgggttctaattgcattggtgtattcagctctgttttgaaaacccaatccattcgagaactaattgttctaggagagcaatgtacaatgtacttaactaggggaaaattgtggacacttgctaaaactaaagatttgattgtcttgatgaggtctcttgttgctgcatctgatatcttgtgatctgcagaaatggggcgctttgcgattatatgtccggtgctgaatagctgccttcactgacggtcatcatgaatcgtttagaccattgttgcttcacagattccggaaccagagatccaccaatgaaagggttccaagagtctccctttgcactagcaatcacccaattgattttcaagggggggggggggggggggggggggggggggggggggggggggggg

SEQ ID NO: 14369 - DNA, 490 bp, Echinacea purpurea
actctacacacaagcaaacacaaacacaaatcgaaatggatgctagcggaaaagctaagaagggtgccgcaggacgcaaagccggcggtccaaggaagaagtcggtcactcgctccgtcaaagccggtctccagtttccagtcggaagaattggccggtacttgaagaacggtcgctatgcaaagcgtgtcggaaccggagctccggtttatcttgctgctgttcttgaataccttgctgctgaggttttagaattggctggaaatgctgcaagagacaacaagaagaacagaatcaatccaaggcatgtgttgttggctgtgagaaatgatgatgaacttggaaagcttcttgcgggtgtgacaattgcccatggtggcgttcttccgaacatcaatccagttctgttgccaaagaagtctcatgaaaaagcggcaaaggaacccaaatctccatccaagtcgactaaatccccaaagaaagcttagtt

SEQ ID NO: 14370 - DNA, 666 bp, Fagopyrum esculentum
tctagaatcaatttacccgcttcaacatttcaaatttctcctccgaaaccacagatcgacatttctctcgaaatggatgccagttcaaaggtcaagaagggagccgccggaaggaaggccggtggtccgaagaagaagtctgtttcccgttccgtcaaggccggtttacagtttccagtcggtcgtattggccggtatctgaaaaacggccgatacgcaaagcgtgtcggaagtggagctccagtatacctcgctgctgtcctcgagtacttggctgctgaggtcttggaattggctggaaatgccgctagggataacaagaagaccagaattattccacgacacctcttgcttgctgtgaggaacgatgaggagcttggaaagctgttgaatggtgtgacgattgctcatggcggtgtcttgcctaacattaacccggtgcttttgccaaagaagactgccgagaaggcccccaaagagcctaaatctccttccaaagctaaaaagtctcccaagaaagcttaggctgtagaaattaagaattgtagcaagttaatctcgtgagttgcagcaacgagaacatgtttagttactgttgatctttgcatttgtaatcattttcccgatgattgttcaattagatgaagttagatgtgaacttttgtt

SEQ ID NO: 14371 - DNA, 563 bp, Fagopyrum esculentum
tttcaaatttcccctctgaaacctcggatctacatttcccttcaaatggatgctactaccaaggtcaagaaaggagccgccggaaggaaagctggtggtccgaagaagaagtcagtttcccgttctgtcaaggccggtttgcagttcccagtcggtcgtattggccggtatttgaagaacggccgatacgcaaggcgtgttggaagcggagctccggtttacctcgctgctgtcctcgagtacttggccgccgaggtgttggaattggctggaaatgctgctagggataacaagaagaccagaattattccaagacacctcttgcttgccgtgaggaacgatgaggagcttggaaagttgttgaatggtgtgactattgctcatggaggtgttttgcctaacattaacccggtgcttttgccaaagaagaccgccgagaaggccccaaaagagcctaaatctccttccaaagctaaaaagtctccaaagaaggcttagattgtagagaatatggaatgtaacagagtaatttggtttgttggtgctatgataattctccttag

SEQ ID NO: 14372 - DNA, 685 bp, Fagopyrum esculentum
aaaatctagaatcaatttacccgcttcagcatttcaaatttctcctctgagaccacagatccacatttctctccaaatggatgccagttcaaagggcaagaaaggagccgccggaaggaaggctggtggtccgaagaagaagtcggtttcccgttcgatcaaggccggtttacaatttccagtcggtcgtattggccggtatctgaagaacggccggtacgcaaagcgtgtcggaagtggtgctccggtttacctcgctgctgtcctcgagtacttggccgctgaggtgttggaattggctggaaatgctgctagggataacaagaagaccaggattattccaagacacctattgcttgccgtgaggaacgatgaggagcttggaaagttgttgaacggtgtgacgattgctcatggaggtgttttgcctaacattaacccggtgcttttgccgaagaagactgccgagaaggcccccaaagagcctaagtctccttccaaagctaaaaagtctccaaagaaggcataaattgtagtaattaagcgttgtagcaagagcaagttcattttcgttagttgcataaacgatagccaagtttattactgcaaatctgttgatcattgcacttgtaatcattttcccgatgattgttcaattagatgataatatatgccatccttttgt

SEQ ID NO: 14373 - DNA, 719 bp, Fagopyrum esculentum
tccccaaatctagaatcaatttgcccgcttcagcatttcaaatttctcctccgaaaccacagatccgcatttctcttaaaatggatgccagttcaaaggtcaagaagggagccgccggaagaaaggctggtggtccgaagaagaagtccgtttcccgttccgtcaaggccggtttacagtttccagtcggtcgtattggccggtatctgaagaacggccggtacgcaaagcgtgttggaagtggtgctccagtttacctcgctgctgtcctcgagtacttggccgctgaggtgttggaattggctggaaatgctgctagggacaacaagaagaccaggattattccaagacatctcttgcttgccgtgaggaacgatgaggagcttggaaagctgttgaatggtgtgacgattgctcatggaggtgttcttcccaacattaacccggtgcttttgccgaagaagaccgccgaaaaggcccccaaggagcctaaatctccttccaaagctaaaaagtctcccaagaaggcttagatggctgtaattaagaattgtagcaagttaatctcgtgagttgcagtagcgataaccatgtttagtttcagcaaatttgttgacctctgcgtttgtaatcattttcccgatgattgttcaattagatgaagatagatgtgaacttttgttaacttgtttatgtgcacttaacttgttctggttggc

SEQ ID NO: 14374 - DNA, 688 bp, Silene vulgaris
cctcaaatcctctcctacaactcacaatttaacaaaaaaattaattaagagaaatggattcaactggagccaagggaaagaagggagccggtggaaggaagggtggcggtccaaagaagaaggcggtttcgaggtcgatcaaggctggtttacagtttccggttggtcgtattgggaggtacttgaagaaagggaggtatgctcagcgtgtcggttccggtgctccggtttacatggctgctgttcttgagtaccttgctgctgaggtgctggagttggctggaaatgctgcacgtgacaacaagaagaacagaatcatcccaaggcacgtgcttcttgccataaggaatgatgatgagctcggaaaattgcttgctggagtgaccattgcacatggaggagttctgccgaatattaacccggtgttgttgccgaagaagactgctgagaaatcgccgaaagagccgaaatctccatccaaggctgccaagtcaccaaagaaggcttaagttttacagtagcagttgatataagttggttgcattttaatgatatatgtatgtaatggtagaagtagtttgagtaggttgtttaagaagtttaattaagaatctgggatcgatagctaattgattctggaaatctgttgtttttcgagcatttaattaaatatataaatcttaatttc

SEQ ID NO: 14375 - DNA, 1291 bp, Glycine max
gcatctcaccatcactctcgctcttgcaattattcctcttctcgcaatccgcactaaaattctagggttccgaaatggacgctgacggaaagatcaagaagggcgccggcggaagaaagggcggcggcccaaagaagaagccggtttcaaggtccgtcaaagccggtctccaattccccgtcggaagaattggccgttatttgaagaaaggaaggtacgctcagcgtgtcggtaccggtgctcccgtatacttggctgcagttctcgaatacctagctgccgaggtgcttgagttggctgggaatgcagcacgtgacaacaagaagaacaggattattccaagacacgtgcttttggcagtgaggaacgatgaggagttggggaaattgcttgctggagtgacaattgcacatggtggcgtgcttccaaacattaaccctgttttgttgcctaagaagtctgagagggcttccaaggaacctaaatctccatccaaggctactaaatctcctaagaaggcttaattgacttattagtttattgttctctatttagtgtgcacaatgtaaatctgtgtttaggttcttttttctatcaccataattgtagttctcaaatcgttgtttattttttgcattttcactcaattagtcgaaacagcaagttctcagtaagggattaatttaattttcttatattcgtataattgtatcctttctcattctctctctcaatcgagatgttgtgaaatgttacattgttgaatgcctttgcaatcgtttttttttttttttactcctgtttgaaaactatttagatgagagtttctcagaatttgattttaatttcatcatacttcttgtttggagtttggactggtgtatgtgtgatgcaataaagaaatggacgtagagagtatgttaccttaatgcactattgaaggcagtggcaagagtgtaatgtcaggtttgaatgtcaaattgagtctcagttctagtgcaggctctccccgtcttgctatcctatagactttagatcgactgaaagtcaatttgaatggactgtttcgttgctactgtgtttgacgtggatgtaatcagcaagttacatagcgttgacttgtagcttgaacggttaaaaattttcatcttgaaattttgttgttatgataagatggaaaggcagaatatttacctggtttccacttgaaattgctttgccgaatttctcttttttggtgcttgtttaaatttgttgactctagctttgctagtgtggtgtcaacttttgt

SEQ ID NO: 14376 - DNA, 925 bp, Panicum virgatum
ttggtcgagccacccgctcccacggatcgcgctccgcgagctccatcgtggccgtcggctggactccagatctgaccgctcgttgcccccgcacgcggatcgacgggcccaccacttcccctatcgcgccctttaaatggccggcatcgccttccattacggccggggaccgtgcgatctcgcattcctctctccaatctctcgagcctttcctcctcgtccgtcccgagacactcgaagcccagcggcggcatggacaacaccggcaccggagctggcggcaaggtgaagaagggagccggtgggcgcaagacaggcgggccaaggaagaagtcggtgacgaggtccgtgaaggctgggctccagttccccgtcggccgtatcgggcgctacctcaagaagggccgctacgcgcagcgcgtcggcagtggtgcccccgtctacctcgccgccgtcctcgagtatctcgccgctgaggttctggagctcgccggcaacgcggccagggacaacaagaagacgcgcatcatcccccgccacgtgctcctggcgatccgcaacgacgaggagctcgggaagctgctctccggcgtcaccatcgcccacggcggcgtcctccccaacatcaacccggtcctgctgcccaagaagacggcggagaaggcgtccagtggcggcagcaaggaggccaagtcgccgaagaaggcggccaagtcccccaagaaggcatagagggtggacttagatccaaatgtgtagcgccgtctcgtgtttcctgtgatgtttaggttgttgatgagggaaagttgtgggcggatatgagccagtggtgtcgtaacttgtgatctgtggttttcaatggaagaaatggttagttcaacttaactcggtgcgcctgattttgaaatgtgccgtaactctttct

SEQ ID NO: 14377 - DNA, 615 bp, Chrysanthemum coronarium
caccaaatggagggagctggtaaagttaagaagggagcagcaggaaggaaagccggtgggccgcgaaagaagtcagttactcgatctgtaaaagccgggcttcagtttccagttggtagaattgggaggtatttgaagaaaggtcgttatgctctccgtgttggtactggtgctcctgtttatcttgctgccgttctcgaataccttgcagctgaagtcttggaattggctggaaatgcagccagggacaacaagaagaccagaatcatcccaagacatgttttgttggcgattaggaatgatgaggaactcggaaagctgttgtctggagttacgattgctcatggtggtgttttgccaaacattaaccctgttttgttgcctaagaagactgctgctaaagagtcaacaccaaagtctccatctaaagctggaaagtctcctaagaaagcttagattagtttgatgctattggattaatgtaactgtggtgttttcgtttgtttgatttgctaggaaagttagcctagtttgaatgattggatgtaatcatccaaattgaatgaaagctacttgtttctgtttattttgccacgtttgatattttattgctga

SEQ ID NO: 14378 - DNA, 501 bp, Chrysanthemum coronarium
cacaacctcaaacactctcaaaacaaacaaacactcattttttataagtaagaatggagggaatcggtaaagtgaagaagggagcagcaggaaggaaagccggcgggccacgaaagaagtcagttactcgttccgttaaagccgggcttcagtttccagttggtagaattggaaggtatttgaagaaaggccgttatgctaagcgtgttggtactggtgctcctgtttatctcgctgccgttcttgagtatctagcagccgaagtgttggaattggcgggaaatgcagctagggacaacaagaagactaggattattccgaggcatgtgttgttggcgataaggaatgatgaggagcttggaaagttgttgtctggggttacgattgcacatggtggtgttttgccgaatattaaccccgtcttgttgcctaagaagactgctgctaaagaatcaacaccaaagtctccatccaaagctgcaaagtcacctaagaaggctg

SEQ ID NO: 14379 - DNA, 633 bp, Parthenium argentatum
acaacacacacacacagaaaacccacaaaccatcaaccaaaagttaccaatggaaaccaccggtaaagcaaagaaaggtgcagcaggacgcaaagccggcggtccacgtaagaaggccgtcacccgttccgtcaaagccggtctccaattccccgtcggtagaatcggccgttacctaaaaaaaggccgttacgctaaacgtgtcggtaccggagctccggtttatctagccgccgtacttgaataccttgcagcagaagttttggagttggcgggaaatgctgcaagggataataagaagaataggataattcctaggcatgtgttgttggcgataaggaatgatgatgagcttggaaagttgttggctggggtaacgattgctcatggtggggtgttacctaatattaatcctgttttgttaccgaagaagagtgctgctgctgtgaaggaggggaagtcacctaaggctgctaagagtcccaagaaggcttaggttgtgttaggttaggtttggttgttgttttgggtttttattgtagttaagttggaaattgattgtaggttgttgatggtgttgttaagtttttatgttgatgttgaggttaatgaatgaaagaaaccgcttgtttc

SEQ ID NO: 14380 - DNA, 629 bp, Glycine max
ttattcctcttcccattctagggttcccaaatggacgctggcggaaagatcaagaagggcgccggaggaagaaagggcggcggccctaagaagaagccggtttcaaggtccgtcaaggccggtctccaattccccgtcggaagaattggccgttatttgaagaaaggaaggtacgcccagcgtgtcggtaccggtgctcccgtttacttggccgcagttctcgagtacctagctgctgaggtgcttgagttggctgggaatgctgcacgtgacaacaagaagaacaggattattccgagacatgtgctgttggctgtaaggaacgatgaggagttggggaaattgcttgctggtgtcaccattgctcatggtggtgttcttccaaacattaaccctgttttgctacctaagaagactcaggttgctaaggaaccaaaatctccatccaaggctaccaagtctccaaagaaagcttagatgtttttattttattttaatatatgtatatcagtgtttagatgctttttatgtaaaagaaaatagtatctgttggaaacactgtaattcttatcgtcttgcatgtaggagtttgctaaataatgaaaatatcttattattttgggtcaaaa

SEQ ID NO: 14381 - DNA, 782 bp, Cenchrus ciliaris
aaggtgaagaagggagcggccgggcgcaaggccggcggccctaggaagaagtcggtgtccaggtccgtgaaggccgggctccagttccccgtcggccgcatcgggcgctacctcaagaagggccgctacgcgcagcgcgtcggcaccggcgcccctgtctacctcgccgccgtcctcgagtacctggccgctgaggttcttgagctcgctgggaacgctgccagggacaacaagaagagtcgcatcatcccccgccacgtcctcctggcgatccgcaacgacgaggagctcgggaagctgctcgctggagtcaccatcgcccacggtggcgtcctccccaacatcaacccggtgctgctgcccaagaagacggcagagaaggcgtcaagcggcggcagcaaggaggccaagtccccgaagaaggccgccaagtcgcccaagaaggcatagagggtggactcagatctgatgtcgcgccatttcctgttacctgtggtgtttaggttgtagatgtgaggaaattggggcttggtgatgaaccagtattgtaacttgtgatctgtggttttcgatggaagaaatggctagtttaagtttattaatatggtgtgcccgatttatctcaattcgtcctgtgattttgcaatctggatgttttttccttgggcgatttggaatcatccgctgtgtccaatggaatcatctttcgtttatataaatgggaatttagaatccccttgtgaaatctctcatgtttgtgcaagtagtgcgtttaacttttc

SEQ ID NO: 14382 - DNA, 654 bp, Linum usitatissimum
tttcaaaaatggacgccggaacaaccaaagttaagaagggagccgccggcaggaaaatcggtggcccgaagaagaagccagtctccaggtccctcaaagccggacttcaattccccgtcggaagaatcggtcggtacctgaagaaaggaaggtacgctcagcgagttggcaccggagctcctgtctacttggccgccgtcctcgaatatctcgccgctgaagttcttgagctggcgggaaacgcagcgcgtgacaacaagaagaacaggatcatcccgcgccacgttcttctggcgatcaggaacgacgaggagctaggaaagctgctggccggagtgacgattgcgcacggcggtgttctcccgaacatcaacccggtgctgttgccgaagaagtcagagaaagctgcccccaaggaacccgcggagaagaaggcatccgccaaggctaccaagtcccccaagaaagcttgatttaggtcattgaaattggatataggcttgtcttgttcttgtagctgtgtaactaatttctccagattagcttttgtggttgtttgcaaatgtatcgttgtttggatcaaggtttgacagtgatagggaatctctgtattggtttgcaatggaaatgaagatgaaacatttcgtttcaatc

SEQ ID NO: 14383 - DNA, 633 bp, Avena sativa
atcccaatctcgcgctaccacttctcatctcctccgccgatcgagtaaccagcagcagcaccaagtcatggacgtctcaagcacagcaactggagccaaggggaagaagggcgcggccgggcggaaggccggcggccccaggaagaagtctgtcactagatccgtcaaggccggcctccagttcccggtcggtcgcgtcggccggtacctgaagaagggccggtacgcccagcgcgtcggcaccggcgcccccgtatacctcgccgccgtcctagagtacctctccgccgaggtgctggagctcgccggaaacgccgccaaggacaacaagaagagccgcatcatccccgccacttgctgctcgctgtcaggaatgacgaggagctcgggaagctgctcgccggcgtcaccatcgcccacggcggcgttctgcccaagatcaacccagtgctgctgcccaagaagacggcggagaaggcggccaaggagcccaagtcgccgaagaagactggcaagtccccgaagaaggcctagatgaactcgtttcattgcctaggttggtatctgggaacgatctgtgtgcttcagagtagaatgttaatgtctgtcctgtcctctgtcgttgtactaccg

SEQ ID NO: 14384 - DNA, 735 bp, Silene vulgaris
ggaaacatttccaaatctcaaattctctccttcactttccaaattacaattcaacaaaaaaatcaattaagagaaatggattcaactggagcaaagggaaagaagggagccggtggaaggaagggtggcggtccaaaaaagaaggctgtttcgaggtcggttaaggctggtctccagtttcctgttggtcgtcttgggaggtacttgaagaaaggaaggtatgctcagcgtgtcggttccggtgctcccgtttacatggctgctgttctcgaataccttgctgctgaggtgttggagttggctggaaatgctgcacgtgacaacaagaagaacaggatcatcccaaggcacgtgcttcttgccataaggaacgatgatgagctcggaaagttgcttgctggagtgaccattgcacatggaggagttctgcctaatattaacccggtgctgttgccgaagaagactgctgagaaggcacctaaagagccgaaatctccatccaagaccaaggctgctaagtcaccaaagaaggcttaggagtttacagtagtagttgatatgagttggttttattttaattatgtttgttttagtttattggaatatgtatctaatggtagaagtagtatgagtaggacgttgaagaagtttaattaagaatctgggatcaatagctgattgattctggaaactgttgttttgagtattattaatcaaatatataaatcttcaatt

SEQ ID NO: 14385 - DNA, 780 bp, Nicotiana tabacum
tctctcgctccgacaaccaattttttccttcaaatcattcatcatcctgctctaaattcttctatcttcaaatggatactagcggcaaagcgaagaaaggtgcagccggaagaagaggcggcggtccaaagaagaagccggttacccggtccgtgagagccggtcttcagttcccggtcggtagaatcggtcggtacctgaaaaaaggccgttacgctcaacgtgttggtactggtgctcccgtttacttggctgctgttctcgaatatctggctgctgaagtgttggagttggctggaaatgcggcacgtgacaacaagaagaacaggattatcccaaggcatgtgcttttagctgtgaggaatgatgaagagttagggaagttgcttgctggcgtgacaattgcacatggtggtgttcttcccaacattaacccaattttgttgcctaagaagactggaggtgataaggctggcaaagaacctaaatctccttccaaagctaccaaatctcctaagaaggcttagatttagtggttgtaatagccttttgtttttctatctttatttggatatttactgtatgtatctgtgctgttagaatgtgttcgatcgttcttcggggatgacaaaagggaattaattggaacttggaactgttagaccttactaggttgttttctattatcaggttgttttctattatcaatcaatgaaaccccttgtttcgattttaaaacaacccacatgacgacacaaaaaaaaaaggggcgccacggct

SEQ ID NO: 14386 - DNA, 458 bp, Flaveria ramosissima
aaatggaagccaccggaaaaaccaaaaagggcgccggaggacgaaaagccggcggcccaagaaagaaagccgtcactcgctccgtcagagccggtctgcagttcccggtcggaagaatcggccggttcttgaaaaaaggccgatacgcccaacgagtcggcaccggagctccggtctacctcgccgccgtcctcgaatacctcgccgccgaagtgttggagttggcgggaaatgctgctagagataacaagaagaacaggataatccctaggcatgtgttgttggcgattaggaacgatgaggagcttgggaagttgttggctggagtgacgattgctcatggtggtgttcttccgaatattaatcctgtgctgttgccgaagaagactgctgcggctaaagaacctaagtcaccgtcgaaagctactaaatctccgaagaaggcgaattagttttgt

SEQ ID NO: 14387 - DNA, 801 bp, Petroselinum crispum
tttcttcaaaaacctcccaattctaccgatctcaaacaatctcaatttattagcaagtagtactattttattaagatttgtagaaatggagagcccagctgccggaaaagtgaagaaaggagctgccgggaggaaagccggtggaccaaagaagaagtcagtgactcgttctgtcaaagctggactccaattccccgttggaagaattgggaggtttttgaagaaaggtcgttatgctcagcgtgttggtagtggcgctcctgtttaccttgctgccgttctcgagtacctcgctgcggaggtccttgagttggctggaaatgctgcaagagacaacaagaagactcgaataattccgaggcatttgttgttggcaatcaggaacgatgaggagctgggaaagctgttgggaggagtgacaattgcacatggtggagtgttgcctaatatcaaccctgttctgttgcccaaaaagactgttgagaaggctgccaaagaaccggctgctaaggttgctggaaagtccccaaggaaggctgccaagtgatgatgtagttgtttaattaggctaatgatcctgttatggactagttatgctcagtgttagttcctgcaatcagatagttattgcaatttaagtgataatagttagttctggattagtctgtggttgttttgttctcttgtgattatgttggatgttttattgaagtatgcttaaggagaattatagagatgaagattgtaattcctactctaatatatggatagtgttgatttaagttttatttttgtttcgtg

SEQ ID NO: 14388 - DNA, 696 bp, Sarracenia psittacina
aacaagtgagaatggatgccgctggaaaggtgaagaaaggtgccgcagggagacgtggtggcggtccgaagaagaagccggtatcccggtccgtcaaagccggtctgcagtttccggtcggaaggatcggccggtatttgaagaaaggtcgctactctcagcgcgtcggcaccggtgcaccggtttatctcgccgcggtgctcgagtacctcgccgctgaggttttggaattggctgggaatgctgcaagagacaacaagaagaacagaatcataccgaggcatttgcttcttgctgtgaggaatgatgaagaacttggaaagctacttgctggtgtgactattgcccatggaggtgtgctcccaaacattaacccagttcttctccccaagaaaggtgaaaaagcagcatcgaaggagcccaaatctccatctaaggccaccaaatcgccaaagaaggcttaacttagcttttgtttgtagaagaaagcattatctaactctcttttcctcttgtatgtaatttcattttatgactttatgtcgtggtttaaggagggaaaagcttcatggtggcaggaattattgtactctttattgtttcaatatctgtgttagggcaccaatgttgctaatcaaagacatcagattgttgctttcagttctctacttggaattttgatggattgcccttgtg

SEQ ID NO: 14389 - DNA, 776 bp, Arachis hypogaea
cactcaaacacacaactctcgttctcattttctcacaatctctctctctttctccgcaaagaatctgcaatggacgctgcatcgaaagtgaagaagggtgccggtggcaggaaaggaggcggcccaaagaagaagccagtttcccgctccgtcaaagccggtctccagttccccgttggaagaatcggacgttacttgaagaaaggaaggtactcccaacgtgttggaaccggtgcccctgtctaccttgctgccgtattggagtatctagcagctgaggtgttggaattggctggaaatgctgccagggacaacaagaagaacaggattattccaaggcatgttcttttggccgtgaggaacgatgaagaattggggaaattgcttgctggtgttaccattgcacatggtggtgttcttcccaacattaaccctgttttgttgcctaagaaaaccgctgagaaagctcccaagggaaaaaaagtcaccctccaaggccactaagtctccgaagaaagcttgatttgggtgtttagtgtcaatatgtgcgtgttagctccttaatatataacttgtaacgggaaagatcgtgatgggtttggattttgggacaacatttatgtaattgttatgtttgtgtcttatgttttagcatttttagccaatcaatagaaacatccaagtttattagtttgccaaaaaaaagaaaaaaaaacaaaagtactctgcgttgataccactgcttctgagactgccaaggcacacaggggataggc

SEQ ID NO: 14390 - DNA, 1050 bp, Populus trichocarpa
tacgcggatcggtagcactcactcatgaaccgtcgatggaaaacaatccaacagtaagaaatcgtccatccagaaaaccaaaaggttctctccatttttctctcaccaggcaggccccgtatttatctgcccccaaccccatctatgtctctcgcacaaatctagctaggtttctaattgtctgtgtttactgtgcctgtgagagagagacttctagcaagtagtcgttgtagtagtgatggagactggtggaaaggtgaagaaaggagcagcagggaggaaaggaggcggtccaaagaagaaaccggtgtcccgctccgccaaagccggtcttcagttccctgttggtcggatcggtcgatacttgaagaaaggccgttactctcaacgtgttggatccggagctcctgtctaccttgccgctgtgcttgagtatcttgctgctgaggttttagagctggctggaaatgcagcaagggataacaagaagaacaggataataccaaggcatgtgttgttggctgtgaggaatgatgaagaacttggaaagctacttgcaggtgtgaccatagctcatggcggggtgttgcctaacatcaatcctgttcttttgcctaagaaaaccgaaaaggcagccaaagaacccaagtcaccttccaaggccaccaagtccccgaagaaggcttagccactctacccaccactagtgatagagtatttagttttagcagtccttctttcgatatctgcttcctcgtctatgtctgtaatttgcttttgatgtgcttgccctgcttgtaggtaaatcttttactttgtgtttttcttttctaggatttatttagatccatggagttggctctttacttctactccgccatgtacaacaacatcctcgaatgaatgaaatcaattgttgtgttctaaatgtttaagatctgcccatgttcaaatcagctgtttgtttgcacagccatgttctgaggaggtgcgcatcagctaaagctaaaaatgggctttggctacgagattacaaggaagaaaactaca

SEQ ID NO: 14391 - DNA, 1026 bp, Glycine max
tcatctcaccatcactctcgctcttgcaattagtcctcttccaacaatccgcacctaaactctagggttctgacatggacactggtggaaagatcaagaagggcgccggaggaagaaagggcggcggcccaaagaagaagccggtttcaaggtccgtcaaggccggtctccaattccccgtcggaagaattggccgttatttgaagaaaggaaggtacgcccagcgtgtcggtaccggtgctcccgtttacttggccgcagttctcgagtacctagctgctgaggtgcttgagttggctgggaatgctgcacgtgacaacaagaagaacaggattattccgagacatgtgctattggctgtgaggaacgatgaggagttggggaaattgcttgctggtgtcaccattgctcatggtggtgttcttccgaacattaaccctgttttgttgcctaagaagactgagagggcttccaaggagcctaagtctccatccaaggctactaaatctcctaaaaagtcttaactgacttagtttattgtttctctatttagtgtgcacaaaatgtaaatctgtgtttaggttccttcttgtatcaccattatttgtagttctcaagtcgctgtttctttttcacattttcattcaatctgttgagacagcaagctctcagtaatggattgatttaattttcttatattcgtataattgtatcccgccttctctctatcgaaagattgcgcaatttgatttagacgatttgaatttccatcataattattgtttggataggtgtatgtgtgatccaagaaagaaatggacgttgatagtatgttacttagcactattgtaggcagtgacaagagtttaatgtcaaattatgcatttgcttgatttgattgtttttgagactttctttgtaatttagttggagaagaatttataattaaatttggatccagaatgattataaattcaaataattgtgtagttttgaattttttattaaattttacttttaagttga

SEQ ID NO: 14392 - DNA, 916 bp, Glycine max
tcgctcttgcaattagtcctcttccaacaatccgcacctaaactctagggttctgacatggacactggtggaaagatcaagaagggcgccggaggaagaaagggcggcggcccaaagaagaagccggtttcaaggtccgtcaaggccggtctccaattccccgtcggaagaattggccgttatttgaagaaaggaaggtacgcccagcgtgtcggtaccggtgctcccgtttacttggccgcagttctcgagtacctagctgctgaggtgcttgagttggctgggaatgctgcacgtgacaacaagaagaacaggattattccgagacatgtgctattggctgtgaggaacgatgaggagttggggaaattgcttgctggtgtcaccattgctcatggtggtgttcttccgaacattaaccctgttttgttgcctaagaagactgagagggcttccaaggagcctaagtctccatccaaggctactaaatctcctaaaaagtcttaactgacttagtttattgtttctctatttagtgtgcacaaaatgtaaatctgtgtttaggttccttcttgtatcaccattatttgtagttctcaagtcgctgtttctttttcacattttcattcaatctgttgagacagcaagctctcagtaatggattgatttaattttcttatattcgtataattgtatcccgccttctctctatcgaaagattgcgcaatttgatttagacgatttgaatttccatcataattattgtttggataggtgtatgtgtgatccaagaaagaaatggacgttgatagtatgttacttagcactattgtaggcagtgacaagagtttaatgtcaaattatgcatttgcttgatttgattgtttttgagactttctttgtaatttagttggag

SEQ ID NO: 14393 - DNA, 941 bp, Tropaeolum majus
taagaaattactgtttattaccaatccagtatatactataacctcattggccagacaccaaagccacggatagctagctgattaaacacgccgtagattgatactaatccagcggtataccttcatcaagcctaataccaaggttttcttcggtttctcaacgaactccataaataacctcatcgccggtgcaataacaacctcataaacgctcgaatcattttaccggcggcctcaaaacagtaactctcttaaatatattattctgacattgaattctcatttcttgcctagagataaatggacgccggagggaaagcaaaaaagggcgccggaggtaggaaagcaggtggtccgaagaagaaggctgttaccaggtccattaaagccggtcttcagtttcctgttggtaggattggtcggtacctgaagaaaggccgttactctcagcgtgttggatctggtgctccggtctatctcgccgctgttcttgagtaccttgctgctgaggttcttgaattggctggtaatgcggcaagggacaacaagaagaatcggattataccgagacatcttctattggcagttaggaatgatgaagagcttgggaagcttcttgctggcgtaacaattgcgcatggtggtgtgttgcctaacatcaatcctgtattgcttccaaagaaatctgaaaaagctggtgccaaagaagccaagtctcccaagactactaaatcgcctaagaaggcttaggttactattgtgtacgtactttactaagtgtatctactcgtccaaagatttcgatccttagaacttaagaaaccatttgtatttctttcttgttttatggaacttacattatctgaaatgaggataccaaatttctaaatgctagtatgttgcagaaaatgctatgtccagatttatactattttaccact

SEQ ID NO: 14394 - DNA, 725 bp, Medicago truncatula
atcacactctccatttctcacaaattcttacatcacagcgaattcgtagcaaaaaatctagagttccaaattccaatctcagaaatggacgcaagcaccaagacgaagaagggagctggtggaaggaaaggtggtccaaggaagaagtcagtgacaagatccaccagagctggtcttcaatttccagtcggaagaatcggtcgttacttgaagaaaggaagatacgctcagcgtgttggtactggtgctcctgtttacttagctgctgttcttgaatatcttgctgctgaggttcttgagttggctggaaatgcagcacgtgacaacaagaagaacaggatcatccctaggcacgtgttgttggctgtgaggaacgatgaagaacttggaaaattgttagctggtgttacaattgcacatggaggtgttcttccaaacatcaacccaatccttttgcctaagaagaacgagaaggctgcaactactaccaaatctccatccaaggctaccaaatctccaaagaaagcttagatttagtttctagggtttggtgtttatatctaagtttagcatagcagacatatttcgatgtgtttgtagcaatgcattttggatctcagtgtgtttctgatgtagtaggagtctgattcatgaatgaaaacatcttgtttttactcattttttgttgcttaaacaattcatcttatttaatgctactatcattc

SEQ ID NO: 14395 - DNA, 690 bp, Cichorium intybus
gtgtgaaatggaagccggaacaaaggtgaaaaagggagccgccggaaggaaggctggtggtcctaagaagaagccggtttctcgctccgtcaaggccggtcttcagttccccgtcgggagaatcggccggtacatcaaaaaaggtcgttacgccaagcgtgtgggtaccggtgctccggtctacctcgctgccgttctcgagtaccttgctgctgaggtgttggagttggctggaaatgctgctagagacaacaagaagaccaggattataccgagacatgttttgttggctgtgagaaatgacgaagaacttggaaagcttttagctggtgtgacaattgctcatggtggtgttcttccaaatatcaatccaattcttttaccaaagaagtctcttgagaaagccacaaaggagcccaaatctcctgccaaatcagctaaatccccaaagaaagcttgagtgttgaacaccatgttctataatccatctctttgtatttattcaccttgtgttgttgatttaggatagtatgtagttcaatgtgtttttaggggagattttcaagtattctagtctgctttgtttatggtagggcttaggtttgaaaaagaatatttttccaagttaaaattgcaatccttttaatttaatggatcttttggcatctcaatgcaaaaactattacaaag

SEQ ID NO: 14396 - DNA, 697 bp, Euphorbia peplus
tgtttgtttcccgagaaaagggcagaaacttcactgtccctttcttcatcatcttaattaacattttgaggcatggatgccggaggaaagttgaagaaaggagccggaggaagaaagggaggcggtccaaagaagaaaccagtctcaagatccgtcaaagccggtcttcagtttccagtaggtcggatcggtcggtttttgaagaaaggccgttatgctcagcgtgtaggaagcggagctcccgtttaccttgccgccgtgctagagtatctcgccgctgaggtattggaattggctgggaatgcagcaagggataataagaagaatagaataatacctaggcatgtgctgttggctataaggaatgacgaagaacttggtaagctactagcaggtgtgactatagctcatggtggagttttaccaaacattaatccaatacttttgcctaagaaatccgaaaagattgcagccaaggagcccaaatcaccatccaaggccactaaatcccctaagaaggcttagatctttctttcattttaggcttcttgttatctatctcaacttgtgtatctaatttggtttctatgtacttggtttgtaggaagaattaatatgcttttagcatgttagaaccattgtgctctttcttaaccccatgtagaagatccatttctcattaagtaattaattgttc

SEQ ID NO: 14397 - DNA, 910 bp, Petroselinum crispum
ggagttcagacgtgtgctcttccgatcctctctctctccctcctatattctagtgcctgtatatcttttatcaaatctgaaatggagaccgccggaaaagcaaagaagggatttggtggaaggaaaggcggtccaaggaagaagtccgtgactcggtcggtgaaagccggtttgcagtttccggtcggtagaattggccggtatcttaagaaaggccgctatgctcagcgtgttggtaccggtgctccggtttatttggctgccgttctcgaataccttgccgctgaagttttggagttggctggaaacgcagcaagggacaacaagaagacgagaatcattcctcgacatttgctgttggcagtgaggaacgatgaggagctgggaaaactgttggctggagttacatttgctcatggtggtgttttgccaaacatcaacccagtgttgttgccaaagaagactgctgagaaagctgctaaagagccaaagtctccatctaaggccggaaagtcaccaaagaaggcttaatttatcttttatgtataagtagtttgtgtctaatagtactgaattgcattgagcattaaatctgtttagttggtttcgtttgtaatgcaaagtggtcgtgtatttgcttcatttctagttatttaaatgttttatcttatctgcaatgactctgattagtccttgtttaatttatttaatgcttatatattaacgtaatgtagattataaacatgaaaggaatgtttaattaacatttgtggatttttaagtacagactgaaaaccaaatccatgaactgaaagaaattcgatgaatgtacataattgcgatactgataatactagttgaaaattgttttagtcttgattgaactaaaggactgattcatgggttgcag

SEQ ID NO: 14398 - DNA, 790 bp, Arachis hypogaea
cctatcccctgtgtgccttggcagtctcagaagcagtggtatcaacgcagagtacggggggctcaaaacactcaaacacacaagtctcgttctcattctctcacaatctctctctttttctccgcaaagaatctgcaatggacgctgcatcgaaagtgaagaagggtgccggtggcaggaagggaggcggcccaaagaagaagccagtttcacgctccgtcaaagccggtctccaatttcccgttggaagaatcggacgttacttgaagaaaggaaggtactctcaacgtgttggaaccggtgcccctgtctaccttgctgccgtattggagtatctagcagctgaggtgttggaattggctggaaatgctgcgagggacaacaagaagaataggattattccaaggcatgttcttttggctgtgaggaacgatgaagaattggggaaattgcttgctggtgttaccattgcacatggtggtgttcttcccaacattaaccctgttttgttgcctaagaagaccgctgagaaagctcccaaggaaacaaagtcaccctccaaggccactaagtctccgaagaaagcttgatttgggtgtttagtgtcaatatgtgcgtgttagatccttaatatataacttgtaacgtgaaagatcgtgatgggtttggattttggaacaacatttatgtaattgttatgtttgtgtcttatgttttagcatttttagccaatcaatagagaacatccaagtttattagtttgccaaaaaaaaaaaaaaacaaaagtact

SEQ ID NO: 14399 - DNA, 747 bp, Scabiosa columbaria
caactcagtattcaaattcatcattcttaaatacttgattactctgagaaaatggaggctagcggtaagggaaagaaaggtgccggaggtaggaagggcggtggaccaaggaagaaatcggtgactcggtcggtcaaggccggtcttcagttccccgtcggtagaattggccggtatttgaagaaaggccggtatgctaagagagttggaactggtgccccggtttatcttgctgctgtgcttgaataccttgctgctgaggttcttgaattggctggaaatgcagcacgtgacaataagaaaacacgaattataccaagacatgttttattagcaattaggaatgatgaagaattgggaaaattgcttgctggtgttacaattgcacatggtggtgttttgcccaacattaacccaattctgctgcctaagaagtctgaaaaagctgctagcgaaccgaaatcacccaaggcttctaaatctcccaagaaagctgcttagattagtaattcccgttgtcttttgtatgtagctgttgttcttgaatctagagtgttgttttgttgtgtatcttgttaagagtaatttggttaggaagagtactggcaatgtctttgtttaatttatcagtgtaggtgaatgaaactacttgtttctttaattgatgtttccttttaaattccatctatcttaatcattagaaagaaagtgcactttgataattatgttaggacatggcaagtgcta

SEQ ID NO: 14400 - DNA, 785 bp, Zea mays
atcacaattcacagcgctcaagttctcgcgcccacagccaaatttttctccactcaatcgcggcataagctgcactgcagccatggacgccagcggagccggtagcaaggcgaagaagggggcggctgggcgcaaggctggcggccccaggaagaagtcggtgtcgcggtccgtcaaggccgggctgcagttccccgtcggccggatcgggcgctacctcaagaagggccggtacgcgcagcgcgtgggcaccggcgcccccgtctatctcgccgccgtgcttgagtacctcgccgccgaggtgctggagctggccggcaacgcggcgaaggacaacaagaagacgcgcatcgtcccgcgccacgtgctcctggcgatccgcaacgacgttgagctcggcaagctgctggctggcgtcaccatcgcgcacggcggtgtcctccccaacatcaacccggttctcctgcccaagaaggtggcggagaaggcgtctagcggcggcagcaaggagagcaagtcccctaagaaggccgccaagtccccaaagaaggcagccaagtccccgaagaaggcttagaaattagtcactccactagcgctctgctgtagcatgttcgtgtttagatctgtggatgttatgtgttccggcctaatttcctctttgccttgtggcttctgatatgttcatcggcatgtttgccgtgttgtgtttccttgttctgattttgcaattcatcatcttgttgaatgaacttactatcgggaaatgaagcataataacgatg

SEQ ID NO: 14401 - DNA, 597 bp, Chrysanthemum coronarium
ttctatgatcatgacgtcagatgatccccggacattaccaccaaatggagggagctggtaaagttaagaagggagcagcaggaaggaaagccggtgggccgcgaaagaagtcagttactcgatctgttaaagccgggcttcagtttccagttggtagaattggaaggtatttgaagaaaggtcgttatgctctccgtgttggtactggtgctcctgtttatctcgctgccgttctcgaataccttgctgctgaagtgctggagttggctggaaatgcagctagggacaacaagaagaccagaatcatcccaagacatgttttgttagcgattaggaatgacgaggaactcggaaagctgttgtctggagttacgattgctcatggtggtgttttgccaaacattaaccctgttttgttgcccaagaggactgctgctaaagaatcaaccccaaagtctccatcaaaagctggaaaatccccaaagaaggcttagattagattgatgacactgttgtgttttggttgattacttgatttgttagagagttgtagagtagtttataattttattagatctgatctaatcaattcaatac

SEQ ID NO: 14402 - DNA, 612 bp, Phalaenopsis aphrodite
gcatcccacatctattctcccgtaaaacacccaccaagtctctcatggacgccaccagcaagatcaagaagggcgcaggcggccgcaagggcggcggcccgaagaagaagcccgtttcccgttccgtccgtgctggcctccagttccctgtcggccgtataggccgatatctcaaaaaaggccgatacgctcaccgtgtcggtactggtgctcccgtttacctcgccgccgttctcgaatacctcgccgctgaggttttggaacttgcaggaaatgctgcgcgtgataacaagaagaaccgtatcattccaaggcatgttctacttgctatcagaaatgatgatgagctcgggaagcttctgggtggagtgacgattgcgcatggaggagttctgccaaacattaaccctgtgcttctgccaaagaaaactgcggcgaaggagccgaaggagccttctaaggcagcgaaatctcccaagaaggcggcggcttaggctttggataggtggctttgtatgtaatttgagttctggtgttgctggtttgggaaagaatgtagtttggtaatgcaatggcttttaatttgaagaaaaatatctatttgtttgaaaa

SEQ ID NO: 14403 - DNA, 624 bp, Scabiosa columbaria
cagttcatttcaaatatttccttccaaatcccaactctccgtcaaaaatcacttccttgaaatcacaaatggacgccggcggcaagtcaaagaagggtgccggaggtagaaagggagccggtccacggaagaagtcagtctctcgttcagttaaggctggtcttcagttccccgtcggtagaatcggccggtttctgaagaaaggccggtatgctcagagagttggtagtggtgctccgatataccttgctgccgtgcttgaatatctagctgctgaggttctggaattggctggtaatgctgctcgtgacaacaagaaatctcgaattattccaaggcatgttcttctcgctgtgaggaatgatgaagaattggggaaattgctagcaggtgttacaattgcacatggtggagttttacccaacattaaccctgttttgttgcctaagaagactgagagagcagaaaaagaggcaaaatctccatcaaaggctactaagtctcctaaaaaagcttagatttttatctatttgacatctaatagtctatggaaatttagggttttgtactttcacttttttttcccatctatttatatgaaatgttagttttcttctaatagtt

SEQ ID NO: 14404 - DNA, 801 bp, Oryza sativa
taaatccaaatcggcgccggaaatcccttcaaatcccccccgaattccgctccatttcaccctcacgtttcccggagatggacgtcggcgtcggcggcaaggcggcgaagaaggcggtggggcggaagctgggcgggccgaagaagaagccggtgtcgcgctccgtcaaggccgggctccagttccccgtcggccgcatcggccgctacctcaagaagggccgctacgcccagcgcgtcggcaccggcgcccccgtctacctcgccgccgtcctcgagtacctcgccgcagaggtgctggagctcgccgggaacgcggcgcgggacaacaagaagaaccggatcatcccgaggcacgtgctgctggcgatccgcaacgacgaggagctcgggaagctgctcgccggggtcaccatcgcgcacggcggcgtgctgccgaacatcaacccagtgctgctcccgaagaagaccgcggagaaggccgacaagccggccaaggcgtccaaggacaaagccgccaagtcccccaagaagcaggcgcgctcctagcttcatgtccttccattcattggtcactgtatatgtagtacttagtttgttcgattcgagattagttcgtatcactaggcatttaactggatgttttcgattttagcttgcaagacactagggtagttctaatgagaagatgaagtgtctcgctttgtcttctggatcccatgtgcttcaatatgtggtttctcaattgaaatttgtttgtgttcagtaagtttaatagcctgattgtgaatctgatctaaaa

SEQ ID NO: 14405 - DNA, 542 bp, Oryza sativa
cttcaaatcccccccgaattccgctccatttcaccctcacgtttcccggagatggacgtcggcgtcggcggcaaggcggcgaagaaggcggtggggcggaagctgggcgggccgaagaagaagccggtgtcgcgctccgtcaaggccgggctccagttccccgtcggccgcatcggccgctacctcaagaagggccgctacgcccagcgcgtcggcaccggcgcccccgtctacctcgccgccgtcctcgagtacctcgccgcagaggtgctggagctcgccgggaacgcggcgcgggacaacaagaagaaccggatcatcccgaggcacgtgctgctggcgatccgcaacgacgaggagctcgggaagctgctcgccggggtcaccatcgcgcacggcggcgtgctgccgaacatcaacccggtgctgctcccgaagaagaccgcggagaaggccgacaagccggccaaggcgtccaaggacaaagccgccaagtcccccaagaagcaggcgcgctcctagcttcatgtccttccattcat

SEQ ID NO: 14406 - DNA, 647 bp, Cirsium arvense
gggaccatcattaccttcaaacacttcccaatcactcatttcttctgtaaatcgcttgagaaattaagagagatggaaggcaccgcaaaagcgaagaaaggcgccggaggaaggaaaggcggtggtccgagaaagaagtcggtgactcgttcagttaaagctggactacagtttcccgtcggtaggattggccgttacctgaagaaaggacgttatgctcaacgtgttggtaccggagctccggtataccttgccgccgttctcgaatatctcgccgccgaagtgcttgaattggctggaaatgcagctagagacaataagaagaacagaattatccctagacatgtgttgttagccataaggaacgatgaagagcttggaaaattgttggctggagtaacaattgcacatggtggtgttcttccaaacattaaccctattttattgcccaaaaagactgctaccaaagaaccaaagtctccttccaaagctgccaaatctccaaagaaagctgcttagatgactcatgattagactattctccttttgtatctgtaattgtaagcttctctttcttgtaacccttcatgtttgttgattgggtaatttggatagagtagtagaatagtttatttcatcagagaata

SEQ ID NO: 14407 - DNA, 673 bp, Avena sativa
tcctccgagccccgtcgagcagtagcagcagcgcgccatggacgtctcaggcaccggagctggagccaagggcaagaagggcgcggcagggcgcaaggccggcggccccaggaagaagtccgtgacgcgctccgtcaaggccggcctccagttccccgtcggccgcatcgggaggtacctcaagaaggggcggtacgcccagcgcgtcggcaccggcgcccccgtctacctcgccgccgtcctcgagtacctcgcagctgaggtgctggagctcgccggcaacgccgccaaggacaacaagaagtcccggatcatcccgaggcacgtgctgctcgccgtcaggaacgacgaggagcttgggaagttgctgtcgggcgtcaccattgcacacggtggtgtgatccccaagatcaacccggtgctcctccccaagaagactgcggagaaggaggccaaggagcccaagtctcccaagaagactgccaagtccccgaagaagaccaaggcttagactgatgcgttccgtatcttaggctgtgtagtgtccttcctagtgggttagtagtgttcggctagttccgtcgttgtaccttgttctgtgcttgttaatggaagaatgtctaaaaatatctcatcgttgtttaatttttgattattgttcgaagtttcgtca

SEQ ID NO: 14408 - DNA, 596 bp, Avena sativa
gcagcagcgcgccatggacgtctcaggcaccggagctggagccaagggcaagaagggcgcggcagggcgcaaggccggcggccccaggaagaagtccgtgacgcgctccgtcaaggccggcctccagttccccgtcggccgcatcgggaggtacctcaagaagggccgctacgcccagcgcgtcggcaccggcgcccccgtctacctcgcggccgtcctcgagtacctcgccgctgaggtgctggagctcgccggcaacgctgccaaggacaacaagaagtcccggatcatcccgaggcacgttcttctcgccgtcaggaacgacgaggagctcgggaagctgctgtcgggcgtcaccattgcacacggtggtgtgatccccaagatcaacccggtgctcctccccaagaagaccgcggagaaggaggccaaggagcccaagtctcccaagaagactgccaagtccccgaagaagaccaaggcttagagcgatgcgttccgtatcttaggctgtgtagtgtccttcgtagtgttcggctagtgttgtggctgtaccttgttctgtgcttgttaatggaagaatgtctaaaataaaa

SEQ ID NO: 14409 - DNA, 833 bp, Valeriana officinalis
ctatgtacaatcgatctgcttcctgaatcgtacaaggttcgcgatggtcggatctgtatctccaagcttcaagcttcaaagtggttcattgatacacggttactcgaaccgtattctcatcatctcgtggccgaatcatcacaatcaaagcctcaaagtgtgtggatctgtagatccgacaccactgtggttttcacggcgatggaaactggaggcaaacagaagaagggagcagccggaaggaaagcgggcggtccgaagaaaaagtcagtttctcgatctactaaggctggtcttcagtttccggtgggtcgtattggccgatacttgaagaaaggacggtatgctcaacgggtcggtagcggagctccggtttatttggctgctgttctcgaatatctcgcagcagaggttctggaattggcaggaaatgcagcaagagacaacaagaaatcaaggattattcccaggcatcttctactggcagttcggaatgatgaggagttaggaaagttgctagctggagttactattgctcatggaggtgttcttcctaacataaaccctgttctcttgcccaagaagactgctgctaaggaaccttctgctactcccactaaggcagctaaatctcccaagaaagcttgatgttcagatgtcttttaaccaattagatatctagttggctttggtgttttgttttgtatgtattggatttggtagttttgtgtatcatctttatgttgctccctccgtcccctccaatgtttcctaatttgactttgttattttttttatcactttgcagaatggactagaatacaatcaggttt

SEQ ID NO: 14410 - DNA, 662 bp, Chrysanthemum coronarium
gatctaaaaaatggatgcaacaaaatcaaagaagggagctgctggacgcaagggaggcggtccaaggaagaagtctgtcacccggtctgtgaaagccggtctccagtttccggtcgggagaattggaaggtatttgaagaagggaaggtatgctaagagggttggtactggtgccccggtttatcttgctgctgtccttgagtaccttgctgctgaagttttggaattggctggaaacgctgcaagggacaacaagaagaccaggatcatcccaaggcacgttctattggccatcaggaacgatgatgagcttggaaagttgctatctggagtgaccattgcacatggtggagtgcttcccaacattaacccagtcttgttgcctaagaagacagcaagcaaggaacctaaatcgcctgcaaagaaggcagcaaagtctcctaagaaacctgctgccactgttgctgctgagtagatgggtagtgtgtggaatgtggttgttgctgggtttgtaattgtagttaatgaatgattatgtgatcagttgtttgtttaggttgttatggtatgtgttgttgactgttggttattaatgaagaaacttcttgtttcagtatcttgctttgttattcaatgcatgagctatgcttatttgattgtta

SEQ ID NO: 14411 - DNA, 666 bp, Cichorium intybus
cgacacacctacttcaccatcatcacccccaatcaattcgatcactcatttctgaagatccttagacggagagaaatggaaggaaccggaaaagcgaagaagggcgccgcaggaaggaagggcggtccaaggaagaaggcggtgagccgttcagtcaaagccggtttgcagtttcccgttggtagaatcggtcgatatttgaagaaggggcgttatgctaaacgtgttggaactggtgctccagtttatcttgctgccgtcctcgaatacctcgctgctgaagtgctagagttggcaggaaatgcagccagggacaacaagaagaccagaataatcccaaggcatctactgttggccattaggaacgatgaagagcttggaaaattgttggctggagtaacaattgctcatggcggtgttctaccaaatatcaaccccattctattgcccaagaaaactgctgctgctaaagagccaaaatctccttctaaggctgcaaagtcacccaagaaagccgtaaaagcttagtttattttatatatgcttgtatgggtcttgatcttctaatcattcatgttggctgaattgttaaagagcgtagaatagtttatagattatcagatgtatccaatttaaatgaatgaaacaacttgtttcttttttcac

SEQ ID NO: 14412 - DNA, 523 bp, Daucus carota
tatgcatacaaattatatatctaaacaccctctctctaaatctcctcggaaaaaatggagacaggtggaaaagtgaaaaaaggagctgccggaagaaagtttggcggtggcggtccaaggaagaagtcagttacccggtccgtcaaggccggtctacaattccccgtcggaagaatcggccggtacctcaagaaaggccgttatgcccagcgtgttggtactggagctccggtctatcttgccgctgtccttgagtatcttgctgctgaggttttggaattggctggaaatgcagctagggataacaagaagactagaattatcccaagacatgtgttgttggctgtgaggaatgatgaggagcttggaaagcttctagctggtgtcacaattgcccatggtggagttcttccaaacatcaaccccgtgctattgcctaagaagtcggagaaggccgcggcggcaaaggaaccgaccaaggcgacgaaatcgcctaagaaggctgctgcctaataatttaaac

SEQ ID NO: 14413 - DNA, 830 bp, Linum usitatissimum
ggcagttcataactaacctctcaaatttctctctattacgctgttctcaaagatcgatttcaactctccgactctctcaagtaatctctatttcaaaaatggacgccggaacaaccaaagttaagaagggagccgccggcaggaaaatcggtggcccgaagaagaagccagtctccaggtccctcaaagccggacttcaattccccgtcggaagaatcggtcggtacctgaagaaaggaaggtacgctcagcgagttggcaccggagctcctgtctacttggccgccgtcctcgaatatctcgccgctgaagttcttgagctggcgggaaacgcagcgcgtgacaacaagaagaacaggatcatcccgcgccacgttcttctggcgatcaggaacgacgaggagctaggaaagctgctggccggagtgacgattgcgcacggcggtgttctcccgaacatcaacccggtgctgttgccgaagaagtcagagaaagctgccgccaaggaacccgcggagaagaaggcatccgccaaggctaccaagtcccccaagaaagcttgatttaggtcattgaaattggatataggcttgtcttgttcttgtagctgtgtaactaatttctccagattagcttttgtggttgtttgcaaatgtatcgttgtttggatcaaggtttgacagtgatagggaatctctgtattggtttgcaatggaaatgaagatgaaacatttcgtttcaattctctttgtttcagtaatcgtcactgttcatttgcatatgtgatatcaattgtttgcctttgctttcaattcaagcaaattttgaac

SEQ ID NO: 14414 - DNA, 799 bp, Catharanthus roseus
tctgcatccgtaaattcttcgtttcatcagttttatcattcaattctatcccttttttgacttatcccaagtgtagtggagtcgatggatactgcaggaaaagtgaagaagggtgccgccggaaggaagggcggtggccccaagaagaagcccgtcactcggtcaactagggctggcttgcaatttccggttggtagaattggccggtacttgaagaagggtcgttattctcagcgagttggtaccggtgctccggtttatatggctgccgtccttgaatatttagctgctgaagttcttgagttggctggaaatgctgctagggataataagaagaacagaataatcccaaggcatgtgcttttggccataagaaatgatgaagaacttgggaaattgttggctggtgtgacaatcgcacatggtggagtgctacccaacattaaccccgtgttgttgccaaagaagagtggtgaaaaggttgccaccaaagaaccgaagtctccatcaaaggcaacaaaatccccaaagaaggctgcttagatttgtctaatctgattaggcttcttccttttatcctttgctagcgttgctccgatgtgtatgtaatgtgggttagagcctttttagccttatgttttggaggatagcagaaaatggtattgtaattgttagcttgtgatttaggagcttcaacttgaatcgataaatctgattgaatggaatggcttttgatgaatctgcacgttttttttttactctttttcatttgaaatttaccaattctcaaatgtgtttc

SEQ ID NO: 14415 - DNA, 849 bp, Curcuma longa
agagatgggtgagcttagagaagacgccacgaggcttaccgaacccggcaccagcgccatcggagggggagggctcgtcggagacgacgcagtcgacgcggacgacgacgtcgtccacatgggcaacgaggtcgcggaagcggcgcgacacagcgcagagccgaccgagggccctaacgtccctcgtgccgaattcggcacgagggggatttaaaatggaaacgagcggagcaggaggcggcaaggtaaagaagggcgccgcggggcggcggaccggcgggccgaagaaaaaggccgtgtcacgatcggtgaaggccggcctccagttccccgtcggccgcatcggtcgcttcctgaagaagggccgctactcccagcgcgtcggcagtggcgcgccggtctacctggcggccgttctggaatacctggcggcggaggtgctggagcttgctggcaacgcagcgcgcgacaacaagaagaaccgcatcatcccccgccacgtcctgcttgctatccgcaacgatgaggaactggggaagcttctcgccggcgtcaccatcgcccacggtggcgtcctccccaacatcaacccggtgctgcttccgaagaagacggcggccgctaaggaaccaaagtcgccgtcgaaggccaccaaatcgccgaagaaaacagcttaaaaatcaaattttgctaatatttttctattagcatagtagtgcttgcttgaatttatcttttgttttgcttaatgttaactgttggttaaccaatttatcagctttaaatttaaggagtgcttttgcatgctccactataatggtagcatcttaacaatgtttatattcttct

SEQ ID NO: 14416 - DNA, 751 bp, Echinochloa colona
tcgaaatcgtctccctcgctccctccctccctcccaaacccaaaaccaaattccctccaaatccacaccaccccggagagatggacgccggcgccgcgaaggtgaagaaggctgcggcgggccggaagctcggcggcgggccgaagaagaagccggtgtcgcgctccgtcaaggccgggctccagttccccgtcggccgcatcgggcgctacctcaagaaaggccgctacgcgcagcgcgtcggcaccggcgcccccgtctacctcgccgccgtcctcgagtacctcgccgccgaggtcctcgagctcgccggcaacgcggcgcgcgacaacaagaagaaccgcatcatcccgcgccacgtcctcctcgccatccgcaacgacgaggagctcggcaggctgctcgccggcgtcaccatcgcgcacggcggcgtcctgcccaacatcaaccccgtgctcctccccaagaaggccgccgagaaggcggagaaggcgcccaagtcgcccaagaaggccgccgccaagtcccccaagaagtaggctgccgctcatgtcatgctcccagtcgatctcatcgggtctgatgcgatgtgatctgatctgatcccagtagcattccccccttttcttgttttgtgtgtgtgtatgtagttcttcgtctcattgtaccgtgtgcttggatatgtggatcgaaaggtgtagctctaggtctagctgtagtggttggtgttgggatttctatgtgttatcta

SEQ ID NO: 14417 - DNA, 790 bp, Echinochloa colona
tcgaaatcgtctccctcgctccctccctccctcccaaacccaaaaccaaattccctccaaatccacaccaccccggagagatggacgccggcgccgcgaaggtgaagaaggctgcggcgggccggaagctcggcggcgggccgaagaagaagccggtgtcgcggtccgtcaaggcggggctccagttccccgtcggccgcatcgggcggtacctgaagaagggccggtacgcgcagcgcgtgggcacgggcgcccccgtctacctcgccgccgtcctcgagtacctcgccgccgaggtcctcgagctcgccggcaacgcggcgcgcgacaacaagaagaaccgcatcatcccgcgccacgtcctcctcgccatccgcaacgacgaggagctcggcaggctgctcgccggcgtcaccatcgcgcacggcggcgtcctgcccaacatcaaccccgtgctcctccccaagaaggccgccgagaaggcggagaaggcgcccaagtcgcccaaaaaggccgccgccaagtcccccaagaagtaggctgccgttcgtgtcatgctgccagccgatctcatcagatctgatcccagtagcattcccccgtgttcctgtttgtttttgtgcgtgtatgtagtgcttactccttagtttcaatgtatcctgtgctttggatgtgtggatcgaaagtgtaggtctaggtttagctctagttggttggtgttgggatttctgtgttatctaaaatttaatgagaagaaatggaagcgacttgcttttgtgatttctggatc

SEQ ID NO: 14418 - DNA, 692 bp, Lupinus angustifolius
tcttccatttttctctctacaaatcaaaatctccgttagggtttaggaaatggataccgctaccggaaaattaaagaaaggcgccggaggaaggaaaggcggtggtccacggaagaagtccgtcacgagatccgtcaaagctggtctccaattccccgtcggaagaatcggccgttacctgaaaaagggaaggtacgctcagcgcgttggaactggtgctccggtttacctcgccgccgttctggaatacctagctgctgaggttttggagttggctggtaatgctgctagggataacaagaagaataggattattccaaggcatcttttattggctgtgaggaatgatgaagagcttggaaaattgcttgctggtgtgactattgcacatggtggtgttctacctaacattaaccctgttttgttgccaaagaagaatgagaaagttgcttctgcaaaagaacccaagtctccatctaaggccactaagtcaccaaagaaagcttgatttattttagtctctcattatgagtttatgacctgtatatttgcgttttaggactatctttatgtagcttcaagtttagtggttgtggttgaaactggacaatgtacctatggtagcattatctcccttttgggactatcaatcaatgaaaacagtttgttttagttattcaaaaaagaaaaaa

SEQ ID NO: 14419 - DNA, 659 bp, Trifolium pratense
ttcaattccctcatcttctcaaaactcatcttcaaccaccaaaccctaatttcccaatctcgaaatggattccaccacaaacacaaagacaaagaaaggtgccgcaggaagaaaaggcggaggtccaagaaagaagtcagtcaccagatccaccagagctggtcttcaattccccgtcggaagaattggtcgttacttgaagaaaggtcgatacgctcaacgtgtcggtaccggtgctccagtttacttagccgccgttcttgaatatcttgctgctgaggtgcttgagttagctggaaatgctgcacgtgataacaagaagaataggataatcccaaggcatgtgttattggctgtgaggaatgatgaagaacttggaaaattgcttgctggtgtcactattgctcatggtggtgttcttccaaatattaacccaattcttttgcctaagaagactgatagatctacttctgctagtaaggagccaaagtctccaaaagctgggaaatcaccaaagaaagcttagatatgtttgaatgaatgaatgtttagtttatggattatgattgtgtatatctgagattaggtttctggtttgtaatagaaatagaaactttccatgcttttgagaaaattttatgtaattttgatctaattat

SEQ ID NO: 14420 - DNA, 712 bp, Nicotiana benthamiana
acatctctcgctccgacaatcaagttttccttcaaatcattcatcatttttgtctaaattctattatctgcaaatggataccagcggaaaagctaagaaaggcgcggccggaagaagaggcggcggtccaaagaagaagccggttacccggtccgtgagagccggtcttcagttcccagtcggtagaattggtcgttacctgaaaaaaggccgatacgcccagcgcgttggtactggtgctcccgtttacttggctgctgtgcttgaatacttggccgctgaagtgttggaattggctggaaatgcggcacgtgacaacaagaagaacaggattatcccacggcatgtgcttttagctgtgaggaatgatgaagagttagggaagttgcttgctggtgtgacaattgcacatggtggtgttcttcccaacattaacccaattttgttgcctaagaagaccggaagtgacaaggcgggcaaagatcctaaatctccttccaaagctaccaaatctcctaagaaggcttagatttaatgtctgttacaagccttttgtttttctatgtttacttggatcttcactgtatgtaattcttgttttagaatgtgtttgattttcctgttgaaaagggaattagttggaattgctagatcttattaggttgtcctctattatcaatcaatgaaaccccttgtttcgaatttacaattt

SEQ ID NO: 14421 - DNA, 477 bp, Aquilegia formosa
ctggttcttttgctacaatggaagcaacaggtggaaaaacaaagaagggagcagcaggaaggaaagctggtggtccaaagaagaagtcagtttctcgctctgtgaaagctggtcttcagtttccagttggtagacttggacgttatttgaagaaaggccgatatgctcaacgtgttggtagcggtgctccggtttacttagctgctgttcttgaatatcttgcagctgaggttttggaattagctggaaatgcagcaagagataacaagaagaatcgaatcattccaaggcatgttctgttggcaattaggaatgatgaagaacttggaaaacttttatctggtgtgacaattgctcatggaggtgttttgccaaacattaatccagttctgttaccaaagaagtctgagaaggttgctaacaaagaacctaagtctccatccaagactgctactaagtcaccaaagaaagcttaaa

SEQ ID NO: 14422 - DNA, 913 bp, Panax ginseng
aagcagtggtatcaacgcagagtacatgggggacttactttcacaatttctctgtacttccaaaataaaacacaactccaacttaattccaccccacaacatatcaacaagacaaggcaagaaaggaaaggaaaagaagcagtggtatcaacgcagagtacatggggaccctccattggacaaactaatattttctctttctctctccagattccggctgtctgtataatttcttctctttcttccatatctcaacgactcattgagatacaatggagactggtggaaaattgaagaaaggtgccgccggcaggaaaggaggcggtcccaagaagaagccggtgtcccgctccgtcaaggccggcctacagtttcccgttggaagaatcggccgatacctcaagaagggccgatacgctcagcgagtcggtaccggagctccggtctacctagccgccgttcttgagtaccttgctgctgaggttcttgagttggctggaaatgcagcaagagacaataagaagaacaggataataccgaggcatctgctattggctgtgaggaatgatgaggaacttggaaagctccttgctggtgttacaattgctcatggaggtgtgcttccaaacattaacccggttctgttaccaaagaagtctgagaaggcagccaaggaacctaccaagtctccctcaaaggcaactaaatcccctaagaaagcttaggttttagctataaattagtatttctgttcatctgcccgtctgtgttggtgtttctagttgctctcttgtatgtaatttctggtaccgttgtttagagattaggttgattgtagttttctctttgatcccccatattagtacttagaacatctttaatttgaaatggaatggaatcgttaccttttgaa

SEQ ID NO: 14423 - DNA, 677 bp, Panax ginseng
attggacaaactaatattttctctttctctctccagattccggctgtctgtataatttcttctctttcttccatatctcaacgactcattgagatacaatggagactggtggaaaattgaagaaaggtgccgccggcaggaaaggaggcggtcccaagaagaagccggtgtcccgctccgtcaaggccggcctacagtttcccgttggaagaatcggccgatacctcaagaagggccgatacgctcagcgagtcggtaccggagctccggtctacctagccgccgttcttgagtaccttgctgctgaggttcttgagttggctggaaatgcagcaagagacaataagaagaacaggataataccgaggcatctgctattggctgtgaggaatgatgaggaacttggaaagctccttgctggtgttacaattgctcatggaggtgtgcttccaaacattaacccggttctgttaccaaagaagtctgagaaggcagccaaggaacctaccaagtctccctcaaaggcaactaaatctcctaagaaagcttaggttttagctataaatttgtatttctgttcatctgcccgtctgcgttggtgtttctagttgctctcttgtatgtaatttctggtaccgttgtttagagattaggttgattgtagttttccctttgat

SEQ ID NO: 14424 - DNA, 729 bp, Nicotiana benthamiana
acatctctcgctccgacaaccaattttttccttcaaaatcattcatcatcctgctctaaattcttctatcttcaaatggatactagcggcaaagcgaagaaaggtgcagccggaagaagaggcggtggtccaaagaagaagccggttacccggtccgtgagagccggtcttcagttcccggtcggtagaatcggtcggtacctgaaaaaaggccgttacgctcaacgtgttggtactggtgctcccgtttacttggctgctgttctcgaatatttggctgctgaagtgttggagttggctggaaatgcggcacgtgacaacaagaagaacaggattatcccaaggcatgtgcttttggctgtgaggaatgatgaagagttagggaagttgcttgctggcgtgacaattgcacatggtggcgttcttcccaacattaacccaattttattgcctaagaagactggaggtgataaggctggaaaagaacctaaatctccttccaaaactaccaaatctcctaagaaggcttagatttagtggttgtaatagccttttgtttttctatctttatttaaatatttactgtatctaactgtgctgttagaatgtgttcaatcgttcttcggggatgaaaaaatggaattagttggaacttggaactgttggaccttattaagaggttgtgttctattgtcaatcaatgaagccccgtgtttcgaatttacaatt

SEQ ID NO: 14425 - DNA, 742 bp, Tabernaemontana elegans
cgatttcttctcgggcgaaaaatatttttcaggtattttcttttcttcactagtcacttgtagactagtagtgtagctgtagcatttctcggccacggtgacggagttgtgaaatggagagtgctggtggaaaattgaagaagggtgctgccggcagaaaaggcggcggtccaaagaagaagcccgtctcccgctccactagagcagggctccaatttccggttgggaggatcggccgttacttgaagaagggtcgctactctgagcgcgtcggaaccggcgctcctgtctatatggctgccgtcctcgagtaccttgctgctgaggttttggaattggctggaaatgcagcaagggacaacaagaagaacaggatcataccgcgacatgtgctgttggctgtgaggaatgatgaggaacttgggaaacttcttgctggcgtgaccattgctcatggaggtgtgcttcccaacattaacccagtactgctgccaaagaagaatgagaaggctgcaaaggagcctaccaaatctccagccaaggccaccaagtcccctaagaaggcttagtttctcatctgcttagaagggactcgttatcctctaatctctctgtatgtaattttcagtgtctgttgtcactatgtagagaggttgtcaaaatttaggatcattctgctgttgcttctgttgctctttaggacatcctttggttacagttaatgaaatgaattgttagctta

SEQ ID NO: 14426 - DNA, 713 bp, Vinca minor
aatagtcacaagtacgactaatttactgtagcatttgtcggcaaccgtgactgccggaattgttgaagaaatggaaggtgctggtggaaaagtgaagaagggagctgccggacgaagaggcggtggaccgaagaagaagccggtcacccgctccaccagagctggattgcagtttcctgtcggcaggatcggccgatacttgaagaaaggtcgctactctcagcgtgtcggtaccggagctccggtctacttggctgccgtccttgagtaccttgctgctgaggttttagaattggctggaaatgcagcaagagacaataagaagaataggatcataccacgccatgtgctgttggctgtgaggaacgatgaggaacttgggaaacttcttgctggggtgacaattgctcatggaggtgttcttcctaatattaacccagtgctgttgccaaagaagaatgagaaggctggaaaggagccggccaaatctccagctaaagccaccaagtcccctaagaaagcttaattagtttcgacttaattgaaaaaaaaaagactcattatcatcatctctaatttctctgtatgtaatgtcattatcagttaagactgtaaaagatgttatgaagatttagggatcattgtgcttttgttgcgcttgttttttaacattctctgttcaccaattaatgaagtgaatctctaacttattc

SEQ ID NO: 14427 - DNA, 786 bp, Phaseolus vulgaris
tcatcatcttcttaccgatactctcacaccacactgttatcttctcctaaaatatagggtttggccatggataccaccggaaaaatcaagaagggcgccggaggaaggaagggcggcggaccaaaaaagaaggcagtgtcgaggtctgttaaggctggtcttcaattccccgtcggaagaatcggacggtttttgaaaaagggaaggtacgctcagcgtgtgggtgccggcgctcccgtttatttggctgcagttcttgaatacctagcagctgaggttcttgagctggctggaaatgctgcccgtgacaacaagaagaacaggattattcctagacatgttcttctggctgtgaggaacgatgaggaattggggaaattgctttctggcgtgaccattgcccatggtggtgtgcttcccaacatcaaccctgttctgttgcccaagaagtccgagaaggctgccaaggaacccaaatctccatctaaagctaccaaatctcccaaaaaggcttagaatagaaatttaatttagttatgtatatctctgttaggatgccattggtgtaatagatatgagatttgacggttgaaacttgtattcttgctttactgtaatgcgtgtagaagtttgcttcattaatggaaacctatcgttttcatccatttgttctatctacgacaactgtttgttgatcttatatgggaagagacttctttaaggtttgaatagggcaaataaaagtgactctgcattgttattctgatgcttatttaaggttatttc

SEQ ID NO: 14428 - DNA, 738 bp, Cichorium intybus
cgctctatctcttcttcttacctccaagaagtcacctgaaaagctttccatcaacgttgaaatggagaccagtggcaaggtgaaaaagggtgccgccggaaggaaggcaggcgggccgaagaagaagccagtcaccaagtccgtcaaggccggtcttcagttccccgtcgggagaatcggccggtacatcaaaaaaggtcgttacgccaagcgtgtgggtaccggtgctccggtttacctcgctgccgttctcgagtaccttgctgctgaggttttggagttggctggaaatgctgctagagacaacaagaagaccaggattataccgagacatgttttgttggctgtgagaaatgacgaagaactcggaaagcttctagctggtgtgacaattgctcatggtggtgttcttccaaatatcaacccaattcttttaccgaagaagtctcttgagaaagccacaaaggagccgaaatctcctgctaaatcagctaaatccccgaagaaagcttaaatgttgaagaacatgttctataatcatctctttgtatttattcaccttctgttggtgatctaggatagtatgtagctcgatgtttttaggggagattttgaagtattttagtttgggttgtttatggtaggacctagatttgaaaaagaatctctctttttcgaaattaagattgtaatctttttaatttaatggatcttttggtatctcttcgacttttactc

SEQ ID NO: 14429 - DNA, 578 bp, Triphysaria pusilla
cagagagaaatggaaaccggagggaaagcgaagaagggagctgctggaaggaaggctggcggtccgaagaagaaatccgtctcccgctcagtgaaagccggtctccagtttccggtcggcaggatcggacgttttctgaagaagggacgttatgctcagcgcgtcggttctggtgccccggtttacctggctgcggttctagaataccttgctgctgaggtattggagttggctggaaatgcagcaagagacaacaagaaaagcaggattatcccaaggcacttgctgctcgccgtgaggaacgatgaggagcttggtaaacttctggctggagtgacaattgctcatggtggcgttataccgaacataaacccggttctgttgcccaagaaatctgacaaggtggctgagaaggcacccaaatcaccatcgaaggctactaagtctccgagaaaggcttagactgagatttttctttctgaatgtgggactgggataaaataacctttattggtttgtagggattgtgttatcttgtggctatgtaggtgttgatgtttataactgcagtaattgta

SEQ ID NO: 14430 - DNA, 739 bp, Linum usitatissimum
actcacctctcatatttctctctcttccggcgttctctaaattccatttcaactctccgactccctcaagtaatctttctttcaaaaaatggacgccggatcaaccaaagttaagaagggagccgccggcaggaaaatcggtggcccgaagaagaagccagtctccaggtccgtcaaagccggacttcaattccccgtcggaagaatcggacggtacctgaagaaaggaaggtacgctaagcgagttggcaccggagctcctgtctacttggctgccgtcctcgaatatctcgccgctgaagttcttgagctggcgggaaacgcagctcgtgataacaagaagaacaggatcatcccgcgccatgttcttcttgcgatcaggaacgacgaggagctaggaaagctgctggccggagtgacgattgcgcacggcggtgttcttcctaacatcaacccggtgctgttgccgaagaagtctgccgccaaggagcccgcggagaagaaatctcccgccaaggctaccaagtcccccaagaaagcttgatttaggtcatagaaattgggtataggcttgttgttgttgttcttgtagctgtgtaactaatttctccagattagcttttgttgttgtttgcaaatgtatcgttgtttggctcatggtttgacagtgttagggaatctctgtattgatttgcaatggaaatgaagatgaaacatttcgtttcaatccttttgtttc

SEQ ID NO: 14431 - DNA, 674 bp, Acacia harpophylla
gatcatccaaaatttcaatcattttctgtttctttcctgagtacggtcgagttacttcaatattaccataatggacgctggaggaaagttgaagaaaggcgcaggaggaagaaggggaggcggtcccaaaaagaagccggtgtctcgctccgtcaaagccggcctccagttccctgtcggaaggatcggtcgctacttgaagaaggggaggtactcccaacgtgtcggcaccggagctccggtttacctcgcagctgtgcttgagtatcttgccgctgaggttttggagttagctggaaatgctgccagagataacaaaaagaacagaatcatcccgagacatgttctgttagcggtgaggaacgacgaagagcttggaaaactgttggctggcgtcaccattgcgcatggtggtgtgttgcctaacatcaaccctgttctgctacctaagaaggctgaaagggcgaccacagaatctaagtctccatccaaagccaccaagtcccctaagaaggcttgaattgctgcaacattatcgagggaatgttcagcttttgtgtatgtagttgcgtctgtagtgtgacttttgtatcgagatgtaatcggtaaaattttatggacatgacactcactcttttaatatccttgtagaactacttttgtttcattcaaat

SEQ ID NO: 14432 - DNA, 765 bp, Amorphophallus konjac
gggaaggagagatggatgcctctgggaaggtgaagaagggagcggcggggaggaagggcggcggccccaagaagaagcccgtctcgaggtcggtgaaggccggcctgcagttccccgtcgggaggattgggcgctacttgaagaaggggcgctacgcgcagcgcctcggcactggtgctccggtttatctcgccgccgtgctcgagtacttggcagccgaggtgttggagttggctggcaacgcggcgagggacaacaagaagaaccggatcatccctaggcacgttctccttgctattaggaacgacgaggagcttggaaaactgctcacgggggtcaccatagctcatggtggcgtcctccccaacatcaacccggtgctcctgcccaggaggggcgagaaggcggctaaggagcccgtgtcgcccagcaaggcgacaaagtccccgaagagggcctagggcagcatccctgccgtcctttccaccttttgtacttgcgacagaagtttctggcttagaaactgtgtggtcctgggaacagcgttcctcgctggcttgttgcaccttacctacttgcggcagaagtttctggcttagagactttgaagttcctttgtttgtaacactctggagtgcttcttcgtctctctttctattgttttctttttgatgccgaagtcagaaggctgtaggagtgtgatgttacgttaaagaaacatgaaactttttatgtgggcttgtgtatgttaatggaagcgatgga

SEQ ID NO: 14433 - DNA, 682 bp, Fagus grandifolia
tttccattttcatttctagtcaaattctttcttctttctattcataagctctgtttgtttctcgagaaaattttgtgattctcatggataccggaggaaaagtaaagagaggtgctgcagggagaaagggaggcggtccgaagaagaaacccgtttcccggtccgtcaaagccggtctccagttcccagtcggtcggatcggccgatacttaaagaaaggccgatactctcagcgtgtcggaaccggtgctccggtttacctcgccgccgtgctcgagtacctagctgctgaggttttggagctggctggaaatgctgcaagagacaacaagaagaacaggattatcccgaggcatgtgttgttggcggtgaggaacgacgaagagctcggaaagcttcttgctggtgtgacaattgcccatggaggtgtacttcccaacatcaaccctgttcttctgccgaagaagactgagaaggcggccgcgaaggagcccaagtctcctgccagggctaccaagtcccctaagaaagcttaatgtgttataacaatgtcagtcttttgtgtcaatcaatgtatgtaatttcctatctgtatgtggcttgtagggaagcttttcattttcttaggacttagaaccatttgtacctctttgtttccatgtccttgtagtgttaaaaaaat

SEQ ID NO: 14434 - DNA, 1050 bp, Cicer arietinum
gtcgtcaattaaagtcattcattggtccatttcaaaaccagcggatcgccacacaaattatctacaaccgttgataattctcaatctaacggctttacgtttgctcaatctaagaatcgacggggatcgagttgtgtccgtaaagctatataacctcgccaacgattcattcccattcacttaacacattataacaccattcagaagtttgcatttcctgcatctcacagtttccacagctagattttagggttaaaacttctaaacacaaaatggaagctagcacaaaaacaaagaaaggagccggaggaaggaagggaggaggaccaaggaagaagtcggtaacaagatctatcagagccggtcttcaatttcccgtcggtagaatcggccgttacttgaagaaaggtagatatgctcagcgtgttggtactggtgctcctgtttacttagctgctgttctagaatatctcgctgctgaggtgcttgagttggctggaaatgcagcacgtgacaacaagaagaatagaattattcctagacatgtgttgttggctgtgaggaacgatgaagagcttggaaaattgcttgctggtgttactattgctcatggtggtgttcttcctaatatcaacccaatactattgcctaagaagactgaaaaagctgccaaggaacttccgtctccatctaaggcgaagaaatctccaaagaaagcttagattgttgatgtgcgatttgttaggatcattttgtgtgtatatctgcgcttagatctttcttttataatagaatgatttaatgcgtttgaaacaatgtaattttgattcactgtctccatttagtattaatatgaatatgatcaattcacttgaaatattatttgttaatttatctatgatgttgggataaatgaattgcataatttgaggtttaaatcctaaattattatgttttcagttaatgtttgcaacaacttagatacttacatatgaaatctcacatctcataatgattcaatttgtttttaatcttcgccacatatatttg

SEQ ID NO: 14435 - DNA, 730 bp, Cichorium intybus
cgctctatctccggacaagaagtcacctgaaaagctattcatcgacgttgaaatggagaccagtggcaaggtgaagaagggtgccgccggaaggaaggcaggcggtccgaagaagaagccagtcaccaagtccgtcaaggccggtcttcagttccccgtcgggagaatcggccggtacatcaaaaaaggtcgttacgccaagcgtgtgggtaccggtgctccggtttacctcgctgccgttctcgagtaccttgctgctgaggtgttggagttggctggaaatgctgctagagacaacaagaagaccaggattataccgagacatgttttgttggctgtgagaaatgacgaagaactcggaaagcttctagctggtgtgacaattgctcatggtggtgttcttccaaatatcaacccaattcttttaccgaagaagtctcttgagaaagccacaaaggagccgaaatctcctgctaaatcagctaaatccccgaagaaagcttaaatcttgaagaacatgttctataatcatctctttgtatttattcaccttctgttggtgatctaggatagtatgtagttcgatgttataggggagattttgaagtattttagtttgggttgtttatggtaggacctagatttgaaaaagaatctctctttttcgaaattaagattgtaatctttttaatttaatggatcttttggtatctcttcgacttttactgag

SEQ ID NO: 14436 - DNA, 720 bp, Cichorium intybus
cagacagcaacattaatctgaaaattcagagagtttttattttccttcaaggttatttccgtatcttagtcgtttgagtgtgaaatggaagccggaacaaaggtgaaaaagggagccgccggaaggaaggctggcggtcctaagaagaagccggtttctcgctccgtcaaggccggtcttcagtttcccgtcggtaggttgggtcgctacctcaagaaaggccagtatgcaaagcgtgttggcaccggtgctccggtttacctcgccgccgtcctcgagtaccttgctgctgaggttttggagttggctggaaatgctgcaagagacaacaagaagaccagaatcattcccagacatgttcttttggctgtgagaaatgatgaagaattaggaaagcttctatctggtgtgacgattgctcatggtggtgttcttccaaacatcaacccagttcttctgccaaagaaggctcttgacaaagcaacaaaggagcctaaatctccctcaaaagcaaccaaatcacccaaaaaagcttagttagtggtcgaatacgaatgtctattggggttctttgttaatcttatttgtatttaggagcgacaattgtgttttagggaaagttagggctattgtagtctctcatgtattgaggacatgttgctggatctaattgtgtgtaaaacaacatctcgtttgtttttaaatgacaattggtatttc

SEQ ID NO: 14437 - DNA, 546 bp, Trifolium pratense
atctcgcaatggatacttccccaaaatcgaagaaaggagctggaggaagaaaaggaggaggtccaaggaagaagtcagtaaccagatccactagagccggtcttcaattccccgtcggaagaatcggccgttacttgaagaaaggtcgttacgctcagcgtatcggtactggtgctccggtttacttggccgctgttcttgagtatcttgctgctgaggttcttgaattggctggaaatgctgcacgtgacaacaagaagaataggattatccctaggcacgtgttgttggctgtgaggaatgatgaggagcttggaaaattgcttgctggtgttacaattgctcatggtggtgttcttcctaatatcaacccaattctcttgcctaagaagagtgaaagaactgctgctaaggagcctaaatctccatctaaggctggaaaatctcctaagaaagcttagatttagttttctagatttggattatgaattattatgaattttgtgcatatctaagcttaggatcctgttatgtaatgtggtttaa

SEQ ID NO: 14438 - DNA, 514 bp, Epimedium sagittatum
agatatatttcaattccttttttcttctcaatctcagaaatggaaactagtggtaaggcaaagaagggagcagcaggaaggaagatgggtggcccaaagaagaagtcagtcccccgttccgtcaaagccggtcttcagttcccagtcggaagaatcggacggtacttgaagaaaggccgatatgccaagcgtgttggctctggagctccggtttacttagctgctgtccttgaataccttgcggctgaggttttggaattggccggaaacgctgcaaaggacaacaagaagagtagaatcatcccaaggcatgttctgttggcaatcaggaacgatgaggagcttggaaagttgcttggaggagtcactattgcacatggaggtgttcttcctaacatcaacccagttctgctgcccaagaagactgagaaatcctctcaggagcctaaatctcccaaaaaggctgccaagtccccaaagaaagcataatcatcaacaaaagttggatctgatt

SEQ ID NO: 14439 - DNA, 1076 bp, Eucalyptus grandis
agcctctcaatttcatcacctcgatcgatcgactcctgggaaaataatttccatctaattttcccgagaaagagttgagagattttcctcttcgtcttttactccggcgagatttgcgcgagaagagaatggaaaccggagggaagctgaagaaaggtgccggagggaggaagggtggcggtccgaagaagaagccggtctctcggtctgtcaaggccgggctgcagttcccggtcggtcggatcggtcggtacttgaagaagggccgttactcccagcgcgtcggcaccggagctccggtctacctcgccgccgttctcgagtacctcgctgctgaggtcctggagttggctggtaatgctgcaagagacaacaagaagaacaggatcatcccgagacatgttctcttagctgtgaggaatgacgaggagcttgggaaattgctcgctggagtgaccatcgcccatggaggggtgcttcccaacatcaacccggtcctcctgccaaagaagactgagaaggcgaccaaggaaccaaaatctccttccaaggccaccaagtcacccaagaaggcttaagggattagtctattttgatttggtctggtgcctaaggtgactgtttgtattgccctctttttacgcctctgcaggctgtatgtaatttagctcgatgtacttacaagcccttttaggtgaagttgatggtgttaggattttcaggccattgggctacttggttttatgtttccgtagaacatcttttgtttctccgaattgaatgacatcctgaaagcttttagaaagttattgatttgccctccgttgggagctgggattatttgtcattactagagtggtctctctttccagtagttattttttggcattgcgatcatgaacaagttgttccggagtcgaactgtaaagtatgtaccaaggtagttggtctagtagtgaatgagtcacttatttttatgagattatgagtttgatttacattgcaaatgaatttctaatagttcatttggtcttcgccccaccaataaactagaattttgtataatgttgaagaaa

SEQ ID NO: 14440 - DNA, 642 bp, Fagopyrum esculentum
aaaaatctagaattcaaattgactctaaaaccgaaacagcaaattcaagccatttctcatcaaatggataccacgaccaaggttaagaagggagtcgccggaagaaaggccggaggtcctaagaagaagtcggtaacccgatccgtcaaggccggtttgcagttccccgtcggtcgtattggcaggtatctgaaaaacggccggtacgcaaggcgtgtcggaagcggagctccggtgtacctcgccgctgttcttgagtacttagccgctgaggtcttggagttggctggaaatgctgcaagggataacaagaagaccagaattattccacgacaccttttgctcgctgtgaggaacgatgaggagcttggaaagctgttgagtggtgtaacaatcgctcatggcggtgttttgcccaacattaaccctgtgctcttgcccaagaaaactgcagaaaaggctcccaaggaacctaaatccccttccaaggctgctaaatctcccaagaaggcttagtccgtagaaatctagattcgtataagagtaattttcctttgtaggtgacgtgttgatccgatgtctgtagctttctctgaaagttgttcgattagatggaaatatatatttgaaatgttcgtcatt

SEQ ID NO: 14441 - DNA, 667 bp, Fagopyrum esculentum
aaaatcaatttccggctacccgcttcagcatttcaaatttctcctccgtagccacagatccacatttctctccatatggatgctagttcaaagggcaagaagggagccgccggacggaaggctggtggtccgaagaagaagtcagtttctcgttccatcaaggccggtttacaatttcccgtcggtcgtattggccggtatctgaagaacggccggtacgcaaggcgtgtcggaagcggtgctccagtttacctcggtgctgtcctcgagtacttggccgctgaggtgttggaattggctggaaatgctgctagggataacaagaagaccagaattattccaagacacctcttgcttgcggtgaggaacgatgaggagcttggaaagttgttaaatggtgtgactattgctcatggaggtgttttgcctaacattaacccggtgcttttgccgaagaagaccgccgagaaggccccaaaagaaactaaatctccttccaaagctaaaaagtctccaaagaaggcttagaatgtagtaattacaaattgtagcaagtcaatctagtgagttgctgaaatgaaacaatgtttagtttcagcaaatttgttgatctttgcgtttgtaaacattttccgaatgattgttcaattagatgaagatagatttg

SEQ ID NO: 14442 - DNA, 760 bp, Lactuca sativa
atttctcaaaaacatcacacacaataagtttaatcggaaaaatcacaggcgctttcttcttccgtcaggttaatttcctaatttagtcgttgaaaggtgaaatggacgccggaacaaaggtgaaaaagggtgccgccggaaggaaggctggtggtcctaagaagaagccggtttcccgctccgtcaaggccggtcttcagttccccgtcggcaggttgggtcgtttcctcaagaaaggccagtatgcaaagcgtgtcggaagcggtgctccggtctacctcgccgccgtcctcgagtaccttgctgctgaggttttggagttggctggaaatgctgccagagacaacaagaagaccagaatcattcccagacacgttcttttagctgtgaggaatgatgaagaattgggaaaacttctttcgggcgtgacaatcgctcatggtggtgttcttccaaacatcaacccggttcttctgcccaaaaaggctcttgacaaagcaaccaaagagcctaaatctccatcaaaagcaaccaaatcacctaagaaagcttagtggatggatatcacaatccatcagttggttgttaatcttctgaacatttgtttgcgatttagggaaagttagttattgtagtctctctgtactcagaatattattgctggatttaactatgtagaacaacatctcgtttgtttgaaatgaaaattagtatttttgtatacacgattcccatatccttgatttattttcatttgctg

SEQ ID NO: 14443 - DNA, 682 bp, Arachis hypogaea
aatcacacctcttccattaccggaaaagaaaagaaaagaaaagaaaagttaattaaggttctgatggacagccccgctgtaaaagggaagaaaggagctgccggaaggagaggcggtggtcccaagaagaagtcagtgtcaaagtccgtcaaagccggtctccaattccccgtcggaaggatcggtcgctacttgaagaaaggccgttatgctcagcgcgtgggaagcggcgctccggtttatctcgccgccgttttggaatacctagctgctgaggttttggaattggctgggaatgctgctagggataacaagaagaacaggattattccaaggcatgtgctgttagctgtgaggaacgatgaagagcttggaaaattgcttgctggtgttaccattgctcatggtggtgttcttcctaacattaaccctgtgcttttacctaagaagagtcaaaccgctgctgctaaggaaccgaagtctccatctaagggcacaaagtctcctaagaaagcttaattgaccatgcttttatgattatgatattttggtgttaggttacttttggtttctctttaattttaatgtatatctgttattaggtacctttagtcctttttaggatggcaggaatatgtgatgcttgtcatggtatcctcatttggaatttatggtgaatgga

SEQ ID NO: 14444 - DNA, 757 bp, Cajanus cajan
agggtgccaacgcaccgttcatccgcatcttgccatcactctcgcacttgtgattattccctttctagcaccacaccaaatccacgcccaaaatctagggtttccatggacaccgccggaaagatcaagaagggcgccggaggaaggaagggtggtggccccaagaagaagccggtgaccaggtccgtcaaggctggtctccaattccccgttggaagaattgggcgttacttgaagaaaggaaggtatgcgcagcgcgtgggaactggtgctcccgtttacctagctgctgttctcgaatacctagctgctgaggtgcttgagttggctggtaatgctgctcgtgacaacaaaaagaataggattatccccagacacgtgcttttggctgtgaggaacgatgaggagttggggaaattgcttgctggagttaccatcgctcatggtggtgtgcttcccaacatcaaccctgtgcttttgcctaagaagactcaggctgctgctaaggagcccaaatccccatccaaggccaccaagtctcccaagaaagcttgatgataaatgcctagattaattgttttcggtttagtatgtatattagtctttagatgcttttgttgtaaaagaaaaatttcatgtgttggaagacactgtaatttttatcttgttttctctcatttaagagtttgctacattaatggaaacttcttgttttcggttcaattttcttttttgtgtttctgtttgacatgacttg

SEQ ID NO: 14445 - DNA, 1216 bp, Chenopodium quinoa
accatcaatctcattcaatttctctctcaactttctcactctaaaaatccccattttaatctctgcaaattcctatcaatggattccaccaccggaggaaaggcgaagaagggagccgccggaaggaagggcggaggccccaagaagaagtcggtgactcgctcagtgaaagctggattgcagtttcccgttggtagaattggccgttacttgaagaaaggtcgttacgctcagcgtgttggtagtggcgctcctgtttacctagccgctgttcttgagtaccttgctgctgaggttctggaattggctggaaacgctgcaagagacaacaagaagaacaggatcatcccaaggcatgttctccttgcagtaaggaacgatgatgagcttggaaaattgctctcaggagtgacaattgcgcatggaggagttctaccaaacattaacccagttttattgccaaagaagacaggagataaggctgcaaaggatgtgaagccatctcccaagggtgttaaatcccctaagaaagcttagatgatgatgatagcgaggtcggtttcgggttagattgaaggatatgtttgaagttggtttgtgttattgcattttgtaactatggtagtataagtttaattagggtttttaaagggttagtcaggggttgtatgttaaaggggattgagtcaatagctgattgattcagtttctgtaatcatacgcttattaatgaaaaacaatatttattactaaaaaccccttaaaaaaaaaaaaaaaaaaaaaaagaaaaaaaaaaaaaaaagaaaaaaaaaaaaaaaagaaaaaaaaaaaaaagaaaaaaaaaaaaaaaaaaaaaaaaaaaaaaaaaaagaaaaaaaaagaaaaaagaaaaataaataataataatatatatatatatatatatatatatatatatataataataataatatatataatataatatatatatatatatatatatatatataggtatatatatatatatatatatatatatatatatatatatatatatatatatatatatatatatatatatatatatatatatatatatatatatatatatatatatatatatatatatatatatatatatatatatatatactaactaataataataataatatatatatatatatatatatatatatatatatatatatatatatagtagtagtagtagtag

SEQ ID NO: 14446 - DNA, 714 bp, Chenopodium quinoa
ttctctctccactttctcactctataatcgccattaaaatctctgcaaatttctagaaagagaaacaatggattcaactaccggaggaaaggcgaagaagggagctgccggaaggaagggcggaggccccaagaagaagtcggtgactcgctcagttaaggctggattgcagtttccagtcggtagaattggccgatatttgaagaaaggtcgctacgctcagcgtgttggtagtggcgctcctgtttacttagccgctgttcttgagtaccttgctgccgaggttctggaattggctggaaatgctgcaagagacaacaagaagaatagaatcatcccaaggcatgttctccttgcagtaaggaacgatgacgagctcggaaaattgttgtcaggagtgacaattgctcatggaggagttctaccaaacattaacccagttttattgccaaagaagacgggagacaaggctgccaaggatgttaagccctctcccaagggcgttaaatcccctaagaaggcttagatgatagcgaatttggtttcgggttaggtttaaggatgtgtttggcttggaagttggttttgtgtttttgcattttgtaactatgttagtataagtttaaattaggctttttaaaggggttagtgagggctgtatgttaaagggggttgtatggggattgagtcaatagctgattgattcagtttctg

SEQ ID NO: 14447 - DNA, 662 bp, Scabiosa columbaria
gaacctatcttttcaactcatcgattcaatcgctaatcaaattctcttcaactcagttcctacttcgtttcagttccgcttcgctactcaaactcgctgagaaatggaaaccggcggcaagggaaagaagggtgccggaggtaggaaaggcggtggtccaaggaagaaatcggtgacaaggtctgtcaaggctggtcttcagttccccgtcggtagaattggccggtatttgaagaaaggccggtattctcaaagagttggtaccggagctccggtgtatttggctgccgtacttgaatacctcgctgctgaggttcttgaattggctggaaatgctgcacgagataacaagaaaacaagaatcattcctaggcatgttttgttagcggtgaggaatgatgaagaattggggaagctacttgctggtgtaacaattgcccatggtggtgttttgccaaatatcaacccaattctgttgccaaagaaggctgagagagctgcaagtgaacccaagtcccccaaggctactaaatctcccaagaaagctgcataggttttaagctgttaaacaagtagtatgttcaattggagggtttcttttatcctttgtatttaggtgctatttctgaatttagattgttgttttgttgtggatctgttag

SEQ ID NO: 14448 - DNA, 757 bp, Scabiosa columbaria
cgattcaatcgctaatcaatttctcttcagctcaattcctacttcgtttcagttacgcttcgctactcaaactcactgagaaatggaaaccggcggcaagggaaagaagggtgccggaggcaggaaaggcggtggtccaaggaagaaatcggtgactaggtctgtcaaagctggtcttcagttccccgtcggtagaattggccgatatttgaagaaaggccggtattctcaaagagttggtaccggagctccggtgtatttggctgccgtgcttgaatacctagctgctgaggttcttgagttggctggaaatgctgcccgtgataacaagaaaacaagaatcattcctaggcatgttttgttagctgtgaggaatgatgaagaattgggtaagttgcttgctggtgtaacaattgcgcatggtggtgttttgccaaatatcaacccaattcttttgccaaagaaggccgagagagctgcaagtgaacctaagtcccccaaggctactaaatctcccaagaaagctgcataggttttaagctgttaagcaagtagtatgttcaattggagggtttcttttatcctttgtatttaggtgctatttctgaatttagattgttgttttgttgtggatctgttagatttggatagggaatatgttttcttctgagcatattgttggctgcttgtttatttgttcagtggagtgaatgaaactacttgtttctctatttcctttcaagaatatttgttcagt

SEQ ID NO: 14449 - DNA, 704 bp, Helianthus annuus
aaaccaccattcaatccgttttcttcacaaaagttgtcatggacgccggtggaaagttgaagaaaggtgctgccggaaggaaagcaggcggtccgaagaagaaaccggtcacacggtccgttaaagccggtttgcagtttcctgttggtaggatcggccggtacctcaaggttggacgctacgcgaaacgagtcggtactggtgctccggtttatctcgctgctgtgcttgaataccttgctgctgaggttttggaattggctggaaatgctgcaagagacaacaagaagaacagaatcaacccgaggcatgtgttgttggctgtgagaaatgatgatgagctcggaaagcttcttgcgggtgtgacaatcgctcatgggggtgttcttccaaacatcaatccggttcttttgccaaagaagtctcatgacaaagctgcaaaggaacccaaatctccggctaaaccaaccaaatctccgaagaaagcttagtttgtttatccacatttccatggtgatgtagggtatatcaaatttatggtgtttttagagatgatttagtaggattgtattgtgatgctatgttgatgttaggacttaggtgtgaagaaagaagaagaatctctctttttctaaatgaaaattgttaaatttctgaagttatgaaatcctttgaacatgtgtttgattgatgtgtactacatt

SEQ ID NO: 14450 - DNA, 668 bp, Triphysaria pusilla
ccccaaatctgcaagctcaatttcatcttcatcctcttcactaacttctttcattcagagaaaaatggaaaccggtgggaaagtgaaaaagggagccgctggaaggaaggccggtggacctaagaagaaatctgttacccgctccgtgaaagccggtctccagtttcctgtcggcagaatcggccggtttctgaagaagggtcgctatgctcagcgcgtgggttctggtgccccggtttatctggctgcggttctagagtaccttgctgctgaggttctggagttagctggaaatgcagcaagagacaacaagaaaagcaggattatcccaaggcacttgctgctggctgtgaggaacgatgaggagcttggtaaacttctggctggagtgacaattgctcatggtggtgtgataccgaacataaacccggttctgttgcccaagaaatccgacaaggtggctgagaaggcgcctaaatcgccatcgaaggctgctaagtctccgaaaaaggcttaaagttcatgttcaattttcagggggggggggtgagtgtcgatggtgtgcggcgccgggcggcggaggtggcggtgggattttgaaaggggggtgagtgtttagtggctcgacaccggtggtgatgtagaacatatgtacttaaattattttt

SEQ ID NO: 14451 - DNA, 498 bp, Triphysaria pusilla
aatttcatcttcatcctcttcactaacttctttcattcagagaaaaatggaaaccggtgggaaagtgaaaaagggagccgctggaaggaaggccggtggaccaaagaagaaatccgtcacccgctccgtcaaagccggtctccagtttcctgtcggcaggatcggtcggtttttgaagaagggtcgctatgctcagcgcgtgggttccggtgctccggtttacctggctgcggttcttgagtaccttgctgctgaggttctggagttagctggaaatgcagcaagagacaacaagaaaagcaggattatcccgaggcacttgttgctggcagtgaggaacgatgaggagcttggtaaacttcttgctggagtcacaattgctcatggtggtgtgataccgaacataaacccggttctgttgcccaagaaatccgacaaggtggctgagaaggcacccaaatcgccatcgaaggctgctaagtctccgaaaaaggctta

SEQ ID NO: 14452 - DNA, 689 bp, Triticum aestivum
gaggaattcggcacgaggcggcagtctggctctctcatccaatcccgacctaccgtcctctctcgcacgccatggacgccacggccaccggcgccaaggggaagaagggcgcggccgggcgcaaggccggcggccccaggaagaagtcggtgacgcggtccgtgaaggccgggctccagttccccgtcggccgcatcgggcgctacctcaagaagggccgctacgcccagcgcgtcggcaccggcgcccccgtctacctcgccgccgtcctcgagtacctcgccgccgagctgctggagctcgccgggaacgccgccaaggacaacaagaagagccgcatcatcccccgccacctgctgctcgccgtcaggaacgacgaggagctcggcaagctgctggccggcgtcaccatcgcgcacggcggcgtgatccccaagatcaacccggtgctgctccccaagaagacggcggagaaggagggcaaggcgcccaagtcccccaagaaggcggccaagtcgcccaagaaggccgccaccccgaagaaggcttaagagagatgcgatctgtatcgtttaggctgtgtgctgtgtagtgttcgtctgaatagcggagtgaaggtgttctgtctagttgtcgatgtaacctgtgttgtgatggaagaaattcagaaatctctttgaatttccaaa

SEQ ID NO: 14453 - DNA, 732 bp, Lupinus angustifolius
tcacacttcttcattcacttctctctctttgcgaatcaaaattctctcttagggttcagaaaatggataccggtgccggaaaatcgaagaagggtgccgccggaaggaaaggcggtggtccaaggaagaaggccgttactagatccatcagagctggtcttcaattccccgtcggaagaatcggccgttacttgaagaaaggaaggtatgctcagcgcgtcggaactggtgctcctgtttacctcgccgccgttcttgaatatcttgccgctgaggttttggaattggctggtaatgctgctagagataacaagaagaataggattatcccaaggcatgtgttgttggcagtgaggaatgatgaagagcttggaaaattgcttgctggtgttactattgcacatggtggtgttcttcctaatattaacccagtacttttgccgaagaaaactggtgcttcttcttctgcttcttctgctaaagaaccaaagtctccatctaaggctgccaagtctcctaaaaaagctgcttaattgttatttaggctttatcaactcttttgatttttttgttatgtatatctgtgtttaggaggaagcttttttgtatgacaagaaagtttagtgcctttgattgtaattctgatcttattatctcctttaatcaatggaaacgacttgtttttagtgttaatgttctcactctatgaatactccatgtagtgtaagttta

SEQ ID NO: 14454 - DNA, 638 bp, Ambrosia trifida
caaccatttctacacacacagaaaagaaagaaagctaataacccatcaaacataatctcaatggaaaccacaggtaaagcaaagaagggtgctgcaggacgcaaagccggcggtccaaggaagaaggccgtcacccggtccgtcaaagccggtctccagttcccggtcggtagaatcggccgttacctcaaacacggccgttacgctaaacgtgttggaaccggtgccccggtttaccttgcagctgtattggaataccttgcagcagaagtattggaattggcgggaaatgcagcaagggataataagaagaataggataattcctaggcatgtgttgttggcgataaggaacgatgatgagcttggaaagctgttgtctggagtgacgattgctcatggtggtgtgttgcctaatattaaccctgttttgttgccgaagaagagtgctgctgcttctaaagaggctaagtcacctgctaaggctgctaagagtcccaagaaggcttagggtgtgtttgggttaggtttgtttttgtggtggtgttgtagttatattggaatggtaatttggttggtaatagtgttgttatgttgatgttgaggttaaggttaatttatgaatgaaagaaacccctt

SEQ ID NO: 14455 - DNA, 502 bp, Chrysanthemum coronarium
ctctcaaaacaaacaaacactcattttttattagtactaaaatggagggaatcggtaaagtgaagaagggagcagcaggaaggaaagccggcgggccacgaaagaagtcagttactcgttccgttaaagccgggcttcagtttccagttggtagaattggaaggtatttgaagaaaggccgttatgctaagcgtgttggtactggtgctcctgtttatctcgctgccgttcttgagtatctagcagccgaagtgttggaattggcgggaaatgcagcaagagacaacaagaagaacagaataatcccaagacatgtgttgttggcgattagaaatgacgaggagctcggaaagttgttgtctggtgttacgattgctcacggtggtgttttgccgaatattaaccctgttttgttgcctaagaagactgctgctaaagagtcaacaccaaagtctccatctaaagctggaaagtctcctaagaaagcttagattagtttgat

SEQ ID NO: 14456 - DNA, 572 bp, Chrysanthemum coronarium
cacacacacattcttcaatctctcattcataaaaaccaaatggaggaaaccggaaaagttaagaagggagcagcaggaaggaaagccggtgggccgcgaaagaagtcagttactcgatctgttaaagccgggcttcagtttccagttggtagaatgggaaggtatttgaagaaaggtcgttatgctctccgtgttggtactggtgctcctgtttatctcgctgccgttctcgaataccttgctgctgaagtcttggaattggctggaaatgctgctagggacaacaagaagaccagaatcatcccgagacatgttttgttggcgattaggaatgacgaggaactcggaaagctgttgtctggggttacaattgctcatggtggtgtcttgccaaacattaaccctgttttgttgcctaagaagactgctgctaaagaatcaaccccaaagtctccatcaaaagctggaaagtctcctaagaaagcatagattagtttgatgtaactgtcatgtgttggttgattacttgatctgttagtcagtgtagagtagtttataattttataagatct

SEQ ID NO: 14457 - DNA, 682 bp, Cyamopsis tetragonoloba
ctcaagctcctctctactcacaacgattcatcaaatcaaatttgcagctacgttctagggtttcgaattcgccatggataccggagcgaaggtgaagaaaggtgccggaggaagaaagggaggagggccaaagaagaagccagtcacaagatctgtgagagctggacttcaatttccagtcggaagaattgggcgttacttgaagaaaggaagatacgctcagcgtgtcggtactggtgctccggtttacttggctgctgttctcgagtatctcgccgctgaggtgcttgagttagctggaaatgcagctcgtgataacaagaagaacagaattattccgaggcatgttcttttggctgtgaggaacgatgaggagcttggtaaattgcttgctggtgttacaattgctcatggcggtgttcttcccaacattaaccctgtgcttttgcccaagaagaccaaccaggctactaaggaaccaaaatctccttccaaggccaccaaatctcccaagaaggcttaatggatttatcttctcttgagatttagtttatttctcttaatttagtgtgtatatctgcatttaggtccttgttctgcaacaggaaaaccaatgcgtttgaaactttgtaattttggtttcattctcttccctgcaatagtttctttgatcaatgaaaac

SEQ ID NO: 14458 - DNA, 692 bp, Phalaenopsis aphrodite
ctcccgtaaaacacccactaagtctctcatggacgccaccagcaagattaagaagggcgccggcggccgcaagggcggcggcccgaagaagaagccagtttcccgttccgtccgtgctggcctccagttcccagtcggccgtatcggccgatatctcaaaaaaggccgatacgctcaccgtgttggtactggtgctcccgtttacctcgccgccgttctcgaatacctcgccgctgaggttttggaacttgcaggaaatgctgcgcgtgataacaagaagaaccgtattattccaaggcatgttctacttgctataagaaatgatgatgagctcgggaagcttctgggtggagtgacgattgcgcatggaggagttctgccaaacattaaccctgtgcttctgccaaagaaaactgcggcgaaggagccgaaggagtcttctaaggcagcgaaatctcccaagaaggcggcggcttaggctttggataggtggccttgtatgtaatttgagttctggtgttgctggtttgggaaagaatgtagtttggtaatgcaatggcttttaatttgaagaaaaatatctatttgtttgaaagtgttgtgctattctcctcaagctgtggctttcccgctcgttctatgtcttgttgattgttcaattgatggtgatgcgaggggatgttcggtgttct

SEQ ID NO: 14459 - DNA, 580 bp, Scabiosa columbaria
caacattacgagctgttgattccaacgctaacttttaatttaatctttttgttgcacaatctctcgatatggataccggcggcaaatcaaagaaaggagcagccggaaggaagctcggcggtcctaagaagaagccagtgtctcgatcagtcaagtccggtcttcagtttcccgtcggtcgtatcggccggtacctgaagaaaggacgatacgctcagcgcgttggaactggtgctccggtgtacttggccgccgttctggaatacctagcggctgaggtattggaattggctggaaatgcagcaagggacaacaagaagaacaggataataccaaggcatgtgttgttggcaatcaggaatgatgaagaacttggaaaattgctttctggtgtaacaattgcacatggtggtgttcttccaaatataaaccctattcttttgcctaagaagactgctgctaaggagcctaaatctccttccaaggcaactaaatctcccaaaaaggctgctgcttagtgatatttagatttggttttctgttttgcgtctagtgctgtatgtatttgttatggatttgg

SEQ ID NO: 14460 - DNA, 768 bp, Brachypodium distachyon
acaacccactcacttcccaatcccccgcatcaccacaccaaatctctgaaatcgaaagcggttgctgcttcacctgccgagcaaatggacaccggagccgggaaggcgaagaagggcgctggcgggcgcaaggcaggcggcggcggcggccccaggaagaagtcggtgacgcggtccgtcaaggccgggctccagttccccgtcggccgcatcgggcgctacctcaagaagggccgctacgcgcagcgggtcggctccggtgcccccgtctacctcgccgccgtcctcgagtacctcgcagccgagctgctcgagcttgcaggcaacgccgccagggacaacaagaagacccgcatcattccgcggcacttgctgctcgccatcaggaacgacgacgagctcgggaagctgctggccggcgtcaccatcgcccacggcggcgtgatgcccaagatcaaccaggtgcttctccccaagaagacggcggccaaggagcccaaggaacccaagtcgcccaagaaggccgccaagtcccccaagaaggcttagaaagatgtgtcacattgcttaattaggttgtgtagtgtggttcatagtggaattctcctcgttcgctgtgccttgtggtctctgattgttagtaattgaagaatttcagaagtcgctgatttgatttgcagaaatatcgtgctgtctagtgtcttccaattttgcatcgctattgagattttggaattagcagggtggtatgtacctggtagcttcggc

SEQ ID NO: 14461 - DNA, 596 bp, Ambrosia trifida
attgctaataatatctctatacatttttagcattacaaatggagtcaactggaaaggctaagaagggtgctggaggaaggaaaggtggcccaaggaagaaggctgtcactcgttcagtcaaagccggtctacaattccccgttggtagaatcggtcggtatttgaaaaaaggtcgttacgctaagcgtgttggaactggtgctcctgtttacttagccgcggtccttgagtatctcgcagcagaagtgttggagttggctggaaatgcggctagggacaacaagaagaatagaataataccaaggcatgtgttgttagccataaggaatgatgaggagcttggaaagcttttggctggtgtaacgattgctcatggtggtgtgcttccgaatattaatccggttcttttgcctaagaagactgctgctaaagagcctaaatcgccatcgaaagcggctaaatctcccaagaaagcgaagtagattagttggatatgtgtgagaagagtttggtttagttgtttggttctgttatgttttagggtagtttatattgtttagatgtagttgactttaagctgtttaatgaaaccactt

SEQ ID NO: 14462 - DNA, 749 bp, Triphysaria pusilla
tttcaactgagaattttacataattactcctcaatcagtcaattctacagcaaaacctaataatggatgctagtgcaaaggttaagaaaggagctggtgggagaaaggccggtggcccaaagaagaaacctgtttcacgatccgtgaaagccggtctccagttccctgtcggcaggatcggccggtatctaaaaaagggacgatattctgagcgtgtcggttccggtgcgccggtttatatggcggcggttctggaatatcttgccgctgaggtcctggagttggctggaaatgctgcaagagacaacaagaagaacaggattataccaaggcatgtgttgcttgcagtgaggaacgatgaggagcttggtaaacttcttgctggagttacaattgcacatggtggtgtaataccgaacataaaccctgttttgttgcccaagaaggcggctgagaaggcatctaaatcgccagccaaggcaactaagtctccaaagaaggcttaaactacgattctttgctaaatgtgtgattgaatgatctttgatgtttttagggattgtgtgatcttgttgggttattgtaggtgatgatgtctataactggagtaatttgtacttcttatcttttttattgctacttttgttgttaaatcccataattgaaatttaatggaaagatagattcttttcagatttctgaaactgaaaggcatggtttggttgcaatttatgtttctttgattggca

SEQ ID NO: 14463 - DNA, 702 bp, Cynodon dactylon
agcagtctcgcatttcctctttccccgcaaccgcatcctcctcgtcccgagaagctttcctcgaagcgcagcagcagccatggactccaccggtaccggagctggcggcaaggtgaagaagggagcggccgggcgcaaggccggtggtcccaggaagaagggtgtgtcccgttccgtgaaggccgggctccagttccccgtcggccgtatcgggcgctacctcaagaatggccgctacgcccggcgcgtcggctccggcgcccctgtctacctcgccgcggtcctcgagtacctcgctgctgaggtccttgagctcgccggcaatgcagctagggacaacaagaagactcgcatcgtccctcgccacgtgctgctggcgatccgcaacgatgaggagctcgggaagctgctgtccggagttaccattgcccacggtggtgttctgcccaacatcaacccggtgctgcttcccaagaagacggcggagaaggcgtccactggtgggagcaaggaggccaagtcccccaagaaggctgctgccaagaagtcccccaagaaggcatagagagtggagttctgaatctgttttaatgcctagtgttgtgccgtgttgctagcttgtgatggggtaggttgtagatgtaatgggtgttgatgataagtggatctgtcgttgtagtagcttgtctttatctgtgctta

SEQ ID NO: 14464 - DNA, 634 bp, Medicago truncatula
caattcaaaccttcttcgcattcaaattttctttttctctcgaaatctcagttcgaaatggacgcaagcaccaagacaacgaagaagggagccggtggaaggaaaggaggaggaccaaggaagaagtcggtgacaagatcaatcagagccggtcttcaatttccagtgggaagaatcggtagatacttgaagaaaggaagatacgctcagcgtgtcggaacaggtgctccggtatacctagcagcagttcttgaatatcttgctgctgaagttcttgagttggctggaaatgcagcacgtgataacaagaagaatagaatcattccaaggcatgtgttgttggctgttaggaatgatgaagagcttggtaaattgcttaatggtgttaccattgctcatggtggtgttcttccaaacattaaccccatcctcttgcctaagaagactgaaaaggctgtttctaaggagccaaagaaggctggaaagtctccaaagaaggcttagatctgattctaggaacaattagatcttttaattagttttctttcttttttttttgcttttgaagttgtgatgaagtaacgggatcttgttgatcctttttgtgtatgataatggtggaattaatgaaaat

SEQ ID NO: 14465 - DNA, 681 bp, Elaeis guineensis
aggatcggaagcgaaagagatcaccggagaggagagagatggagatcgggggcaagctcaagaagggggctggtggccggaggggtgggggtccaaagaagaagccggtctcccggtccgtcaaggccggtctccagttcccggttggccggattggccgctacctcaagaagggccgctactcccagcgcgtcggaaccggagcccctgtctacctcgccgccgtcctcgaatacctcgccgctgaggttctggagctggccgggaacgcggcgcgggacaacaagaagaaccggatcatcccaaggcacgtgctgctggcggtgaggaacgacgaggagctggggaagcttctcgctggggtgaccatcgcccatggaggggttctgcccaacattaacccggtgcttctcccgaagaagaccgcgagcaaggagcccaagtcgcccaccaaggccaccaagtcccccaagaaagcttaggaaccgttgacccttgtgttgttattcctgctttcttaattctgtatgtaattctgtggatccgttttaggttgttttcttcttttgtttggtgtaggggatggtgtaatgaggaggaggggacgagacttggaaaaaaggatttgtatcaattctctttcgtttcaggaaatgttaaagacggtgttttaatgtggat

SEQ ID NO: 14466 - DNA, 714 bp, Triticum aestivum
acagctttcaatcccaatctccatcacaaaaccaatcctcctctgccccccgatccccaagagcatcacctgcaagcaatggacgtttcgggcaccggagctggcgccaagggcaagaagggcgcggccgggcgcaaggccggcggccccaggaagaagtcggtgacgcggtccgtcaaggccgggctccagttccccgtcggccgcatcgggcgctacctcaagaagggccgctacgcccagcgcgtcggcaccggcgcccccgtctacctcgccgccgtcctcgagtacctcgccgccgagctgctggagctcgccggaaacgccgccaaggacaacaagaagagccgcatcatcccgcgccacctgctgctcgccgtcaggaacgacgaggagctcggaaagctgctggccggcgtcaccatcgcgcacggcggcgtgatccccaagatcaacccggtgctcctccccaagaggaccgcggagaaggagggcaaggagcccaagaagacgaccaagtcccctaagaaggccaccaaggcttagatcgatccattccatgtcgtagactgtactagtgttcttcatagtggtccggttgtgttcctgtagcggtgtcgtttcatcttgttatgtgcatgtttaatggaagaacgtcagaaatctctctgacttgcccaaaaaaaaaaaaaaaaaaaaaaaaaagggcggcgc

SEQ ID NO: 14467 - DNA, 651 bp, Triticum aestivum
cagcagtcaagcaatccccactcacatctctccacttcccgaatcctttgtccagctcgccatggacgcctcagccaccgtagccaccgggaaggggaagaagggcgtggccgggcgcaaggcgggcggccccaggaagaagtccgtgtcgcggtccgtcaaggccgggctccagttccccgtcagccgcatcgggcgcttcctcaagaagggccgctacgcgcagcgcgtcggctccggcgcccccgtctacctcgcggccgtcctcgagtacctcgccgccgagctgctggagctcgcgggcaacgccgccaaggacaacaagaagagccggatcatcccccgccacctgctgctcgccatcaggaacgacgaggagctcggcaagctgctcgccggcatcaccatcgcgcacggcggcgtgattcccaacatcaacccggtgctgctccccaagaagacggctgagaagtcgaccaaggagcccaagtcgccgaagaagaccgccaagtcccctaagaaggcttaggttccttgcgtagttaggctgtagctggggtgtatggatgggtgtgcttgaggatacttcagttcgaagtagactgttcttgctttgtcgttgtattttctgaccgtgatttcaatgaaaca

SEQ ID NO: 14468 - DNA, 881 bp, Sorghum bicolor
cactccaaaatccaaaaaaaatcccccgcttcctcccaaacccaaattaccactccctccaaatcctcatttccctccacgagcaccctcgactcgactccatggacggcggcggcgcgaaggcgaagaaggcggcggcggggcggaagctgggcggcggagggccgaagaagaagccggtgtcgcggtccgtcaaggccgggctgcagttccccgtgggccgcatcgggcggtacctgaagaagggtcggtacgcgcagcgcgtgggcacgggcgcgcccgtctacctcgccgccgtcctcgagtacctcgccgccgaggtccttgagctggcgggcaacgcggcgcgcgacaacaagaagaaccgcatcatcccgcgccacgtcctcctcgccatccgcaacgacgaggagctcggcaagctgctggcgggcgtcaccatcgcccacggcggcgtgctccccaacatcaactccgtcctcctccccaagaaggccgccgagaaggctgagaaggccgcctccgctaccaagtcgcccaagaaggccgccgccgccaagtcgcccaagaagtagtggtgcccgtctcgtctcgtcggattctcatctcagcttggctgagtgggtggtcgtggatgccttttgctgttcttgcgtgtttgtgtgtatgtagtgatgcgtcgcctcatgtgtcgtgtgcctcgatcgatctaagtctaggtggtttgtgatgggatctcagtgttatctaagatttaatgagaacaagaggaagtgccttgctttctttgatggtttgcattcatctgtctctggattgcatccattaatttgtgaatctattttttttccccaaattttgtctttgattccaaattggct

SEQ ID NO: 14469 - DNA, 928 bp, Malus domestica
cctaaaccactgtctgaaaattttcaattctttctctccatttccgatttggataattgagtcaaaagggtctcagattctcagtgatttagggttgagatatggagactggtggtaagttgaagaaaggtgccgggggaaggaagggcggtggtccgaagaagaaggcggtgacccggtccgtcagagccggcctccagttcccagtcggaagaatcggtcgctacttgaagaaggggaggtatgctcagagagtcgggtctggagctccggtttacttagccgctgtgctcgagtacctcgcagctgaagtgctggaattggctggaaatgcagctcgggacaacaagaagaacaggattatcccaaggcatctgctacttgctgtgaggaacgatgaggagcttggaaaattgcttgctggtgtgaccattgctcacggcggcgtgcttccaaacattaacccagtcctcctgcccaagaaatcagaaaaggccgccggaaaagagccaaaatcgccatcgaaggctaccaagtctcccaagaaggcttaggtttctccatcaaatcaacccaccaaatgtttagctttttatgaatcaaacctccatgtttagatttagttcgtgaccctccccatttgtatgtaatctgtatgcaggtctatgtctttgttggttgtagggaaaagagataccaagacttgaaattccaataatcttatgtgatgatgatgttcaagttttaggtttattgatcttgttggaatccatttatgaaaccccttgtttctggcattacttccgtttggtatgtgtgtatgatgagatgtgagattctcttattccctttgatttgaggtgctatttgttgatgggttgctttatcgaatgcttttgaagaaaggaacctcctttttgcttttctc

SEQ ID NO: 14470 - DNA, 852 bp, Malus domestica
ctataaagcacatcctcttaactgattcccaaatccactgtctgaacattggcaattctttctctccgtttccgatttgggtttttgagtcagaagggtgtctcaggttctcagtgaattttagtgcggttagggtttgagatatggagactggtggtaagttgaagaaaggtgccggaggaaggaagggcggcggtccgaagaagaaggcggtgacccggtccgtcagggccggcctccagttcccagtcggaagaatcggccgctacttgaagaagggacggtatgcgcaaagagtcgggtctggagctccggtttacttagccgctgtgctcgagtacctcgcagctgaagtcctggagttggctggaaatgcagctcgggacaacaagaagaacaggattatcccaaggcatctgctactggccgtgaggaacgatgaggagcttggaaaattgcttgctggtgtgaccattgctcacggcggtgtgcttccaaacatcaacccggtcctcctgcccaagaaatcagagaaagccgccggaaaggagccaaaatctccaaccaaggcaaccaagtctccaaagaaggcttaggttctctcagtgaatcaatcccagcaaatgtttagtcaaatccccacatgtttagatttagtttgtgacccctccccatttgtatgtagtctgtatgcagcaggtctttgtctttcgtttgttgtaggaaaaaagagaaatcgagacttgaacttccattgaatttgaaagcagttgtaatccttcaaaatcttgtgtgatcttgtcatgttttaggagctttgattttcttggaattccatttatgaaattgaaa

SEQ ID NO: 14471 - DNA, 773 bp, Panax ginseng
aagcagtggtatcaacgcagagtacatggggaccctccattggacaaactaatattttctctttctctcttcagattccgtctgtctgtataatttcttctctttcttctatatctcaacgactcattgagatacaatggagactggtggaaaattgaagaaaggtgccgccggcaggaaaggaggcggtcccaagaagaagccggtgtcccgctccgtcaaggccggcctacagtttcccgttggaagaatcggccgatacctcaagaagggccgatacgctcagcgagtcggtaccggagctccggtctacctagccgccgttcttgagtaccttgctgctgaggttcttgagttggctggaaatgcagcaagagacaataagaagaacaggataataccgaggcatctgctattggctgtgaggaatgatgaggaacttggaaagctccttgctggtattacaattgctcatggaggtgtgcttccaaacattaacccggttctgttaccaaagaagtctgagaaggcagccaaggaacctactaagtctccctcaaaggcaactaaatcccctaagaaagcttaggttttagctatgaattagtatatctgttcatctgtccgtatgtgttggtgtttctagttgctctcttgtatgtaatttctgttgccgttgtttagagattaggttgattgtagttttccctttgatcccccgtattagtactcagaatatctttaatttgaaatggaatggaatcgttaccttt

SEQ ID NO: 14472 - DNA, 770 bp, Catharanthus roseus
tcctctcgggcaaaaatatcttctggtatttttattttcttcactagtcgctctagtggtgactgttactgtagtgtagttttaccatttctcggccaccgtgacggatacatggatacggctactgggaaaatgaagaagggagctgctggcaggagaggcggcggtcctaagaagaagcctgtctcccggtcctccagagccggtctacagttcccggtcggaagaatcggccggtacctgaagaaaggtcgatattcgcagcgtgtaggaaccggcgctcctgtctatatggctgctgtcctcgagtaccttgctgctgaggttttagaattggctggaaatgctgcaagagacaacaagaagaacaggatcataccccgacatgtgctgttagctgtgaggaatgatgaggagcttgggaaacttcttgctggtgtgaccattgctcatggaggcgtgcttccaaacattaacccagttcttctgccgaagaagaatgagaaggctgctgcaaaggaaccagccaagtctcctgctaagggcaccaagtcccctaagaaagcttagtttctcatctgttaagaaagggctttgcctctaatctctctgtatgtaatgtcattttctgttctcagtatgtagaagacatttccaaaatttgatcattctgctattgcttttgttttttgtgttaggacatcctgtggctaaaattgatagaatgaatttagattaatcagctcatgtgtagtgtttctattgtgttg

SEQ ID NO: 14473 - DNA, 882 bp, Cicer arietinum
tcacattccccaattactcacaactcgtaccatattcctcctcacattacaatctactcatccttcattcctcataatctaactttgcacaaaatctagggttccaatttcacaatggaagctagcacaaaaacgaagaaaggagccggaggaaggaaaggaggaggaccaaggaagaagtcggtaacaagatctatcagagccggtcttcaatttcccgtcggtagaatcggccgttacttgaagaaaggtagatatgctcagcgtgttggtactggtgctcctgtttacttggctgctgttctcgaatatctcgctgctgaggtgcttgagttggctggaaatgcagcacgtgacaacaagaagaatagaattattcctaggcatgttttgttggctgtgaggaatgatgaagaacttggaaaattgctttctggtgtcaccattgcacatggtggtgttcttcccaacatcaacccgatactattgcctaagaagactgaaaaagctgcaaaggagcctaaatctccatcaaaggccgttaaatctccaaagaaggcagcatagatctgttatctgtcttagtttattatcggttatggtgattttgtgcatatctaagattagctctgtcttatgtaatagaaaagttcaatgtttttgaagcctgtattttggatatcatgtatctcctttaggagtcttaacatctatcaatgaaaacatttgtatcggcactttttcattgtgtttggtaattttaatttctgatgcatttgttcttgtatttgcaaatccatatttaaaaagtcattatattggtcttttattaatcaataaatgtaaattgttatttgtctaattgttttaatttatttttag

SEQ ID NO: 14474 - DNA, 633 bp, Chrysanthemum coronarium
caatatcaaacacacaaacacataaacacttttataaataaaagaatggagggaaccggtaaaatcaagaagggagcagcaggaaggaaagcaggcggtccacgaaagaagtcggttactcgatctgttaaagccgggcttcagtttccagttggtagaattggaaggtacttgaagaaaggccgttatgctaagcgtgttggtaccggtgctcctgtttatcttgctgcggtccttgaatatctcgcagctgaagtgttggaattggctggaaatgcagctagggacaacaagaagactaggattattccgagacatgtgttgttggcgattaggaacgatgaagagcttggaaagttgttgtctggtgttacgattgctcatggtggtgttttaccaaacattaaccctgttttgttgcctaagaaaactgctgctaaagaagcaacaccaaagtctccatcgaaagttggaaagtctcctaagaaggctgctgcttagattagtttggtggtgattgatttgatgtaattggggtgttctattctggtttatgtgatcgtgaagttggtgtagttaatttgattagatgtaatcttttctatggaatgaaatcaagtattcataattaaa

SEQ ID NO: 14475 - DNA, 691 bp, Chrysanthemum coronarium
acactactcgtacgatgatgatgatcttgatgaccaaggtgttcgttctcaggatacatgggatgacgtcgacccagatgaactatcaaacacacaaacacataaacacttttataaataaaagaatggagggaaccggtaaaatcaagaagggagcagcaggaaggaaagcaggcggtccacgaaagaagtcggttactcgatccgttaaagccgggcttcagtttccggttggtagaatcggaaggtatttgaagaaaggtcgttacgctctgcgtgttggtactggtgctcctgtttatcttgctgcagtcctcgagtatctcgcagctgaagtgttggaattggcaggaaacgcagcaagggacaacaagaagactaggattattccgagacatgtgttgttggcgattaggaatgacgaggagctcggaaagctgttgtctggtgttaccattgctcatggcggagttttgccaaacattaaccctgttttgttgcctaagaaaaccgctgctaaagaatctacaccaaagtctccatccaaagccggaaagtctcctaagaaagcagcagcataagattagtttcatgtaatttcggttgatttcttaagtcaatttagagtagtttatgattctcaatggtcacatgtaatcagttttatggaatggaaattgtttgtttcaaa

SEQ ID NO: 14476 - DNA, 789 bp, Citrus clementina
ttctcacctagccccgtataagttttaccaccaacgcctcacattgcggtcacacagtcacactacatttcttttagtttccgtttgtttctcgagaaaattttgtttttgccatttttttctcccccctaacttcttcttgactttgctggtgtgatggagagtggaggaaaggtgaagagaggagcaggaggaaggaaagggggtggtccaaagaagaaaccggtctcgcggtcggtgaaagccggtctgcagttcccggtcggtcggatcggtcgctatctgaagaagggacgctactctcagcgtgtgggaaccggcgctccggtctatcttgctgctgtacttgagtacctcgcagctgaggttcttgagttggctggtaatgcagcgagggacaacaagaagaataggatcatcccaaggcatgttctattggctgtaagaaacgatgaggagcttgggaagcttcttgctggtgtgacaattgctcatggtggagtcttgccaaacatcaacccagttcttctgccgaaaaaatctgagaaggcagcaacgaaagagccgaagtctccagccaaggccactaagtccccaaagaaggcttagtttttagtcttctcatctttaactgtgtgtatgttacttctttgatgtattcggcttgtaggaaagcttcatgctcgtaggatttagggaccattctactgtttttaattgtccgtcactgtgtagaacttcttttgcttggactgtagaatgaatgaaatcatagtacttgttccgata

SEQ ID NO: 14477 - DNA, 836 bp, Trifolium pratense
cacgtcaccactactcaaaatcttccatttccaacatcaaaccaatttcgtagcaaaaaatctagggttcatttccaagctcgaaaatggacgcaagcacaaagaccaagaaaggtgccggaggaagaaaaggcggaggtccaaggaagaagtcagtcaccagatccaccagagctggtcttcaattccccgtcggaagaattggtcgttacttgaagaaaggtcggtacgctcaacgtgttggtaccggagctccggtttacttagccgctgttcttgaatatcttgctgctgaggttcttgagttggctggaaatgctgcacgtgataacaagaagaataggataatcccaaggcatgtgttattggctgtgaggaatgatgaagaacttggaaaattgcttgctggtgtcactattgctcatggtggtgttcttccaaatattaacccaattcttttgcctaagaagactgatagatctactactgctagtaaggagccaaagtctccaaaggctaagaaatctcctaagaaagcttagattagggttctgatttgtggttgttgaaatgttgatgatgatgatgtttattttgtgtgtatatctgctacgctttaatgcgtttgaaatgttgatgtaattctgatttctgtttcgacttttagtattaatatgaacaattcagtagaaataatattttcttcaatgtttgtggagtttaactattagtatttatggaatttagagaattagtatttctgttaatatgagctgcatcttaaataattgtacttgttggtggttttattggcttataaagttttcaatttggtt

SEQ ID NO: 14478 - DNA, 564 bp, Pennisetum glaucum
gaagggagcggccggtcgcaagacaggcgggcccaggaagaagtccgtgacgcggtccgtgaaggccgggctgcagttccccgtcggccgcatcgggcgctacctcaagaagggccggtacgcgcagcgcgtcggcagcggcgcccccgtgtacctcgccgccgtcctcgagtacctcgccgccgaggtgcttgagctcgccggcaacgcagcgagggacaacaagaagacgcgcatcgtcccgcgccacgtgctccttgcgatccgcaacgacgaggagcttggcaagctgctgtccggggtcaccatcgcccacggcggcgtcctccccaacatcaacccggtgctcctgcccaagaaggtggcggagaaggcggctgccaaggaggccaagtcgcccaagaaggctgctaagtctcccaagaaggcctagagaggctctccatttagtgctttactgtatgctgtattgctgttcgatgttcctgtctggtagatctgtagttgggatggcttcttatctagtatagttactgtggctttgtgatctgcgcattttgctgg

SEQ ID NO: 14479 - DNA, 1090 bp, Petroselinum crispum
catttcaagctccaacaaataccaacctctacatacaaactttatatctacacatctctctacatctcgccggaaaaaatggaaactggaggaaaagtgaagaaaggagccgccggaagaaagttcggcggtggcggtccaaggaagaagtccgtgacccggtccgttaaggccggtctgcaatttccggtcgggagaatcggccggtacctgaagaaaggccggtatgctcaacgtgtcggtactggagctccggtctatctcgccgccgttctcgagtatctcgctgctgaggttttggagttggctggaaatgcagctagggataacaagaagaacagaattatcccgaggcatgttctgttggctgttaggaatgatgaggagcttgggaagctattagctggtgttacaattgctcatggtggagtgcttcctaacattaaccctgtgcttttgcctaagaagtctgagaaggcagctgctaaggagccaacgaaggcgactaaatcgcctaagaaggctgctgcttaataaattgaagtagtgtttaggtgcgaaagaagtgtagtgtttatgctttcgagtgcatctgtgtatgtaatttatggattatgatcggtgttagggttctagtgtaatttatgtgtttgaagcttgtgttggtagatctttgttttgaatgaaatggagtttgtaccatgtgaatgatttgttatggctaatcaaatgttggtttgaatacttgagtttgaatgtgcatttcttgatttggtatgtgactttcatctcagttttcaactgagaaatctaagttgtagtttaaattccctttagaaatgtattgctcaagtgaggacgtagggcttgaatgactcaacttgaacaaaatctcaatgtatgagctatgttttgtgcttgtatggaacagtgagagactttggatttgtcaccagagtatgaagaatacaagggacagtgaacattaacaacaaattataaagccttatgattgctggggtgttgctctactattgttgccttctgaggtggtctcagacttgtctaacatacgtcttgtgttcaatct

SEQ ID NO: 14480 - DNA, 913 bp, Petroselinum crispum
caaacaccaacctctacatacaaactttatatctacacatcctctctctacatctcgccggaaaaaatggaaactggtggaaaagtgaagaaaggagctgccggaagaaagttcggcggtggcggtccaaggaagaagtcggttacccggtctgttaaggccggtctacaattcccggtcggaagaatcggccggtacctgaagaaaggccggtatgctcaacgtgtcggtactggagctccggtctatctcgccgccgttctcgagtatctcgctgctgaggttttggagttggctggaaatgcagctagggataacaagaagaacagaattatcccgaggcatgttctgttggctgttaggaatgatgaggagcttgggaagctattagctggtgttacaattgctcatggtggagtgcttcctaacattaaccccgtgcttttgccaaagaagtctgagaaggcagctgctaaggagccaacgaaggcgactaaatcgcctaagaaggctgctgcttaataaattgaagtagtgtttaggtgcgaaagaagaaagaagtgtagtgtttatgctttcgagtgcatctgtgtatgtaatttatggattatgatcggtgttagggttctagtgtaatttatgtgtttgaagcttgtgttggtagatctttgttttgaatgaaatggagtttgtaccatgtgaatgatttgttatggctaatcaaatgttggtttgaatacttgagtttgaatgtgcatttcttaatttggtatgtgactttcatctcagttttcaatcgagaaatcttagttgtagtttaaattccctttaggaatgtattgctcaagtgaggacgtagggcttgaatgactaaacttgaacaaaatctcaatgtatgagctatgttttgtgc

SEQ ID NO: 14481 - DNA, 612 bp, Silene vulgaris
gaagaagggtgcagctggaaggaaagccggcggtccaaagaagaagtcagttacccggtccatcaaagctggtctgcagttcccggtcggtcgtattggaaggtacttgaagaaaggtcggtatgctcagcgagtcgggtccggtgctccggtttacttggctgctgttcttgagtaccttgctgctgaggttttggaattggcgggaaatgcggctcgtgacaacaagaagaacaggataatcccaaggcatgtgttgctggcaataaggaacgatgaagagctcggaaagctgctagcaggagtaacaattgcacatggaggagtgttgccgaacattaacccgattctgttacctaagaagactgctgagaagtctcccaaggaacctaagtctccatccaaggctgcaaaatcgccaaagaaagctgcttaagtttgatttctaagtgatttgtgtatgtaagctaattaggttttcggaataggtagtatggttcttaagttgatggttatcttattttggagttgatttctgattgattcttgtcttttgtattcgctgaagtgttatgaatgaaaacgtttatgatatataaacttcagttatct

SEQ ID NO: 14482 - DNA, 692 bp, Theobroma cacao
aatccagatcggtcttgccaaattcacttcttgaagggtagcgggtgttgtcggggtcgggttgaaccaatggataccggaggaaaagtgaagaagggcgctggaggaaggaagggcggcggcccaaagaagaaacctgtttcaaggtcggttaaagctgggctccaatttcccgttggaaggatcgggcgttacttgaagaaaggaaggtactcgcagcgagtcggaaccggagcaccagtttacatggctgccgttcttgagtacttagccgctgaggttctggaattggctggaaacgcagcgcgtgacaacaagaaaaacaggatcataccaaggcacgtactactcgcagtgaggaacgatgaggaacttgggaagcttctcgccggcgtcaccatcgcccacggtggcgtcttgccaaacatcaaccctgttcttttgccaaagaagactgacaaagccacaaaggaacccaaatctccatcgaaagccaccaagtctctcaagaaagcttaattcgatcaagaaactctcatttttaggccttcttttgttcttatttagttgtatgtgattacggggtctttaggattttggttgttaatgtggatgtgtaggtggaaaactgtttcaaagaaaatttaagatattattgttagactcccattatcatgtatgtgatcttcatg

SEQ ID NO: 14483 - DNA, 919 bp, Castanea mollissima
cgggggctcacacaatttccatttccatttcccacttccagtccaaccactactctttccctcactcccttgtttgtttctcgagaaaattttttcgtgtgtgattttttcatggataccggtggaaaagtgaagagaggagctggaggaagaaaaggcggcggtccaaagaagaaacccgtctcccggtccgtcaaagccggtctacagttcccagtcggtcggatcggccggtacttgaagaaaggccgatacgctcagcgtgtcggtaccggtgctccggtttacctcgccgccgtgctcgagtacttagctgctgaggttttggaattggctggaaatgctgcaagagacaacaagaaaaacaggattatcccgaggcatgtgttgctagcggtgaggaacgacgaagagcttggaaagcttcttgcaggtgtgaccattgcacatggaggtgtacttcccaacatcaaccctgtccttcttccgaagaagaccgagaaggcggccacaaaggagcctaagtctccagccagggccactaaatcgcccaagaaagcttaatgtgttaaaacaaattcagtcttttgtgtcactgtatgtaatttccttatctgtatgtggcttgtagggaagctttttaatgttgttaggagttaggaccatttgtactctttgtttccatgtcattgtagtgttaaaacatcctttgttttaagtcattgaaatgaaattgcagcccagtttggaattctcatttgttactttggttgaagttgttgtaatgtaattaggcttaatttgggttgtttgtggttttgaccatttggtttgttgtggaattaagtgtttagaagaaaaatcctggcctacacgtgtgagttaagaatagtgctgcatgtttggatgttgattgaag

SEQ ID NO: 14484 - DNA, 691 bp, Gossypium hirsutum
cagttctcctgtaccaatcaatatcctctaattctaaagctaagagttttaagttaacgaagcatttgggtcgtttcgaagtaatggaaacttcaggaaaagtaaagaagggagccggaggaaggaaaggtggtggcccgaagaagaagcccgtttcaaggtctgtcaaagctggtctccagttccctgttggtaggatcggccgttatttgaagaaaggaaggtattcgcagcgggtcggaaccggagccccggtttacttggctgctgttcttgagtacttggccgctgaggttctggaattggctgggaacgctgcacgtgacaacaagaaaaacaggatcatcccaaggcacgttctactcgccgtgaggaacgacgaagaattagggaagcttctcgccggcgtaaccatcgctcacggtggtgtgttgccgaacatcaacccagttcttttgccgaagaagactgaaaaggccgccggcaaagaacccaaatctccatcaaaggccaccaagtctcctaagaaagcttaatttgttttaacaaaactagattcacagggctttatttttcttagttgtatgtccttttgggtgattgttttcacagtgtaggggaagactgccttaagcaatatggaagcattgttagaatctcattatgatgtatgttactttaatggaaatga

SEQ ID NO: 14485 - DNA, 707 bp, Gossypium hirsutum
cggagttctcctgtaccaatcaatatcctctaattctaaagctaagagttttaagttaacgaagcatttgggtcgtttcgaagtaatggaaacttcaggaaaagtaaagaagggagccggaggaaggaaaggtggtggcccgaagaagaagcccgtttcaaggtctgtcaaagctggtctccagttccccgttggtaggatcggccgttacttgaagaaaggaaggtattcacagcgtgttggaaccggagccccggtttacttggctgctgttcttgagtacttggctgctgaggtcctggaattggctgggaacgctgcacgtgacaacaagaaaaacaggatcatcccaaggcacgttctacttgccgtgaggaacgacgaagaattagggaagcttctcgccggcgtaacaatcgctcacggtggtgtgttgccgaacatcaacccagttcttttgccgaagaagactgaaaaggccgccggcaaagaacccaaatctccatcaaaggccaccaagtctcctaagaaagcttaatttgttttaaaaaagactagatccacagggctttatttttcttagttgtatgtccttttggggggattgttttcatagtgtaggggaagaatgctgtaagcaaattggaggaattgttagaatgttatcatgatgtatgttactttaatggaaatgaaacatctagttt

SEQ ID NO: 14486 - DNA, 1056 bp, Gossypium hirsutum
aagtttcagcccttgcccattggatcttccctcattctttgtttcatcctctttttcccccttgtcgttcctttgccattttcctcctatgcaaatcctctgcagcacgcattgctgcttggtttctctaatcggtatcctctaattttaaacctaagagttttaagttaacgaagcatttgggtcgtttcgaagtaatggaaacttcaggaaaagtaaagaagggagccggaggaaggaaaggcggtggcccgaagaagaagcccgtttcaaggtccgtcaaagccggtctccagttccccgttggtaggatcggccgttatttgaagaaaggaaggtattcacagcgggtcggaaccggagccccagtttacttggctgcagttcttgagtacttggcggctgaggttttggaattggctgggaacgctgcacgtgacaacaagaaaaacaggatcatcccaaggcacgtgctactcgccgtgaggaacgacgaagaattagggaagcttctcgccggcgtaaccatcgctcatggtggtgtgttgccgaacatcaacccagttcttttgccgaagaagactgaaaaggccgccggcaaagaacccaaatctccatcaaaggctaccaagtctcctaagaaagcttaatttgattgttaagaaagttagtttaatagggctttatttttcttagttgtatttcctttgggatgttttaagcaaactggaagaagtgttagaatcccattatcatgtacgttactttaatggaaatgaaacatctagtttctattcttgataatttatcatgtggtttgtacaaccaatactcacatgatagcttctaagggttcttttgattagttgttgaagttattgttggcgttaaattttagttgggggaatgaaataggattgtaatagaataaaaatgaaattagtaatgcagttgtttaattaaatagaatgaaatatatctgtaataaatattacttgtgtttggttgaatgtaatatgagttgtaataatataaggaaaatggcttaaatagaat

SEQ ID NO: 14487 - DNA, 867 bp, Quercus alba
atcaacgcagagtacatggggacacaatttccatttccatttcccacttccagtccaaccactctttccctaactccctgtttgtttctcgagaaaattctttttgtgtgattttttcatggatacaggtggaaaagtgaagagaggagctggaggaagaaaaggcggcggtccaaagaagaaacccgtctcccggtccgtcaaagccggtctacagttcccagtcggtcggatcggtcggtacttgaagaaaggccgatacgctcagcgtgtcggtaccggtgctccggtttacctcgccgccgtgctcgagtacttagctgctgaggttttggaattggctggaaatgctgcaagagacaacaagaaaaacaggattatcccgaggcatgtgttgctagccgtgaggaacgacgaagagcttggaaagcttcttgcaggtgtgaccattgcacatggaggtgtacttcccaacatcaaccctgtccttcttccgaagaagaccgagaaggcggccacaaaggagcccaagtctccagccagggccactaaatcgcccaagaaagcttaatgtgttaaaacaaattcagtcttttgtgtcactgtatgtaatttcctatctgtatgtggcttgtagggaagctttttaatgttgttaggagttaggaccatttgtactctttgtttccatgtcattgtagtgttaaaacatcctttgttttaagtcattgaaatgaaattgcagcccagtttggtattctcatttgttactttggttgaagttgttgtaatgtaattaggcttaatttggattgtttgtggttttgaccatttggtttgttgtgttaagtgtatagaagaaaaatc

SEQ ID NO: 14488 - DNA, 796 bp, Arachis hypogaea
gcaatcacacctcttccatcaccggaaaaagaaaaggaaagaaaaaaaaaagttaattaaggttctgatggacagccccgctgtaaaagggaagaaaggagctgccggaaggagaggcggtggtcccaagaagaagtcagtgtcaaggtccgccaaagccggtctccaattccccgtcggaaggatcggacgctacttgaagaaaggccgttatgctcagcgtttgggaagcggcgctccggtttaccttgccgccgttttggaatacctagttgctgaggttttggaattggctgggaatgctgctagggataacaagaagaacaggattattccaaggcatgtcctgttagctgtgaggaacgatgaagagcttggaaaactgcttgctggtgttaccattgctcatggtggtgttcttcctaacattaaccctgtgcttttgcctaagaagagtcaagctgctgctgctaaggaaccgaagtctccatctaagggcacaaagtctcctaagaaagcttaattgattatgatattttggtgttaggttacttttggtttctctttgattttaatgtatatctgttgttaggtacctttagtcttttttaggctggcaggaatatgtgatgcttgtcatggtatcctcatttggaatttatggtgaatggattattcgaaatagctctttttcatgtagcaaagattagaatttgaatgttaatgcaaattggcttatgatatatttctattatgtaattttctatttagtaaagatgtcataaagcgcaaatga

SEQ ID NO: 14489 - DNA, 789 bp, Triphysaria pusilla
cgaggctttacggattctctccttcttcacctcccagagttcaccagctaatgcatcgccaactttgggaacaccatcgccatttgcaacctttgtttgtgcatctgacatacaattttcctcctaaccaatcatctttgcaccaaaaccaaaaatggaagctactccaaaggcaaagaagggagctgctggaagaaaggccggtggaccaaagaagaaatccgtcacccgctccgtcaaagccggtctccagtttcctgtaggcaggatcggtcggtttctgaagaagggtcgctatgctcagcgcgtgggttctggtgccccggtttacctggctgcggttctagaataccttgctgctgaggtattggagttggctggaaatgcagcaagagacaacaagaaaagcaggattatcccaaggcacttgttgctggccgtgaggaacgatgaggagcttggtaaacttctggctggagtgacaattgctcatggtggtgttataccgaacataaacccggttctgttgcctaagaaatccgacaaggtggctgagaaagcacccaaatcgccatcgaaggctgccaagtctccgagaaaggcttagactgaaatttgttctttctgaatgtgggattgggataaaataacctttattggtttgtagggattgtgttatcttgtggttatgtaggtgatgatgtttataactgcagtaattgtacttttaaccctttttcttgctattttgtttttaaatctcatgatttaaacttaatgaaagattgc

SEQ ID NO: 14490 - DNA, 587 bp, Triphysaria pusilla
ctgcaagctcaatttcatcttcatcctcttcactaacttctttcattcagagaaaaatggaaaccggtgggaaagtgaaaaagggagccgctggaaggaaggccggtggaccaaagaagaaatccgtcacccgctccgtcaaagccggtctccagtttcctgtaggcaggatcggccggtttctgaagaagggtcgctatgctcagcgcgtgggttctggtgctccggtttacctggctgcggttctagagtaccttgctgctgaggttctggagttggctggaaatgcagcaagagacaacaagaaaagcaggattatcccgaggcacttgttgctggctgtgaggaacgatgaggagcttggtaaacttcttgctggagtgacaattgtgcatggtggagtaatcccgaacataaacccggttctgttgcccaagaaatccgacaaggtggctgagaaggcgcctaaatcgccatcgaaggctgctaagtctccgaaaaaggcttaaaatttttgtcaaattttgaaagggggtgagtgtcaattggtgtgcggtgccgggcggcggaggtggcggtgggatttt

SEQ ID NO: 14491 - DNA, 864 bp, Cicer arietinum
caagccgcattttccattattttctcacaatcatcgattcttctccatttctcatacatcacagcgaaatctcagctagaatctagggttcgaaatttgcaatggatacttctccaaaatcgaagagaggtgctggtggaaggaaaggaggaggaccaaggaagaaggcggtgacaagatccaccagagccggtcttcaattccccgtcggaagaatcggccgttacttgaagaaaggtagatacgctcagcgtgttggcactggtgctcccgtttacctagctgctgttctcgaatatctcgctgctgaggtgcttgagttggctggaaatgcagcacgtgacaacaagaagaatagaattattcctagacatgttttgttagctgtgaggaacgatgaagagcttggaaaattgcttgctggtgttactattgctcatggtggtgttcttcctaatatcaacccgatactattgcctaagaagaatgagagagctgtgaaggaaccaaaatctccatctaaggctgtgaagtctccaaagaaggcttagatttagtttctatttgtatatctaagtttagggttgtattttgttattgaaatatttaatgtgtttgaagctgtgtaagttggatctcgaatgtttctcatgtagaagttttaattcatctatgaaaacaacttgtttttatgttattgtttatgatccaaatttatagttgtcttccaaacagtgtttcttttgcgtttgctttaaattcggaaatgaagtactgattttcacagacgtataataaccggttatttgttgaaatgagccgtgaaacatagggttattcttcttgttaagaatttataactcg

SEQ ID NO: 14492 - DNA, 676 bp, Acacia harpophylla
gactttgcttcagtcctacaaatctagcgtcccaaaaatctttcttgtctctaatcggcaaacgaagtagcattcaatggattcaacagtgaaggtgaagaagggcgctggaggaaggaaaggtggtggtcctaagaagaagccagtgtcccggtctgtgaaagccggtcttcaatttcccgttggaagaatcggtcggtatctgaagaaaggaaggtactcacagcgtgttggaacaggtgctccagtctacatggctgccgtccttgagtacttagctgctgaggttttggagcttgctggaaacgcagctcgtgataacaagaagaacaggattatccctaggcatgttcttctcgcggtgcggaacgatgaggagcttgggaagcttcttgccggtgtgactatcgctcatggaggtgtcctgcccaacattaacccagtgcttttgcccaagaagaccgaaaaggccaccaaagagcccaagtctccatcgaaagccactaagtccccgaagaaagcataattctattttcagaccattcgtctctttgttttttgtgtgatgtaaattagcgattaggcttatgctttagcaacatttcatatatgctgtagccctgtgatgtaattgtcacattgactcattgaatgaaatcacctcgattttagttca

SEQ ID NO: 14493 - DNA, 626 bp, Amaranthus tuberculatus
ccattattacagtttctgttcacctgcacaaagattcctccattttcgcagggaagtaagaagaagaagaaaaatggatagcacaggtggaaaatcaaagaagggagcagcaggaaggaaaggaggaggaccaaagaagaagccagtttcaagatcagtaaaagctggtttacaatttccagttggaagaattggaaggtacttgaagaaaggtcgttatgctcaacgtgttggtactggtgctcctgtttatttagctgctgttcttgagtatcttgctgctgaggtgttggagttagccggaaatgctgcaagagacaacaagaagaacagaatcatcccaaggcatgtattacttgctgtaaggaacgatgatgagcttggaaagcttcttgctggagtaacaattgctcatggaggtgttcttccaaacatcaacccagttttattgccgaagaagactacagaaaagtcccctaaggaacccaaatccccttctaagggtaccaagtccccaaagaaagcttaagtagattaatggtggatttggctggttctcagtttagattgtatttcatggaaccttgtatgtaatgtcggtagatgtttattagggttttttattt

SEQ ID NO: 14494 - DNA, 594 bp, Arnica chamissonis
actcacacacaaacaaaggcaccagccatcgttatggagaccggtggaaagttgaaaaagggagccgccggaaggaaggcaggcggtcctaagaagaagccagttacccggtccgttaaggccggtcttcagttccccgtcggtaggatcggccggtacctcaaggtaggccggtacgccaagcgcgttggtaccggtgctccggtttacctcgctgctgttctcgagtaccttgctgctgaggttttggagttggctggaaatgctgcaagagacaacaagaagaccagaatcataccacgtcatgttttgttggctattcgaaacgatgatgagcttggaaagcttctatctggtgtgacaattgctcatggtggtgttcttccaaacatcaatccggttcttctgccaaagagggttcatgacaaagctgcaaaagaacccaaatcgccatcaaaatcaactaaatcccctaagaaggcataggtgatgaagaaaatactctttgtatgtatccattttcttatgatgatgaaggttaggatgttttagggctgatttagaaggaccgtgagctcttttgtttatgttatg

SEQ ID NO: 14495 - DNA, 671 bp, Vaccinium corymbosum
ctctctgctgtttgtttcccgagaaaatcctcttttctgcctgaaaacctgaggaaaaatggagactggcggaaaggccaagaaaggtgccgctggaagaaggggtggcggtccgaagaagaaacccgtttcccggtccgtcaaagccggtttacagtttccggtcgggaggatcggccggtacttgaagaaaggccgttatgctcagcgtgttggaaccggtgctccggtttacctcgccgccgtacttgaatatctcgctgctgaggttttggaattggctgggaatgctgcaagagacaacaagaagaacaggattgtaccgagacacttgcttctggctattaggaacgatgaggaactcggaaagcttcttgctggcgtgacaatcgctcatggaggggtgcttcccaacataaaccctattcttctccccaagaaaagtgagaaagcagcagcaaaggagcccaagtctccatccaaggccaccaagtcgccgaagaaagcttaacttcttatagtgcataggaaaccttatctaattttagattggtctctttttctctttgtatgtaagtttcatttttctgtagtggtgtgtggtagagtctgttgccaggaaatatattgtactctttgttacaatatacacaatgaaagacttgaaattg

SEQ ID NO: 14496 - DNA, 487 bp, Chrysanthemum coronarium
aagaagggagcagcaggaaggaaggctggtgggccacgaaagaagtcagttactcgttccgttaaagccgggcttcagtttccagttggtagaattggaaggtatttgaagaaaggccgttatgctaagcgtgttggtactggtgctcctgtttaccttgccgcggtcctcgaatatcttgcagctgaagtgttggaattggcgggaaatgcagctagggacaacaagaagactaggattattccgagacatgtgttgttggcgattaggaacgatgaagagcttggaaagctgttgtctggtgttacaatagctcatggtggtgttttgcccaatattaacccggtcttgttgcctaagaaaactgttgcgaaagaaccaacaccaaagtctccatccaaagctgcaaaatctccaaagaaagcagcatagattagtttgtttcatgtatttgtggtgttacgattgctcatggtggtgttttgcc

SEQ ID NO: 14497 - DNA, 562 bp, Chrysanthemum coronarium
ctcacacattttaaaaatcaaatggagggaactggtaaaattaagaagggagcagcaggaaggaaagccggtgggccacgaaagaagtcagtcactcgatctgtgaaagccgggcttcagttcccagttggaagaattggaaggtatttgaagaaaggccgttatgctaagcgtgttggtaccggtgctcctgtttatcttgctgcggtccttgaatatctcgcagctgaagtgttggaattggctggaaatgcagctagggacaacaagaagactaggattattccgagacatgtgttgttggcgattaggaacgatgaagagcttggaaagctgttgtctggtgttacaatagctcatggtggtgttttgcccaatattaacccggtcttgttgcctaagaaaactgctgcgaaagaaccaacaccaaagtctccatcaaaagttggaaagtcgccgaagaaagcagcatagattggtttgtttgatgtatttgtggtgttttgtcagtaaattcagatgtagtcatttctattgaatgaaagccttttctttctgtttc

SEQ ID NO: 14498 - DNA, 543 bp, Chrysanthemum coronarium
ctctcaaaacaaacaaacactcattttttataagtaagaatggagggaaccggtaaagtgaagaagggagcagcaggaaggaaagccggtgggccacgaaagaagtcagtcactcgatctgtgaaagccgggctccagtttccagttggtagaattggaaggtatttgaagaaaggccgttatgctaagcgtgttggtactggtgctcctgtttatctcgctgccgttcttgagtatctagcagccgaagtgttggaattggcgggaaatgcagctagggacaacaagaagactaggataattccgagacatgtgttgttggcgataaggaatgacgaggagcttggaaagctgttgtctggggttacgattgctcatggtggtgttttgccgaatattaacccggtcttgttgcctaagaaaactgctgcgaaagaaccaacaccaaagtctccatctaaagttggaaagtcgccgaagaaagcagcatagattagtttgtttgatgtatttgtggtgtttcgttagtgaattcagatgtag

SEQ ID NO: 14499 - DNA, 532 bp, Chrysanthemum coronarium
ttttataaaaatcaaatggagggaaccggtaaaattaagaagggagcagcaggaaggaaagctggtgggccgcgaaagaagtcggtgaccagatctgttaaagccgggctccagtttccagttggaagaattggaaggtatttgaagaaaggtcgttacgctaagcgtgttggtactggtgctcccgtttatcttgctgcggtcctcgagtatcttgcagctgaagtgttggaattggctggaaatgcggcaagggacaacaagaagaatagaattattcccagacatgtgttgttggcgattaggaatgacgaggagcttggaaagttgttgtctggtgttaccattgctcatggtggagttttgccaaacattaaccctgttttgttgcctaagaagactgctgctaaagagtcagcaacaccaaagtctccgtcaaaagctggaaagtctccaaagaaggcttagattagtttgatgcgtttggattaatgtaactgttgctggtgttttcgtttgtttgatttgctag

SEQ ID NO: 14500 - DNA, 686 bp, Cichorium intybus
ttttcttttccttcaaggttatttccgtatcttagtcgtttgagtgtgaaatggaagccggaacaaaggtgaaaaagggagccgccggaaggaaggctggcggtcctaagaagaagccggtttctcgctccgtcaaggccggtcttcagtttcccgtcggtaggttgggtcgctacctcaagaaaggccagtatgcaaagcgtgttggcaccggtgctccggtttacctcgccgccgtcctcgagtaccttgctgctgaggttttggagttggctggaaatgctgcaagagacaacaagaagtccagaatcattcccagacatgttctcttggctgtgagaaatgatgaagaattaggaaagcttctgtctggtgtgacgattgctcatggtggtgttcttccaaacatcaacccagttcttctgccaaagaaggctcttgacaaagcaacaaaggagcctaaatctccctcaaaagcaaccaaatcacccaaaaaagcttagttagtggtcgaatatgaatgtctattggggttatttgttaatcttatttgtatttaggagcgacaattgtgttttagggaaagttagggctattgtagtctctcatgtattgaggacatgttgctggatctaattgtgtgtaaaacaacatctcgtttgtttttaaatgacaattggtatttc

SEQ ID NO: 14501 - DNA, 810 bp, Cichorium intybus
aaacatcttcagacagtaaagattaatctgaaaaaaatcaaagaggttttcttttccttcaaggttatttccgtatcttagtcgtttgagtgtgaaatggaagccggaacaaaggtgaaaaagggagccgccggaaggaaggctggtggtcctaagaagaagccggtttctcgctccgtcaaggccggtcttcagtttcccgtcggtaggttgggtcgctacctcaagaaaggccagtatgcaaagcgtgttggcaccggtgctccggtttacctcgccgccgtcctcgagtaccttgctgctgaggttttggagttggctggaaatgctgcaagagacaacaagaagtccagaatcattcctagacatgttctcttggctgtgagaaatgatgaagaattaggaaagcttctgtctggtgtgacgattgctcatggtggtgttcttccaaacatcaacccagttcttctgccaaagaaggctcttgacaaagcaacaaaggagcctaaatctccctcaaaagcaaccaaatcacccaaaaaagcttagttactggtcgaatatgaatgtctattggggttctttgttaatcttatttgtatttaggagcgacaattgtgttttagggaaagttagggctattgtagtctctcatgtattgaggacatgttgctggatctaattgtgtgtaaaacaacatctcgtttgtttttaaatgacaattggtatttctgaaaacgtggttcatttccagttatttattcgtaatcatgtgtgaaaaagttatgggaaatggctgtttttcacccc

SEQ ID NO: 14502 - DNA, 683 bp, Gossypium hirsutum
ttctaaagctaagagttttaagttaacgaagcatttgggtcgtttcgaagtaatggaaacttcaggaaaagtaaagaagggagccggaggaaggaaaggtggtggcccgaagaagaagcccgtttcaaggtctgtcaaagctggtctccagttccccgttggtaggatcggccgttacttgaagaaaggaaggtattcgcagcgtgttggaaccggagccccggtttacttggctgctgttcttgagtacttggccgctgaggttctggaattggctgggaacgctgcacgtgacaacaagaaaaacaggatcatcccaaggcacgttctactcgccgtgaggaacgacgaagaattagggaagcttctcgccggcgtaacaatcgctcacggtggtgtgttgccgaacatcaacccagttcttttgccgaagaagactgaaaaggccgccggcaaagaacccaaatctccatcaaaggccaccaagtctcctaagaaagcttaatttgttttaacaaaactagattcacagggctttatttttcttagttgtatgtccttttgggtgattgttttcacagtgtaggggaagactgccttaagcaatatggaagcattgttagaatctcattatgatgtatgttactttaatggaaatgaaacatctagtttccttgaagaaa

SEQ ID NO: 14503 - DNA, 689 bp, Gossypium hirsutum
ctctaattttaaagctaagagttttaagttaacgaagcatttgggtcgtttcgaagtaatggaaacttcaggaaaagtaaagaagggagccggaggaaggaaaggtggtggcccgaagaagaagcccgtttcaaggtctgtcaaagctggtctccagttccccgttggtaggatcggccgttacttgaagaaagggaggtattcacagcgtgttggaaccggagccccggtttacttggctgctgttcttgagtacttggctgctgaggtcctggaattggctgggaacgctgcacgtgacaacaagaaaaacaggatcatcccaaggcacgttctacttgccgtgaggaacgacgaagaattagggaagcttctcgccggcgtaacaatcgctcacggtggtgtgttgccgaacatcaacccagttcttttgccgaagaagactgaaaaggccgccggcaaagaacccaaatctccatcaaaggccaccaagtctcctaagaaagcttaatttgttttaaaaaagactagatccaaagggctttatttttcttagttggatgtccttttggggggattgttttcatagtgtaggggaagaatgctttaagcaaattggaggaattgttagactgttatcatgatgtatgttactttaatggaaatgaaacatctagtttctttgaaaa

SEQ ID NO: 14504 - DNA, 955 bp, Eucalyptus grandis
gcgacacggatcgccacctcatcgatccacgaccgttcgcgagctccccatccgacggcccgcgcgcgccgatggacgaatccgggtgctctctcccagactcccctgcgctccatttaaagaccgcctcgcgactctgtccactcaccgtcccacagggaaagaaatattctcgctcccaattcgaataccggcgaagaactttttcccaccgttttctccggaaaatcctttcgcatttccccggttcgtcttccccggccttcgatccgctcggcgatggagtccctaggcaagccgaagaagggcgccggaggcaggaagggaggcggcccgaagaagaagcccgtctcccgctccgtcaaggccggcctccagttcccggtcggccgtatcgggaggtacctgaagaagggccgctactcccagcgcgtcggcaccggggccccggtctacctcgccgccgtcctcgagtacctcgccgctgaggttctggagctcgcggggaatgcggcgagggacaacaagaagaacaggatcatcccgaggcacgtgctgttggcggtgaggaacgacgaggagctcgggaagctgctcgccggagtgacgatcgcgcacggaggcgtgctccccaacatcaacccggtcctcctgccgaagaagacggagaaggcgaccaaggagcccaagtctccgtccaaagccaccaaatcaccaaagaaggcttaggctttgatgttagggtttagggtcgagaacttctggttcttatagtttgaatgtctgccgatctctctctctctctctctctctcactccatgtatgtactgctttgtcttgaagcaaatcgagttgttcatgtaggtgctggtttgttagattcttacctggtgatttgtgctttgactcttgtgcttcaatgaaatgagatggcaaaatttgaaaggttttggc

SEQ ID NO: 14505 - DNA, 836 bp, Gossypium raimondii
tcccctgtaccaatcggtatcctctaattttaaagctaagagttttaagttaacgaagcatttgggtcgtttcgaagtaatggaaacttcaggaaaagtaaagaagggagccggaggaaggaaaggcggtggcccgaagaagaagcccgtttcaaggtccgtcaaagccggtctccagttccccgttggtaggatcggccgttatttgaagaaaggaaggtattcacagcgggtcggaaccggagccccagtttacttggctgcagttcttgagtacttggcggctgaggttttggaattggctgggaacgctgcacgtgacaacaagaaaaacaggatcatcccaaggcacgtgctactcgccgtgaggaacgacgaagaattagggaagcttctcgccggcgtaaccatcgctcatggtggtgtgttgccgaacatcaacccagttcttttgccgaagaagactgaaaaggccgccggcaaagaacccaaatctccatcaaaggctaccaagtctcctaagaaagcttaatttgattgttaagaaagttagtttaatagggctttatttttcttagttgtatttcctttgggatgttttaagcaaactggaagaagtgttagaatcccattatcatgtacgttactttaatggaaatgaaacatctagtttctattcttgataatttatcatgtggtttgtacaaccaatactcacatgatagcttctaagggttcttttgattagttgttgaagttattgttggcgttaaattttagttgggggaatgaaataggattgtaatagaataaaaatgaaattagtaatgcagttg

SEQ ID NO: 14506 - DNA, 716 bp, Tropaeolum majus
aaaaaaactcgactgtcctactctttgttcgtataatatttcggccaactcagtacggttagttaaggcgagttaactcagactttgaatttagaatggatactacagggaaagcaaagaagggagcaggaggaaggaagggaggaggccctaagaagaagtcggttacccggtctgttagggcaggcctccagtttccggtaggtagaatcggtcgttacttgaagaaaggaaggtatgctgctcgagttggtaccggagctccggtttacctagccgcagttctcgagtatcttgccgctgaggttcttgaacttgccggcaacgcagcgagagacaacaagaagtccagaatcattccaaggcatctgttgcttgctgtaaggaacgatgaagaacttggaaaacttctctcaggtgttacaattgctcatggtggagtccttcccaacattaacccaattctattgcctaagaagaccgagaagtcggcacatgagcccaagtctcctgccaaggcagggaagtccccaaagaaagcatagttgaatcagcctcaatcagaattttaacttatgtctagatatatgtatgatgtgggtaggatcagtttttgttgatttgtaggtggtggtggtgggatggcctgtgaatggcattgccatacaaaactagtaatggttctttttgtaatggtctgatattttagtgttatt

SEQ ID NO: 14507 - DNA, 662 bp, Arachis hypogaea
tctgatggacagccccgctgtaaaagggaagaaaggagctgccggaaggagaggcggtggtcccaagaagaagtcagtgtcaaggtccgccaaagccggtctccaattccccgtcggaaggatcggacgctacttgaagaaaggccgttatgctcagcgtttgggaagcggcgctccggtttaccttgccgccgttttggaatacctagttgctgaggttttggaattggctgggaatgctgctagggataacaagaagaacaggattattccaaggcatgtcctgttagctgtgaggaacgatgaagagcttggaaaactgcttgctggtgttaccattgctcatggtggtgttcttcctaacattaaccctgtgcttttgcctaagaagagtcaagctgctgctgctaaggaaccgaagtctccatctaagggcacaaagtctcctaagaaagcttaattgattatgatattttggtgttaggttacttttggtttctctttgattttaatgtatatctgttgttaggtacctttagtcttttttaggctggcaggaatatgtgatgcttgtcatggtatcctcatttggaatttatggtgaatggattattcgaaatagctctttttcatgtagcaaagattagaatttgaatgttaaa

SEQ ID NO: 14508 - DNA, 610 bp, Platanus occidentalis
atttttacgagccaagtggtagtcacttttccggcgagtggtagcagcgttttatttttcttccggcgagaaacttgagagatggaggcgaccggaaaggtgaagaagggtgccggaggaaggaagggaggtggaccgaagaagaaacccgtctcgcggtccgtgaaggctggtctgcagttcccggtaggaaggataggccgttacttgaagaaaggccgatactcacagcgtgttggaactggtgctccggtttatatggctgctgttcttgaatatctcgcagctgaggttttggaattggcggggaatgcagctcgggacaacaagaagaacagaatcatcccaaggcacgttcttttggcggtgaggaacgacgaggagctgggaaagcttctctctggtgtgacgattgcccatggaggagtccttcccaacatcaaccctgttctcttgcccaagaagtccgagaaggctgccaaagaacccaaatctccctccaaggccattaaatcccccaagaaagcttgattgcttaaaaaccatattaacccttctttctcttcttgtatgtaattcaggatttcttttcgtttcttttttttttcca

SEQ ID NO: 14509 - DNA, 647 bp, Platanus occidentalis
agtcgtcttaccgttgagatctagtcatttttccgggcttaagcttttttagtttcatcgccggcgagaacgttgagagatggagacgacaggaaaggtgaagaaaggtgccggaggaaggaagggaggtggcccaaagaagaagccggtctcccggtcggtgaaggccggtctgcagtttccggtaggaaggatcggccgttacttaaagaaaggtcgatattcgcagcgtgtcggaacaggtgctccggtttatttggctgccgtccttgaatatctcgcagctgaggttttggagctcgccggaaatgcagctcgggacaacaagaagaacagaatcatcccaaggcacgttcttttggctgtgaggaacgacgaggagctcggaaagcttctatctggcgtgacgattgcgcacgggggtgtccttcccaatatcaaccctgttctcttgcccaagaagtccgacaaggccgccaaggaacccaagtctccctctaaggccgtgaaatctcccaagaaggcttgatttacatcagaagctataacacttctttcttctcttgtatgtaattttgggttttgttctttgggttgctcttgctgtgtaggagaccttcctaggactttacaattgtactctttcc

SEQ ID NO: 14510 - DNA, 795 bp, Triphysaria pusilla
tcgaggctttacggattctctccttcttcacctcccagagttcaccagctaatgcatcgccaactttgggaacaccatcgccatttgcaacctttgtttgtgcatctgcatacaattttcctcctaaccaatcatctttgcaccaaaaccaaaaatggaagctactccaaaggcaaagaagggagctgctggaagaaaggccggtggaccaaagaagaaatccgtcacccgctccgtcaaagccggtctccagtttcctgtcggcaggatcggtcggtttctgaagaagggtcgctatgctcagcgcgtgggttctggtgccccggtttacctggctgcggttctagaataccttgctgctgaggtattggagttggctggaaatgcagcaagagacaacaagaaaagcaggattatcccaaggcacttgttgctggctgtgaggaatgatgaggagcttggtaaacttcttgctggagtgacaattgctcatggtggagtaataccgaacataaacccggttctgttgcccaagaaatccgacaaggtggctgagaaggcacccaaatccccatcgaaggctgctaagtctccgagaaaggcttagactgaaatttttctttctgaatgtggggttgggataaaataacctttattggtttgtagggattgtgttatcttgtggttatgtaggtgatgatgtttataactgcagtaattgtacttttaaccctttctattgctacttttgttgttaaatctcatgatttaaatttaatggaaagattgcttttc

SEQ ID NO: 14511 - DNA, 741 bp, Triphysaria pusilla
tcgtcttttacccctaaatctgtcaagctcaatttcatcttcatcctcttcactaacttctttcattcagagaaaaatggaaaccggtgggaaagtgaaaaagggagccgctggaaggaaggccggtggaccaaagaagaaatccgtcacccgctcagtcaaagccggtctccagtttccggtcggcaggatcggccggtttctgaagaagggtcgctatgcgcagcgcgtgggttctggtgccccggtttacctggctgcggttcttgagtaccttgctgctgaggttctggagttagctggaaatgcagcaagagacaacaagaaaagcaggattatcccgaggcacttgttgctggcagtgaggaacgatgaggagcttggtaaacttcttgctggagtcacaattgctcatggtggtgtgataccgaacataaacccggttctgttgcccaagaaatccgacaaggtggctgagaaggcgcctaaatctccatcaaaggccaccaaatctccgaaaaaggcttaaaaactgtgttttaggtgatagaatgtctttgatttgtagagttgtaatttggattagtgttgttggtgtggttgaagtaggaactagtaatgatatttgtgcttttaatttggtatttgtcaatgagacttcttgtaatttcattcagaaattaaactctttgaattcttatttttgaatggaaatatcattttgaatttcttgtgcaaaaa

SEQ ID NO: 14512 - DNA, 525 bp, Tripterygium wilfordii
ttcttctgccttcaagagagtttgtttttattcgggtctgtatttgagctatggacgccggaggaaaggcaaagaagggagccggagggaggaaaggtggaggtcccaagagcaagccagtttctcggtcggtgaaggccggtcttcagtttccggttggaagaattggtcgttacttgaagaaggggaggtactctcagcgtgtcggttccggagctccggtgtacttggctgcagtcctcgagtacttagctgctgaagtgttggagctggctggaaatgctgcccgtgacaacaagaagaatagaattatcccaaggcatctattactggctgtgaggaatgatgaggagcttgggaagcttctttctggagtcaccattgctcatggaggtgtccttcccaacatcaaccctgttcttttacccaagaagactgacaaggcctccaaagagcccaagtcaccttccaaagctaccaagtcccccaagaaggcctaatttctgacacccattgtagcttgtt

SEQ ID NO: 14513 - DNA, 621 bp, Taraxacum officinale
gcggggatttcacaggcaaatcgctcagtcatatttgaaaaacactatacagagaaatggagaagaagggtgcagccggaagaaagggtggtccaaggaagaaggccgtgagtcgttcagtcaaagccggtctccagttccccgttggtagacttggtcgatatctgaagaacggacgttatgctaaacgtgtcggaaccggtgctccggtataccttgctgccgtcctcgaataccttgccgcagaagttctagagttggcaggaaacgctgccagggacaacaagaagaccagaattatccccaggcatgtgcttttggctgtgaggaacgacgaagagcttggaaaattgttggcgggagtaacatttgctcatggtggtgttctacccaacatcaaccctgttcttttgcccaagaagactgcggctgccaaagagccaaaatctccatccaaagctgctaaatcacccaagaaggctacaaaagcttagtttaagttgctttgtaatcatttgtgtttgctagctcgatgaaaatcctagagtagtttatatattgtcagatgtatccatttttagtgaatgaaacaacttgtttcttaaaaaaaaaaaaaaaaaa

SEQ ID NO: 14514 - DNA, 772 bp, Secale cereale
cccaatccccacctaccgtccgctctcgcacgccatggacgccacaggcaccggcgccaaggggaagaagggcgctgccgggcgcaaggccggcggccccaggaagaagtcggtgacccgctccgtgaaggccgggctccagttccccgtcggccgcatcgggcggtacctcaagaagggacgctacgcccagcgcgtcggcaccggtgcccccgtctacctcgccgccgtcctcgagtacctcgccgccgagctgcttgagctcgccgggaacgccgccaaggacaacaagaagagccgcatcatcccccgccacctgctgctcgccgtcaggaacgacgaggagctcggcaagctgctggccggcgtcaccatcgcgcacggcggcgtgatccccaagatcaacccggtgctgctccccaagaggacggcggagaaggaggacaaggcgcccaagtcccccaagaaggccgccaaatccccgaagaaggtcgccacaccgaagaaggcttaagagagatgcgttatgtctagttgatgatgtaccctgtttagttgtttaggctgtcttgtgttcgtctggatagtggcgtgaaggtgttctgtctagttgatgtaccttgtgttgttcatgttcatggaagaaattcagaaatctctctgagttcccaatatgctgctgtctcttcgtgacatcgcactggagattttgcatcactgaagctcgagctattgtcttcatttgctattaccgctggtgtcgcctagaaaa

SEQ ID NO: 14515 - DNA, 528 bp, Ambrosia trifida
tcaaattcccaatcttaacaccaaataattcgaatggacggagccgggaaagcgaagaaaggcgctggtggccgaaaaggcggaccgagaaagaaggcggttacaaggtctgttaaggctggccttcagtttcctgttgggaggattggaaggtaccttaagaaagggcggtatgcgaaacgagtcggtactggtgccccggtttacctcgctgcggtccttgagtacctcgctgctgaagtgttggaattggcgggaaatgcggctagggacaacaagaagaacagaattattcctaggcatgttttgttggcgataaggaatgatgaagagcttgggaaattgttagcgggtgtgacgattgctcatgggggtgttttaccgaatattaacccgatcttgttgcccaagaagactgcggcgaaagagcccaaatcgccagcgaaggctaccaagtcacctaagaaggctgctgcttagattagtttgttagagttgtattgtttttatgttagtttatattattgt

SEQ ID NO: 14516 - DNA, 611 bp, Chrysanthemum coronarium
gtaaagttaagaagggagcagcaggaaggaaagccggtgggccgcgaaagaagtcagtgactcgatctgttaaagccgggcttcagtttccagttggtagaattggaaggtatttgaagaaaggtcgttatgctctccgtgttggtactggtgctcctgtttatctcgctgccgttcttgaataccttgctgctgaagtgctggagttggctggaaatgcagctagggacaacaagaagaccagaatcatccccagacatgttttgttggcgattaggaatgatgaggaactcggaaagctgttgtctggagttacgattgctcatggtggtgttttaccaaacattaaccctgttctattgcctaagaagactgctgctaaagagtcaaccccaaagtctccatcaaaagctggaaagtctcctaagaaggcttagattagattgagtagtttataattttataagatctgatgtaatcaattcaatggaatgcaaattgattgtttatgtttatttccctggtgtttgatgttgtttaattcagcagtttatgctgtaatcgcaatgtgtagagagaagggtttaaacccattttttattgttccccaa

SEQ ID NO: 14517 - DNA, 690 bp, Chrysanthemum coronarium
gtaaagttaagaagggaggacatcaatctcaaacactcaaaacacacacaaattcttcaatttctcattcataaaaaccaaatggaggaaaccggtaaagttaagaagggagcagcaggaaggaaagccggtgggccgcggaagaagtcagttactcgatctgttaaagctggccttcagtttccagttggtagaattggaaggtatatgaagaaaggtcgttatgctctccgtgttggtactggtgctcctgtttatcttgctgctgttctcgaataccttgcagccgaagtcttggaattggctggaaatgcagccagggacaacaagaagaccagaatcatccccagacatgttttgttggcgattaggaacgatgaggaactcggaaagctgttgtctggagttacgattgcacatggtggtgttttgccaaacattaaccctgttttgttgcctaagaagactgctgctaaagagtcaacaccaaagtctccatctaaagctggaaagtctcctaagaaagcttagattagtttgatgctattggattaatgtaactgtggtgttttcgtttgtttgatttgctaggaaagttagcctagtttgaatgattggatgtaatcatccaaattgaatgaaagctacttgtttctgtttattttgccacgtttgatattttattgctga

SEQ ID NO: 14518 - DNA, 667 bp, Cyamopsis tetragonoloba
caagtttgccgctaagttctagggttcccaattcgccatggataccggagcgaaggtgaagaaaggtgccagtggcagaaaaggtggcggcccaaagaagaaaccagtcacaagatccgccagagctggacttcaatttcccgtcgggagaattgggcgttacttgaagaaaggaagatactctcagcgtgtcggtactggtgctccggtttacttagctgctgttcttgagtatcttgctgctgaggtgcttgagttggctggaaatgcagcccgtgacaacaagaagaacaggattattccgaggcatgttcttttggctgtgagaaacgatgaggagcttgggaaattgcttgctggagttacaattgctcatggtggtgttcttcccaacattaatcctgtgcttctgcccaagaagaccaatcaggcaaccaaggaaccgaaatctccatccaaggcaaccaagtcccccaagaaggcttgatatagtgatttcgatcttagaataattccctttatttagtttgtataaatgcaattaggtcgttctctgtaacaaattgatgcttttgaaaaggtgtatttctgataagatgtacccttttggatctcagccgggatctttatcattaatgaaattcggccctattttacctgataaaaa

SEQ ID NO: 14519 - DNA, 639 bp, Echinacea purpurea
ggtggtgcaaaggccaaaaaaggtgccggcggcaggaagggcggcggccctaagaagaaaccggtttcccggtccgtcaaagccggtcttcagttccctgtcggtaggctcggtcggtatcttaagaaaggccgctatgcacagcgtgtgggaaccggcgctccggtctaccttgctgccgttcttgagtatcttgctgccgaggttttggagctggctggaaatgcagcaagagataacaaaaagaacagaatcattccaagacatgttcttttggctgtgaggaacgatgaagagctcggaaagcttctagctggtgtgacgattgctcatggtggtgttcttccaaacattaacccggtccttttgcctaagaagtcagccacaaaggagcctacgaaatctccatcgaaagcgacgaaatcaccaaagaaagcagcttagttttagtggttgaatagcgatttctgggttctgccttttttgtgtaattaggaacacaatttgacaccggtgttaggggacttttggtctattttagtctgatgtattgtgtcgtgtttctggttctatgtttggtataaacatctcgtttgtttgaaatgaaatggtaattttctcattgtttttcgtggatca

SEQ ID NO: 14520 - DNA, 762 bp, Arachis hypogaea
gcagagtacgggggatcttcatcatcatcactctcttctcacccaaaaaactcatcctttccgtaaactttcttcatggacagccccgccggaaaaaccaaaaaaggagccgccggcaggagaggcggtggtcccaagaggaagccagtctcaaggtccgtcaaagccggtctccaattccccgtcggaagaatcggacgctacctgaagaaaggccgttactctcagcgcgtcggaaccggtgctccggtttacctcgccgccgttttggaatacctagccgccgaggtgttggagttggctgggaatgctgctagagacaacaagaagaataggattattccaaggcatgtgttgttagctgtgaggaacgatgaggagcttggaaaattgcttgctggtgttaccattgctcatggtggtgtccttcctaacataaaccctgttctgttgccaaagaaatctcaaactgctaccaaggaaccaaagtctccatctaagggcactaagtctcctaagaaggcttgatcttatagttgatgatgctaagttgttgttattagtttgttttggaacttttatttttcatgtatatgtatgttgttagattcttctcttagaacagtcccttggaaaagaatgtaatgcttttatggtttaaagttatctcaatgatgtagggttctaaagcgaattgaaagcagctcgtttcaaatcaaaaaaaaagaaaaaaaaacaaaagtactctgcgttgataccact

SEQ ID NO: 14521 - DNA, 720 bp, Phalaenopsis aphrodite
agttccgatcaacttcctcatggattccggtggtaaggtcaaaaagggtgctggtggccgcaaaggcggaggcccaaagaagaaagctgtttctcgctctgtgcgtgctggactccagttccccgtcggtcgtatcggccgatacctaaagaatggccgatatgctcgccgtgttggtaccggtgcccccgtttacctcgctgctgtgctcgaatacctcgccgctgaggttttggaactcgcgggaaacgcggcgcgtgacaacaagaagaatcgtattattcctagacatgtgcttctcgccattcggaatgatgatgagcttgggaaacttttgggaaaggtgacgattgcacatggcggtgttcttccgaatattaatccggtgttgcttccgaagaaggcgctggaaaaggagccaaaggagacagtgaagaaggcgaagaagtctcctaaaaaggcggcgtaagttatcgaatggtgttgttgttcattgctgttttacatgtaatttttatctttcgtgttttgttgttgccttagaggtggcaggaatagagtagggtttttcaatggttagttctgtattgaaagtgaaatctttcctgcttgccaaatgtttatgtattttttatcaagatgacatttttcggttattttggaagtaattggacaatttggattgctaaattggggaaatatatgcttagtgcatatcca

SEQ ID NO: 14522 - DNA, 636 bp, Helianthus annuus
caaacaatccgatcaaatggaggccacaggaaaagctaaaaagggtgccgcaggtcgcaaagcaggcggcccaaggaagaaggccgtcacccggtctatcagagccggtcttcagttcccggtcggtagaattggccgttatttgaagaacggtcgttatgccaaacgtgttggaaccggtgctccggtttatctcgctgctgtgctcgaataccttgctgctgaagtgttggaattggcgggaaacgcagcaagggacaacaagaagaacagaataaacccaagacatgttctgttggcaattaggaatgatgatgagcttggaaagcttttggctggtgtgacgattgctcatggtggtgttctaccaaacattaacccagttttgttaccaaagaagactgctgcgaaagagccgaaatcacctgctaaagctaccaaatctcccaagaaagctgctgcttagacgttagatctgttgttgttcttatgtgatgtgattgtagttaaattgagaatgaatctagctttatgttaattgttatattgtttgttaatgtatggaagaaacctctggtttttgttttattttgtttagttggctttgttgcattcttaataataataacaacaaac

SEQ ID NO: 14523 - DNA, 626 bp, Helianthus annuus
gcggggacaacaaccatttattattattcaccgatatacaatcaatcaaacaatccgatcaaatggaggccaccggaaaagctaaaaagggtgccgcaggtcgcaaagcaggcggcccaaggaagaaggccgtcacccggtctatcagagccggtctgcagttcccggtcggtagaattggccgttatttgaagaacggtcgttatgccaaacgtgttggaaccggtgctccggtttatctcgctgctgtgcttgaataccttgctgctgaagtgttggaattggcgggaaatgcagcaagggacaacaagaagaacagaataaacccaaggcatgttctgttggcaattaggaatgatgatgagcttggaaagcttttggctggtgtgacgattgctcatggtggtgttctaccaaacattaacccagttttgttacctaagaagactgctgcgaaagagccgaaatcgcctgctaaagctaccaaatctcccaagaaagctgctgcttagatgttagatctgttgttgttcttatgtgatgtgattgtagttaaattgagaatgaatctagctttatgttaattgttatattgtttgttaatgtatggaagaaacctctggttt

SEQ ID NO: 14524 - DNA, 830 bp, Brachypodium distachyon
atcacccccacatctccaaatccccaatctagcatctctcaccaaatcaatcttccccgccgcaaagagcgtttgttggaagccatggaagtctcaagcaccccagccgggaagggtaagaagggagcggccgggaggaaggtcggcggccccaggaagaaggccgtgacgcgatccgtcaaggccgggctccagttccccgtcggccgcgtcgggcgactcctcaagaagggccggtacgcccagcgcgtcggctcaggcgcccccgtctacctcgccgccgtcctcgagtacctcgccgctgaggtgctggagcttgccgggaacgccgcgagggacaacaagaagagccgcatcatcccccgccacgtgttgctcgccatcaggaacgacgaggagctcggaaagctgctcgccggcgtcaccattgcccacggtggcgtgctgcccaacattcacaccgtgcttctccctaagaagaccgcggagaaagcccccaaggaggctaaggagcccaagtccccgaagaaagccgccacccctaagaaggcagccaagtcccctaagaaggcttagatagattccatggcttggcttaagctctagttgttcatagtgagatgttggtgttcctctagctatgtgggggtaaagcccgtgatatgtgtaactgtgttaatgaagaacatcagacatcgttctgatctgcctagttaccgtgttctcgctgttctcttcatatgacggtgctctggaaattaacatcatcccctgcaaccctttattattttgacagttcccctgtttgtttgcagggaggaataatcgag

SEQ ID NO: 14525 - DNA, 657 bp, Cynara scolymus
cgcggggacatcacttgtcacaaacgaagcgaaagagagaaatggaaactaccggaaaagcgaagaagggtgccggaggccggaaaggaggcggtccaaggaagaaggcggtgactcgttccatcagagctggtctgcagttccccgtcggtaggattggccgttaccttaagaacggacgctatgctaaacgtgtcggaactggtgctccggtttacctcgccgccgttcttgaataccttgctgctgaagttttggaattggcaggaaatgcagcaagagataacaagaagaacagaataatcccaagacatgttttattggcgattaggaatgacgatgagcttggaaaactgttggctggagttaccattgcacatggaggtgttcttcccaacataaacccagttctgttaccaaagaagacagctgcaaaagagcctaaatctccatcaaaagctaccaaatcgccaaagaaagctgattagcttactttaataatgaatgatgttgttcatctgtgtctgtaattgtagttaaattgaaaatggaatttagtttttctaaccattgggtctgttttagatggtcatgatatatttcttggcttggtgtgacatcagtttcaatgcgagaaacctcttgtttctatctcag

SEQ ID NO: 14526 - DNA, 724 bp, Helianthus annuus
gaccgccatcaaatcaaaacccaaaacaaaacaaactcacaaccaaaccaaatccttttagagatggagtcaaccggaaaggtgaagaagggagccgcaggaaggaaagccggcggtccaaggaagaaggcggtcacccgttcagtcaaagccggtcttcagttcccagtcggtagaatcggccggtttttgaagaaaggacgttatgctcaacgtgttggatccggtgcaccggtttaccttgctgctgtccttgagtatctagcagcagaagtgttggagttggctggaaatgcggcaagggacaacaagaagaacagaataatcccgagacatgtgttgttggccattaggaatgatgaggagcttggaaagcttttggctggagttaccatcgctcacggtggtgttttgccgaatattaacccgattcttttgcccaagaagactgccgctaaagagcctaagtctccatcgaaggctgctaaatcccccaagaaagcaaagtagtttaatgtagactttgttgtaattgtttgtttgtttgtttgttttgtggtggttttagaatagtttgtgtttacatgtattgtattcaacctagagaatgaaatcgcttgtttctgttttgggtagattattgtgttaatctcttttatgtttagtgagtttgattataatttttgtgatgatagacatgaatataatcagattttgaccaaaa

SEQ ID NO: 14527 - DNA, 668 bp, Helianthus annuus
aaatacacagatggaaaggaggctaaaaaggggaccatcattcaaaaataacttacaaactccagcagtttctcctttccatctgtgtattttcatcttccagagtttcaatggaggctaaaaagggtgccggtggtagaaaggctggtggtcctaagaagaaaccggtttcccggtctgtgaaagccggtctccagttccctgttggcaggctcggtcgttacctcaaaaaaggccgctatgcacagcgtgtaggcaccggtgctccggtctaccttgccgccgttctcgagtaccttgctgctgaagttttggagttggcgggaaatgcagcaagggacaacaagaagaacaggattattccgagacatgttttgttggcggtgaggaatgatgaagagcttggaaagcttctagcgggtgtgacgattgctcatggtggtgttcttcccaatattaacccggttcttttgccaaagaaggctgctgcaaaggaggctacaaaatctccagcaaaagtgactaaatcaccaaagaaagcctagtgtttgcgtgttttaggattttgtgtaattaggaaacacaatttgatcgatgattttaggggaatttttattgttggctataggtttgttaagaacatcttgtttgaaatgaaatgacagcca

SEQ ID NO: 14528 - DNA, 694 bp, Cichorium intybus
gtacgcggggatcgacacaccgaacaactcgcccatttcttactgtttattcgtcgctacaaggaaaatggaaggagcaggaaaaacaaagaagggtgccggaggaagaaagggaggcggtccaaggaagaaggcggttgcccgctccgtcaaggccggacttcagtttccagttggtaggattggtcgttacttgaagaaaggacgttatgctcagcgtgttggaagcggtgccccggtttacctcgccgctgtccttgaataccttgctgctgaagtgctagagctggccggaaatgctgctcgggacaacaagaagaccagaataattccaaggcatctactgttggccattaggaacgatgaagagcttggaaaattgctgggtggagttacgattgcacatggtggtgttcttcctaatataaaccctgttctattgcccaagaagacagctgccaaggaaccttctactccatctaaagctgccaaatctcctaagaaagctaagtaggctgaatagattacttggttagaattgtagcttttgtattaagatcgtatgataagttggaaagttgatgttaatcaagatttatcgaatgaaaccacttgtttcttataactgttgcaacataatcctcttacaatatgcattatatttctaatcatgttgatcgagattttttggttg

SEQ ID NO: 14529 - DNA, 895 bp, Cucurbita pepo
acggtcaaacgtgcacccatttctgagttcgtctccatcctcaaatgctcgttgtttcataccgctctataaaacattacctcaatttcagagcttctcatcgtcatatccactgatccaaatctgttttcctgtaatctctgcaactgcctttgattttccggcgaccagggtcaagttccgatggattctagcgccaagttaaagaagggagcaggtggaagaaagggcggcggtccgaagaagaagccagtttcccgctccgttaaggctggtctccagttccccgtcggtagaattggtcggtacttgaagaatggccggtatgctcgacgtgtcggtaccggagctccggtctacttggccgccgttcttgaatatctcgccgccgaggtgttggaattggctggaaatgcagcccgagacaacaagaagaacagaataattcctaggcatgtattgttggccataagaaacgatgaagagcttgggaaattgctagccggcgtaacgattgcacatggtggtgttcttccaaacataaacccagttctgttgcctaagaagagtgaaaaagcagccactaaagaacctaaatctccatcaaaggcctctaaggctacaaaatccccaaaaaaggcttaggttcttttgttcaatctgaaaaactgacttgttctttgcccatttgtatgtactttgttgcctttttagagtcgtcttctgtgttgtttattaatgtaagctcaaacctgatcaatttgaacactctgtatcactcccatcatcatcttaatgatcaatccttgtactggttatatgattgtttagccttttcttcattttgataatctttgattggcttctatggatatgagatagctcggaatcacgg

SEQ ID NO: 14530 - DNA, 648 bp, Capsicum annuum
caaacaatcagtcattcaatattttctctctctaagaatctttctcgctggaaaatggagtcaaccggtaaagcgaagaagggtgccgccggaagaagccgtggtggcccaaagaagaagcctgtttcccgttctattaaggcaggtctgcagtttcccgtcggtagaattggtcgcttcttgaagaaaggccgatacgctcatcgtgttggttctggtgctcccgtttacttggctgccgttcttgaatacttggctgctgaagtgttggagttggctggaaatgctgctcgtgacaacaagaagacgagaatcatcccaaggcatttgcttttagcagtgaggaatgatgaagagttgggcaaacttcttgctggtgtgacaattgcgcatggtggtgttcttccgaacattaatccagttttgttgccaaagaagactggagctgaaaaggcaccaaaatctccttccaaagctaccaagtcacccaagaaggcttagatttagtggttgttctggtttatgtatgtaattgtgctgttagaatgtgttgattttgtgtccttcaggtgatatttacgaaggctttagttggaactgcactgtttagatctttttatcaatcaatgaaaccacttgtttcaagtt

SEQ ID NO: 14531 - DNA, 703 bp, Brachypodium distachyon
aacacacagcaattctctctgccattcctgccttccaagaattttcctgcgcaagctctagcaatggacgtctcaggcaccggagccgggaaagcgaagaagggcgcggcggggcgcaaggccggcgggccgaggaagaaatcagtcactcggtccgtcagggccgggctccagttccccgtgggccgcatcgggcggtacctgaagaagggccgctacgcgcagcgcgtcggcaccggcgcccccgtctacatggccgccgtcctcgagtacctggccgccgaggttctcgagctcgcgggcaacgccgccagggacaacaagaagtcccgcatcatcccgcggcacgtgctgctcgccgtcaggaacgacgatgagctcgggaagctgctggccggagtcaccatcgcgcacggcggggtgttgcccaagatcaacccgattctcctccccaagaagaccgcggagaaggcacccaaggaacccaagtcgccgaagaaggctgctactcccaagaaggccgacgctaaatccccaaagaaggcgtagatgcaggttcgattggttaacttctagatggatatattatggatggatgagccccagagtagttgtggggctgttcgtcttgtggtgtggttgtaccttgtgtttgtagtctctaattgaacaagaatgccaaatattgctacattccaattca

SEQ ID NO: 14532 - DNA, 707 bp, Daucus carota
acattatctgtatctatattattctctctagattccggcaatggaaggaggtggaaaactgaaaaaaggtgccgccggcagaaaaggcgacggtccaaggaagaagtccgtcactcgctccgtcaaggccggtcttcaatttccggtcggtcgaatcggtcgctaccttaagaaaggccgttatgctaagcgcgtcggtaccggagctccggtctatctcgccgccgttctcgagtacctcgccgcagaggttttggagttggccggaaatgcagcaagagataacaagaagtcgaggataataccgagacatttgctgcttgcaatcaggaatgatgaggagctagggaagcttctagctggtgttaccatagctcatggtggtgtgcttcccaacattaatccggtcctgttacctaagaagtccgaaaaggcagcagctgcaaaagagcctaccaagtctccgtccaaagctgctaaatcgccaaagaaagcttaactgattcacctgttagtagaagaacaaagcatagattgcttcctttatgatcagtcttttgtatgtaattttctgttatggggttcttttacttggttagggttattgtaatttctctagttctgtgaagttgttgacatctttacttttggatgaaatgatatctgaaccattctaatcatcaggcattgcccaagcaaaatgttta

SEQ ID NO: 14533 - DNA, 745 bp, Daucus carota
cagcatctttctccttctcaacaaatatacctatacatacattatctgtatctatattattctctctagattccggcaatggaaggaggtggaaaattgaagaaaggtgccgccggcagaaaaggcgacggtccaaggaagaagtccgtcactcgctccgtcaaggccggtcttcaatttccggtcggccgaattggtcgctaccttaagaagggccgttatgctaagcgcgtcggtaccggagctccggtctatctcgccgccgttctcgagtacctcgccgcagaggttttggagttggccggaaatgcagcaagagataacaagaagtcgaggataataccgagacatttgctgcttgcaatcaggaatgatgaggagctagggaagcttctagctggtgttaccatagctcatggtggtgtgcttcccaacattaatccggtcctgttacctaagaagtccgaaaaggcagcagctgcaaaagagcctaccaagtctccgtccaaagctgctaaatcgccaaagaaagcttaactgattcacctgttagtagaagaacaaagcatagattgcttcctttatgatcagtcttttgtatgtaattttctgttattgggttcttttacttagttagggttattataatttctctagttctctgaagttgtcaacatctttacttttggatgaaatgatatctgaaccattctaatcatcaggcattgcccaagcaaaatgttta

SEQ ID NO: 14534 - DNA, 708 bp, Daucus carota
acgcttcattaacagcatctttctcctcctcaacaaatacacctatacatacctgtatctatattattctctctagattccggcaatggaaggaggtggaaaattgaagaaaggtgccgccggcagaaaaggcgacggtccaaggaagaagtccgtcactcgctccgtcaaggccggtcttcaatttccggtcggccgaattggtcgctaccttaagaagggccgttatgctaagcgcgtcggtaccggagctccggtctatctcgccgccgttctcgagtacctcgccgcagaggttttggagttggccggaaatgcagcaagagataacaagaagtcgaggataataccgagacatttgctgcttgcaatcaggaatgatgaggagctagggaagcttctagctggtgttaccattgctcatggtggtgtgcttcccaacattaatccggtcctgttacctaagaagtccgaaaaggcagcagctgcaaaagagcctaccaagtctccgtccaaagctgctaaatcgccaaagaaagcttaactgattcacctgttagtagaagagcaaagcatagattgcttctttatgatcagtcttttgtatgtaattttctgttatggggttcttttacttggttagggttattgtaatttctctagttctgtgaagttgttgacatctttacttttggatgaaatgatatc

SEQ ID NO: 14535 - DNA, 734 bp, Euphorbia peplus
ctcatcctaatttcctaatcattttctgtttgtttcccgagaaaatttcactcttcctagtttctcacaaccttaaatatggatgccggaactaaggtgaagaaaggagctgcaggaagaaagggaggaggtcctaagaagaagccagtctcaaggtccgtcaaagccggacttcagtttccggtaggtcggatcggaagattcttgaagaaaggaaggtatgctcagcgtgtcggaagtggtgctccggtctatatggccgccgtgctcgagtatcttgccgctgaggtattggagctagctggaaatgcagcaagagataacaagaagaatagaatcataccgaggcatgtgctattggctgtgaggaacgatgaagaacttggaaagttgttagccggagtgaccatagctcacggtggagttctaccaaacattaacccagttttgttgccaaagaaatccgagaaggcagcagccacaaccaaggagcccaaatcacccgccaaagctactaaatcgcctaagaagacttagatccgtcatttctaggtgtcttgatatcagtccatcgctgtatctaaatttgtttctttttttcaaatgtaatttggattgtaggacaaactgatgtgcctttgggcattgtagaattgttgtgctctctcttaacttgatgtagaacaactccttctctgtttcttattaagtaaattaattgttctgtttagctg

SEQ ID NO: 14536 - DNA, 940 bp, Lippia dulcis
tctcgtctgcagcagagaacaatggatgccagcggaaaaccgaagaagggagctgggggaaggaagggcggcggcccgaagaagaagccggtttctcggtccgtgaaggccggcctgcagtttccggtggggagaatcggacggtacttgaagaaggggcgctatgcgcagcgtgtgggaactggtgcgccggtgtacatggctgcagtgctcgagtacctggctgctgaggttcttgaattggctgggaatgcagcaagagacaacaagaaaaacagaattatcccgagacacgttttgcttgctgtgaggaatgatgaggagcttggaaagcttcttgcaggagttacaatcgcacatggaggagtcttgcctaatatcaaccccgttcttctccctaagaaatctgaaaagtctgcagcggcagagaaaaagcctgctaaatccccaacgaaggcaactaaatctcctaagaaggcttgataatgttgaatttgggattgttcttttctagttgcttgaggtctgtgtatgtaatttgaattgatgttggtatgtagggaaaagtctgttgataatgggatttgtgattggtcccttgtactcttatccctttttagccgttcttgttcgatttgaatttgaatggaaacatcaatattgcttaggcttttgcagcaagattttgcattcggaatgaattttgagatgggtcttggcaaggcacactgaaatgtgcattttcgtctaaatttgaagtcaagatttttcgggatggagctttcaagattgtaagtacactgttcttttattagagtttggctagtggaattatggtactttagcgaagaaatggaatcagggagtgcaatagaaggctatttccgtgtcctttacaatgcagctattattaattttataaccaagatgcatatatgag

SEQ ID NO: 14537 - DNA, 715 bp, Secale cereale
tcagtcctattctacctaaatcttatctctctgcccctttccagcttttcttcagaagcgccgtcgtccgcaatggaggcctcaggcgctgctgcgaaggggaagaagggcgcagccgggcgcaaggccggcggccccaggaagaagtcggtgacgcggtccgtcaaggccgggctccagttccccgtcggccgtatcgggcggtacctcaagaagggccgctacgcccagcgcgtgggcaccggcgcccccgtctacctcgccgccgtcctcgagtacctcgccgccgagctgctggagctcgccgggaacgccgccaaggacaacaagaagagccgcatcatcccgcgccacctgctgctcgccgtccggaacgacgaggagctcggaaagctgctggccggcgtcactatcgcgcacggcggtgtgattcccaaaataaacccggtgctgctccccaaaaagacggcggagaagtcgcccaaggagcccaagtcgccgaagaaggccgccaagtcccccaagaaggccgccaaggcttagaaacccgcataggttgctgtaggctgtttagtgcgttgtaatagcgctcgttgtttggctaatggtgtcgatgtaatctttgctgctaagagaaatgtcagaaatctctctgaatttgaccaaaaaaaacagagaactgccgaacgcacaacagggagtaaggggggggggg

SEQ ID NO: 14538 - DNA, 817 bp, Secale cereale
acccgctcctcgacatctccaggacctgcacggcagcgacttcagacgagtggtcgaggagtgcctgcgggtgtccgccgagtatcagcgcgacggcggcgaccgggcggcgaagctgggcgagctgggggcgctgtcacgagcctggacgtgggcgacgccatcatggtgtccagctccctgtcgtgccccctttccagcttttcttcagaagcgccgtcgtcagcaatggaggcctcaggcgctgctgcgaaggggaagaagggcgcggccgggcgcaaggctggcggccccaggaagaagtcggtgacgcggtccgtcaaggccgggctccagttccccgtcggccgcatcgggcggtacctcaagaaaggccgctacgcccagcgcgtgggcactggcgcccccgtctacctcgccgccgtcctcgagtacctcgccgccgagctgctggagctcgccgggaatgccgccaaggacaacaagaagagccgcatcatcccgcggcacctgctgctcgccgtccggaacgacgaggagctcggaaagctgctggccggcgtgactatcgcgcacggcggcgtgatccccaagatcaacccggtgctgctccccaagaagacggcagagaagtcgcccaaggagcccaagtcgccgaagaaggccgccaagtcccccaagaaggccgccaaggcttagaaacccgcataggttgctgtaggctgtttagtgcgttgtaatagcgctcgttgtttggctaatggtgtcgatgtaatctttgctgctaagagaaatgtcagaaatcaaaaaaaaaaaa

SEQ ID NO: 14539 - DNA, 688 bp, Vinca minor
ttcgtcttttgtaactatatttttcacttcctttttgctataattaaagttgactgaaattgttatggagactggaggaaaagtgaagaagggtgccgccggaaggaaagctggtggcccaaagaagaagtcagttactcggtctactagggctgggttgcaatttccggtcggtaggattggccggtacttgaaaaaaggtcgctattctcagcgagttggtaccggtgctccggtttacatggctgctgtccttgaatacttagctgcagaggttcttgagttggctggaaatgctgcaagggacaacaagaaaaacagaataatcccaaggcatgtgcttttggccattagaaatgatgaagagctaggaaaattactggccggtgtgacaattgcacatggaggagttttaccaaacatcaacccaatcttgttgccaaagaaaactgataaggctggtgccaccaaggaacccaagtcttctgctaaggctgctaagtccccaaagaaggctgctgcttagatttatctaattttatttgtcttttctttttgccttttgtgtgggaattttagatggtggttgtgtatgtattctgtgggttagaacttctttagccttaatgttatgtgaccttaggagttaaggttattgtaattcttaatttggttttttaggattagc

SEQ ID NO: 14540 - DNA, 1098 bp, Lactuca sativa
gtcgcaactctctttagcgggagaattgaaatattattggaatttcaaattgtgctcatctcacgcggatcgtgattcaacaaataagaaccgttgattaagacttcatccaacggttgaaacaattcaatcgatccatagcccccgccacccacctctacataatcaaaccatgtcgatgtttgctcatcaccgaaatccaaagcctcaatcgttcgttgactctttcgtcgacgttaatcagaattcaaaagatggagggagctggaaaagctaagaaaggtgccggaggaaggaagggcggtggcccaaggaagaaggcggttacccgctctgtcaaggccggactgcagtttcccgtcggtagaattgggcgttttctgaagaaaggacgttatgcgcagcgtgttggaagcggagctccagtttacctcgccgctgtgcttgaataccttgctgctgaagtgttagagttagctggaaatgcggccagggacaacaagaaaaccagaatcatcccaagacatcttctgttagccattagaaacgatgaagagcttggaaaattactgggtggagttacgattgctcatggtggtgttcttccaaacatcaatcctattttgttgccgaagaagactgctgctaaggagccatcaactccttctaaagctgctaaatctccaaagaaagctaagaaggctgaataggttaagctgtttagaatttatccttttgtgaaaaatatagggatggggagatttgtattcgatgatgtattttaccagaatgcataatgttaaacgcttgcttcttacgatctactgtttaggctttatgacttctatcttagaatgaatctttcaataattcatggagattttgatttctcatttaattgtttttaagtttataatatcctttcctgcaatatgtctagcaaaatgaaccaacaaagagtttcaccttagaaatgtatctatgcaaacagttaaaaccccctcttgccatctccctcagtaatgaatcaaatttgcaggtttactgaatcaggcttgtttttaatttaagaaccctaaatcctttgctttcaatcgg

SEQ ID NO: 14541 - DNA, 805 bp, Setaria italica
accaccccaaaagtcgaatcccatctccctcgcttcctcccaaacccaaaaccgaattccctccaaatccaccccacccccaaacccctcggagatggacggcggggccgcgaaggtgaagaaggcggcggtcggccgcaagctcggcggcccgaagaagaagccggtctcgcgctccgtcaaggccgggcttcagttccccgtcggccgcatcgggcgctacctcaagaagggccggtatgcgcagcgcgtgggcagtggcgcccccgtctacctcgccgccgtcctcgagtatctcgccgccgaggttctcgagctcgccggcaacgcggcgcgcgacaacaagaagaaccgcatcatcccgcggcacgttctcctcgccatccgcaacgacgaggagctcggaaggctgctggcgggcgtgaccatcgcgcacggaggcgtcctccccaacatcaacccggtgctcctccccaagaaggccgccgagagggctgagaaggccgagaaggcggccaagtcgcccaagaaggccgccaccaagtcccccaagaagtaggctgcgcgtgccagcgcgctccgatctcgtctgatctgagacaattgtttccctgtgtctgttgcttttgtgtgtatgtaatggtgcatctcaatctatgtatcgtgtccatcgatctgcggatcgaaagtttagggctagttctagctgtagtggttggtgcagggatttctatgttatccatatttaacgagaagaagaggaaggaatttgcaatcctttatgatttctggatctggatttctg

SEQ ID NO: 14542 - DNA, 1353 bp, Rosmarinus officinalis
ggccgggggaggtaggaagagagcctttcctcatttgccgacaactatgtcttccggagaactacttctaaagctcttcgatttcttctggttcgagcatggcttttttagcggatcatcaccgtcgtcaaccaccggagtaagtaaaggccttgatgtggatgaagaggttgaagaaccaccaccaccgaagctttgtcgaactccaactgtgatggttagatctttcagtgaccaggctttgagctcgaaagatgaatcgagttctgattcttcctctccgatgtcggttctctcggtgcctaagcttcagacgattctttccggtaaagaagtggcagaatttgcagaagtaatagcaagtaaagtcggtcccgattttgctgcggaagatagggagagccataggaggaggaggcggagtacccccccccccccccccccccccccccccccccctcagttttccgatgatgataaagcttcgagcttggtctctatcattcctggactgcaaagattaggaagaaaagatcaccaaagtggggatgaagaagataagaattttcatgaatctacagtttcaaggccttatctttctgaagcttgggatttttcggagaagaagaaaactgaaaacccattgacgaattggagaattccagctttcggcaacgaaatggagctgaaagatcatctcaagttctgggctcatactgttgcatcgactgtaagatgatgatgaacaaacactttggataatcttcattttgcaattttgttaattatcttgaattaattttctctatctgcatcccaaaattcatcgttgtatcaattgtttattgctcttttaatttgattaatctcaagtgtagcggaatcgatggagactgcaggaaaagtgaagaagggtgccgccggaaggaagggcggtggccctaagaagaagcccgtcactcggtcaactagggctggcttgcaatttccggtcggcagaattggccggtacttgaagaagggtcgctattctcagagagttggtactggtgctccggtttatatggctgcggtccttgaatatttagctgctgaggttcttgagttggctggaaatgctgctagggataacaagaagaacagaataatcccgaggcatgtgcttttggccataagaaatgatgaagaacttgggaaattgttggctggtgtgacaatcgcacatggtggagtgctacctaacataaaccccgtcttgttgccaaagaagactggtgaaaaggtcgccacaaaagaacccaaatctccatcaaaggctacaaaatcccccaaaaaggctgcttagatttgtct

SEQ ID NO: 14543 - DNA, 671 bp, Amsonia hubrichtii
cttttcttcactagtcgctagtagactagtactgtagcatttatcggccaccgggacggagttgtgaaaatggagagtggtggtggaaaattgaagaagggtgctgccggcagaaaagggggcggtccaaagaagaagcccgtctcccgctcctccagagccgggctgcagtttccggtcgggaggatcggtcgtttcttgaagaagggtcgctactctgagcgtctcggaaccggcgctcctgtctacatggctgccgtcctcgagtaccttgctgctgaggttttggaattggctggaaatgcagcaagagacaacaagaagaacaggatcataccgcgacatgtgctgttagccgtgaggaatgatgaggaacttgggaaacttcttgctggcgttaccattgctcatggaggtgtgcttcccaacattaatccagttcttctgccaaagaagaacgagaaggctgcaaaggagaccaccaagtcccctaagaaggcttagtttctcatctgttaagaaaggacttgtgctctaatctctctgtatgtaatttccagtataagttgtcagcatgtagaagggattgtcaaaatttaggatcattgtggtgttgcttctgttgctcgttttagaatatcctttggctacaattagtggaatgaattttt

SEQ ID NO: 14544 - DNA, 754 bp, Catharanthus roseus
atccaaagaattcggcacgaggccaaaattcatcgttgtatcaattgtttattgctcttttaatttgattaatctcaagtgtagcggaatcgatggagactgcaggaaaagtgaagaagggtgccgccggaaggaagggcggtggccctaagaagaagcccgtcactcggtcaactagggctggcttgcaatttccggtcggcagaattggccggtacttgaagaagggtcgctattctcagagagttggtactggtgctccggtttatatggctgcggtccttgaatatttagctgctgaggttcttgagttggctggaaatgctgctagggataacaagaagaacagaataatcccgaggcatgtgcttttggccataagaaatgatgaagaacttgggaaattgttggctggtgtgacaatcgcacatggtggagtgctacctaacataaaccccgtcttgttgccaaagaagactggtgaaaaggtcgccacaaaagaacccaaatctccatcaaaggctacaaaatcccccaaaaaggctgcttagatttgtctaattggattaggcttcttcctttatctagcgtagctcctatgtgtatgtaatgtgggttagagtatttttagccttttgatatggataggagaaaatggtattgtaattgtaaacttgtgatttaggattttcaatttgaatggatcaacttggttgttttgctatcaaatttcagtgcttaatcaaatggcttt

SEQ ID NO: 14545 - DNA, 485 bp, Cirsium arvense
ctaccttcaaacaaatcctttcgccatttctgcaatcagcctttcagaaactaagagagagagatggatgccaccggaaaagtgaagaaaggagctgccggaaggaaggccggaggtccgaggaagaagtcggttactcgttcggtcaaagccggtcttcagtttccggtcggtaggattggacgttacttgaagaaaggacgttacgctcagagagtcggaaccggagctccggtgtacctcgccgccgttctcgagtaccttgccgcagaagtgttggaattggctggaaatgcagcaagagacaacaagaagaacagaatcatcccaaggcatgtgttgttagccatcaggaatgatgaggagcttggaaaattgttggctggagtcacaattgctcatggaggtgttcttccaaacatcaaccctattctgttgcccaagaagactgctaccaaggagcctaaatctccatccaaagctgc

SEQ ID NO: 14546 - DNA, 651 bp, Cocos nucifera
agagagagagatggagaccggggggaagattaagaagggcgcaggcggccggaggggcggcggcccgaagaagaagccggtatcccggtccgtcaaggcgggcctccagttcccggtcggccggatcggtcgttacctcaagaagggccgctactcccagcgcgtcggcaccggcgctcccgtctacctcgccgccgtcctcgagtacctcgccgctgaggttctggagttggccgggaacgcggcgcgggacaacaagaagaaccggatcatccccaggcacgtgcttctggcggtgaggaacgacgaggagctgggcaagctgctcgccggtgtgaccatcgcccatggaggggttctgcccaacattaacccggtgcttctcccgaagaagacggcgagcaaggagcccaagtcgccctccaaggccaccaagtcccccaagaaagcttaagcgctgacgacccttgtgttgttattccaactttcgtacttccgtatgtaattccgtgatccttcttaggcggttttcttctttcgtttgtatcggtgaaggtgtaaggaggagggtacgaaagtggaaaaaaggatttgtattaatcgtctttcctttcaggaaatgttaagaacggtgtttttactttggaagaa

SEQ ID NO: 14547 - DNA, 621 bp, Flaveria ramosissima
tttactctcacaacattcattcacacacaaacaaacaaccacaaacctccaatggaagccaccggaaaagcgaaaaagggcgccggaggccgcaaagccggcggtccacgtaagaaagccgtcacacgctccgtcaaagccggtctccagttccccgtaggtagaatcggtcgttaccttaaacacggtcgttacgcaaaacgtgtcggcaccggagctccggtgtacctcgccgccgtgctcgaataccttgcagcagaagttttggaattggcgggaaatgctgcgagagataataagaagaataggataattcctaggcatgtgttgttggcgataaggaatgatgatgagcttgggaagttgttgtctggagtgacgattgctcatggtggtgttttgcctaatatcaaccctgtgttgttgccgaagaagactgctgcaaaagagcctaaatcgccttcgaaagctacgaaatcgccgaagaaggcttagattacgttgatatgattgttgttttgtgttatcgttgtaggtagattgaaagttgagtttagttttctggtggtgttgttatgttgtatgtttattgaatgaaaggaaaacctaccttgtttacct

SEQ ID NO: 14548 - DNA, 595 bp, Guizotia abyssinica
aacaaactcatttctttacacacagaaaaacagaaacaaaaacagacgtagaaatggaaaccaccggaaaagctaagaagggtgccgcaggacgcaaagccggcggtccaaggaagaaggcggtcactcgctccgtcaaagccggtctccagttcccggtcggtagaattggtcgttaccttaagaacggacgttatgcgaagcgtgtcggcaccggtgctccggtctatctcgctgccgttctggaataccttgcagctgaaatattggagttggccggtaatgctgcacgtgacaataagaagaacagaattatccctaggcacgtactgctggcgattaggaacgatgatgagcttggaaaactattgtccggagtgacgattgctcatggcggtgttcttcctaacattaaccctgtgctattgccaaagagcgctgctgcaaaagaggctaagtcaccagcaaaagctaccaagtctccaaagaaagcttagattggttgtgtaattgtagttaatttgaacatggagagtagttttttaacattgttgttattttgatgttcttgaatggagtaaacctcttatttcat

SEQ ID NO: 14549 - DNA, 912 bp, Elaeis guineensis
ctaccgttactctcgctacgccgtatccgctgcgcctagcgagactgaagacgagtacgaaggagagcggaaaaatggagaccgggggaaaggttaagaagggcgcaggcggccggaggggtggcggcccgaagaagaagccggtatcccggtccgtcaaggctggccttcagttcccggtcggccggatcggtcgttacctcaagaagggccgctactcccagcgcgtcggcaccggcgcccccgtctacctcgccgccgtcctcgagtacctcgccgctgaggttctggagttggctgggaacgcggcgcgggacaacaagaagaatcggatcatcccgaggcacgtgcttctggcggtgaggaacgacgaggagctgggcaagcttctcgctggtgtgaccatcgcccatggaggggttctgcccaacattaacccggtgcttctcccgaagaagacagcaagcaaggagcccaagtcgccctccaaggccaccaagtcccccaagaaagcttaagagctgacgatccttgtgttgttattccaaccttcgtatttctgtgtgcaatttcgtgatcctttttaggcggttttcttcttgcgtttgtatcggtggtggtgtaaggagaagggtacgaaactggaaaaaagggatttgtattaattctctttcctttcagaaaatgttaagaactgtgtttttactatggacgagcatgttttttcttttatatttttggtcctggaatcgattgtagctttccgagtttctagttgatgtctgataccccaatttgtggagaaatactgtaccagaatggggactttcgtcgcattgtatgagaacggatatcaattttagaagttgttactaaaggagagcggcgaggtgatttatttttcaaaaaaac

SEQ ID NO: 14550 - DNA, 671 bp, Primula obconica
acatttctctttctaaaatggagagcgtgggaaaggcgaagaagggggcaggaggaaggaagggaggcggtccaaagaagaaatcggtaacacggtcatcaaaagccggtctgcagttcccggtcgggagaatcggtcggtacctcaaaaaaggccgatactccaaacgggtcggatccggtgcccccgtttacctcgctgctgtcctcgaatacctcgccgctgaggtactagagttagcaggcaatgctgcaagggacaacaagaagaacaggatcgtacctaggcacgtgctgttggctattaggaacgatgaagaacttggtaaactactcgcaggcgtgactattgctcatggtggggtcctccctaacatcaaccccatcctactcccaaaaaagacaaaagagcccgcagctaaatctccttcgaaggccaccaagtcccctaagaaagcttaaccaggtcttacggtttgttacttgtctgtgttttatgtaattttcgtttgtatttgcggtttgtagaccttgtccctggaactattgtactttgattggtagttataaactcaggtgttgatgttatggatttgtggtgttcggttctgaatttgaaaacaatggttgctgattttcggaattgaaaacaatgggtttgtttggttgctt

SEQ ID NO: 14551 - DNA, 710 bp, Secale cereale
ctccaatcaacagatctccccagttcccggatcatttctcttcaagcgcagcagcctgcaatggacgcgtcagccaccgtcgccgccgggaaggggaagaagggcgtggccgggcgcaaggccggcggccccaggaagaagtccgtgtcgcggtccgtcaaggccgggctccagttccccgtcagccgcatcgggcactacctcaagaagggccggtacgcccagcgcgtcggcaccggcgcccccgtctacctcgcggccgtcctcgagtacctcggtgccgagctgctggagctcgcggggaacgccgccaaggacaacaagaagagccgcatcatccccaggcacctgctgctcgccgtcaggaacgacgaggagctcggcaagctgctagccggcgtcacaattgcgcacggcggcgtggtccccaagatcaacccagtgctgcttcccaagaagacggccgagaaggcgaccaaggagcccaagtcgccgaagaagacccccaagtcccccaagaaggcctaggaggcgcgtcgccttgctcagattgttgtatttagctgggatggatcgatgggtgtgcttcaaagtagacggttgttgttggtctgggtgtgtcgctgtatcttctcatctgtgacttccatggaacaatgcgttgcataatcaattgtgttcctttgcccgcaaaaaaaaaaaaactgaga

SEQ ID NO: 14552 - DNA, 596 bp, Secale cereale
cagctcgccatggacgcctcagccaccgtagccaccgggaagggcaagaagggcgcggccgggcgcaaggcgggcggccccaggaagaagtccgtgtcgcggtccgtcaaggccgggctccagttccccgtcagccgcatcgggcgcttcctcaagaagggccgctacgcgcagcgcgtcggctccggcgcccccgtctacctcgcggccgtcctcgagtacctcgccgccgagctgctggagctcgccggcaacgccgccaaggacaacaagaagagccgcatcatcccccgccacctgctgctcgccgtcaggaacgaccaggagctcggcaggctgctcgccggcgtcaccatcgcccacggcggcgtgatccccaacatcaacccggtgctgctccccaagaagaccgccgagaagtcccccaaggagcccaagtcgcccaagaagaccgccaagtcccccaagaaggcctaggtggtcattgcttagttaggctgtagctgggatggatggatggatgggtgtgcttcaggttacttcagttcgaagtagactgttctcgccgcgtcggttgtattttctgaccgtgattt

SEQ ID NO: 14553 - DNA, 668 bp, Secale cereale
ctccagtcaaggaatccccgcacatctctccactccccgaatcctctctccacttccagcgccgcagctcgccatggacgcctcagccaccgtagccgccgggaaggggaagaagggcgcggccgggcgcaaggctggaggccccaggaagaagtccgtgtcgcggtccgtaaaggccgggctccagttccccgtcagccgcatcgggcgcttcctcaagaagggccgctacgcgcagcgcgttggctccggcgcccccgtctacctcgcggccgtcctcgagtacctcgccgccgagctgctggagctcgctggcaacgccgccaaggacaacaagaagagccgcatcatcccccgccacctgctgctcgccgtcaggaacgaccaggagctcggcaggctgctcgccggcgtcaccatcgcccatggcggcgtcatccccaacatcaacccggtgctgctccccaagaagaccgccgagaagtcccccaaggagcccaagtcgcccaagaagaccgccaagtcccccaagaaggcctaggggaccattgcttagttatgtctgtgtagctggaatggatgtatgggcgtgcttcagctcgaagcagagtgttcttgttgtgtcgttgtatcttctgatctgcgaattcaatggaacaatgagttgc

SEQ ID NO: 14554 - DNA, 624 bp, Secale cereale
cagctcgccatggacgcctcagccaccgtagccaccgggaaggggaagaagggcgcggccgggcgcaaggcgggcggccccaggaagaagtccgtgtcacggtccgtcaaggccgggctccagttccccgtcagccgcatcgggcgcttcctcaagaagggccgctacgcgcagcgcgtcggttccggcgcccccgtctacctcgcggccgtcctcgagtacctcgccgccgagctgctggagctcgccggcaacgccgccaaggacaacaagaagagccgcatcatccctcgccacctgctgctcgctgtcaggaacgaccaggagctcggcaggctgctcgccggcgtcaccatcgcccatggcggcgtcatccccaacatcaacccggtgctgctccccaagaagaccgccgagaagtcccccaaggagcccaagtcgcccaagaagaccgccaagtcccccaagaaggcctaggtggtcatttgcttagttaggctgtagatggcatcgatggtttggtgtggttcaggaatcaggatacttcagttcgaagtagactgttcttgcttagtcgttgtattttctgaccgtgatttcaatgaaacaataagttgctttgat

SEQ ID NO: 14555 - DNA, 563 bp, Silene vulgaris
gaagaagggagcagctggaaggaaagccggcggtccaaagaagaagtcagtcactcggtccatcaaagccggtcttcagttcccggtcggtcgtattggaaggtacttgaagaaaggccgatatgctcagcgtgtcggatccggtgctccggtttacttggctgctgttcttgagtaccttgctgctgaggttctggaattggcgggaaatgcggcacgtgacaacaagaagaacaggataatcccaaggcacgtgctactggcaataaggaatgatgaagaactcggaaagctgttggctggagtgacaattgctcacggaggagttttgccaaacataaacccgattctgttgcctaagaagactgctgagaagtcaccaaaggagcctaaatcgccatccaaggccgcgaaatcgccaaagaaagctgctgcttaagtgtttattcctatgagttgtgtatgtaatcaatctaagtagggtttgggattagttagtatcgttggttgtttagtcgtatggttcaggagtcgatatctgatcgattcttggcgtttgtatt

SEQ ID NO: 14556 - DNA, 762 bp, Trigonella foenum-graecum
aaatcaatttctcagctagattctaaggttccaatcgcagaaatggacgcaagcacaaaaacgaagaagggtgcaggaggaagaaagggaggtccaaggaagaaagctgttaccagatccaccagagctggtcttcaatttccagtcggaagaatcggtcgttacttgaagaaaggtagatacgctcagcgtgttggtactggtgctcctgtttatcttgctgctgttcttgaatatcttgctgctgaggtgcttgagttggctggaaatgcagcacgtgataacaagaagaataggattattccaaggcatttgttgttggctgtgaggaacgatgaagagcttggaaaattgcttgctggtgttacaattgctcatggtggtgttcttcctaacatcaaccctgttcttttgcctaagaagaatgagaaggctgcaactgcaactgctagcaagtctccagctaaggctaccaaatctccaaagaaagcttagatttagtttctagggtttcttgatttcgatttcgtgttttgtttatatctaagtttagtcataacagacatgtttaatgtgtttgtagcaatgtattttgaatatcagcgtttctcatgtagggatctgattcatcaatgaaaacatcttgtttcattgcctaaacacttcatattatgtgatattttgttatgtggagatctctataatctattttctgattaattattgctatgattatgattttcctaacaaaaaaaaaaaaaa

SEQ ID NO: 14557 - DNA, 705 bp, Triticum aestivum
gccaccaacgcactcggcaatcagcagccaagcaatccccacacacatctctccacttcccgaatcctttctcctcctcaccaccagcgcagcagctcgccatggacgcctcagccaccgtagccaccgggaaggggaagaagggcgcggccgggcgcaaggccggaggccccaggaagaagtccgtgtcgcggtccgtcaaggccgggctccagttccccgtcagccgcatcgggcgcttcctcaagaagggccgctacgcgcagcgcgtcggctccggcgcccccgtctacctcgcggccgtcctcgagtacctcgccgccgagctgctggagctcgcgggcaacgccgccaaggacaacaagaagagccgcatcatcccccgccacctgctgctcgccgtcaggaacgaccaggagctcggcaggctgctcgccggcgtcaccatcgcccacggcggcgtgatccccaacatcaacccggtgctgctccccaagaagaccgccgagaagtcccccaaggagcccaagtcgcccaagaagaccgccaagtcccccaagaaggcgtaggttaccattgcttagttaggtcggagtagctgggatggatgtatgggtgtgcttcagctcgaagcagagtgttcttgttgtgtcgttgtatcttctgatctgtgaattcaatggaacaatgagttgctttgataaa

SEQ ID NO: 14558 - DNA, 669 bp, Triticum aestivum
ccaatctcccatcacaaaaccaatcctcctccgcgccccgatccccaagagcatcacctgcaagcaatggacgtctcaggcaccggagctggcgccaagggcaagaagggcgcggccgggcgcaaggccggcggccccaggaagaagtcggtgacgcgctccgtcaaggccgggctccagttccccgtcggccgcatcgggcgctacctcaagaagggccgctacgcccagcgcgtcggcaccggcgcccccgtctacctcgccgccgtcctcgagtacctcgccgccgagctgctggagctcgccggaaacgccgccaaggacaacaagaagagccgcatcatcccgcgccacctgctgctcgctgtcaggaacgacgaggagctcggaaagctgctggccggcgtcaccatcgcgcacggtggcgtgatccccaagatcaacccggtgctcctccccaagaggaccgcggagaaggagggcaaggagcccaagtctcctaagaagacgaccaagtcccccaagaagaccaccaaggcttagatcgatgcgttccatgtcgtagtgttcttcgtagtggtccggtggtgttcctgtagcggtttcgtttcatcttgttatgtgcatgtttaatggaagaacgtcagaaatctctctgacttgctcaaa

SEQ ID NO: 14559 - DNA, 624 bp, Secale cereale
accaaatcctcctcttcgccccgagtcccagagcatcacctgcaagcaatggacgtctcaggcactggagctggcgccaagggcaagaagggcgtggccgggcgcaaggccggcggtcccaggaagaagtcggtgacgcggtccgtcaaggccgggctccagttccccgtcggccgcattgggcggtacctgaagaagggccgctacgcccagcgcgtgggcaccggcgcccccgtctaccttgccgccgtcctcgagtacctcgccgccgagctgctggagctcgccgggaacgccgccaaggacaacaagaagagccgcatcatcccgcggcacctgttgttggccgtcaggaacgacgaggagctcggaaagctgctggccggcgtcaccatcgcgcacggcggtgtgatccccaagatcaacccggtgcttctccctaagaggaccgcggagaaggaggcgaaggagcccaagtctcccaagaagacgaccaagtcccccaagaagaccaccaaggcttagatcgatgcgttccatgtcgtagtgttcttcgtagctggtgtcgtttcgtcttgttatgtgcatgtttaatggaagaacgtcagatatctctctgacttg

SEQ ID NO: 14560 - DNA, 709 bp, Ricinus communis
attattattttttataatttgtgattttctattttgtgtattttaaacgggtcggatcttattggagaaatggagtcaggagggaaagtgaaaaagggagcgggaggaaggaaaggtgggggtccgaagaagaaaccggtaactcggtcagtgagagccggtcttcagtttccagttggaagaattgggaggtacttgaagaagggaagatatgcacagcgggttggtactggtgctcctgtttacatggctgctgttcttgagtacttagctgctgaagtattggagttggcagggaatgcagcaagagacaacaagaagaacaggataataccaagacatgtattgcttgctgtgagaaacgatgaggaacttggaaaattgctagccggtgttaccattgctcatggaggagtcttgcctaatattaatcctgttctcttgcctaaaaagactgagaaagctaccaaagaacccaccaagtctccctccaaggctaccaagtcaccaaagaaggcttaaaaagtttgtctcaccatagaaagctcaagaagcttctcctgttgtatgtaattttgggtttcatggttgatcttattttgttgatgatgtgtaggcgaactttaattttttttttttttttaaagtatgtagtactactgctagaatgtggcatctcagattaatagatgaaactacatgtttctgc

SEQ ID NO: 14561 - DNA, 664 bp, Ricinus communis
taatatatatcagaatttctttttgtgcattgtaaacgggtcgggtcttattggagaaatggagacgggagggaaagtgaaaaagggtgcgggaggaaggaaaggtggaggtccgaaaaagaaaccggtaactcgctcagtgagagcgggtcttcagtttccagttggaagaattgggcggtacttgaagaagggaaggtatgcacagcgggttggtactggtgctcctgtttacatggctgctgttcttgagtatttagctgctgaagtattggaattggcagggaatgctgcaagagacaacaagaagaacaggataataccaagacatgtattgcttgctgtgagaaacgacgaggagcttggaaaattgctagccggtgttaccattgctcatggaggagtcttgcctaatattaatcctgttctcttgcctaaaaagactgagaaagctaccaaagaacccaccaagtctccctccaaggctaccaagtcaccaaagaaggcttaaagagtttgtctcaccaaagaaagatcaagaagcttctcttgttgtatgtaattttgggttgatgttattttgttgatgatgtgtaggggaatttaaactgtttttttttttaaaatagtatgtagtactacttgttagaatgtggcattttag

SEQ ID NO: 14562 - DNA, 786 bp, Gossypium hirsutum
agaaaatttcactgcgagattcatatcgggtttcaactcttttcctccaatttgcacttgaagtgatggataccggatcaaaggtgaagaaaggagccggaggaaggaaaggcggcggtccaaagaagaaaccggtttctcgttcagtgaaagccggattacagtttcccgtcggtcgaattggccggtacttgaagaaagggcgatactctcaacgtgtgggaacgggtgctccagtttaccttgctgctgttcttgaatacctagctgctgaggttcttgagttagctggcaatgctgcaagagacaacaagaagaataggatcattccaaggcatgttctattggcagtgaggaacgatgaagaacttgggaagcttttagctggtgtgaccattgctcatggtggtgttttgcccaatattaacccagttcttttaccaaagaaaaacgaaaaggtggcgaccaaggagcctaaatcgccatccaaggctaccaagaagtctcctaagaaggcttagtttcatttatttgattatgtatttagtttcctctgtgtaggaaaatgttaatgttggtaatgtaggaatttagggccattgtatttctgaaatctaatttcccagtgttgtttcgaataggtttgtttgaaatgaatgaatggaattcagattatatggctttgttataggggtaattcgtcccttgcaatagttgcagtatccttcctcgttgattattggcagtgataaaggtccatatggcattaatgtcccttccttcaaa

SEQ ID NO: 14563 - DNA, 763 bp, Gossypium hirsutum
agtctccaaatccgtaagccaaatgtctcccatttttctcacttcgcatataaattgaactaatttccaacacgaaatcacaaacattttctcgagaaaatttcactgcgagatttcatatcggattttcaagtcttttcctccaatttgcacttgaagtgatggataccggatcaaaggtgaagaaaggagccggaggaaggaaaggcggcggtccaaagaagaaaccagtttctcgttcagtgaaagccggattacagtttcccgtcggtcgaattggccggtacttgaagaaagggcgatactctcaacgtgtgggaacgggtgctccggtttaccttgctgcagttcttgaatacctagctgctgaggttcttgagttagctggtaatgctgcaagagacaacaagaagaataggatcattccaaggcatgttctattggcagtgaggaacgatgaagaacttgggaagcttttagctggtgtgaccattgctcatggtggtgttttacccaatattaacccagttcttttaccaaagaaaaacgaaaaggtggcgaccaaggagcctaaatcgccatccaaggctaccaagaagtctcctaagaaggcttagtttcatttatttaattatgtatgtaatttcctttgtgtaggaaaatgttaatgttggtaatgtaggattttagggccattgtatttctaaagtctaatttcccagtgttatttcgaataggttttgtttgaaatgaatgaatgaaa

SEQ ID NO: 14564 - DNA, 822 bp, Panax ginseng
gaagcagtggtatcaacgcagagtacatggggattgcaaatcaatctcgcttcagataagtcgtagggtttatattgtcatttgccccagttcaattagttgagagagtgaaatggataacactggaaaagggaaaaaaggcgccggcggcagaaagggaggcggcccaaggaagaaggcagttacccgctccgccagagccggtttacagtttcccgtcggtagaattggccggtatctcaagaagggtcgctatgctcagcgtcttggaaccggtgctccggtttacttggccgccgtgctcgaatacctagctgctgaagtattggagttggccggaaatgctgcaagagacaacaagaagaacaggattattccaaggcatttgctgttggcagtgaggaatgatgaggagctggggaaattgctgggcggagtgacaattgcacatggtggggtgttgccaaatataaacccagttttgttgccaaagaagactgataaggcaaccaaggaacccaagtctccttccaaggcagctaccaagtcccccaagaaagcttaagttcattgattagattttctgttctattagcccaatcagtcattagtagattaaggcttaattttctctctatccccttgtatgtaatattgggtttttatggaacatgttttgttgaatatctcttttaagtgaatttgggaagatggatattccaagtccgcaccctcattatgagggttaatgttggtgaagatttctatttgctcaatggaagatattacttactgattttgttgtaaaaaaaaaaaaaaaaa

SEQ ID NO: 14565 - DNA, 750 bp, Amsonia hubrichtii
ccgaatacaccgttcccgtagttatttgtgtccccaaatctttaaccttgttttgcttcttccagagttgtagtgaatcgtcatggacactggaggaaaagtgaagaagggtgccgcaggaaggaagggcggtggcccgaagaagaagcctgtctctcggtctaatagggctggcttgcaatttccggtcggtagaattggccggtacttgaagaagggtcgctattctgagcgagttggttccggtgctccggtttatatggctgccgttcttgaatatttagctgccgaagttcttgagttggctggaaatgctgctagggataacaagaagaacagaataatcccaaggcacgtgcttttggccataagaaacgatgaagagcttggaaagttgttggccggtgtgacaattgcacatggtggagtgctaccaaatattaaccccatcttgttgccaaagaagactgacaagcccgtcaaagaacccaaatctccatctaaggctaccaagtccccgaagaaggctgcttagatttgtctaattggattaggctcctttaaaaccttgttaaaggatcttaggtgaccgtgtatgtaatgtgggttagaacttttttagcttaatgttaaggaagataggagtgaacaagggtattgtaattcttagcttgctttttaggagttcaacttcaatatgaatgaatgaatctttttgttcttctaataatttgttggaaatttttttct

SEQ ID NO: 14566 - DNA, 615 bp, Vaccinium corymbosum
tttccgatagcgttttccgatagtgaagaaatggagactggtgggaaagtgaagaagggtgccggaggtcggggaagaggtaccggtccgaagaagccgccggttacccgctccgtcagggctggtctgcagttccccgtcggcaggattggccggtacttgaagaaaggccgatatgcccagcgcgtcggaaccggtgctccggtctacttggccgccgtcctcgaatacctagctgctgaagttcttgagttggctggaaacgcagcccgtgacaacaagaagaacagaatcattccaaggcacgttcttttggctataaggaacgatgaagagcttggaaagttgttggctggagtgacgattgcacatggtggagtcctgccaaacatcaaccctgttctgttgccaaagaagtctgacaaggcaatgaaggagcccaaatctccctccaaggccaccaagtctcccaagaaagcttagattttccaatgcccagtttgaagttacatctctttcgttgtgtatgtaattttagagattagaacttgatttgctagtcctttaggttatgtttatgaatatcattgtaatgtctcttgagtttggcatttc

SEQ ID NO: 14567 - DNA, 680 bp, Vaccinium corymbosum
aggcttaaaacgaaatcgacgggatcgctctctgtgctaaatctgttgtcattttctgatagtgtgagatggagactggtgggaaagtgaagaagggcgccggaggtcggggaagaggtaccggtccgaagaagccgccggttacccgctccgtcagagctggtctgcagttccccgtcggcaggattggccggtacttgaagaaaggccgatatgcccagcgcgtcggaactggtgctccggtctatttggctgccgtcctcgaatacctagctgctgaagttcttgagttggctggaaacgcagcccgtgacaacaagaagaacagaatcattccaaggcacgttcttttggctataaggaacgatgaagagcttggaaagttgttggctggagtgacgattgcacatggtggagtcctgccaaacatcaacccggttctgttgccaaagaagtccgataaggcaatgaaggagcccaaatctccctccaaggccaccaagtctcccaagaaagcttagattttccaatgcccagtttgaagttacatctctttcgttgtgtatgtaattttagagattagaacttgatttgctagttctttaggttatgtttatgaatatcattgtaatgtctcttgagtttggcatttcagtgttcaatcaatggatgaaaccctc

SEQ ID NO: 14568 - DNA, 645 bp, Vaccinium corymbosum
aatctgttgtcattttccgatagtgaagagatggagactggtgggaaagtgaagaagggcgccggaggtcggggaagaggtaccggtccgaagaagccgccggttacccgctccgtcagggccggtttgcagttccccgtcggcaggattggccggtacttgaagaaaggccgatatgcccagcgcgtcggaactggtgctccggtctatttggctgccgtcctcgaatacctagctgctgaagttcttgagttggctggaaacgcagcccgtgacaacaagaagaacagaatcatcccaaggcacgttcttttggctataaggaacgatgaagagcttggaaagttgttggctggagtgacgattgcacatggtggagtcctgccaaacatcaaccctgttctgttgccaaagaagtctgacaaggcaatgaaggagcccaaatctccctccaaggccaccaagtctcccaagaaagcttagattttccaatgcccagtttgaagttacatctctttcgttgtgtatgtaattttagagattagaacttgatttgctagttctttaggttatgtttatgaatatcattgtaatgtctcttgagtttggcatttcagtgttcaatcaatggatgaaaccctcttt

SEQ ID NO: 14569 - DNA, 625 bp, Chrysanthemum coronarium
ctctcaaaacaaacaaacactcattttttataagtaagaatggagggaaccggtaaagtgaagaagggagcagcaggaaggaaagccggcgggccacgaaagaagtcagttactcgttccgttaaagccgggcttcagtttccagttggaagaattggaaggtatttgaagaaaggtcgttacgctaagcgtgttggtactggtgctcctgtttatctcgctgcggtccttgagtatctcgcagctgaagtgttggaattggcaggaaatgcagcaagggacaacaagaagaacagaataatcccaagacatgtgttgttggcgattagaaatgacgaggagcttggaaagttgttgtctggtgttacgattgctcatggtggtgttttaccaaacattaaccctgttttgttgcctaagaaaactgctgctaaagaagcaacaccaaagtctccatcgaaagttggaaagtctcctaagaaggctgctgcttagattagtttgatggtgattgatttgatgaaattgtggtgttctattttggttgatgtgatggtgaagttagtgtagttaatttgattagatgtaatcttttctatggaatgaaacccacttgtttctgttt

SEQ ID NO: 14570 - DNA, 942 bp, Panax ginseng
aatttgcttctctaattctccacttttagtagtatttcatacgcttttcttaatggccacagttgaggttgtatcagcaaaaagggcaatccatgaggagaaattgaggaaccaaacaagcctcagcaagcacccaaagcagtggtatcaacgcagagtacatggggattgcaaatcaatctcgcttcagataagttgtagggtttatatcgtcatttggcccagttcaatcagtttgagagagtgaaatggataacactggaaaagggaaaaaaggcgccggcggcagaaagggaggcggcccaaggaagaagtcagttacccgctccgtcaaagccgggttacagtttcccgtcggtagaattggccggtatctcaagaagggtcgttatgctcagcgtcttggaaccggtgctccggtttacttggccgccgtgctcgaatacctagctgctgaagtattggagttggccggaaatgctgcaagagacaacaagaagaacaggattattccaaggcatttgctgttggcagtgaggaatgatgaggagcttgggaaattgctgggcggagtgacaattgcacatggtggggtgttgccgaatataaacccagttttgttgccaaagaagactgataaggcaaccaaggaacccaaatctccttccaaggcagctactaagtcccctaagaaagcttaatttcattgattagattttctgttctattagcccaatcagtcatattagtagattaagacttaattttctctctatccccttgtatgtaatattgggtttttatggaacatgttttgttgaatatctctttaagtgaatttgggaagatggacattgcaagtccgcaccctcattatgagggttaatgttggtgaagatttctatttgctcaatggacgacattacttgatctttttactga

SEQ ID NO: 14571 - DNA, 741 bp, Panax ginseng
taagttgtagggtttatattgtcatttgccccagttcaatcagtttgagagactgaaatggataacactggaaaaggaaaaaaaggcgccggcggcagaaagggaggcggcccaaggaagaagtcagttacccgctccgtcaaagccgggttacagtttcccgtcggtagaattggccggtatctcaagaagggtcgttatgctcagcgtcttggaaccggtgctccggtttacttggctgccgtgctcgaatacctagctgctgaagtattggagttggccggaaatgctgcaagagacaacaagaagaacaggattattccaaggcatttgctgttggcagtgaggaatgatgaggagcttgggaaattgctgggcggagtgacaattgcacatggtggggtgttgccaaatataaacccagttttgttgccaaagaagactgataaggcaaccaaggaacccaaatctccttccaaggcagctactaagtcccctaagaaagcttaagttcattgattagattttctgttctattagcccaatcagtcatattagtagattaagacttaaattttctctctacccccttgtatgtaatattgggtttttatggaacatgttttgttgaatatctcttttaagtgaatttgggaagatggacattgcaagtccgtaccctcgttatgagggttaatgttggtgaagatttctatttgctcaatggacgacattacttga

SEQ ID NO: 14572 - DNA, 708 bp, Gossypium raimondii
acaaacattttctcgagaaaatttcactgcgagatttcatatcggattttcaagtcttttcctccaatttgcacttgaagtgatggataccggatcaaaggtgaagaaaggagccggaggaaggaaaggcggcggtccaaagaagaaaccggtttctcgttcagtgaaagccggattacagtttcccgtcggtcgaattggccggtacttgaagaaagggcgatactctcaacgtgtgggaacgggtgctccggtttaccttgctgcagttcttgaatacctagctgctgaggttcttgagttagctggtaatgctgcaagagacaacaagaagaataggatcattccaaggcatgttctattggcagtgaggaacgatgaagaacttgggaagcttttagctggtgtgaccattgctcatggtggtgttttacccaatattaacccagttcttttaccaaagaaaaacgaaaaggtggcgaccaaggagcctaaatcgccatccaaggctaccaagaagtctcctaagaaggcttagtttcatttatttaattatgtatgtagtttcctttgtgtaggaaaatgttaatgttggtaatgtaggaatttagggccattgtatttctgaaatctaatttcccagtgttgtttcgaataggtttgtttgaaatgaatgaatggaattcagattatatggctttgttgtag

SEQ ID NO: 14573 - DNA, 766 bp, Sarracenia psittacina
aaccatatttcagacaaatcgagaccagatttgacggcctgcattccttttcttcggtgttgatttctcgttgcgtttcatttttattcaagttcttcagcgagagtccggtgagagatggatgctaccgcgaaagttaagaaaggcgccggaggaaggaagggtggaggtccgaggaagaaggcggtaacccgttctgtcaaagccggattgcagttccccgtcggcaggattggccggtacttgaagaagggacggtactctcagcgtgtcggaaccggtgctccggtttacttggccgccgttcttgaatatcttgctgctgaagttctggagttggccggaaacgccgctcgtgataacaagaagaccagaatcatcccgaggcatcttctcctggcagttaggaacgatgaagagctgggaaagctgctggccggtgtgaccattgcgcacggtggcgtgcttcccaacatcaaccccgttctcttgccgaagaagacggacaaggcgaccaaggagccgaagtctccgagcaaggcaaccaagtcccccaagaaggccgcttagagttgtttctactcatctaattgcagttgttgccatttccatttcctttgtatgtattttgctggttttcatagttgttttgttgctccgtagtgaaatttgtcaggatgatggtgactctgtttatgttagaattttctgtttggatcaatggatggagatcgccctgttatttggcgtgatattaatgatagat

SEQ ID NO: 14574 - DNA, 958 bp, Triticum aestivum
aaccaaatccctactctccctcgtcccggcgagcaccagcggccggacatggacgtctcaggcaccggagctggcgctaagggcaagaaaggcgcggccggacgcaaggctggcggccccaggaagaagtcggtgacgcggtccgtcaaggccgggctccagttccccgtcggccgcatcgggcgctacctcaagaagggccgctacgcccagcgcgtcggcaccggcgcccccgtttaccttgccgccgtcctcgagtacctcgccgccgagctgctggagctcgccgggaacgccgccaaggacaacaagaagagccgcatcatcccgcgccacctgctgctcgccgtcaggaacgacgaggagctcggaaagctgctggccggcgtcaccatcgcgcacggcggcgtgatccccaagatcaacccggtgctgctccccaagaggacggcggagaaggagggcaaggagcccaagtctcccaagaaggccgccaagtcccccaagaaggccgacaagaaggcgtagagacgcgtgctttgtagaactaatggtgtagatgtagatctgtgctcccaagaaaaagcaattcagaaatctctcttcgattggcttagccgctgtagtgctctgtagtaacggtgattgctgtgtcgatgtagatctgtgccgcgaagaggaaaatgtcagaaatctctctgatttgagcaaattgtttgttcttctgttcttggtattgcaatgttagcatagttacggtggaaaaactcagatctattcgaatttgtcaacatttctttcttgtggtactgagcggagttcgccttagtggagttctccttggaagtttcagcgatgcccaagatgaagtaagccaaaattagttgagatcatttaatcggttggagccagccatgattctctgtaacggtggatgatgacagtgccatcagcaatg

SEQ ID NO: 14575 - DNA, 710 bp, Rosa hybrid cultivar
aattttactttattactttttctctgtttaattccaggccgaggtttgagctatggagaccggaggcaagttcaagaagggcgccggaggcaggaaggccggcggtcccaagaagaagccggtgacccggtcgaccaaagccggactgcagttccccgtcggaagaatcggccggtacttgaagaatggccggtacgctcagcgggtcggatccggagctccggtttaccttgctgctgtgctcgagtaccttgctgctgaggttttggaattggctggaaatgctgccagagacaacaagaagaatcgcataatcccaaggcacgtgctattggctgtgaggaatgatgaagaactcggaaagctgcttgctggtgtgacaattgctcatggtggtgtgcttcccaacatcaaccctgtgcttctgccaaagaactctgggaagacggctgcgaaggagccaaagtctccatccaaagccaccaagtcccctaagaaggcggcttaggcttaacttctctcagtactctgatctgatcagtagtgtatgtggtagtcatgtatctctgtatgaaatctacctgtttgtatttcatttctagggttgctcgttatgcccttaggatttcatatcattgtacaagctttatttccatttcctgttgaacatcgatccttcatttcagatgaaatgaaatttgcctgactcc

SEQ ID NO: 14576 - DNA, 757 bp, Fragaria vesca
actttattactttttctccctgtcaaattcccgagtttgagctatggagaccggaggcaagttcaagaagggcgccggagggaggaaggccggcggtcccaagaagaagccggtgacccggtccaccaaggccggtctgcagttcccggtcggaagaatcggccggtacttgaagaacggccggtatgctcagcgggtcggatccggagctcctgtttaccttgctgctgtgctcgagtaccttgctgctgaggttctggaattggctggaaatgctgcaagagacaacaagaagaatcgcattatcccaaggcatgtgttattggctgtgaggaatgatgaagaactcggaaagctgcttgctggtgtgacaattgctcatggtggtgtgcttcccaacatcaaccctgtgcttctgccaaagaactctggcaagacggctgccaaggagcccaagtctccatccaaagccaccaagtcccctaagaaggcggcttaggcttaacttttctcagtactctgatctgatcaatagtgtatgtggtagccatgtatctctctgtatggaatctccccgtgtatttcatttctagggttgctcatcatgcccttaggatttcatatcattgtacaatcgttatttccctttcctttagaatctcaatctttcatttcagatgaaatgaaatttgcccgactattacctgtgaaatttgcagttggaatgttatataactaatgttcttttaggttgttg

SEQ ID NO: 14577 - DNA, 826 bp, Rosmarinus officinalis
tttcaactctacctgcaaaattctctccatcaatcaattcccatttgcagcaaattaagaaatggaaaccggtgggaaattgaagaagggagctgggggaaggaagggcggcggcccgaagaagaagccggtttcccggtccgtcaaggccggcttgcagttccccgtcggtagaatcggccggtatttgaagaagggccgttattcccagcgggtgggaaccggagcgccagtttacttggctgccgtgctcgagtatcttgcagctgaggttttggagttggcagggaatgctgctagagacaacaagaaaaacaggattattccgcggcacgtgctgcttgctgtgaggaacgacgaggagcttgggaagcttctagctggagtcaccattgctcacggtggagttctaccgaacatcaacccagttcttctacctaagaagtcggagaaggtggcggagaagtcccaaaaatcaccatccaaagggactaaatctcccaagaaggcttgatgttgtgtgatgcgtagtgttgtggttgagtagcatcgttttcgttctttgtatgtaatttgcattcttgttggttatgtaggaaggaggctgttcataactggattaaaaatctctgtactatctcgttggattgctccttgttagaattgatgggaaatatcaggatgattggctttcaacatatttattttcttgcaaggggaaaggttaaggttcaatatattgaaattacaaaggggggaaaatatagttgtagtggttgagggacgccttactgaatcaaaatgtaactaacataccgacatatgt

SEQ ID NO: 14578 - DNA, 740 bp, Vitis vinifera
actcacgaattgctcgtttcggacggtgatacctgttttgttttctcgggaatttgattttccgccgactgtatccgggaaatggaggctgctggaaaggtgaagaagggtgccggaggaaggaagggcggtggtcccaagaagaaacccgtatcccgctccgtcaaagctggtcttcaattcccggtcggtcgtatcggcagatacctcaagaagggccgttattctcagcgcgttggaactggtgccccggtctacctcgctgccgtgctggagtacctagctgctgaggttttggagttggctggaaatgcagcaagggataacaagaagaacaggataatcccgaggcatgttttgttggctgtgagaaatgatgaagaacttgggaagcttctagctggagtcacaattgctcatggtggtgtcctgccgaacatcaaccctgttcttctgccaaagaagtctgacaaggcagcaaaggaacccaagtcgccatccaaggccaccaaatctcccaggaaaacttagtttatcaattgtgttagagaaacacttgtcttcttcttatctctctctgtatgtagtctcccttctctgtccatgggtgataggaaagctttattcgatcagaaaataggagcattgtactctttgtttccatgttctcttaggacattctgtttcaaatgaatgaaattcagttttcagataatttcagggttttttaatagagacgc

SEQ ID NO: 14579 - DNA, 673 bp, Ocimum basilicum
gcacgaggaaatctctccccatcaatcaatttccctttgctgcaaaattaagaaatggaaaccggcggaaaattgaagaagggtgcaggaggcaggaagggcggtggccccaagaagaagccagtttcccggtccgtcaaggccggtctgcagtttccggttggcagaatcggccggtatctgaagaagggccgctattcccagcgagtcggcaccggcgcccctgtctacatggccgccgtgctggagtatcttgcagctgaggttcttgagttggctggcaatgctgctagggacaataagaagaacaggattattccgaggcatgtattgcttgcagtgaggaatgatgaggagctggggaagcttctggctggagttacgattgcacatggtggagttctacccaacatcaacccagttctgctacccaagaaatccgggaatgtggctgagaagaccccgaaatctcccaaggccaccaagtctcccaagaaggcttgaagctgtgatgccatgttcccatgttttggttgaagggcatcgttttatgtctttgtatgtaatttgaattgttgttatgtagggaacatgttcataactggattaaaacctttgtaccctcagttggattgtttttattagagttggaattaaaaccatttctgctact

SEQ ID NO: 14580 - DNA, 695 bp, Phaseolus vulgaris
cttcatcacacgcaattctgctcaacatcccttaacctttctcgttcctcacttttgttatttttcaagcgcagctaatttctagggttccgacatggaaaccggtggaaagattaagaagggcgccggaggaagaaagggcggcgggccaaagaagaagccggtcacgaggtccgttagggcgggactccaatttcctgtcggaagagtagggcgttacttgaagaaaggaaggtacgcgaagcgtgtgggaaccggtgctcccgtttacttggctgctgttcttgaatacctagctgctgaggtgcttgaattggctgggaatgctgctcgtgacaacaagaagaacaggattattcctagacatgtgcttttggctgtgaggaacgatgaagaattggggaaattgctttctggtgtgaccattgcccacggtggtgttcttcccaacattaaccctattctgttgcccaagaagaccgataaggctgtcaaggagcccaaatctccatctaaagctaccaaatctcccaagaaggcttagagtatattttaatttagttctgtatatcagtgtttagggtgctttggctgtaacaggaagggggtttgatgttttgaaacactgtattttcatctaattgtgttgtttgaagaagtttgttcatttatcgaaacctcttgttttcacccaa

SEQ ID NO: 14581 - DNA, 710 bp, Gossypium hirsutum
cagttctcctgtaccaatcaataccctctaattttaaagctaagagatttaagttaacgaagcatttggtcggttcgaagtaatggaaactaccggaaaagtaaagaagggagccggaggaaggaaaggtggtggcccgaagaagaagcccgtttcaaggtctgtcaaagccggtctccagttcccagttggtaggatcggccgttacttgaagaaaggaaggtattcacagcgggtcgggaccggagccccggtttacttggctgcagttcttgagtacttggccgctgaggttctggaattggctgggaacgctgcacgtgacaacaagaaaaacaggatcatcccaaggcacgtgctacttgccgtgaggaacgacgaagaattagggaagcttctcgccggcgtaaccatcgctcacggtggtgtgttgccgaacattaacccagttcttttgccgaagaagactgaaaaggccgccggcaaagaacccaaatctccatcaaaggccaccaagtctcctaagaaagcttaaattgatttaacaaaactagatccacagggctttatttttcttagttgtatgtccttttggggggattgttttcacagtgcagggggagactgctttaagcaaaatggaagcattgttagaatctcattatgatgtatgttactttaatggaaatgaaacatctagtttctttgaa

SEQ ID NO: 14582 - DNA, 845 bp, Nicotiana tabacum
ggccattacggccggggcatccacatctaccgctccgacaatcaactgataatatcaattataatacacaaatcacaactttggtctttttcatttccagatggatactgccggaaaagcgaaaaaaggtgccggcggtaggaaggttggcggccaatcgaagaagccggtttcccggtccgtcaaagccggtcttcaattcccggttggtagaattggtcgttacctgaagaagggtcgttacgctcaacgtgttggaagtggtgctccggtttatttggctgctgttcttgaatatttggccgctgaagtgttggaattggctgggaatgcagcgcgtgacaacaagaagaacagaattattccaaggcacgttctgttggctgtgaggaacgatgaagagctagggaagcttcttgccggtgtgaccattgctcatggcggtgtgcttcccaatatcaacccgattttgttgcctaagaaaactggtgctgaaaaggcaccgaaatctccagctaaggccacaaaatctcccaggaaagctgcagcttagaatttgtttttagtgactgttgaaactgaactttattttgtatgtaattctggtcctagatctagttcttttgttagtgagggaatttgagaagaatattgttgtaattctgaacttcgagtattagagttgtaggttatgagatagttgagtctttccttagttcgtacatttgtgaggctagtttggtagggtttttgtctgagacagctagcggcaatattgtgtcttactactttttcgtttcatagagccgactctatttaatggttaccgcttttgctttgcacct

SEQ ID NO: 14583 - DNA, 668 bp, Triphysaria pusilla
ggactcaagttctatcccatacctaaatctgcttcaattctcatcctcttgagtagcttttgttatttgattttagtaccagagaaaaatggaaaccggtgggaaagcaaagaagggtgctgctggaaggaaggctggcggtccgaagaagaaatccgtctcccgctctgtgaaagccggtctccagtttccggtcggcaggatcggacgttttttgaagaagggacgatatgctcaacgtgtgggttctggtgccccggtttacttggcggcggttttggaatacctcgctgctgaggttttggagttggctggaaatgcagcaagagacaacaagaagtcaaggatcattcctaggcacttgttgcttgcagtgaggaatgatgaggagctcggtaaactacttgctggagtgacaattgctcatggtggcgtgataccgaacattaacccggttctgttgccaaagaaaaccgataagggggctgacaaggaacccaaatcgccatcaaaggcaaccaaatctcctaaaaaggcttaaatctaatgttctttgttttgtagagttgtaagtttggttaatgttgcactcatattgatatttaggaaggatattctgcttttattgtgttttgtttggatcattatatcaatgaaccgatttgaat

SEQ ID NO: 14584 - DNA, 782 bp, Triphysaria pusilla
caagctcaatttcatcttcatcctcttcactaacttctttcattcagagaaaaatggaaaccggtgggaaagtgaaaaagggagccgctggaaggaaggccggtggaccaaagaagaaatccgtcacccgctccgtcaaagccggtctccagtttcctgtcggcaggatcggtcggtttttgaagaagggtcgctatgctcagcgcgtgggttccggtgctccggtttacctggctgcggttcttgagtaccttgctgctgaggttctggagttagctggaaatgcagcaagagacaacaagaaaagcaggattatcccgaggcacttgttgttggccgtgaggaacgatgaggagcttggtaaacttcttgctggagtgacaattgctcatggtggtgtaattccgaacataaacccggttctgttgcccaagaaatctgacaaggttgctgagaagtcgcccaaatcgccatcaaaggccaccaaatctccgaaaaaggcttgaaaactgtgttttaggtgatagattgtctttgatttgtagagttgtaatttggattaatgttgttggtgtggttgaagtaggaactaggaatgatatttgtgcttttaatttggtatttgtcaatgagacttcttgtaatttcattcagaaattaaactctttgaattcttatttttgaatgtaattgaatggaaatatcattttgaatttaaaaaaaaaaaaaaaaacaaaaaaaaaaaaaacaaaaaaaaaaaacaaaaaaaaaacaaaaaaaac

SEQ ID NO: 14585 - DNA, 634 bp, Ocimum basilicum
caaaattaagaaatggaaaccggtggaaaattgaagaagggtgctggtggcaggaagggcggtggccccaagaagaagccagtttcccggtccgtcaaggccggtctgcagtttccggttggtagaatcggccggtatctgaagaagggccgctattcccagcgagtcggcaccggcgcccctgtctacatggccgccgtgctggagtatcttgcagctgaggttcttgagttggctggcaatgctgctagggacaataagaagaacaggattattccgaggcatgtattgcttgcagtgaggaatgatgaggagctggggaagcttctggctggagttacgattgcacatggtggagttctacccaacatcaacccagttctgctacccaagaaatccgggaatgttgctgagaagaccccgaaatctcctaaggccaccaagtctcccaagaaggcttgaagctatgatgccatgttcccatgttttggttgaagggcatcgttttatgtctttgtatgtaatttggattgttgttgttatgtagggaacatgttcataactggattaaaacctttgtaccctcagttggattgtttttattagagttggaattaaaaccatttctgctact

SEQ ID NO: 14586 - DNA, 591 bp, Chrysanthemum coronarium
acacactcaaaacacacacgcattcattcatcagttactcattcagataaaaaatggaaggaaccggtaaaatcaagaagggagcagcaggaaggaaagctggtgggccccgtaagaagtcggtcacccgatcttttaaagctgggcttcagtttccagttggaagaattggaaggtatttgaagaaaggtcgttacgctaagcgtgttggtactggtgctccagtttatctcgctgcggtcctcgagtatcttgcagccgaagtgttggaattggctggaaatgcagcaagggacaacaagaagaacagaataatcccgagacatgtgttgttggcgatcagaaacgacgaggagctcggaaagttgttgtctggtgttacgattgctcatggtggtgttttgcccaatattaacccggtcttgttgcctaagaaaactgctgcgaaagaaccaacaccaaagtctccatctaaagttggaaagtcgccgaagaaagcagcatagattagtttgtttgatgtatttgtggtgttttgtcagtaaattcagatgtagtcatttctatcgaatggaagccttttctttctgt

SEQ ID NO: 14587 - DNA, 595 bp, Trifolium pratense
acattttcaacatcacattccctatcttcaaactcttcatctcacatattcaattctctcatcttcaatcaaaccctaatttctgaatctcgaaatggcggagaaaggtgccggaggaaggaaaggtggaggtccaaggaagaaatcagtaaccagatccaccagagctggtcttcaattccccgtcggtagaatcggtcgttacttgaagaaaggtagatatgctcagcgtgtcggtaccggagctccggtttacttagccgccgttcttgaatatcttgctgctgaggttcttgaattggctggaaatgctgcacgtgataacaagaagaataggataatccctaggcacgtgttgttagcggtgaggaatgatgaagagcttggaaaattgcttgctggtgttactattgctcatggtggtgttcttcctaacatcaaccctgtgcttttgcctaagaagaatgaaagaactgctgctaaggagcctaaatctccttctaaggctggaaaatctcctaagaaagcttagatctgtttgaatgaaattaattattagtttatggattttgattgtgtatatctgagattaggt

SEQ ID NO: 14588 - DNA, 752 bp, Echinacea purpurea
tctctctctctaaaacgcgctctctctctagattgaacatcatcacccattgccatggaaaccggtggaaagtcgaagaaaggagctgcaggaagaaaggccggcggtccaaagaagaagtcggtcacccggtccgtcaaagccggtcttcagttccccgtcggtagaatcggccgctatcttaaagtaggccgctacgccaaacgcgttggcaccggtgctccggtttaccttgctgccgttctcgagtaccttgctgctgaggttttggagttggctggaaatgctgcaagagataacaagaagaacagaatcacaccaaggcacgtgttgttggccgttagaaacgatgatgagcttggaaagcttttatctggtgtgacaattgctcatggtggtgttcttccgaacattaatccggttctgttgccgaagaaggctcatgacaaggctgcaaaggaacctaaatcgccgtccaaagcgacaaaatcaccaaagaaggcttagatgttgttgtttgtatttgcttttgtatggtgatgtagttggatgtgagatttaggatgtgtttttagatgggttgtaaaatgctttgtttatgctggtatgaaaaggaagaatctctctttctggaaatgacaagtgttaagtatcaatattcaattctatctgtgctatatatattgtttgcttaaatgtgtgtgaatatgttttttaatttctacatttatagtaatgggattagggtggaa

SEQ ID NO: 14589 - DNA, 806 bp, Euonymus alatus
ataggaccatcccaacagccaaaccgtttcatttcttctgccttcaagagagtttggtttcattcgggttgggtaatggataccggaggaaaggcgaagaagggtgccggagggaggaaaggtggaggtcccaagagcaagccagttactcggtcggtgaaggccgggcttcagtttccagtgggaagaattgggcgttacttgaagaaggggaggtactctcagcgggtgggttccggagctccggtgtacttggctgctgtcctcgagtacttagctgctgaagtgctggagctggctggaaatgctgcccgtgacaacaagaagaacagaattatcccaaggcatgttttactggctgtgaggaatgatgaggagcttgggaagcttctttctggtgtcaccattgctcatggtggtgtccttcccaacatcaaccctgttcttttacccaagaagacggacaaggcctccaaagagcccaagtcaccttccaaagctaccaagtcccccaagaaggcctaatttctgacggccattgtagtttgtttgtcttttcagatgtatgtagcttgggtttaggatttaaattaccatctgtttaggggattactctcaaaggtaaatctgtgaaaccgcttgtttcttgtttaatgcagtctcttttgaagttttatctcttgaatgattagatgatcagatggtactggattctaaaggaaagaacctttatcgcttttgcaaaagaaaaaaattaccagcaaagaatttggcatcacattccttgaccttttgtagatagattc

SEQ ID NO: 14590 - DNA, 817 bp, Euonymus alatus
acctttataaatccgtcctacactctcatacaccatcgaacggaaccattccaaacctgaattcgtgaccgtttcgtttcttctgctttccagagagttgagttttattcgggttgattgtttgtgttatggataccggaggaaaggtcaagaagggagctggagggaggaaaggtggaggtcccaagagcaagccagtttctcggtctgtgaaggccggtcttcagtttccggtgggaagaattgggcgttacttgaagaaggggaggtactctcagcgggtcggttccggtgctccggtttatttggctgctgtactcgagtacttagctgctgaagtgctggagttggctggaaatgctgcccgtgacaacaagaagaacagaattatcccgaggcatgttctgctggctgtgaggaatgatgaggaacttgggaagctgctttctggtgtcaccattgctcatggaggtgtccttcccaacatcaacccagttctcttacccaagaagacggacaaggcctccaaagagcccaagtcaccatccaaagctaccaagtcccctaagaaggcctaatttctgacagccattgatagcttgtttgtcttttcaggtgtatgtagttttgttttaggattaggaaatgaatgtgatcttactggaaatactatttgaactctggaaggtaaactagtgaagctgcttgtttcttgttatctgtagtctctgttgcagttttaatctctacaatgtctggattttgtggagttgtgatatgcttttggaaattctttgtcaattcagatggtactaga

SEQ ID NO: 14591 - DNA, 697 bp, Euphorbia peplus
ggaaatgcggcaagggatacaagaagaacagagcttcttcttttcctttttttaatattagctagtaagaaattttcagagatggagagcgcaaatgtgaagaaaggtgccggaggtaggaagggtggaggccccaagaagaagcccgttaccagatccgccagagctggtctacagtttccggtcggtagaatcggccggtatttgaagaaaggccgatatgcacagcgggttggaaccggcgctccggtttacttggctgctgtactcgagtacctggctgctgaagtgttggaattggctggaaatgcggcaagggataacaagaagaacaggattataccgagacatgtattgcttgcaatcagaaatgatgaagagcttggaaagttgttggctggtgttacaattgctcatggaggtgttcttcctaacattaaccctattctcttgcccaagaagaccgagaaagccaccaaggaaccaaaatctcctactaaggctactaagtctccaaagaaggcataaatactgtttgtttaaattacttagccaatttaggttttctgcttttggttattgtaatttgaatgtattgtaggggatgggcttattttggatgtaggaaaatgcttataaatctgaatcttgtgtagtcttttatttaggctgtaatactcatgttaaagtcaacatt

SEQ ID NO: 14592 - DNA, 656 bp, Fagopyrum esculentum
gagatatacattcgccgccaaacaatcagttctcgcattttatctgcaaaaacacaatccagattcagaatggacggtgctagcaagtcaaagaagggagccgccggaaggagaggtggaggcccaaggaagaagtccgtttcccgatcaattaaggccggacttcaatttccggtgggtcgtattggccggtatctgaagaagggccgatacgctcagcgtgtaggttccggagctccgatttacgttgctgctgtgttggagtaccttgctgctgaggttttggagttggctggaaacgctgctagagacaacaagaagaccaggatcatcccaaggcacattctgttagccgtgaggaacgacgaagaattagggaaacttctttctggtgttaccattgctcatggaggtgttcttcccaacatcaaccccattctgttgccaaagaaagttgcagagaaggcccctaaggagggtaaatctccatccaaggcttccaagtctcccaagaaggcctaaaatgaaggatgctaattttctgtttgtaggtgtagtatagatggctaaatgtgtagaagggctcttttatgtcgattgcaattctggttagagctgcttttgtaagatttgaatcaaaagtctgaattgattca

SEQ ID NO: 14593 - DNA, 701 bp, Gossypium raimondii
tttaataccctctaattttaaagctaagagatttaagttaacgaagcatttggtcggttcgaagtaatggaaactaccggaaaagtaaagaagggagccggaggaaggaaaggtggtggcccgaagaagaagcccgtttcaaggtctgtcaaagctggtctccagttcccagttggtaggatcggccgttacttgaagaaaggaaggtattcacagcgggtcgggaccggagccccggtttacttggctgcagttcttgagtacttggccgctgaggttctggaattggctgggaacgctgcacgtgacaacaagaaaaacaggatcatcccaaggcacgttctacttgccgtgaggaacgacgaagaattagggaagcttctcgccggcgtaaccatcgctcacggtggtgtgttgccgaacatcaacccagttcttttgccgaagaagactgaaaaggccgccggcaaagaacccaaatctccatcaaaggccaccaagtctcctaagaaagcttaatttgttttaacaaaactagatccacagggctttatttttcttagttgtatgtccttttggggggattgttttcacagtgtaggggaagactgctttaagcaaaatggaagcattgttagaatctcattatgatgtatgttactttaatggaaatgaaacatctagtttctttgaaaagcaca

SEQ ID NO: 14594 - DNA, 1011 bp, Lactuca sativa
ttcatttgctaccttcacgctccatctctttctcttaccttcaacaaaaaactcgccggaaaacttacaatctctccatttccctcgattattttctctagaatccacatacgttgaaatggagaccagtggtaaggtgaaaaagggtgccgccggaaggaaggcaggtggtccaaagaagaagtccgtctccaagtccgtcaaggctggtcttcagttccccgtcgggagaattggccgacacatcaagaatggtcggtacgccaagcgtgtgggtagcggtgctccgatttacctcgccgccgttctcgagtaccttgctgctgaggtgttggagttggctggaaatgctgcgagagacaacaagaagaagagaatcataccaagacatgttttgttggctgtgagaaatgatgaagagcttggaaagcttctagctggtgtgacaattgctcatggtggtgttcttcccaacattaacccagttcttttgccaaagaaatctcttgagactgccacaaaggagcccaaatctcctgctaaagcagctaaatccccaaagaaagcttaggcgttgaagaaaacgttctctcagtgtctctttgtacgtattcacattgttctggtgatgtaggataacttcatgtttaatcggtttttaggtaatgtttggaagtattgtagtttgccttgcttatgttagcttctaggtttgaagaagaatctctctttttcgaaatgaaaattttagttttctgaaattaatggaccctttgtaatctacttatctatagtacgagtgtttttggttcattttctttaccctattgatttatttagattttgagctacattctatataagcagctgcaccgatttgttttctcatcctaagaaacataaaatcttaatgaagaagatactttgggaaaattgagcggaatagcaacgtgcattatcccactaccaagctatattcgaaggataactctagatactcgagctcttaat

SEQ ID NO: 14595 - DNA, 684 bp, Lippia dulcis
cacccgcacagcaatcgaattcgctccaaatctcaaattttcttctctatagcagccgagaatggaaaccggtgggaaaatgaagaaaggtgctggtggaaggaaaggtggcggcccaaagaagaaaccggtgtcccgctccgtgaaagccgggctccagtttcccgtcggtaggatcggccggtatctgaagaagggtcgttattctcagcgtgttggtaccggagcgccggtttacatggctgctgtgcttgagtaccttgctgctgaggttttagaattggctggaaatgctgcaagagacaacaaaaagaacaggatcattccaaggcatgtcttacttgccgtgaggaatgatgaggagcttggtaaacttctggctggggtcacaattgcacacggaggagttttaccaaatattaatccagttcttctgcccaagaaatccgagaaggcatctgagaaggctgccaagtcccccgccaaggctacaaagtctcccaaaaaggcttaattagctagtgttgaatttattgacttcgttctgtttctagggttcttgttggaatgtaggagaaaggtgtttataactggagtaattgtattgtatcctatttactgttccttgtttagatcccttgtgatttaaattaatggaaaccgatttgttttccttcacttttc

SEQ ID NO: 14596 - DNA, 759 bp, Platanus occidentalis
cgctcctaccaagtgtagattgtttacattccggcgggagctagtcacttttcctacgcttcgtagccttttttttttcccaccggcgagaaggttgagagatggaagcgaccgggaaggtgaagaaaggtgccggaggaaggaagggaggaggacccaagaagaagccagtctcccgctccgtgaaagctggtctgcagtttccggtgggaaggatcggccgttacttgaagaaaggccgttactcgcagcgtgttggaactggtgctccggtgtatatggctgccgtccttgaatatctcgcagctgaggttttggagttggcgggtaatgcagctcgcgacaacaagaagaacagaattatcccaaggcacgttcttttagcagtgaggaacgacgaggagctcggaaagcttctctccggtgtgacgattgcccatggaggagttcttcccaacatcaaccctgttctcttacccaagaaatccgagaaggctgccaaagaacccaagtcaccctctaaggccatcaaatcccccaagaagacttgattttaaccaaaaaaaaaaaaaaaaggaatgtatttacacttcattgctcttctttcctctctatttctgtatgtaacttgggttttcgttcgttttttttggttactgtgtaggactttctcatgaattttaaacacattgtactgtctcttgtatctttttgttaggttcttatccttccattaatgaatgaaaccacttgtttctt

SEQ ID NO: 14597 - DNA, 705 bp, Helianthus annuus
aacactcgccggaaaaccaccattcaatccgttttctccacaaaagttgtcatggaggccggtggaaagttgaagaaaggtgctgccggaaggaaagcaggcggtccgaagaagaaaccggtcacacggtccgttaaagccggtttgcagtttcctgttggtaggatcggccggtacctcaaggttggacgctacgcgaaacgagtcggtactggtgctccggtttatctcgctgctgtgcttgaataccttgctgctgaggttttggaattggctggaaatgctgcaagagacaacaagaagaacagaatcaatccgaggcatgtgttgttggctgtgagaaatgatgatgagctcggaaagcttcttgcgggtgtgacaatcgctcatgggggtgttcttccaaacatcaatccggttcttttgccaaagaagtctcatgacaaagctgcaaaggaacccaaatctccggctaaaccaaccaaatctccgaagaaagcttagtttgtttatccacatttccatggtgatgtagggtatatcaaatttatggtgtttttagagatgatttagtaggattgtattgtgatgctatgttgatgttaggacctaggtgtgaagaaagaagaagaatctctctttttctaaatgaaaattgttaaatttctgaagttatgaaatcctttgaacaagtgtttgattgat

SEQ ID NO: 14598 - DNA, 872 bp, Trigonella foenum-graecum
caattatcaccactcaaaatcttccacttcacacaacacacagatttcgtagcaaaaaatctagggttccaaattccaatctcggaaatggacgcgagcacgaaggcgaagaaaggagctggtggaaggaagggtggaggtccaaggaagaagtcggtgaccagatccatcagagctggtcttcaattccccgtcggaagaattggtcgttacttgaagaaaggtagatacgctcaacgtgttggtaccggtgctcctgtttacctcgccgctgttcttgaatatcttgctgctgaggtgcttgaattggctggaaatgcggcgcgtgataacaagaagaataggattatcccaaggcatttgttgttggctgttaggaacgatgaagagcttggaaaattgcttgctggtgtaaccattgctcatggtggtgttcttcctaacatcaaccctgttcttttgcctaagaagactgagagagctgctgctgctgctgcaagcaaggaaccaaagtctcctaaggcaaaggctggaaaatctccaaagaaggcttagattattagatttatgatgatttgtggtgtttgatgtttattttgtgtgtataattgcgctttaggttggtgttttgtaactggaaggtttaatgcttttgaaattatgtaatttggaagtcactggcttcttttagtattaatgtgaacgattcagtagaaataatatttgcctcaaattgtcttatgagtttagattctggattttgtatcgtgttcaagatgagacatttgaatgttaatgaaccaactattgtgtttcaatgccattcatgttatgagacatttcataaccttgcaaggttgtgaaatattgta

SEQ ID NO: 14599 - DNA, 687 bp, Triphysaria pusilla
tcgttactttttgtctttttctatctgacatacaaatcttctcctaaccaatcatctttgtaatcaaaccaaaaatggaagctactccaaaggcaaagaagggagctgctggaagaaaggccggtggaccaaagaagaaatccgtcacccgctccgtcaaagccggtctccagtttcctgtaggcaggatcggtcggtttctgaagaagggtcgctatgctcagcgcgtgggttctggtgccccggtttacctggctgcggttctagaataccttgctgctgaggtattggagttggctggaaacgctgcaagagacaacaagaaaagcaggattattccaaggcacttgctgctggccgtgaggaacgatgaggagcttggtaaacttctggctggagtgacaattgctcatggtggtgttataccgaatataaacccggtactgttgccgaagaagtccgacaaggtggctgagaaggcacccaaatcaccatcaaaggccaccaaatctcctagaaaagcttagaccgttttttactgaatgtgggattgagataaaataacctttattggtttgtagggattgtgttatcttgtggctatgtaggagatgctgtttataactgcagtaattgtacttttaaccgtttttcttgctattttgttattaaatctcatgatttgaa

SEQ ID NO: 14600 - DNA, 768 bp, Triphysaria pusilla
cttccattctcatcctcttgagtagcttttgtcatttgattttagtaccagagaaaaatggaaaccggagggaaagcgaagaagggagctgctggaaggaaggctggcggtccgaagaagaaatccgtctcccgctccgtgaaagccggtctccagtttccggtcggcaggatcggacgttttctgaagaagggacgatatgctcagcgcgtgggttctggtgccccggtttacttggcggcggttttggagtacctcgctgctgaggttttggagttggctggaaatgcagcaagagacaacaagaagtcaaggattattcctaggcacttgttgcttgcagtgaggaatgatgaggagctcggtaaactacttgctggagtgacaattgcgcatggtggtgtgataccgaacattaacccggttctgttgccaaagaaaaccgataagggggctgacaaggaacccaaatcgccatcaaaggcaaccaaatctcctaaaaaggcttaaaactattgttctttgttttgtagagttgtaagtttgattaatgttgctctcatattggtatttaggaaggatattgcgcttttattgtgttttgtttggatcattatatcaatgaaccgattcgaatttaactcaaaaaaaaaaaaaattaaaaaaaaaaacccaacagcggcaaggaccaaaatgaattccacggaaaaaaccaaggcgacgctcgcgatatttatggtggactggccgttgaaaacgaaaaacgtg

SEQ ID NO: 14601 - DNA, 621 bp, Triphysaria pusilla
attctcatcctattgagtagcttttgtaatttgattttagtaccagagagaaatggaaaccggagggaaagcgaagaagggagctgctggaaggaaggctggcggtccgaagaagaaatccgtctcccgctcagtgaaagccggtctccagtttccggtcggcaggatcggacgttttctgaagaagggacgttatgctcagcgcgtcggttctggtgccccggtttacttggcggcggttttggagtacctcgctgctgaggttttggagttggctggaaatgcagcaagagacaacaagaagtcaaggattattcctaggcacttgttgcttgcagtgaggaatgatgaggagctcggtaaactacttgctggagtgacaattgcgcatggtggtgtgataccgaacattaacccggttcttttgccaaagaaaaccgataagggggctgacaaggaacccaaatcgccatcaaaggcaaccaaatctcctaaaaaggcttaaatctattgttctttgttttgtagagttgtaagtttgattaatgttgctctcatattggtatttaggaaggatattgcgcttttattgtgttttgtttggatcattatatcaatgaa

SEQ ID NO: 14602 - DNA, 728 bp, Triphysaria pusilla
gacatacaattctcctcctaaccaatcatctttgcaccaaaaccaaaaatggaagctactccaaaggcaaagaagggagctgctggaagaaaggccggtggaccaaagaagaaatccgtcacccgctccgtcaaagccggtctccagtttcctgtaggcaggatcggtcggtttctgaagaagggtcgctatgctcagcgcgtgggttctggtgccccggtttacctggctgcggttctagaataccttgctgctgaggtattggagttggctggaaatgcagcaagagacaacaagaaaagcaggattatcccaaggcacttgctgctggccgtaaggaacgatgaggagcttggtaaacttctggctggagtgacaattgcgcatggtggagtcataccaaacataaacccggttctgttgcccaagaaatccgacaaggtggctgagaaggcacccaaatccccatcaaaggccaccaaatctcctagaaaagcttaatctgaattttttctttctgaatgtgggattgggataaaataacctttattggtttgtagggattgtgttatcttgtggaattgtaggtgatgatgtttataacttcagtaatttgtacctttaacctttttcttgctatttgttgttaaatctcatgatttaaacttaatgggaaaaaaaaaaaaaaaaaacaaaaaaaaaaaaaagaaaaaaaaaaaactaaaaac

SEQ ID NO: 14603 - DNA, 660 bp, Triphysaria pusilla
aatcatctttgcaccaaaaccaaaaatggaagctactccaaaggcaaagaagggagctgctggaagaaaggccggcggcccaaagaagaagtccgtttcccgatccgtgaaagccggtctccagttccccgtcggcaggatcggccggtttctcaaaaagggtcgctactctcagcgtgtcggttccggtgcaccggtttacatggccgcggttctagagtaccttgctgctgaggtattggagttggctggaaatgcagcaagagacaacaagaaaagcaggattatcccaaggcacttgctgctggccgtgaggaacgatgaggagcttggtaaacttctggctggagtgacaattgctcatggtggcgtaatcccgaacataaacccggttctgttgcccaagaaatctgacaaggtggctgagaaggcacccaaatcaccatcgaaggctgctaagtctccgagaaaggcttagactgagatttttctttctgaatgtgggactgggataaaataacctttattggtttgtagggattgtgttatcttgtggctatgtaggtgttgatgtttataactgcagtaattgtacttttaaccctttctattgctacttttgttgttaaatctcatgatttaaatttaatggaaagattg

SEQ ID NO: 14604 - DNA, 846 bp, Triphysaria pusilla
tctttgcttttcatctgcatacaattttcctcctaaccaatcatctttgcaccaaaaccaaaaatggaagctactccaaaggcaaagaagggagctgctggaagaaaggccggtggaccaaagaagaaatccgtcacccgctccgtcaaagccggtctccagtttcctgtaggcaggatcggtcggtttctgaagaagggtcgctatgctcagcgcgtgggttctggtgccccggtttacctggctgcggttctagaataccttgctgctgaggtattggagttggctggaaatgcagcaagagacaacaagaaaagcaggatcatcccaaggcacttgttgctggccgtgaggaacgatgaggagcttggtaaacttctggctggagtgacaattgctcatggtggagtaataccgaacataaacccggttctgttgccgaagaagtccgacaaggtggctgagaaggcacccaaatcaccatcgaaggctaccaagtctccgagaaaggcttagactgaaatttttctttctgaatgtcggattgggataaaataacctttattcagttattggtttgtagggattgtgttatcttagggttatgtaggtgatgatgtttataactgcagtaattgtacttttaaacctttctattgctacttttgttgttaaatctcatgatttaaatttaatggaaagattttctttttacaaaaaaaaaaaaaaaaaaaaacaaaaaaaaaaaaaaaaaaacaaaaaaaaaaaaaaaaaaacaaaaaaaaaaaaaaaaacaaaaaaaaaaaaaacaaaaaaaaaaaacaaaaaaaaacaaaaaacaaaacg

SEQ ID NO: 14605 - DNA, 646 bp, Triphysaria pusilla
tctaaatctgcttccattctcatcctcttgagtagcttttgtcatttgattttagtaccagagaaaaatggaaaccggagggaaagcgaagaagggagctgctggaaggaaggctggcggtccgaagaagaaatccgtctcccgctccgtgaaagccggtctccagtttccagtcggcaggatcggacgttttctgaagaaggggcgatatgctcagcgcgtgggttctggtgccccggtttacttggcggcggttttggagtacctcgctgctgaggttttggagttggctggaaatgcagcaagagacaacaagaagtcaaggattattcccaggcacttgttgcttgcagtgaggaatgatgaagagctcggtaaactacttgctggagtgacaattgcgcatggtggtgtgataccgaacattaacccggttctgttgccaaagaaaaccgataagggggctgacaaggaacccaaatcgccatcgaaggcaaccaaatctcctaaaaaggcttaaatctaatgttctttgttttgtagagttgtaagtttggttaatgttgcactcatattggtatttaggaaggatatcgtgcttttattgtgttttgtttggatcattatatcaatgaaccgatttgaa

SEQ ID NO: 14606 - DNA, 707 bp, Triphysaria pusilla
cttttcatcttacatacaaatttccccctaaccaatcatctttgtagccgaaccaaaaatggaagctactccaaaggcaaagaagggagctgctggaagaaaggccggcggcccgaagaagaagtccgtttcccgatccgtaaaagccggtctccagttccccgtcggcaggatcggccgatttctcaaaaagggacgctactctcagcgtgttggttccggtgcaccggtttacatggccgcggttctagagtaccttgctgctgaggtattggagttggctggaaatgcagcaagggacaacaagaaaagcaggattatcccaaggcacttgttgctggccgtgaggaatgatgaggagcttggtaaacttctggctggagtgacaattgctcatggtggcgttataccgaacataaacccggttctgttgcccaagaaatctgacaaggtggctgagaaggcacccaaatcaccatcgaaggctgctaagtctccgagaaaggcttagactgaaatttttctttctgaatgtcggattgggataaaataacctttattcagttattggtttgtagggattgtgttatcttagggctatgtaggtgatgatgtttataactgcagtaattgtacttttaaccctttctattgctacttttgttgttaaatctcatgatttaaatttaatggaaagattgctttcc

SEQ ID NO: 14607 - DNA, 681 bp, Triphysaria pusilla
actttgcttttcatctgacatacaattttcttataaccaatcatctttgcagccgaaccaaaaatggaagctactccaaaggcgaagaagggagctgctggaagaaaggccggcggcccaaagaagaagtccgtttcccgatccgtgaaagccggtctccagttccccgtcggcaggatcggccggtttctcaaaaagggacgctactctcagcgtgtcggtcccggtgcaccggtttacatggcggcggttttagagtaccttgctgctgaggtattggagttggctggaaatgcagcaagagacaataagaaaagcaggattatcccaaggcacttgttgctggctgtgaggaacgatgaggagcttggtaaacttctggctggagtgacaattgctcatggtggtgtaataccgaacataaacccggttctgttgcccaagaaatccgacaaggtggctgagaaggcacccaaatctccatcgaaggctgctaagtctccaagaaaggcatagactgagttttttctttctgaatgtgggattgggataaaataacctttattagtttgtagggattgtgttatcttgtggttatgtaggtgatgatgtttataactgcagtaattgtacttttaaccttttttcttgctattttgttgttaaatctcatgatttaaa

SEQ ID NO: 14608 - DNA, 659 bp, Triphysaria pusilla
cctatcccctgatgcgtgtctcagcccaaatctacaagcttgatttcatcttcatcctcttcactaacttctttcattcagagaaaaatggaaaccggtgggaaagtgaaaaagggagccgctggaaggaaggccggtggaccaaagaagaaatccgtcacccgctccgtcaaagccggtctccagtttcctgtaggcaggatcggtcggtttctgaagaagggtcgctatgctcagcgcgtgggttctggtgccccggtttacttggctgcggttcttgagtaccttgctgctgaggtattggagttggctggaaatgcagcaagagacaacaagaaaagcaggattatcccaaggcacttgttgttggccgtgaggaacgatgaggagcttggtaaacttctggctggagtgacaattgctcatggtggtgtaattccgaacataaacccggttctgttgcctaagaaatctgacaaggtggctgagaaggcacccaaatcaccatcgaaggctactaagtctccgagaaaggcttagactgaaatttttctttctgaatgtcggattgggataaaataacctttattcagttattggtttgtagggattgtgttatcttagggctatgtaggtgatgatgtttataactgcagtaa

SEQ ID NO: 14609 - DNA, 758 bp, Tripterygium wilfordii
gacttatggatgccggagggaaggtgaagaagggagccggaggaaggaaaggtggaggtcccaagagcaagccagtttctcggtcggtgaaggccggtcttcagtttccggtgggaagaattgggcgttacttgaaaaaagggaggtactctgagcgagtcggttccggtgctccggtgtatttggccgctgtcctcgagtacttagctgctgaagtgttggagttggcaggaaatgctgcccgtgacaacaagaagaacagaattatcccaaggcatgttctactggctgtgaggaatgatgaggagctcgggaagcttctttctggtgtcaccattgctcatggaggtgttcttcccaacatcaaccctgttctcttacccaagaagtcggacaaggcctccaaagagcccaagtcaccatccaaagctaccaagtctcccaagaaggcctaatttatgacagccattgtagcttgttagtcttttaagatgtatgtatttgggtttaggatttaaatgccattgttctctttaattgtaggaattaaatgtgatcttactggaaacactatttgaacttcgggatctctgttggggatttctgtggaaggtaaatcagtgaaactgcttgtttcttgtttactgtagtctcatttgaagggtctatttctacaatgttgtgatatgctttttggaaattttttgtcaattcagatggtactggatgttggaggaaagaaccttttaatgcttttg

SEQ ID NO: 14610 - DNA, 620 bp, Chrysanthemum coronarium
aatggagggaaccggtaaaattaagaagggagcagcaggaaggaaagctggtggaccccgtaagaagtcagttactcgatccattaaagccggtcttcagtttccagttggaagaattggaaggtatttgaagaaaggtcggtacgctaagcgtgttggtactggtgctcctgtttatctcgctgcggtccttgagtatctcgcagctgaagtgttggaattggcaggaaatgcagcaagggacaacaagaagaacagaataatcccaagacatgtgttgttggcgattagaaacgacgaggagcttggaaagttgttgtctggtgttacgattgctcatggtggtgttttgccgaatatcaacccggtcttgttgcctaagaagactgctgctaaagaatcaacaccaaagtctccatccaaagttggaaagtctcctaagaaaactgctgcttagattgatggtgattgatttgatgtaattgtggtgttttcttttggttgatttcatagagaagttagtgtagtgaatttgattagatgtaatcatttaaattgaatgaaacccactcgtttctgtttattttgccgtgtttaataatttagttgtaaaaccaggc

SEQ ID NO: 14611 - DNA, 828 bp, Arachis hypogaea
ccccccccccccctatcccctgtcgttgccttggtcagtctcagaagcagtggtatcaacgcagagtacgggggaccatcttcatcatcatcactctcttcacacccaaaaaactcatcctttccgtaaactttcttcatggacagccccgccggaaaaaccaagaaaggagccgccggtaggagaggcggtggtcccaagaggaagccagtctcaaggtccgtcaaagccggtctccaattccccgtcggaagaatcggacgcttcctgaagaaaggccgttactctcagcgcgtcggaaccggtgctccggtttacctcgccgccgttttggaatacctagccgcggaggtgttggagttggctgggaatgctgctagagacaacaagaagaataggattattccaaggcatgtgttgttagctgtgaggaacgatgaggagcttggaaaattgcttgctggtgttaccattgctcatggtggtgtccttcctaacataaaccctgttctgttgcccaagaaatctcaaactgctaccaaggaaccaaagtctccatctaagggcactaagtctcctaagaaggcttgatcttatagttgatgatgctaagttgttgttattagtttgttttggaacttttatttttcatgtatatgtatgttgttagatttttctcttagatcagtcccttggaaaagaatgtaatgcttttatggtttaaagttatctcaatgatgtagggttccaaaacgaattgaaagcagctcgtttcaattcattcttgtagctttaataccaattgctatttttgtcctattgtttttt

SEQ ID NO: 14612 - DNA, 769 bp, Euphorbia peplus
cacttatcctatttcctaatcggtttctgtttgtttcccgagaaaaagtgagaaaaattcactcttcctaatttttcatcatcttaacgcgttgagatatggataccggagctaagttgaagaaaggagccggagaaagaaagggaggcggtcctaagaagaagccagtctcaaggtccgtcaaagccggtcttcagtttccggtaggtcggatcggtcgattcctgaagaaaggccggtatgctcagcgtgttggaagcggagctccggtgtacttggccgccgtgctcgagtatcttgccgctgaggtattggagctagctggaaatgcagcaagagataacaagaagaacagaatcataccaaggcatgtgctattggctgtaaggaacgatgaagaactaggaaagctattagctggagtgaccatagctcatggtggagttttaccaaacataaacccagttcttttgcctaagaaagctgaaaaggcagcagcagcagcaaccaaggagcccaaatcaccagccaaggctactaaatcacctaagaaggcttagatctatcatttttaggcatcttgatatcagtccatcgctgtatctaaattgtttttccttttttttaaaatgtaatttggattgtaggacaaagtaatgtgcctttgagcatagtagaatcgtttgtgctctctcttaactcaaatgtagaagattttcttctttgtttctgattaagtaaagtaattgtcatgctgcaaatttttttg

SEQ ID NO: 14613 - DNA, 489 bp, Pennisetum glaucum
ccggcaaggtgaagaagggagcggccggtcgcaaggccggcggacccaggaagaagtcggtgacccggtccgtgaaggctgggctgcagttccccgtcggccgtatcgggcgctacctcaagaagggccggtacgcgcagcgcgtcggcagcggcgcccccgtgtacctcgccgccgtccttgagtacctcgccgccgaggtgcttgagctcgccggcaacgcggcaagggacaacaagaagacgcgcatcgtcccgcgccacgtgctcctggcgttccgcaacgacgaggagctcggcaagctgctggccggcgtcaccatcgcccacggcggcgtcctccccaacatcaacccggtgctgctgcccaagaaggcggcggagaaggtggccagcggcggcgcaaaggagcccaagtcaccgaagaagggcgccaagtcccccaagaaagcttagaaaagcttagaggaactccattaaaatgtttatg

SEQ ID NO: 14614 - DNA, 831 bp, Brachypodium distachyon
aaatcaaatcctcccagcagcagcagaaccaaatctctctcgcttccaattcccgaatcctctcacggtcagaagaaggagatggacggagccggcggcaaggcgaagaagggagccgtcgggaagaagctcggcgggccgaggaagaagtccgtgacgcggtccgtcaaggccgggctccagttccccgtcggccgcatcggccggttcctcaagaagggccgctacgcccagcgcgtcggctccggcgcccccgtctacctcgccgccgtcctcgagtacctcgccgccgaggtgctcgagcttgccgggaacgcggcgagggacaacaagaagacgaggatcatcccgcgccacgtgctgctggcgatccgcaacgacgaggagctcgggaggctactgggcggtgtcaccatcgcgcacggcggcgtgctgcccaacatcaacccgctgctgctgcccaagaaggcggccgagaaggccggcaccgagaaggtggccgccaagtcccccaagaagcccgccggcaagtcgcccaagaaggccgccgccaaggcgtagcagatctgatctcatcgtctccctgtatgtagtttagttctttgatttgtagttgtagggcccgtgtgtgtgtgtgagtgagtgagtgaggtttgatctcttcttgtgctttgccctccaatttaatcgccaaaaggaagccgcttgcttcctgttttatgatatatgcaattgcagcacttctcatcgtgtgctgatgtttcaagggtctttttgaagttcagatttgaaatacagttgatgcaccaagattaaagaaaagaattgttt

SEQ ID NO: 14615 - DNA, 654 bp, Centaurea maculosa
tcaccaaaatcaatcacttgtcaaatatatcaccagagagaaaaaagagagagaagaaatggaaggtaccggaaaagcgaagaagggcgccggtggccggaaaggtggcggtccaaggaagaaggcggtgactcgctctatcagagctggcctccagtttcccgtcggtaggattggccggtaccttaagaacggccgttatgctaagcgtgtaggtaccggagctccggtgtacctcgccgccgtgcttgaataccttgccgctgaagttttggaattggcagggaatgcagcaagggacaacaagaagaacagaataattcctagacatgttctgttggcaattaggaatgatgatgagcttggaaaactgttggctggagtgacaattgcacatggtggtgttcttcccaacataaacccaattctgctaccaaagaagacagctgcaaaggagcctaaatcaccttcaaaagctaccaaatctccaaagaaagctgattaggttatgataatgaatggtgttgtttatgtctgtctgtaatttgtagttaaattggaaatggaatttagttttcttctaaccattgagactgttttagatgttgatgttgattatatgttggtatggatcagtttcaatgcaagaaaccc

SEQ ID NO: 14616 - DNA, 721 bp, Medicago truncatula
acaacaattagaattatcaccacttaaaagcttccatttcacaccgaattcgtagcaaaaaagttagggttccaaattccaatctcagaaatggacgcaagcaccaagacgaagaaaggagctggtggaaggaaaggtggaggaccaaggaagaagtctgtgaccagatccatcagagctggtcttcaatttccagttggaagaatcggtcggtacttgaagaaaggaagatacgctcagcgtgttggtactggtgctcctgtttacctcgccgctgttcttgaatatcttgctgctgaggttcttgaattggctggaaatgcggcacgtgataacaagaagaataggataattccaaggcacgtgttgttggcagtgaggaatgatgaagagctaggaaaattattagctggagttacaattgcacatggtggtgttcttccaaacatcaaccctgtgcttttgcctaagaagactgaaaggtctaacactgttagcaaggaaccgaagtctcccaagcctaaggctggaaaatctccaaagaaggcttagatttaggtttcttatggttgatgtttattttgtgtgtataattccgctttaggttggtgttttgtaactggaaggtgtaatgcgtttgaagtgatgtaatttggaagcctctggcttcttttttagtattaatgtgaactttcagtagaaataatatttggcttaaatt

SEQ ID NO: 14617 - DNA, 818 bp, Helianthus annuus
aaacccaaaacaaattcatccataatttctttcttccgagcattttagtgatggagtcaactggaaaggtgaagaagggagccgcaggaaggaaagccggcggtccaaggaagaaggcggtcacccgttcagtcaaagccggccttcagttcccggtcggtagaatcggccggtttttgaagaaaggtcgttatgctcaacgtgttggatccggtgcacccgtctaccttgctgctgtcctcgagtacctagcagcagaagtgttggagttggctgggaatgcggcaagggacaacaagaagaacagaataatcccgagacatgtgttgttagccattaggaatgatgaggagcttggaaagcttttggctggagttacgatcgctcatggtggtgttttgcctaacattaacccgattcttttgcccaagaagactgccgctaaagaacctaagtctccatcaaaagctactaaatctcccaagaaagcaaagtagattagttagatatgtttgtcttttgtcttttgtttgtctggttttagagtagtttatatgttcagatgtgttcaacctctagaagaatgaaacgacttgttttttaattttggggtattttattgtcttaaatttttatgtagttgtgtttgattgcaaattgtgagacgatggatatctagacatgatgaattggcctttttgtatggagtaattttcactatagcaaacgcaaggttgcagttgtttcatgttgcatgttatgtgttcgatgaaaacattgattcttttttagtagaacatgatataattacctccttt

SEQ ID NO: 14618 - DNA, 558 bp, Helianthus annuus
aaacaaattcatccataatttctttcttccgagcattttagtgatggagtcaactggaaaggtgaagaagggagccgcaggaaggaaagccggcggtccaaggaagaaggcggtcacccgttctgtcaaagccggtcttcagttcccggtcggtagaatcggccggtttttgaagaaaggacgttatgctcaacgtgttggatccggtgcaccggtttaccttgctgctgtccttgagtatctagcagcagaagtgttggagttggctggaaatgcggctagggacaacaagaagaacagaataatcccgagacatgtgttgttggccattaggaatgatgaggagcttggaaagcttttggctggagttaccatcgctcacggtggtgttttgcctaacattaacccgattcttttgcccaagaagactgccgctaaagaacctaagtctccatcgaaagctaccaaatctcccaagaaagcgaaatagtttagttagatatgttgttttagtttaattcatatggtcagatgaatgaaaccacttgtttcgttttt

SEQ ID NO: 14619 - DNA, 2326 bp, Musa acuminata
gggtttgtccaaaccggcacgaagcgcaacgccgagtagatggaggcgaccgggaagggcaggaaaggcgccggcggtcggaggggcggaggccccaagaagaagccggtctcccggtcggtgaaggccggcctccagttccctgtgggccgtatcggccgctacctcaagcaaggccgttacgcccagcgtgtcggcactggcgcccctgtctacctcgctgccgtcctcgagtacctcgccgccgaggtgttggagttggccggaaacgcggcaagggacaacaagaagaaccggatcattccgcggcatgtgctgctggccatcaggaacgacgaggagctggggaagcttctcgccggcgtgacgatcgcccatggcggggtgcttcctaacatcaaccccgtgctcttgccgaagaagaccgcgaacaaggaacccaaatcgcccgccaagcccgccagcaagtcgcccaagaaggcttagtggggcgttggatccttcaagtctcctctttgctctctctttgtgtgtgattctgtggttatattagcttctttttcttccttgctttcttttgttggggtagtggaatgatgggtcgaatctggaaaagggggagagctttgtttgtatctgtcgtggttgcttttccttgctggggattttagacgaacaaagcgtttgaattgtggaacctacgactctctaatggggaatttgaagtgttctcgttgcaaatcataagatctgttgcaattgggaaggggaaagatgggaatttggtttcaggaattgaggccattgctgtgtgaaagtgtcctctgcatttgagttcttactttataccagttagtgttccatgcttttctgctttctcatggtcttgcttcttcgtgagttctcctcattggagtgcctgaggtgcaccctctggttattagtaagtagtacagaagcaaacaaactttgttgattctttctatgtcatagtatatattgtgtggtctgatgtttgcagtctattgttcattttgactattggattacctaaagttggtgcttgaaatcatagcacaaattccaaatatgtagctttatctgtgttccatgttatgttgccacatcagtctagactcttgtgatccaggcagggtcatgtagtagctagattcacttgaccaatgagtggtggaagagttcatgcaatcaattcatgtttgccaaatgggcttttgtttctactccttccattttctttagtgataatactaagtattttggagcttgttattgtttcattagcacttgaaacaattgtctaaatgtctttggttaatagactttagcttattatggtcagtaatttaatgttggatcacttacagtctgaatcacttgctttaccaatccagtccgaaagattcattggttgtttggcacttgtatcataacatctgtttctcacttgattattacaagctgcttgtcaatcatatgtttgggactatctgtttgatattccaatatgtaaatgatgattatattgtttctacaacaagtgttttcttttttttgcgtatataaacccacgcctccgttctcctccgctttcgcttacgttgtcgagtttagggtttggggcggttctccgcgttggcgagatccttcttcccgaggcttgaccaggatggtgagaatcagcgttttgaatgatgctctcaagagcatgtacaatgcagagaagcgtggaaagcggcaggtcatgattagaccatcatctaaagtgattattaagtttctccttgtaatgcagaagcatggatatattggtgagtttgaatacgtggatgatcaccgggctggtaaaatagttgttgagttgaatgggagactgaacaaatgtggtgtgattagccctcgctttgatgtgggcgtcaaagagattgagccttggactgccaggctactcccatcacgtcagttcggttacattgtgttgaccacatctgctggaatcatggatcacgaagaagctagaagaaagaatgttggtggtaaagtgctcggcttcttttactagatgggcttttttttttatgaggctgcagatcataaatgtaatcctggtgagaacgtggtaattttggattatggtatccgtcttctctgtcagctcctggatctggagtccatattgaacaagtcagatactccatttcaaagtagacctgattgattctgcttccaatagtttattatcttaatacttaatcacgaaaaaaatttaaatgtgttttagttcttggtaatacataatttcaac

SEQ ID NO: 14620 - DNA, 634 bp, Hordeum vulgare
aatcctcccccgagcagcgaatcccaggagcatcacctgctaccagcaatggacgtctccggcgctgcagcgaaggggaagaagggcgcggccgggcgcaaggccggcggcccgaggaagaagtcggtgacgcggtccgtcaaggccgggctccagttccccgtcggccgcatcgggcgctacctcaagaagggcagatacgcccagcgcgtcggcaccggcgcccccgtcttcctcgccgccgtcctcgagtacctcgccgccgagctgctggagctcgccgggaacgccgccaaggacaacaagaagagccgcatcatcccgcgccacctgctgctcgccgtcaggaatgacgaggagctcggcaagctgctggccggcgtcaccatcgcgcacggcggcgtgatccccaagatcaacccggtgctgctccccaagaggaccgcggagaaggagggcaaggagcccaagtctcccaagaaggccaccaagtcccccaagaaggccaccaaggcttagagcgatgcgttccatatcgtagattgttgcagtgctcttcgtagtcgcccggtggtgttcctgtagcggtgtcgttttatcttgtagtaatgtgcatgtttaatggaagaacgtc

SEQ ID NO: 14621 - DNA, 851 bp, Chrysanthemum coronarium
tttcacccatcaacacaaaaaccatataaatatccccacatcccatcctcacattcccacatcttcatcttcatttcatcttcatccaaacaaacaatcttttatctttctaaaaatggaaacaggtggaaagaaaaagggagcagcagggaggaaagggccaggaggggggccaaggaagaagtctgtgacaaggtctgtgaaagctggccttcagtttcctgttgggaggattggaaggtatttgaagaaggggaggtatgcgaaacgtgtcggaactggtgctcctgtttatcttgctgctgtccttgagtatcttgctgctgaggttttggagctagctggaaatgctgctagggacaacaagaagacaaggatcataccaagacacgtcttgttggcgataaggaatgacgaggagctaggaaagcttttgtctggtgtgactattgctcatggtggtgttcttcccaacattaacccggttttgttgcctaagaagagtgccacaaaggaatctacccccaagtctccagcgaaggcggccaagtccccaaagaaagctgctgcttagttattgaagaaatgtgactcttgttgtatgggtggtgtaggttgacttgactttatctcgttgtagggttatgtaggagaattgtatgctggtttgtttatgttaggacctaggtatgaagaagaatctctcttctttgttatcagaattgttagtttccgattgtatgaaaatgtgtaatcatcagtttgaatgagtactacatttgattgcaaaagacggtgaagtttctcagagctgttttatgttcatttccttgattaaatctttgatgcgg

SEQ ID NO: 14622 - DNA, 738 bp, Cucumis melo
cgtgtctcagcggaaaattttctcttccaatggattctggcggcaaggcgaagaaaggcttcgccggcagaagaggcggtgccggtcctaagaagaagcctgtctctcgctctgtcaaagccggcctccagtttcccgtcggcagaatcggtcgctacttgaagaatggccgttactctcaacgagtcggaaccggcgctccggtttaccttgctgctgtgcttgagtacctcgctgctgaggttttggaactggctgggaatgcagcaagagacaacaagaaaaacaggatcatcccgagacacgtgctcttggctgtgaggaatgacgaggaactcgggaagcttcttgccggggtgacaattgctcatggtggggtgcttccgaacatcaacccagtccttcttccaaagaaatccgagagggcagggacggcagcaaaggagcctaagtctccctccaagggtaccaagtcccccaagaaggcctagcttagcttaagttctaatatgctccacgactactcaatttctgtatttagattggagctatcttcatgtttaggaccgccttttatctgtttgtgcctttatatattgtagtatattcctttgtgttatcccaaatctcagttgaaatgatgtaagttttaacatctcttatgaatgtttgtatcttctccactgatgggttaatgtatgtagaaggctttctgagatggattgaatgattggatca

SEQ ID NO: 14623 - DNA, 668 bp, Tropaeolum majus
agattataatcccgattcatatattcagttctaaatttctcaaaaattcatcaaagttcttcgtagatctccaatccacctttaacatggacactgccgggaaagcaaagaagggcgccggaggaaggaaaggcggaggtcccaagaagaaggcggttacaaaatctgttagggcaggacttcaattccccgtcggtagaatcggtcgttatttgaagaagggaagatatgctgctcgtgttggtaccggagctccggtatacctggctgccgtgctcgagtaccttgctgctgaagttctagagcttgctggaaatgcagcgagagacaacaagaagtccagaatcatcccaaggcatctattgctcgctgtgaggaacgatgaagagcttggaaaattgctctcaggtgttactatcgctcatggaggtgttcttcctaacattaaccctattctattgccgaagaagactgataaggctgaacctaaaccaaaggcaggaaaatcgccaaagaaagcctagacatggattttacaaggctagatctgtgaattattgtttctagggattacagttaatgtattattttgatgtttttgtttgattgtattggtgtagatctggcttgtttggcaacatgaaatcgaaaccgcttgtttctatctt

SEQ ID NO: 14624 - DNA, 772 bp, Papaver somniferum
ctccaaattgtttctctcagctagactttcttttagggcaaaaggtaaattgaagtcatggagacaccaggaggaaaagcaaagaaaggatttgcaggaagaagaggtggtggtcctaaaaagaaagcagtcacaagatcagtcaaagctggtttgcaattcccagttggtagaatcggaagatatctgaagaaaggtcgatatgctcaacgtgttggtagtggtgcccctgtttatctcgccgcagttcttgaatacctcgcagctgaggtattggaattggctggaaatgctgccagggataacaagaagacaagaattataccaaggcatgttttattagctgtaagaaatgatgaagaacttggaaagcttttatcaggtgttaccattgctcatggaggagttttgccaaatatcaacccaattttattgccaaagaaaactgctgagaaagcagctactggtggttctaaagagccaaagtctccaaaagctggaaaatcacctaagaaggcataattgtagaaacctagttaatgtttatgttgtatcttgccattttttgtatgtaatttttgtgtttccctttatattttcttgggtctgttgttagttaggtcttgttgttagttaggtcttgttgtttaatctgtaagtggtacatggtttggtgaatctttggatgttggttgtagtactctttttaatcatcttgttgaaatgaatgtttatcttcctataaatcaatgaatttgtctactctttgata

SEQ ID NO: 14625 - DNA, 830 bp, Sesamum indicum
agccgttccgccagggagatactctctcctctcccagttgtagttaccattttgcctctctctgtacccctagtctcaagggctgaataatcgtttcatggacgccgccggaaaagtgaagaagggcgctggaggaagaaagggcggcggcccgaagaagaagcctgtttccaggtctgtcagggctggtctgcagttccctgttggtagaatcggacgttacttaaagaaaggacggtatgcccagcgggttggcaccggagctccggtttacatggctgccgttctcgagtatttagctgctgaggtactggagttggctggaaacgcggcgcgagataacaagaagaacaggattataccgaggcatgtgctcttggctgtgaggaacgacgaggagcttgggaagctgctgcagggtgtgaccattgctcatggtggtgtgcttccgaacatcaatccggtgctgttgccgaagaaaacagggggagataaggctaccaaggagcccaagtcgccgtccaaggctggcaagtcaccgaaggcggctgcttcttagttacaaatggatgtgaatcacaaagcttttatctcttttgtgtaatttttggcttaaatagactgctctcagtagattcaaatgggtgtggcttagagagactgctctcagtagatttggaaggaaagagaaatgtaaggttgtaattctgtgtttagggccaatgtggagtgtgaatccagttgattaaaccacattttcgtcttcctttactcttgttatttttcctaattccttgcttcgactttgggtctttgagattagtttggta

SEQ ID NO: 14626 - DNA, 616 bp, Helianthus annuus
aacaaattcatcaataatcaccaatttctataaaccattttagagatggagtcaaccggaaaggtgaagaagggagccgcaggaaggaaggccggcggtccaaggaagaaggcggtgacccgttcagtcaaagccggtcttcagttcccggtcggtagaatcggccggtttttgaagaaaggtcgttatgctcaacgtgttggatccggtgcaccggtctaccttgctgctgtccttgagtacctagcagcagaagtgttggagttggctggaaatgcggcaagggacaacaagaagaacagaataatcccgagacatgtgttgttggccattaggaatgatgaggagcttggaaagcttttggctggagttaccatcgctcacggtggtgttttgccgaatattaacccgattcttttgcccaagaagactgctgctaaagaacctaagtctccatcgaaggctactaaatctcccaagaaagcgaaatagtttagttagatatgttgttttagtttaattcgtatggtcagatgaatgaaaccacttgtttcgtttttattttttttggtgtttattgtgttaaatttatttttatgaatttctaagctaaaaa

SEQ ID NO: 14627 - DNA, 520 bp, Helianthus annuus
ttttagagatggagtcaaccggaaaggtgaagaagggagccgcaggaaggaaggccggcggtccaaggaagaaggcggtgacccgttcagtcaaagccggtcttcagttcccggtcggtagaatcggccggtttttgaagaaaggtcgttatgctcaacgtgttggatccggtgcacccgtctaccttgctgctgtccttgagtacctagcagcagaagtgttggagttggctggaaatgcggcaagggacaacaagaagaacagaataatcccgagacatgtgttgttggccattaggaatgatgaggagcttggaaagcttttggctggagttacgattgctcatggtggtgttttgccgaatattaacccgattcttttgcccaagaagactgctgctaaagaacctaagtctccatcgaaggctaccaaatctcccaagaaagcgaaatagtttagttagatatgttgttttagtgtaattcatatggtcagatgaatgaaaccccttgtttcttt

SEQ ID NO: 14628 - DNA, 495 bp, Helianthus annuus
acccaaaacaatttcatccttaatttctttcttccgagcattttagtgatggagtcaaccggaaaggtgaagaagggagccgcaggaaggaaagccggcggtccaaggaagaaggcggtgacccgttcagtcaaagccggtcttcagttcccggtcggtagaatcggccggtttttgaagaaaggtcgttatgctcaacgtgttggatccggtgcaccggtttaccttgctgctgtccttgagtacctagcagcagaagtgttggagttggctggaaatgcggctagggacaacaagaagaacagaataatcccgagacatgtgttgttggccattaggaatgatgaggagcttggaaagcttttggctggagttaccatcgctcatggtggtgttttgcctaacattaacccgattcttttgcccaagaagactgccgctaaagaacctaagtctccatcgaaagctactaaatctcccaagaaagcaaagtag

SEQ ID NO: 14629 - DNA, 726 bp, Vinca minor
taatcaaagtttattactgaaaattgatatggagactggaggaaaagtgaagaagggtgccgctggaaggaaaggaggtggcccaaagaagaagcccgtttctaggtcttctagggctggactgcaatttccggtcggtagaattggtcgttacttgaaaaaaggtcgctattctcaacgtgttggtaccggtgctccggtttatatggctgccgtccttgagtatttagctgctgaggttcttgagttggctggaaatgcagcaagggataacaagaagaacagaataatcccaaggcatgtgcttttggcaattaggaatgatgaagagcttggaaagttgctgtctggtgtgacaattgcacatgggggagtgttaccaaacattaacccaatcttgttgccaaagaagactgataaggctggtgctaccaaagaacccaagtctcctgctaaagctgctaagtctcctaagaaggctgctgcttaggtttgtttatttaatttggattaggcttttgtttttagtgccctttgtgttttgaggaatctttagttatggtggttgtgtatgtattctgggttagaacttctttagccttaatgttataggaggaggattaggtattgtacttcttagtttgtgatttaggagtagcaatttcaatatgaatgaatggacttatttggtctttttaatatttcttaaccaaattaatgcttttg

SEQ ID NO: 14630 - DNA, 781 bp, Triticum aestivum
aatcccaaatcaccaaccaattccccttccctcctctcccgcgtcccgacgagcaccggccgccagacatggacgcctcagccaccggagccggagcgaaggcgaagaagggcgcggccgggcgcaaggccggcgggcccaggaagaagtcggtgacgcggtcggtcaaggccgggctccagttccccgtcggccgcatcggccgctacctcaagaacggccggtacgcgaagcgcgtcggcacgggcgcccccgtctacctcgccgccgtcctcgagtacctcgccgcggagctgctggagctcgccgggaacgccgccaaggacaacaagaagtctcgcatcgtgcccaggcacctgctgctggccgtccggaacgaccaggagctcgggaggctgctggccggcgtgaccatcgcgcacggcggcgtgctgcccaacatcaacccggtgctgctgcccaagaagaccgcggagaaggagcccaagtcgcccaagaaggccgccaaatcccccaagaaggccgacaagaaggcctagagagagacgcgcacccattagcctaggcgttgtagtgctctgtagtgacagtgatcgctgtttcgatgtagatctgtgttgaaaatgtcagaaatctctctgatttgaggaaattgtttgttcttcttcatttttggcgttgcaatgttaacataggtgcggtggaaaaacccagatctgttcgaatttgtcaacgtttattcgcttgtggtactgaattcgcgtgtggggtgttttccttg

SEQ ID NO: 14631 - DNA, 724 bp, Triticum aestivum
cccaaactaccaacccgatccctcctccccctcgtcccgacgagcaccagcggccggccatggacgcctcagccaccggagccggagcgaaggcgaagaagggcgcggcggggcgcaaggccggcggccccaggaagaagtcggtggcgcggtccgtcaaggccgggctccagttccccgtcggccgcatcggccggtacctcaagaacggccggtacgcgaagcgcgtcggcacgggcgccccagtctacctcgccgccgtcctcgagtacctggccgcggagctgctggagctcgccgggaacgccgccaaggacaacaagaagtcccgcatcgtgcccaggcacctgctgctggccgtgaggaacgaccaggagctcggcaggctgctggccggcgtgaccatcgcgcacggcggcgtgctgcccaacatcaacccggtgctgctccccaagaagacggcggagaaggagcccaagtcgcccaagaaggccgccaagtcccccaagaaggccgacaagaaggcctagagagaggcgcgcatcgattagcttgccgtgctttgtagaactaatggtttcgatgtagatctgtgctgccaagaaagaacaattcagaaaacctctattcgattggtttagccgctctagtgctctgtagtaacagtgattgctgtgccgatgtagatctgtgctgcgaagaggaaaatgccagaaatctctct

SEQ ID NO: 14632 - DNA, 753 bp, Rosa hybrid cultivar
aaaatctcccaattctttctctccaatttgtgaattctctctcaaaagggtttcagattcagtgctcagattaggttgaaatggagactggcggtggtaagatcaagaagggcgccggaggaaggaagggtggtggccccaagaagaaggcggtgacccgctccgtcagagccggcctgcaatttccggtcggtaggattggccgttacttgaagaagggaaggtatgctcagcgtgtcggctccggagctccggtctacttggccgccgtgcttgagtacctcgcagctgaagtgctggagttggccggaaatgcggctcgggacaacaagaagaacaggattatcccaaggcatctgttactggctgtgaggaacgatgaggaacttggaaagcttcttgctggggttactattgctcatggaggtgtgctacccaacatcaacccaattctgctacccaagaaggctgagaaggctggaggagttgccaaggagcccaagtccccatcgaaggctggcaagtcacccaagaaggcggcggcatagattctgtgaatggttgcatgtttagggtttagtttgaattggtccatttgtatgtaatcaatctcagtatccaggatgttgcttttgttatttgtagggaaaattccaaggaaatttaaagcttttgttatcgttacatgttagtgttcatcatcaagtctaggaactttttggatttggtttgagatttgatcaatgaaacccc

SEQ ID NO: 14633 - DNA, 686 bp, Medicago truncatula
atcaaattctcaattcaaaccttcttcgcattcaaattttctttttctctcaaaatttttctcagtttgaaatggaggcaagcaccaagacaacaaagaagggagccggtggaaggaaaggaggaggtccaaggaagaagtcggtgacaagatcaatcagagccggtcttcaatttccagtgggaagaatcggtagatacttgaagaaaggaagatacgctcagcgtgtaggcacaggtgctccagtatacctagcagcagttcttgaatatctcgctgctgaggttcttgagttggctggaaatgcagcacgtgataacaagaagaatagaatcattccaaggcatgtgttgttggctgttaggaatgatgaagaacttggtaaattgcttaatggtgttaccattgctcatggtggtgttcttccaaacattaaccccatcctcttgcctaagaagactgaaaaaactgctcctaaggagccaaagaaggctggaaagtctccaaagaaggcttagatctgatctgttttcaatctttagatgattgtgtttatatctaagactagggttactttatgtgatataaatcggttttagtgctttcatataatgtaactccatcttattgcatttctcctttaggacttttatctatcaatgaaatttattcaatttcaatattat

SEQ ID NO: 14634 - DNA, 573 bp, Helianthus annuus
agcagtttctctattttcatctttttctttttcaaatggagtccaaaaagggtgccggtggcagaaaggcaggtggtcctaagaagaaaccggtttcccggtccgtcaaagcgggtctccagttccctgttggcaggctcggtcgttacctcaaaaaaggccgctatgcacagcgtgtaggaaccggcgctccggtctaccttgccgccgttctcgagtaccttgccgctgaggttttggagttggcgggaaatgcagcaagggacaacaagaagaacaggattatcccgagacatgttttgttggcggtgaggaatgatgaagagcttggaaagcttctagcgggtgtgacgattgctcacggtggtgttcttcccaatattaacccggttcttttgccaaagaaggctgctgcaaaggaggctgcaaaagtgactaaatcaccaaagaaagcctagtgtttgtggttcaactgttctagaattttgggtttttgtgtaattaggaaacacaatttgatggatggtttattttaggttgatgtaatgtaacgaaatgaaatgaaatggcaac

SEQ ID NO: 14635 - DNA, 777 bp, Lactuca sativa
aaccaaaccatgtcaacacctgttcttcatccataacgaagcatctgctcatttctccctgtttattcatcgctaaaagaaaatggaaggcgcagcaaagtcaaagaagggtgccggaggaagaaaggccggtggtccaaggaagaaggcggttacccgctctgtcaaggccggacttcagtttcccgtcggtagaattgggcgttttctgaagaaaggacgttatgcgcagcgtgttggcagcggtgctccggtttacctcgccgctgttcttgaataccttgctgctgaagtgctagagttggctggaaatgctgccagggacaacaagaagaccagaatcattccaagacatcttctgttggccattagaaacgatgaagagcttgggaaattattgggtggagttacgattgctcatggtggtgttcttccaaatatcaatccaattctattgccaaagaagactgctgccaaggagccttcaactccatctaaagcagctaaatctccaaagaaagctaaaaaggccgagtagattatgacattagaatttgtagttctgtttggataagattatagtaaaagtttgtattctgatgttgatcaaggtttagtgaatgaaacgacttgtttcttataattgttgcaacgtgggccttcttattatattcactattttccaaataatgccaattgagatttagttatttaactcacttgtttttttattgctgttgtaattatctaatccgcaaagcacatttgttagcatgt

SEQ ID NO: 14636 - DNA, 606 bp, Cichorium intybus
aatggagggagccggaaaagctaagaaaggtgccggaggaagaaagggaggcggtccaaggaagaaggcggtttcccgttctgtcaaagctggtctgcagtttccagttggtaggattggacgttttctgaagaacggacgttatgccaagcgtgtcggaactggtgctccggtttacctcgccgctgtccttgaatacctcgctgctgaagtgctagaattagctggaaacgccgctagggataacaagaagagcagaataattcctagacatcttctattggccataaggaacgatgaagagcttgggaaattactgggtggagttacgattgctcatggtggtgttcttccaaatataaaccctgttctattgccaaagaagacagctgccaaggagccttcaactccatctaaagctgccaaatctcccaagaaagctaaaaatgctgagtagattagttgtttgaatcgtatctttttgttctggttcacaagattagtgtatttagcgtttacgaaaaaatgaactagcttgggaagaattgtatttcaatgatgtatttttaccaaaatacgtaatgataaacacccaaaatagattac

SEQ ID NO: 14637 - DNA, 604 bp, Centaurea maculosa
gaagaaatggaaagtaccggaaaagcgaagaagggagccggtggccggaaaggtggcggtccaaggaagaaggcggtgactcgctccatcagagctggcctccagtttcccgtcggtaggattggccggtatcttaagaacggccgttatgctaagcgtgtaggtaccggagctccggtgtacctcgccgccgtgctggaataccttgccgctgaagttttggaattggcagggaatgcagcaagggataacaagaagaacaggataatccctagacatgtgctgttggcaattaggaatgatgatgagcttggaaagcttttggctggagttactattgcacatggtggtgttcttcccaacataaacccaattctgctaccaaagaagacagctgcaaaggagcctaaatcaccatcaaaatcaacaaaatctccaaagaaagctgattaggttgctttattaaatgaatggttgttgtttatggctgtctgtaatttgtagttaaattggaaatggaatttagttttcttctaaccattgggcctgttttagatgatgatgatgattattatatgttgttatggatcagtttcaatgcaag

SEQ ID NO: 14638 - DNA, 731 bp, Elaeis guineensis
ctcccttctcgtgctataaaataacccctcgtcgtcaggcaaccggtaatttctggaggatcggaagcgaaagagatcaccggagaggagagagatggagatcgggggcaagctcaagaagggtgctggtggccggaggggtgggggtccaaagaagaagccggtctcccggtccgtcaaggccggtctccagttcccggttggccggattggccgctacctcaagaagggccgctactcccagcgcgtcggaaccggagcccctgtctacctcgccgccgtcctcgaatacctcgccgctgaggttctggagctggccgggaacgcggcgcgggacaacaagaagaaccggatcatcccaaggcacgtgcgtgctggcggtgaggaacgacgaggagctggggaagcttctcgctggggtgaccatcgcccatggaggggttctgcccaacattaacccggtgcttcttccgaagaagaccgggagcaaggagcccaagtcgcccaccaaggccaccaagtcccccaagaaagcttaggaaccgttgacccttgtgttgttattcctgctttcttaattctgtatgtaattctgtggatccgttttaggttgttttcttcttttgtttggtgtaggggatggtgtaatgaggaggaggggacgagacttggaaaaaaaggatttgtatcaattctctttcgttgcaggaaatgttaaagatggtgttttt

SEQ ID NO: 14639 - DNA, 668 bp, Secale cereale
gactcagcagtcaggcaatcccccacacacatctctccacttcgcgaatcctttccccagctcgccatggacgcctcagccaccgtagccgccgggaaggggaagaagggcgcggccgggcgcaaggccggaggccccaggaagaagtccgtgtcgcggtccgtcaaggccgggctccagttccccgtcagccgcatcgggcgcttccttaagaagggccgctacgcgcagcgcgtcggctccggcgcccccgtctacctcgcggccgtcctcgagtacctcgccgccgagctgctcgagctcgccggcaacgccgccaaggacaacaagaagagccgaatcatcccccgcacctgctgctcgccgtcaggaacgaccaggagctcggcaggctgctcgccggcgtcaccatcgcccacggcggcgtgatccccaacatcaacccggtgcttctccccaagaagacggccgagaagtcccccaaggagcccaagtcgcccaagaagacagccaagtcccccaagaaggcgtaggtggccattgcttagttatgtctgtgtagctggaatggatgtatgtgcgtgcttcagctcgaagcagagtgttcttgttgtgtcgttgtatcttctgatcttggatttcaatggaacaatgagttgctttgaatt

SEQ ID NO: 14640 - DNA, 700 bp, Euphorbia esula
aaaatcaaaccttcatttcttgcttttatttgaatctacaaattcgtcggatatatttagcgagatggatagcactacagtgaagaaaggtgccggaggaaggaaaggtggaggccccaagaagaagcctgttaccagatctgtccgagctggtcttcaatttcccgttggtagaatcggaaggtatttgaagaaggggagatatgcccaacgagttggaaccggagctccggtctacttagctgcagtccttgagtacctagctgctgaggtgctggaattggctggaaatgcagcaagagataacaagaagaacaggattatacctagacatgtattgcttgcagtgagaaatgatgaagagcttggaaagttactggctggtgttacaattgctcatggaggtgttcttccaaacataaaccctattcttttgcccaaaaagacagagagatctgccgctgcagccaaggagccaaaatctcccgctaaagctgctaagtctcccaagaaggcataagtagtgtttgattagtcagcttaggtgttctgcttgtttatgtaatttgaatgtattttgggaagtaggcataaatcagatgaagtcagagccatgtttagctgtttatttagcctgtgtaatactctgttaaaatttaacatttgaagtcaatgaatgaaagtcccagtttcttgtttc

SEQ ID NO: 14641 - DNA, 687 bp, Euphorbia peplus
catttcttgcttttatttgaatctacaaattcgtcggatatatttagcgagatggatagcactacagtgaagaaaggtgccggaggaaggaaaggtggaggccccaagaagaagcctgttaccagatctgtccgagctggtcttcaatttcccgttggtagaatcggaaggtatttgaagaaggggagatatgcccaacgagttggaaccggagctccggtctacttagctgcagtccttgagtacctagctgctgaggtgctggaattggctggaaatgcagcaagagataacaagaagaacaggattatacctagacatgtattgcttgcagtgagaaatgatgaagagcttggaaagttactggctggtgttacaattgctcatggaggtgttcttccaaacataaaccctattcttttgcccaaaaagacagagagatctgccgctgcagccaaggagccaaaatctcccgctaaagctgctaagtctcccaagaaggcataagtagtgtttgattagtcagcttaggtgttctgcttgtttatgtaatttgaatgtattttgggaagtaggcataaatcagatgaagtcagagccatgtttagctgtttatttagcctgtgtaatactctgttaaaatttaacatttgaagtcaatgaatgaaagtcccagtttcttgtttc

SEQ ID NO: 14642 - DNA, 730 bp, Festuca arundinacea
acaacacattctgcagtccaccaatctcaccagcacttcttgccctttgggagctccatctctatcaatggacgtctcaggaaccggagccggagtgaaggggaagaagggcgcttctgggcgcaaggccggcggccccaggaagaagtccgtgacaaggtcggtcaaggccgggctccagttcccggttggccgcatcgggcgctacctcaagaagggccggtacgcccaacgtgtcggcaccggcgcccctgtctacctcgcagccgtccttgaatacctcgccgccgaggtgctagagctcgccgggaacgccgccaaagacaacaagaagtcacgcatcatcccgagacacctgctccttgctgtcagaaatgatgaggagcttgggaagctgctggctggcgtcaccatcccgcacggtggcgtgctgcccaagatcaacccggtgctgctccccaagaagacggcggagaaggctgccaaggagcccaagtcactaaaggaggcagccaagtccccgaagactaggattgggtggattaattgagcactggttgctgtggtgccctttggcatgccagtgaatgttggtatttctgagaggaaactgtgttgaagttacatgatgtgacagagaacaaagtgcggccatatgtaacacgaatttgttatgaactaaaactagctcaagaagtaagaagacagcttgaaaaaaaaaaaaaaaaaa

SEQ ID NO: 14643 - DNA, 584 bp, Avena sativa
gtctcaagcacagcaaccggcgggaaggcgaagaagggagcggccggtcgcaaggccggaggccccaggaagaagtcggtgacgcggtcggtcaaggcggggcttcagttccccgtaggccgcgtcggtcgctacctaaagaagggcaggtatgcccagcgcgtcggcaccggcgcccccgtctacctcgcggcagtcctcgagtacctcgccgccgaggtactggagcttgccgggaacgccgccaaggacaacaagaagtcgcgcatcatcccaaggcacttgctgctcgctgtcaggaacgacgaggagctcggcaagctgctcgccggagtcaccattgcgcacggaggcgtgctgcccaagatcaacccggtgcttctccccaagaagacggccgagaaggccgccaaggagcccaagtcacccaagaaaaccgccaagtccccgaagaaaactgccaaatctccgaagaaggcgtagagattggttgcattcctttgtttgttgctgcatttcttcagagtagttcgttgttgtttgtctggtggtgtcgctgtaccttctgatctgtaatttcaatg

SEQ ID NO: 14644 - DNA, 665 bp, Secale cereale
tcagcagtcaggcaatccccacacacatctctccacttcgcgaatcctttccccagctcgccatggacgcctcagccaccgtagccaccgggaagggcaagaagggcgcggccgggcgcaaggcgggcggccccaggaagaagtccgtgtcgcggtccgtcaaggccgggctccagttccccgtcagccgcatcgggcgcttcctcaagaagggccgctacgcgcagcgcgtcggctccggcgcccccgtctacctcgcggccgtcctcgagtacctcgccgccgagctgctggagctcgccggcaacgccgccaaggacaacaagaagagccgcatcatcccccgccacctgctgctcgccgtcaggaacgaccaggagctcggcaggctgctcgccggcgtcaccatcgcccacggcggcgtgatccccaacatcaacccggtgctgctccccaagaagaccgccgagaagtcccccaaggagcccaagtcgcccaagaggaccgccaagtcccccaagaaggcgtaggtagccattgctcggttatgttgtaatagctgggatggatgtatgggcgtgcttcagctcgaagcagagtgttcttgctgtgtcgttgtatcttctgatctgtgaattcaatggaacaatgagttgctttggtaa

SEQ ID NO: 14645 - DNA, 566 bp, Helianthus annuus
cccaaatggaaaccaccggaaaagctaagaagggtgccgcaggtcgcaaagccggcggtccaaggaagaagtccgtcacccgctccgtcaaagccggtctccagtttcccgtcggcagaatcggccgttacctcaaacacggccggtatgcaaagcgtgtcggtaccggtgctccggtttacctcgccgccgtcttggaataccttgcagctgaagtgttggaattggcaggaaatgcagctagggataacaagaagaacaggataacaccgaggcatgttttgctggcgataaggaacgatgatgaattgggaaagttgttggccggagttacgattgctcatggtggtgttttgccgaacattaacccggtgttgttgccgaagaagagtgctgctgctgcgaaagagcctaataagtcgcctgctaaaactacaaagtctcccaagaaggccgcataagttgggatgggttaagttgtagttaaaatcgggaatgaatgtagtttggtaatagtgttggttatgtttatgttgaggttaatgaatgaatgaaagaaaccgctt

SEQ ID NO: 14646 - DNA, 526 bp, Triticum aestivum
catggacgcctcagccaccgtagccgccgggaaggcgaagaagggcgcggccgggcgcaaggccggaggccccaggaagaagtccgtggcgcggtccgtcaaggccgggctccagttccccgtcggccgcatcgggcgcttcctcaagaagggccgctacgcgcagcgcgtcggctccggcgcccccgtctacctcgcggccgtcctcgagtacctcgccgccgagctgctggagctcgcgggcaacgccgccaaggacaacaagaagagccgcatcatcccccgccacctgctgctcgccgtcaggaacgaccaggagctcggcaggctgctcgccggcgtcaccatcgcccacggcggcgtgatccccaacatcaaccccgtgctgctccccaagaagaccgccgagaagtcccccaaggagcccaagtcgcccaagaagaccgccaagtcccccaagaaggcgtaggtggccactgcctagttatctcggggtagctgggatggatatatgggtgtgcttcag

SEQ ID NO: 14647 - DNA, 826 bp, Panax ginseng
cccccccccccccccctatcgtgtgccttggcagtctcagtcaacgcagagtacgcggggacggtcgattggacaaacaccctttttagttttaatctttgtttctctctagattctggttgtttttataatttctcctcgactcattgaaataaaatggagactggtggaaaatttaagaaaggtgccgccggaaggaaaggaggcggtcccaagaagaagtcggtgtctcgctccgtcaaggccggactacagttccccgtcggaagaatcggccggtacctcaaagtgggtcgttatgctaagcgcgtcggctccggagctccggtctacctagctgccgttcttgagtacctagctgctgaggttttagaattggctggaaatgcagcgagggacaacaagaagaaaacgattataccaaggcatgttctattggctgtgaggaatgatgaggagcttggaaggcttcttgctggagttacaattgctcatggaggtgtgcttcccaacattaacccagttctgttgccgaagaagtctgagaaggcagctaaggaacctaccaagtcaccctcaaaggcaactaaatccccaaggaaagcttagttatggtttctttctctgtgtgtttagaagaaagaaagcctagttgtagctttctagttcctctcttgtatgtaatttgttttacagttgtggggttttaggaaatttgtgcccttagttgttaggccgattgtagtttctcttctgtttcctctgttagtacttgaaaacatctttaatttgaaatgaaatggttaccttttgtttaaaaaaaaaa

SEQ ID NO: 14648 - DNA, 793 bp, Panax ginseng
aagcagtggtatcaacgcagagtacatggggatggtcgattggacaaacaccctttttagttttaatctttgtttctctctagattccggttgttttataatttctcctcgactcattgaaataaaatggagactggtggaaaatttaagaaaggtgccgccggaaggaaaggaggcggtcccaagaagaagtcggtgtctcgctccgtcaaggccggactacagttccccgtcggaagaatcggccggtacctcaaagtgggtcgttatgctaagcgcgtcggctccggagctccggtctacctagctgccgttcttgagtacctagctgctgaggttttagagttggctggaaatgcagcgagggacaacaagaagaaaacgattataccaaggcatgttctattggctgtgaggaatgatgaggagcttggaaggcttcttgctggagttacaattgctcatggaggtgtgcttcccaacattaacccagttctgttgccgaagaagtctgagaaaggcagctaaggaacctaccaagtcaccctcaaaggcaactaaatccccaaggaaagcttagttatggtttctttctctgtgtgtttagaagaaagaaagcctagttgtagctttctagttcctctcttgtatgtaatttgttttacagttgtggggttttaggaaatttgtgcccttagttgttaggccgattgtagtttctcttctgtttcctctgttagtacttgaaaacatctttaatttgaaatgaaatggaattgttaccttttgaaaa

SEQ ID NO: 14649 - DNA, 731 bp, Malus domestica
tttcacttctacaatttatttaattattttctgtttgtttctcgggaaagtcggttcagaagttgatcccagcgcggagggcagggtgatggaaaccggtgggaagttcaagaaaggcgcaggagggaggagagccggcggtcccaagaaaaaaccggttacccggtctgtgagagctggtctgcagttcccggtcggacgtatcggccggtacttgaagcatggccgatacgctcagcgaatcggaaccggagctccggtttatctggctgctgtgctcgagtaccttgctgctgaggttttggaactggctggaaatgctgcaagagacaacaagaagaatcgcattatcccaaggcatgtgctattggccgtgaggaacgatgaagaacttggaaagctcctgaagggtgtgacaattgctcatggcggtgttcttcccaacatcaatcctgtgcttctgccaaagaagcatgagagggttgcgaaagagcccaagtcgcccgtcaaagctgccaccaagtcccctaagaaggcataactgatctaattagcagtgtctatggtagtacctgtctatggagtctccatgtctgtacatggttagtaggatgccttcatgtgtcgttatccccttcgttatccccctaggacttaagactctttgcactctctgtttcaatatccgcttagaacatctgtgtttcatatgaaatgaaattcacccgact

SEQ ID NO: 14650 - DNA, 908 bp, Actinidia deliciosa
cgagtttgtatctcttgattctcatctatacttttacgcgagggtagaatcgacatttcgagatggagactggcggaaaaccgaagaagggggccgccgggaggcggggaggcggtccgaagaagaagcctgtgtcccggtccgtgaaggcaggtctgcagttcccggtcggcaggatcggccggtacttgaagaagggtcgatacgctcagagggtcgggactggagctccggtctatatggctgccgtgctcgaatacctagcagctgaagtactggagttggctggaaacgcagcccgagacaacaagaagaacagaatcataccaaggcacgttctgttggccataaggaacgacgaagagcttgggaagctgttggctggagtgaccatcgcacacggtggagtgctccccaacataaacccagttctgttgcccaagaagaccgaaaaggcctccaccaaggaacccaaatctccctccaaggccaccaagtctcccaagaaagctgtttagttttttgctcaacccagtctcaggttttgcgtgtaatttgggctttgggacttttgtttcgttgctgggtaggccgaattgctggaaaaagtataaattattgcaatcctaatttaggagttttcagtttgatcaatggatgaaagtgaaactacccatttcactttctattttgcgctcagttttcttattgggtcttcgctttttcgtgcgtgtgttataagccattcatagggtcgttcagcttggtgggtattttagttgcatacttgttccaaggagaatttcaaatcacgggtaatttgaaagagtaatattgtgacgggggacccaaaatcaaaatatcactctcatggaatctaaactgtccgtggaataaaatgcctctct

SEQ ID NO: 14651 - DNA, 739 bp, Medicago truncatula
atcaaattcccaatccaaagcacttcttcttcttctttcttgttcgcattcaaatattcttttcctctcaaaatctcagttcaaaatggacgcaagcaccaagacaacaaagaaaggagccggtggaaggaagggaggaggtccaaggaagaagtcggtgacaagatccatcagagccggactccaattcccagtcggaagaatcggccgttacctgaagaaaggtcgatatgctcagcgtgtcggcaccggtgctccggtttacctagctgcagttcttgaatacctcgctgctgaggttcttgaattggcaggaaacgctgctcgtgataacaagaagaatagaatcattccaaggcatttgttgttggctgttaggaatgatgaagagcttggaaaactgcttgctggtgttacaattgctcatggtggtgttcttccgaacattaacccaattctgttgcctaagaagactgaaagggctaatactggtggcaaggagccaaagactactaaggctggaaagtctcctaagaaagcttagatctgattttaggaagaattaattttttttttttttgcttttgaagatgtaatgaagtaattggatctttctgatcttttttgtttatgaaaatggtgatttaatgatattggtcttcaaaaatgtttctattttacaaagagatgaagttgaattcctatttaaagtagtgattgactatgtataaatgtatag

SEQ ID NO: 14652 - DNA, 669 bp, Nicotiana benthamiana
atccacatctctaccgctccaacaatcaactataatatcaattctttttcaccaatcacaactttgctctttctcatttccaaatggatactgccgggaaagcaaaaaagggtgccggcggcagaaaggctggtggccagtcgaagaagccggtttctcggtccgtcaaagccggtcttcaattcccggtcggtagaattggtcgttacctgaagaagggtcgttacgctcaacgtgttggaagtggtgctccggtttatttggccgctgttcttgagtatttggccgctgaagtgctggaattggctgggaatgcagcgcgtgacaacaagaagaacagaattattccaaggcacgttctgttggctgtgaggaacgatgaagagctagggaagcttcttgctggtgtgacaattgctcatggcggtgttcttccaaatatcaacccgattttgttgcctaagaaaacaggcggagctgaaaaggaaccgaaatctcctgctaaggccacaaaatctcccaggaaagctgtagcttagaccttttaagtgactgctgaaactcaaacttcttttggtttgtttttcttttgtatgtaattgtaatttttgaactttgtgcccgtgccagttgttcttcatagtcaaatcattgaaaccccttgtttct

SEQ ID NO: 14653 - DNA, 663 bp, Hordeum vulgare
cgggaggagggagtccgcctccttctggccgtcgtcgccgtggtagcaaggcatggacgcctccggcaccgtcgcgaagggcaagaagggcgccgccgggcgcaaggccggcggccccaggaagaagtcggtgtcccgctcggtcaaggccggcctccagttccccgtcggccgcatcgggcggtacctcaagaagggccgctacgcgcagcgcgtcggcacgggcgcccccgtctacctcgcggccgtcctcgagtacctggccgccgagctgcttgagctcgccgggaacgccgccaaggacaacaagaagagccgcatcatcccccgccacctgttgctcgccgtcaggaacgacgaggagctcggcaagctgctggccggcgtcaccatcgcgcacggcggcgtggtccccaacatcaacacggtgctgctccccaagaggaccgcggagaaggagggcaaggcgcccaagtcccccaagaaggcccccaagtcccccaagaaggccgccacgcccaagaaggcctagagagatgcgttctgtgtcgtttagggccgccaccccgaagaaggcctgatggagatgcgttctgtgtcgtttaggctgtgtgctgcgtagtgttcttcttctgaatctgaataggggtgtgaagtcgttcg

SEQ ID NO: 14654 - DNA, 702 bp, Chrysanthemum coronarium
atcaagaagggagcagcaggaaggaaagccggtggaccgcgaaagaagtcagtcactcgatctgtgaaagccgggctccagtttccagttggtagaattggtaggtatctgaagaaaggtcgttacgctaagcgtgttggtaccggtgctcctgtttatcttgccgcggtcctcgaatatctcgcagctgaagtgttggaattggcgggaaatgcagctagggacaacaagaagactaggattattccgaggcatgtgttgttggcgataaggaatgatgaggagcttggaaagttgttgtctggggttacgattgcacatggtggtgttttgccgaatattaacccggtcttgttgcctaagaagactgctgctaaagaatcaacaccaaagtctccatccaaagctgcaaagtctcctaagaaggctgctgcatagattagtttgatgtaattgtggtgttttggttagtcaatttcgagtagtttataatttttaatggtcagatgtaatcacttctatataatgggaatgtattatttctgtttattctccttgttttttatatttagatgtaacttcgataattatgaatttatgattaatgcaaaaacaatgtagttttggagaaccaaaagtatgctatgtaatgtttcgggctttcgcctactttttcattattgtaatgcaaaaacaatgtag

SEQ ID NO: 14655 - DNA, 511 bp, Euphorbia peplus
ttttcagagagatggatagcaccaccgtgaagaaaggtgctgcaggccgtaaaggcggaggcccgaagaagaagtcggttaccagatccgtccgagctggacttcagttcccagttggtagaatcggaaggtacttgaagaagggaagatatgctaagcgggtcggatccggagctgctgtttacctagctgccgttcttgagtacctagctgctgaagttcttgaattggctgggaatgctgcgagggataacaagaagaacaggattataccaaggcatttgttgcttgctgtaagaaatgatgaggagctcgggaagttgttggcgggtgtaacgattgcgcatggaggtgttcttccgaacattaacccggttttgttgcctaagaagaacgagaaggcgagccaggaaccaaaatctcctgcgaagaaggctgcaaaatcacccaagaaggcttaaatagtgtctgggttaaagtaattacgagtagtttaggtgtagttgttatg

SEQ ID NO: 14656 - DNA, 778 bp, Fraxinus spp
gattggaatctgaaggaacagtttcctcctttatcccaagtattatttcgattcacaaaacccatttttagggctactatttgtagtgaatagaatttgtaatggacactggtggtaaactgaaaaagggagccggaggaagaaggggcggcggccccaagaagaagccggtttctcgctccgtcaaggcaggtctacagtttccggtcggcaggatcggccggtacttgaagaaaggtcgctattcgcagcgtgtaggtaccggagctccggtttatatggctgctgtcctcgagtaccttgctgctgaggttttggaattggctggcaacgcagccagagataacaagaaaaacagaatcataccaaggcatgtgctactcgccgtgaggaatgatgaggagctcggaaaacttctagccggagtgacaattgcttatggaggagttctaccgaacatcaatccggtacttctgcctaagaaatctgagaaggccgggaaggagcctgcgaaatcccctaccaaggcaactaaatctcccaagaaggcctagtcttcgggctgcaactagtattgaatttaattgacttggtctctctttcagttatttgtatgtaatttgatttactgttgttggtatgtaagcaagtctgtttatacctagaaccattgtactagtcattctcctgcttctggtagattgttgttcgtaatttctcaatctcattttgcaatttctttgtgaatggaatgaatgaaaagtgaatttgttctttc

SEQ ID NO: 14657 - DNA, 826 bp, Nicotiana benthamiana
catccacatctaccgctcctacaatccactgataatatcaattcttttgtgcaaatcacaactttgttttttgtcattctcaaatggatactgccggaaaagcgaaaaagggtgccggcggcagaaaggctggtggccaatcgaagaagccggtttctcggtccgtcaaagccggtcttcaattcccggtcggtagaattggtcgttatctgaagaagggtcgttacgctcaacgcgttggaagtggtgctccggtttatttggctgctgttctggaatatttggccgctgaagtgttggaattggctggaaatgcagcgcgtgacaacaagaagaacagaattattccaaggcatgttctgttggctgtgaggaacgatgaagagttaggaaagcttcttgctggtgtcaccattgctcatggtggtgtgcttccaaatatcaacccgattttgttgcctaagaaaactggcggtgctgaaaaggaaccgaaatctcctgctaaggccacaaaatctcccaggaaagctgcagcttagagtttttttgtgactgttgaatctgaaacttcttttgctttttgttcgtgttgtatgtatttctggttttagatctagttcttgttttagcgagggaatttgagaagaatatagctgtaattttgaacttgttgttagttgttctttatagttaaatcaatgaaaccccttgtttctatctatggcctctttcaatctatacatcgttttacatcaatcatcgttgggcatacttattttgtgatgcagaatgtagataattttctttcttaattgatgttcctttt

SEQ ID NO: 14658 - DNA, 791 bp, Plantago ovata
ctcaggccggggcccggggtacttacctaaccttctattgctctctccctcccctattactgacaaccaactctttaccatcaaaatcaaccctcctccacaacatctctgttactctgcaagcaatggaaaccgacggcaaggttaagaagggagctggcggcaggaagggcggtggccctaagaagaagtcagtttcccgctccgtcaaggccggtctccagtttcctgtcggtagaatcggccgttacttgaagaaaggccgttacgcccagcgtgttggcagcggagctcctgtctacatggctgctgtgctcgagtacctcgctgctgaggttctggaattggctggaaatgctgcaagggacaacaagaagaccaggattattcctaggcatgtgctgttggctgtgaggaacgatgaggagcttgggaagttgctcgctggtgttacgattgctcatggtggcgtgctgccgaacattaacccggtactactgccgaagaagaatgagaaggctgagaaagagactgctactaaatctcctgctaaggccaccaagtctcctaagaaataatgatgcgatgatgatcagctgttgtgtggaagaatttgaatgaatgacattgtttgtttgtttactcgtagggtttcatgtatgtagttccagtggatgatgaatgttgttggcatttaggaacaaaaatgctgtctatatagacttagctctgcgctgttaacatttccttttattagattggattatctatcttaatgaagagatatggtt

SEQ ID NO: 14659 - DNA, 749 bp, Sarracenia psittacina
ggacacgtcgaatctctactctttcgttcagacaagaacgtctccccttgcagatctctacatttcagccgtttgtttctcggggaaaaccccttttctgatcgagaaaatggagaccgttggaaagtcgaggaaaggagcggcaggaagaaagggcggcggtccaaagaagaaaccggtttcccggtcggtcaaagccggattgcagtttccggtcggcaggatcggccggtacttgaagaaaggccgctactctcagcgtatcggaactggtgctccggtttatcttgccgccgtgctcgagtacctcgccgctgaggttttggaattggctggtaatgccgcaagagacaacaaaaagaatagaatcataccgaggcatgtgcttttggctgtgaggaatgatgaggagcttggaaagctactcgctggtgtaacaattgcccatggaggagtacttcccaatattaacccggttcttcttcccaagaaaagtgaaaaggcagcaacaaaggagcccaagtctccatccagggcaaccaagtcacccaagaaagcctaactttgtagcgtgttgaagaggcctaattgcttctctctttctctctctctctctctgtatgtaatttggtttagttgtgctatgtagggaaagttgatgttgcttcgaaaaattgtactcttttatatcaaatcctatttggacatctctgtttgcaatcaaaatcttgaaatgcctatttcaatga

SEQ ID NO: 14660 - DNA, 703 bp, Tabernaemontana elegans
ttatttatctcccaaatcattatccctctttagcttcttccagagttgtggaatcgttatggaatctggaggaaaagtgaagaagggtgccgcaggaaggaagggcggtggcccaaagaagaagcccgtctctcggtctaccagggctggcttgcaatttccggtcggtagaattggccggtacttgaagaagggtcgctattctgagcgagttggtaccggtgctccggtttatatggctgccgtccttgaatatttagctgccgaagttcttgagttggctggaaatgctgcgagggataacaagaagaatagaataatcccaaggcatgtgcttttggccataagaaatgacgaggagctgggaaaattgctggccggtgtgacaattgcacatggtggagtgctaccaaatattaaccccatcttgttgccaaagaagactgacaagcccaccaaagaacctaagtctccatccaaggctaccaaatctccaaagaaggctgcttagatttgtctaattggattatctcctttacccttgttaaaggatcttagatcactgtgtatgtaatgtgggtgactttagaagttttttagtttcatgttgaggaagaataggagaaaatggtattgtaattcttagcttgtgttttaggagtttcaacttcaatatgaatgaatgaatgagtctgctcgtttc

SEQ ID NO: 14661 - DNA, 789 bp, Vinca minor
atcctctccttccaaccaaaaaaaaaatctggtatttttcttttctttactagtcagactacaattactgtagcaatttctcggccatcgtgaccgccggagttgttgaagaaatggaaggtgctggtggaaaattgaagaagggagctgcaggaagaagaggcggcggaccaaaaaagaagccggtcactcgctctactagagctggattgcagtttccggtcggcaggatcggccgttacttgaagaaaggtcgctactctcagcgtgtcggtaccggcgctccggtctatatggctgccgtccttgagtaccttgctgctgaggttttagaattggctggaaatgcagcaagagacaacaagaagaataggatcataccgcgacatgtgctgttggctgtgaggaacgatgaggaacttgggaagcttcttgctggggtgacaattgctcatggaggtgttcttcctaacattaacccagttctactgccaaagaagaatgagaaggctactaaagaaccggccaagtctccagctaaagcaacgaagtcgcctaggaagacttaatcagtttcttatctgttaagaagaaaaaaaagacttgttatcctctctaatttctctgtatgtaaggtaattattcagtgttttcagtatatagaagaagatgttatcaagatttatggatcattctgatgttgcttttgttgctcttgttttagaacattctctgttcaccaattggtgaagtaaaactttagcttattcagttcatgttgattggctt

SEQ ID NO: 14662 - DNA, 775 bp, Vitis vinifera
agaccgttttctccgataacttcagatccattattcccgatcacgctcatcgccgccgccgaagtctgcaactgtgagaaatggagtctaccggaaaagttaagaagggggccggtggaaggaagggtggtggtcccaagaagaagccagtgtctcggtccgttaaggccggtttgcagttcccggtcggaaggattggccgttacctgaagaagggccggtactcccagcgtgtagggactggtgctccagtgtacttggctgccgtgcttgagtacctggctgcagaagtgctagagttggctggaaatgcagctcgggacaataagaagaacaggatcattccaaggcacgttctattggcagtaagaaacgacgaggaactaggaaagctgctctctggagtgaccattgctcatggaggcgttctccccaacatcaacccagtactcttgccaaagaagacagacaaggctaccaaagagcccaagtcaccttccaaggccactaagtctcccaagaaggcttaaccattgcagctacgcccttttccatttgtatgtaatgtgggtttagaagtcctcttctttcttttgttcatgtttagggaggagtcaggaattgaaaacattgtacttcttgaaactcttaatgttatttcttttaggattttctctttgaatcaatggatgaaacccctagttttgcccaaaagcttcaagacccttctctttgacgccattatcttttcgtgtggtgagtgttgtcatgggga

SEQ ID NO: 14663 - DNA, 744 bp, Hordeum vulgare
aaacacaagacactcccgccttctccgcacctccaatcctgaaatctacccgccatggacgcatcaaccgccggcgccgtctccaaggcgaagaagtacgtggtggggcgcaagctcggcggcggccccaggaagaaggcggtggcgcggtccgtcaaggccgggctgcagttccctgtcagccgcatcgcccgcttcctcaagaagggccgctacgcgcagcgcgtcggcatgggcgcccccgtctacctcgcctccgtcctcgagtacctcgccgccgagcttcttgagctggccgggaacgccgccaaggacaacaagaagtcccgcatcatcccgcgccacctgctgcttgcagtccggaacgacgaggagctcggcaagctgctcgccggcgtcaccatagcgcatggcggcgtgctgcccaacatcaacaccgtgctgctccccaagaagacggccgagaaggagcccaagtcgcccaagaaggccgccaagtcccccaagaaggcatagccgattactttctagtgcttcctaattgaataagtggttgctgtttgggtaatcgtgtagatgtagtaatgctctgttctgcttttgggaaaaaaaaagtctgttcatgatttacagtaaattcattctctgttttctgtctgttcatgattttccaatgctatgtagttttagatctgtgtcgtgggatgaatcctccgtattgtattcacgggtcattcgaatctg

SEQ ID NO: 14664 - DNA, 710 bp, Phaseolus vulgaris
gtgcatcttgttctcttgcaattattcctttttcatcactactcagaaatttcaccaaaatcctagggttctgatatggaaaccaccggcaagatcaagaagggcgccggaggaaggaagggtggcggaccgaagaagaaaccagtgtcaaggtcggtcaaagccggtcttcagttccccgtcggaagaattggacggtacttgaagaaaggaaggtacgcgcagcgtgttggaagcggtgctcccatttaccttgctgcagttcttgagtatcttgctgctgaggttcttgagttggctgggaatgctgctagggataacaagaagaacaggattatcccaagacatgttcttttggctgtgaggaatgatgaagagttggggaaattgcttgctggtgtaaccattgcccatggtggtgtgcttcccaacattaaccctgtcttgttgcccaagaagacagagaaggcttccaaggagcctaaatctccatccaaggctaccaagtctccgagaaagtcctagatgacttagtttgcgatgataatttactgtgcacaatgtacatctgtgtttaggctttttcttgtatcatcattgtgatgactttgatacatcatgtagttttgattttacctcttctttatgatgttgcacttaatcagagtaaacaaggctcagtaatgaatagatttgtctttctgattctc

SEQ ID NO: 14665 - DNA, 807 bp, Prunus persica
actgtccaaaaattttcaattctctctttgccatttctgattgggtttttttagccaaaagggtgtcagtggctttagtgggtctagggtttgagaattttcagagctgagagatggagactggtggtaaggtgaagaaaggtgctggtggaaggaaaggtgggggtccgaagaagaagccggtgacccggtccgtcaaggccggtctgcagtttccggtcggtcgtattggacggtacttgaagaagggaaggtatgctcagagagttgggtctggagctccggtttacttggccgcggttcttgagtacctcgcagctgaagtgcttgaattagctggaaatgcagctcgggacaacaagaagaacagaattatcccaaggcatctgttattggctgttaggaacgatgaagagcttgggaaattgctcgccggtgtgaccattgctcatggtggtgtgcttccaaacatcaacccagtcctcttgcccaagaaatcagagaaggctgccgccaaagagcctaaatctccatccaaggccaccaagtctcccaagaaagcttaagcttctctcaatgaatcccccaccacatgtttagttttaagaacccccacatgtttagttttaggttgggctcctctccatttgtatgtaatctgtgttcagatctttgtttttgttggttggtagtctaaaatgcttaatgaatttgaaagcatttgtaacctctcaaatctatgtgatcatgaccaagttttaggaactttgtttttcttggaattcattaatgaaacctcttgtttct

SEQ ID NO: 14666 - DNA, 1155 bp, Amorphophallus konjac
aaaacgactcctttttgtcccacctcattggtccatttccgactgcgcggatagccaagcacagatctcagccgtccgcctagaagcttatccaacggccgcggaacgcccacactcggatcgggaccccctcgcccgcggatataaaagctccatcctcgccatcaccgcgaagcatccgagtttttgccatcttagagatcgagttcgccgagtttttctctatttgtccgaagaggaagaggaaggggaaggagggtagaggaaatggatacagccggtaaggtgaagaagggcgccgggggcaggaagggcggcggccccaagaagaagccggtctcgaggtcggtcaaggccgggctccaattccccgtcggcaggatcgggcggtacctcaagaaggggcgctactcgcagcgggtcgggaccggtgcgccggtctacctcgccgccgtgctcgagtatctggcggctgaggttctggagttggcgggtaacgctgcgaaggacaacaagaagaacaggattatcccgaggcacgtcctactggccgtgaggaacgatgacgagctcggcaggctgctttctggggtcaccatcgcccacggcggcgtgctccccaacatcaaccccgtgttgctgcctaagaagtctgagaaggccagcaaggagcccaaatcgcctggcaaggcgaccaagtcccccaagaaggcttagaaagcttgacgacgttgcctctacctcccgctttctacttctcataggtttgtcgggaggggcgcgtctatgctctcctctttccatttatttctccgggggtttttcttgttaatttttaggttgacgggcctgacgacactttgtagaatggtgcgatcttggaaatctgaaccgcttgtggtgggtatgttgatgtagttacggaaaaactttttaatggaaggaggaatttagaagatttccatcagaactgtactggtgctagtgaatttatcagttttcttttatgtgcctcaatttgttgctgctgtactaagtcatagacctttcttcctctctccttcctcggaatatattccttgatgggttcttccttgcttttgacttttcatttacgcatggaagcctgtgaagaaatggatgaagttagtaagt

SEQ ID NO: 14667 - DNA, 841 bp, Musa acuminata
cgttcgtgactcggtcgggccgtgtgaactcgttccatctttactccattcccaagtcaaccaggagcgtcctaaagtggtggtgtggctatggacggcggagggagcaaggtgaagaagggagccgctggccggaggggtggtggccccaagaagaagcccgtctcacggtccgtcaaggccggcctccagttccccgtcggtcgcatcggccgcttcctcaagaagggccggtacgcccagcgcgtcggcgccggcgctcccgtctacctcgccgccgtgctcgaatacctggcagccgaggtcttggagttggccgggaatgcggcgcgtgacaacaagaagaaccggatcataccgaggcacgtcttgcttgccatcaggaacgacgaggagctcgggaagcttctcgctggggtgaccatcgcgcacggaggggttctgcccaacattaaccctgttcttctgccgaagaagactgacaagggtggcaaggagcccaagtcgccatcgaaggccaccaagtcaccgaagaaagactagggttagcggatatgaaagggggtttctatctcctgcaattcctcttctttgtgtattttgtaggactggaatagtgtaggtggaagaaagagatgaattagatgaagccaaatgtttcttcttcctatgttttcatgcaatgttaatgatagtagtgatttatatgtgatttggtgtggttttatttggtttgacttggaccttttcgtgaaagggacaacagccgctgtaagaaattgggagttttggaggaggaagaaggttaatgggctttgttattatgtgttatacgagaggg

SEQ ID NO: 14668 - DNA, 1118 bp, Phaseolus vulgaris
atgtgcatcttgttctcttgcaattactcctctttcatcaccactctgatttttcgcctaaaatatagggtttggccatggataccaccggaaaaatcaagaagggtgccggaggaaggaagggtggcggaccaaaaaagaaggcagtgtcgaggtctgttaaggccggtcttcaattccctgtcggaagaattggacgttttttgaaaaaaggaaggtacgcgcagcgtgtaggatccggtgctcccgtttatttggctgcagttcttgaatacctagctgctgaggttcttgagctggctggtaatgctgcccgtgacaacaagaagaacaggattattccaagacatgttcttttggctgtgaggaacgatgaggaattggggaaattgctttctggtgtgaccattgctcatggtggtgtgcttcccaacattaaccctgttttgttgcccaagaagtccgataaggcttccaaggagcccaaatctccatctaaagctaccaaatctcccagaaaggcttagaatataaatttaatttagttatgtatatcagtgttaggatgcctttggtgttatagagatgggatttgatggttgaaacttgtattcttgctttattgtattgcgtgtagaagtttgcttcattaatggaaacctcttgttttcgtccaacttttctctccacgtcaactgtttataacaccaaaggcatgtgtaccaaaggttttgtattgtgcaaattaaaggttatggaatgctgtgtaccaaaaacgcaagtgactttggctgtggtattctgatgcttatttaatgttattccatgttatgtttcgtggttgtagtggggaggaggagttggggaagttgcttatagttgctatcagtggtgctatttccaacttgactgtcttgttgctgaaagaagactgataaggcctccaagtagcccaaatgtgtatccaaggaccaaacctctcctgaagggattgatgatctagtttttaaaaataaataaattaatttgatgttttcaatttagttgtgttttaggtgtttctggtatcttaaagttgatgcttttgattgatgtagttctgatattactggttgtta

SEQ ID NO: 14669 - DNA, 519 bp, Chrysanthemum coronarium
gtaaagttaagaagggagcagcaggaaggaaagccggtgggccgcgaaagaagtcagttactcgatctgttaaagccgggcttcagtttccagttggtagaattggaaggtatttgaagaaaggtcgttacgctctccgtgttggtactggtgctcctgtttacctcgctgccgttcttgaataccttgcggctgaggtgttggaattggctggaaatgcggctagggacaacaagaagactaggattattccgagacatgtgttgttggcgattaggaacgatgaagagcttggaaagttgttgtctggtgttacgatagctcatggtggtgttttgccgaatattaacccggtcttgttgcctaagaaaactgctgcgaaagaaccaacaccaaagtctccatcaaaagttggaaagtcgccgaagaaagcagcatagattggtttgtttgatgtatttgtggtgttttgtcagtaaattcagatgtagtcatttctattgaatgaaagccttttct

SEQ ID NO: 14670 - DNA, 644 bp, Cichorium intybus
aaggtgaagaagggtgccgccggaaggaaggcaggcgggccgaagaagaagccagtcaccaagtccgtcaaggccggtcttcagttccccgtcgggagaatcggccggtacatcaaaaaaggtcgttacgccaagcgtgtgggtaccggtgctccggtctacctcgctgccgttctcgagtaccttgctgctgaggtgttggagttggctggaaatgctgctagagacaacaagaagaccaggattataccgagacatgttttgttggctgtgagaaatgacgaagaacttggaaagcttttagctggtgtgacaattgctcatggtggtgttcttccaaatatcaacccaattcttttaccgaagaagtctcttgagaaagccacaaaggagccgaaatctcctgctaaatcagctaaatccccgaagaaagcttaaatgttgaagaacatgttctataatcatctctttgtatttattcaccttctgttggtgatctaggatagtatgtagttcgatgtttttaggggagattttggagtattttagtttgggttgtttatggtaggacctagatttgaaaaagaatctctctttttcgaaattaagattgtaatctttttaatttaatggatcttttggta

SEQ ID NO: 14671 - DNA, 804 bp, Echinacea purpurea
acgctctctctctaacttatctctctaaaaacagtcaccggaaaaccaaccgttttctctacaaagtcaccgacaaccgtcgttatggagactggtggaaagatgaagaaaggtgctgctggaaggaaggccggcggtccgaagaagaagccggttactcgatccgttaaggccggtttgcagtttccagtcggtaggatcggccggtacttgaaggtcggtcggtacgctaagcgagttggtactggtgctccggtttatcttgctgctgttcttgaataccttgctgctgaggttttagaattggctggaaatgctgcaagagacaacaagaaaaacagaatcaatccaaggcatgtgttgttggctgtgagaaatgatgatgaactaggaaagcttcttgcaggtgtgacaattgcccatggtggcgttcttccgaacatcaatccagttctgttgccaaagaagtctcatgaaaaagcaacaaaggaacccaaatctccatccaaatcaaccaaatccccaaagaaagcttagtttgtttatcaacattcctatggtggtgtagggtgaatcgaattaatggtgtttttagggatgatttagaatggttgtaatatgctatgtttatgttaggacctaggtgtgaagaagaagaatctctcttttttctaaatgaaaattgttaaattgttgaatttatgaaatcctttgaaccattgtttatgtgtactacgttgtttgttcaattgtttttatatgtttctggaatatatgactgcttttaggattcttgtttggacc

SEQ ID NO: 14672 - DNA, 630 bp, Fagopyrum esculentum
tctctaaaatcgaagcaacaaaatttaagcttttctaatcaaatggataccacgaacaaggttaagaagggagtcgccggaagaaaggctggaggtccgaaaaagaagtcagtaacccgatccgtcaaggccggtttgcagttcccggtcggtcgtattggcaggtatttgaaaaacggccggtacgcaaggcgtgtaggaagcggagctccggtgtacctcgccgctatccttgaatacttagccgctgaggtcttggagttggctggaaatgcagctagggataacaagaagactagaataattccacgacaccttttgctcgccgtgaggaacgatgaggaacttggaaagttgttgagtggtgtaacaattgcccatggcggtgttttgcccaacattaaccctgtgctcttgcccaataaaattgcagaaaaagctctaaaggaacctaaatccccttctaaggctgttaaatcgccaaagaaggcttagtttgtagagatatagattcgtataagagtattttttgtttagtttgtagagatatagattcgtataagagtattttttgtttgtaggagacattgatcttgcctatttctgaaaacttgttgatccgttgtctgt

SEQ ID NO: 14673 - DNA, 629 bp, Flaveria ramosissima
attcacgttctatcttcatcttctctcctcaacaatactcgccggaaaacacaataacatcatctccattttctccacaaagtcgccggattcgccatggaaaccggtggaaagttgaaaaaaggagctgccggaaggaaggccggcggtccgaagaagaagccggtcacccggtccgtgaaagccggacttcagtttccggtcggaagaatcggccggtacctgaaggtaggccggtacgcgaaacgagtaggtaccggtgctccggtttatctcgctgcggttctcgaataccttgccgctgaggttttggaattggctggaaatgctgcaagagacaacaagaagaacagaatcataccaaggcatgtattgttggctgtgaggaatgatgatgagctgggaaaacttcttgctggtgtgacaattgctcatggtggtgttcttccaaacattaatcctgttcttttgccaaagaaatctcatgataaagctacaaaggaaccaaaatctccatccaaatcaactaaatccccaaagaaagcttagttgattcatccgcatatctatatggtgatataggatgaatcagcagatcttagaaggattgtaatatgttatgtttatgg

SEQ ID NO: 14674 - DNA, 581 bp, Flaveria ramosissima
aatggagaccaccggaaagttgaaaaaaggagccgccggaaggaaggccggaggtccggagaagaagccggtcacccgctccgtcaaggctggacttcagttccccgtcggtagaatcggccggtatctcaacgttggccgctacgctaagcgcgttggcaccggagctccggtgtatcttgctgcggttcttgagtaccttgctgctgaggttttggagttagctggcaatgctgcaagagacaacaagaagaacagaatcataccaaggcatgtattgttagctatccggaatgacgatgagcttggaaagctgttagctggtgtgacaattgctcatggtggtgttcttccaaacatcaatccagttctgttgccaaagagggttcatgataaagctacaaaggaacccaaatcgccatcaaaatcaactaaatccccgaagaaggcttaggtgattaggatgatgctgtatgtatctgttcatctttgtatggtgatatagggataatggaatttagggtgttgttagggttggtttacatggattgtaaactcgtttgtttatgttagaatgtaag

SEQ ID NO: 14675 - DNA, 673 bp, Orobanche aegyptiaca
cagagaaaaaaaaacaagaaagagaaaatggatgctagtgcaaaggtaaagaagggagctggtgggaggaagggcggcgggccgaagaagaagccggtttctcgatccgtgaaagccggtctgcagttcccggtcagtaggatcggacggtatctgaagaagggacgttattctcagagggtaggtaccggtgcaccagtttacctggccgcggtgctggaataccttgctgctgaggttctggaattggctggaaatgcagcaagagacaacaagaagaacaggataattccgaggcatctgttgcttgctgtgagaaatgatgaagagcttggaaaacttcttggtggagttacaattgctcatggtggagttataccaaacattaaccctattctgttgcctaagaagagtgataaggttgctgagaagacgcctaaatccccagcaaaggccacaaagtctcctaagaaagcctaatttaggacagtgttattgtcgatagcgggtagtgttattgtagagctgtttactttgcatcagttgatgtttgttggcaatgtagtataaatattttgtgcttttaatgccacggtggtttaatatgcagacggttgtttagaatgccttgtttgcattcttatcaatggaatattgtttacattcagtaaaa

SEQ ID NO: 14676 - DNA, 935 bp, Prunus mume
ccttccctgaacaatatgatccacaatacatctcaccctataaaaccaattctctaacaggttcctaaatccactgtccgaaaattttcaattctctctttgccatttctgattgggtttttgagccaaaagggtgtcagtggttttagtgggtctagggttcgggaattttcagagctgagagatggagactggtggtaaggtgaagaaaggtgccggtggaaggaaaggtgggggtccaaagaagaagccggtgacccggtccgtcaaggccggtctgcagtttccggtcggtcgtattggacggtacttgaagaagggaaggtatgctcagagagttgggtctggagctccagtttacttggccgcggttcttgagtacctcgcagctgaagtgcttgaattagctggaaatgcggctcgggacaacaagaagaacagaattatcccaaggcatctgttattggctgtgaggaacgatgaagagcttggaaaattgctcgccggtgtgaccattgctcatggtggtgtgcttccaaacatcaacccagtcctcttgcccaagaaatcagagaaggccgccgccaaagagcctaaatctccatccaaggccaccaagtctcccaagaaggcttaagcttcccccaatgaatcccccaccacatgtttagttttaagaacccccacatgtttagttttaggttgggctcctctccatttgtatgtaatctgtgttcagatctttgtttttgttggttggtagtctaaaatgcttaatgaatttgaaagcatttgtaacctctcaaatctatgtgatcatgaccaagttttaggaactttctttttcttggaattcattaatgaaacctcttgtttctgttattgtcttaatgggtcttgtcttgatgggctgctttatgaaagctttgaagaaa

SEQ ID NO: 14677 - DNA, 676 bp, Secale cereale
ctcctcttcgccccgagtcccagagcatcacctgcaagcaatggacgtctcaggcaccggagctggcgccaaggggaagaagggcgcggcagggcgcaaggccggcggccccaggaagaagtcggtgacgcggtccgtcaaggccgggctccagttccccgtcggccgcatcgggcgctacctcaagaagggccgctatgcccagcgcgtgggcaccggcgcccccgtctacctcgccgccgtcctcgagtacctcgccgccgagctgctagagctcgccggaaacgccgccaaggacaacaagaagagccgcatcatcccgcgccacctgctgctcgccgtcaggaacgacgaggagctcggaaagctgctggccggcgtcaccatcgcgcacggcggtgtgatccccaagatcaacccggtgctcctccctaagaggaccgcggagaaggaggcgaaggagcccaagtctcccaagaagacgaccaagtcccccaagaagaccaccaaggcttagatcgatgcgttccatgtcgtagtgttcttcgtagctggtgtcgtttcgtcttgttatgtgcatgtttaatggaagaacgtcagatatctctctgacttgctcaaatactgcgctgtctcttgattctctgtgatttgcccaaatatcgctccgtcctga

SEQ ID NO: 14678 - DNA, 558 bp, Helianthus annuus
caaaatcccaaatggaaaccaccggaaaagctaagaagggtgccgcaggtcgcaaagccggcggtccaaggaagaagtccgtcacccgctccgtcaaagccggtctccagtttcccgtcggcagaatcggccgttacctcaaacacggccggtatgcaaagcgtgtcggtaccggtgctccggtttacctcgccgccgtcttggaataccttgcagctgaagtgttggaattggcgggaaatgcagctagggataacaagaagaacaggataacaccaagacatgttttgttggcgataaggaacgatgatgagctggggaagttgttggccggagttacgattgctcatggtggtgttttgccaaacattaacccggtgttgttgccaaagaagagtgctgctgctgccaaagagactaagtcgcctgttaaacctggaaagtctcccaagaaggccgcataatttgggttgggttaagttgtagttaaaattgggaatgaatgtagtttggtaatagtgtttgttatgtttatgttgaggttaatgaatgaatgaa

SEQ ID NO: 14679 - DNA, 582 bp, Helianthus annuus
aacacacactaaacaaaatccctgatggaaaccaccggaaaagctaagaagggtgctgctggtcgcaaagctggcggtccaaggaagaagtccgtcacccgctccgtcaaagccggtctccagtttcccgtcggcagaatcggccgttacctcaaacacggccggtatgcaaagcgtgtcggtaccggtgctccggtttacctcgccgccgtcttggaataccttgcagctgaagtgttggaattggcgggaaatgcagctagggataacaagaagaacaggataacaccgagacatgttttgttggcgataaggaacgatgatgagctggggaagctgttggccggagttacgattgctcatggtggtgttttgccaaacattaacccggtgttgttgccaaagaagagtgctgctgctgccaaagagactaagtcgcctgttaaacctggaaagtctcccaagaaggccgcataatttgggttgggttaagttgtagttaaaattgggaatgaatgtagtttggtaatagtgtttgttatgtttatgttgaggttaatgaatgaatgaaagaaaccgctt

SEQ ID NO: 14680 - DNA, 553 bp, Helianthus annuus
tcccaaatggaaaccaccggaaaagctaagaagggtgccgcaggtcgcaaagccggcggtccaaggaagaagtccgtcacccgctccgtaaaagcaggtctccagtttcccgtcggcagaatcggccgttacctcaaacacggccggtatgcaaagcgtgtcggaaccggtgctccggtttacctcgccgccgtcttggaataccttgcagctgaagtgttggaattggcgggaaatgcagctagggataacaagaagaacaggataacaccgagacatgttttgttggcgataaggaacgatgatgagctggggaagttgttggccggagtcacgattgctcatggtggtgttttgccaaacattaacccggtgttgttgccaaagaagagtgctgctgctgctaaagagactaagtcgcctgttaaacctggaaagtctcccaagaaggccgcataatttgggttgggttaagttgtagttaaaatttggaatgaatgtagtttggtaatagtgtttgttatgtttatgttgaggttaatgaatgaatgaa

SEQ ID NO: 14681 - DNA, 522 bp, Tragopogon dubius
ggggatccatacaatataacttaccggaaaaatcagagcggcttccttttcggtcagattataatttcagatattttgtttgaggtgaaatggagaaaaagggagctggtggcaggaaggccggtggtcctaagaagaagccggtttcccgctccgtcaaggccggtcttcagttccccgtcagcaggctcggtcgttacctcaagaaaggccggtatgcaaagcgtgttggtaccggtgctccggtttacctcgccgccgttctcgagtaccttgctgctgaggttttggagttggctggaaatgctgcaagagacaacaagaagtccagaatcattccacgacacgttcttttggcggtgaggaatgatgaagagttgggaaagcttctgtccggtgtaacaattgctcacggcggtgttcttccaaacatcaacccagttctattgccaaagaagactgtagagaaagaaggaaaggaacctaaatcacccaagaaagcagccaagtcgcccaagaaag

SEQ ID NO: 14682 - DNA, 724 bp, Triphysaria pusilla
ttgcatttcatctgcatacaattaatcctcatccaaccaatcatctttgcaccaaaaccaaaaatggaagctactccaaaggcaaagaagggagctgctggaagaaaggccggcggcccaaagaagaagtccgtttcccgatccgtgaaagccggtctccagttccccgtcggcaggatcggccggtttctcaaaaagggacgctactctgagcgtgtcggttccggtgctccggtttacatggcggcggttctcgagtaccttgctgctgaggtattggagttggctggaaacgctgcaagagacaacaagaaaagcaggattatcccaaggcacttgttgctggctgtgaggaacgatgaggagcttggtaaacttctggctggagtgacaattgctcatggtggtgtaattccaaacataaacccggttctgttgccgaagaaatccgacaaggtggctgagaaggcacccaaatcaccatcaaaggctgctaagtctccgagaaaggcatagactgaaaattttctttctgaatgtcggattgggataaaataacctttattcagttattcgtttgtagggattgtgttatcttatggctatgtaggtgatgtttataactgcagaaattgtacttttaacccttttttcttgctattttgttgttaaatctcattatttaaacttaatggaaatgttgttttaacaaaaaaaaaaaaaa

SEQ ID NO: 14683 - DNA, 630 bp, Triphysaria pusilla
ctttgcttttcatctgacatacaattttcctcctaaccaatcatctttgtagccaacccaaaaatggaagctactccaaaggcaaagaagggagctgctggaagaaaggccggtggcccaaagaagaagtccgtttcccgatccgtgaaagccggtctccagttccccgtcggcaggatcggccggtttctcaaaaagggtcgctactctcagcgtgtcggttccggtgcaccggtttacatggccgcggttctagagtaccttgctgctgaggtattggagttggctggaaatgcagcaagagacaacaagaaaagcaggattatcccaaggcacttgttgctggccgtgaggaacgatgaggagcttggtaaacttctggctggagtgacaattgctcatggtggagtaatcccgaacataaacccggttctgttgcccaagaaatctgacaaggtggctgagaaggcacccaaatcaccattgaaggctactaagtctccgagaaaggcatagactgaattttctctctgaatgtggggttgggataaaataacctttattggtttgtagggattgtgttatcttagggctatgtaggtgatgatgtttataactgcagtaattgta

SEQ ID NO: 14684 - DNA, 639 bp, Triphysaria pusilla
gtctttaccccaaatactgcaagctcaatttcatattcatcttcttcactatcttctttcattcagagaaaaatggaaaccggtgggaaagtgaaaaagggagccgctggaaggaaggtcggtggaccaaagaagaaatccgtcacccgctccgtgaaagccggtctccagttccccgtcggcaggatcggtaggtttctgaagaagggtcgctatgctcagcgcgtgggttctggtgccccggtttatctggctgcggttctagagtaccttgctgctgaggttcttgagttggctggaaatgcagcaagagacaacaagaaaagcaggattatcccgaggcacttgttgctggccgtgaggaacgatgaggaacttggtaaacttctggctggagtgacaattgctcatggtggtgtaattccgaacataaacccggttctgttgcccaagaaatctgacaaggtggctgagaaggcacccaaatcaccattgaaggctactaagtctccgagaaaggcatagactgaattttctttctgaatgtggggttgggataaaataacctttattggtttgtagggattgtgttatcttagggctatgtaggtgatgatgtttataactgcagtaattgta

SEQ ID NO: 14685 - DNA, 691 bp, Triphysaria pusilla
aaccaatcatctttgtagccaaaccaaaaatggaagctactccaaaggcaaagaagggagctgccggaagaaaggccggtggcccaaagaagaagtccgtttcccgatccgtgaaagccggtctccagttccccgtcggcaggatcggccgatttctcaaaaagggacgctactctgagcgtgtcggttccggtgcaccggtttacatggccgcggttctagagtaccttgctgctgaggtattggagttggctggaaatgcagcaagagacaacaagaaaagcaggattatcccaaggcacttgctgctggctgtgaggaacgatgaggagcttggtaaacttctggctggagtgacaattgctcatggtggagtaataccgaacataaacccggttctgttgccaaagaaatctgacaaggtggctgagaaggcacccaaatcaccatcgaaggctgctaagtctccgagaaaggcttagactgaaatttttctttctgaatgtcggattgggataaaataacctttattcagttattggtttgtaaggattgtgttatcttagggctatgtaggtgatgatgtttataactgcagtaattgtacttttaaccctttctattgctacttttgttgttaaatctcatgatttaaatttaatggaaagattgcttaaccaaaaaaaaaaaa

SEQ ID NO: 14686 - DNA, 654 bp, Triphysaria pusilla
acactcaccattttcgactttgcttttcatctgacatacaaattctctcctaaccaatcatctttgtaatcaaaccaaaaaatggaagctactccaaaggcaaaaaagggagctgctggaagaaaggccggcggcccaaagaagaagtccgtttcccgatccgtgaaagccggtctccagttccccgtcggcaggatcggccggtttctcaaaaagggacgctactctcagcgtgttggttccggtgcaccggtttatatggccgcggttctagaataccttgctgctgaggtattggagttggctggaaacgctgcaagagacaacaagaaaagcaggattattccaaggcacttgttgctggctgtgaggaacgatgaggagcttggtaaacttcttgctggagtgacaattgcgcatggtggagtaattccgaacataaacccggttctgttgcccaagaaatccgacaaggtggctgagaaggcacccaaatcaccatcaaaggccaccaaatctcctagaaaagcttaaattttttttttctgaatgtgggattgggataaaataacctatattggtttgtagggattgtgttatcttgtgggtatgtaggtgatgctgtttataaccgcagtaattgtacttttaacc

SEQ ID NO: 14687 - DNA, 730 bp, Tripterygium wilfordii
accatcccaagcctgaattcgtgatttctgtttcaccggcagccaaacagtttcattcttctgcatttaagagagcttggttttattcaggcgggtattcaatctatggataccggaggaaagttgaagaagggagccggagggaggaaaggcggaggtcccaagagcaagccagtctctcggtcagtgaaggccggtcttcagtttccggtgggaagaattgggcgatacttgaagaaggggaggtactctcagcgagtcggttctggtgctccggtgtacttggctgctgtcctcgagtacttagctgctgaagtgctggagttggctggaaatgctgcccgtgacaacaagaagaacagaattatcccaaggcatcttctactggctgtgaggaatgatgaggagcttgggaagcttctttctggtgtcaccattgctcatggaggtgtccttcccaacatcaaccctgttctcttacccaagaagactgataaggcctccaaagagcccaagtcaccatccaaagctaccaagtcccccaagaaggcctaatttctggcagccattgtagcttgtttgtcttttcacatgacatatgtagtttggttttaggatttaaatggccatgttttctttacatgtaggaattaaatgtgatctttttggaaatactattgaactttgggatctatgttgggatttctgtcgaaggcaaatcagtgacccc

SEQ ID NO: 14688 - DNA, 714 bp, Vaccinium corymbosum
cgctctttcaaacctccccaagtcactcattgtttttccgacgtgcaacagagaagagatctgagaaatggaaggtggtggaaaagttaagaagggtgcggcaggaaggaagggaggcggtccgagggctaagccggtcacccggtccatcaaggccggtttgcagttccccgtcggcaggattggccggtacttgaagaagggtcgctatgctcagcgcgtcggaaccggagctccggtttatttggctgccgtcctcgagtacctcgccgctgaagtgctggagttggctggaaacgcagcccgtgacaacaagaagaacagaatcatcccaaggcacttgctcctcgcggttcggaacgacgaagagttgggaaaattgcttgctggtgtgaccattgcccacggtggtgttcttccaaacatcaacccaattctgttgccaaagaagactgacaaggctaccaaggaacccaaatctccttccaaggccaccaaatctcccaagaaatcagcttagtcattagactagaatagacaaggctagtaatgaacctagttctatatgattttcagttgtaatttttggggcttatgacttattttgttgttttgtggtgaaattggtaggaaaggccaatgtaattactctgctatcaggattttcttttggattaatggatgaacaacttgtttaatctactttacttggcg

SEQ ID NO: 14689 - DNA, 757 bp, Triphysaria pusilla
tctttaccccaaatctgcaagctcaatttcatcttcatcctcttcactaacttctttcattcagagaaaaatggaaaccggtgggaaagtaaaaagggagccgctggaaggaaggccggtggaccaaagaagaaatccgtcacccgctccgtcaaagccggtctccagtttcctgtcggcaggatcggtcggtttttgaagaagggtcgctatgctcagcgcgtgggttccggtgctccggtttacctggctgcggttcttgagtaccttgctgctgaggttctcgagttggctggaaatgcagcaagagacaacaagaaaagcaggattatcccaaggcacttgttgctggctgtgaggaatgatgaggagcttggtaaacttctggctggagtgacaattgctcatggtggtgtgataccgaacataaacccggtcctgttgcccaagaaatccgacaaggtgtctgagaaggcgcctaaatcgccatcgaaggctgctaagtctccgaaaaaggcttaaaattcatgttcaattttgaaaggggggtgagtgtagattggtgtgcggcgccgaccggttttgtggctcgacatcggtcagtgatgtagaacatatgtacttaaattatttttctttttaaacaaaatagttcaattttttcttattcagaacaattaattgttgattgttgtatggaaaaaatggagtatattcaaatgctagttattatgtcacgttatcattttttgcgaaa

SEQ ID NO: 14690 - DNA, 716 bp, Theobroma cacao
atccctgaattttttttttgtgaaaaagaaattaactgcaagaattcatttttcctctaattctcaaattttttgagtgatggatgccggagcgaaagtgaagaaaggagccggaggaaggaaaggaggcggtccgaagaagaaaccggtttctcgctctgtaaaggccgggttgcaatttccggtcggcaggatcggtcgttacttgaagaaaggccgttactctcagcgcgtggggaccggtgctcccgtttaccttgctgctgttctcgagtaccttgctgctgaggttctggagttggctggtaatgctgcgagagacaacaagaagaatagaatcattccgaggcatgttcttttggctgtaaggaatgatgaggaacttgggaagcttttggctggtgtgaccattgctcacggtggagtcttacccaacattaacccagttcttctgccaaagaaaaatgacaaggcgccaaaggaacctaagtcgccatcgaaggctacaaagtctccaaagaagtcacctaagaaggcttagtttagtctagtctttgcttcttatttctcttgtctatgtagcttcctttgtgagctttccttgtaacaaaaatgtggatgttggtaggaatttaggaccattgtacttctaattgtctgtgttgtgtagaacatcctatgtttggaatgaatcaaatgaaatttccatgatcaaa

SEQ ID NO: 14691 - DNA, 1272 bp, Zingiber officinale
atttgtatattcgtgttcaatattctgtgcttatcagattgctgaaccaaacacatcaggaacttctatgctgccaaagaaggagcattagtttatgtacacagtagaacacaaaccggaaaggaaggtacagatcaacttcatttctttttcctttatgatttcatgacttgaatcagctttaccctttagaatatgaaggcggctggagcaaacgctggcacaagtttagctgctctatagtacccgtagtcgtccttgaaggagcggggacggacacttctggctgacttggccttcgacgccttgcgcgtcccaccaccgccgccagcggctgccttggccgtggcgtctccggtcgcaaacagcgcgacgtcctccgagatcgacatcagcgacggccgccacggtgccgccctccgctgactcttcgtcgacccggtcggcgccgacgtcgtccggtccttcgccgcctccggccgtggcgatcgccagcgaccctcgcgccgaattcggcacgaggcagatcggttagagctcggtgcgcattttacgctcgacggcggagatggagctaggtggcaaggcgaggaagggcgccggcggccggaggggtggtggcgggcctaagaagaagccggtctctcgctccgtcaaggccgggctccagttcccagtcggtcgcatcgggcgctatcttaagaacggccgctacgcgaagcgcgtcggcaccggcgctccggtctacctcgccgccgtgctcgagtacctcgccgccgaggtgttggagctggcggggaacgccgcaagggacaacaagaagaaccggatcataccgcggcacgtgctgttggccatcaggaacgacgaggagctagggaagctactcgccggcgtcacgatcgcccacggaggggtgctgcccaacatcaacccggtactgttgccgaagaaagccgccggcaaggagcccaaatcgccggccaaatccgccgccaagtcaccgaaaaagccttaatttggttcttctacagcaccagttgtcttaattacttcctcggtatgtgatttctatctaaaattagcctctccctttttttttttatggaattgtggcggattgcaacgctgatgttatcgatgaattcaagggattcctgctgtgatcttcttcattttctgggaatttagcatgaatctagttgctgttacttgcgttcaatcttcaacactcatgctaatctctacattgcttgcgtttgtgaaaaaaaa

SEQ ID NO: 14692 - DNA, 987 bp, Cucumis melo
aaaatcatttccgcaacttcaatccttctcatcgtcatatccactcacccaattccattttcttctcacacccttttgatttttacggccaccccactctagttccgatggaaaccggcggcaagttgaagaagggagctggtggaagaaagggcggcggcccgaagaagaagccggtttcgcgttccgttaaggccggcctccagttccccgttggtaggatcggtcgatacttgaagaatggccgatatgctcgtcgtgttggtactggagcacctgtctacttggccgccgttcttgagtatctcgccgctgaggtgttggagttggctggaaatgccgccagagacaacaagaagaacagaataattcctagacatgtattgttggccataaggaatgatgaagaacttgggaaattgcttgctggtgtaacaattgcacatggtggtgttcttccaaacataaacccagttcttttgccaaagaaaagtgagaaagcaactactaaagaaccaaaatctccatcaaaggctcctaaagcaactaaatctccaaagaaggcttaggttttttcttttttactttttttttcctccatctgaaaaaaaactttgacttgttctttgcccatttgtatgtagtttgttggctttttaggatcttcttctgtgttgtttatcaaatgtaagctccaaaactgatgaatttgatgaatttggagactctgtatcactcctcatcatcttgatgattaaactttgtattggttatgatttgtttaggccatcgatttgctttcttcaatctgctaatctttgtttggtttaatggatgaggatggaagaatggagatatttggtcaattgacctcctaaatttaaatacgagaatagctcaaatcacttttgtgtttttagtatagttttaaatgaataatgtgtgaaaaagttcgaaattaatgtgaattgatttttgagtgactaa

SEQ ID NO: 14693 - DNA, 615 bp, Eschscholzia californica
caccactactaccaagaaaaccgaaacttcagatccaccattttcccggctaattattccggcaaactagttaagaaagatatggataccggaaaagtgaagaaaggtgccggaggaagaaagggaggtggaccaaagaagaaatcagtttctcgttcagttaaagctggtttacagtttcctgtgggtagaatcggtaggtatttgaagaaaggacgttactctcagcgtgtcggaagtggtgctcctgtttatcttgctgctgttcttgagtatctcgcagctgaggtattggagttggcaggaaatgcagcaagagacaacaagaagaacagaataataccaagacatgtattattagcagtaagaaatgatgaagaacttggaaaacttctagctggtgtaaccattgctcatggaggtgttcttccaaatataaaccctattctcttacccaagaaatcagagaaagcagcagaaaaagcagctactaaaacccccaaatctccttccaaggcaactaaatctcctaagaaagcttaattctctttcctcttcttacccacaagaaaaagaaaatcccatcttgttttttgtatgtaaaatttgaagtgg

SEQ ID NO: 14694 - DNA, 929 bp, Chrysanthemum coronarium
cccattcgccaaacacatctcccacggatcacaatctccaccatcaaacccctcccatatccaacggccacaaacccacctcacatttcacccatcaacacaaaaaccatataaatatccccacatcccatcctcacattcccacatcttcatcttcatttcatcttcatccaaacaaacaatcttttatctttctaaaaatggaaacaggtggaaagaaaaagggagcagcagggaggaaagggccaggaggagggccaaggaagaagtctgtgacaaggtctgtgaaagctggccttcagtttcctgttgggaggattggaaggtatttgaagaaggggaggtatgcgaaacgtgtcggaactggtgctcctgtttatcttgctgctgtccttgagtatcttgctgctgaggttttggagctagctggaaatgctgctagggacaacaagaagacaaggatcataccaagacacgttttgttggcgataaggaatgacgaggagctaggaaagcttttgtctggtgtgactattgctcatggtggtgttcttccaaacattaacccggttttgttgcctaagaagagtgccacaaaggaatctacccccaagtctccagcgaaggcggccaagtccccaaagaaagctgctgctgcttagttattgaagaaatgtgactcttgttgtaggttgacttgaattttattttgttgtagggttatgtaggagaattgtatgctggtttgtttatgttaggacctaggtatgaagaagaatctctctttttcgttatcagaattgttagtttctgaatgtatgaaaatgtgtaatcatcagtttgaatgagtactacatttgattgcaaaagacggtgaagtttctcagagctgttttatgttcatttccttgattaaatctttgatgcgg

SEQ ID NO: 14695 - DNA, 498 bp, Gossypium hirsutum
tttttcctccaatttgtatttgaagtgatggatgcaggatcaaaggtgaagaaaggagccggaggaaggaaaggcggcggtccaaagaagaagccggtttctcgttcggtgaaagccggattacagtttcccgttggtcgaattggccgatacttgaagaaaggccgatactctcaacgtgtgggaaccggtgctccggtttaccttgctgctgttcttgaataccttgctgctgaggttcttgagttagctggtaatgctgcaagagacaacaagaagaataggatcattccaaggcatgttctattagcagtgagaaacgatgaagagcttgggaagcttttagctggtgtgactattgctcatggtggtgttttacccaatattaacccagttcttttaccaaagaaaaacgagaaagcggctgcaaaagagcctaagtcgccatctaaggctacaaagtctccaaagaaatcacctaagaaggcttagttgttt

SEQ ID NO: 14696 - DNA, 2439 bp, Gossypium raimondii
gataagaaatcacaaacattttctcgagaaaattttactgcgaaatttcatttccgttttcgattttttcctccaatttgtatttgaagtgatggatgccggatcaaaggtgaagaaaggagccggaggaaggaaaggcggcggtccaaagaagaagccggtttctcgttcggtgaaagccggattacagtttcccgttggtcgaattggccgatacttgaagaaaggccgatactctcaacgtgtgggaaccggtgctccggtttaccttgctgctgttcttgaataccttgctgctgaggttcttgagttagctggtaatgctgcaagagacaacaagaagaataggatcattccaaggcatgttctattagcagtgagaaacgatgaagagcttgggaagcttttagctggtgtgactattgctcatggtggtgttttacccaatattaacccagttcttttaccaaagaaaaacgagaaagcggctgcaaaagagcctaagtcgccatctaaggctacaaagtctccaaagaaatcacctaagaaggcttagttgtttgtctattatagggtttgttttgatttatctgttaatgtatgtaggttccttttgtgtactttggttgtaggaaaatgttggtaatgttgtttagaatatgttttgtttgaaatgaatgaactgaaattcagattatatgggtttgtgcttattttatcaaattgattatcgtcagtgataacattccttcaatcgatcttcccgtactgaaaatctaacaatcatcttaccgggtctatagcatcgcaaccgcgtgcggaggttttgcccttctgttcttcctttccggttatgttcttgtttttgttcttcgttgacttctgttgctttttgccactaaccatgtgggataccaatgttggcaaaggatcgtatacatcgagcactcatgtcgcggtcaacttcaattgtaacccctgtttttcacggctaccttttaagggccgatacctgcttcaatggagtcttctgtaagaacggatgacagcacaaaaggcctaactaaagactccaacgagagcaaggtaactagtcggaatccttgaggaacatccgctgcaatgctgttctaggttgatcgatgaatgaactttattttcacggaattaagatagaatgttaacggttttaagggccgatacctgcttcaatggagtcttctataagaacggatgacagcacaaaaggcctactaaagactcgaccgagagcaaggtaactggtagaaatcctcgaggaatatctgctgcaatgcggttctaagttgattgatgaatgaacattattttaacggaattaagattaaatcgatagaattttttagtatcagaaaaagaactgtagtaatcaatagttaagtgaatatttatccccttacatcaacttgattggattgttccatttcacgaggattgccaaacgagttgcatatacaccgtcgattaaacaaccaattaaacggctcaaaatctccaaatccgtaagccaaatatctcccatttttctctcctcgcataaatagatccaaattatcagatacgaaatcacaaatattttctcgagaaaatttcactgcgagatttcatttcggattttaagtcttttcctccaatttgtacttgaagtgatggatacggtttctcgttcagtgaaagccggattacagtttcccgtcggtcgaattggccggtacttgaagaaagggcgttactctcaacgtgtggggaccggttctccggtttaccttgctgctgttcttgaataccatgctgctgacgtaatttcattttttaccaagcgttgagttatccccatagaagttaaggatttggttgatttaaacttaaattgtagatacacccttaagtatgtttctagaattgggtttttatttatttatttaaaggttcttgagttagctggtaatgctgcaagagacaacaagaataggatcattccaagcatgttctattggcagttaggaacgatgaagagcttgggaagctattagctggtgtgaccattgctcatggtggtgttttacccaacattaacccaattcttttaccaaagaaaaacgagagggcggctgcaaaagagcccaagtcaccatccaaggctaccaagaagtctcctaagaaagcttaatttcatttatttgtatatgtatgtagcttccttcgtgtaggaaaatgttaatactggtaatggtactttgccagtgttgtttagaacagactttggtctgaaatgagtgaagtgaattcagattatatggcgttgtgttaatggcatttgttgcatcgttgtagggtaataaaggctgtttcgtcttgttagtgtaaagtctctttgccccttgcaatagttgcttttct

SEQ ID NO: 14697 - DNA, 715 bp, Momordica charantia
atatccagggagcccccgatatttctctaatccctgcaactgaactgcaactgcgtttgattttccggcgacggggtcaaattccgatggagaccggcgggaagttgaagaagggagcaggagggagaaagggcggcggcccgaagaagaagccggtttcacgttccgtcaaggccggcctccagtttcctgtcggtaggatcggtcgatacttgaagaatgggaggtatgctcgacgtgtcggaaccggagctccggtatacttggccgccgttctcgagtatctcgccgccgaggtgctggagttggctggaaatgcagcccgagacaacaagaagaacaggataattcctcggcatgtattgctggccataaggaacgatgaggagcttgggaaattgcttgctggtgtaacgattgcgcatggtggtgttcttccaaacattaatccagtgctgttgcccaagaaaagtgagaaggcagtcacgaaagaaccaaaatccccatcaaaggtcaccaaggcaacaaaatccccgaagaaggcttagatttcctctcaaaaaacttgacttgttcgtcccccatttgtatgtactttggcttttaggatcatcttctgtgttgtttatcaatgtaagctcagaattgatgaaattctagactctgtattcctcccaccatcttaatgataaaactctgtactggttatgattgt

SEQ ID NO: 14698 - DNA, 742 bp, Lippia dulcis
caaacgttctcacgtagaagatactctcatttcctgtttgtagtaaccatatttgctctccgtcgatatttaggttcagttgtcagatattcatctcatggagaccaccggaaaagtgaagaagggtgccggaggaaggaagggtggaggcccgaagaagaaggcagtttcacgctctgtcagagccggtctgcagtttccggtgggtaggattggacgttacttgaagaaaggccgctacgcccagcggattggcaccggagccccagtgtacatggcagccgttctcgagtatttagccgctgaggttctggaattggctggaaacgctgcgcgagacaacaagaagaacagaattatccctaggcatgttctgttggctgtgaggaacgatgaggagctcgggaagttgttgcagggtgtcaccattgctcatggtggtgtgcttccgaacatcaacccggttctgttgccaaagaagaccggaggcgcggacaaggcggcgaaggagccgaaatcaccgtccaaggctggcaagtcaccgaagaaggcagctgcttagatttacatagaattggttcatcagagatttaattcctctatggtgttttgggcttagatttagtttgtaagagaattggacgtgaagaaaaagaagtttaatgttgtaattatgtagttctgttgttttgaagcccgttctaaatatcaatcaagtgaatcgaacctcattttgcggatc

SEQ ID NO: 14699 - DNA, 951 bp, Citrullus lanatus
acggtcagacgtgcacccatttgtgaatccgcctccatccccaaatccccgttgttttatgccgctctataaaatcattcccgcaacttcaatccttcagatcgtcatatccactgactcaatttccattttcttgtaattccttttcattttccggcgaccaagttaagttcccatggagaccggcggcaagttgaagaagggagcaggaggaagaaagggcggcggcccgaagaagaagcccgtttctcgctccgttaaggccggtctccagttccccgtcggtaggatcggtcgatacttgaagaatggccggtatgctcgacgtgttggtactggagctccggtctacttggccgccgttcttgagtatctcgccgctgaggtgttggaattggctggaaatgcagccagagataacaagaagaacagaataattcctaggcatgtattgttggccataaggaacgatgaagagctcgggaaattgcttgctggtgtaacaattgcacatggtggtgttcttccaaacataaacccagttctgttgccaaagaaaagtgagaaggcaaccactaaagaaccaaaatctccatcaaaggcccccaaagcaaccaaatctccaaagaaggcttaggtttttttttttttttttttttttttttttttttatctgaaaaacttttgacttgttctttgcccatttgtatgtactttgttggctttttagggtcttcttctgtgttgtttatcaatgtaagctcaaaactgatgaatttgagactctgtatcactcctccatcatctcgatgatcaaactctgtattggttatgattgtttagccatcaatttgctttctttgtttggttaaatggatgaggttggaagagtgggagtatttgatcaattgagctcccaaattagaactttgacgtcaatcttcaatatca

SEQ ID NO: 14700 - DNA, 596 bp, Helianthus annuus
gacacaaaaccatttcccacacagaaacacacacaaaacaaaatcccaaatggaaaccaccggaaaagctaagaagggtgtcgcaggtcgcaaagccggcggtccaaggaagaagtccgtcacccgctccgtcaaagccggtctccagtttcccgtcggcagaatcggccgttacctcaaacacggccggtatgcaaagcgtgtcggtaccggtgctccggtttacctcgccgccgtcttggaataccttgcagctgaagtgttggaattggctggaaatgcagctagggataacaagaagaacaggataacaccgagacatgttttgttggcgataaggaacgatgatgagctggggaagttgttggccggagttacgattgctcatggtggtgttttgccgaacattaacccggtgttgttgccgaagaagagtgctgctgctgctaaagagactaagtcgcctgttaaacctggaaagtctcccaagaaggccgcataatttgggttgggttaagttgtagttaaaattgggaatgaatgtagtttggtaatagtgtttgttatgtttatgttgaggttaatgaatgaatgaa

SEQ ID NO: 14701 - DNA, 681 bp, Artemisia annua
tggccattacggccggggaccacattcacacacactcaaaacacacatattcatcaattactcatttatataaaaatggaaggaactggtaagatcaagaaaggaaggaaagctggtgggccacgaaagaagtcagttactcgatctgttaaagcggggcttcagtttccagttggtagaattggaaggtatttgaagaaaggtcgttatgctaagcgtgttggtactggtgctcctgtttatctcgctgccgtactcgagtacctcgcagctgaagtgttggaattggctggaaatgcggctagggacaacaagaagaccagaataatcccgagacatgtgttgttggcgattaggaatgatgaggagcttggaaagctgttgtctggagttacgattgctcatggtggtgttttgccgaatatcaacccggtcttgttgcctaagaagactgctgctaaagaatcaacaccaaagtctccatccaaagttggaaagtcgccaaagaaagctgctgcttagattagtttgattgtgatttggggtgttttcttttggttggtttcgtagagaagttagtgtagttaatttgattagatgtaatcgtttctactgaatgaaaactacttgtttctgtaaaaaaaaaaaaaaaaacatgttggatctagaattgtcgagcgt

SEQ ID NO: 14702 - DNA, 588 bp, Chrysanthemum coronarium
ttttataaaaatcaaatggagggaaccggtaaaattaagaagggatcagcaggaaggaaagctggtgggccgcgaaagaagtcggtgaccagttctgtcaaagccgggcttcagtttccagttggaagaattggaaggtatttgaagaaaggtcggtacgctaagcgtgttggtactggtgctcctgtttatctcgctgcggtcctcgagtatctcgcagctgaagtgttggaattggcaggaaatgcagcaagggacaacaagaagaacagaataatcccaagacatgtgttgttggcgattagaaacgacgaggagcttggaaagttgttgtctggtgttacgattgctcatggtggtgttttgccgaatatcaacccggtcttgttgcctaagaagactgctgctaaagaatcaacaccaaagtctccctcaaaagttggaaaatctcctaagaaggctgctgcttagattagtttgatgtggttgatttgatgtaattggggtgttctattttggttgacgtgatagtgatgttagtgtagttaatttgattagatgtaatattttctatggaatgaaacccac

SEQ ID NO: 14703 - DNA, 549 bp, Chrysanthemum coronarium
aaaatcaagaagggagcagcaggaaggaaagcaggcggtccacgaaagaagtcagttactcgatctgttaaagccgggcttcagtttccagttggaagaattggaaggtatttgaagaaaggtcgttacgctaaacgtgttggtactggtgctcctgtttatctcgctgcggtcctcgaatacctcgcagctgaagtgttggaattggcaggaaatgcagcaagggacaacaagaagaacagaataataccaagacatgtgttgttggctattagaaacgacgaggagctcggaaagttgttgtctggagttacgattgctcatggtggtgttttgccgaatatcaacccggtcttgttgcctaagaagaccgctgctaaagaatcaacaccaaagtctccctcaaaagttggaaagtctcctaagaaggctgctgcttagattagtttgatggtgattgatttgatgaaattgtggtgttctattttggttgatgtgatagtgatgttagtgtagttaatttgattagatgtaatcttttctactgaa

SEQ ID NO: 14704 - DNA, 613 bp, Chrysanthemum coronarium
ggaaccggtaaaatcaagaagggagcagcaggaaggaaagctggtgggccccgtaagaagtcggtcacccgatcttttaaagctgggcttcagtttccagttggaagaattggaaggtatttgaagaaaggtcgttatgctaagcgtgttggtactggtgctcccgtttatctcgctgccgttctcgaatacctagcagctgaagtgttggaattggcaggaaatgcagcaagggacaacaagaagaacagaataatcccaagacatgtgttgttggcgattagaaatgacgaggagcttggaaagttgttgtctggtgttacgattgctcatggtggtgttttgccgaatatcaacccggtcttgttgcctaagaaaactgctgctaaagaatcaacaccaaagtctccatccaaagttggaaagtctcctaagaaaactgctgcttagattgatggtgattgatttgatgtaattgtggtgttttcttttggttgatttcatagagaagttagtgtagtgaatttgattagatgtaatcatttaaattgaatgaaacccactcgtttctgtttattttgccgtgtttaataatttagttgtaaaaccaggc

SEQ ID NO: 14705 - DNA, 696 bp, Cichorium intybus
ggggatcaatcacttgtttacatagcaaaaattcaattgtatacatacccataaagagaaatggataccaccggaaaagcgaagaagggtgccggaggaaggaagggtggtggcccaaggaagaagtcggtgactcgatccgtcaaagctggtctgcagtttcccgttggtaggattgggcgttaccttaaggccggacgctatgctaaacgtgttggaaccggtgcaccggtctacctcgccgctgttcttgaataccttgctgctgaagttttggagttagctggaaatgctgctagggacaacaagaagtccagaattatcccaagacatgttctattggccattaggaacgacgatgaactaggaaaattgttgggtggtgttacaattgcacacggtggtgttcttcctaacatcaaccctgttctattgccaaagaagtcggcaacaacagagcccaaatcaccatcaaaagctgctaaatcaccaaagaaagctgccaaatctccaaagaagactgaatagactactgtagtttggatgttgttggtctgtgtgtgtatttgtcgttaaattgcatatggagttagttttctaacaatttcgtttgtttagatgatctatcatatgttctcacctctgttcatcaatggaagaaaccacttgtttctatttttatattttgtatctcca

SEQ ID NO: 14706 - DNA, 632 bp, Solanum tuberosum
gatcatctctccgacaatcaattatctctttcaaagaaaataaagaagctattcttgaaatggagtctaccggaaaagtgaagaagggtgccgccggcaggaggggaggaggcccaaagaagaagcctgtttcccggtctgtaaaggccggtcttcagttccccgttggaagaatcggaaggtttttgaaaaaaggccgatacgctcaacgtgttggttctggtgctcccgtttacttggccgccgttcttgaatatttggctgctgaagtgttggagttggctggaaatgctgctcgtgataacaagaagaacagaatcatcccaaggcacttgcttttggctgtgaggaatgatgaagaacttgggaaacttcttgctggtgtaacaattgcacatggtggtgttcttcctaacatcaacccaattttgttgccaaagaagactggaggtgaaaaggcccctaaatctccatccaaagctaccaaatctcccaagaaggcttagattcctaatgggttttttttttttggatcttctgtgtatgtaattttgttgttagaagctgatgattattaaatggaattagttggaactactgttaagttttttttcctcaatcatcaatcaatg

SEQ ID NO: 14707 - DNA, 718 bp, Solanum tuberosum
gcattgtgtttggtaccgggaatcggccattacggccggggatatctctccgacaatcaattatctctttcaaatcaaacaaaataaagaagcagttgttgaaatggagtctaccggaaaagtgaagaagggtgccgccggcagaaggggaggaggcccaaagaagaagcctgtctcccggtctgtaaaggccggtcttcagttccccgttggaagaatcggaaggtttttgaaaaaaggccgatacgctcaacgtgttggttctggtgctcccgtttacttggccgccgttcttgaatatttggctgctgaagtgttggagttggctggaaatgctgctcgtgataacaagaagaacagaatcatcccaaggcacttgcttttggctgtgaggaatgatgaagagcttgggaaacttcttgctggtgtaacaattgcacatggtggtgttcttcctaacatcaacccaattttgttgccaaagaagactggaggtgaaaaggcccctaaatctccatccaaagctaccaaatctcctaagaaggcttagattctattagggtgttggtttttttggatcttctgtgtatgtaattctgttgttagaagctgttgattgtccttgatggatattaaaatggaattagtggaactactgttagatctttgttagtttttttctcaattatcaatcaatgaaaccccttgtttcgacttt

SEQ ID NO: 14708 - DNA, 655 bp, Solanum phureja
atcatctctccgacaatcaattatctctttcaaagaaaataaagaagctattcttgaaatggagtctaccggaaaagtgaagaagggtgccgccggcaggaggggaggaggcccaaagaagaagcctgtttcccggtctgtaaaggccggtcttcagttccccgttggaagaatcggaaggtttttgaaaaaaggccgatacgctcaacgtgttggttctggtgctcccgtttacttggccgccgttcttgaatatttggctgctgaagtgttggagttggctggaaatgctgctcgtgataacaagaagaacagaatcatcccaaggcacttgcttttggctgtgaggaatgatgaagaacttgggaaacttcttgctggtgtaacaattgcacatggtggtgttcttcctaacatcaacccaattttgttgccaaagaagactggaggtgaaaaggcccctaaatctccatccaaagctaccaaatctcccaagaaggcttagattcctaatgggtttttttttttttggatcttctgtgtatgtaattttgttgttagaagctgatgattattaaatggaattagttggaactactgttaagttttttttcctcaatcatcaatcaatgaaaccccttgtttcgactttaca

SEQ ID NO: 14709 - DNA, 801 bp, Rosmarinus officinalis
gttcaacttcaatactcgcagagggctaaaatcgtcatttcatttccatggaggctgccgcaaaaccgaagaagggcgctgcgggaaggaggggcggcggccccaagaagaagccggtctcccgctccgtcagagccggcctgcagtttccggttggcagaatcggccgttacttgaagaaaggccgctacgcgcagcgtgttggcactggcgcgccggtatacatggctgccgttctcgagtatttagctgctgaggtgctcgagttggctggaaatgcggctcgggacaacaagaagaacaggatcatcccgaggcatgttctattggctgtgaggaatgatgaggagctcggaaagttgttgcagggcgtgaccatcgctcatggcggtgtgctgccgaacatcaatccggtgctcttgccgaagaagactggtggagacaaggccactaaggagccgaagtcgccagccaaggctgcaaaatcgcccaagaaagctgctgcttagttttaggtggattgggtttttatcaattttatgtgatttttggcttagaatgtgttccttggcggaatttagagggcagagaatgaatgatgttgtaattatatagtgctgttgatttagagcccagttttaatatgaatctagttaattcagccacattttgcggatcgcgtttggtttcattgttatttcttaagatttgttgtggtttttgtttagtgctgtttcattagatggttattctgccggaatcattagctaaatttttgccgtttcgttaaagttggcactg

SEQ ID NO: 14710 - DNA, 758 bp, Actinidia deliciosa
aaaataggttcaccaatctgctatttcggctgtctgtttcttgggaaaatcgtgcaaccgtgaaaatggagaccggtggaaagatgaagaaaggtgctgcgggaagaaggggcggtggtccgaagaagaaaccgattacgcggtccgtcaaggccggcctgcagttccctgtcgggaggatcggccggtacctgaagaaaggccgatacgctcagcgcgtcggcagcggtgctccggtttacctcgccgccgtgctcgagtacctcgctgctgaggttttggaattggctgggaatgctgcgagagacaacaagaagaatagaatcataccgaggcacgtgcttcttgccgtgaggaacgatgaggagcttggaaagctacttgctggtgtgacaattgctcatggaggagtgcttcccaacatcaaccctgttcttctccccaagaaaactcaagcaacaaaggagcccaagtctccaaccaaggccactaagtcacctaagaaagcgtaacttctcggtgtgtctaagaaagcctttttgtgcaattttagctctctagaaactctttctctccctgtatttaacttcatcttctgttgtgatgtgaggaaatcttcatgttgtaggagatattgcaatctgtttcaatttgtttgaaatcaaagacatgaattgttagttcaaatcctgttagtttaatgtattgttgtctgtgttagttttttatttaaaaaaatcatttggctgtttgaaaaa

SEQ ID NO: 14711 - DNA, 693 bp, Triticum aestivum
ccctcccctcccgcgtcccgacgagcaccagcggccagacatggacgcctcagccaccggagccggagcgaaggggaagaagggcgcggccgggcgcaaggccggcggccccaggaagaaggcggtggcgcggtccgtcaaggccgggctgcagttccccgtcggccgcatcgggcggttcctcaagaagggccgctacgcgcagcgcgtcggcatgggcgcccccgtctacctcgcctccgtcctcgagtacctcgccgccgagctgctggagctcgccgggaacgccgccaaggacaacaagaagtcccgcatcatcccgcgccacctgctgctcgccatccggaacgaccaggagctcggcaggctgctcgccggcgtcaccatcgcgcacggcggcgtgctgcccaacatcaaccccgtgctgctccccaagaagacggcggagaaggagcccaagtcgcccaagaaggccgccaagtcccccaagaaggccgacaagaaggcgtagagacagacgagcatcgattagcttgtagaactaatggtttcgatgtagatctgtgctgccaggaaagaaaacaattcagaaatctctcttcgattggcttagccgctgtagtgctctgttgtaacggtgattgctgtgacgtagatctgtgctgcgaagaggaaaaagtgagaaatctctct

SEQ ID NO: 14712 - DNA, 700 bp, Arnica chamissonis
aaaataaccaaccgtttgtttacagatagataacgagaaatggaagctaccggaaaagccaaaaagggtgccggaggacgaaaaggaggaggccccaggaagaaggcggtgactcggtccatcagagccggtctacagttccctgtcggtagaattgggcgttaccttaagaacggacgttatgcgaagcgtgtaggaaccggtgctccggtttatctcgctgccgttcttgaataccttgctgctgaagtgttggaactggccggaaatgcagcaagagacaacaagaagaacagaataatcccaaggcacgttcttttggcgattaggaacgatgatgagcttggaaagctattatcaggggtgacgattgctcatggtggtgttcttccaaacataaaccctgttctactaccaaagaagacagctgcaaaagagcctaaatcgccggctaaatctaccaaatctccaaagaaagctgcttagattggtgtaattgggttgttcttttgttatgtcgttgtagttaagttaataatgggaattagttttctattatttgttatcttggtgtttatggattgaaaaaacctcttgtttctattctccattgttgcattctcaacaatcaaaagatgaatataaagatgatctgtagggatgtgcaagaatagtagaatactgaaatttcagatatttg

SEQ ID NO: 14713 - DNA, 753 bp, Daucus carota
acacttatttcatgctattcatacactgatctccttgtgcagttaattgtatacttacagcaacctcatctccgacgaccaaccggaaatggaaggcggtggaaaagtgaagaaaggtgccgccggcaggaaagcaggtgggcccaagaagaagccggtgtctcgctccgtcaaggccggactcacgtttccggtcggtaggattggccggtttctcaaaaaaggccggtatgctcagcgtgtcggtaccggagctccggtgtatctcgccgccgttctcgagtatcttgctgctgaggtgttggagttggctggaaatgcagccagagacaacaagaagagcaggattataccaaggcatctactgttggctataagaaatgacgaggagcttggaaaattgcttgctggagttactattgctcatggaggcgttcttcccaacattaacccggttctgttgcctaagaaatcagagaaggcgagtcaggagtcaaccaaatcgccatccaaggcaactaaatcccctaggaaagctgctgcttaagatttgttagattggtagggatgtttctggttgcagttattctggtgcttcttgtatgtaattgttcaagtctccgagtggttgtttagagattagttggactgtaattgttgttgattgtcctatattagtacttgaaatgatcttaattgggaatgaagtgtcaaatatatgacttctgttgattaattcacttggaatgttac

SEQ ID NO: 14714 - DNA, 548 bp, Centaurea maculosa
tcaccaaaatcaatcacttgtcaaatatatcaccggagagaagaaaatggaaagtaccggaaaagcgaagaagggcgccggtggccggaaaggtggcggtccaaggaagaaggcggtgactcgctccatcagagctggtctccagttccccgtcggtaggattggccggtaccttaagaacggccgttatgctaagcgtgtaggtaccggagctccggtgtacctcgccgccgtgcttgaataccttgccgctgaagttttggaattggcagggaatgctgcaagggataacaagaagaacaggataatcccaagacatgtgcttttggcaattaggaatgatgatgagcttggaaaactgttggctggagttactattgcacatggtggtgttcttcccaacattaacccaattctgcttccaaagaagacagctgcaaaggagcctaaatcaccatcaaaagctaccaaatctccaaagaaagctgattaggttatgataatgaatggttgttgtttatgtctctctgtaatttgtagttaaattg

SEQ ID NO: 14715 - DNA, 746 bp, Chrysanthemum coronarium
ctttctaaaaatggaaacaggtggaaagaaaaagggagcagcaggaaggaaagggccaggaggagggccaaggaagaagtcggtgacaaggtctgtgaaagctggcctgcagtttcctgttgggaggattggaaggtatttgaagaaggggaggtatgcgaaacgtgtcggaactggtgctcctgtttatcttgctgctgtccttgagtatcttgctgctgaggttttggagctagctggaaatgctgctagggacaacaagaagacaaggatcattccaagacacgttttgttggcgataaggaacgatgaggagctaggaaagcttttgtctggtgtgactattgctcacggtggtgttcttccaaacattaacccggttctattgcctaagaagagtgccacaaaggaatctacccccaagtctccagcgaaggcggccaagtccccaaagaaagttgctgcttagttattgaagaaatgtaacctgttgtgatgtaggttgactttttatcttgttgtagggttatgtaggagaattgtatgctggtttgtttatgttaggacctaggtatgaagaagaatctctcttctttgttatcagaattgttagtttccgaatgtatgaaaatgtttaagcatcaatttgaatgggtacttaatttgttgggcaactttgtgctttttgaatcttgccacggatgagtaggattttaattgggaaatatgaagttgacttgttgttt

SEQ ID NO: 14716 - DNA, 668 bp, Cirsium arvense
tgaaggattcatcaaattagttgaagatttggatgattaaaggtcaagaacacaaaggtatgtgtagaacaactagtattttaagttgaaactcttatttaggccaatgattcaatcttcgatttcataatctgtttttggacttgaaattgtgagaagagaagaaaatggaatctaccggaaaagcgaagaagggcgccggtggccggaaaggtggcggtccaaggaagaaggcggtgactcgctccatcagagctggtctccagttccccgtcggtaggattggccggtaccttaagaacggccgttatgctaagcgtgtaggtaccggagctccggtgtacctcgccgccgtgctcgaataccttgccgctgaagttttggaattggcagggaatgcagcaagggacaacaagaagaacagaataattcctagacatgttcttttggcaattaggaatgatgatgagcttggaaaactgttggctggagtgacaattgcacatggtggtgttcttcccaacataaacccaattctgctaccaaagaagacagctgcaaaggagcctaaatcaccatcaaaagccaccaaatctccaaagaaagctgattaggttatgataatgaatggtgttgtttatgtctgtctgtaatttgtagttaaattg

SEQ ID NO: 14717 - DNA, 610 bp, Cyclamen graecum
cagagagagagaatggagtcgacggggaaagcgaagaaggggtttggaggaaggaagggtggaggcccgaagaagaagccggtgtctcggtccgtcaaagccggcctgcagttccccgttgggaggattggccgataccttaagaaagggaggtactcgcagcgggttgggactggagctccgatctaccttgctgcggtcctcgagtaccttgctgctgaggtgttggaattggctggaaatgctgcccgtgacaacaagaaaaacaggattattccgaggcatgttctccttgcaatcaggaatgatgaggagcttggaaaattactagctggggtgacgattgcccatggtggtgttctcccaaacatcaacccgatcctgttgcccaagaagacagcagacaaggagcctgcatcccctgcaaagaaggccaccaaatccccgaagaaggcttagaatggaatgtcccaagattagtagtgtttaataaccatttgctttttgttgtttgttatgtatccatccatctgggtttggaacatcctcctcctcctcctatgcttgtttaaatcatcagttgaagaaacttcctgtttctattgtccca

SEQ ID NO: 14718 - DNA, 572 bp, Flaveria ramosissima
caaatcacaaaaacagcaatggaagccaccggaaaagctaaaaagggtgccggaggtcgcaaaagcggtgaccggaagaaagccgtcactcgttcaatcagagctggtttgcagtttcccgttgggagaatcggtcgatacctcaagaacggacgttatgcgaagcgtgtcggcaccggagctccggtgtacctcgccgccgttcttgaataccttgctgctgaagttttggagttggctggaaatgcagcgagagataacaagaagaacaggataatcccaaggcatgtgcttttggcgattaggaacgatgatgagttggggaaattgttagctggggtgacaattgctcatggtggtgttcttccgaacattaaccctgttttgttgccgaagaagacagctgctaaggagcctaaatcgccggctaaagctaccaaatctccgaagaaagctgcttaggttgatgtgattgtgttgttcttttgtggtgttattgtagttagattggaaatggagtttatgtagtttttggtgtctgtggattgttattttgttatattaatggaagg

SEQ ID NO: 14719 - DNA, 763 bp, Mimulus guttatus
tccattttcaatctcacaatcttcttctttagctcttcgtcgttcctttatcgtagcagagagaaatggaagctggcggtgtgaaagcgaagaaaggagctgcgggaaggaaggccggcggtccgaagaagaaatcggtttcccggtccacgaaagccggtctacagttccccgtcggcagaatcggccgttatctgaagaaaggacgctactctgagcgcgtgggctccggtgcgcctgtgtacttggctgctgtgcttgagtaccttgctgctgaggtattggaattggctggaaatgcagcaagagacaacaagaagaacaggattactccaaggcattttctgcttgctgtgaggaacgacgaggaactcggaaaactccttgccggagttacgattgcgtatggaggagttttgccgaacatcaatccggttcttctgcccaagaagaacgaaaaggtgggcgaaaatgaaaatgctgcaaaatcgccatcaaaggcgactaaatcccctaagaaagcttagtatgtactgttcttttgttcggatatatagttgaattggatgaagtcgttcgatttgtagagtttgggttgtgtaatttggaataatgtttctgttcgtatgtagagaatatgtttacatcaccattatagctctgctgcaaattatagtaaatcgtttgttacgattgtatcacctctcatgagttccaaattacagtggattattgaaaaactggtccagctcgaggattcgat

SEQ ID NO: 14720 - DNA, 548 bp, Allium cepa
cttctttctccccaaatcaattcagaaaaccctaggtttaatcgagaagtccaaactcgaagcaatggagggaggcggaaaaatgaagaagggagctgcaggtagaaaggggccaagcggacccaggaagaagtccgtcacaagatccgtcaaagctggtcttcaattccccgtcggccgtattggccgatacttgaagaaaggccggtacgctcagcgtgttggcaccggagctcccgtttaccttgcggccgttcttgaatatttagcagcagaggtcctagagcttgctggaaatgcagcgaaagacaacaagaaaaaccgaatcattccgaggcacgttcttcttgcaataagaaacgatgaagagttggggaaactgttaggtggagtgacaattgcgcatggtggagtgttgccgaacattaaccctgtccttttgcctaagaagactgctgcaaaggaatccgacacctcaaaatctcctaagaagactgctgccaaaacacctaaaaaggctgcttaacagatttcgatggaagatgccg

SEQ ID NO: 14721 - DNA, 634 bp, Allium cepa
ccccaaatcaattcagaaaaccctaggtttaatcgagaagtccaaactcgaagcaatggagggaggcggaaaaatgaagaagggagctgcaggtagaaagggaccaagcggacccaggaagaagtccgtcaccagatcgatcaaagccggtcttcaattccccgtcggccgtattggccgatacttgaagaagggccggtacgctcagcgtgttggcaccggagctcccgtttaccttgccgccgttcttgaatatttagcagcagaggtcctggagcttgctggaaatgcagcgaaagacaacaagaagaaccgaatcattccgaggcatgttcttcttgcaataagaaacgatgaagagttgggaaaattgctaggtggggtaacaattgcgcatggcggagtattgccaaacatcaaccctgtccttttgcctaagaagactgccgcaaaggaatctgagaccccaaaatcacccaagaagaccgctgctaaaacgcccaaaaaggctgcttaatttatttttgatggtagaaccgaattactgtgtttatatgatgaaagattatgtgactttctattggaagtttgatggtagaaccgaattactgtgtttaaaggctgctaaaacgcc

SEQ ID NO: 14722 - DNA, 616 bp, Helianthus annuus
caaaaaacaacttacaaactcgtagcagtttctctattttcatccttttctttttcaaatggagtccaaaaagggtgccggtggcagaaaggctggtggtcctaagaagaaacccgtttcccggtccgtcaaagccggtctccaattcccagttggcaggctcggtcgttacctcaaaaaaggccgctatgcacggcgcgtaggcactggtgctccggtctaccttgccgccgttctcgagtaccttgccgctgaggttttggagttggcgggaaatgcagcaagggacaacaagaagaacaggattattccgagacatgttttgttggcggtgaggaatgatgaagagcttggaaagcttctagcgggtgtgacgattgctcatggtggtgttcttcccaatattaacccggttcttttgccaaagaaggctgctgcaaaggaggctacaaaatctccagcaaaagtgactaaatcaccaaagaaagcctagtgtttgtgtgttttaggattttgtgtaattaggaaacacaatttgatggatgattttaggggaatttttgttgttggctataggtttgttaagaacatcttgtttgaaatgaaatgtcagcca

SEQ ID NO: 14723 - DNA, 575 bp, Helianthus annuus
ttttagagatggagtcgaccggaaaggtgaagaagggagccgcaggaaggaaagccggcggtccaaggaagaaggcggtgacccgttcagtaaaagccggtcttcagttcccggtcggtagaatcggccggtttttgaagaaaggtcgttatgctcaacgtgttgggtccggtgcacccgtctaccttgctgctgtccttgagtacctagcagcagaagtgttggagttggctggaaatgcggccagggacaacaagaagaacagaataataccgaggcatgtgttgttggccattaggaatgatgaggagcttggaaagcttttgggtggagttacaattgctcatggtggtgttttgccgaacattaacccgattcttttgccgaagaagactgctgctaaagaacctaagtctccatcgaaggctactaaatctcccaagaaagcaaagtagtttaatgtagagtttgttgtaattgctttttttttggttttgtggtggttttagaatagtttgtgttcacaagtatcgtattcaacctagagaatgaaattgcttgtttctgttttgggt

SEQ ID NO: 14724 - DNA, 848 bp, Triticum aestivum
cccctcctcccgcgtcccgacgagcaccagccgccggacatggacgcctcagccaccggagccggagcgaagtccaagaagggcgcggcggggcgcaaggccggcggccccaggaagaagtcggtgacgcggtccgtcaaggccgggctccagttccccgtcggccgcatcgggcgctacctcaagaacggccgctacgcgaagcgcgtcggcacgggcgcccccgtctacctcgccgccgtcctcgagtacctggccgccgagctgctggagctcgccgggaacgccgccaaggacaacaagaagtcccgcatcgttcccaggcacctgctgctcgccgtgaggaacgaccaggagctcgggaggctgctggccggcgtgaccatcgcgcacggcggcgtgctgcccaacatcaacccggtgctgctccccaagaagacggcggagaaggagcccaagtcgcccaagaaggctgccaagtcccccaagaaggccgaaaagaaggcttagacagagacgcgcatcgatcgattagcttgtcgtgctctgtagaactaatggtgtagatgtagatctgtgcttccaagaaaaaccaattcagaaatctctcttcgattggcttagccgctgtagtgctctgtagtaacagtattgctgttgtcgatgtagatctgcgctgcgaagaggaaaatgtcagaaatctctctgatttgagcaaattgtttgttcttctgtttttagtattgcaaaatgttaacataggagtggtggaaaaactcagatctgttcgaacttgtcagcatttctttgcttgtggtactgaattcgcccgatggtacttttccttg

SEQ ID NO: 14725 - DNA, 935 bp, Rosmarinus officinalis
cggccggggcagctcaaggttttctgaaattgttggtgccgccatatcacgtgatgtgccagacagtgaaaagtcgaaaatgcccttggttttgaagaacaaggcacctaggtggcacgaacagcttcaatgctggtgtctgaacttcaggggacgcgtgacgattgcctctgtgaagaacttccagctgattgccgcccaaccgccaccagtagcagcgggggctccatcttcatctaagaattcaccgttccaacgattaattttccctcttttgattcatcacaagtgttgcggaatctatggagacaggaggaaaagtgaagaagggtgctgcaggaaggaagggcggtggcccgaagaagaagcccgtttctcggtctaccagggccggcttgcaatttccggttggcagaataggccggtacttgaagaagggtcgctattctcagcgagttggtactggtgctccggtttatatggctgctgttcttgaatatttagctgccgaagttcttgagttggctggaaatgctgccagggataacaagaagaacagaataatccctagacatgtgctcctggccataagaaatgatgaagaacttgggaaattgctggccggtgtgacaattgcacatggtggagtgctaccaaacattaatcccgtcttgttgccaaagaagactgaaaaggccaccaccaaggagaccaagtctccagccaaggctaccaaatctcccaagaaggctgctgcttagatttgtctaactggattaggcttctttaccttcttagaggttcttagatggatgtgtatgtaatgtgggttagagcctttttagccttatgttttggaggatagcagaaaatggtattgtaattgttagcttgtgatttaggagcttcaacttgaatcgataaatctgattgaa

SEQ ID NO: 14726 - DNA, 666 bp, Pisum sativum
gaacacagtgatttaattggaatcagaaaatggacgcaagcacaaaggtgaagaaaggagccggtggaaggaaaggaggaggaccaaggaagaaatcggtgacaagatctgttagagccggacttcaatttcccgtcagtagaatcggtcgttttttgaagaaaggaagatatgctcagcgtgttggtaccggtgctcctgtttacttggccgctgttcttgaatatcttgctgctgaggttcttgagttggctggaaacgcagcacgtgacaacaagaagaatagaattagtccaagacatttgctgctggctgtgaggaacgatgaagaacttggaaaattacttgctggtgttaccattgctcatggtggtgttcttcctaacatcaaccctgttcttttgcctaagaggactgaaagtgcttcttcttctgcaaaggaacctaaatctccatcaaaggccaagaaaactcccaagaaagcttagattttgcttctcccttctgtgttgatatctcttaatcttagtttttaggcgtctctctctttttaatatataacaagcaatcaatgtaattccaatgtcattagttaatgaaatccttttatttttaatacacaatgctttgctggtgtttgtttatgatccaaaaaaaaaaaaaaaa

SEQ ID NO: 14727 - DNA, 674 bp, Lupinus angustifolius
ctctctctaagcacaaaaagtctctaagcttatttggcttcaatggatgccaccagcggaaaatcgaagaaaggtgccggaggaaggaaaggcggtggtccaaggaagaagtccgtgacgagatccatcagagctggtcttcaattccccgttggaagaatcggacgttacttaaagaaaggaagatacgctcaacgtgttggaactggtgctcccgtttacctcgccgccgttctcgaatatctcgccgccgaggttttggagttggctggaaatgctgctcgtgataacaagaagaatagaattatcccaaggcatgttttgttagcagtgaggaatgatgaagagcttgggaaattgctttctggtgttactattgcacatggtggtgttattcctaatattaacccagttttgttgccaaagaagaatgaaaaggttgttgctgctaaagaaccaaaatctccatctaaggctactaagtcacctaggaaagctgcttgatgagttttagttttaggattaatgtttatttcttactatattagtcattagctgtactctgaagtgtgaaatttggtgctttggaagtaatgtaatgtggattgtattatgtccttttaggattttcaatgaatgatttaaaacagcttgttttaagattttcgactcta

SEQ ID NO: 14728 - DNA, 708 bp, Medicago truncatula
attcttcaatttctcaaaccaaaacattccttcttctccgcattcaaattttctttttctctcaaaatttttctcagtttgaaatggaggcaagcaccaagacaacaaagaagggagcaggaggaaggaagggaggaggaccaaggaagaagtcggtgacaagatccatcagagctggtcttcaatttccggttggaagaatcggtagatacttgaagaaaggaagatacgctcagcgtgtaggcacaggtgctccagtatacctagcagcagttcttgaatatctcgctgctgaggttcttgagttggctggaaatgcagcacgtgataacaagaagaatagaatcattccaaggcatgtgttgttggctgttaggaatgatgaagaacttggtaaattgcttaatggtgttaccattgctcatggtggtgttcttccaaacattaaccccatcctcttgcctaagaagactgaaaaggctgtttctaaggagccaaagaaggctggaaagtctccaaagaaggcttagatctgatctgttttcaatctttagatgattgtgtttatatctaagactagggttactttatgtcatagaaatcggttttagtgctttcatataatgcaatgtaactccatcttattgcatttctcctttaggacttttatctatcaatgaaatttattcaatttcaatattataaact

SEQ ID NO: 14729 - DNA, 486 bp, Scabiosa columbaria
cctcacaattactagatcacagcatttagattaaattttatcttctcgctgatatggataccggtgccaaatcaaagaaaggagcagccggaaggaagctcggcggtccaaagaagaagccagtgtctcgatcagtcaagtccggtcttcagtttcccgtcggtcgtatcggccggtacctgaagaaaggacgatacgctcagcgcgttggaactggtgctccggtgtacttggccgccgttctcgaatacctagcagctgaggtattggaattggctggaaatgcagcaagggataacaagaagaacaggataattccaaggcatgtgttgttggcaatcaggaatgatgaagagcttggaaaattgctttctggtgtaacaattgcacatggtggcgttcttccaaatataaaccctattcttttgcctaagaagactgctgctaaggagcctaaatctccttccaaggcaactaaatctaccc

SEQ ID NO: 14730 - DNA, 745 bp, Silene vulgaris
acttctctcccacacttcaccccatcaataattcatctacttttctctctctctttttaccttcatttcccggtcacataaccgacagatggactccaccggtggtaaaggcaagaaaggcgcagccggtcgtaagggtaccggtcctaaaaagaagccggtttcacgatcggtcaaggccggtttacagtttccggtcggtcgtattggtaggtatttgaagaaagggaggtatgctcagcgtgttggtagtggtgctccggtttatctctccgctgttcttgaatatctcgccgctgaggtgttggagttggccggaaatgcggcacgtgacaacaagaagaacaggataataccacgacacgtgctgttggctgtgaggaacgatgatgagctcggaaagctgttagccggagtgacaattgcacatggaggtgtgttgccgaatattaacccggtgttgttgccaaagaaggctgctgagaagtcaccaaaggaacctaagtcgccttccaaggctaccaaatctcctaagaaagcagcagcttgaaagcctaagctaatttaattaagagatagatgaactgttgtttgtttgattaatgtcatttgtacttaatttgtcgttctttgtttagatttgtgaattcgcatttcgtagtaatcggatggatgttgtagttgtagcagagaattgaaatgaaaagttgtttagcatgcaattaaaaaatggaagttgtttggc

SEQ ID NO: 14731 - DNA, 745 bp, Centaurea maculosa
aaatggagaccggtgggaagttgaaaaagggcgctgccggaaggaaggccggtggtggtcccaagaagaagccggttacccgttccgttaaggccggtttgcagtttccggtcggcaggatcggccggtacctgaaaaaaggccggtattcgaagcgtgtcggtaccggagctccggtgtacctcgccgccgttctcgagtaccttgctgctgaggtgttggagttagctggaaatgctgctagggacaacaagaagaacaggatcatacccagacatgttttgttggctgtgagaaatgatgatgagcttggaaagcttctctctggtgtgacaattgctcatggtggtgttctaccaaacatcaatccagttcttttgccaaagaagtcacatgaaaaagctacaaaggaaccttcaaaatctccatccaaagcaaccaagtccccaaagaaagcttagttgttgaacagtctctttattctccttgtatctatctattcacctctttttggtgatgtagggatatattaaatgaaatgttatgatggtgttttttagggagatttagaagtacttgtcttttgatatatgattatgtttaggagctaggtttgaagaagaagaatctctctttttctgaatcttttttagatgggtgttacatttgtataagaaaattgttaaagattgctcagatatgttgatgtgtttcttggacaaaacaaatcaaacagggccgcctc

SEQ ID NO: 14732 - DNA, 707 bp, Cocos nucifera
ggccaatttctgaaggatagagagcgagagagatcaccggagaggagagagatggagctcgggggaaaggtcaagaagggcgctggcggccggaggggcggcgggccgaagaagaagccggtctcccggtccgtcaaggccgggctacagttcccggtcggccggatcggccgctacctgaagaagggccgctactcccagcgcgtcggaaccggagcccccgtctaccttgctgccgtcctcgaatacctcgccgctgaggttctggagctggccggtaacgcggcgcgggacaacaagaagaaccggatcatcccgaggcacgttctgctggcggtgaggaacgacgaggagttgggcaagcttctcgctggggtgaccatcgcccatggaggggttctgcccaacattaacccggtgcttctcccgcagaaggccgcgagcaaggagcctaagtcgcctaccaagtccaccaactcccccaagaaagcttaggagccgttgacccctgtgttgttattcccgctttcttcattctgtatgtaattctgtggatcctttttaggttgttttcttcttttgtttggtgtagggcatggtgttatgaggaggaggggacaagacttggaagaaaggatttgtatcaattctctttcgtttcaggaaatgttaaagacggtgtttttaatgtggaattgatgtttttt

SEQ ID NO: 14733 - DNA, 726 bp, Allium cepa
tagttacgggggccattacggccagttacggggatcgtaatcgtatttcccccaaataaaatccggaaaccctagctttaatttagaagttcaaactcaaagcaatggaggcaggcggaaaaatgaagaaaggagctggaggtagaaagggaccgagcggacccaggaagaagtccgtcacaagatcggtcaaagctggtcttcagttccccgtaggacgtatcggcagatacttgaagaagggccgatacgctcaacgtgtcggtaccggagcgcctgtttaccttgccgccgttctggaatatctagcagcggaggtcctagagctggctggaaatgcagcgaaagacaacaagaagaatcgaataattccaagacatgttcttcttgcaataagaaacgatgaggagttgggaaaattgcttggtggagtgaccattgcgcacggtggagtgttgccaaatataaaccctgtccttttgcctaagaagactgctgctaaggaatccgagactccaaaatcacctaagaagactgctgccaaaactcccaaaaaggctgtttaattgatttttatggtagatgtcaattgctgtgtttatataatgaagtttggcggtttgaagttttcctcaaattataatgtcaactgagattgtgtcaagttctgacgtgatatggatttagacttgttttctctcttgcttttacgatccgttgagttgc

SEQ ID NO: 14734 - DNA, 621 bp, Allium cepa
gtatttcccccaaataaaatccggaaaccctagctttaatttagaagttcaaactcaaagcaatggaggcaggcggaaaaatgaagaaaggagctggaggcagaaaggggccaagcggaccgaggaagaagtcggtcacaagatcggtcaaagctggtcttcagttccccgtaggccgtattggccgatacttgaagaagggccgatacgctcaacgtgtcggtaccggagcacctgtttaccttgccgccgttctggaatatctagcagcggaggttctagagctggctggaaatgcagcgaaagacaacaagaagaatcgaatcattccaagacatgttcttcttgcaataagaaacgatgaggagttgggaaaattgcttggtggagtgaccattgcgcatggtggagtgttgccaaatataaaccctgtccttctgcctaagaagactgctgctaaggaatccgagactccaaaatcacctaagaaggctgctgccaaaactcccaaaaaggctgtttaactgattttgatagtagatgccaatatctgtgtttatataatgtattttcttccattctataagcgtggatttgctgtttcatgtttgcgaatttttt

SEQ ID NO: 14735 - DNA, 636 bp, Secale cereale
tccccctcctctcccgcgtcccgacgagcaccagccgccagacatggacgcctcagccaccggaggcggagcgaagggcaagaagggcgcggcagggcgcaaggccggcggccccaggaagaaatcggtgacgcgatccgtcaaggccgggctccagttccccgttggccgcatcggccgctacctcaagaagggccggtacgcgaagcgcgtcggcacgggcgcccccgtctaccttgccgccgtcctcgagtacctcgccgccgagttgctggagctcgccgggaacgccgccaaggacaacaagaagtcccgcatcgtgcccaggcacctgctgctggccgtgaggaacgaccaggagctcgggaggctgctggccggcgtgaccatcgcgcacggcggcgtgctgcccaacatcaacccggtgctgctccccaagaggacggcggagaaggagcccaaggagggcaagtcgcccaagaagaccgccaagtccccaaagaaggccgacaaaaaggcttagagagagacgcgcgtcgattagcttaagctttgctgtaacagtgatcgctgttttactaatggtgtcgatgtagatctgtgctgccaagaaaaagcaattcagatttttctctg

SEQ ID NO: 14736 - DNA, 1513 bp, Zea mays
ctttctaaaaaaatcatctccgaaaactgcacatattccaaatctccctatataagcagacacagctaggtgggtgattacaataggcattcaatcattcaagcgaagcagccaccaccctctccactgtgactccgtgacctgcctgccctgctgcacagcacagcacacacaccccgcacaccgcaccagctcagctcagctcaccaagacaatcaatcatggctcgcccgcgcagtgtcgctgccgctgcccccctcctgctgctgctcgccgccgccgcagcggggctcgtgtccgccgcgtcgccggcagccagcgacttcgtccgcaagtcgtgccgcacgacgcagtacccgtcggtgtgcgagcagagcctggcgtcgtacggcgggtcgccgccgccgcggagcccgcgggagctggcgcgcgccgcgctgtcggtgagcgcggaccgcgcgcgcgccgcgtcggcgtacgtgggccgcctgtgcggcgccagcaacggcaaaggcgcgaagaaggggtcggggtcggggtcggggtcggcgtcggcaggtcccgtgcgagactgcctggacaatctggcggacagcgtgggccacctccgcgacgcggcgcaggagatgggcggcgccgggatgggccgcgcggggacgccggcgttcaggtggcacctcagcaacgtgcagacctggtgcagcgccgcgctcaccgacgaggacacctgcctcgacggcctctcgtcccgcgccgtcgacgccggcacgcgcgccgccatccggggcaaggtcgtcgaggtcgcgcaggtcaccagcaacgcgctcgcgctcgtcaataaggtcgggcctgggtactaacacggtgaggggacccaagatccaggcccaggcccaggccagataccacacccgctactagtataatactaggcgcctccacacctccacggcgttgggtgtttctcgtccgttaatagctcggtttgctttgcttgtgtttgtgtaagatatacattagttaagggcaataagcttgtactattatgagtggcggccgaggagtacagtacgttctcctctgtccgatcatgccatcattaacattaattaatgtgggagatatcttttgtccaatgtggggctacaggcaaaggcacgtccgttctactacgagtgtcttgttgtgcctgggacaggcagaggcgtcgtgcactcatcgatggaaggacaaggaccggacctccagttgccaaacagagagtttgtggtgacctgtcagtcttacgtggccatgtggccttggacccgcacgcggcacgcatgcatggcatgggggcagtgtcagactgccagtcaagtgctacttccgtccgatccatgcttggccggttaattagtttattaaccgcgcgatgtctcatcggacggcattcgtgtccatcgtcgcgcgcgccatcgattaggcttctaaaaagttattattagtcctcgtaaaatattaatccctcggc

SEQ ID NO: 14737 - DNA, 1294 bp, Sorghum bicolor
cacaaatttccaaatctccctatatataaggagacacggaggtgggtgattacaaaagccattcaatcattcaagtgaagcagccagcacactccactgtgactccgtgatctgccggcactgcacactccccgcacagccgcaccaccagctagctcagcaatcatggctcgcctgctcctcctcctcgccgccgccgccgcagcggcgttcctggccgtggaggccgcgtcgccggtggccagcgacttcatccgcaagtcttgccgcgcgacgcagtacccgtcggtgtgcgagcagagcctggcgtcgtacgggggcaccccgccgccgcggagcccgcgggagctggcgcgcgccgcgctgtccgtgagcgcggaccgcgcgcgcgccgcgtccgcgtacgtgggccgcctgtgcggcgccggcaccggcgcgaagaaggggtccgggtcgcggccggcggcggcgggccccgtgcgcgactgcctggagaacctggcggacagcgtgggccacctccgcgacgcggcgcaggagatgggcggcgccgggatgagccgctccgggacgcccgcgttcaagtggcacctcagcaacgtccagacctggtgcagcgccgcgctcaccgacgagaacacctgcctcgacggcctctcctcccgcggcgtcgacgccggcacgcgcgccgccatccgcggcaaggtcgtcgaggtcgcgcaggtcaccagcaacgcgctcgcgctcgtcaacaaggtcgggcctgggtactagcccaaggcccaggcccaggaccaagcccagcccagataacaccccttgccagcagacggatcaggtgttctttgtgcgtcggttatgtctggtttttcattttaccactttgcttgtgttgtgtaagatatagttaagggcgataagtacactaagacgcatgtactcttctgtccgatcctgtcactgtcacggtcacggtgaataagctaagtgtcatcgttaacattgatatgatcttaaaagaaaatataaaaacgtttactagaaattagtagtgtgtctgtgctaacactaggatataatataaaacaagataaagttgtaaaagaatacaatcagattcattaaaattagtgtctttatcactttcgtaaaaaaaactatgtgagagaaccaaaaccgtttggttgaggttagtccatctcacctatgagcggtctgctttttcttcctctaacaccaactgttcctctccctcgtaggtgagacattttatccaacatgtgaagcatgtttt

SEQ ID NO: 14738 - DNA, 1209 bp, Capsicum annuum
gttctctcacatttcaaattatctaacaaatagtcacattttcttggagtacatatggctaaagacattgaagttggcactgaatatgcaccaaaagactaccaagatccacctccagcacccttgattgaccctgaagaacttggtaaatggtcattttatagagccattattgctgaattcatcgccacattgttattcctctatatcactgtccttactgtaattggctacaagagccaaagtgccaccgaccaatgtggtggtgttggcattcttggaattgcttgggcctttgggggtatgatattcgtacttgtttattgcactgctggtatttctggtggacacattaaccctgctgtcacattcgggcttttcttggcccgaaaagtgtcgctggttcgggccattatgtacattgtggctcagtgtttaggagccatttgtggttgtggtttggtcaaggcttttcaaaaggcgtattatttcaggtatggtggtggtgctaatacgttgaatgatgggtatagcacgggtactggtttgggtgcggagattataggcactttcgttcttgtttacactgtctttgccgccactgatcctaagagaaacgccagagactctcatgttcctgtgttggcaccactcccaattggattcgcggtgttcatggttcacttggctacaattcctgttactggaactggtattaatcctgctaggagttttggggctgctgttatttatggcaaagacaaagcatgggatgaccaatggatattttgggttggaccctttattggtgctgcaattgctgcattttaccatcagtttattttgagagctggagcagtcaaagcacttggttccttcagaagcaatgcctaatcatcaagaatcaatagctgggaggcctatgagaaatggagtcaaattaaagaatggtcaaatttcccacttaatatgggatatgatacatccatttaagaaattgtatataagtatttgggagaagtcttttcaaattatgctttcttaggttattagagttgtcttggctatttggcacttgttttaaatgtgccaaacattgtcactgcagcttctcgagttgtttccctttcttttgtgtgtttatgtaattttcactatgcttgttttgagcatccaaataatggaatgagcaaggctatattagctatt

SEQ ID NO: 14739 - DNA, 1131 bp, Solanum tuberosum
gttttctcaaatcacaaaattaacttagcaaacctcaaagttaacatattcttcttcttcttcttatttggtgtacaaatggcaaaagacattgaagttgccactgaatatgccccaaaagactaccaagacccacccccagcacccttaattgatcctgaagagttaggaaaatggtcattttacagagccataattgctgaattcatagctactcttttatttctctacataactgtcctcactgttattggatacaaaagccagagttccactgaccaatgtggtggtgttggtattcttggaattgcttgggcatttgggggtatgatttttgtacttgtttattgtactgctggtatttctggtggacacattaaccctgctgttacattcggccttttcttggcacgaaaagtatcgttggttcgggccataatgtacattgtagctcagtgtttaggagccatttgtggttgtggattggttaaatcttttcaaaaagcttattatgttaaatatggtggtggtgctaatatgttgagtgatggatatagtactggtaccggtttgggggcagagattattggaactttcgttcttgtttacactgtttttgctgctactgatcctaagaggaatgccagagactcacacgttcctgtattggcgccacttccaattggatttgcggtgtttatggttcacttggctacaattcctgttactggaactggtattaatcctgctaggagttttggggctgctgttatttatggacatcacaaagcttggaatgaccaatggatattttgggttggaccatttattggtgctgcaattgctgcattttatcatcagtttattttgagggctggagctgttaaagcacttggttcattcaggagcaatgcttaataattatcatcaagaattgaaattgtatataagtatttgagaagaaaagtctctttgaattatgttgttagagttgtcttggctgtttggcacttattttagatttgccaaacaacttttctactttgtttcccttttcttttttgtgtgtgtttctgtaattttcactatgctatgttttaagcatccaaataatgaaatagtaaggctatt

SEQ ID NO: 14740 - DNA, 1240 bp, Solanum phureja
tattattctttcatacactagaaggccaattttctccataaatacccctttcactcctcatcaattccactacactctgttttctcaaatcacaaaattaacttagcaaacctcaaagttaacatattcttcttcttcttcttttttggtgtacaaatggcaaaagacgttgaagttgccactgaatatgcaccaaaagactaccaagatccacccccagcacccttaattgatcctgaagagttaggaaaatggtcattttacagagccataattgctgaattcatagctactcttttatttctctacataactgtcctgactgttattgggtacaaaagccagaattctactgaccaatgtggtggtgttggtattcttggaattgcttgggcatttgggggtatgatttttgtacttgtttattgtactgctggtatttctggtggacacattaaccctgctgttacattcggccttttcttggcccgaaaagtatcgttggttcgggccataatgtacattgtagctcagtgtttaggagccatttgtggttgtggattggttaaatgttttcaaaaagcttattatgttaaatatggtggtggtgctaatatgttgaatgatggatatagtactggtaccggtttgggggcagagattattggaactttcgttcttgtttacactgtttttgctgctaccgatcctaagaggaatgccagagactcacacgttcctgtactggcgccacttccaattggatttgcggtgtttatggttcacttggctacaattcctgttactggaactggtattaatcctgctaggagttttggagctgctgttatttatggacatcacaaagcttggaatgaccaatggatattttgggttggaccatttattggtgctgcaattgctgcattttatcatcagtttattttgagggctggagctgtgaaagcacttggttcattcaggagcaatgcttaataattatcgtgaagaattgaaattgtatataagtatttgagaagaaaagtctctttgaattatgttgttagagttgtcttggctgtttggcacttattttagatttgccaaacaacttttctactttgtttcccttttcttttttgtgtgtgtttctgtaattttcactatgctatgttttaagcatccaaataatgaaatagcaaggctattgtccatttaacttcccccttctttattataa

SEQ ID NO: 14741 - DNA, 1178 bp, Capsicum annuum
tatacaaacattataatttcttgcttaaagatgcctaaagacgttgaagttggcactgaatatgcaccaaaggactaccaagatccacctccagcacccttaattgatcctgaagaacttggtaaatggtcattttatagagccattattgctgaattcatcgccacattgttattcctctatataactgtccttactgtaattggctacaagagccaaagtgccactgaccaatgtggtggtgttggcattcttggaattgcttgggcctttgggggtatgatattcgtacttgtttattgcactgctggtatttctggtggacacattaaccctgctgtcacattcgggcttttcttggcccgaaaagtatcgttggttcgggctattatgtacattgtggctcagtgtttaggagccatttgtggttgtgggttggtcaaggcttttcaaaaggcttactattttaggcatggtggtggtgctaatacattgaatgatggatatagcacgggtactggtttgggtgctgagattattggcacttttgttcttgtttacaccgtctttgccgctactgatcctaagagaaacgccagagactctcatgttcctgtattggcaccacttccaattggattcgcggtgttcatggttcacttagcaacaatacctgttactggaactggtattaatcctgctaggagttttggggccgctgttatttatggcaaagacaaagcctgggatgatcaatggatattctgggtgggaccctttattggtgctgcaattgctgcattttaccatcaatttatcttgagggctggagctgttaaagcacttggttcattcagaagcaatgcataatcatatcaagaatttctagttgggaggcctatgaaaaatggagtcaaattaaagaatggtcaaaatttcccacttaatatgggatatgatgcattccattcaagaaactgtatataagtatttgggagaagtcttcaaattatgttttcttatgttattagagttgtcttggctatttggcattttttaaaaatgtgccaaacatcgtcattgctgcttttctagttgtttccctttcttttttgtgtgtgtttatgtaattttcaatatgcttgatttgggcatccaaataatggaatgagcaaggc

SEQ ID NO: 14742 - DNA, 1099 bp, Solanum phureja
aaaaaacagagagccaaaaatgggtaaagacattgaagttggtactgaatatgcaccaaaagactaccaagatccacccccagcacccttaattgatcctgaagagttaggaaaatggtcattttacagagccataattgctgaattcatagctactcttttatttctctacataactgtcctgactgttattgggtacaaaagccagaattctactgaccaatgtggtggtgttggtattcttggaattgcttgggcatttgggggtatgatttttgtacttgtttattgtactgctggtatttctggtggacacattaaccctgctgttacattcggccttttcttggcccgaaaagtatcgttggttcgggccataatgtacattgtagctcagtgtttaggagccatttgtggttgtggattggttaaatcttttcaaaaagcttattatgttcagtatggtggtggtgctaataagttgaatgatggatatagtactggtaccggtttgggggcagagattattggaactttcgttcttgtttacactgtttttgctgctaccgatcctaagaggaatgccagagactcacacgttcctgtactggcgccacttccaattggatttgcggtgtttatggttcacttggctacaattcctgttactggaactggtattaatcctgctaggagttttggagctgctgttatttatggacatcacaaagcttggaatgaccaatggatattttgggttggaccatttattggtgctgcaattgctgcattttatcatcagtttattttgagggctggagctgtgaaagcacttggttcattcaggagcaatgcctaaaaattatcatcaagaattgaaaattgtataaaagtatttgagaagaaaaatctctttaaattatgctttttatgttattagagttgttttggctgtttggcatttgtttttagatttgctaaacaatgtcactactactttttttattttcctttttttgtgtgagtgcttctgtaattttcactatgcttgttttgagcatccaactaatggaattatgaacaaggctttatccttata

SEQ ID NO: 14743 - DNA, 1049 bp, Solanum tuberosum
caaatcacaaaattaacttagcaaacctcaaagttaacatattcttcttcttcttcttatttggtgtacaaatggcaaaagacattgaagttgccactgaatatgccccaaaagattaccaagatccacccccagcacccttaattgaccctgaagagctaggaaaatggtcattttacagagccataattgctgaattcatagctactcttttatttctctacataactgttctcactgttattgggtacaaaagccagagttccactgaccaatgtggtggtgttggtattcttggaattgcttgggcatttgggggtatgatttttgtacttgtttattgtactgctggtatttctggtggacacattaaccctgctgttacattcggccttttcttggcacgaaaagtatcgttggttcgggccataatgtacattgtagctcagtgtttaggagccatttgtggttgtggattggttaaatcttttcaaaatgcttattatgttcagtatggtggtggtgctaatacattgagtgatggatatagtactggtaccggtttgggggcagagattattggaactttcgttcttgtttacactgtttttgctgctaccgatcctaagaggaatgccagagactcacacgttcctgtattggcacctcttccaattggatttgcggtgtttatggttcacttggctacaattcctgttactggaactggtattaatcctgctaggagttttggagctgctgttatttatggagatgacaaagcttggaatgaccaatggatattttgggttggaccatttattggtgctgcaattgctgcattttatcatcagtttattttgagggctggagctgtgaaagcacttggttcattcaggagcaatgcctaattatcatgaaaaattgtatataagtatttgagaagaaaagtctctttgaattatgttgttagagttgttttggctgtttggcacttattttagatttgccaaacatttttctactttgtttccttttcttttttgtgt

SEQ ID NO: 14744 - DNA, 1084 bp, Solanum melongena
ccacactctgttctctcaaatatcaaacacttttcaacatcagtctttaatttctttagttagccaaaaaacagagagcaaaaaaatggcaaaagacattgaagttggcacagaatatgcaccaaaagattaccaagatccccctccagcacccttaattgaccctgaagagttaggaaaatggtcattttacagagccataattgctgaattcatagccactctgttattcctctacataactgtcctgactgtaattggctacaaaagccagagtgaaactgacaaatgtggtggtgtcggcattctcggaattgcttgggcttttgggggcatgattttcgtccttgtttactgcactgctggtatttctggaggtcacatcaaccctgctgtcacgttcgggcttttcttggcccgaaaggtgtcgttggttcgggccataatgtacattgtggctcagtgtttaggagccatttgtggttgtggattggtgaagtcgtttcaaaaggcttattatgttaagtatggtggtggtgctaatagcttgaatgatggatatagcacgggtgccggtttgggtgcggagattattggaactttcgttcttgtttacactgtttttgctgctactgatcctaagaggaatgccagagactctcatgtccctgtgttggcgccacttccaattggatttgctgtgtttatggttcacttggcaacaattcctgttactggaactggtattaatcctgccaggagttttggggctgctgttatttttggtaaagataaaccctgggatgaccaatggatattttgggttggaccttttattggtgctgcaattgctgcattttatcatcagtttattttgagggctggagctgttaaagcacttggttcatttagaagcaatgcctaacaatcatcacctatttaaactgtatataagtattatttgacaagtctttttaaattgtgctatttgtgctcttttatcatttttggcacttgttttacattgtgttgtacctttcttcctgcttgcctatctagagatcaatggaaaaaataaaatctc

SEQ ID NO: 14745 - DNA, 1191 bp, Nicotiana benthamiana
cactacattctcctctctcagaattggcaaagctcaaatttaacatattatgagtctattctttggtgaacaaatggctaaggacactgaagttggcacagaatacgccccaaaagactaccacgatccaccccctgctcccttaattgaccctgaggagctggggaaatggtcgttttacagagccataatagctgaattcatagccactttattatttctctacattactgtcctcactgtgattggatacaagagccaaattgaccctgaccataacggtgagcaatgtggtggtgttggaattcttggaattgcatgggcatttgggggcatgatttttgtccttgtttattgtacggctggtatttctggtggacatattaaccctgctgttacatttgggctattcttggctagaaaagtgtcgctggttcgcgcaattatgtatatattggctcagtgtttaggagccatttgtggttgtggtttggttaaggcatttcagaaggcgtattatgttaagtatggtggtggtgctaatacgttgaatgatggttatagtacaggtaccggtttgggtgctgaaattattggaacttttgttcttgtttacactgtttttgctgctactgatcctaagagaaatgctagagactctcatgttcctgtattggcaccacttccaattggatttgctgtgttcatggttcatctggctacaattcctgtaactggaactggtattaacccagctagaagttttggagctgctgttatttatggtaaaaacaaagcctgggatgaccaatggatattctgggttggacctttcatcggagctgcaattgctgcattttaccatcaattcatattgagggctggagcagtcaaagctcttggttcattcaggagcaatgcctaattaatcacgagaatctgcaattgtatatttgagagaagtctttatgcttttcgtttagtagagtggttttggctatttggcacttttttaaaatgtgccaaatatttgtcagtgctgcttttcttcttgtttcccttgcttgttttttttgtttgtgtatgtaatttttcttatgcttgtttcagatgcaaaataatggtatgtgcaaggctattatatttaactcttcttcttcaccaaatttaatataacaatatcgttttttt

SEQ ID NO: 14746 - DNA, 1230 bp, Solanum lycopersicum
ttttctccataaatacccctttcactcctcactcctcatcaattccactgcactctgtttttctcaaatcacaaaattaacctattctttatctttctttttggtgtacaaatggcaaaagatatggaggttggtactgaatatgcaccaaaagatttaccaagacccacctccagcacccttaattgatcctgaagagttaggaaaatggtcattttacagagctataattgctgaattcatagctactctgttatttctctacataactgtccttactgttattggctacaaaagccagagttccactgatcaatgtggtggagttggtattcttggaatcgcttgggcatttgggggtatgatctttgtacttgtttactgtactgcgggtatttctggtggacacattaaccctgctgttacatttggtcttttcttagctcgaaaagtatcgttggttcgagctatcatgtacattgtagctcaatgtttaggagccatttgtggttgtggattagtaaaagcttttcaaaaagcttattatgtcaaatatggcggtggtgccaatacgttgaacgatggatatagtactggtactggtttgggtgcggagattattggaacattcgttcttgtttacactgtttttgctgctaccgatcctaagaggaacgccagagactcacacgttcctgtacttgcgcctctacccattggatttgcggtgtttatggttcacttggctacaattcctgtaactggaactggaattaatcctgcaaggagttttggtgctgctgttgtttatggacataacaaagcttgggatgatcaatggatattttgggttggaccatttattggtgctgcaattgctgcattttatcatcagtttattttgagagctggagctgttaaagcacttggttcattcaggagcaatgcttaattagtacaattatcatgaagaattgaaaattgtatatataagtatttgagaagaaaaaaagtctctttgaattatgttgttagagttgtgttggatgtttggcacttaattttagatttgccaaacactacatttctactttatttcccttttttctttgtgtgtgtttgtgtttttgtaatttttactatgctaatgttttaagcatctaaataatgaaaatagcaaggctattgtccatttaactttccccccttccctattataatgaatcttcg

SEQ ID NO: 14747 - DNA, 1017 bp, Nicotiana benthamiana
tattactcacaccaaacccaaagcttctccataaatacatcctttcactcctcaacaactccactacattctcctctcttaaaattagcaaagctcaaatttaatttcttatgagtatattttttggtgaacaaatggctaaagacactgaagttggcacagaatacgccccaaaggactaccaagacccaccccctgcacccttaattgaccctgaggagctaggaaaatggtcattttacagagccataatagctgaattcatagccactttattatttctctacattactgtcctcactgtaattggatacaagagccaaattgaccctgaccataagggtgaagaatgtggtggtgttggaattcttggaattgcatgggcatttgggggcatgatttttgtccttgtttattgtactgctggtatttctggtggacatattaaccctgctgttacatttggactattcttggctaggaaagtttcattggttcgtgccattatgtatatgttggctcagtgtttaggagccatttgtggttgtgggttggttaaggcatttcagaaggcgtactatgttaagtatggtggtggtgctaatacgttgaatgatggttatactacaggtacaggtttgggtgctgaaattattggaacttttgttcttgtttacactgtttttgctgctactgatcctaagagaaatgctagagattctcatgttcctgtgttggcaccacttccaattggatttgctgtgtttatggttcatttggccacaattcctgtaactggaactggtattaacccagctagaagctttggagctgctgttatttatggtaaagacaaagcatgggatgaccaatggatattctgggttggacctttcattggagctgcaattgctgcattttaccatcaattcatattgagggctggagcagtcaaagcacttggttcattcaggagcaatgcctaattaatcacgagaatctgcaattgtatatttg

SEQ ID NO: 14748 - DNA, 1319 bp, Petunia hybrida
attgagactcatgtataggtgactcatagtaacagtttgtacaaaaagacaggactggtaccggtaccggaattcctcgagacactgttggcctactggacttctctacatccagctctctctcaacattagcaaagctaaactttaacatacttcttttcggtgcacaaatggctaaggacattgaggttgccactgaatatgcaccaaaggactaccaagacccacctccagcacccttgattgaccctgaagaactaggaaaatggtcattttacagagctataattgctgaattcatagccaccctcttatttctttacataactgttctcactgttattggatacaaaagccagagtgacattacagctaatggtgatcaatgtggtggtgttggtattcttggcattgcttgggcttttggtggcatgattttcgtacttgtttactgcactgctggcatttctggaggacacattaatccagctgtgacttttggacttttcttagctagaaaagtgtcattggttcgtgcaattgcgtacatagtggctcagtgtttaggagctatttgtggatgtgggttagtgaaggctttccagagtgcttattatgttaagtatggtggtggtgctaatacactcgctgagggctataacactggcactggtttaggtgctgagatcattggtacatttgttcttgtttacactgtctttgctgccactgatcctaagagaaatgctagagactctcatgttccagtgttggcaccacttccaattggatttgctgtgttcatggttcatttggcaacaatccctgttactggaactggtattaaccctgctagaagttttggggctgctgttatttatggcaaagacaaagcctgggatgaccaatggatattctgggttggacccttcattggtgctgcaattgctgcattttaccaccaattcatattgagagctggagcagtcaaagctcttggttctttcaggagcaatgcctaatttatcatgtcaatatgcagttatgagaatatgaaaatgaaatcaaagaatggtcaagttttcaagttcacaagggacatcatttcatgaagaaactgtatataagtagtatttgaagggaaatctctttaaattatgctttattatattagagtagtctgtggctgtttggcgctacttattttttaagtgccaaacattgttcttgtttgccaacgttgttttctatttgtgtttatgtaattttccttatgcttatttgagcattaaaataatggaatgagcaaggttatttcc

SEQ ID NO: 14749 - DNA, 1254 bp, Nicotiana benthamiana
acaccctcaaattaaatttccaactccataaataccccatcacccttctatcaacttcactccagccaaatatcaaacaatattttcaagattagtctttcttccttagccgaattaaacaaagagcaaatatgggcaaggacattgaagttggcacagaatatgccccgaaagactaccaagacccaccccctgcacccttaattgaccctgaagagctaggaaaatggtcattttacagagccataatagctgaattcatagccactttattatttctctacattactgtcctcactgtaattggatacaagagccaaattgaccctgaccataagggtgaagaatgtggtggtgttggaattcttggaattgcatgggcatttgggggcatgatttttgtccttgtttattgtactgctggtatttctggtggacatattaaccctgctgttacatttggactattcttggctaggaaagtttcattggttcgtgccattatgtatatgttggctcagtgtttaggagccatttgtggttgtgggttggttaaggcatttcagaaggcgtactatgttaagtatggtggtggtgctaatacgttgaatgatggttatactacaggtacaggtttgggtgctgaaattattggaacttttgttcttgtttacactgtttttgctgctactgatcctaagagaaatgctagagattctcatgttcctgtgttggcaccacttccaattggatttgctgtgtttatggttcatttggccacaattcctgtaactggaactggtattaacccagctagaagctttggagctgctgttatttatggtaaagacaaagcatgggatgaccaatggatattctgggttggacctttcattggagctgcaattgctgcattttaccatcaatttatactgagagctggagcagttaaagcacttggttccttcaggagcaatgcctgattgaataaatctgcaattatgaagtacttgagaaaatggagtcaatgaatataaggtcttaaattcagagttcaaactatataattgctccaagtaactgtaaataagtattccagaaaaagatggtctcttcaaattgtgttttgttgccttttgccctttctcttattgttttttaccagttgtttttcctggtagttttctttcctcctcctgtcaccactatccaaataaaataatgaaattagcaaggactttcgtgcttattggc

SEQ ID NO: 14750 - DNA, 925 bp, Nicotiana tabacum
tgaagttggcaccgaatacgccccaaaagactaccaagacccaccccctgcacccttaattgaccctgaggaactaggaaaatggtccttttacagagccataatagctgaatttatagccactttattatttctctacatcactgtcctcactgtaattggatacaagagccaaactgaccctgaccataacggcgaacaatgtggtggtgttggtattcttggaattgcatgggcatttgggggcatgattttcgtccttgtttattgcactgctggtatttctggtggacatattaatcctgctgttacatttggactattcttggctaggaaagtgtcgttggttcgtgcaattatgtatatgttggctcagtgtttaggagccatttgtggttgcgggttggttaaggcatttcacaaggcgtactatgttaagtatggtggtggtgctaatatgttgaatgatggttatagtacaggtaccggtttgggtgctgaaattattggcacatttgttcttgtttacactgtttttgctgctactgatcctaagagaaatgctagagactctcatcttcctgtgttggcaccacttccaattggatttgctgtgttcatggttcatttggccacaatccctgtaactggaactggtattaaccctgctagaagttttggagctgctgttatttatggtaaagacaaagcatgggatgaccaatggattttctgggttggaccttttattggagctgcaattgctgcattttaccatcaattcatattgagggctggagcagtcaaagctcttggttcattcaggagcaatgcctaatttatcacgagaatctgcaattgtatatttgagaagaagtctctctaaattatgcttttcatttagtagagtgttcttggctgtttg

SEQ ID NO: 14751 - DNA, 1087 bp, Petunia hybrida
tcagttttgtacattattttatctatagctctcaaacaaacattatttagtgttaagtgtacaaatggccaaggacatcgagtatggtgagtacaacgcccctaaggactaccaagatccacctccagcaccactcattgacacagaggagcttggaaaatggtctttttatagagccattattgctgaattcattgccactctcttatttctctacatcactgtcctcactgtgattggctacaagagccaaagtgacactacccataatggtgatcaatgtggtggtgttggcattcttggcattgcttgggccttcggtggcatgattttcgttcttgtttactgcactgctggtatttctggaggacacattaatccagctgtgacatttgggctattcttggctagaaaaatctcattgattcgagcagttttatacatggtagcacaatgtttaggagctatttgtggttgtggtttggtaaaggcattccagaaggcttactatgttaagtatggtggtggtgccaatgaacttgctgatggttacagcacaggcactggattaggtgctgagatcattggcacttttgtccttgtttacaccgtcttctctgccacagacccaaagagaaatgctagagactctcatgttcctgtattggcaccacttccaattggatttgctgtgtttatggttcacttggccactattccagtcactggaactggtattaacccagccagaagttttggagctgcagtaatctatggcaaagaaaaagcttgggatgaccaatggatcttttgggttggaccttttattggtgctgccattgctgcaatataccaccaatacatattgagagctggagcagttaaagcacttggctcattcaggagcaatgcctaattataaatattgaatgctaagaaaattctgaggtcaaatggttatggttacatgtagaaatttgtatagatgtatcagtgaaggaaagggcctcttaaattgtgatttgttagcagtgtggttttggcagtttggtacttatttttatatgtgccaaattaaagttgttgt

SEQ ID NO: 14752 - DNA, 1093 bp, Solanum phureja
ccacaatcaattattttcacacatttctctctaactcaaaaacaaatatttttagtagtttacaaatggccaaggatatggagtatggaaatgaccaatatgcccctagtaaagactaccaagacccacctccagcaccacttattgaccctgaggaacttggaaaatggtcattttacagagctattattgctgaatttattgccacacttttgtttctatacatcactgtactcactgtgattggctacaagagccaaagtgatggtgaccaatgtggtggtgttggcattcttggcattgcttgggcttttggtggaatgatttttgttctcgtctattgcactgctggcatttctggaggacatattaaccctgctgtgacatttgggctctttttggctagaaaagtgtcattagtgagagcaattttttacatagtagcacaatgcttaggagccatttgtggttgtggtttagtgaagttatttcagaaggcttattatgttaagtatggtggtggtgctaatgaacttgctgttggttacaacacagccactggattaggtgctgaaattattggcacttttgttcttgtttacactgttttttctgctactgatcccaagagaaatgccagagactctcatgttcctgtattggcaccacttccaattggatttgcggtatttatggttcatttggccacaattccaattactggaactggtattaacccagctagaagttttggagctgctgtaatttatggcaaaaataaatcctgggatgaccaatggattttttgggttggaccttttattggtgctgcaattgctgcattatatcaccaatatattttgagagctggagcatccaaatcaattaactcattcagaagcaatgcctaataataagaattaatataaactatattggcaattattaattttaaaatgtgccaaaatattgtacaattattccttcttgtttggttgctttttcttgttttggtttcttaattttccttgtaaattttctcctacttgtttcaacatcaaaataatggactaagcaaagtgtgttctactct

SEQ ID NO: 14753 - DNA, 1102 bp, Capsicum annuum
atcaacttttacacatttctctcataactctaaagccctcaaaaaacaaatattacattccttacaaatggctaaggacattgagtatggaaatgaccaatatgcccctaataaggactaccaagatccacctccagcaccacttattgaccctgaggaacttggaaaatggtctttttacagagctattattgctgaatttattgccacacttttgtttctatatataactgtcctcactgtgattggctacaagagccaaagtgacaccaaacataatggtgaccaatgtggtggtgttggtattcttggcattgcttgggcctttggtggcatgattttcattcttgtttactgcactgctggcatttctggaggacacattaacccagctgtgacatttgggctcttcttggctagaaaagtgtcattggtgagagcagttatgtacatagtagcacaatgcttaggagcaatttgtggttgtggcttagttaaatcattccaaaaggcttattatgttaagtacggtggtggagctaatgaacttgctgatggttacaacactgccactggattaggtgctgagattattggcacttttgtccttgtttacactgtcttttctgccactgatcctaagagaaatgccagagattctcatgttcctgtgttggcaccacttccaattggatttgctgtattcatggttcatttggccactattccaatcactggaactggtattaacccagccagaagttttggagctgcagtcatttatggcaaagaaaaatcatgggatgaccaatggattttttgggttggaccttttattggtgctgcaattgctgcattatatcaccaatttattttgagagctggagctgctaaagcacttggatcacacagaagcaatgcttaatgataaaataatctgcatgaatttataagctctattattgacacttaattttaaatgtgccaaatattgtaattccttcttgtttggttgtctttttttttttcttcttattttggtttcctaatttctcttgtaaatttcctcctcctggcttcagcatcaaaataatggactgaa

SEQ ID NO: 14754 - DNA, 1095 bp, Solanum lycopersicum
accacaattaattatttttacacatttccctctaactcaaaaaaaaaaacaaattatttttttattagttacaaatggcaaaggatatggagtatggaaatgaccaatatgcccctagtaaagactaccaagacccacctccagcaccacttattgaccctgaggaacttggaaaatggtcattttacagagctattattgctgaatttattgccacacttttgtttctatacattactgtactcactgtgattggctacaagagccaaagtgatggtgaccaatgtggtggtgttggcattcttggcattgcttgggcctttggtggcatgatttttgttcttgtttattgcacagctggcatttctggtggacatattaaccctgctgtgacatttggactcttgttggccagaaaagtgtcattagtgagagcaattttttacatagtagcacaatgcttaggagctatttgtggttgtggtttagtgaagttatttcaaaaggcttattatgttaagtatggtggtggtgctaatgaacttgctgttggttacaacatagccactggattaggtgctgaaattattggcacttttgttcttgtttacactgttttttctgctaccgatcccaagagaaatgccagagactctcatgttcctgtattggcaccacttccaattggatttgctgtatttatggttcatttggccactattccaattactggaactggtattaacccagctagaagttttggagctgctgtaatttatggcaaaaataaatcatgggatgaccaatggattttttgggttggaccttttattggtgctgcaattgctgcaatatatcatcaatatattttgagagctggagcatccaaatcaattaattcattcagaagcaatgcataataataagaattaatataagctatactggcaattattattaattttaaaatgtgccaaaatattgtaattccgtcttgtttggttgtttttaattattttggttttctaatttctcttgtaaatttgcttcaacatcaaaataatggactaagaaaagtgtgttctactctctcaa

SEQ ID NO: 14755 - DNA, 965 bp, Solanum tuberosum
attagtttacaaatggccaaggatatggagtatggaaatgaccaatatgcccctagtaaagactaccaagacccacctccagcaccacttattgaccctgaggaacttggaaaatggtcattttacagagctattattgctgaatttattgccacacttttgtttctatacatcactgtactcactgtgattggctacaagagccaaaatgatggtgaccaatgtggtggtgttggcattcttggcattgcttgggcttttggtggcatgatttttgttcttgtttattgcactgctggcatttctggaggacatattaaccctgctgtgacatttgggctctttttggccagaaaagtgtcattagtgagagcaattttttacatagtagcacaatgcttaggagccatttgtggttgtggtttagtgaagttattccaaaaggcttattatgttaagtatggtggtggtgctaatgaacttgctgttggttacaacacagccactggattaggtgctgaaattattggcacttttgttcttgtttacactgttttttctgctactgatcccaagagaaatgccagagactctcatgttcctgtattggcaccacttccaattggattttctgtatttatggttcatttggccactattccaattactggaactggtattaacccagctagaagttttggagctgctgtaatttatggcaaaataaatcctgggatgaccaatggattttttgggttggaccttttattggtgctgcaattgctgcattatatcatcaatatattttgagagctggagcatccaaatcaattaactcattcagaagcaatgcctaataataagaattaatataagcaatattggcaattattaatttttaaatgtgccaaaatattgtaattccttcttgtttggttgctttttcttgttttggttttcttaat

SEQ ID NO: 14756 - DNA, 965 bp, Amsonia hubrichtii
catattcaaatctcctgtgagggcatatggcgaaggacatggaagttggcggcactgagtatgctaccaaggactaccaagatccgcctccagcacctcttattgaccctgaggaactcactaagtggtcattctacagggccatcattgctgaattcatcgccacgctcttgttcctctacattactgttttgacggtcatcggatacaacagccaaaccgatgagaaaagtggcggagatcaatgcggtggtgttggcattcttggcattgcctgggcctttggtggcatgatctttatcctcgtttactgcactgctggtatttctggagggcacattaacccggctgttacatttgggctgttcttggctcgcaaagtctcactggttcgagcaatcatgtacatggtggctcagtgcttgggtgcaatctgtggttgtgggttggtgaaggctttccaacgggcttactatgtcaggtacggcggtggtgccaacatgctcaatgatggttacaacacaggcaccgggttgggagctgagatcattggcacatttgtcctggtttacactgttttctctgcaacagaccccaagagaaatgcacgagactcccacgttcctgtactggccccgctcccaattggatttgctgtattcatggttcacctggctacgattccaatcactggcactggtattaatcctgctcgaagctttggagctgctgtgatctacggcaaagagaaagcttgggacgatcaatggatcttttgggttgggcccttcgttggtgctgccatcgctgctttataccaccagtacgttttgagagcaggagcagtgaaagctcttggatcattcaagagcacaacatactaaagaatcaccccggaaacaatgcagaaaactcaagtctttctgttttgcaagttgtaaataaacaattgtgtttatcaagtt

SEQ ID NO: 14757 - DNA, 1235 bp, Ipomoea nil
gaccatagccaacaactccacaattctctccatcttctcagaccactcctgttctccaatcacattctttcttgctaagagttaaaaatggctaaggacgttgagggtgccactgagtatgctgctccaaaagactaccaggaccctcctccagctccactcatcgacccagaagagctggggaagtggtcattttacagggcgatcatagccgagttcatcgccactctcctgtttctctacgtcactgtcctcactgtgattgggtacaagagccagaccgacccaaatgtgaagggcactgatgaatgtggcggcgtgggcattcttggaatcgcatgggcctttggtggcatgatcttcattcttgtttactgcactgccggtatttctggtggtcacattaatccggcggtgacattcgggctgttcttagccaggaaggtgtccctggtccgagccgtgatgtacatggtggcgcagtgcctgggagccatctgcggatgtgggctggtgaaggccttccagaaagcttactatgtgagatatggcggcggggcaaatggattgcaagatgggtatagcaaaggcactgggttgggcgctgagataattgggacttttgttcttgtttacactgtcttcgccgccactgaccccaagagaaatgccagagactcccatgttcctgtgttggctccactcccaattggatttgctgtgtttatggttcacttggccacaattccgatcaccggcaccgggattaacccggctaggagctttggagctgctgtcatctatggcaaagacaaggcctgggatgaccaatggatattctgggttggaccatttgttggagctgccattgctgcagtgtaccaccagtatgtgctgagagcaggagcagccaaagctctgggatcatacaggagcaatgcctaattgtggaggtctgcaataattgtgagccaaatccatggaggaattgtaaataccaaccaagatttggtgaattgatctgagggtctctatctctatctccatctacagtggtgcatgttttggcacttctgttttaagtgtgtgccaatgcaaatcaagattgtgatttccactttctcctttttgcttttcattttcaccttttttcttgggtcttttcttcttgtttggtatgtagtcttttgattctggttgtaatgcacaatgaataataaagctaggaacgacga

SEQ ID NO: 14758 - DNA, 1137 bp, Fraxinus spp
aatctctgtaaattcagtgtgttttggtgcttaaaagggaaaaatggcgaaaaatattgaggttggagaccctgaatttacagcaaaagactatcaagacccacctccagcaccgttgattgatcctgaagaactgactaaatggtcattttacagggctatcattgctgaattcatagctactttactgttcttatacattactgttttgactgtgattgggtacaaaagccagagcgccaccgatgaatgcggcggcgttggcattttggggattgcttgggcctttggtggcatgatttttatacttgtttactgcactgctggtatttccggagggcacattaacccggcagtgacattcgggttgtttttagcccgaaaggtttcattggttcgggccattatgtacatggtggctcagtgtttaggggccatttgtgggtgtggattggtgaaggcattccagagggcttactatgttagatacggtggtggtgccaatggacttgaagttggatatagcacaggaaccggattggcggccgagatcatcggcacttttgtccttgtttacactgttttctcggccacggaccctaaaagaagtgccagagactcccatgttccggtattggcaccactgcctattggatttgctgtgttcatggttcatttggctacaattccgatcaccggcacgggtatcaaccctgcccgaagttttggagctgcagtgatctatggcaaggataaggcctgggacgatcaatggatcttctgggcgggacctttcattggggcagccattgctgcattctaccatcagtacattcttagagcaggtgcagttaaagctctaggatcattcaggagtagtgcttctacttattaaaatcacttgtgggagaatccaattggggaaatcaacccacggagtaaatgttgtggtagtcttgggaattggcacttgttttcaagtgtgcctaaagtagtctcttttttctctgtttgtcaaggtctttttaagtgtaagcatcgaattaataatttactttcaagtctgcagcttcaaatggtattactatttatgcaatgtactgttcaaggcaccaatctaatggatatattagtttt

SEQ ID NO: 14759 - DNA, 1232 bp, Nicotiana tabacum
caatcaattctacatatttctatctaaaagctttaaaaacaacattattcaagattagcataatcttcttttggtgagccttaatttagagaacagagtgcaaaaatggccaaagacattgagtatggcactgatcaatatgcccctaataaggactaccaagatccacctccagcaccactaattgatgcagaggaacttggaaaatggtcattttatagagccattgttgctgaatttattgcaactctgttatttctctatatcaccgtcctcactgtgattggctacaagagccaaagtgatactaaacataatggtgatgcatgtggtggtgttggcattcttggcattgcttgggcttttggtggcatgattttcgttcttgtttactgcactgctggtatttctggaggacatattaacccagcagtgacatttgggctcttcttggctagaaaaatctcattggccagagccgttatgtatatgatagcacagtgtttaggagccatttgtggttgtggtttggtgaaggcatttcagaagtcttactatgttaattatggtggtggtgccaatgagcttgcaacaggctacagcactggcactggattagctgctgaaatcattggaacttttgtccttgtttatactgtcttttcggccactgaccccaagagaaatgccagagactctcatgttcctgtattggcaccacttccaattggatttgctgtattcatggttcacttggctacaatcccaatcactggaactggtattaatccagctagaagttttggagctgcagtcatatatggcaaagaaaaagcctgggatgaccaatggattttctgggttggaccttttattggtgctgcaattgctgcattgtatcaccaatacattctgagagctggagcagtcaaagcacttggctcattcaggagcaatgcctaaatgataagaatttagagctatttaaggagatggaatgaatattaaatggtcaaaattgtatagtggtattggtggagatggcctcttttaattgtgcttttgtttgctttgtgggttggcacttaatttaaatgtgccaaacattgtcattttgaagcttttcttcttgtttggttgcatttcctacttttgtttaattcctgtcccctgtaaatttccttattctgtattcaataataatacttgattgaccagggctctttatattc

SEQ ID NO: 14760 - DNA, 1217 bp, Actinidia deliciosa
tcacttctcaccacacccagaaacacatcacttcccctctttctcactcttctttctctctctaatggccaaggacatcgaggtgggcggcaacgagtatgcggccaaggactaccaggacccgccgccggcgccgctagtcgacgcggaggagctgacccagtggtccttctacagggctatcattgccgagttcattgccacgctgttgtttctttacattactgttttgactgtgattgggtacaagagccagactgacccggacaagaatagcgatgcgtgcggtggtgtgggcattttgggaattgcttgggcctttgggggcatgatttttgttcttgtttattgcactgctggcatctccggggggcacattaacccggcggtgacgttcgggctgttcttggctagaaaagtgtccctggtccgagccattatgtacacggtggctcagtccttgggagccatatgcggttgcgcgttggtgaaggctttccaggaggcccactatgtcaagtacggcggcggagccaatgggctctccgcaggctacagcaccggcaccggcctggctgccgaaatcattggcacctttgtgcttgtctacaccgtcttctccgccacggatcccaagagaaacgctagagactctcatgtacctgttttggcaccactccctattggattcgcggtgttcatggttcacttagccaccatcccaatcaccggcaccggcatcaaccctgcccgaagcttcggagctgctgttatttatggcaaagataaggcttgggacgatcagtggatcttctgggtgggaccgttcatcggcgccgccatcgccgccttctaccaccagtacatcctcagagcaggagctgttaaagctctgggatctttcaggagctctgcctaacaatatgcatcaccatatacagttcttaaggacttcaaatctttatgttgagaggggattagggaaaatggcagaagttgtaaataagtgttggtgggaagggtaaatgtgtcaattgggttgggcattgtggtcttggcacttgctttttggatgtgtcatcaactctgttttgctttgctttgttttgttttgttttggccttgtcctttgtaattgcatcatgggtgttctaagaaataattattaaataagaaatgagcaaatgctcttgtgttattttctcaaaaaaaaaaaa

SEQ ID NO: 14761 - DNA, 1115 bp, Cichorium intybus
tctctctcactctcacacgctgagatttcgaagaagaaaatggggaaagacattgaggtgggtagccatgaatacggtgctaaagattaccaagaccctccacctgctcaactctttgacgccgaagaactcacgaaatggtcgttttacagagccatcattgctgagttcattgccaccctcttgttcctttacatcaccgtcttgactgtcatcggctacaagtcccagaccgatcccgcccacagcaccgaccagtgcggtggcgtaggaatcctcggcatcgcttgggccttcggtggcatgatcttcgtcctcgtttattgcaccgccggcatctccggaggacacattaaccctgcggtcacatttgggttgttcttggccaggaaggtatcactccccagggcagtgatgtacattgtggctcaatgcttgggtgctatctgtggttgtggtctggttaaagctttccagaagacttattatactacttacggtggcggcgccaacgagcttgccgacggctacagtaaaggcactggattgggtgcagaaatcatcggcacattcgtcctcgtatacaccgtcttctccgccactgacccaaagagaaatgctcgggattcccatgtccccgtgctggcacctcttcccatcggatttgctgtgttcatggttcacttggccacaatcccaatcaccggcaccggaatcaaccctgctcgtagttttggtgcggcagtcatgtacggaaaagacaaagcctgggatgatcaatggatattctgggtgggacctatgatcggagctgccatagccgccttctaccaccagtacgtattaagagcagcggcggtcaaagctcttggatccttcaggagcaacgcctagggcataagcatgaaacttgcaatagtttccatgaaattgtacaaatttgccttttgcttttattagagttcatctctaaaatgtattcgctatttagggccagtggtttttgaatgtgcccaataaagtcctttcactatatttttctgtgtaatttgtccctttttgttttcgatgtaattggttaaagggtttatttgctacccaaatgctaatatcca

SEQ ID NO: 14762 - DNA, 983 bp, Olea europaea
tcagtgtgttttagggcttaaaagggaaaatggtgaaggatgttgaggtcggaggccctgaatttactacaaaagactatcaagaccctcctccagcaccgttgattgatccggaagaactgactaaatggtcattttatagagctatcattgctgaattcgtagctacattactgttcttatacattactgttttgactgtgattgggtacaagagccagagcgccaccgatgaatgcggcggcgttggcattttgggcattgcttgggcctttggtggcatgattttcgtacttgtttactgcactgctggtatttccggagggcacattaacccggcagtgacattcgggttgtttttagcccgaaaagtttcattgattcgggccattatgtacatggtggctcagtgtgtaggggccatttgtgggtgtggattggtgaaggcattccagagggcttactacgttagatacggtggtggcgccaatgaacttggagatggatatagcacaggcaccggattggcggccgagattatcggcacttttgtgcttgtttacactgtcttctccgccacggaccctaaaagaagtgccagagactcccatgttccggtattggcaccactgcctattggatttgctgtgttcatggttcatttggctacaattccgatcaccggcactggtatcaaccctgcccgaagttttggagctgcagtgatctatggcaaggataaggcctgggacgatcaatggatcttctgggctggacctttcattggggcagccattgctgcattgtaccatcagtacattcttagagcaggtgcagttaaagctctaggatcattcaggagtagtgcttctgcctattgagaatcacttatgggagagtccaattgtggagatcaacccatggagaaatgatttgtggtcttggaaattggcacttgtttttaaatgtgcctaaatttgtct

SEQ ID NO: 14763 - DNA, 1205 bp, Panax ginseng
gtcttaatattatttataaattttgagaattgaaactctatgctagatcatcgttctcatctatctataaataccccctcacttcttcaacctctaatatcaaatcacctctttttctctagatcttcaaaacactcaaaaagaaagactctatatagatagggcagatagatgggtaaggacattgtggttgcagagcatggcctagactacgaagacccaccggcagctccactctttgattccgaagaactaaccaaatggtccttttacagggccatcattgcagaattcattgcaaccctcctgttcctttacattactgttttaactgttattggttacaagagccagaccgaatcagatcagtgcggcggcgttggcattcttggcattgcttgggccttcggtggcatgatctttgtccttgtttattgcaccgccggtatatccgggggtcacataaaccctgcagtgacatttgggttgtttttggctcggaaggtgtcactggtgcgggcagtaatgtacgtggtggctcagtgtctcggagcaatctgtggtgttgggttggtcaagtcattccagaaatcttactacgtcaggtatggcggcggcgctaatgaactcgccgacggctacagtaccggtacaggattgggtgccgagattattggtacttttgttcttgtttacactgtattctctgccacggatcccaagagaaatgcaagagattcccatgttcctgtgttggctccacttcctattggatttgctgtattcatggttcatttggctacgatcccaataaccggaactgggatcaacccagctcgtagtttcggaactgcagtgatgtatggaaaagagaaagcttgggatgatcaatggatattctgggtgggaccattcattggtgcagccattgctgcattctaccatcagttcatattgagagcagcagcagttaaagctctgggatcattcaggagcaacgcttaattaattggtcggacagagaattcgagttcatgaaatggacaatttgtaaataacaagcggagggttttatctcaattatggtctctgttctgggcacttgttttttttcttctgtttttcccttcttgttttactcgtgtttgttgttgttgatcatcataatatgttaaagcatccaaataatgtcaagtttgcctttt

SEQ ID NO: 14764 - DNA, 1120 bp, Vaccinium corymbosum
ccttgccatggccaaggacattgaaggcggcgagttcaccaccaaggactaccacgacccgccaccggccccgttgatcgaccccgaggaactgatcctctggtcattttacagggctataattgctgagttcattgcaactctgttgttcctttacattacagttttgactgtgattggatacaagagccaaactgacccagccaagaatggcgatgcgtgcggtggcgtgggcattctgggcatcgcttgggcatttggtggcatgattttcgtccttgtttattgcacggccggtatctctggaggccacataaatccagccgtgacgttcgggttgttcttggctagaaaggtgtcgttggtccgagccataatgtacatggtggctcagtgtttaggagccatttgtggttgtgggctagtcaaggccttccaaaaggcttactacgttaagtacggtggtggagccaacgagctctctgccgggtacaataccggtaccggacttggggcagagatcatcggcacctttgttcttgtttacaccgttttttcggccactgatcccaagagaaacgcccgcgattctcatgtccccgttttggcaccgctccctattggattcgccgtattcatggttcacttggccaccatcccagtcaccggcactggcataaacccggcccggagcttcggagcagctgtgatctatggccaacaaaaggcctgggacgatcagtggattttctgggttggaccattcatcggtgccgccattgccgccttctaccaccaatacatcctcagagcagcagcggtcaaagcttttggatctttcaaaagcactgcttataactaagagtcatgggagttcttagaacttcaagtctgtgttctcagaggggatttgggaatattgggtaaagttgtaaataagtattggtgtggaggatagtgtggtcaatttggttgctttgtgatcttggcacttgtttttaaccgtgccaattgtgttgtcatctgttctgctttcattttccttgttttgcctttatgttttgtttgtttcatcatggtgttccaagcataaatataatatatgagcaagtgcttgttt

SEQ ID NO: 14765 - DNA, 1238 bp, Camellia sinensis
cagccatcaaactactctcaatccccaaaacacacacacacacacacacacacacacactctctctctctctctctctctcatacacacaaacacacactagccatggcaaaggacatagaagtgggaggcggcgagtacgcggcgaaggactaccaagacccaccaccggcgctattgatagatgcagaggagctgacactgtggtcattgtatagagccaccattgcagagttcgtagcaacactcttgttcctctacattactgttttgactgtgattggttacaagagccaaactgacccaaccaagactactgatgcctgtggtggtgttggaatccttggcattgcttgggccttcggtggcatgatcttcgtcctcgtttactgcactgcaggcatctctggggggcacattaacccagcagtgacatttggtctgttgctggccaggaaggtgtctctggtccgagccattctgtacattgtggctcagtgcttgggtgccatatgtggttgtgggttggtgaaggcattccaaaaggcctactacgtcgagtatggtggtggagccaacgagctctcttctgggtacagcaccggcactggactcgctgctgagattatcggcacttttgtccttgtttacacggtcttctctgctaccgatcccaagagaaatgcccgcgattctcatgtccctgttttggcaccactccctatcggattcgctgtgttcatggttcacttggcgaccatcccaatcaccggcactggcatcaacccagcccgaagctttggcgccaccgtggtctacggcaaacaaaaagcctgggatgatcaatggatcttctgggtcggaccattcattggagccgccatcgctgccttctatcaccagtacatcctgagagccgccgcagttaaagcccttggatcatccaggagcaatgcctaaataatgtgaattagtttcaattttacatgttcagagggtattttggcaacctggcaaagttgtaaatatgtgcttggatcacttgttggcattgtggttttggcacttgttcttattgtgcttatttgttgttttctactctttttttttcattgttgttttgctctttttcctttgttgttgttgcatcttggtgttcccaagtataatatatgagcaagtgcttttgtgttttgtcccgaaaaacaaaaacatgtcggccgcctcggcctaatgtgc

SEQ ID NO: 14766 - DNA, 1126 bp, Triphysaria pusilla
aaactttctaagcttagtacactcagttgcaaaaaaatggctaaggatatggaagttggagggaacgaatacaacgccaaggactaccaagacccgcccccggccccactcatcgacccggatgagctaggcaagtggtccttgtaccgtgccgtgatagctgaattcatcgcaacccttttgtttttatacatcaccgtgttgacggtgatcggttacaaggcccagagtgccactaacgaatgtgccggtgttggcattctcggcattgcttgggcctttggcggcatgattttcgtcctggtttactgcacagctggcatttccggtgggcacataaacccggccgtgacgttcgggcttttcctggcccggaaggtgtctttggttcgggccgtgttgtacatagtggctcagtgcttaggggccatctgtgggtgtggactggtaaaggcgtttcaaagttcgtactatattagatacggtggtggggccaacgaggtggcggatgggattagcaatggtactggactggcagccgagattatcggcacttttgttctcgtttacacggtcttctcagccaccgaccccaaaagaagcgcccgagactcccatgttccggttttggcaccacttccaattgggtttgctgtgttcatggttcacttggcaacaatcccagtcaccggcacaggtatcaacccggcccggagtttcggagctgctgtgatatacggcaaagaaaaggcctgggatgatcagtggatattttgggttggaccatttattggagcagccattgcagcaatctaccatcagtatattctaagggctggtgcagttaaagctctgggatcattcagaagcacttcttagttattaccaaaatacactttagggttatcagcattaaaaaaatgcagattggagtgtgaaaaaaggtctttgttgtgttgggatggggtgcactggtttttatagtgtgcccaaacttgtatttttcttttgtttttcatttcagttacattggtgtcctttttttttttgtaatcaacactggtatatggtgtgttttaagcattaaagtaataaaatatatctgcaagtgatcaactcatttaac

SEQ ID NO: 14767 - DNA, 1305 bp, Cichorium intybus
atccaaacacactctctatctctcacactctcacacgcagagatttcgaagaagaaaatggggaaagacattgaggtgggtagccatgaatacggtgctaaagattaccaagaccctccacctgctcaactctttgacgccgaagaactcacgaaatggtctttttacagagccatcattgccgagttcattgccaccctcttgtttctttacatcaccgtcttgactgtcatcggctacaaggcccaaaccgatccagctcacagctccgaccagtgcggtggcgtaggaatcctaggcatcgcttgggccttcggtggcatgatcttcgtccttgtttattgcaccgccggcatctctggaggacatatcaaccctgcggtcacatttgggctgttcttggctagaaaggtgacactccccagggcggtgatgtacattgtggctcaatgcttgggtgctatctgtggttgtggtctggttaaagctttccagaagacttattatactacttacggtggcggcgccaacgagctcgccgacggctacagtaaaggcactggattgggtgctgagatcatcggcacatttgtccttgtatacacagtcttctccgccactgacccaaagagaaatgctcgcgattcccatgtccccgtgttggcacctcttccaatcgggtttgctgtgttcatggttcacttggccacaatcccaatcacaggcaccggaatcaaccctgctcgtagttttggtgcagccgtgatgtatggaaaagacaaagcctgggatgatcaatggatattctgggtgggaccgatgatcggagctgccatcgccgccttctaccaccagttcgttctaagagcagcggccgtcaaagctcttgggtccttcaggagcaatgcctagggtgagagcatgaacgctttgcaatgtttccactttccatgttgtgttcaagaaattgtacagatttgcgtttgccttggtttttattaaagagttcatatcttaaatgtaatttgataattagggctctttgtttttcaatatgcccaataaggtcccttggctaaatttttatgtgctctttagtcccgtttgttttgatgcaattgttcagagggtttacttgctaattgctatcccaatccgaagcaaaggggttttgtgttcgagttttatctctcttatgttttatggttgcatctgaaaccctttactttcttaatatttcaattatatatctataattgcagttttaatttttacatattagaatgaaatttaatattggtcatt

SEQ ID NO: 14768 - DNA, 1268 bp, Cichorium intybus
ctctctcactctcacacgctgagatttcgaagaagaaaatggggaaagacattgaggtgggtagccatgaatacggtgctaaagattaccaagaccctccacctgctcaactctttgacgccgaagaactcacgaaatggtcgttttacagagccatcattgctgagttcattgccaccctcttgttcctttacatcaccgtcttgactgtcatcggctacaaggcccaaaccgatccagctcacagctccgaccagtgcggtggcgtaggaatcctaggcatcgcttgggccttcggtggcatgatcttcgtccttgtttattgcaccgccggcatctctggaggacatatcaaccctgcggtcacatttgggctgttcttggctagaaaggtgacactccccagggcagtgatgtacattgttgctcaatgcttgggtgctatctgtggttgtggtttggttaaggctttccagaagacttactatcatacttatggtggtggcgccaacgagctcgccgatggttacagtaaaggaactggattgggtgctgaaatcatcggcacatttgttctcgtatacaccgtcttctccgccactgacccaaagagaaatgctcgggattcccatgtccccgtgctggcacctcttcccatcggatttgctgtgttcatggttcacttggccacaatcccaatcaccggcaccggaatcaaccctgctcgtagttttggggctgccgtgatgtacggaaaagacaaagcctgggacgatcaatggatattctgggtgggaccgatgatcggagctgccatcgccgccttctaccaccagttcgttctgagagcagcggccgtcaaagctcttgggtccttcaggagcaatgcctagggtgagagcatgaacgctttgcaatgtttccactttccatgttgtgttcaagaaattgtacagatttgcgtttgccttggttttttattaaagagttcatatcttaaatgtaatttgataagtagggctctttgttctttaatatgcccaataaggtcccttggctaaatttttatgagctctttagtcccgtttgttttaatgcaattgttcagagggtttatttgctaattgctatcccaatccgaagcaaaggggtcttgtgttcgagttttatctctcttatgttctatggttgcatctgaaaccctttactttcttaatatttcaattatatatctataattgcatttttaacttttacatattagaatg

SEQ ID NO: 14769 - DNA, 1480 bp, Cichorium intybus
acacgcagtgacgcagagctttcgaagaagaaaatggtgaaagacgttgaggttggtggccatgactacagcgcaaaagattaccaagaccctccaccagctgaactctttgacgccgaggaactcacgaaatggtctttttacagagccatcattgccgagttcattgccacactcttgttcctttacatcaccgtcttgacagtcatcggctacaagtcccagaccgatcccgcccacagctccgaccagtgcggtggcgtaggaatcctcggcatcgcttgggccttcggtggcatgatcttcgtcctcgtttattgcaccgccggcatctccggaggacacattaaccctgcggtcacatttgggttgttcttggccaggaaggtatcactccccagggcagtgatgtacattgtggctcaatgtttgggtgctatctgtggttgtggtctggttaaagctttccagaagacttattatactacttacggtggcggcgccaatgagctcgccgatggctacagtaaaggcactggattgggtgcagaaatcatcggcacattcgtcctcgtatacaccgtcttctccgccactgacccaaagagaaatgctcgcgattcccatgtccccgtgttggcacctcttccaatcggatttgctgtgttcatggttcacttggccacaatcccaatcaccggcaccggaatcaaccctgctcgtagttatggggctgccgtgatgtacggaaaagacaaagcctgggacgatcaatggatattctgggtgggaccgatgatcggagctgccatcgccgccttctaccaccagttcgttctaagagcagcggccgtcaaagctcttgggtccttcaggagcaatgcctagggtgagagcatgaacgctttgcaatgtttccactttccatgttgtgttcaagaaattgtacagatttgcgtttgccttggtttttattaaagagttcatatcttaaatgtaatttgataagtagggctctttgttctttaatatgcccaataaggtcccttggctaaatttttatgtgctctttagtcccgtttgttttgatgcaattgttctgagggtttacttgctaattgctatcccaatccgaagcaaaggggtcttgtgttcgagttttatctctcttatgttctatggttgcatctgaaaccctttactttcttaatatttcaattatatatctataattgcagttttaatttttacatattagaatgaaatttaatattggtcattataccaattccccccccccccccccccccccccccccccccccccccccccccccccccccccccccccccccccccccccccccccccccatcgcgactagtgccagtatccatatacacagtattttattgcacaaagaaagtttcagttgagaaaagagtttgttgtcaaaataagtaactacatgtaaccatata

SEQ ID NO: 14770 - DNA, 1314 bp, Cichorium intybus
atccaaacacactctctatctctcacactctcacacgcagagatttcgaagaagaaaatggggaaagacattgaggtgggtagccatgaatacggtgctaaagattaccaagaccctccacctgctcaactctttgacgccgaagaactcacgaaatggtcgttttacagagccatcattgccgagttcattgccaccctcttgtttctttacatcaccgtcttgactgtcatcggctacaaggcccaaaccgatccagctcacagctccgaccagtgcggtggcgtaggaatcctaggcatcgcttgggccttcggtggcatgatcttcgtccttgtttattgcaccgccggcatctctggaggacatatcaaccctgcggtcacatttgggctgttcttggctagaaaggtgacactccccagggcagtgatgtacattgtggctcaatgcttgggtgctatctgtggttgtggtctggttaaagctttccagaagacttattatactacttacggtggcggcgccaacgagcttgccgacggctacagtaaaggcactggattgggtgcagaaatcatcggcacattcgtcctcgtatacaccgtcttctccgccactgacccaaagagaaatgctcgcgattcccatgtccccgtgttggcacctcttccaatcgggtttgctgtgttcatggttcacttggccacaatcccaatcaccggcaccggaatcaaccctgctcgtagttttggggctgccgtgatgtacggaaaagacaaagcctgggacgatcaatggatattctgggtgggaccgatgatcggagctgccatcgccgccttctaccaccagttcgttctaagagcagcggccgtcaaagctcttgggtccttcaggagcaatgcctagggtgagagcatgaacgctttgcaatgtttccactttccatgttgtgttcaagaaattgtacagatttgcgtttgccttggtttttattaaagagttcatatcttaaatgtaatttgataattatggctctttgtttttcaatatgcccaataaggtcccttggctaaatttttatgtgctctttagtcccgtttgttttgatgcaattgttcagagggtttacttgctaattgctatcccaatccgaagcaaaggggttttgtgttcgagttttatctctcttatgttttatggttgcatctgaaaccctttactttcttaatatttcaattatatatctataattgcagttttaatttttacatattagaatgaaatttaatattggtcattataccaatt

SEQ ID NO: 14771 - DNA, 1194 bp, Cichorium intybus
gaaaatggggaaagacattgaggtgggtagccatgaatacggtgctaaagattaccaagaccctccacctgctcaactctttgacgccgaagaactcacgaaatggtcgttttacagagccatcattgctgagttcattgccaccctcttgttcctttacatcaccgtcttgactgtcatcggctacaaggcccaaaccgatccagctcacagctccgaccagtgcggtggcgtaggaatcctaggcatcgcttgggccttcggtggcatgatcttcgtcctcgtttattgcaccgccggcatctccggaggacacattaaccctgcggtcacatttgggttgttcttggccaggaaggtatcactccccagggcagtgatgtacattgtggctcaatgtttgggtgctatctgtggttgtggtctggttaaatctttccagaagacttattatagtacttacggtggcggcgccaacgagctcgccgatggctacagtaaaggcactggattgggtgcagaaatcatcggcacattcgtcctcgtatacaccgtcttctccgccactgacccaaagagaaatgctcgcgattcccatgtccccgtgttggcacctcttccaatcggatttgctgtgttcatggttcacttggccacaatcccaatcaccggcaccggaatcaaccctgctcgtagttttggggctgccgtgatgtacggaaaagacaaagcctgggacgatcaatggatattctgggtgggaccgatgatcggagctgccatcgccgccttctaccaccagttcgttctaagagcagcggccgtcaaagctcttgggtccttcaggagcaatgcctagggtgagagcatgaacgctttgcaatgtttccactttccatgttgtgttcaagaaattgtacagatttgcgtttgccttggtttttattaaagagttcatatcttaaatgtaatttgataattagggctctttgtttttcaatatgcccaataaggtcccttggctaaatttttatgtgctctttagtcccgtttgttttgatgcaattgttctgagggtttacttgctaattgctatcccaatccgaagcaaaggggttttgtgttcgagtttttctctcttatgttttatggttgcattgaaactttacttcttaatattaattatatatctat

SEQ ID NO: 14772 - DNA, 1144 bp, Orobanche aegyptiaca
gtacactcaaagctcaaaatcactctttcgttcttaagtctcagcaagaaaagtgcaaatggccaaggatactgaggttggagccaccaccgagtatgccgccaaggactaccacgaccctccgccggcacccctcatcgacccggaggagctaggcaagtggtcattgtacagggccgtgatagccgaattcattgcaacgcttttatttttgtacataaccgtgttgaccgtgattggttacaagagccagagtgccgccgatgagtgcggcggcgttggcattctcggcattgcttgggcctttggtggcatgatttttgtccttgtttactgcactgctggcatttctgggggacacatcaatccggctgtgacattcgggctgttcctggcccgaaaagtgtctctagttcgggccgtgctgtacatagtagcacaatgcttaggtgccatatgtgggtgtgggctagtgaaggcattccaaaagtcatactatgttacatacgggggaggcgccaactcgttggcggatggctacagcacgggcactggattagcggctgagatcatcggcacttttgttcttgtctacactgtcttctccgccactgaccccaaaagaagcgccagagactcccatgttcctattctggcaccacttccaattggatttgctgtgttcatggttcacttggccacaatcccaatcaccggcacaggcatcaatccggcccggagttttggagctgctgtgattttcggcaaagataaggcctgggatgatcagtggattttttgggttggaccactaattggagcaaccattgctgcgatataccatcagtatgtcctcagggcaggtgcagttaaagctctaggatcattcagaagctcttcttattcataatccagtctaacggattaatagcatttcaaaaatgttgcgagaaaactgtctcgattggtgttaagatgggtggcactggtttttaagtgtgctcaaatgtgtatttgtgctctttttcccttgtgtttgcatttcagtttaattgggctcctgtttttcttgcacttggaactgatataattgtgtgatttaagcatcaaagtaataaaaatatatcagcaagtgtttttactg

SEQ ID NO: 14773 - DNA, 1030 bp, Helianthus annuus
tttatacacacgtatatcagcagccagttttctaaaagaaaatggcaaaagacattgaagtagcaagccatgaatacggtgcaaaagactaccaagaccccccaccagctgacctcattgacccagaggagctcaccaaatggtccttttaccgagccatcattgctgagttcgtcgccaccctcttgttcctttacatcaccgtcttgactgtcatcggctacaagtcccaaaccgaccccgaccacagcactgaccagtgcggtggcgtcggcattctcggtatagcttgggctttcggtggcatgatatttgtcctcgtttactgcactgctggtatctctggtggacacattaaccctgcggtcacattcgggctgtttttggcaaggaaggtgaccctcccaagggcggttatgtatatggtggctcagtgcttgggtgcggtctgtggttgtggtctggtgaaagctttccaaaagtcttactacaccaattatggcggtggtgccaatgagcttgcagatgggtacaacaaaggcaccggtttgggtgcggaaatcattggcacattcgtcctagtctacaccgtcttctcagccactgacccaaagagaaacgcacgtgactctcatgtccccgttttggcacctcttcctatcggattcgccgtattcatggttcacttggccaccatcccaatcaccggtactggaatcaaccctgctcgtagttttggggccgcggtcatctacggaaaagaaaaggcatgggatgatcaatggatattctgggtgggaccgatgatcggagcggcgatagcggctatctaccatcagtacatattgagggcaggggcagttaaagctcttggatcattcaggagcaatgcctaagcatcaaactttgtcatgtatttccaagaaattgtacaaattgcgtttgttttctacttttatccaagacgctctttcttatatgtattttggttatttagggcacttagttttttaacgtgtcccaatttggt

SEQ ID NO: 14774 - DNA, 1087 bp, Triphysaria pusilla
aaactttctaagctttagtacactcagtttcaaaaaaatggctaaggatatggaagttggagggaacgaatacaacgccaaggactaccaagacccgcccccggccccattcatcgacccggatgagctaggcaagtggtccttgtaccgtgccgtgatagctgaattcatcgcaacccttttgtttttatacatcaccgtgttgacggtgatcggttacaaggcccagagtgccaccgacgagtgtgccggtgttggcattctcggcattgcttgggcctttggcggcatgattttcgtcctggtttactgcacagctggcatttccggtgggcacataaacccagccgtgacattcgggcttttcctcgcccggaaggtgtctttggttcgggccgtgctgtacatagtggctcagtgcttaggagccatctgtgggtgtgggctagtgaaggcgtttcaaagttcgtactatattagatacggtggtggggccaacgaggtggcggatgggattagcaacggcactggattggcagctgagattatcggcacttttgtgctcgtttacacggtcttctcagccaccgaccccaaaagaagcgcccgagactcccatgttccggttttggcaccacttccaattgggtttgctgtgttcatggttcacttggcaacaatcccagtcaccggcacaggtatcaacccggcccggagtttcggagctgctgtgatatacggcaaacaaaaggcctgggatgatcagtggatattctgggttggaccatttattggagcagccattgcagcaatctaccatcagtatattttaagggggggggcagttaaagctctgggatcattcagaagcacttcttagttattaccaaaatacactttgtgttgggatggggtgcactggtttttatagtgtgcccaaacttgtatttttcttttgttttttatttcagttacatgggggtctttttttttttgtaatcaacactggtatatggggtgttttatgcattaaagtaataaaatatatcagcaagtgatcaactcatttaataaaaaaaaaaaaaaa

SEQ ID NO: 14775 - DNA, 1206 bp, Ambrosia trifida
catcaaccactctaatctctctctcacatatatacaaagaagactaataataataataatgggcaaagacgttgaagttggaggccatgaatacggcgcaaaagattaccaagaccctccaccagctgacctcttcgacgcagaggagctaaccaagtggtctttttaccgagccatcattgctgagttcattgccacactcttgttcctttacatcaccgtcttgactgtcatcggctacaagtcccaaaccgaccccaaccatagcgctgaccaatgcggtggtgttggcattcttggcatcgcttgggcctttggtggcatgatctttgtccttgtctattgcactgctggcatctcaggaggacacatcaaccctgcggtgacatttgggttgtttttggctagaaaggtgacactccctagggcattcatgtacattgtggctcaatgcctaggtgccgtgtgtgggtgcggtttggttaaagcattccaaaagacttactacaatacttatggcggtggtgccaacgagctcgcagatggctacagcaaaggcactggcttgggtgctgagatcattggcacgtttgtccttgtttacaccgtcttctcagccactgaccccaagagaaatgcacgagattctcatgtccccgtattggcacctctccctatcggatttgctgtattcatggttcacttggccaccatcccaatcactggaaccggaatcaacccggctcgaagttttggtgccgcggtcatgtacggaaaagacaaagcctgggatgatcaatggttattctgggtgggaccgatgattggagccgccatcgccgccttctaccaccagtatgtattgagagcaggggcagtcaaagctcttggatccttcaggagcaatgcttaggagccagagcattttatttctatgttggtttggagaaattgtacaaatgtatttggtacttatggcacttagtttttgaatgtacccactatggtcctgctttcaactttcaagtccctttatcttcaagtttatatccatttagtgcttcttgttttcttgtaactaaatggtgtatttgctagccaaataataagatgaggttttgttaccatatttaatgtgttgctattaatgtgttgctaaaagcttataagccttgttatgttaaaaattatatacccaaaaaagaa

SEQ ID NO: 14776 - DNA, 1001 bp, Chrysanthemum coronarium
tctctcactcttataacacattcttctacacacaaataacagcaaagtaaagagctagaaaatgagcaaagacgttgaggtaggtggacatgatcactacggtgctaaagactaccaagaccctccaccttctccccttttcgactccgaagaactcaccaaatggtctttttaccgagccattatagccgagttcattgccacattgttgttcctttacatcactgtcttgactgtcatcggttacaagtcccaagtcgaccccgctcacagcactgaccaatgcggtggtgttggaatccttggtatcgcatgggcttttggtggcatgatttttgtccttgtttattgcactgcaggtatctcaggaggacacattaaccctgctgttacattcggactgtttttggctaggaaagtaacactaccaagggcatttatgtacattgtggctcaatgtttgggtgctatttgtggttgtggtcttgttaaggctttccaaaagacttactatcataattatggtggtggtgctaatgagcttgctgatggttacagcaaaggaaccggtttgggtgctgaaatcataggtacctttgttcttgtttacactgtcttctcagctactgacccgaagagaaatgcacgcgactctcatgtccctgtgttggcacctcttcctatcggatttgcggtgttcatggttcacttggccacaatcccaatcactggaactggaatcaacccggctcgtagttttggtgctgctgtcatgtatggtaaagaaaaagcatgggatgatcaatggttattctgggttggaccgatgattggtgctgcgattgctgctttctaccaccagtacgtattgagagctggtgcagtgaaggctcttggatcattcaggagcaatgcctagatcaagagcattaaaaatgcaatgtttctcctgttttaagtaattgtataaatttgcttgttttcttgaagagtgtatgtgg

SEQ ID NO: 14777 - DNA, 1252 bp, Cichorium intybus
ctctcacactctcacacgcagagatttcgaagaagaaaatggggaaagacattgaggtgggtagccatgaatacggtgctaaagattaccaagaccctccacctgctcaactctttgacgccgaagaactcacgaaatggtctttttacagagccatcattgccgagttcattgccaccctcttgtttctttacatcaccgtcttgactgtcatcggctacaaggcccaaaccgatccagctcacagctccgaccagtgcggtggcgtaggaatcctaggcatcgcttgggccttcggtggcatgatcttcgtccttgtttattgcaccgccggcatctctggaggacatatcaaccctgcggtcacatttgggctgttcttggctagaaaggtgacactccccagggcggtgatgtacattgtggctcaatgcttgggtgctatctgtggttgtggtctggttaaggctttccagaagacttactatcatacttatggtggtggcgccaacgagctcgccgatggttacagtaaaggaactggattgggtgctgaaatcatcggcacatttgtcctcgtatacaccgtcttctctgccactgacccgaagagaaatgctcgcgattcccatgtccccgtgttggcacctcttccaatcggatttgctgtgttcatggttcacttggccacaatcccaatcaccggcaccggaatcaaccctgctcgtagttttggtgcagccgtgatgtatggaaaagacaaagcctgggatgatcaatggatattctgggtgggacctatgatcggagctgccatcgccgccttctaccaccagtacgtattaagagcagcggcggtcaaagctcttggatccttcaggagcaacgcctagggcataagcatgaaacttgcaatagtttccatgaaattgtacaaatttgccttgcttttattagagttcatctctaaaatgtattcggtatttagggccagaggtttttgaatgtgcccaataaagtcctttcactatatttttctgtgtactttgtccctttttgttttcgatgtaattggtaaaagggtttagttgctacccaaatgctaatatccaaagcgaggggttttgtctactggtggcaatcgggtcttgttgggtcgggtcggcttcaggtttgttggttgcgccttgatgggcccgaaactccaatccggacacaacctgtataattaagcgtgtcagctttttcaacc

SEQ ID NO: 14778 - DNA, 1279 bp, Flaveria ramosissima
aaaaaaggaaatgtcaccttacactattttatgattatcatctcaaagttctcgatagttctactacattctcaccatatatatactcccacttgtttcttcacttcatcatcacccacaacttgagtaatcaatcttcatcacacacatatacacacaaaattaacaagctttcgattcaaagaggcaatggcgaaagacattgagggtgcagaatacggtgcaaaagactaccaagacccaccaccagctgagctatttgacgcagaggagctaaggaaatggtcattctacagagccattatcgcagagtttatagccaccctcttgttcctctacatcaccgtcctcaccgtcatcggctacaagtcccaaaccgaccccgaccacagcgctgatcaatgcggtggcgtgggcattctcggcatcgcgtgggccttcgggggcatgatattcgtgctcgtgtattgcactgctggcatctccggaggacacattaaccctgcggttacgtttgggctgtttttggctaggaaggtgaccctccccagagcggttatgtacatggtggctcagtgcttgggtgcggtctgtgggtgtggtctggttaaggctttccagaagtcttactacaacgcttatggtggtggtgctaatgagcttgctgatggctacagtaaaggcactggcttgggtgctgagatcattggtacgtttgtgcttgtctacaccgtcttctccgccactgatcccaagagaaatgcacgcgattctcatgtccccgtgttggcacctctccctatcggattcgcggtgttcatggttcacttggccaccatcccgatcacgggcaccgggatcaaccccgctcgtagttttggtgccgcggtcatgtacggaaaagaaaaggcctgggatgatcaatggttattctgggtgggaccgatgatcggagctgcgatcgcggccttctaccaccagtacgtgttgagagcaggggcagtcaaagctcttggatcattcaggagcaatgcctaagaagaagcatagcatgaatgaacgaaaaagcgtttttcatgtggctttgaagaaagtgtacaaatttggcttaaatgtatttggtatttaagggcacttagttttataatgtgcccaatatggtcctgctttcgagtgcttaagcttcttttaatttcctattttgttcatcttgttttgttttatttggtcaaagttcaaagggttgtaatatttgctacccaaataataatataagagg

SEQ ID NO: 14779 - DNA, 1004 bp, Flaveria ramosissima
aaagaggcaatggcgaaagacattgagggtgcagaatacggtgcgaaagactaccaagacccaccaccagctgagctgtttgacgcagaggagttaaccaaatggtcattctacagagccattatcgcagagtttatagccaccctcttgttcctctacatcaccgtcttgaccgtcatcggctacaagtcccaaaccgaccccgaccacagcgctgatcaatgcggtggcgtcggcattctcggcatcgcgtgggccttcgggggcatgatattcgtgctcgtgtattgcactgctggtatctccggtggacacattaaccctgcggtgacgtttgggttgtttttggctaggaaggtgacactccccagggcggttatgtacatggtggctcagtgcttgggtgcggtctgtgggtgtggtctggttaaggctttccagaagtcttactacaatgcttatggtggtggcgctaatgagcttgcagatggctacagtaaaggcactggtttgggtgctgagatcattggtacgtttgtgcttgtgtacaccgtcttctccgccactgatcccaagagaaatgcacgcgattctcatgtccccgtgttggcacctctccctatcggattcgcggtattcatggttcacttggccaccatcccgatcaccggcaccggaatcaaccccgctcgtagttttggtgccgcggtcatgtacggaaaagaaaaggcttgggatgatcaatggttattctgggtgggaccgatgatcggagctgcgatcgcggccttctaccaccagtacgtgttgagagcaggggcagtcaaagctcttggatcattcaggagcaatgcctaagaagaagcatagcatgaatgaatgatgaagtgtttttcatgtggctttgaagaaattgtacaaatttggcttaaatgtatttggtatttaagggcacttagtttttaatgtgccaatatggtcctgcttccgagtgcttaagtctt

SEQ ID NO: 14780 - DNA, 1073 bp, Rosmarinus officinalis
tcttcttctacttctcctcctcattgcagaccagattaactgatcacatttttcttcttcttcatatcttgcttgagggcaaatggcgaaggatattgaggttggcggcactgagtatgctaacaaggactaccaagatccgcctccggcacctcttattgaccctgaggaactcacccagtggtcgttctacagggccatcattgctgaattcgtcgccacgctcttgttcctctacattactgttttaacagtcatcggatacattagccaaacagacgagaaaagtggcggagaccaatgcggtggcgttggcattctcggcattgcctgggcctttggtggcatgatctttatccttgtttactgcaccgctggtatttctggagggcacattaacccggccgtgacatttgggctcttcttggctcgcaaagtctcgctggttcgagcaatcatgtacatggtggctcagtgcttgggagcaatctgtggttgtgggctggtgaaggctttccaaagggcttactatgtcaggcatggcggtggtgccaacgtactcaacgatgggtataacgcggggacgggattgggagctgagatcattggcacatttgttctcgtctacaccgttttttctgccacagaccccaagagaaatgcaagagactcccacgttcctgtactggctccgctcccaattggatttgctgtattcatggttcacttggctacaattccaattactggcaccggtattaaccctgctcgaagcttcggagctgctgtgatctatggcaaacagaaagcttgggacgatcactggatcttttgggttggacccttcatcggtgccgccatcgctgctttatatcaccagtacgttttgagggcagcagcagtgaaatctcttgggtctttcaagagcacaacatactaaatgaagcatcatcctccggaggttggatgaaagtcatttgcaagttgtaaatagggaattgtttccctgcatttgggattcttggggacttgttttaatcattcccaaagtttgatgtgatgttctttttgct

SEQ ID NO: 14781 - DNA, 1440 bp, Artemisia annua
gggatcaacaaacactccaatctctcactcttataacacattcttctacacacaaataacaacaaacaaagagctagaaaatgagcaaagacgtagaggttggtggacatgatcactacggtgctaaagactaccaagaccctccaccttctccccttttcgaccccgaagaactcaccaaatggtctttttaccgagccataatagccgagttcattgccacattgttgttcctttacatcactgtcttgactgtcatcggttacaagtcccaagtcgaccccgcccacagcactgaccaatgtggtggtgttggaatccttggtatcgcatgggcttttggaggcatgatttttgtccttgtttattgcactgctggtatctcaggaggccacattaaccctgctgttacattcgggttgtttttggctaggaaggtgacattaccaagggcatttatgtacattgtggctcaatgtttgggtgctatttgtggttgtggtcttgttaaggctttccagaagacttactatcatacttatggtggtggtgctaatgagcttgctgatggttacagtaaaggcactggcttgggtgctgaaatcatcggtacctttgttcttgtttacaccgtcttctcggctactgaccctaagagaaatgcacgcgactcccatgtccccgtgttggcacctcttcctatcggatttgcggtgttcatggttcacttggccacaatcccaatcactggaactaacccggctcgaagttttggcgcagctgtcatgtatggtaaagaaaaagcatgggatgatcaatggttattctgggttggaccaatgattggagcagccatcgcagcgttttaccaccagtacgtattgagagctggcgcggttaaagctcttgggtctttcaggagcaatgcctagatcaagagcatgaaatacgcaaatgtatttcatgtttttaagaaattgtacaaatttgcttgttttcatgaagagtgttttatttaagggcactaggttttttttaatgtgccctgtatgctctgtttttaagttgcttgtctttctttttgtttccacttaatccctcttgttttgctgtaattgatgaaaaggagcattatagttagctagccaactaataagatcaaagcaaagggtttttttgcagtatattaactcttgtgtattgtaatacatcattgaaagtttttgattgttttggatatcaagctagttaacttttagtggcatgtgagttgccaccaagagtggaaggtgcagtgaggagatgaatctcctcatttggggcccacgggtgccacatcaccttaaatattcttgacaactaacctccctaactaacaaataacctcaacttattcatttagggtccaccacttacacctttattttatttttcactcat

SEQ ID NO: 14782 - DNA, 1147 bp, Helianthus annuus
ccacttcatctctctcttctcattctatacacacacatacacatcaaaaacagccagttttctaaaagaaaatggcaaaagacattgaagtagcaagccatcatgaatacggtgcaaaagactaccaagaccccccgccagctgacctcattgacccagaggagctcaccaaatggtccttttaccgagccatcattgctgagttcgtcgccaccctcttgttcctttacatcaccgtcttgaccgtcatcggctacaagtcccaaaccgaccccgaccacagcactgaccagtgcggtggcgtcggcattctcggcatcgcttgggctttcggtggcatgatctttgttctcgtttactgcactgccggtatctctggtggacacattaaccctgcggtcacattcgggctgtttttggcaaggaaggtgacccttccaagggcggttatgtatatggtggctcagtgcttgggtgcggtctgtggttgtggtctggtgaaagctttccagaagtcttactacaccaattatggcggtggtgccaatgagcttgcagatgggtacaacaaaggcaccggtttgggtgcggaaatcattggcacattcgtcctagtctacaccgtcttctcagccactgacccaaagagaaacgcacgtgactctcatgtccccgttttggcacctcttcctatcggatttgccgtattcatggttcacttggccactatcccaatcaccggcactggaatcaaccctgctcgtagttttggggccgcggtcatttacggaaaagaaaaggcctgggatgatcaatggatattctgggtgggaccgatgatcggagcggcgatagcggctatctaccatcagtacatattgggggcaggggcagttaaagctcttggatcattcaggagcaatgcctaagcatgaaactttgtcatgtattttctaagaaattgtacaaattgcgtttgttttctacttttatccaagacgctcttcttatatgtattttggtatttagggcacttagttttttaatgtgcccaatttggtcttgtttcctttttttatgtcaatttggcctttcttgctttgttgtatttctacctaaataataatatcaaagctaagagttttct

SEQ ID NO: 14783 - DNA, 1022 bp, Chrysanthemum coronarium
ctctcactcttataacacattcttctacacacaaataacagcaaagtaaagagctagaaaatgagcaaagacgttgaggtaggtggacatgatcactacggtgctaaagactaccaagaccctccaccttctccccttttcgactccgaagaactcaccaaatggtctttttaccgagcaataatagccgagttcattgccacattgttgttcctttacatcactgtcttgactgtcatcggttacaagtcccaagtcgaccccgcccacagcactgaccaatgtggtggtgttggaatccttggtatcgcatgggcttttggaggcatgatttttgtccttgtttattgcactgctggtatctcaggaggacacattaaccctgctgttacattcgggttgtttttggctaggaaggtgacattaccaagggcgtttatgtacattgtggctcaatgtttgggtgctatttgtggttgtggtcttgttaaggctttccaaaagacttactatcatacttatggtggtggtgctaatgagcttgctgatggctacagcaaaggaaccggtttgggtgctgaaatcatcggtacctttgttcttgtttacaccgtcttctcggctactgaccccaagagaaatgcacgcgattcccatgtcccagtgttggcacctcttcctatcggatttgcggtgttcatggttcacttggccacaatcccaatcactggaactggaatcaaccctgctcgtagttttggtgctgctgttatgtatggtaaagaaaaagcatgggatgatcaatggttattctgggttggaccgatgattggagctgcgattgccgctttctaccaccagtacgtattgagagctggtgcgattaaggctcttggatctttcaggagcaatgcctagaccaagtgcgtacatgtttttaagaagttgtacaaatttgcctgttttaatgaagtgtgtaccgtattatttaagggtatattgtcaaagggcacaaagttttt

SEQ ID NO: 14784 - DNA, 1116 bp, Chrysanthemum coronarium
ctcactctttaacacattcttctacagacaaataacaattaacaaagagctagaaaatgagcaaagacgtagaggttggcggacatgatcactacggtgctaaagactaccaagaccctccaccttctccccttttcgactccgaagaactcaccaaatggtctttttaccgagccataatagccgagttcattgccacattattgcgcctttacatcactgtcttgactgtcatcggttacaagtcccaagtcgaccccgctcacagcactgaccaatgcggtggtgttggaatccttggtatcgcatgggcttttggaggcatgatttttgtccttgtttattgcactgcaggtatctcaggaggacacattaaccctgctgttacattcgggctgtttttggctaggaaagtgacactaccaagggcatttatgtacattgtggctcaatgtttgggtgctatttgtggttgtggtcttgttaaggctttccagaagacttactatcataattatggcggtggtgctaatgagcttgctgatggctacagtaaaggaaccggtttgggtgccgaaattattggtacctttgttcttgtttacaccgtcttctcggccactgaccctaagagaaatgcacgcgattcccatgtcccagtgttggcacctcttcctatcggatttgcggtgttcatggttcacttggccacaatcccaatcactggaactggaatcaacccggctcgtagttttggtgctgctgtcatgtatggtacagaaaaagcatgggatgatcaatggttattctgggttggaccgatgattggagctgcgattgctgctttctaccaccagtacgtattgagagctggtgcagtgaaggctcttggatcattcaggagcaatgcctagatcaagagcattaaaaatgcaatgtttctcctgttttaagtaattgtataaatttgcttgttttcttgaagagtgtatgtgggcagaaagggcacttgatcttttaatgtgctgtatgctctgttttttacatatctttctttttatttccacttaatccctcttgttttaccgtaatgaatcaataggtgcatttgctacc

SEQ ID NO: 14785 - DNA, 1132 bp, Chrysanthemum coronarium
tctagactaacaccagaacgtgaagcataccatacaaaacatagcataatagataaagttctttaaaacattttgaagtagcaacaactcattcatttacctttggacggctactaatagcacaataaaacccaaaggactcttctacacacaaataacaccaaagtaaagagctagaaaatgagcaaagacgtagaagttggtggacatgatcactacggtgctaaagactaccaagaccctccaccttctccccttttcgactccgaagaactcaccaaatggtctttttatcgagccataatagccgagttcattgccacattgttgttcctttacattactgtcttgactgtcatcggttacaagtcccaagtcgaccccacccacagcactgaccaatgcggtggtgttggaatccttggtatcgcatgggcctttggaggcatgatttttgtccttgtttattgcactgcaggtatctcaggaggacacattaaccctgctgttacattcgggttgtttttggctaggaaagtaacactaccaagggcatttatgtacattgtggctcaatgtttgggtgctatttgtggctgtggccttgttaaggctttccaaaagacttactatcataattacggtggtggtgctaatgagcttgctgatggctacagtaaaggcactggcttgggtgctgaaattattggtacctttgtgcttgtatacaccgttttctctgctaccgaccctaagagaaatgcacgcgattcccatgtccccgtgttggcacctcttcctatcgggtttgcggtgttcatggttcacttggcgacaatcccaataactggaactggaatcaacccggctcgtagttttggtgctgctgtcatgtatggtaaagaaaaagcatgggatgatcaatggttattctgggttggacccatgattggagcagccatcgcagccttttaccaccagtacgtattgagagctggcgcgatcaaagctcttggatctttcaggagcaatgcctagatcaagagcatgaaatatgaaaatgtatttcatgtttttaagaaaatgtacaaatttgcttgttttcatgaaagagtgttttatttaagggcgc

SEQ ID NO: 14786 - DNA, 1240 bp, Rosmarinus officinalis
ttgtcaccgagagaaatccagatgaccaaggatgtagaggcggtgggtggccacgactacggcgccaaggactaccaagacccgccgccggcgccgctaatcgacatggaggagctgggcaaatggtcactgtacagagccgccatcgccgaattcatcgcaaccctcctcttcctctacgtcacggtgctcaccgtcatcggctacaagagccagagcgccgccgaccagtgcggcggagtcggcatcctcggtatcgcctgggccttcggcggcatgatcttcgtcctcgtatactgcaccgccggcatttccgggggtcacatcaacccggccgtgacgttcgggctgctcctggcccggaaggtgtcgctggttcgggccgtgctatacattgtggcgcagtgcttgggagccatctgcggttgcgggctggtgaaggcgttccagaagacgtactacattcagtatggcggcggcgccaacgagctcagcgacggctacagcaccggcaccggagtggcggccgagatcatcggcacatttgttctcgtctacaccgtcttctccgccaccgaccccaagagaaatgccagagactcccacgtccctgttttggcaccacttcctattggatttgccgtgttcatggtacacttggccacaattccggtcaccggcaccggcatcaacccggcccggagtttcggcgcggccgtgatttacggcaaggacaaggcatgggacgaccagtggattttctgggtgggaccctttgtcggagcagccattgctgcaatctaccaccagtttgtgctgagggcaggagcggtgaaagctctgggatcattccggagctcttcgtataattaagcagtgtgaccatatttaatgtgtgcaaatatttgtgtggtagtttggcacttattttaaagcgtgcccgaaattggtgtgcactttttttcttcttcttatgtatgcttttctcctctctctcctaccttagcactaaatatagtgcttaatttatgcatccaagttataaagtttactatttcacggatttgtgtttatctttcttaaacatgactggctctattcaatgtagacttggacaagaccaaacatataccacacagactaacgtaaataaacctcaatgcctcctctttgctattaagatgagacgtaattggatgaggagggataattggaaattatttcagactgaaacaatatt

SEQ ID NO: 14787 - DNA, 1069 bp, Helianthus annuus
atcatccaccactctaatctctctcaaacactatatatacaacccttaaactaatattatagtctaacaatgggcaaagacgttgaggttggaggtcatgagtatggtgcaaaagattaccaagaccctccaccggctgccctcttcgacgcggaagagctcaccaagtggtctttttaccgagccatcattgccgagttcattgctaccctcctcttcctttatatcactgtcttgactgtcatcggctacaagtcccaaaccgaccccgcccatagcccagaccaatgcggcggtgttggcattctcggcatcgcctgggccttcggtggcatgatctttgttctcgtctattgcactgccggcatttcaggaggacacattaaccctgcggtgacatttgggctgtttttggctagaaaggtgacactcccaagggcgttcatgtacatcgtggctcaatgcttgggtgccgtatgtggttgcggtctggttaaagctttccaaaagacttactacaatacttatggcggtggtgccaatgagctcgcagatggctacagcaaaggcactggtttgggtgctgaaatcattggcacatttgtcctcgtttacaccgtcttctcggccactgatcccaagagaaatgcacgagattcccatgtccctgtattggcacctctccctatcggatttgccgtattcatggttcacttggccaccatcccaatcactggcactggaatcaacccggctcgtagtttcggtgccgctgttatgtacggaaaagaaaaggcctgggatgaccaatggttattctgggtgggaccgatgattggagccgcggtagccgccttctaccaccagtacgtattgagggcaggtgctgtcaaagctcttggatcctttaggagcaatgcttaggagccagagcttgaagtttgcagtaatttctatgttggtttgaaaaaattgtacaaatgtatttggtatttgtggcacttagtttttgaatgtgcccactatggtcctacttttaagtcccttaaatcttcttttctatatccct

SEQ ID NO: 14788 - DNA, 965 bp, Ambrosia trifida
gggcaaagacgttgaggttggaggccatgaatacggtgcaaaagattaccaagaccctccaccggctgacctctttgacgcagaggagctaaccaagtggtctttttaccgagccatcattgctgagttcattgccacactcttgttcctttacatcaccgtcttgactgtcatcggctacaagtcccaaaccgaccccaaccatagcgctgaccaatgcggcggtgttggcattcttggcatcgcttgggcctttggtggcatgatctttgtccttgtctattgcactgccgggatctcgggaggacacatcaacccagcggtgacatttgggttgtttttggctagaaaggtgacactccctagggcgtttatgtacatcgtggctcaatgcctaggggccgtgtgtgggtgcggtttggttaaagcatttcaaaagacttactacaatacttatggcggtggtgccaacgaactcgcagatggctacagcaaaggcactggcttgggtgctgaaatcattggcacatttgtccttgtttacaccgtcttctcagccactgaccccaagagaaatgcacgagattcccatgtccccgtattggcacctctccctattgggtttgctgtgttcatggttcacttggccaccataccaatcactggcactggaatcaacccagctcgtagttttggagccgcggtcatgtacggaaaagacaaagcctgggatgatcaatggttattctgggtgggaccgatgattggagccgccatcgccgccttctaccaccagtatgtattgagagcaggggcagtcaaagctcttggatccttcaggagcaatgcctaagagccaaaacatgaagtttcagtaatttctatgttggtttggagaaattgtacaaatgtatttggtacttatggcacttagttttgaatgtgcccactatggtcctgctttc

SEQ ID NO: 14789 - DNA, 1185 bp, Cichorium intybus
atccaaacacactctctatctctcacactctcacacgcagagatttcgaagaagaaaatggggaaagacattgaggtgggtagccatgaatacggtgctaaagattaccaagaccctccacctgctcaactctttgacgccgaagaactcacgaaatggtctttttacagagccatcattgccgagttcattgccaccctcttgtttctttacatcaccgtcttgactgtcatcggctacaaggcccaaaccgatccagctcacagctccgaccagtgcggtggcgtaggaatcctaggcatcgcttgggccttcggtggcatgatcttcgtccttgtttattgcaccgccggcatctctggaggacatatcaaccctgcggtcacatttgggctgttcttggctagaaaggtgacactccccagggcagtcttgtacatcgtagctcaatgcctgggtgctatctgtggttgtggtctggttaaggctttccagaagacctactatcatacttatggtggtggcgccaacgagctcgccgatggctacagtaaaggaactggactgggtgcagaaatcatcggcacatttgtcctcgtatacaccgtcttctccgccactgacccaaagagaaatgctcgcgattcccatgtccccgtgttggcacctcttcctatcggatttgctgtgttcatggttcacttggccacaatcccaatcaccggcaccggaatcaaccctgctcgtagttttggtgcagccgtgatgtatggaaaagacaaagcctgggatgatcaatggatattctgggtgggacctatgatcggagctgccatcgccgccttctaccaccagtacgtattaagagcagcggcggtcaaagctcttggatccttcaggagcaatgcctagggcataagcatgcatgaagctttcaatagtttccaagaaattgtacaaatttgccttgcttttattagagttgatctctaaattgtattttgtaattggggccattggtttttgaatgtgcccaataaggtcgcttgactatatttttatgtgcatttagtctcttttgttttcgatgtaattggtcaaagggtttatttgctacgcaaatgctaatatcaaaagcgaggggtttatttgtatctgaaagcctttaatattgctttttcaagt

SEQ ID NO: 14790 - DNA, 1289 bp, Cichorium intybus
tcctctctcactctcacacgcagagatttcgaagaagaaaatggggaaagacattgaggtgggtagccatgaatacggtgctaaagattaccaagaccctccacctgctcaactctttgacgccgaagaactcacgaaatggtctttttacagagccatcattgccgagttcattgccaccctcttgtttctttacatcaccgtcttgactgtcatcggctacaaggcccaaaccgatccagctcacagctccgaccagtgcggtggcgtaggaatcctaggcatcgcttgggccttcggtggcatgatcttcgtccttgtttattgcaccgccggcatctctggaggacatatcaaccctgcggtcacatttgggctgttcttggctagaaaggtgacactccccagggcagtcttgtacattgtagctcaatgcctgggtgctatctgtggttgtggtctggttaaggctttccagaagacctactatcatacttatggtggtggcgccaacgagctcgccgatggctacagtaaaggaactggactgggtgcagaaatcatcggcacatttgtcctcgtatacaccgtcttctccgccactgacccaaagagaaatgctcgcgattcccatgtccccgtgttggcacctcttcctatcggatttgctgtgttcatggttcacttggccacaatcccaatcaccggcaccggaatcaaccctgctcgtagttttggtgcagccgtgatgtatggaaaagacaaagcctgggatgatcaatggatattctgggtgggacctatgatcggagctgccatcgccgccttctaccaccagtacgtattaagagcagcggcggtcaaagctcttggatccttcaggagcaatgcctagggcataagcatgaaacttgcaatagtttccaagaaattgtacaaatttgccttaatagagttatctctaagttgtattttgtaattggggccattggtttttaatgtgcccaataaggtcccttgattatatttttatgtgcatttagtcccttttcgttttcgatgtaattggtcaaagggtttattactttatttgctacccaaatgctaatatccaaagcgaggggttttgtcatcgtatttcatctctcttatttcctgaggtagtatctgaaagcctttaatatatgctattgcaattacacatctataatagcaatgtttttatatgtatatgttggaatgaaattttagtattaataatatctgtctacaggtccaaaaaattgtat

SEQ ID NO: 14791 - DNA, 999 bp, Cichorium intybus
ctttcgaagaagaaaatggggaaagacgttgaggctggtgctcatgattacagcgcaaaagactaccaagaccctccaccagctgaactctttgacgccgaggaactcacgaaatggtctttttacagagccatcattgctgagttcattgccacactcttgttcctttacatcaccgtcttgacagtcatcggctacaagtcccagaccgatcccgcccacagctccgaccagtgcggtggcgtaggaatcctcggcatcgcttgggccttcggtggcatgatcttcgtcctcgtttattgcaccgccggcatctctggaggacatattaaccctgcggtcacatttgggctgttcttggctagaaaggtgacactccccagggcggtgatgtacattgtggctcaatgcttgggtgctatctgtggttgtggtctggttaaagctttccagaagacttattatactacttacggtggcggcgccaacgagctcgccgacggctacagtaaaggcactggattgggtgctgagatcatcggcacatttgtccttgtatacacagtcttctccgccactgacccaaagagaaatgctcgcgattcccatgtccccgtgttggcacctcttcctatcggatttgctgtgttcatggttcacttggctacaatcccaatcaccggtaccggaatcaacccggctcgtagttttggggctgccgtgatgtacggaaaagacaaagcctgggacgatcaatggatattctgggtgggacctatgatcggagctgccatcgccgccttctaccaccagtacgtattaagagcagcggcggtcaaagctcttggatccttcaggagcaacgcctagggcataagcatgaaacttgcaatagtttccatgaaattgtacaaatttgccttgcttttattagagttcatctctaaaatgtattcggtatttagggccagaggtttttgaatgtgcccaataaagtcc

SEQ ID NO: 14792 - DNA, 954 bp, Echinacea purpurea
cggccgggggatccgcctctctattatctctaatctgtctctaacacacacacaacaagcttttgaagagtaaattatgggcaaagacgtggaggttggtagccatgagtacggtgcaaaggactaccaagaccctccaccggctgacctcttcgacgcggatgagctaaccaagtggtccttttaccgagccatcattgctgagttcattgccaccctcctcttcctctacatcaccgtcttgaccgtcatcggctacaagtcccagaccgaccccgcccatagctctgaccaatgtggtggtgtcggcatccttggcatcgcctgggccttcggtggcatgatctttgtgctcgtctattgcactgccggcatctcaggaggacacataaaccctgcggtgacatttgggctatttttggctaggaaggtgacactccctagagccttcatgtacatcgtggctcaatgcttgggtgcggtttgtggttgcggtctagttaaagctttccaaaagacctactacaacacttatggtggtggcgccaacgagctcgcagatggctacagtaaaggcaccggcttgggtgctgaaatcatcggcacatttgtcctcgtttacaccgtcttctcggccactgaccccaagagaaatgctcgagattcccatgtccccgtattggctcctcttcctatcggatttgctgtattcatggttcacttggccaccatcccaatcaccgggaccggaatcaacccggctcgtagtttcggtgcggctgtcatgtacggaaaagaaaaggcatgggacgatcaatggttattctgggtgggaccgatgatcggagccgcgattgccgccttctaccaccagtacgtattgagggcaggcgcagtcaaggctcttggatccttcaggagcaatgcctaagagccagagcatgaagtttggaa

SEQ ID NO: 14793 - DNA, 1015 bp, Echinacea purpurea
tctctattatctctaatctgtctctaacacacacacaacaagcttttgaagagtaaattatgggcaaagacgtggaggttggtagccatgagtacggtgcaaaggactaccaagaccctccaccggctgacctcttcgacgcggatgagctcaccaagtggtccttttaccgagccatcattgctgagttcattgccaccctcctcttcctctacatcaccgtcttgaccgtcatcggctacaagtcccagaccgaccccgcccatagctctgaccaatgtggtggtgtcggcatccttggcatcgcctgggccttcggtggcatgatctttgtgctcgtctattgcactgccggcatctcaggaggacacataaaccctgcggtgacatttgggctatttttggctaggaaggtgacactccctagagccttcatgtacatcgtggctcaatgcttgggtgcggtttgtggctgcggtctggttaaagctttccaaaagacctactaccacgcttatggtggtggtgccaacgagctcgcagatggctacagtaaaggcaccggcttgggtgctgaaatcatcggcacatttgtcctcgtttacaccgtcttctcggccactgaccccaagagaaatgcacgtgattcccatgtccccgtattggcacctcttcctatcgggtttgccgtattcatggttcacttggccaccatcccaatcaccgggaccggaatcaacccggctcgtagtttcggtgccgcggtcatgtacggaaaagaaaaggcctgggatgatcaatggttattctgggtgggaccgatgatcggagccgccatcgccgccttctaccaccagtacgtattgagagcaggcgcagtcaaggctcttggatccttcaggagcaatgcctaggagccagagcatgaagtttggaaagaaattgtacaaattgcttggttttctagtcatatatgcatttggtttttgtggcacttagtttttgaatgtgccca

SEQ ID NO: 14794 - DNA, 1263 bp, Flaveria ramosissima
tgtcaccttacactattttatgattatcatctcaaagttctcgatagttctactacattctcaccatatatatactcccacttgtttcttcacttcatcatcacccacaacttgagtaatcaatcttcatcacacacatatacacacaaaattaacaagcttccgattcaaagaggcaatggcgaaagacattgagggtgcagaatacggtgcaaaagactaccaagacccaccaccagctgagctatttgacgcagaggagctaaggaaatggtcattctacagagccattatcgcagagtttatagccaccctcttgttcctctacatcaccgtcttgaccgtgatcggctacaagtcccaaaccgaccccgaccacagcgctgatgaatgcggtggcgtgggcattctcggcatcgcgtgggccttcggaggcatgatattcgtgctcgtgtattgcactgctggcatctccggtggacacattaaccctgcggttacgtttgggctgtttttggctaggaaggtgaccctccccagggcggttatgtacatggtggctcagtgcttgggtgcggtctgtgggtgtggtctggttaaggctttccagaagtcttactacaatgcttatggtggtggtgctaatgagcttgctgatggctacagtaaaggcactggcttgggtgctgagatcattggtacgtttgtgcttgtctacaccgtcttctccgccactgatcccaagagaaatgcacgcgattctcatgtccccgtgttggcacctctccctatcggattcgcggtgttcatggttcacttggccaccatcccgatcacgggcaccgggatcaaccccgctcgtagttttggtgccgcggtcatgtacggaaaagaaaaggcctgggatgatcaatggatattctgggtgggaccgatgatcggagccgccattgccgcgatctaccaccagtacgtgctgagggcaggtgctgttaaagctctcggatctttcaggagcaatgcttaagcagttaagctatgagtactttcagtgtgttttggaagaaattgtacaaatttgtgtggtgatattgtgtgacctttgtggcgcttggtttttatatgtgctcaaaggttttttattttaagtcctttcaatctttttgagtttctattcagttcctcttgtttgttgtaattggtacatgggcgacttttcaacccttgtggtattgaataaactataaaaagtcgtttttgtaa

SEQ ID NO: 14795 - DNA, 1169 bp, Flaveria ramosissima
aatatcggggatccacaacttcagtaatcaatcttcaacacccatacacacaagctttcgattcaaagagccaatggcgaaagacattgaggttgcagaatacggtgcaaaagactatgaagacccaccaccagctgagctgtttgacgcagaggagctaaccaaatggtcattctacagagccatcatcgctgagttcatcgccaccctcttgttcctttacatcaccgtcttgaccgtcatcggctacaagtcccaaaccgaccccgaccacagcgctgatcaatgcggtggcgtcggcattctgggcatcgcttgggccttcggtggcatgatattcgtgctcgtgtattgcactgctggtatctccggaggtcacattaaccctgcggttacgtttgggttgtttttggctaggaaggtgaccctccccagggcggttatgtacatggtggctcagtgcttgggtgcggtctgtgggtgtggtctggttaaggctttccagaagtcttactacaatgcttatggtggtggtgccaacgagcttgcagatggctacagtaaaggcacaggattgggtgcggagatcattggcacgtttgtacttgtgtacaccgtcttctccgctactgatcccaagagaaatgcacgcgattctcatgtccccgtgttggcacctctccctatcggattcgccgtgttcatggttcacttggccaccatcccgatcaccggcactggaatcaaccctgctcgtagttttggtgcagcggtcatgtacggaaaagaaaaggcctgggatgatcaatggttattttgggtgggaccgatgatcggagctgcgatcgcggccttctaccaccagtacgtgttgagagcaggggcagtcaaagctcttggatcattcaggagcaatgcctaagaagcagagcatgaatgatgcagtgtttttcatgtggcttcgaagtaactgtacaaatttggcttaaatgtatttggtatttaagggcgcttagttttttaatgtgcccaatatggtcctgcttccgagtgcttaagcttctttttaatgtccattttgttcctcttgttttgttgtatttggtcaaacttcaaagggtgtaatatttgctacccaaataataacgtcagaggcttttgaccgttaa

SEQ ID NO: 14796 - DNA, 1339 bp, Flaveria ramosissima
tttctaaatccatataatattttagtcacataattgggtttaacaaaaaaaggaaaggtcatcttacactattttatcatctcaaagttcgagagacttctactacattcttaccatataaatactcccacttgctacactctatcatcatccacaacttcactaatcaatcttcaacacacatacactcacaacaagctttcggttaaaagaaaccaatggccaaagacattgaggttgcggaatacggtgcgaaagactaccaagacccaccaccagccgagctctttgacgcagaggagctaaccaaatggtcattctacagagccgttattgcggagtttatagccaccctcttgttcctctacatcaccgtcttgaccgtcatcggctacaagtcccaaaccgaccccgaccacagcgctgatcaatgcggtggcgtaggcattctcggcatcgcttgggccttcggtggcatgatattcgtgctcgtgtattgcaccgctggtatctcgggtggacacattaaccctgcggttacttttgggctgtttttggctaggaaggtgaccctccccagggcggttatgtacatggtggctcagtgcttgggtgcggtctgtgggtgtggtctggttaaggctttccagaagtcttactacaatgcttatggtggtggtgccaacgagctcgcagatggctacagtaaaggcactggattgggtgcggagatcattggcacatttgtgcttgtgtacaccgtcttctccgccactgaccccaagagaaatgcacgtgattctcatgtccccgtgttggcacctctgcctatcggattcgcggtattcatggttcacttggccaccatcccaatcacgggcaccggaattaaccctgctcgtagttttggtgccgcggtcatgtacggaaaagaaaaggcctgggatgatcaatggttattctgggtgggaccgatgatcggagctgcgattgcggccttctaccaccagtacgtgttgagagcaggggcagtcaaagctcttggatccttcaggagcaatgcctaaggagcatagcatgaatgttgcagtatttttcatgtggcttcgaagaaattgtacaaatttggcttaaatgtatttggtatttaagggcgcttagtttttaatgtgcccaatatggtcctgcttccgagtgcttaagcttctttttaatttccattttgttcctcttgttttcttgtatttggtcaaacttcaaagggtgtaatatttgctacccaaataataatatcagaggcttttgaccgttatactaaagaaaaaaaaaaaaaaaaaaa

SEQ ID NO: 14797 - DNA, 1133 bp, Flaveria ramosissima
tcatcatccaccacttcagtaatcaatctccatcacacatacacacaaaacaagctttcggttcaaagagccaatggcgaaagacattgagggtgcagaatacggtgcaaaagactatgcagacccaccaccagctgagctgtttgacgcagaggagctaaccaaatggtcattctacagagccattatcgcagagtttatagccaccctcttgttcctctacatcaccgtcctcactgtcatcggctacaagtcccaaaccgaccccgatcacagcgctgatcaatgcggtggcgtcggcattctcggcatcgcgtgggccttcggtggcatgatattcgtgctcgtgtattgcactgctggtatctccggtggacacattaaccctgcggttacgtttgggctgtttttggctaggaaggtgacactccccagggcggttatgtacatggtggctcagtgcttgggtgcggtctgtgggtgtggtctggttaaggctttccagaagtcttactacaatgcttatggtggtggtgctaatgagcttgcagatggctacagtaaaggcactggtttgggtgctgagatcattggtacgtttgtgcttgtgtacaccgtcttctccgccactgatcccaagagaaatgcacgcgattctcatgtccccgtgttggcacctctccctatcggattcgcggtattcatggttcacttggccaccatcccgatcaccggcactggaatcaaccctgctcgtagtttcggtgccgcggtcatgtacggaaaagaaaaggcctgggatgatcaatggttattctgggtgggaccgatgatcggagctgcgatcgcggccttctaccaccagtacgtgttgagagcaggggcagtcaaagctcttggatcattcaggagcaatgcctaagaagaagcatagcatgaatgaatgatgaagtgtttttcatgtggctttgaagaaattgtacaaatttggcttaaatgtatttggtatttaagggtgcttagttttttaatgtgcccaatatggtcctgcttctgagtgctttaagtcttttttttttaatgttcctatttttgttcctcttttttttgttgttatttggtcaaagttcaaa

SEQ ID NO: 14798 - DNA, 1430 bp, Prunus mume
cggccaacctaaagtttaataataccacttccactctcattcaactctccatataaacccccaaacccctccactcttccccatcacaaacaccaaactcacttcactttcatctctctctctctctctctctctctctctctctctctctacctaagctaagagctagctagctacccaattagccatggccaaagacagtgaagttggtggagggcataatagattctcaggaaaagactaccaggaccctcctccagcaccattgattgatgcagaggagcttggccagtggtctttttacagagccattatagctgagttcatagctaccctcttgttcttgtacatcactgtgctcacagtgattggatacaagagccaatctgatggagaccaatgtggtggtgttggcattcttggcattgcttgggcctttggtggcatgatctttgtccttgtttactgcaccgctggcatctctggagggcacataaaccctgctgtcacatttgggctgtttttggctaggaaggtgtcacttgtcagagccatattgtacatggtggctcagtccttgggagccatatgtggtgttgggcttgtgaaagctttccaaaaggcttactttaccaagtatggtggaggggccaatggacttgctgatgggtacagccaaggcactggtttggctgctgagattattggcacctttgttcttgtctacactgtcttctctgccaccgatcccaagagaaatgcaagggattcacacgtcccagttttggcaccactgccaattgggtttgctgtgtttattgtgcaccttgccacaatcccaatcactggcactggcataaacccagcaagaagccttggagctgcagtgatctacgacaatgacaaggcttgggatgaccaatggatcttctgggttgggccattcattggtgctgccattgctgccttctatcaccaatacatactgagagcaggagctgttaaagctcttggctctttcaggagctcctccaacatataatttctcagaggattggttgtgttttctgaatggaagcttggattttgtaaatctgtgtgtacaaggcactcattttaaatgtgcctcaatgttgctttctgctctgtttttacaaaatttcagtttggttattgtgtcatcaagaagttttaattatgagcgattactttgttgtgaattgtgatggaaaactttagtacttgttccatacgtaagaaacgaaattatgaaaccctcactcgagcgctaaatcttaaaccctaaactataaactttttgttaaccgtaaagcgtatttcggtctcatagtaccttgcatctgatttgccagatggaaaattagaggtaacgcaacagcaagcggaatcaacatatgtggcaaacagtt

SEQ ID NO: 14799 - DNA, 1146 bp, Helianthus annuus
ccacttcatctctctcttctcattctatacacacacacatcaacaatagccatgttttctaaaaggaaatggcaaaagacattgaagtagcaagccacgaatacggtgcaaaagactaccaagaccctccaccagctgacctcattgacccagaggagctcaccagatggtccttttaccgagccatcattgctgagttcgtcgccaccctcttgttcctttacatcaccgtcttgactgtcatcggctaccagtcccaaaccgaccccgaccacagcaccgaccagtgtgggggtgtgggcattcttggtatcgcgtgggccttcggtggcatgatctttgtcctcgtttactgcactgccggtatctctggtggacacattaaccctgctgtcacattcgggctgtttttggctaggaaggtgaccctcccaagggcggttatgtatatggtggctcagtgcttgggtgcggtctgtggttgtggtctggtgaaagctttccaaaagtcttactacaccaattatggcggtggtgcgaatgagcttgcagatgggtacaacaaaggcaccggtttgggtgcggaaatcattggcacattcgtcctagtctacaccgtcttctcagccactgacccaaagagaaacgcacgtgactctcatgtccccgtgttggcacctctccctattggattcgccgtattcatggttcacttggccaccatcccaatcaccggcactggaatcaaccctgctcgtagttttggggccgcggtcatctacggaaaagaaaaggcatgggatgatcaatggatattctgggtgggaccgatgatcggagcggcgatagcggctatctaccatcagtacatattgagggcaggtgcagttaaagctcttggatcattcaggagcaatgcctaagcatgaaactttgtcatgtattttcgaaaaaattgtacaaattgcctttgttttctacttttatccaagacgctctttcttatatgtattttggtatttagggcactttgtttttttaatgtgcccaatttggtcttgcttccttttttttttatgtcaatttggcctttcttgctttgttgtatttctacctatataataatttcaaagataagagttttct

SEQ ID NO: 14800 - DNA, 1170 bp, Daucus carota
atctctctccctctttaaatactcccccactctctcctctttgctccatctctcaacactaaatctctctcgcacttgcacacaaatatacattttatatggcgaaggacggagaagtggcggagcagagcgggttctcgtccaaggactaccatgatccgccaccagcggcgtttatcggcactgatgagctgaccaaatggtcgttctacagggctttgatagctgagttcatagccacccttctctttttgtacatcactgttttgactgtgattgggtacaagagccagtcttctacggaccagtgcggtggagttgggcttctgggcatagcgtgggcctttggtggcatgatctttgttctcgtttactgcactgccggcatctccggaggacacataaacccagcggtgacattcgggttgtttctggcgaggaaagtgtcactaataagggcagtgatgtatatggtggcacagtgtttgggtgcgatctgtggggtagggttggtgaaggccttccaaaagtcttactataacaggtatggtggaggggccaacgagctggctgatggttacaacaaaggcactggcctaggtgccgaaattattggcacttttgttcttgtctacacagtcttctcagccacggatcctaagcgaaatgccagagattcccatgtccctgtgctggcccccctgcctattggattcgcggtgttcatggttcacttggccacaattccgatcactgggaccggtatcaaccctgctaggagtttcggagctgcagttatctataacaaagagaaagcctgggatgatcagtggatattctgggtcgggcctttcatcggtgctgccatagctgcattctaccaccagttcattctcagagcagcagctgtcaaggctcttggatccttcaggagcaatgcctaattaatttaataatcttttcttaattcaccagcaaggatgggttatcgattgattgcatttatcagtacccttaatcaagaatctaagaagtctggttgagcaaaatgtgaagttaattagagagggaaaggccatggaattgtagatatatgtaattcatgatatctatgctgtattttcagtttccacatggtgtgtcatcatattttattttcttcgcattttt

SEQ ID NO: 14801 - DNA, 1338 bp, Daucus carota
ccactctctcctctttgctccatctctcaacactaaatctctctcgcacttgcacacaaatatacattttatatggcgaaggacggagaagtggcggagcagagcgggttctcgtccaaggactaccatgatccgccaccagcggcgtttatcggcactgatgagctcaccaaatggtcattctacagggctttgatagctgagttcatagccacccttctcttcttgtacatcactgttttgactgtgattgggtacaagagccagtcttctacggaccagtgcggtggagttgggcttctgggcatagcgtgggccttcggtggcatgatctttgtccttgtttactgcactgccggcatctccggaggacacataaacccagcggtgacattcgggttgtttctggcgaggaaagtgtcactaataagggcagtgatgtatatggtggcacagtgtttgggtgcgatctgtggggtagggttggtgaaggccttccaaaagtcttactataacaggtatggtggaggggccaacgagctggctgatggttacaacaaaggcactggcctaggtgccgaaattattggcacttttgttcttgtctacacagtcttctcagccacggatcctaagcgaaatgctagagattcccatgtccctgttctggctcccctgcctattggattcgcggtgttcatggttcacttggccacaattccgatcactgggaccggtatcaaccctgctaggagtttcggagctgcagttatctataacaaagagaaagcctgggatgatcagtggatattctgggtcggacccttcatcggtgctgccatagctgcattctaccaccagttcattctcagagcagcagctgtcaaggctcttggatcctttaggagcaatgcctaattaatttaataatcttttcttaattcaccagcaaggatgggttatcgattgattgcatttatcagtacccttaatcaaggatctaagaagtctggttgagcaaaatgtgaagttaattagagagggaaaggccatggaattgtagatatatgtaattcatgatatctatgctgtattttcaggttccgcatggtgtgtgatcatattttattttcttggcatttttagattttctttgttctcgtgttaagttttaaatcaaatattttgtactgggacggttgttcataaatcaagaagatggtttgttgtttaatgtatcatctatctgagcattgatgtgtggttgcctaattttggatcaagcatctgtccttttttctgctttcagacgtaactatttatgatttcaagtttcag

SEQ ID NO: 14802 - DNA, 1610 bp, Petroselinum crispum
caataattttctactattcgataaatgggggcggtagtaataaataatattagtgatagctgtttaattttctagtgtagggtattctcgcatattctaaactctccatgatcactagtagtatactagtatatgctataaaaactcatcactactacttcactcttacaataatcatctcccaatcatctcctgtcttactaaaaaacaagaagagaaagaagcaagagatttagttatagtttaatggggaaggacattgaggttgcagagcatggtcgagactaccaagaccctcctccagttgatttctttgatgctgaagaacttggtagttggtcattttacagggctatcattgctgagtttgttgcaactcttttgtttctttacattactgtcctcactgttattggctacaaggcacaatctgatacagaccagtgtggtggtgttggacttctcggcattgcttgggcctttggtggcatgatcttcgtcctcgtttactgtactgctggcatatcagggggacatattaatccagctgtgacattcggattgtttttggctcgaaaggtgtcactggtgcgggcagtgatgtacatgatcgctcagtgccttggagcaatctgcggggttgggttggtcaaggcctttcaaaagtcttattatatccgctacggtggtggggcaaatgaattagcggatggttacaacaaaggcacgggtttgggtgctgaaattattggtacttttgttcttgtttacactgttttctctgccaccgatcctaagagaaatgctcgagactctcatgttcctgtgttggctccacttcctattggatttgctgtattcatggttcacttggctacgatccctatcaccggaactggtatcaatccagctcgtagttttggagctgcagttatctatggaaaagagaaagcctgggatgatcaatggattttctgggtaggtccatttatcggggctgcaattgccgccttctatcatcagtacatcttgagagcagcagctgttaaagctctgggatcattcaggagcaacgcttaatttatcgtccagatgagaatggtcagaggtcagcgtgtgaataagaaggaactcatggagtggagttggcgcacaagttgtaaattgttggtttagtagaaggtttcactcgtattggattgtcaattattatcaatcacagggcacttgtttttctcagtgtttccaagtgtttaatatatcctctgttttgcctttttattggtttgtgtcaattttcccatttcttctgctgctatttacctctttttgatgtatttcatgatcataatgcttaagcatgcagtgtccgacaaacttaaaaattgtggttcaatctgcccataatcagattaattgttttcgacctatatacctcgttcaaagtacaacttcactaccgaggtcttacattgggctgcaagagtagtttcatgtctacatatgtctcataagaatgtaacaaaataaattatagcaatccttcagaaaagcgtttaactaaatttaaaagatccttccagagatgatgacgatcagtgataatcccg

SEQ ID NO: 14803 - DNA, 1219 bp, Nicotiana benthamiana
cacaatcaattctacatatttctatctaaaagctctcaaaaacaacattattcaagattagcataatcttcttttggcgagcctaatttggagtgcaaaaatggctaagaacattgagtatggcactgatcaatacgcccctaattaggactaccaagatccacctccagcaccactaattgatgcagaggaacttggaaaatggtcattttatagagccattattgctgaatttattgcaactctgttgtttctctatatcactgtcctcactgtgattggctacaacagccaaagtgatactaaacataatggtgatgaatgtggtggtgttggcattcttggcattgcttgggcctttggtggcatgattttcgttcttgtttactgcactgctagtatttctggaggacatattaacccagctgtgacatttgggctcttcttggctagaaaaatctcattggccagagcagttatgtatatgatagcacagtgtttaggagccatttgtggttgtggtttggttaaggcatttcagaaggcttactatactagatatggtggtggtgccaatgagcttgcaacaggctacagcactagcactggattagctgctgaaatcattggcacttttgtccttatttatactgtcttctctgccactgaccccaagagaaatgctagagattcccatgttcctgtattggcaccacttccaattggatttgctgtattcatggttcacttggctacaatcccaatcactggaactggtattaatccagctagaagttttggagctgcggtcatatatggcaaagacaaagcctgggatgaccaatggattttctgggttggaccttttattggtgctgcaattgctgcattatatcaccaatacatattgagagctggagcagtcaaagcagttggctcatttaggagcaatgcctaatgattagaatctgcaattagagctatataaggaaatggaatgaatattaaatggtcaaaattgtatagtggtatttgtgaagatggcctcgttaaaatgtgcttttgtttactttgtggtttggcacttaattttaaatgtgccaaacattgtcattttaaagcttttgtttggttgcatttcctacttttgtttcctttcacttgtaaatttccttgttctgttcaataataatactgaattgagcagggcttctttgta

SEQ ID NO: 14804 - DNA, 1081 bp, Centaurea maculosa
ctctttctatctctcttttacacacacacacacactctcttcagaatcacatataattttgggcatatatatatacatatatggggaaagacattgaggttggtggtcatgattacggtgcaaaagattaccaagaccctccaccagctccccttttcgactccgaggaactcaccaaatggtcgttttacagagccataattgccgagttcgttgcgaccctcttgttcctttacatcacggtcttgaccgtcatcggatacaagtcccagactgaccccatccacagccccgaccaatgcggtggcgtcggaatccttggcatcgcttgggccttcggtggcatgatcttcgttctcgtatattgcaccgcaggcatatccggaggacacattaaccctgctgtcacatttgggttgttcttggccagaaaggtgactctaccaagggcagtgatgtacattgtggctcaatgcttgggtgccatatgtggttgtggtctggtgaaggctttccaaaagacttactatgacaattacggtggtggtgccaacgagctagccgatggctacaataaaggcacgggtttgggtgcggaaatcatcggcacctttgttctcgtgtacaccgtcttctcggccactgatcccaaaagaaatgcccgcgattcccatgtccccgtgttggcacctcttccaattggatttgctgtgttcatggttcacttggccacaatcccaatcaccggcaccggaatcaaccctgctcgtagtttcggtgctgccgtgatctatggaaaagacaaagcatgggatgatcaatggttgttctgggtgggaccgatgatcggagccgccatcgccgccatctaccaccagtatgtattgagagcaggagcagtgaaagctcttggatccttcaggagcaatgcttaggagggaaggagaattgaaggttgctgaaatttcaacaattgtacaaattaattaagctgggtttggttttgtttttatgtacttcttatgtatgttggtgtttaaggcacttggtttttgtagtgtgcccattctggtccttcgta

SEQ ID NO: 14805 - DNA, 966 bp, Chrysanthemum coronarium
agctagaaaatgagcaaagacgtagaggttggtggacatgatcactacggtgctaaagactaccaagaccctccaccagctgcccttttcgactccgaagaactctccaaatggtctttttaccgagccattatagccgagttcattgccacaatgttgttcctttacatcactgtcttgactgttattggttacaagtcccaagtagaccctgcccacagcaaggaccaatgtggtggtgttggaatccttggtatcgcatgggcttttgggggcatgatttttgtccttgtttattgcactgcaggtatctcaggaggacacattaaccctgctgttacattcgggctgtttttggctaggaaagtgacactaccaagggcatttatgtacattgtggctcaatgtttgggtgctatttgtggttgtggtcttgttaaggctttccagaagacttactatcataattatggtggtggtgccaatgagcttgctgatggttacagtacaggaaccggtttgggtgccgaaatcattggtacctttgttcttgtttacaccgttttctcggccacagaccctaagagaaatgcacgcgattcccatgtcccagtgttggcacctcttcctatcggatttgcggtgttcatggttcacttggccacaatcccaatcactggaactggaatcaaccctgctcgtagttttggtgctgctgttatgtatggtaaagaaaaggcatgggatgatcaatggttattctgggttggaccgatgattggagctgcgattgccgctttctaccaccagtacgtattgagagctggtgcgattaaggctcttggatctttcaggagcaatgcctagatcaagagcgtacatgtttttaagaagttgtacaaatttgcctgttttaatgaagtgtgtaccgtattatttaagggtatattgtcaaagggcgctaag

SEQ ID NO: 14806 - DNA, 1032 bp, Chrysanthemum coronarium
aatcgaatcctccactctctcactcttataacacattcttctacacacaaataacaattaacaaagagctagaaaatgagcaaagacgtagaggttggcggacatgatcactacggtgctaaagactaccaagaccctccgccttctccccttttcgactccgaagaactcaccaaatggtctttttaccgagccataatagccgagttcattgccacaatgttgttcctttacatcactgtcttgactgtcatcggttacaagtcccaagtcgaccccgctcacagcactgaccaatgcggtggtgttggaatccttggtatcgcatgggcttttggaggcatgatttttgtccttgtttactgcactgctggtatctcaggaggacacattaaccctgcggttacattcgggctgtttttggctaggaaagtgacgctaccaagggcatttatgtacattgtggctcaatgtttgggtgctatttgtggctgtggccttgttaaggctttccaaaagacttactatcataattatggtggtggtgctaatgagcttgcagatggttacagtaaaggaaccggtttgggtgccgaaatcattggtacctttgttcttgtttacaccgtcttctcggccactgaccctaagagaaatgcacgcgattcccatgtcccagtgttggcacctcttcctatcggatttgctgtgttcatggttcacttggccacaatcccaatcactggaactggaatcaacccggctcgtagttttggtgctgctgtcatgtatggtacagaaaaagcatgggatgatcaatggttattctgggcgggaccgatgattggagctgcgattgctgctttctaccaccagtacgtattgcgagctggtgcagttaaagctcttggatctttcaggagcaatgcctagatcaagagcgttcatgtttttaagaagttgtacaaatttgcttgttttaatgaagtgtgtaccgtattatttaagggtatattgtcaaagggcacaaag

SEQ ID NO: 14807 - DNA, 1023 bp, Chrysanthemum coronarium
catcaacaaacactccaatcgctcactctaataacacattcttctacacacaaataacaacaacgcaaagaggtagaaaatgagcaaagacgtagaggttggtggtcacgatcactacggtgctaaagactaccaagaccctccaccagctgcccttttcgactccgaagaactcaccaaatggtctttttaccgagccattatagccgagttcattgccacaatgttgttcctttacatcactgtcctgactgttattggttacaagtctcaagtagaccctgcccacagcaaagaccaatgtggtggagttggaatccttggtattgcatgggcttttgggggcatgatttttgtccttgtttattgcactgcaggtatctcaggaggacacattaaccctgccgttacattcgggttgtttttggctaggaaagtgacattaccaagggcatttatgtatattgtggctcaatgtttgggtgctatttgtggttgtggtcttgttaaggctttccaaaagacttactatcataattatggtggtggtgctaatgagcttgctgatggttacagtaaaggcactggcttgggtgctgaaatcatcggtacctttgttcttgtttacaccgtcttctcggccactgaccctaagagaaatgcacgcgattcccatgtcccagtgttggcacctcttcctatcggatttgcggtgttcatggttcacttggccacaatcccaattactggaactggaatcaacccggctcgtagttttggtgctgctgtcatgtatggtaaagaaaaagcatgggatgatcaatggttattctgggttggacccatgattggagcagccatcgcagccttttaccaccagtacgtattgagagctggtgcggtcaaagctcttggatctttcaggagcaatgcctagatcaagagcatgaaatatgcaaatgtatttcatgtttttaagaaattgtacaaatttgcttgttttcatgaagagtgttttattta

SEQ ID NO: 14808 - DNA, 1113 bp, Chrysanthemum coronarium
tctctcactcttataacacattcttctacacacaaataacagcaaagtaaagagctagaaaatgagcaaagacgttgaggtaggtggacatgatcactacggtgctaaagactaccaagaccctccaccttctccccttttcgactccgaagaactcaccaaatggtccttttaccgagcaataatagccgagttcattgccacattgttattcctttacatcactgtcttgactgtcatcggttacaagtcccaagtcgaccccgcccacagcactgaccaatgtggtggtgttggaatccttggtatcgcatgggcttttggaggcatgatttttgtccttgtttattgcactgcaggtatctcaggaggacacattaaccctgctgttacatttgggctgtttttggcaagcaaagtaacgctaccaagggcatttatgtacattgtggctcaatgtttgggtgctatttgtggttgtggtcttgttaaggctttccaaaagacttactatcataattatggtggtggtgctaatgagcttgctgatggctacagcaaaggaaccggtttgggtgctgaaatcatcggtacctttgttcttgtttacaccgtcttctcggctactgaccctaagagaaatgcacgcgactcccatgtccctgtgttggcacctcttcctatcggatttgcggtgttcatggttcacttggccacaatcccaattactggaactggaatcaacccggctcgtagttttggtgctgctgtcatgtatggtaaagaaaaagcatgggatgatcaatggttattctgggtgggaccaatgattggagccgcgattgcagccttttaccaccagtacgtattgagagcaggtgctattaaggctcttggatcgttcaggagcaacgcctgagctaagatcgagtagtttcaatgtcgatccctttggaagaaattgtacaaatttgtttctctgttaaatgtgtgaggtcctttggtcgctatattttttaatgtgcccaaaagggtttaattactttcaagtcctatttaaattcagtctcttttgcttgttgtaattgattaatgggaatgggtgatcttccg

SEQ ID NO: 14809 - DNA, 1109 bp, Cirsium arvense
acacacacacacacactgtcttcagaatcacatataattttgggcatatatatacatatatggggaaagacattgaggttggtggtcacgattacggtgcaaaagattaccaagaccctccaccagctccccttttcgactccgaggaactcagcaaatggtcgttctacagagccatcattgctgagttcgttgcaaccctcttgttcctttacatcaccgtcttgaccgtcatcggatacaagtcccagactgaccccatccacagccccgaccaatgcggtggcgtcggaatccttggtatcgcttgggccttcggtggcatgatcttcgttctcgtatattgcacagccggcatatcgggaggacacattaaccctgcagtcacatttgggttgttcctggccagaaaggtgacccttccaagggcagttatgtacattgtggctcaatgcttgggtgctatctgtggttgtggtctggtgaaggctttccaaaagacttactatgacgattacggtggtggtgccaacgagctagccgatggctacaataaaggcacgggtttgggtgcagaaatcatcggcacctttgttctcgtgtacaccgtcttctcggccactgatcccaaaagaaatgcccgcgattcccatgtccccgtgttggcacctcttccaattggatttgccgtgttcatggttcacttggccacaatccccatcaccggcaccggaatcaaccctgctcgtagtttcggtgctgccgtcatctatggaaaagacaaagcatgggatgatcaatggttattctgggtgggaccgatgatcggagccgccatcgccgccatctaccaccagtatgtattgagagcaggagcagtgaaagctcttggatccttcagaagcaatgcctaaggaggaaggagaattgaaggttgctgaattttccacaattgtacaaattaattaagctggtttggtttgttttatgtacctcttatgtatgttggtgtttaaggcacttggtttttgagtgtgcccattctggtccttcgtagtttgtttttattgttctaatttaacttcccttttcgtttttgtttgttaatt

SEQ ID NO: 14810 - DNA, 1200 bp, Cirsium arvense
caccaatctctttctatctctcttttactacacacacacacacactcttatcagaatcacatatatataattttgggcatatacatacatatatggggaaagacattgaggttggtggtcatgattacggggcaaaggattaccaagaccctccacccgctcccctttttgacggggaggaactcaccaagtggtcgttctacagagccatcattgccgagttcgttgcaaccctgttgttcctttacatcacggtcttgaccgtcatcggatacaagtcccagactgaccccatccacagccctgaccaatgcggtggcgttggaatcctcggcatcgcttgggcctttggtggcatgatcttcgttctcgtatattgcaccgccggcatatcgggaggacacattaaccctgcagtcacatttgggttgttcttggctagaaaggtgacacttccaagggcagttatgtacattgtggctcaatgcttgggtgccatctgtggttgtggtctggtgaaggctttccaaaagacttactacgacgattacggtggtggtgccaacgagctcgccgatggctacaataaaggcacgggtttgggtgcggaaatcatcggcacctttgttctcgtgtacaccgtcttttcggccactgatcccaagagaaatgcccgtgattcccatgtccccgtgttggcacctcttccaattggatttgctgtgttcatggttcacttggccacaatccccatcacgggaaccggaatcaacccggctcgtagtttcggtgctgccgtgatctatggaaaagacaaggcatgggatgatcaatggttgttctgggtgggaccgatgatcggagccgccatcgccgccatctaccaccagtatgtattgagagcaggagcagtgaaagctcttggatccttcaggagcaatgcttaggaaggaaggagaattgaaggttgctgaatttttcacaattgtacaaattaattaagctgggtttggttttgtttttatgtacctcttatgtatgttggtgtttaaggcacttggtttttgagtgtgcccattctggtccttcgagtttgtttttatgtcaatttactcccttttgttttgttgtaatccattattggttacatatttcccactcaaataataagcacgaaacaggggattacctaaaaaagaa

SEQ ID NO: 14811 - DNA, 968 bp, Prunus persica
acaatctcttccaaacacacttaattttcatctctctctctctctctctctctctctctctctctacctaagctaagagctagctagctacccaattagccatggccaaagacattgaagttggtggagggcaacatagattctcaggaaaagactaccaggaccctcctccagcaccattgattgatgcagaggagcttggacagtggtctttttacagagccatcatagctgagttcatagctaccctcttgttcttgtacatcactgtgctcacagtgattggatacaagagccaatctgagggagaccaatgtggtggtgttggcattcttggcattgcttgggcctttggtggcatgatctttgtccttgtttactgcactgctggcatctccggagggcacataaaccctgctgttacatttgggctgtttttggctaggaaggtgtcactggtcagagccatattgtacatggtggctcagtccttgggagccatatgtggtgttgggcttgtgaaagctttccaaaatgcgtactttaccaagtatggtggaggggccaatgggcttgctgatgggtacagccaaggcacaggtttggctgctgagattattggcacctttgttcttgtctacactgtcttctctgccactgaccccaagagaaatgcaagggattcacatgtcccagttttggcaccactgccaattgggtttgctgtgtttattgtgcaccttgccacaatcccaatcactggcactggcataaacccagcaagaagccttggagctgcagtgatctacaacaatgacaaggcttgggatgaccaatggatcttctgggttgggccattcattggtgctgccattgctgccttctatcaccaatacatactgagagcaggagctgttaaagctcttggctctttcaggagctcctccaacatataatttttcagagga

SEQ ID NO: 14812 - DNA, 848 bp, Helianthus annuus
ggcaaagacgttgaggttggtggtcatgagtacggtgcaaaagattaccaagaccctcccccggctgacctcttcgacgcggaggaactcaccaagtggtctttttaccgagccatcattgctgagttcattgctacccttctcttcctttacatcactgtcttgactgtcattggctacaagtcccaaactgaccccgcccatagttctgaccaatgcggcggtgttggcattcttggtattgcttgggccttcggtggcatgatcttcgtcctcgtctattgcactgctggcatctcaggaggacacattaaccctgcggtgacatttgggctatttttggctagaaaggtgacactcccgagggcgttcatgtacatcgtggctcaatgcttgggtgccatatgtggttgcggtctggttaaagctttccaaaaaacttactacaatacctatgggggtggtgccaatgagctcgcagatggctacagcaaaggcaccggcttgggtgctgaaatcattggcacatttgtcctcgtttacactgtcttctcagccactgaccccaaaagaaatgctagagattcccatgtccctgtattggcacctctccctatcggatttgctgtattcatggttcacttggccaccatcccaatcactggcactggaatcaacccggctcgtagttttggtgcggccgtcatgtacggaaaagaaaaggcatgggatgaccagtggttgttctgggtgggaccgatgatcggagccgccatcgccgccttctaccaccagttcgttttgagagccggcgcagtcaaagctcttggatcctctaggagcatgtg

SEQ ID NO: 14813 - DNA, 1092 bp, Daucus carota
tctctctctgcataattgccacaattttggttaacaatgggcaaagaagaagtgtcagagcaaacccatgagtactccggcaaggactaccaagaccccccaccagcagcattcattggactagatgagcttggtaaatggtcattttacagagctgtcatagctgagttcatagccaccttactcttcctctacatcactgtactaactgtcattggttacaagagccagtctgccactgaccaatgcggtggcgttggccttctcggtatcgcatgggccttcggtggcatgatcttcgttcttgtctactgcactgccggtatctctggaggacacattaaccctgcagtgacatttggattgtttttggcaagaaaagtgtcactaatcagagcagttatgtacatggtagcacagtgtttgggtgctatttgtggagtaggtttagtgaaggctttccagaagtcttactacaacaagtatggtggtggggccaatgagttggctgatggttacaacaagggtactggtctaggtgctgaaattattggcacatttgttcttgtttacactgttttctctgctactgacccaaagagaaatgccagagattctcatgtccctgtgttggctcctcttcctattggattcgccgtgttcatggttcaccttgccaccattcccatcactggaactggaattaaccctgccagaagctttggagctgcggttatttacaacaaagacaaggcctgggatgatcaatggattttctgggttggaccattcatcggcgcagccattgctgcattctaccaccaatacattctgagagcagcagcactcaaggcgctcgggtctttcaggagcaatgcctaggaaattttaaaatttcgcaaagcattgagatctgtctctagctcgatacaagatgctaattcaatctgaggcaatggcaaggaattgtaattatttgtaattttctatgaggttattaagtttgtaatttcctctttgttgtatttgtatcttttgtggttgtaatcatcttttgtttccttttctcctttaataatattctcttcttta

SEQ ID NO: 14814 - DNA, 1072 bp, Daucus carota
aaatctctctcgcacttgcacacaaatatacattttatatggtgaaggacggagaagtggcggagcagagcgggttctcgtccaaggactaccatgatccaccaccagcggcgtttatcggcactgatgagctgaccaaatggtcattctacagggctttgatagctgagttcatagctactctcctcttcttgtacatcacggttttgactgtgattgggtacaagagccagtcttctacggaccagtgcggtggagttgggcttctgggcatagcgtgggcctttggtggcatgatctttgttctcgtttactgcactgccggcatctccggaggacacataaacccagcggtgacattcgggttgtttctggcgaggaaagtgtcactaataagggcagtgatgtatatggtggcacagtgtttgggtgcgatctgtggggtagggttggtgaaggccttccaaaagtcttactataacaggtatggtggaggggccaacgagctggctgatggttacaacaaaggcactggcctaggtgccgaaattattggcacttttgttcttgtctacacagtcttctcagccacggatcctaagcgaaatgctagagattcccatgtccctgttctggctcccctgcctattggattcgcggtgttcatggttcacttggccacaattccgatcactgggaccggtatcaaccctgctaggagtttcggagctgcagttatctataacaaagagaaagcctgggatgatcagtggatattctgggtcggacccttcatcggtgctgccatagctgcattctaccaccagttcattctcagagcagcagctgtcaaggctcttggatcctttaggagcaatgcctaattaatttaataatcttttcttaattcaccagcaaggatgggttatcgattaattgcatttatcagtacccttaatcaaggatcgaagaagtctggttgagcaaaatgtgaaattaattagagagggaaaggccatggaattgtagatatatgtaattcatgatatctatgctgtattttcaggttccg

SEQ ID NO: 14815 - DNA, 1278 bp, Daucus carota
cctatctctctccctctttaaatactcccccactctctcctctttgcttcatctcacaacactaaatctctctacacttgcataaaaatatatatgggaaaggacggagaagtggcggagcagagtgggttctcgtccaaggactaccatgatccgccacccgcggcgtttatcggcactgatgagctcaccaaatggtcattctacagggctttgatagctgagttcatagccacccttctcttcttgtacatcactgttttgactgttattgggtacaagagccagtcttctacggaccagtgcggtggagttgggcttctgggcatagcgtgggccttcggtggcatgatctttgtccttgtttactgcactgccggcatctccggaggacacataaacccagcggtgacattcgggttatttctggcgaggaaagtgtcactaataagggcagtgatgtatatggtggcacagtgtttgggtgcgatctgtggggtagggttggtgaaggccttccaaaagtcttactataacaggtatggtggaggggccaacgagctggctgatggttacaacaaaggcactggcctaggtgccgaaattattggcacttttgttcttgtctacacagtcttctcagccacggatcctaagcgaaatgctagagattcccatgtccctgttctggctcccctgcctattggattcgcggtgttcatggttcacttggccacaattccgatcactgggaccggtatcaaccctgctaggagtttcggagctgcagttatctataacaaagagaaagcctgggatgatcagtggatattctgggtcggacccttcatcggtgctgccatagctgcattctaccaccagttcattctcagagcagcagctgtcaaggctcttggatcctttaggagcaatgcctaattaatttaattatcttttcttaattcaccagcaaggatgggttatcgattaattgcatttatcagtacccttaatcaaggatcgaagaagtctggttgagcaaaatgtgaaattaattagagagggaaaggccatggaattgtagatatatgtaattcatgatatctatgctgtattttcaggttccgcatggtgtgtgatcatattttattttcttggcatttttagattttctttgttctcgtgttaagttttaaatcaaatattttgtactgggacggttgttcataaatcaagaagatggtttgttgtttaatgtatcatctatctgagcattga

SEQ ID NO: 14816 - DNA, 1406 bp, Citrus clementina
aattggtggggctaagaaagtagcaaatgaaagacaccaaaacaatagctcgatggggcggcaaaaaactaagtttaattcatactcaatcatctctttaaactcccccataaataccctccactttcctcactctttttcatcacttaaataaatccacacctctcttatctcctattgggaaatttttttttttttttaaattctcagtgaagaccaatccgtagcaatggccaaggacattgaggttggtgggcaaggcgagttccatgctaaggattaccatgaccctccgccagctccattgatcgatgccgaggagctcactaaatggtcgttttacagggctattatagctgagttcatcgccacgctcttgtttttgtacattactgtgctgacagtgattggttacaaaagccagacggacgccaaccacggcggtgacggatgtggtggtgttggtattctgggcatcgcttgggcctttggtggcatgatctttgttcttgtttactgcactgctggtatctctggtggacacattaacccggcggtgacatttgggctgttcttggcgcggaaggtgtcactggtgcgagccgtaatgtacatggtggctcagtgtttgggagccatatgtggctgcgggctcgttaaggctttccagaagtcttactacacaagatacggcggtggagccaatgagctcgctgatgggtacagcactggcactggattgggtgctgagatcattggtacctttgttcttgtctacactgttttctccgccaccgatcccaagagaaatgctagggactcccatgttcctgtcttggcaccattgccaattggatttgctgtgttcatggttcacttggcgacaatcccagtcactggaactggcatcaaccccgctagaagtttgggagctgcagtgatttataagaaggacaaggcttgggatgatcaatggatcttctgggttggccccttcattggtgctgcaattgctgcattttaccaccaattcatcctcagagcatctgcttctaaagctcttggatccttcaaaagctcctccaacatttaattaacttttaaaataattactggaggattaatcaatggctgtcaagcgccttcgcgactatggaatttgtacattattttatttgcatcagtatttagtagagctggtgtagatcccgcagcactttgtgtgtcttttgtttacctgcgggcacttgtttttagtgtgccccaaaaattgttatttgctttgcttttcttccccttttcgacggctgtactcgtggttttatctaaaatttcgatagtaagtgctttatggcatacaattgtgccgattaaataaaaggagagggtaattcccttaagatata

SEQ ID NO: 14817 - DNA, 1529 bp, Petroselinum crispum
agtgaagatgaggtggctaggtacccacttaatcattatctccactctatcttcccataaatactaaccctttcttcctcatccactcacactcctctatctacgtctctctctaaaccttctcatctgcaaatttgccacaacttttgtcaaagatgggcaaagaagaagtgtcagagcaagcccatgagtactccggcaaggactaccaggacccaccaccagctgcattcattggaatagatgagcttggtaaatggtcattttacagagctcttatagctgagttcatagccaccttactgttcctctacataactgtattgactgttattggttacaagagccagtctgccactgatcaatgtggtggcgttggacttctcggtatcgcatgggcttttggtggcatgatctttgttcttgtttactgcactgccggtatctctggaggacacataaatccagcagtgacatttggattgttcttggcaagaaaagtgtcacttattagagcagttatgtacatggtagcacagtgtttgggtgctatttgtggagtaggcttagttaaggctttccagaagtcttactacaataagtatggaggtggggccaatgagttggctgatggttacaacaagggtactggtctgggtgctgaaattattggcacatttgttcttgtttacactgtcttctctgctactgatcctaagagaaatgccagagattctcatgtccccgtgttggctcctcttcccattggattcgccgtgttcatggttcaccttgccaccattcccatcaccggaactggaattaaccctgccagaagtttcggagctgctgttatttacaacaaagacaaggcctgggatgatcaatggattttctgggttggaccatttatcggtgcagccattgctgcattctaccatcaatacattctgagagctgcagcacttaaggcacttgggtcattcagaagcaatgcttaaattttttaattttcgaaagcattgagatgaaatgtttgtggcaacagttctgtctctccatatatgatgctgattcaattggaggcaaagccaaggaattgtaattatttgtaattttgtatgagaatgttaagtttgtaagtttatgtttgttgtatttgtatcttttgtggtgttgtactcatcttttggttccttttcttcctttaataatattctcttctttatttttctttttgttcccacttcaattatgttctccagcaatgtttcatccagttgtcataactggtatggtgtctattttcttcaattcttgctcagttatcatatcactttagaatcctagcaccttgaactttacaagtgcgcgcatgactaccctattgcctcttcactacacatgttctgaataaaaacaaggtgaagcagagtaatgcatcaagacttacttatctgtatatattaaactaactttaataataagtgacaacatggtcggtgataatatactggtagaattcttta

SEQ ID NO: 14818 - DNA, 1033 bp, Chrysanthemum coronarium
atcaacaaacactccaatctctcatacacattctcatacacacagataacaacaaagcaaaaagctagaaaatgagcaaagacgtagaggttggtggacatgatcactacggtgctaaagactaccaagaccctccaccagctgcccttttcgactccgaagaactcaccaaatggtctttttaccgagccattatagccgagttcattgccacaatgttgttcctttacatcactgtcttgactgttattggttacaagtctcaagtagaccctgcccacagcaaagaccaatgtggtggagttggaatccttggtattgcatgggcttttgggggcatgatttttgtccttgtttattgcactgctggtatctcaggaggacacattaaccctgccgttacattcgggttgtttttggctaggaaagtgacactaccaagggcatttatgtacattgtggctcaatgtttgggtgctatttgtggttgtggtcttgttaaggctttccaaaagacttactatcataattatggtggtggtgctaatgagcttgctgatggttacagtaaaggcaccggcttaggtgctgaaatcattggtacctttgttcttgtttacacggtcttctcggctactgaccctaagagaaatgcacgcgattcccatgtcccagtgttggcacctcttcctatcggatttgcggtgttcatggttcacttggccacaatcccaatcactggaactggaatcaacccggctcgtagttttggtgctgctgtcatgtatggtacagaaaaagcatgggatgatcaatggttattctgggctggaccgatgattggagctgcgattgccgcattctaccaccagtacgtattgcgagctggtgcagttaaagctcttggatctttcaggagcaatgcctagatcaagagcgttcatgtttttaagaagttgtacaaatttgcttgttttaatgaagtgtgtaccgtattatttaagggtatattgtcaaagggcacaaagttttt

SEQ ID NO: 14819 - DNA, 1084 bp, Chrysanthemum coronarium
acactactcgtgtgttcttctttcaaagcatataaataggactacttgttatccagttttctcatcaacaaacactccaatctctcatacacattctcatacacacagataacaacaaagcaaaaagctagaaaatgagcaaagacgtagaggttggtggtcatgatcactacggtgctaaagactaccaagaccctccacctgctgcccttttcgactccgaagaactcaccaaatggtctttttaccgagccattatagccgagttcattgccacaatgttgttcctttacatcactgtcttgactgtcattggttacaagtctcaagtagaccctgcccacagcaaggaccaatgtggtggtgttggaatccttggtatcgcatgggcttttgggggcatgatttttgtccttgtttattgcactgcaggtatctcaggaggacacattaaccctgccgttacattcgggttgtttttggctaggaaagtgacattaccaagggcatttatgtatattgtggctcaatgtttgggtgctatttgtggttgtggtcttgttaaggctttccaaaagacttactatcataattatggtggtggtgctaatgagcttgctgatggttacagtaaaggcactggcttgggtgctgaaatcatcggtacctttgttcttgtttacaccgtcttctcggccactgaccctaagagaaatgcacgcgattcccatgtcccagtgttggcacctcttcctatcggatttgcggtgttcatggttcacttggccacaatcccaatcactggaactggaatcaacccggctcgtagttttggtgctgctgtcatgtatggtacagaaaaagcatgggatgatcaatggttattctgggctggaccgatgattggagctgcgattgctgctttctaccaccagtacgtattgcgagctggtgcagttaaagctcttggatctttcaggagcaatgcctagatcaagagcgttcatgtttttaagaagttgtacaaatttgcttgttttaatgaagtgtgtaccgtattatttaagggtatattgtcaaaggg

SEQ ID NO: 14820 - DNA, 1028 bp, Utricularia gibba
ccggcagcaaatggcgaaggatatcgaggtcggaggtgagatcgctaaggactaccaggacccgccgccggcgccgctcatcgatccggaggagctcgggaaatggtcgttgtacagggcggtgatcgccgagttcatcgctacgcttttgtttttgtacgtcaccgtcttgacggttatcggatacaagagccagagcgccaccgatgcttgcggcggcgtcggaattctcggcattgcttgggccttcggtggcatgatcttcgtccttgtatactgcactgccggcatctccggtggacacattaatccggcggtgacatttgggcttttcctggcgcgaaaagtttctcttgttcgggccgttctgtacatcatcgcacagtgcttgggcgccatatgcggctgcggactggctaaggcgtttcagacggcgcattacaacgagtacggcggcggagctaacggactgtcgagcggctacagcatcggcaccggcctggcagcggagataatcggaacatttgtcctcgtgtacactgtcttctccgcaactgatcccaaaagaaacgcaagagactcccatgttcccgttttggctccacttccaattgggtttgcagtttttatggttcatctagccacaattccagtcaccggcaccgggatcaaccccgctagaagcttcggcgccgccgtgatctttggcaaggcatgggataatcactggattttctgggtgggacccctcatcggagcatttgtggcaatgctgtaccaccagttcatcctgagagccggcgccgtcaaagctttgggttctttcaagagctcctactgaaaagtcgccggaaccaaccggtggcacaacgcgccgccgagtttcaaaccctcaagtgctgctgtgttgtattgtattgtattgtatgtgtggtcttgctattttggtgtctcctcttctcgtactcggcagtaattttgtgcttagtacacaggaaataatgaatgcaattaggacccatcctctt

SEQ ID NO: 14821 - DNA, 1022 bp, Ricinus communis
cttgttactgttgaagttttgttgttgaacatggtaaaggacatggaagtgggtgaaagaggaccgttttcagcaaaggactaccatgacccacccccagcaccgttgattgacgcagtagagttaacaaagtggtcgttttacagggctttgattgctgaattcatagcaactcttctcttcctttacatcaccgttttaactgttattgggtacaagagccagagcgaatctgattcttgtgggggtgttggtattcttggtattgcttgggcttttggtggcatgatcttcattcttgtttactgcactgctggtatttctggaggacacattaacccagcagtgacattcgggctattcctggcccgaaaggtgtcattagtacgtgccataatgtatatggtggcccaatgcctaggagcaatatgcggtgttgggctggttaaggccttccaaagctcacactataagcgatatggtggtggggccaatactttggatgataactacagcacaggcgtcggattaggtgctgagatcatcggtacatttgtgttggtatatacagtgttctctgccactgatcctaagagaagtgctagagactcccatgtgcctgtgttggctccacttccaattggatttgctgtattcatggttcacttggctaccattccaatcactggcactggcatcaacccagcaaggagtttaggagctgctgttatttacaaccaggacaaggcctgggatgaccaatggatcttttgggttggaccattcattggtgcagccattgcagcattctatcaccaattcatcttgagagcaggagctgtgaaggctcttgggtcattcaggagcaaccctactgtttaattttgcagaaaaaggaggaaataatgaaggaattaatattaagtgcttgtgatctggtggttccacttaagtctttttctactgagggtcgaggattatggaaattgtagataaaagtctctttgagaaaaggggctttt

SEQ ID NO: 14822 - DNA, 1038 bp, Cyclamen graecum
gcggcaagactataacgtaaattactacacacccctttgtcacacctcacccataaataccttccaatgctcactaagcaatagaacacaaactccaataccttagaaacagacgttaactttctcgtacagcaatgactaaagatatcgaggtcggtccgggtgagtatgcgtccaaggactacgaggacccgccacccgcacctctgatcgatgcggaggagttgaccaagtggtccttgtatagggctaccatagccgagttcgtagccacgctcttgtttttgtacattacggtgttgaccgtgattgggtacaagagccaaaccgaccttaaaaagaatctggacgggtgcgggggcgtgggtattttgggcattgcgtgggccttcggtggcatgatttttgttctcgtttactgcactgctggtatctcggggggacacataaaccctgcggttaccttcggtctcttcctagctcggaaggtgtccctagtccgagccatactatacatagtggctcagtgcttgggagccatctgcgggtgcggcttggtcaaggcattccaaaagtcctactacacccagtacggtggtggagccaatgagctcagcgatgattacaacacgggtactggtttgggagctgaaatcatcggcacgttcgtgctcgtctacaccgtcttctccgccactgaccccaagagaagtgcccgcgactcccacgtccctgttttggcaccacttcctatcggatttgccgttttcatggtccacttggccacgatcccgatcaccggaactggcattaacccagcccgtagcttcggagctgctgtgatctacggcaaacagaaggcatgggatgaccagtggatattttgggttggaccattcattggagcagccatcgcggccttctaccaccaatacatcctccgagcagcagcggttaaggctatcggatcgttcaggagcacgacctaatctatcacagcacccgaattatacttcttatcacgagaacttgccaagc

SEQ ID NO: 14823 - DNA, 1103 bp, Flaveria ramosissima
tagtaacttttaattaaaggggcaatgggcaaagacgttgaggttggggctcatgaatacggtgcaaaagactatcaagacccaccaccagctgagctcttcgacgcagaggagctaaccaaatggtcattctacagagccgttattgcggagtttatagccaccctcttgttcctctacatcaccgtcttgaccgtcatcggctacaagtcccaaaccgaccccgaccacagcgccgatcaatgcggtggcgtaggcattctcggcatcgcttgggccttcggaggcatgatattcgtgctcgtgtattgcaccgctggtatctcgggtggacacattaaccctgcggttacttttgggctgtttttggctaggaaggtgaccctccccagggcggttatgtacatggtggctcagtgcttgggtgcggtctgtgggtgtggtctggttaaggctttccagaagtcttactacaatgcttatggtggtggtgctaacgagcttgcagatggctacagtaaaggcactggattgggcgcggagatcattggcacgtttgtgcttgtgtacaccgtcttctccgccactgaccccaagagaaatgcacgcgattctcatgtccccgtgttggcacctctccctatcggattcgcggtattcatggttcacttggccaccatcccaatcacgggcaccggaatcaaccctgctcgtagttttggtgccgcggtcatgtacgggaaagaaaaggcctgggatgatcaatggatattctgggtgggaccgatgattggagccgccgtagccgcgatctaccaccagtatgtactgagggctggggcagttaaagctcttggatccttcaggagcaatgcttaagcagttaagctatgagtactttcaatgtgctatggaagaaattgtacaaacttgtgtggtgttattgtgtgacctttgtggtgcttggttttatatgtgctcaaaggttttttatttaagtcctttcaatcttttgagtttctattcagttcctcttctatgttgtaattggtaaaagggcgacttttcaacccgagtggtattgaataaactattaaaagtcg

SEQ ID NO: 14824 - DNA, 1312 bp, Quercus alba
tcaacgctagagtacatgggattaacattcaacaacaacactagcttagaactctctctcacttgctcatcatctcctagctctctctcttcttctgtcactactactcaccctagcttttagctatggctggcaaggatattgaagggttcccatctaaggactaccatgacccaccaccagcaccattggttgatgctgaggagcttacacagtggtccttctacagggctatcattgctgagttcattgccactctcttgttcttgtacattactgtgttgactgtaattggatacaagagccaggttgaccattctactgatccgtgtactggtgttggaattcttggcatagcttgggcctttggtggcatgatctttgtgcttgtttactgcacagctggtatctcaggtgggcacattaaccctgcggtgacattcgggctattcctggctaggaaggtctcgttggttagagccatattgtacatggtagctcagtgcttgggagccatatgcggatgtgggcttgtgaaggcattccagagggcttactacagcaagtacggtggtggagccaacgggctcaatgatggatacagcaagggcaccggattggccgccgagatcatcggtacctttgttcttgtttacactgtgttctctgctactgatccaaagagaaatgcaagggattcccatgttcccgtcttggcaccacttccaattggatttgctgtcttcatggttcaccttgccaccattccaatcactggcactggtatcaatcccgccagaagtttcggggctgcagtgatctacaacgagaagaaggcatgggatgaccaatggcttttctgggtcggaccattcatcggtgctgccattgctgcattctatcaccagtacattttgagagcaggagctattaaagctctagggtccttcaggagctcttcagccatgtaaactacccaatggtgtttctggtaacgaggttggttcaaagaggaatggcattttctatggtcagggagggaggcttttggaaccgtggaatttgtacattgcaatgtctaaggcaaagaatgccctgttttctttctttcgtgtcctgagcactcgttttatatgtgcccaaaatgttgttgtctgtcctattttgcgtttgacaatggtgtacttgtaatgttatgttgaattttatgagcaactgctttgtgttactttctgtttatcactctttttataactgcatttggaaaatcaacatttataaagagcagttcatcaattagttgctgttaatg

SEQ ID NO: 14825 - DNA, 1283 bp, Primula obconica
cttagaactttcgaagttaataagttacgacgttacttgtgaagtaaacgatgtgttatcgggtattagttaattagccatacggccgaaactacactcaaaaacaaactacctaccgtaaactaacatcttatactcactctcactctcattctgtctcccatctctctctcatccaacaatggcgaaggacatcgaggttggacccggtgagtacgcgtctaaggactatcaagacccgccacccgcacctttgttcgactcagatgaattgacaaaatggtccttgtatagggcggttatagcagagtttatagcaacactcttgtttttgtatataacggtgttgacggtgattgggtacaagagccaaacggaccctaccaagaacccggacgggtgtgggggcgtggggattttgggtattgcgtgggcctttggtggcatgatatttgttctggtttactgtaccgccggtatctctggtggacacataaaccctgcggtgacctttggtctcttcctcgctcgaaaagtgtctctagtccgagcggtgctatacatagtggctcagtgtttaggagccatttgcgggtgcgctttggtcaaatcgtttcaaaaaacgtattacaacacctacggtggtggggccaacgagctcaatgacggttacaacattggcactggtttgggagccgaaataatcggaacttttgtgcttgtttacaccgtcttttccgccactgaccccaagagaagtgcccgtgactctcatgtccctgttttggcaccgcttcctatcggatttgctgtttttatggttcacttggcgacgatccccgtcaccggaactggcattaacccggcccgtagctttggagcagctgtgatatatggcaaacaaaaatcatgggatgatcagtggattttctgggtgggacccttcgtcggagcagccatagccgccttctaccaccagtacatcctccgagcagcggcggtgaaggcgctcggatcgttcaggagcacagcctgatgtggcactagcgaaacactggattatttctcatgaaaacttatgtttttctttggcttctgagggaggatatgagaccatgggactaagttgtaaatagtgttatgtggtgtcatttgaattgtggttttggttttagcacttattttcattgtgctaacttcttgtcatttgctatggtggtttgtttttgcatttttatttacattatggtgatgtacgcaagttttataataaaatatcacta

SEQ ID NO: 14826 - DNA, 1190 bp, Tripterygium wilfordii
atatctatctaaagtggtaagccaggctgtagaaatggcgaaagatgttgaagttcaaccagaattttcagctaaggactacactgatccgcctccaacgccgttgtttgatttggaagagctgaccaaatggtctttctacagagctctaattgcagagttcattgccacactcctcttcctttatatcactgttttgactgtgattggctacaagagccaaaccgaccctaatttgaacactgaccagtgtggtggtgttggaattcttgggattgcttgggccttcggtggcatgatcttcatcctcgtttactgcactgctggtatttctggtggacacattaacccggctgtgaccttcggactattcctggggcgcaaggtgtcgctcatccgtgccgtgatgtacatggtagcacagtgtttgggtgcaatctgcggttgtgggcttgtgaagggtttccaaaaggcttactacaataggtatggaggtggggccaacacgctcgctgatgggtacaacaagggcactggattgggtgctgagatcatcgggacctttgttcttgtctatactgtcttctccgccacagatcctaagaggaacgctagagactcacatgttcctgttttggcaccattgcccattggattcgctgtattcatggttcacctagccaccatccccatcactgggacgggtatcaaccccgctaggagttttggagctgctgtcatatacaacaaagagaaggcctgggatgaccaatggatattctgggttggaccatttattggagctgcaattgctgcattctaccaccaggtcattctaagggctgcagccattaaggccctgggttccttcaggagcaacgcttgattgaactggccggtactttccgatgagcgagcgtggatggttcacggttcgatcaatcgatctggcgagggcctgcacggaattgtaaataaaaaaagtatgaaagttattgatgaacaaggggtgtctttttattcctttgtttttgtacgtgtttcattattactgtattttatgttgtgctgtctggtctgcctgtctgttcatctttatccttttaatttatcttttcttgtttccctttcaattatcttttccttgggtgtacttatgtttcctggtaaattaagtaaagaagtattct

SEQ ID NO: 14827 - DNA, 1025 bp, Valeriana officinalis
ctattacactctcataattaatcactcttgttgtaagaatgacaaaggatgtcgaggttgcagagtatactggcggaaaggactaccaagatccacctccggtcagcttgtttgactccgaggagttgactaaatggtcgttttacagagcgataatcgcagagtttatcgctacactcttattcctttacattactgtattgaccgtcatcggatacaaaagtcaaactgatccgttaaagggaactgatcaatgtggcggtgttggtattctcggtatagcttgggcttttggtggaatgatctttgttcttgtctactgtaccgctggtatctccggtggtcatattaatccggcagtgacatttgggttgttcttggctcggaaggtgtcgttatgtagagcagtgttgtacatgatagctcagtgtttgggagctatttgcggatgcggattagttaaagctttccaaaaaacgtactataacacatacggcggtggtgctaacgagcttgcgcccggatacagtaaaggaactggactaggtgctgagatcatcgggacttttgtacttgtctacaccgtcttctctgctactgatcccaaaagaaacgctcgtgattctcatgttcctgttcttgcaccacttccgattggattcgctgtatttatggttcacttggccacaattcccattaccggcactggcattaaccctgcacgtagttttggagctgcagtgatttatggaagagagaaagcatgggatgatcaatggatattttgggttggacccttcatcggagcggcaatagcagcaatctaccaccagtttgtattgagagctgcagctgttaaagctctgggatcattcaggagcaatgcttaataatttcttcttgtttttgaaaagttcaggaataaattgaatttagccactttaatttgttagatactgcatcaaatttggttatgttgcaaaaattgtaatcaagggtttaaaaaatataaaaaaagttatttg

SEQ ID NO: 14828 - DNA, 1432 bp, Malus domestica
tctgccccatatatatatacccctctacactcacacctctccatccacactcacaatcccaaacgacctctctctcctctcattccttcaaaagccaaaagccacttaattagtcacagaagccatggcaaaagatgtagagggagctgaacacggtgagtttgccaccaaagactaccatgaccctcctccaacccccttgtttgatgctgaggagctcaccaagtggtctttctacagagctctcattgctgagttcattgccaccctcctcttcctttacatcacagttttgaccgtcattggctacaaatcccagagcgaggctgaccaatgcggcggtgttggcattcttggtatcgcttgggccttcggtggcatgattttcgtccttgtttactgcaccgccggtatctcaggaggacacattaacccagctgtgacctttgggctgttcttggctcgcaaggtttcactgatcagggcagtgttgtacatcatagcacagtgtttgggtgctatctgcggtgtagggttggtgaaggccttccagaagtcatactacatgaagtatggtggtggagccaacgagttgtctgctggctacaacaagggcactggtttgggtgctgagatcatcggtacctttgttcttgtctacaccgtcttctccgccaccgaccccaagagaaatgccagagactctcacgtccctgtcttggccccacttcccattggatttgctgtgttcattgttcacttggccactattcccatcactggaactggcatcaaccctgctaggagttttggagctgctgtcatctacaacaaggacaaagcttgggatgaccaatggatcttctggcttggacctttcattggagctgccattgctgccttctaccaccaatacattctgagagcaggagccatcaaggctctgggatctttcagaagcaatgcttaattaattaaggcttttaatttcatccatggttttcaaatggagatggtgattctaaaggaataacaaaatagaggagtgcaagtctctcatggtctcaaaaggagaaatttgaagggcggtggaactgtagataattacgtctttgggcaaagagtgctattttgtatccatctcttctttgttatctttgctttgcatgtttgtgctattttcatttcttctgtgtattcttatcttttattttatttactattttctcttgtcaccttttcaagtggttgtgtatttatattgatgccagagaaagctaatgaaatacgagttgtaccttgtaatgcttatcctggttttagtttaatgaatattcctcagcacaattatcagattaggtagagttaattaatcaggtttgaaaatggggtcatttgattaagagataatgaaagatacactttaacttaa

SEQ ID NO: 14829 - DNA, 1162 bp, Daucus carota
aaggacggagaagtggcggagcagagtgggttctcgtccaaggactaccatgatccgccaccagcggcgtttatcggcactgatgagctcaccaaatggtcgttctacagggctttgatagctgagttcatagccacccttctctttttgtacatcactgttttgactgtgattgggtacaagagccagtcttctacggaccagtgcggtggagttgggcttctcggcatagcatgggccttcggtggcatgatctttgtcctcgtttactgcactgccggcatctccggaggacacataaacccagcggtgacattcgggttatttctggcgaggaaagtgtcactaataagggcagtgatgtatatggtggcacagtgtttgggtgcgatctgtggggtagggttggtgaaggccttccaaaagtcttactataacaggtatggtggaggggccaacgagctggctgatggttacaacaaaggcactggcctaggtgccgaaattattggcacttttgttcttgtctacacagtcttctcagccacggatcctaagcgaaatgctagagattcccatgtccctgttctggctcccctgcctattggattcgcggtgttcatggttcacttggccacaattccgatcactgggaccggtatcaaccctgctaggagtttcggagctgcagtaatctataacaaagagaaagcctgggatgatcagtggatattctgggtcggacccttcatcggtgctgccatagctgcattctaccaccagttcattctcagagcagcagctgtcaaggctcttggatcctttaggagcaatgcctaattaatttaattatcttttcttaatttaccaggatgggttatctattaatcgcatgtatcagtacccttaatcaagaatcgaagaagtcagggtgagcaaaatgtgaagttaattagagagggaaaggccatggaattgtagatatatgtaattcatgatatctatgctgtattttcaggttccgcatggtgtgtgatcatattttattttcttggcatttttagattttctttgttctcgtgttaagttttaaatcaaatattttgtactgggacggttgttcataaatcaagaagatggtttgttgtttaatgtatcatct

SEQ ID NO: 14830 - DNA, 1419 bp, Phaseolus vulgaris
tataccccttctcatctcagactaatcaaacacaaccttgtttctttttctctgagcctctctttcaggttcttttcttcatcagtgtcaaaagggtggttccaaattgcaatggctaagcatgatgctgagggtggttccttctctgcaaaggactaccatgaccctcctccagcacccttgattgatgctcaggaactcacacagtggtccttctacagggccttgattgctgagttcattgccacactgctcttcctttacatcacagtgctcaccgtcattggttacaagagccagagtgatgtcaaagctgggggtgatctctgtggtggggttggcattcttggcattgcttgggccttcggtggcatgatcttcatccttgtttactgcactgctggaatctcaggaggtcacataaaccctgcagtgacttttggactcttcttggctcggaaggtgtctttgataagggctataatgtacatggtggctcagtgcttgggggccatatgtggagttgggttggttaaggccttccaaaaggcttactacaacaagtatggtggtggggccaatgagctgagtgatgggtacagcacaggtgttggattgggtgctgagatcattggaaccttcgttttggtgtacacagtcttctctgctaccgaccccaagaggaatgctagagattctcatgtcccggttctggctccactgccaattgggtttgctgtgttcatggttcacttggcaaccatcccagtgactggcactggtattaaccctgctagaagtcttggagctgctgtcatatacaacaaagagaaggcctgggatgaccaatggatcttttgggttggaccattcattggagcagccattgcagccttctaccaccaattcatcttgagagcaggtgctgctaaggctcttggatcattcaggagcaaccccactgtttgagttatccaatatcctcccatgggttcaaaagcaagataattgggcaaaatgagttgatattgcaacagcaataataataattggaaatgtttgtccttttagtctatctagattgaaggttctttcaagacaagggatcctttggtaaatagtaagcacccttagtatttctagaactttcctttcttttcttctcttctctccacaagttgtgagcatgaataagttaaagtcaacatggagtaggtgaaattgcatgataacccatgttttaagggagtggttatgctaattcaatgtcacctgcacttttttgcttgtaacatgtatttttccaaaaaatatgtcagtacatgtacgttgaaaaactctgaatcaaaatgcactttctgatgcactgttagaaaaattattaatgggacaaatgtcatcaaatctttcttattcctg

SEQ ID NO: 14831 - DNA, 1415 bp, Eucalyptus grandis
atggtgtgccatagcccttccagaggtgctgtcggcccgtcccccaatcctccacctactcctagctttctgcacgccgccgataaatacgacccactccccgtcacatcccttccatcacacgccaatctccaaagagcgagcaaagcgagcgagccctctctctctctctctctctctctctcgatctctcggaagcaagaagcgggaatggccaaggacatggaggtgggaggcgggcacggctcgttccagtcgaaggattaccaggacccgccgccggcgccgctggtggacgcggaggagctggggcagtggtccttctacagggccatcatcgcggagttcatcgccacgctcctgttcctctacattaccgtcctcaccgtgatcggctacaagagccaggtcgagacctccggcgaccagtgcggcggcgtcggcatcctcggcatcgcctgggccttcggcggcatgatcttcgtcctcgtttactgcactgccggcatttctggaggtcacataaacccggcggtcaccttcgggctgttcttggcgaggaaggtgtcgttggtacgagctgtgctctacatggtggctcagtgcttgggcgccgtatgcgggtgcggtctggtgaagcagttccagaaggcatactacatcgaacaggggggcggcgccaatgggctgagcgagggttacagcacgggcaccggtttggccgcggagatcattggaaccttcgtccttgtctacaccgtcttctcggccacagaccccaagagaaacgccagagactcccacgttccggtgttggctccactgcccataggattcgccgtgttcatggttcacctcgccaccattcctatcaccggaaccggcatcaacccagctcgtagctttggagccgcggtgatgtatggcaagcaaaaggcatgggatgaacaatggatcttctgggtcggaccattcatcggcgcggcgatcgctgctttctatcatcaatacatcctgagagctggagctgctaaggcgctcggttccttcaggagctcatctgtcgtgtaaatccccagaagaatctcagggacttgaggatggaaactgaagctgtggaagttagcgttgttgttctgtgttgggcacttggatttttttggcagtgcccctagagttggctttctatctgcttttgccatgttagctgtttctctggtactttgtcggcccttttggcatgcggtcgtcgagttcaaggtgctatttacatggatgcaatgaatgcattttgttcgctttattcccattttgaataaacccaagctcttttggtacgagtgtccgtgcgccgtgtcgaattgggaatataatcgaacctcaaatccataagatacatgaggaccaaacttaca

SEQ ID NO: 14832 - DNA, 1243 bp, Manihot esculenta
ctttgtaattctcccatggcgaaggacgttgaagttgcagagaatcccggcgagttctcaggcaaggactaccatgacccaccacctgcaccgctgatcgatgtggaggagcttggtaaatggtctttttacagagctcttattgcagagttcatagccacacttctctttctttatatcacagtattgactgtgattggctacaagagccaaactgatcctgctaagaactctgatgcctgtggtggtgttggtattcttggtattgcttgggcttttggtggtatgatctttattctcgtttactgcactgctggtatctctggaggacacataaacccagctgtgacctttgggctgttcttggcccggaaagtgtcgctgatcagggcccttttgtacatggtggctcagtgcttgggtgcaatctgtgggtgtggtttagtgaaggcttttcaaaaggcttattacaacaggtatggaggtggggccaatgaactgtcatctgggtacagtaagggaactggattgggtgctgagattattggtacttttgttcttgtctacactgtttttgctgccactgatcctaaaagaaatgcaagagactcccatgttcctgtattggcacctctccccattggatttgctgtgttcatggttcacttggccactattccaattactggcactggcatcaaccctgcaaggagttttggagctgctgttatttacaataaagacaaggcctgggatgatcaatggatcttctgggttggacctttcattggagctgcaattgctgctttctaccaccaatacattcttagagcagcagccattaaagctctaggatccttcaggagcaatgcttaattaattaagtttttttttatttaattttatttgatgaaatttgaagaaagagggtgatgatgcttaagaagaataacaatggaggaggatgagtggtgaagtttgtgtctttttaaggggtcctttcagtaatttctttctcattccctttcaagggattttaggaagaaatttggaaaagcccttggaattgtaaataataaggattaatggtcaagggtgtcttttcaatccttgttgttttaattatgtcactgatgtctatcctttgatccttatcttatgtttatgtttatggttttttttaatcttttatcttttgggtgtacttgtttaagcataattagtaatttgagttttgtttttt

SEQ ID NO: 14833 - DNA, 1806 bp, Glycine max
ccttgccataaaaaggattcaacggtagaataatctcacaacttgtagaagtttgaagaaagtctgagaacccgtgattgcaaaggcagcaacagccaaccactcaactcagtcgtgcgtagacttgaagacacgaaaaatgacaaaaacaagagaaattaaaaataagcaaatgaaaaagaagggagtggggggtggtgtggtatggcaaactgtggtggagggtcggtgaaagctaaaaataaaatcaaaccaaacccttttttaaaaacaattagtactacatgcctgtcaaattagatatatttaatcaaaacactaaaatacactttaattaagagaagtaaatttaatatcactcaaattaaacacttgttaatattaaagagaccccatcaacaccaaatagagtttttagaaatttatttttaaaaagaaaaaagaaaaaagaaaaaaatggtcttggtctaatactgaatgtgcaccaggcaccagcatatataccccttctctactcactctcttccacacttgcccatcatcaaagtttcttcctttctctgctctttgtcttctctgacacatttggggccttgttgagtgtgtttttgcaagagggtatggcgaaggacgttgaggttgctgagcgtggctccttctctgggaaggactaccaggaccctccaccagcaccactcattgatgctgaggagctcacaaagtggtccttttacagggctcttattgctgagttcattgccactttgctcttcctctacattactgtgctcacagttatagggtacaagcaccagacggatcatgctgatgcgtgtggtggggttggcattcttggcattgcatgggcctttggtggcatgatcttcatccttgtctactgcactgctgggatttcaggaggtcacattaacccagcagtgacatttgggctgtttttggctcgcaaggtgtctttgatccgagccatcatgtacatggtggctcagtgcttgggtgctatctgtggagttggtttagttaaggctttccaaaagtcttacttcaacaagtatggtggtggggctaattccctcgctgatgggtacagcacaggtactggattgggtgctgagatcattggcacctttgttttggtgtacactgtcttctctgccactgaccctaagaggaatgctagagattcccatgttccggttttggctccacttcccattggatttgctgtgttcatggttcacttggccaccatcccagtcactggcactggtatcaaccctgctaggagtcttggagctgctgttatctacaaccaagataagccatgggatgaccattggatcttttgggtaggaccatttattggggcagccattgcagccttctaccaccagttcatcttgagagcaggtgcagccaaggcccttggatcattcaggagtaacccccataattgagatgtctttctcttcatgatgatggctctagtggaaagaagataattggagagatggaggttgatatggcaagtttaataatgggaaatgcttttggctttgtatttgcaacgtttctttgaccctctcgattatgtcttcaagattgtggataagtgtagattaaagtctctttcatgacagggggagccttttgcactttcctctgtggtgttcttccctttagtgtgtcatttttcttttttaagttattctcttctgtcatctctgtactcaaacaaatcatgggaaatattttaaattttaattttacattcctgcttttttacta

SEQ ID NO: 14834 - DNA, 1217 bp, Glycine max
gtttcttcctttctctgctctttgtcttctctgacacatttggggccttgttgagtgtgtttttgcaagagggtatggcgaaggacgttgaggttgctgagcgtggctccttctctgggaaggactaccaggaccctccaccagcaccactcattgatgctgaggagctcacaaagtggtccttttacagggctcttattgctgagttcattgccactttgctcttcctctacattactgtgctcacagttatagggtacaagcaccagacggatcatgctgatgcgtgtggtggggttggcattcttggcattgcatgggcctttggtggcatgatcttcatccttgtctactgcactgctgggatttcaggaggtcacattaacccagcagtgacatttgggctgtttttggctcgcaaggtgtctttgatccgagccatcatgtacatggtggctcagtgcttgggtgctatctgtggagttggtttagttaaggctttccaaaagtcttacttcaacaagtatggtggtggggctaattccctcgctgatgggtacagcacaggtactggattgggtgctgagatcattggcacctttgttttggtgtacactgtcttctctgccactgaccctaagaggaatgctagagattcccatgttccggttttggctccacttcccattggatttgctgtgttcatggttcacttggccaccatcccagtcactggcactggtatcaaccctgctaggagtcttggagctgctgttatctacaaccaagataagccatgggatgaccattggatcttttgggtaggaccatttattggggcagccattgcagccttctaccaccagttcatcttgagagcaggtgcagccaaggcccttggatcattcaggagtaacccccataattgagatgtctttctcttcatgatgatggctctagtggaaagaagataattggagagatggaggttgatatggcaagtttaataatgggaaatgcttttggctttgtatttgcaacgtttctttgaccctctcgattatgtcttcaagattgtggataagtgtagattaaagtctctttcatgacagggggagccttttgcactttcctctgtggtgttcttccctttagtgtgtcatttttcttttttaagttattctcttctgtcatctctgtactcaaacaaatcatgg

SEQ ID NO: 14835 - DNA, 1105 bp, Arnica chamissonis
cttataacctttcgaattgaagagaaattaatcaattaattaatggcaaaagacattgaggttggcagccacgaatacggctcaaaagactaccaggaccctccaccagctgacctctttgacgcagatgagctcaccaaatggtctttttacagagccatcattgctgagttcatcgctaccctcttgttcctttacatcaccgtcttaaccgtcatcggctacaagtcccaaaccgaccccaaaaacaacgccgaccagtgtggtggtgtcggcattctcggcatcgcctgggccttcggtggcatgatattcgtcctcgtttattgcacggccggcatctcaggaggacacattaaccctgcagtcacattcgggctgtttttagccaggaaggtcaccctccccagggctttcatgtacatcgtggctcaatgcttgggtgcgatgtgtggttgcggtctggttaaggctttccaaaagtcacactacaacacctacggtggtggcgccaacgagctcgcagacggctacactaaaggcactggcttgggtgcggaaatcattggcacatttgtcctcgtctacaccgttttttccgccactgaccccaagagaaacgcacgtgattctcatgtgcccgtgttggcaccactccctatcggatttgccgtattcatggttcacttggccaccatcccaatcaccggcaccggaatcaaccctgctcgtagttttggtgccgccgtcatgtacggaaaagacaaagcctgggatgatcaatggttattctgggtgggaccgatgatcggagccgctatcgccgccttctaccaccagtacgttttgagagcagccgcagtgaaagctcttggatctttcaggagcaatgcctaagatgaaggttgcagtatttttcatgtggctttgaagaaattgtacaaaattttctacttttctcttaaatgtattttgtatttagggcactttgcttttaaacgtgcccaagtatggtcctgtttccaagtccctcaaccttgtattttatgtctatttagtccctcttgttttgttgtaattggtcaaggacccaattttaataata

SEQ ID NO: 14836 - DNA, 943 bp, Cyclamen graecum
ccaaaactactaatttcgaaacactctcaacttcctcatcttgcaatggctaaggatatcggggtcggacccggtggtgggtacgcgcccaaggactaccaagaccccccacccgcacccttgatcgatgcggaggagctcaccaagtggtccttgtacagggctaccatcgccgagttcatagccacgcttttgtttctgtacataaccgtgttgacggtgattgggtacaagagccaaacggaccctagcaagaaccccgacgggtgcgggggcgtggggattttgggtatcgcatgggctttcggtggcatgatattcgttctcgtttactgcactgccggtatctccggggggcacataaaccctgccgtgaccttcggtctcttcctggctcgaaaggtgtccctagcccgagccatactatacatagtggctcagtgcttgggagccgtctgcgggtgcggtttggtcaaggcattccagaagtcctactacactcagtatggtggcggtgccaacacggtccaagatggttacagcaatcgtacaggtttgggagccgaaatcatcggcacattcgtactcgtctacactgtcttttcggccactgacccgaagagaagtgcccgtgactcccatgtcccggttttggcaccacttcctatcgggtttgccgttttcatggttcacttggcgacgatcccgatcaccggaactggcataaacccggctcgtagcttcggagccgctgtgatctacggcaagcaacagccctgggatgatcagtggattttctgggcgggaccattcatcggagcagccatcgccgcgttctaccatcaatacatcctccgagcaggggcggttaaggctctcgggtcgttcaggagcacggcctaatcgggcatcggtttaagcaccaaatatttttcagagggcc

SEQ ID NO: 14837 - DNA, 1060 bp, Euphorbia peplus
aaaagctgggtgtgtaggagtttttcaaaatgactcgacattctaactaggttggcattcaagatcaaaaaaatcatattagcaatgggtaaggacattgaagtttcgggtggcagcaaggactaccaagacccaccaccagcaccgttgatcgatgcggacgagttgacccaatggtcattttacagagctataattgctgagtttatagccacactattgttcttgtacatcactgtgttgactgttattggttacaagagtcagactgatcctgctaagaacgctgacgcttgcggcggcgttggtattcttggaatcgcttgggcctttggcggcatgattttcgttcttgtttattgcactgccggtatttcgggtgggcatataaaccccgcggtgacattcgggttatttttggctagaaaggtgtcattgatccgagccataatgtacatggtggctcaatgtttaggagccatatgtgggtgtgggctagtcaaggcttttcaaaaggcttattataataggtatggtggtggagccaatgagcttgctgatggctacagcactgggacaggtcttggtgctgaaattataggcacttttgttttggtttacactgttttttccgctaccgatcctaagagaagcgcgagagattctcatgttccggtgttggctccactcccaattggatttgcagttttcatggttcacttagccacaattccggtcactggaaccggaattaacccggctaggagttttggagctgctgtgatttataatcaggacaaggcatgggatgaccaatggattttctgggttggaccattcattggggctgcaattgctgcattctatcaccaatatgtcctaagagcaggcgctattaaggctcttgggtctttcaggagcagttcaaatatttaattcggtgaagaaagaataaaattgtcaatttgtaaattattatgaaattttatttggtgtgaatattggggcattgttttatttgtgcccaaacgtttcatccaatttgtaattttcttttctt

SEQ ID NO: 14838 - DNA, 1201 bp, Rosmarinus officinalis
caatcacgctcatcatcacctacagctcaacaaaccaccactcccataatcattccattttccctcacagttgtcaccgagagaaatccagatgaccaaagatgtagaggcggtaggcggccacgactatggcgccaaggactaccaagacccgccgccggcgcagctaatcgacatggaggagttgggcaaatggtcactatacagagccgccatcgccgaattcattgcaaccctcctgttcctctacgtcacggtcctcaccgtcatcggctacaagagccagagcgctgccagccagtgcggcggcgtcggcatcctcggcatcgcctgggccttcggtggcatggtcttcgtcctcgtctactgcaccgccggcatttccgggggacacatcaacccggccgtgacgttcgggctgctcctggcccggaaggtgtcgttggttcgggccgtgctgtacattgtggcgcagtgcttgggtgccatctgcggttgtgggctggtgaaggcgttccagaagacgtactacgttcagtacggcggcggcgccaatgaactcagcgacggctacagcaccggcaccggagtggcggccgagataatcggcacattcgttctcgtttacaccgtcttctccgccactgaccccaagagaaatgccagagactcccacgtccctgttttggcgccacttcctattggatttgccgttttcatggttcacttggccacaatcccggtcaccggcaccggcatcaacccggcccggagtttcggcgccgccgtgatttacggcaaagataaggcatgggacgaccagtggattttctgggtgggacccttcgtcggtgccgccattgcttcaatctaccaccagttcgtgctgagggcaggagcagtgaaagctctgggatcattccggagctcttcatataattaaggagtgtcagtttggcacttattttaaagcgtgccggaatttggtgttgtctttttctcttgtgtatggtttctcctctcctactttagcactaatatagtgctttgtgcatcaaactaataaactttactatttcacctatttctaattattttttatttagaaaaactacaactataaatgattctaggtagggttgtatatgaacaaagctattcggagctcggctcaataaaagttcgttcaagtttatttcgt

SEQ ID NO: 14839 - DNA, 1266 bp, Phaseolus vulgaris
cacactttcccattaccaaagtctcttcctttcttggctctttgccttctctgacaacctaggttcctgtttcagcgtgttgtggcaagggggtagtagtgtatccttgttatcctatggcgaaggacgttgaggttacagagcgtggctccttctctgggaaggactaccatgaccctcctcctgcacccctcattgatactgaggagctaacaaagtggtccttctacagggctctcattgctgagttcattgccactttgcttttcctctacattactgtgctcacagtgatagggtacaagcaccagagtgacctcaaggaccatggtgatgcctgtggtggggttggcattcttggcattgcatgggcctttggtggcatgatcttcatccttgtatactgcactgctgggatatcagggggtcacattaacccagcagtaacatttgggctgtttttggctcgcaaggtgtctttgatccgtgctatcatgtacatggtggctcagtgcttgggggctatctgtggagttggcctggtcaaggccttccaaaagtcttactacaacaggtatggtggtggggctaattccttggctgatgggtacagcacaggtactggattgggtgccgagatcattggcacctttgttttggtatacactgtcttctctgccactgatcccaagaggaatgccagagattcccatgtgccggttttggctccacttcccattggatttgctgtgttcatggttcacttggccaccatcccagtcactggcacaggcatcaaccctgctaggagtcttggagctgctgttatctacaacaaagataagccctgggatgaccattggatcttttgggtaggaccatttattggggcagccattgcagctttctaccaccagttcatcttgagagcaggggcagttaaggcccttggatcattcaggagtaacccccatgtttgagttgtctttctcttcatgatggctcttttggaaagaagataattggagagatggagttgatattgcaagtttaataatgggaaatgcttttggtgtttgcaacgtttctctcaattatgtcttcaagattgtggataagtgtagattaaagtctctttcatgacagggggagccttttgcactttcctgtgttgcctttagtgtgtcatctttctttcaagttattctcttctgtcatctttgtactcaaatatatttatgggaaaaaaaaataatttacctacta

SEQ ID NO: 14840 - DNA, 1273 bp, Vigna unguiculata
gcaaagtctcttcctttcttggctctttgccttctctgacaacctaggttcctgtctgagcttgttgttgcaagagggtagtagtagtagtagtattcttgttatcctatggcgaaggacgttgaggttaccgagcgtggctccttctctgggaaggactaccatgatcctcctcctgcacccctcattgatgctgaggagctaacaaagtggtccttttacagggctctcattgctgagttcattgccactttgcttttcctctacattactgtgctcacagtgatagggtacaagcaccagagtgacgtcaaggccaatggtgatatctgtggtggggttggcattcttggcattgcatgggccttcggtggcatgatcttcatccttgtttactgcactgctgggatatcagggggtcacattaacccagcagtgacatttgggctgttcttggctcgcaaggtgtctttgatccgagccatcatgtacatggtggctcagtgcttgggggctatctgtggagttgggttggtgaaggccttccaaaagtcttactacaacaagtatggtggtggggctaattccctcgctgatgggtacagtacaggtactggattgggtgctgagatcattggcacctttgttttggtatacactgtcttctctgccactgatcccaagaggaatgccagagattctcatgttccggttttggctccacttcccattggatttgctgtgttcatggttcacttggccaccatcccagtaactggcactggcatcaaccctgctaggagtcttggagctgctgttatctacaacaaagataagccctgggatgaccattggatcttttgggtgggaccatttattggggcagccattgcagctttctaccaccagttcatcttgagagcaggtgctgctaaggctcttggatcattcaggagtaacccccatgtttgagttgtctttctcttcatgatggctcttttggaaagaagataattgcagagatggagttgatattgcaagtttagtttaataatggaaaatgcttttggcttgtatttgcaacgtttctttaatcctctcaatcatgtcttcaagattgtggataagtgtagattaaagtctctttcatgacagggggagccttttgcactttcctctgtgttgcctttagcgtgtcatttttcttttatgttattctcttctgtcatctttgtactcagatatatttatggaaaaaaaaataatttaccta

SEQ ID NO: 14841 - DNA, 1197 bp, Amaranthus tuberculatus
attattattatttcttccttccttgcaagcaagctaattagttaaaaatgggtaaggacatggatgttggaggagcaatggtgaaggattaccaagacccacctccatctcctttgattgatgcagaagaattgggaaaatggtcattttatagagcagttatagctgagtttattgcaacattattgtttttgtatattactgtcttaactgtgattggacataaagcccagaatgaagctgatcaatgtaatggtgttggtttacttggtattgcttgggcttttggtggcatgatctttgttcttgtttattgcactgctggtatttctggtggacacataaacccagcagtgacatttgggctattgttggcaagaaaactaacactagtacgagccatactatacatggtggctcaatgcttaggagccatatgcggtgttgggctagtgaaggccttccaaagtgcttactacaacaaatatggaggcggagccaacactttagctgatggttacagcactggtactggtttgggtgctgaaattattggtacctttgttcttgtctacaccgttttctctgccactgaccctaaacgcagcgctagggattctcatgttcccgtgttggccccacttccaattggatttgctgtattcatggttcacttggccacaatcccagtgacaggaactggtattaaccctgctcgtagtttcggtgctgctgtcatctacaattcctccaaggcttgggatgatcagtggatattctgggttggaccattcattggagctgcaatagctgctatctatcaccaatacatcttacgagccggtttcgtcaaggctcttggctcattcagaagctcttctaatgtgtgatcttcatcatcataaacaggattacttgcttcaatttttccataaattatcatcctaaacttgtatatatttatggttttaatttgcattttggtggtaagagtttgtttgtgtgtcttggcactgatttttattgtgtgcctttagtgggtctcatctcattttctatttggttttttggttgtattttgtggtttatgtaccaagtattaataaataagtgtgcaagtttttttcccactaatttatgtttggttttattacatcatagaatagaaagaataaggaaagaattatgttagtaagt

SEQ ID NO: 14842 - DNA, 1240 bp, Lippia dulcis
ctaacactttttcttacccatataatgatataaatacccccatcaatctccgaaaaatattcatcatcaacaaaagaagaaaaaagaaagcactttggacgagaacactccaagcccagtgcccacaatcacacttccgatctccaataagaaaaagaaaacaagtgcaaatgactaaggacgttgagggaggagccgccgagtacagcgtcaaggactaccaggacccgccgccggcgccgctgatcgacgcggaggagctaggcaagtggtcgctctacagggccgtgatcgccgaattcatcgcaacccttttgtttctctacatcaccgtgctgacggtaattggctacaagagccagagcgccgccgatgagtgcggcggcgttggcattctcggcattgcgtgggccttcggcggcatgatcttcattctcgtttactgcaccgctggcatttccggtgggcacattaacccggccgtgacattcgggctgctcctggcccgaaaggtgtcgttggttcgtgctgtactgtacatagtcgcacagtgcttaggagccatttgcgggtgcggattagtgaaagcattccaaaaatcgtactacattcgacacggcggaggcgccaataccctggcggatgggtacagcacgggcaccggattggcggcggagatcatcggaactttcgttcttgtttacaccgtcttctccgccaccgaccccaagcgcagcgccagagattcccatgtccctgttttggcaccacttccaatcggctttgccgtgttcatggttcacctggcaacaatcccgattaccggcacgggcatcaacccggcccggagctttggagctgctgtgatcttcggaagcgaccaggcctgggatgatcagtggatattctgggttgggccgttgattggggcggcgattgctgcaatctaccacgtactggtgttgagggcaggcgcagtcaaagctctcggatcattcaggagctcctcttattaagatttaagcccaggcctatgagatcagttcagtttttgaacttgaacaaaatgtaaatttaagtgtcttcgattgtgtttgtgtggtgtgtgggcttggcaaattggcactgcttttaagttttaagtgcgcgtgcccgcccccaaatctttatcattttctttctgttttacttttgcctgtgcttgtcgttaacaataataaataaaagaattccgcgtttt

SEQ ID NO: 14843 - DNA, 1918 bp, Populus trichocarpa
tctcggtatgtgaggtttttccctcgaatatctttaaataaaaaacgaaaattaaaccccggtttaaaaaacaacgaaaaaatatagaaaagaaattaaaaaagaaaaaaagaaaacggaaagcagtagctaggctatacttactctcatccccatatatagccctgctctctccctcacacactcactcaacttctataatcaagaggccaaaacctctcttcttctgtcaacccttctttgaagaacttgcctttctatctttcggagaagtttaataagcaagcaagtccagtgttttggcatggcaaaggatactgaagtggcagaggcaggatcattctctgcaaaagattaccaagacccacccccagcaccactgattgatgccgaagagttaacaaagtggtcattttatagggccttgattgctgagtttatagcaactatgctctttctttacatcactgttttgactgttattgggtacaaaagccagattgatggaaatgctgatccttgtggtggggttggtattctcggtattgcttgggcctttggtggcatgatctttgttcttgtttactgcactgctggtatttcagggggtcacattaacccagcagtgacatttgggctgttcttggccaggaaggtgtctttgatcagggctgtgatgtacatggtggcccaatgcgcgggagccatatgtggtgtggggttggtcaaggccttccaaaagtcttactacacaaaatataatggcggagccaacgttttggctgatgggtacagcacaggcactggattgggcgctgagattattgggacttttgtcctggtctacactgtgttctctgctactgatcccaagaggagtgctagggactcccatgtgcctgtattggctcctctcccaattggatttgctgtgttcatggttcacttggccaccatcccaatcacaggaactggcatcaaccctgctaggagttttggagctgctgttatctacaacaagaagaaggcctgggatgaccagtggatcttttgggttggacccttcattggtgcagccatagcagccttctaccaccaattcatcttgagagcaggagctattaaggctctcgggtcattcaggagcaacccgaatgtctaaacgtggagtcatttcaacatgaataatgaggaagtgcttgtgcgtgcatgatggtttcttcagcccttagatttctctcgtggggtgggtgaaaaatgagggtttgggaatcatggaatctgtagataaagtctcttcgaaaagggaggcttttattatcccttttgtcattttcaggcacttgccttagaattcacttcaatgttatgttttcttctatgtacctattatgcttctaagagaagtcgaggttgtgttttcttttttgcctataattatagtcactttcaagtttcttcatcatcacatttctcctgcttgaaccactactcagataccgaatcttggcatgccagggcactgcaaatgtaaacaatagataaattgtcgccccatctgtatttatactttgtaagtcagaatttctccaattaagcttgatcattcattaagtgaaccgtgattcagccaaagcctatgtagctaaaagataaaatgaaagattagggcataaccactacatatcctgtctccaataaataaatagctagctttgcacaaatcttcccattgatttgtacaactggcttcaactagagcaatcaagggattcaagcttgcgattgccactctgctactgtgcatcttcttagtcattttgtgaccaccagttagcattttaagttgatttcacagtataaattcttattttatatatacaaaacagggaaactaaataatatttatcttctggaa

SEQ ID NO: 14844 - DNA, 1206 bp, Eucalyptus grandis
acaacacgcacaaaaactaacaagtcaaatcacattcgtaccacctcaccttctaaagtcctgcattcgaagtagaagctcagaagagggagagcccaagcaaatggggaaggacttggaaggtgcccagcccccgttggccgccagggactaccaggacccgccgcccgcccctctggtcgacccggaggagctcggcaagtggtcgttctaccgtgccctcatcgccgagttcattgccacgatgttgttcctctacatcacggtcttgaccgtgatcggttacaagagccagaccgaccccaccatgaacggcagtgactgtggcggcgtcggtattcttggcatcgcttgggccttcgggggcatgatctttgtccttgtttattgcactgccggtatctccggtgggcacataaaccctgcggtgaccttcggtctcttcttggcgcgcaaggtgtcgctcgtccgggccgtgatgtacatggtagcgcagtgcctcggcgccatctgcgggtgtgggttggtgaaggcgttccagagggcgtactacacccggtacggcggcggcgcgaacgagctggccgatgggtacagcaagggcgtggggctgggggcagagatcgtcggcaccttcgtcctggtgtacaccgtgttctcggccaccgatccgaagcgaaacgccagggactcccacgttcctgtgttggcacccttgcccatagggtttgcagtcttcatggtgcatctggccacgatccccataacgggaacaggcataaacccagcaaggagcttcggagctgccgtgatctacaacaaggataaggcttgggacgaccagtggatgttctgggttggaccattcattggggctgcgattgctgcattctatcaccagtatatcttgagagctggagccgtcaaggccttgggatccttcaggagcaacgcttgatgagttcttcaattctccgtttcaagggacggagctggatcaagggagggtcaaagcaaaatgtggataaagaatttgcgattgtgtcttgcgtctcgtctgttgaattttcctttttccaactctccgatctttaagctgtgttctcgagtgctggttgttgtggttatttgctgttttctaatctcttttaactttgtaagtggcgtaatggattgcagcaatgcacatatgtcaactttctagca

SEQ ID NO: 14845 - DNA, 1052 bp, Helianthus annuus
ggcaaagacgttgaggttggtggtcatgagtatggtgcaaaagattaccaagatcctccaccggctgacctctttgacgcaaaggagctcaccaagtggtctttttatagagccatcattgctgagttcattgcgaccctcctcttcctttacatcaccgtcttgactgtcatcggctacaagtcccaaaccgaccccgcccatagcccagaccaatgcggcggtgttggcattctcggcatcgcgtgggccttcggtggcatgatctttgttctcgtctattgcaccgccggcatctcaggtggacatattaaccctgcggtgacctttgggttgtttttggctagaaaggtgacactcccgcgggcgttcatgtacatcgtggctcaatgcttgggtgccatatgtggttgcggtctggttaaagctttccaaaagccttcctccaatacttatggcggtggtcccaatgagctcgcagatgcctacagcaaaggcaccggcttgggtgctgaaatcattggcacatttgtcctcgtttacactgtcttctcagccactgaccccaaaagaaatgctagagattcccatgtccccgtattggcacctctacctatcggattcgctgtattcatggttcacttggccaccatcccaatcactggcactggaatcaacccggcccgtagtttcggtgccgcagtcatgtacggaaaagacaaagcctgggacgatcaatggttgttctgggtgggacctatgatcggggccgccatcgcagccttctaccaccagtatgtattgagagcaggtgcagtcaaagctcttggatccttcaggagcaatgcttaggaggcagagcatgaagtttgcagttatttctatgttggtttgaggaaattgtataaatgtatttggtatttatggcacttggtttttgaatgtgccactatggtcctactttcaagtccctttttctttttctatatccatttagtcccttttgttttgttgtaactaaatggcgtatttgctgcccaaataataagatg

SEQ ID NO: 14846 - DNA, 1240 bp, Theobroma cacao
atcacaaaaattcttttaaggaaagataaacaaacaaggctctcctccaagcttctatcttctctttgatcaccttgtcattgaattttcttagcgcaaagaggccatggctaaggacattgaggtcggtggtcagttccaagccaaagactaccatgatcctccgccagctccgttggtcgacgcggaggagttgacaaaatggtccttttacagggctataatagctgagtttattgccacgctcttgtttttgtacatcactgtgttgacagtgatcggatacaagagccagattgacaagggtggtgatgaatgcggtggtgttggcattcttggcattgcttgggctttcggtggcatgatctttatccttgtttactgcactgctggcatctcaggggggcacatcaatcctgcagtgacctttgggctgttcctggctaggaaggtgtctttggtccgagccattttgtacatggctgctcaatgtttgggagccatctgtgggtgtgggctggtgaaggcattccaaaaatcttactacaaccggtatggaggaggagccaacagcctcgctgatggatacagcaccggaaccggcttgggcgctgaaatcatcggcacctttgttcttgtctacactgttttctctgctactgatcccaagaggaatgcaagagactcccacgtccctgtcttggcaccgcttcccattgggtttgctgtgttcatggttcacttggccactattccgatcaccggcaccggtattaaccctgctcgtagttttggagctgctgttatgtacaaccaggacaagccatgggatgaccaatggattttctgggttggacctttcattggtgccgccattgctgcaatctatcaccagtatatcctgagggcagctgctgctaaagctcttggatccttcaggagcagctctgccatgtaaaaaaatattaagcaataattctccagccacgagagaagaaaaaaggttgccttgaaggaatgaagttttatgtggtcaagaggctttaacggaccattgaatttgtaaattataatggaaggtgtaatgctcctctgcatcatctaacacttatttttaatgtgcccaagtgttgtcatcatccctgtttttcttgcctatcctttttttttctctttgtctcggtgtctctttgttgtctttgaaaattttatcatcgagtaccttgtgtgtctttatttg

SEQ ID NO: 14847 - DNA, 1060 bp, Chrysanthemum coronarium
gatcactacggtgctaaagactaccaagaccctccgccttctccccttttcgactccgaagaactcaccaaatggtctttttaccgagccattatagccgagttcattgccacaatgttgttcctttacatcactgtcttgactgttattggttacaagtctcaagtagaccctgcccacagcaaagaccaatgtggtggagttggaatccttggtattgcatgggcttttgggggcatgatttttgtccttgtttattgcactgcaggtatctcaggaggacacattaaccctgccgttacattcgggttgtttttggctaggaaagtgacactaccaagggcatttatgtacattgtggctcaatgtttgggtgctatttgtggttgtggtcttgttaaggctttccaaaagacttactatcataattatggtggtggtgccaatgagcttgctgatggttacagtacaggaaccggtttgggtgccgaaatcattggtacctttgttcttgtttacaccgtcttctcggccactgaccctaagagaaatgcacgcgattcccatgtcccagtgttggcacctcttcctatcggatttgcggtgttcatggttcacttggccacaatcccaatcactggaactggaatcaacccggctcgtagttttggtgctgctgtcatgtatggtacagaaaaagcatgggatgatcaatggttattctgggttggaccgatgattggtgctgcgattgccgctttctaccaccagtacgtattgcgagctggtgcagttaaagctcttggatctttcaggagcaatgcctagatcaagagcatgaaaaatgcaatgtttctcctgttttaagaaattgtataaatttgcttgttttcttgaagagtgtatgtgggcagaaagggcacttggtcttttaatgtgccctgtatgctctcttttttacatatctttctttttatttccacttaatccctcttgttttgctgtaatgaaatcaataggtgcatttgctacccaaataataaaatcatttcgtggagat

SEQ ID NO: 14848 - DNA, 1242 bp, Mimulus guttatus
caattttagacaattaatttattcaataaattcccatataaatacccctcaaacctccacatcatactcatcaccaagaaaaaaacacaaacacattgcttactacatcttacaacacacacactcaagaacacagagtaataacaagaaaaaaaaacgtgccgaatatggcgaaggatatcgagggaggagccgccgctcatgaatacggggcgaaagactaccacgacccaccgccagcaccactcatcgactccgaagagctaaccaaatggtctctatacagagccgtaatcgccgagttcaccgccacccttttgttcctctacatcacggtcctaaccgtgatcggctacaagagccagagtgccgccgacggctgtggcggcgtaggcattctaggcatagcgtgggcctttggcggcatgatctttgtcctcgtttactgcacagccggaatctccggcgggcacatcaatccagctgtcacattcgggctgttcttggccagaaaggtgtctctcgtgagagctgtgctgtacattatagcacagtgcttgggggctatctgcgggtgtggattggttaaggcttttcagaagagttactatgtcgagcatggcggtggggcgaacgagctggcgttggggtatagtaaaggcactggactcgcggcggagattatcggaactttcgttcttgtttacaccgtgttctctgctactgatcccaagagaagtgctagagactcccatgttcctgttttggcaccgcttccgattgggtttgctgtgttcatggttcacttggccacaatcccgatcaccggaactggaatcaatccggcgaggagtttcggagctgcggtgatatatggaaaagataaggcatgggatgatcagtggattttctgggttggaccattcatcggagctgccattgctgcaatctaccatcagtatattctaagggctggggcagttaaagctctgggatcattcaggagctcttcttacaactgagaatcacttcgaattgtataaaaattggaaatgtgtgaactgctctccttcttcttctgttttcttcttctgttttcatttctcttttgattgtactttggcactgaattatggtgctttcagcatcaaaaagcaataaagtttcatcaagtgttcaaatgtttttgctccttgttcataatattggatatgtttctttaacacccttgtttactttaac

SEQ ID NO: 14849 - DNA, 953 bp, Ananas comosus
ccaataccttagaaacagacgttaactttctcgtatagcaatgactaaagatatcgaggtcggtccgggtgagtatgcgtccaaggactacgaggacccgccacccgcacctctgatcgatgcggaggagttgaccaagtggtccttgtatagggctaccatagccgagttcgtagccacgctcttgtttttgtacattacggtgttgaccgtgattggttacaagagccaaaccgaccttaaaaagaatctggacgggtgcgggggcgtgggtattttgggtattgcgtgggccttcggtggcatgattttcgttctcgtttactgcactgctggtatctcggggggacacataaaccctgcggttaccttcggtctcttcctagctcggaaggtgtccctagtccgagccatactatacatagtggctcagtgcttgggagccatctgcgggtgcggcttggtcaaggcattccaaaagtcctacacccagtacggtggtggagccaatgagctcagcgatgattacaacacgggtactggtttgggagctgaaatcatcggcacattcgtgctcgtctacaccgtctcctccgccaccgaccccaagagaagtgcccgcgactcccacgtccctgttttggcaccacttcctatcggatttgccgttttcatggtccacttggccacgatcccgatcaccggaactggcattaacccagcccgtagcttcggagctgctgtgatctacggcaaacagaaggcatgggatgatcagtggattttctgggtgggaccattcatcggagcagccatcgcggccttctaccaccaatacatcctccgagcagcagcggttaaggctatcggatcgttcaggagcacgacctaatctatcacagcacccgaattatacttcttatcacgagaacttgccaagctgtatataatgt

SEQ ID NO: 14850 - DNA, 1122 bp, Pteridium aquilinum
tttaaggaaagataaacaaacaaggctctcctccaagcttctatcttctctttgatcaccttgtcattgaatttcttagcgcaaagaggccatggctaaggacattgaggtcggtggtcagttccaagccaaagactaccatgatcctccgccagctccgttggtcgacgcggaggagttgacaaaatggtccttttacagggctataatagctgagtttattgccacgctcttgtttttgtacatcactgtgttgacagtgatcggatacaagagccagattgacaagggtggtgatgaatgcggtggtgttggcattcttggcattgcttgggctttcggtggcatgatctttatccttgtttactgcactgctggcatctcaggggggcacatcaatcctgcagtgacctttgggctgttcctggctaggaaggtgtctttggtccgagccattttgtacatggctgctcaatgtttgggagccatctgtgggtgtgggctggtgaaggcattccaaaaatcttactacaaccggtatggaggaggagccaacagcctcgctgatggatacagcaccggaaccggcttgggcgctgaaatcatcggcacctttgttcttgtctacactgttttctctgctactgatcccaagaggaatgcaagagactcccacgtccctgtcttggcaccgcttcccattgggtttgctgtgttcatggttcacttggccactattccgatcaccggcaccggtattaaccctgctcgtagttttggagctgctgttatgtacaaccaggacaagccatgggatgaccaatggattttctgggttggacctttcattggtgccgccattgctgcaatctatcaccagtatatcctgagggcagctgctgctaaagctcttggatccttcaggagcagctctgccatgtaaaaaaatattaagcaataattctccagccacgagagaagaaaaaaggttgccttgaaggaatgaagttttatgtggtcaagaggctttaacggaccattgaatttgtaaattataatggaaggtgtaatgctcctctgcatcatctaacacttatttttaatgtgcccaagtgttgtcat

SEQ ID NO: 14851 - DNA, 903 bp, Valeriana officinalis
ctattacactctcacaattaatcactgttgttgtaagaatgacaaaggatgtcgaggttgcagactacactggcggcaaggactaccaagatccgcctccggtcagcttgtttgactccgaggagttgactaaatggtcgttttacagagcgataatcgcagagtttatcgccacactcttattcctttacattactgtattgaccgtcatcggatacaaaagtcaaactgatccgttaaagggaactgatcaatgtggcggtgttggtattctcggtatagcttgggcttttggcggaatgatctttgttcttgtctactgtaccgctggtatctccggtggtcatattaatccggcagtgacatttgggttgttcttggctcggaaggtgtcgttatgtagagcagtgttgtacatgatagctcagtgtttgggagctatttgcggatgcggattagttaaagctttccaaaaaacgtactataacacatacggcggtggtgctaacgagcttgcacccggatacagtaaaggaactggactaggtgctgagatcatcgggacttttgtacttgtctacaccgtcttctctgctactgatcccaaaagaaacgctcgtgattctcatgttcctgttcttgcaccacttccgatcgggttcgctgtttttatggttcatttggccacaatcccaatcaccggaaccggcattaaccctgcacgtagtcttggagctgcagtgatttatggaagagagaaagcatgggatgatcaatggatattttgggttggacccttcatcggagcggcaatagcagcaatctaccaccagtttgtattgagagctgcagctgttaaagctctgggatcattcaggagcaatgcttaataatttcttgttg

SEQ ID NO: 14852 - DNA, 1150 bp, Ricinus communis
gaacaacgaaagaaaagaacgtactcttttattagcctttattttctaacatctttttcttgcaaaaagaagctatgggcaaggatgttgaagttggaggccacggcggcgagttccatgccaaggactaccatgacccgccacccgcaccattgattgatgccgaggagcttaccaaatggtctttttacagagctattattgctgagtttattgccacgctcttgtttttgtacatcactgtgttgactgtcattggctacaagagtcagactgaccctgccaagaacgctgatgcttgtggtggagttggtattcttggcatcgcttgggccttcggtggcatgattttcattctcgtttactgcactgccggtatttcaggtggacacatcaatcccgctgtgacttttgggctgtttttggcaagaaaggtgtctttggtgagagccataatgtacatggcagctcagtgtttaggtgccatatgtggatgtgggctagtgaaagcattccagagggcttattacaatagatatggtggtggagctaatgagcttgctgatggctacagcacgggcacaggattaggagctgagattattggtacttttgttcttgtctacactgtcttcgctgctactgatcccaagagaaatgccagagattctcatgttcctgtcttggcaccacttccaattgggtttgccgtcttcatggttcacttggctacgattcctgtcactggcactggaatcaacccagcaaggagtttcggagctgctgtaatctacaacaaggagaaggcatgggatgaccagtggattttctgggttggacctttcattggtgctgcaattgctgcaatctaccaccaatatgtgttgagagcatctgctgccaaggctcttgggtcattcaggagcagttccaacatataattttacaagagaatatgtggtcaccataaaatttctggccattccgagttttatctggtcctttgtttatgattatgtgtacattattatgtatgattattatctctgagtgtgcttggggacttgttttatttgtgcccaaatgttgcatccactttcttcatctcattttgcttttccattttagtggctttgtactcatgaagaag

SEQ ID NO: 14853 - DNA, 1286 bp, Fragaria vesca
ccatccacactcacaaacacagccacttcttcttcttccttagtttatttcccaactgcatccactcacagctaaggccatggcgaaagacgttgagggagctgagcacggtgagtttgcggcaaaggactaccatgaccctcctcctactcctcttttcgacgccgatgagctgaccaaatggtcattttacagagctgtcatcgcagagttcatcgccacgcttctgttcctttacatcacggttttgactgtgattgggtacaagagccaaagcgcaactgaccagtgcggcggcgttggaattctcggcattgcttgggccttcggtggcatgatcttcgttcttgtttactgcaccgccggtatctccggaggacacatcaacccagctgtgactttcggactcttcttggcacgcaaggtgtcgctcctcagggctgtgctctacatagtagcacaaagtctgggtgctatctgtggtgtagggttggtgaaggccttccaaaagaccttgtatgacgagtatggtggtggagctaataccttggcccctgggtacagcaagggcaccggattggcggctgagatcatcggcaccttcgttcttgtctacactgttttctctgccactgaccctaagagaaacgccagagactcccatgttcctgtattggcaccacttcccattggatttgctgttttcatggttcacttggccaccattcccattactggcactggtatcaaccctgctagaagtttcggagctgctgtcatctacaaccaagacaaagcctgggatgaccactggatgttctggcttggacctttcattggagctgccattgctgccttttaccaccaatttgttctgagggcaggagcaatcaaggccctagggtctttcaggagcaatgcttaatttcacttaagcaggattttccacccaagcttgatattaaaagatggagatggtcttaatttctaagagaataatagcaacaattgagaattgcaagtctgtctctctctcatggctcaaaaattgaagaacaaaaattgggggccaattgtagataaacatggctttgttgggcacgggtgatcccaatcttttctttctttgctagtatgtatgtgctgttgttatttcttctgcatgtgtatccttatctttaattttattcctaattttatttcacttgtaagtgggtgttttcatgagcttgttgatgccagcagaaagttaatgaaatattggttgtgttgtctggtttcgatca

SEQ ID NO: 14854 - DNA, 992 bp, Daucus carota
agaagatgggaaaagaagaagttgcagaggcaacccatgagtattccggcaaggactaccaggacccaccgccggcagactttattgggattgatgacctgggcaaatggtcattttacagagctctcatagctgagttcatagccaccttactgtttctttacatcactgtgttgactgtgattggttacaagagccagtctgctactgatgaatgtggtggcgttggacttcttggaattgcatgggcctttggtggcatgattttcattcttgtttactgcaccgccggtatctctggaggacatatcaacccagcagtaacatttggattgttcttggcaagaaaagtgtctctaattagagcagtgatgtacatggtagctcagtgtctgggtgcaatttgtggagtaggtttagtgaaggctttccagaagtcatactacaacaagtatggtggtggggctaatgagttggctgatggctacaacaagggcactggcttgggtgctgaaattattggtacttttgttcttgtctacactgtattctctgctactgatcccaagagaaatgccagagattctcatgtccctgttctggctccccttcccatcggatttgctgtgttcatggttcacctcgccacgattcccatcaccggaactggaatcaaccctgccaggagtttcggagctgctgttatttacaacaaagacaaggcctgggatgatcaatggattttctgggttgggcccttcattggagcagccattgctgcattctaccatcagtacattctgagagcagcagctattaaggcacttggctctttcaggagcaatgcctaaaagatttagtttgtgcacatgatcaaatatttgtggcatcagttctgtctctgtttctacctctttataaaaatggagctggaaggggctgaaccatggaattgtagataatttgaattaaattatgcttccttcgtgaga

SEQ ID NO: 14855 - DNA, 997 bp, Fraxinus spp
cttcagaacttttgtctttgatcagtgcaaatggtaaggacgttgaggtcggcgccgaatacaccaccaaggactaccaagatccgccaccggctctgctgattgacccggaggagctaaccaagtggtcattctacagggccattatagctgaattcatagcaacgctcttgtttctgtacattactgttttgactgtgattgggtacaagagccagagcgctgccgatgaatgcggcggcgtcgggattcttggcatagcttgggcttttggtggcatgatttttatcctcgtttactgcactgctggcatttccggagggcacatcaacccggcagtgacattaggcctattcttggcccgtaaggtgtcactgattcgggccatcatgtacatggtggcgcaatgtttaggtgccatttgcggttgcggattggtgaaggcattccagaaatcttactatgtaaaatttggcggcggtgccaatggactggcggaagggtacagcaacggcaccggattggcggcagagatcattggcacatttgtccttgtttacactgtattctctgccactgatcccaagagaaatgctagagactcccacgtccctgttttggcacctcttccaattggatttgctgtgttcatggttcatttagccacaatcccaattaccggcacgggtatcaacccggcccgaagccttggagctgctgttatctatggcaaagacgaggcctgggatgatcaatggattttctgggtgggaccattcattggggcagccattgctgcattttaccaccagtatattctgagggcaggagccgtaaaagctctgggatcattcaggagcactgcttattgagaatcagcatcgtcaagaggaatttgattccatggagaaattgtaaataagcatgaaaagaggtctcgggcccttgttttaaaaacagggccctactctattttccttctgactttgtttttttt

SEQ ID NO: 14856 - DNA, 1307 bp, Prunus persica
tccaaaagcacatacttcacaagccacaacaagcacatagataatttaatttttagtcacagaagaagccatggctaaagatgtagagggagctgagcatggtgagtttgcagccaaagactaccatgaccctcctccaacccccttctttgatcctgaggagctgaccaaatggtctttctacagagctcttattgctgagttcgttgccacccttctcttcctttacatcaccgttttgaccgtcattggctacaagtcccagagcagtggagaccaatgcggcggcgttggcattctgggcatcgcctgggcctttggtggcatgatctttgtccttgtttactgcaccgccggtatttctggtggacacataaacccagctgtgacctttggactattcttggctcgcaaggtttcactgccgagggcagttttgtacatcgtagcccagtctttgggtgcaatctgcggtgttgggttggtgaaggccttccaaaagacatactacgaggagtatggcggtggagccaacgagttggctgctgggtacaacaagggcactggcttgggagctgagatcattggtacctttgttcttgtctacactgtcttctctgccactgaccccaagagaaatgccagagactcccatgtccctgtcttggcaccacttcccattggatttgctgttttcattgttcacctggccaccatcccaatcactggaactggtatcaaccctgctagaagttttggagctgctgtgatctacaacaaggacaaagcttgggatgaccaatggatcttctggcttggaccatttattggagctgccattgctgccttgtaccaccaatacattctgagagcaggagccattaaggctctagggtctttcaggagcaatgcttagttaaatattttcacccatggttttcaaggagatggtctctttttctaaaaagaataattaacaaaatgggggagtgcaagtctgtcctgaggggggtcctttcagcaatctcctcttgtctctctcaagggctcaaagggaagaaattggtggagggccatggaattgtagataagcatggctttgggcaagggtgttattttgtatccctctcttctttgttacttttcttacttttgctttccaattatgtttttgtgctattttcatttcttctgtgtatccttatcttttattcctttttttctttttcttttgttacttttctaagtggtgtatgcatgttgatgatgatggcagagaaagctaatgaaatatggtttgtgttcat

SEQ ID NO: 14857 - DNA, 1311 bp, Arachis hypogaea
tctctctcttcttctattctcttcctttctcttctattctccctttgtgtttggaactagttcaagttgaagtaatggcgaaggacgttgaggttgctgagcgtggatccttctcgggaaaggactaccaagaccctccaccagcaccactcattgatgctgaggagctaactaagtggtccttctacagagccttgattgctgagttcatagccacactcctctttctctacatcactgttctcactgtcattggctacaagagccagactgacaccaccgccaacggtgatgtctgcggcggcgttggcattcttggcatcgcttgggcctttggtggcatgatcttcatccttgtttactgcactgctggaatctcagggggtcacattaacccagctgtgacatttgggttgttcttggcaaggaaggtgtctctgatcagagccatattgtacatggtggctcagtgcttaggtgctatctgtggagttggcttggtcaaggccttccagaaatctctctacaccaggtatggtggtggtgctaattcactcaatgatggttacagcactggcactggtttgggtgctgagatcattggaacctttgttttggtctacactgtcttctctgccactgaccctaagaggagcgccagagattctcatgttccggttttggctccacttccaattggatttgctgtgttcatggttcacttggccaccatcccagtcactggaactggcattaaccctgcaaggagttttggagctgctgttatcttcaaccaagacaagccctgggatgaccattggatcttttgggtaggaccattcattggggcagccattgcagccttctaccaccaattcatcttgagggcaggtgcagttaaggctcttggatcattcaggagcaatcccaatgtctaatgagctaatcttaattagtgcaagttaaacaagattattgagttgatgatgatggtggttgctacttgctaatgtaaaataatgtgaagtggttgtgcttgcattgcatggtccaaggtttctttgaactttctcaactgcattctcttcaaggataacacagggtgtagggtgggggtttgaagatggtggatcattgtagattcaagtctcttttcaagacaattaagggagccttttgtaaaatcccttttgtctttgcacaaacactttcctctgtgtgttgttttcttttcttggttattttccttgtactctattctatgttaatgaaagaatattttaagaaaaatcaaggtttacttgctgctga

SEQ ID NO: 14858 - DNA, 1286 bp, Glycine max
acactccatcacccccatatataccccttctcctctcacactaattaacacactcatcaaaaaacccttctttctttcaggttcattacttgatcagtgtcaaaagggtagttgcaaattgcaatggctaagcatgatgttgagggtggttccttctcagcaaaggactaccatgatcctcctccagcacctttgattgatgctgaggaactcacacagtggtccttctacagggctttgattgctgaattcattgccacattacttttcctttacatcacagtgctcactgtgattggttacaagagccagagtgatgtcaaggccgggggtgatgtgtgtggtggagttggcattcttggcattgcttgggcctttggtggcatgatcttcatccttgtttactgcactgctggaatctccgggggtcacataaacccagcagtgacatttgggctcttcttggctcgcaaggtatctttgattagagccataatgtacatggtggctcaatgcttgggagccatatgtggagttgggttggttaaggcattccaaaaggcatactacaacaggtatggtggtggagccaatgaactcagtgaagggtacagcacaggtgttggattgggtgctgagattattggaaccttcgttttggtctacactgtcttctctgcaactgaccccaagaggaatgctagagattctcatgtgccggttttggcaccacttccaattggctttgctgtgttcatggttcacttggcaaccatcccagtaacaggcactggcattaaccctgctaggagcctaggagctgctgtcatgtacaaccaacagaaggcctgggatgaccattggatcttttgggttggaccatttattggagcagccattgcagccttctaccaccaatttatcttgagagcaggtgctgctaaggctcttggatcattcaggagcaaccccactatttgagtcaatttcctcttcataatcatgggtttcaaaaaggagataattggaagcaaaatgacttgatattgtaagaataataatgttattaataatggcaattgcttgtgcttttattgcaagcttttctttgatcctatgtagattaaaggttctttcaagacaagagcctttggtaaataccctttagtattttcaagcactttcctttcttcagtgtgtgttcttttcttttaggtaattaatctcttctactcaatgtattcatgaaaaaaaaaattatataatatccatgcttttactcaaaa

SEQ ID NO: 14859 - DNA, 1051 bp, Glycine max
aaaaacccttctttctttcaggttcattacttgatcagtgtcaaaagggtagttgcaaattgcaatggctaagcatgatgttgagggtggttccttctcagcaaaggactaccatgatcctcctccagcacctttgattgatgctgaggaactcacacagtggtccttctacagggctttgattgctgaattcattgccacattacttttcctttacatcacagtgctcactgtgattggttacaagagccagagtgatgtcaaggccgggggtgatgtgtgtggtggagttggcattcttggcattgcttgggcctttggtggcatgatcttcatccttgtttactgcactgctggaatctccgggggtcacataaacccagcagtgacatttgggctcttcttggctcgcaaggtatctttgattagagccataatgtacatggtggctcaatgcttgggagccatatgtggagttgggttggttaaggcattccaaaaggcatactacaacaggtatggtggtggagccaatgaactcagtgaagggtacagcacaggtgttggattgggtgctgagattattggaaccttcgttttggtctacactgtcttctctgcaactgaccccaagaggaatgctagagattctcatgtgccggttttggcaccacttccaattggctttgctgtgttcatggttcacttggcaaccatcccagtaacaggcactggcattaaccctgctaggagcctaggagctgctgtcatgtacaaccaacagaaggcctgggatgaccattggatcttttgggttggaccatttattggagcagccattgcagccttctaccaccaatttatcttgagagcaggtgctgctaaggctcttggatcattcaggagcaaccccactatttgagtcaatttcctcttcataatcatgggtttcaaaaaggagataattggaagcaaaatgacttgatattgtaagaataataatgttattaataatggcaattgcttgtgcttttattgcaagcttttcttt

SEQ ID NO: 14860 - DNA, 1077 bp, Vinca minor
ttcaactctacaaatcttggtttaaggaggcccaatggcgaaggatgttgaagtggccggcggagcagagtatgttacaaaggactaccaagatccgccaccagcaccactaatttatccagaagaactaatccagtggtcattctatagagccataattgctgaattcatagccacactactgttcctctacatcacagttttgacagttattggatacagtagccaatctgatgagaaaaatggcggagatcaatgcggcggcgttggcattctcggcatcgcttgggcctttggtggcatgatctttatcctcgtctactgcaccgctggtatttctggaggtcatattaaccctgctgtgacatttgggctattcttggctcgaaaagttacactggtaagagcaataatgtacatgttggctcaatgcttgggagcaatatgtggttgtggccttgttaaggctttccaaagggcttactatcttagatatggtggcggtgcaaatatgctcaatgacggctacaacaccggcaccggattgggggcagagatcattggcacatttgttcttgtttacactgttttctctgctactgatcccaagagaaatgccagagactcccatgttcctgtattggctccgctcccaattggatttgctgtgtttatggttcacttggctacaattccaattactggcactggtattaatcctgctcgtagctttggcgctgctgttatctatggcaaacagaaatcttgggatgatcattggatattctgggttggacctttcattggtgctgccatagctgctttatatcaccagtacgttttgagagcaagtgcagcaaaagctatggggtctttcaagagcacagcatattaaagcatcatcatcaatggaacattctggaaacacctaaaagtgtttccatttgctaagttgtaaataggggactagttttaattctccccaaaggttgtcacttttgtttgatgagtttctttttgttttcatgttgtcatcaaaataatgtactacgagcaagtgaatttatccttttccac

SEQ ID NO: 14861 - DNA, 1342 bp, Conyza canadensis
tctttctctcttccaatcactcacacaaaaatacatacatacatacatacagcttaatataatttttagaattagaagaggggattgattaactgataagaaaaatgagcaaagacattgaggttggaggtcatgatcagtatggtgcaagagattaccaagacccaccccctgctgccctgtttgactccgaagaactcaccaaatggtctttttatcgagccatcattgccgagttcgttgccactctcttgttcctttacgtcacggtcttgacggtcatcggctacaagtcccaagtcgaccccgcccacagtcccgaccagtgtggtggtgttgggatcctcggtatcgcgtgggcctttggtggcatgatctttgtcctggtttattgcacggctggtatctcaggaggccacattaaccccgcggtcacatttgggctgtttttggcaaggaaagtgacacttccaagggctttcatgtacattgtggcccaatgcttgggtgccatttgtggatgcggtcttgttaaggcttttcaaaagacttactacactacttatggtggtggcgccaatgagctagccgatggttacaataaaggcaccggtttgggtgccgaaatcattggcacatttgttcttgtatacaccgtcttctcggccactgaccccaaaagaaatgcccgcgattcccatgtccccgtgttggcacctctacctattgggtttgcggtgttcatggttcacttggctaccatcccaatcacgggcactgggatcaacccggctcgtagttttggtgctgcggttatctacggaaaagataaagcctgggatgatcaatggttattttggataggaccgatgattggagctgccatcgcggccttctaccatcaatatgttttgagagctggggcggttaaagctcttggatccttcaggagcaatgcctagaccaacaactacggcatataaaaatatggtttccatgttcgctttgaacaaattgtataaatttgtttctgttaaatgtgtgttgttgtcgttggtgcgctatgtttttaatgtgcccaaatgactttattttcgagtcctgtgatcatatatatatctttgggttttgagtttattgttattaatgaaacgatttcttttaatttcaacgcatagattacaatgcaattcttgatcggatcgagatggctaaaggtctctttcaatttcgcgaccattggggaacattgaatcctaagttcacctagttaattctataaaaacaaaatatataaataactataacgaagatgatgcactcactgacacatgtaagtttg

SEQ ID NO: 14862 - DNA, 977 bp, Malus domestica
caaacaactagctcttccaacatcaccacattacaaataagctcacttcattttcatccttctctctctctctctctctctctagccatgggcaaagacattgaagttggaggtgggtactcagccaaggactaccaggaccctccgccagagccgctaatcgatgcagaggagctagggaagtggtcgttctacagagccatcatagctgagttcattgccacccttttgttcttgtacatcactgtgctcactgtgattggatacaagagccaaactgacactgctctaaacggagaccaatgtggtggtgttggcattcttggtattgcttgggcctttggtggcatgatctttgtccttgtttactgcacagctggcatctctggggggcacataaaccctgcagtcacattcgggctgcttttggcaaggaaggtgtcactggtgagagccatattgtacatgacggctcagtcgttgggagccatatgtggtgttgggctagtgaaagctttccaaagttcttactatactaagtatggcggtggagccaatgagcttgccgatggctatagcacaggcactggattgggtgctgagattgttggcacatttgttcttgtctacactgtcttctctgccactgatcccaagagaaatgcaagagactcccatgtcccagtattggcaccactgccaattgggtttgctgtgtttattgttcacctagccacaatcccaatcactggtactggtatcaacccagctagaagtcttggagctgcagtgatctacaacaatgacaaggcttggaatgaccaatggatcttctgggttggaccattcattggagctgccattgctgccctgtatcaccaatacatcttgagagcgggagctgttaaagctctgggttctttcaggagctcccccaacatatgatttctaagagaattattgtgtgtttctcaatg

SEQ ID NO: 14863 - DNA, 1331 bp, Fragaria vesca
actcatcaactctctactctatctcagtttctcatcaccaacactagctaccagtctctttctaagcacacaaaacactcacttgtgtctctcttcgatcatctctctagttctgcttcagctagcttgtagccatggccaaggacattgaagtaggtggttttgctgccaaggactaccacgacccacccccaacaccattgatcgatccggaggagtttggaaaatggtctttttacagagccatcattgccgagttcatcgctacgcttttgttcttgtacatcactgtgctcactgtgattggatacaagagccagagtgacactctcaaaggtggagaccaatgtggtggtgttggcattcttggcattgcttgggcctttggtggcatgatctttgtccttgtttactgcactgccggaatctctggagggcacataaaccctgctgtgacatttgggctgtttttggctaggaaggtgtcactgcccagagctgtaatgtatattgtggctcagtctttgggagcaatatgtgggtgtgcgcttgtcaaatcgttccagagtgctttgtacaccaactatggtggtggagctaatgggctagctgatgggtacaacaaaggcaccggtttggctgctgagattattggtacatttgttcttgtctacactgtcttctctgccactgaccccaagaggaatgccagggactcccatgtcccagtattggcaccactaccaattgggtttgctgtctttatggttcaccttgccacaatcccaatcactggtaccgggatcaaccccgcaagaagtttaggagcggcagtgatttacaacaatgagaaggcttgggatgaccattggatcttctgggttggacccttcattggtgcagccattgcggccatgtatcaccaatacatactgagggcaggagcagttaaggctttgggttctttcagaagctcttccaacatataaattcatcggagaggattttaatgcgtattctaaatggtttgggagactttagaagttggaatttggaaccatatggaagttgtacattactgtatctttacgtgtttgagtatgtcgtctgtgtatcaaggcactcgttttaaacttgctttgattcattctgctctgtattcctctgtttaatttaaccatttcagtttcgctgccgagagccggagaatgtatgatatgtgctagtctgttgtactttttttttttttagtcaacaggagacaggagagcagagtgttttcccacctcgaatttattaataaaaaagaaagattacaaacaagtttgatg

SEQ ID NO: 14864 - DNA, 918 bp, Cynara scolymus
gcgggactctccctccccattctctctattctctctcacatatttagctagtcctacccttgggcatggcgaaagacgttggggttggtggccatgattacactgcaagagattaccaagaccctccaccggcagacctttttgacgccgaggaactcaccaaatggtccttttacagagccatcattgccgagttcgttgcaaccctcttgttcctttatatcaccgttttgacagttatcggctacaagtctcagacagaccccatccacagctccgaccaatgcggtggcgtcggaatcctcggcatcgcttgggccttcggtggcatgatattcgtcctcgtttattgcaccgccggcatctccggaggacacattaaccctgccgtcacgtttgggttgttgttggccaggaaggtgagtcttcccagggcggtcatgtacattgtggctcaatgcttgggtgccatctgtggttgtggtcttgtgaaggctttccaaaagacctactatgataattacggtggtggtgccaacgcactcgccgatggctacagcaaaggcacggggttcggtgcggaaatcatcggcacctttgtcctcgtatacaccgtcttctcagccactgatcccaagagaaatgcccgcgattcccatgtccccgtgttggcacctctccctatcggatttgctgtgttcatggttcatttagccacaatcccaattaccggcaccggaatcaacccagctcgtagtttcggtgcggctgttatctatggaaaagccaaggcctgggatgatcaatggttattctgggtgggacccatgatcggagctgccattgccgccatctaccaccaatatgtactgagagcaggagctgtgaaagcacttggatccttcaggaagcatgcgt

SEQ ID NO: 14865 - DNA, 845 bp, Helianthus annuus
caaagacgttgaggttggtgggcatgagtacggtgcaaaagattaccaagaccctcccccggctgaccttttcgatgcggaagagctcaccaagtggtcttttaccgagccatcattgctgagttcattgctacccttctcttcctttacatcactgtcttgactgtaatcggctacaagtcccaaaccgaccccgcccatagttctgaccaatgcggtggtgttggcattcttggtattgcttgggccttcggtggcatgatcttcgttctcgtctattgcactgccggcatctcaggaggacacattaaccctgcggtgacatttgggctgtttttggctagaaaggtgacactcccaagggcgttcatgtacattgtggctcaatgcttgggtgccgtatgcggctgcggtctggtgaaagctttccaaaagacttactacaatacttatggtggcggtgccaacgagctcgcagatggctacagcaaaggcaccggtttgggtgctgaaatcattggcacctttgtcctcgtttacaccgtcttttcagccactgaccccaaaagaaatgcgcgagattcccatgttcccgtattggcacctctccctatcggatttgccgtattcatggttcacttggccaccatcccaatcaccggcactggaatcaaccctgctcgtagtttcggtgcggccgtcatgtacggaaaagaaaaggcatgggatgaccaatggttgttctgggtgggacccgatgatcgagccgccatcgccgccttctaccaccagttcgttttgagagccggcgcagtcaaagctcttggatcctctaggagcatgtg

SEQ ID NO: 14866 - DNA, 1232 bp, Rosa hybrid cultivar
accataaaccagagccaagctctctcttcttctctaacattccaaaactgtgtgtttttgtctaagctttaatggcgaaggacgttgaagttgccgagcggggttccttctcagccaaggactaccatgacccgcctccagctccgctcttcgactcggttgagctgaccaaatggtcgttctacagagctgttatagctgagttcatagcaacccttctgtttctctacatcactgtgctgactgtgatcgggtacaagtcccaaagcgagaccgacgactgcggcggagttgggattttgggtattgcctgggcctttggaggcatgatcttcatcctcgtttactgcactgctggaatctcagggggtcacattaacccggctgtgacttttgggctgttcttggcccggaaggtgtcgctggtccgagctgtgatgtacatagtggctcagagtttgggtgccatagccggagttgggctagtcaaggctttccagagttcttactataaaaagtttggcggtggagccaatacgcttgctgatgggtacagcactggagttggattgtctgctgagattattgggacctttgtgctggtttacactgttttctctgccactgacccaaagaggagtgctagagattcccatgttccggttttggcaccacttccaattgggtttgctgtgttcatggttcacttggccaccatcccaatcaccggcactggcatcaaccccgctagaagtcttggagctgccgttatcttagacgacaagaaggcttgggatgaccagtggatcttctgggttggaccctttattggtgcagcaattgcagctttctaccaccagttcatcttgagagcaggagctgttaaggcgctagggtcattcaggagcaacccccataattgaacattttcagagtcactatgaaagatgtggtttcaagccttttaggtcgggaaacaatggaagaagagtctgtacttttgaaaagaataacggggtagtatttgtggtagctagctaattatgcttgtgtatggaggttaaattttcttttcctggtgtctcaatttggtctagtagagggattgagggagccattgaattgtagatacagtccaggtggagaagggggagctttttgtgtaccccttgatgtttctttaagcactttcctttgaatctacttcaatgttattgtcatcaatttctgct

SEQ ID NO: 14867 - DNA, 1448 bp, Prunus mume
ttaaacaataacataaaaaaatacacactttctatgtgcccccataaatacccctacacactcacaaacccaacatcaagccccattccaaaagcacaaacttcacaagccacaacaagcacatagctaatttaatttttagtcacaaaagaagccatggctaaagatgtagagggagctgagcatggtgagtttgcagccaaagactaccatgaccctcctccaacccccttctttgatgctgaggagctgaccaaatggtctttctacagagctcttattgctgagttcgttgccacccttctgttcctttacatcaccgttttgaccgtcattggctacaagtcccagagcagtggagaccaatgcggcggcgttggcattctcggcatcgcctgggcctttggtggcatgatctttgtccttgtttactgtaccgccggtatttctgggggacacataaatccagctgtgacctttggactattcttggctcgcaaggtttcactgccgagggcagttttgtacatcgtagcccagtctttgggtgcaatctgcggtgttgggttggtgaaggccttccaaaagacatactacgaggagtatggcggtggagccaacgagttggctgctgggtacaacaagggcactggcttgggagctgagatcattggtacctttgttcttgtctacactgtcttctctgccaccgaccccaagagaaatgccagagattcccatgtccctgtcttggcaccacttcccattggatttgctgttttcattgttcacctggccaccatccctatcactggaactggtatcaaccctgctagaagttttggagctgctgtgatctacaacaaggacaaagcttgggatgaccaatggatcttctggcttggaccatttattggagctgccattgctgccttgtaccaccaatacattctgagagcaggagccattaaggctctaggatctttcaggagcaatgcttagttaattattttcacccatggttttcaagtggagatggtctctttttctaaaaagaataattaacaaaatggaggaatgcaagtctgtcctgagggggggttcctttcagcaatctcctcttgtctctctcaagggctcaaagggaagaaattggtggagggccatggaattgtagataagcatggctttgggcaagagtgttattttgtatccctctcttctttgttacttttcttacttttgctttccaattatgtttgtgctattttcatttcttctgtgtatccttttcttttattccctttttttcttttgtttcttttgttacttttctaagtggtgtatgcatgttgatgatgatggcagagaaagctaatgaaatatgggttgtgttcattggtctcaatcaccctctattgatgcttcacacatcatggggttttgct

SEQ ID NO: 14868 - DNA, 1261 bp, Lotus japonicus
ccaaagcttcttccttcctctgttctctgcattctctgagagcttttcctctttcttgactctggttttgcaaaagggtatctctcaaatggccaaggacgttgaggttgctgagcgtggctctttctctagcaaggactaccatgaccctcctcctgcacctctcattgatgcagaggagctcacaaagtggtccttctacagggcagtcattgctgagttcattgccactttgcttttcctttacattactgtgctcactgtgattggctacaaggttcagagtgatgtcaaaaatggtggagatgattgtggaggtgttggcattcttggtattgcttgggcctttggtggcatgatcttcatccttgtttactgcaccgctgggatctcagggggtcacattaacccagcagtgacatttgggctgttcttggctcgtaaggtgtctttgatccgagccatcttgtacatggtggctcagtgcttgggagctatttgtggagttgggttggttaaggctttccagaagtctcactacaacaaatatggtggtggagctaactctcttaatgatgggtacagcacaggtactggattaggtgctgagatcattggtacctttgttttggtatacacagtgttctctgctactgatcccaaaagaagtgccagagattcccatgtgccggttttggctccacttcccattggatttgctgtgttcatggttcacttggccaccatcccagtcactggtactggcattaaccctgctaggagttttggagctgctgttatcttcaaccaatctaaaccctgggatgaccattggatcttctgggtaggaccattcattggggcagccattgcagcattctaccaccagttcatcttgagagcaggtgcagtgaaggctcttggatcattcaggagtaaccccactgtttaagttatcttcaacttcatgatggaaagaagaagataattgaagagtttgaaggaaaataatgtgaagtgcttgtgcttgcttgtatttgctgcaaggtttctttatctccctctcaattaggtcttccagattgtggataagtgtagatttaaaagtccctttggttgtgacaggggagccttttgcactttcctctgtattccctttagtgtgccttctttcctttttatgttattctcttctgtcatctttgtactcattatatatttatgggaatatattttatatttaagtgaattgttcctgccc

SEQ ID NO: 14869 - DNA, 1216 bp, Manihot esculenta
tagtcaatactcacataccccataaataccccttcctcttccacgcttctcaccacaagtttaattaatcaatcaacatccctttctcttctgccatattctttcacagttcccatggccaaggacgttgaagttggaggacaaggcagtgggttccaagccaaggactacagcgaccccccacctgcaccattgatcgatgctgaggagtttactcaatggtccttttatagagctatcattgctgagttcatagcaactcttttgtttttgtacatcactgttttgactgtgattggttacaagagccagactgaccctgccaagaacgccgatgcatgtggcggtgttgggattctcggtatcgcctgggccttcgggggtatgatcttcattcttgtttactgcactgctggtatctcaggtgggcatataaaccctgctgtgacttttgggctatttttggcgaggaaggtgtctctggtgcgagctatattgtacatggcagctcagtgtttgggagccatatgtggatgtgggctcgtgaaggcctttcaaaaggcttattacactaggtatggtggtggagccaatgagcttgctgatgggtacagcaagggcactggattaggagctgagatcattggtacttttgttcttgtctacactgtattttctgctactgatcccaaaaggaatgccagagactcccatgtccctgtcttggctccactcccaattggatttgctgtgttcatggttcatctggccacaattccagtcactggcactggcatcaacccagctaggagctttggagctgctgtgatctacaaccaggacaaggcctgggatgaccaatggattttctgggttgggcctttcattggtgctgcaattgctgcactctaccaccaatacatcttgagagcaggtgctgttaaagctctaggatctttcaggagcacttccaacatataattgagagaaagaaatccctctattcaacagaggctgttgagagtttcttgaggctttgggaacttggaatatgtacatttattttgtatctttgtgtgcttgcttcttgggcacttgcttttatttgtgcccaaaatgctctttccattctattttctttttttgtttttgcccttttatggccctgtactcattatgatgttgataaatttatgggcaactgctttgtgtcatt

SEQ ID NO: 14870 - DNA, 1112 bp, Manihot esculenta
tcttgccaaattcttgccctatggcgaaggacattgaagttggaggacatggaagtgacttccaagccaaggactaccatgaccctccacccgcaccattgatagatgctgaggagctcacacagtggtcgttttacagggctataattgctgagtttatagctaccctgttgtttttatacatcactgttttgactgtgattggttacaagagccaaactgaccctaccaagaacgccgatgcatgtggtggtgttggaattcttggtattgcttgggccttcggcggcatgatctttattcttgtttactgcactgctggtatctcaggtgggcatataaaccctgctgtgacatttgggttgtttttggcgaggaaggtgtctctggtgagagctgtattgtatatggtagctcaatgcttgggtgccatttgtggatgtgggctcgtgaaggcattccaaaaggcttattataataggtacggtggtggagccaatgagcttgctgatgggtacagcacaggcactggattgggagctgagatcattggtacttttgttcttgtctacactgttttctctgctactgatcccaaaagaaacgctagagactcccatgttcctgtcttggctccacttccaattggatttgctgtgttcatggttcacttagccacaattccagtcactggcactggtatcaacccagctaggagccttggagctgctgtgatctacaaccaggacaaggcctgggatgaccaatggattttctgggttggacctttcattggtgctgcaattgctgcattttaccatcagtacatcttgagagcatctgctgctaaagctcttggatcattcaggagcagttccaacatatgattcagggggaaaatgttctctatgcttctgaagttgagagttttatctggtccttaagctttggggcctttggaatttgtacattaattatgtatgtttgtgtgtgtgcttgatgcttgggcacttggttttatttgtgcccaaaatgttgtttcctttctctttttgtggtcattgtagtcatgatgatgttaatctctaataaaaaaaaattatttctctaat

SEQ ID NO: 14871 - DNA, 1415 bp, Phaseolus vulgaris
tggtgggggtggcgtagtgacggtggggacaaggtcggtgaaagtgaaaccgaaaccaagaagtttattgctattattattattattatttggttttgtttttcagtgtagaattgctctaatcaaatgctctagcatcactccatcacctcaatatataccccttctcatctcacactaatcaaacacaaccttgtttctttttctcaaagcctctctttcaggttcttttcttcatcagtgtcaaaagggtggttgcaaattgcaatggctaagcatgatgttgagggtggttccttctctgcaaaggactaccatgaccctcctccagcacccttgattgatgctcaggaactcacacagtggtccttctacagggccttgattgctgagttcattgccacactgctcttcctttacatcacagtgctcactgtcattggctacaagagccagagtgatgccattacggctgggggtgatctctgtggtggggttggcattcttggcattgcttgggccttcggtggcatgatcttcatccttgtttactgcactgctggaatctcaggaggtcacataaacccagcagtgacttttggactcttcttggctcggaaggtgtctttgataagggctataatgtacatggtggctcagtgcttgggggccatatgtggagttgggttggttaaggccttccaaaaggcttactacaccaggtatggtggtggggccaatgagctcagtgaagggtacagcacaggtgttggattgggtgctgagatcattggaaccttcgttttggtgtacactgtcttctctgctaccgaccccaagaggaatgctagagattctcatgtaccggttttggctccactgccaattgggtttgctgtgttcatggttcacttggcaaccatcccagtgactggcactggtattaaccctgctagaagtcttggagctgctgtcatatacaacaaagagaaggcctgggatgaccaatggatcttttgggttggaccattcattggagcagccattgcagccttctaccaccaattcatcttgagagcaggtgctgctaaggctcttggatcattcaggagcaaccccactatttgagttacccaatatcctctcaatgtttcaaaagcatgataattggaagcaaaatgagttgatactgcagcaatcataataatttcaagtgcttgtagttttattgcaagcttttctttgatcctatgcagattgaaggttctttcaagacaagagcctttggtatataccctttagtattaagcactttcttttgtatttccttcattgtgtgatcttttcttttaggtaatttatctcttgtactcaacgtattcatgaaaaaaaaaagatttaaaaagttatgtgaa

SEQ ID NO: 14872 - DNA, 1148 bp, Vaccinium corymbosum
caaacagtcagcagctgaaaaagagtgaagacatgtcgaaggacgttgaagtggcggagcaaccagagtaccagccgaaggactaccaggacccgccgccagcgccgctggtggacgcggaggaactgatcaaatggtcgttctacagggcagtcatcgccgagttcatagctacacttctcttcctctacatcaccgtcctcaccgtgattggctacaagagccagtcggccgccgaccagtgcggcggcgtcggattcctcggcatcgcctgggccttcggtggcatgatcttcgtcctcgtttactgcaccgccggtatctccggagggcacataaacccggcggtgacgttcgggctgtttttggcccggaaggtgtcgctgataagggcggtgtcgtacatggtagcacagtgcttgggtgcaatctgcggcgttggtctggtgaagggcttccagaagggttactacgatacgtacggtggtggggccaacgaggtgcaacctgggtacaacaagggcaccgccttaggggctgagatcatcgggaccttcgttttggtctacactgttttctcagccactgatcccaagaggagcgcaagagactcccatgttcccgttttggctcccctcccaatcggattcgcggtattcatggttcacctagccaccatcccaattacaggcaccggaatcaaccccgctagaagctttggggctgcagttatcttcaacaaatctaaggcctgggatgatcaatggatattttgggtcggaccgtttgttggagctgccattgctgcattctaccaccagttcattctgagagcagcagccatcaaagctttgggttctttcagaagcaatgcctaagccactgaagaagaagaaaagagtaaggtgcaagagtgaaaagggagagaatgccatggacttgtagataacatttgctttggtgaagggtgacttttgtaatttgaattacctgttgtttttgaacttttctttctggatttccaaactttgctttgagtgtatgatgtatctatttggtggtgttaatcatacagacagttcctctattttctgcgttctatttctcttaaataatactcaagtaaaatgggatgtcttccttgattt

SEQ ID NO: 14873 - DNA, 1058 bp, Daucus carota
tctctctctctgagcacagacaaaaaatagaagatgggaaaagaagaagttgcagaggccacccatgagtattccggcaaggactaccaggacccaccgccggcagactttattgggattgatgacctgggcaaatggtcattttacagagctctcatagctgagttcatagccaccttactgtttctttacattactgtgttgactgtgattggctacaagagccagtctgctactgatgaatgtggtggcgttggacttcttggaattgcatgggcctttggtggcatgattttcattcttgtttactgcaccgccggtatctctggaggacatatcaacccagcagtaacatttggattgttcttggcaagaaaagtgtctctaattagagcagtgatgtacatggtagctcagtgtttgggtgcaatttgtggagtaggtttagtaaaggctttccagaagtcatactacaataggtatggtggtggggctaatgagttggctgatggctacaacaagggcactggcttgggtgctgaaattattggtacttttgttcttgtctacactgttttctctgctactgatcccaagagaaatgccagagattctcatgtccctgttctggctccccttcccatcggatttgctgtgttcatggttcacctcgccacgattcccatcaccggaactggaatcaaccccgccaggagtttcggagctgctgttatttacaacaaagacaaggcctgggatgatcaatggattttctgggttgggcccttcattggagcagccattgctgcattctaccaccagtacattctgagagcagccgccatcaaggcacttggctctttcaggagcaatgcctaaaagctttagtttgtgcacatgatcaagtatttgtggcatcagttctgtctctgtttctacctctttataaaaatggagctggaaggggctgaaccatggaattgtagataatttgaattaaattatgcttcctttgtgagaatattaagtttgtaattttctgtttgttgtacttgtat

SEQ ID NO: 14874 - DNA, 1179 bp, Hevea brasiliensis
ggcacgaggtttctcttgccaaatcctgtcacggtacctatggccaaggacgttgaagttggaggacaaggcggtgagttccaagccaaggactacaatgaccctccacctgcaccactgatcgatgccgaggagtttactcagtggtcgttttatagggctatcattgctgagtttatagccacgcttttgtttttgtacatcactgttttgactgtgattggttacaagagccaaaccgaccctgccaagaacgctgatccatgtggtggtgttgggattcttggtatcgcttgggccttcggtggaatgatctttattcttgtttactgcactgctggtatctcaggtgggcatataaaccctgctgtgactttgggtctgtttttggcgaggaaagtgtctctggtgcgagctatattgtacatggcagctcagtgcttgggagccatatgtggatgtgggctcgtgaaagcattccaaaaagcttattacaataggtatggtggtggagccaatgagcttgctgatgggtacagcaagggcactggattgggtgctgagatcattggtaccttcgttcttgtctacactgtcttttctgctactgatcccaaaaggaatgctagagactcccatgttcctgtcttggctccacttccaattggatttgctgtgttcatggttcatctggccacaattccagtcactggcactggtattaacccagctaggagctttggagctgctgtgatctacaaccaggacaaggcatgggatgaccaatggattttctgggttggacctttcattggtgccgcaattgctgcattctaccaccaatatatcttgagagcagctgctgttaaagctttaggatctttcaggagcacgtccaacatataattgagaaaagaaattcctttatgctactaaatttgagagtttcatctggtccttgaggctttgggaccttggaatatgtacattaattatgtatctttgtgtgcttggtgcttgggttcatggttttatttgtgcccaaactgttacttccactctattttctttttcccctttgtggccttgcactcatgatgatgtagacaaatttatgagcaaagtgccttgtgtcaattatatgatttcaattggaaaataaaattcttatatattaat

SEQ ID NO: 14875 - DNA, 1024 bp, Citrus sinensis
caaagtccacacatctctcttttctcttagaaaaaaagaaaaaaaaaagagaaaacaaaaacttaaaattctcagtgaagagcaatctctagcaatggccaaggacattgaggttggtcgggaaggcgagttccatgataaggattaccacgaccctcctccagctccattgatcggcgcggaggagctcactcggtggtcgttttacagggctattatagctgagttcatagccacgctcttgtttttgtacattactgtgctgacagtgattggtcacaaaagccagactgacgccaaacacggcggtgacggatgcggtggtgttggcattcttggcatcgcttgggcctttggtggcatgatctttgttcttgtttactgcactgctggtatctctggtggacacattaacccggcagtgacatttgggctgttcttggcgcggaaggtgtcactggtgcgagccgtaatgtacatggtggctcagtgtttgggagccatatgtggctgcgggctcgttaaggctttccagaagtcttactacacgagatacggcggtggagccaatgagctcgctgatgggtacagcactggcactggattgggtgctgagatcattggtacctttgttcttgtctacactgttttctccgccactgatcccaagagaaatgctagggacccccatgttcccgtcttggcaccattgccaattggatttgctgtgttcatggttcacttggctacgatcccagtcactggaactggcatcaaccccgctagaagtttgggagctgcagtgatttacaacaaggacaaggcttgggatgatcaatggatcttctgggttggccccttcattggtgctgcaattgctgcattttaccaccaattcatcctcagagcatctgcttctaaagctcttggatccttcaaaagctcctccaacatttaattaacttttaaaataattactggaggattaatcaatggctgtcaagcggcttcgcgactatggaaa

SEQ ID NO: 14876 - DNA, 1657 bp, Petroselinum crispum
gtagggttacccacttaatcactatttctactctctctctccccttaaatactaaccctctcctgctcatccactcacactccactctatctctctctacacaacacaaataagaaaggatgggaaaagaagaagttgcagagcaaggtcaggagtattccggcaaggactaccaggacccacccccggcagactttattgggattgatgacttgggtaaatggtcattttacagagctctcatagctgagtttatagccaccttactgtttctttacattactgtattgacggttattggttataagagccagtctgctgctgatcaatgtggtggtgttggacttcttgggattgcatgggcttttggtggcatgatctttattcttgtttactgcaccgccggtatctctggaggacacatcaacccagcagtaacatttggattgtttttggcaagaaaagtgtcactaataagagcagtgatgtacatggtagcacagtgtttaggtgcaatttgtggagtaggtttagttaaggctttccagaagtcatactacaataggtatggtggtggggctaatgaattggctgatggctacaacaagggcactggtttaggagctgaaattattggtacttttgttcttgtctacactgttttctctgctaccgatcccaagagaaatgccagagattctcatgtccctgtcttggctccacttcctattggatttgccgtcttcatggttcaccttgcaaccattcccatcaccggaactggtattaaccctgctagaagtttcggagctgctgttatttacaaccaagacaaggcctgggatgatcaatggatgttctgggttggacccttcattggtgcagccattgctgcattctaccatcagtacattctgagagcagcagcaatcaaggctcttgggtctttcaggagcaatgcctaaagttttaatctgtgcacataatccaatatttgtggcatgagttctgtctctcttccctagctcttcatataaatgaagctaattcagatggagctaggaggggaatggaccatggaattgtagataatttgaattttattattatgttttcttctgtaagagaatattaggtttgtaattttctctttgttgtgtttgtattttctgtggtgttgtgatcttatttctccttgaataatattctctatccttttctctttttgttcccacttaatttatgtactcaaataatgtctcagaattattcataagtaaatatggtttatgttctttatctgattatctctgactatcaatcatgcatcttgtttgttgagactccatggagccttttttctcttctattttctcttctataccaggtgaactacattgctttagaaccatcacacttgtttcattaaattatttaattttccgctacattcggacttcaatatgaattatcccttcgcacttctctcgtaatccaccaaaaacttgtatcatgtaattataaccaggaccaacaatatatatcaacaagattgcatttactatacaaagtaccgatcacacttattaatctgacatctgaaccaacaatatatatgaacgagattgtttgttagtatatatataaataagattaa

SEQ ID NO: 14877 - DNA, 1424 bp, Cajanus cajan
gtgtgatcctgggtctgcaccagcatatataccccttctcttctcactctcatccacacttccccattagcttcctcaaccaaagtttcttcctttttctgctctctgccttctctgacaccttaggtttctcgtagagtgtgttgtggcaagagggtatggcgaaagacgttgaggttactgagcgtggctccttctctggcaaggactaccatgaccctccaccagcacccctcattgatgctgaggagctcacaaagtggtcattctacagggctctcattgctgagttcattgccactttgcttttcctctacatcactgtgctcacagtgatagggtacaagcaccagagtgacctcaaggctggtggtgatctttgtggtggggttggcattcttggcattgcatgggcctttggtggcatgatcttcatccttgtttactgcactgctgggatttcagggggtcacattaacccagcagtgacatttgggctgttcttggctcgcaaggtgtcgttgatccgagctattatgtacatggtggctcagtgcttgggggctatctgtggagttgggttggtcaaggccttccaaaagtcatacttcaacaagtatggtggtggggctaattccctcgctgatggctacaacaaaggcactggattgggtgctgagatcattggcacctttgttttggtctacactgtcttctctgccactgatcccaagaggaatgctagagattcccatgtgccagttttggctccacttcccattggattcgctgtattcatggttcacttggccaccatcccagtcactggcactggcatcaaccctgctaggagtcttggagctgctgttatctacaaccaagataagccctgggatgaccattggatcttttgggtaggaccatttattggggcagcaattgcagcattctaccaccagttcatcttaagggctggtgcagttaaggctcttggatcattcaggagtaaccccaatgtttgagttgtctccctcttcatgatgatggccttgttggtggaaagaagataattggagagatggagttggatattgcaggtttaataattggaaatggttttgccttgtatttgcaacttttctttgaccctctcaattatgccttcaagattgtggataagtgtagattaaagtctctttcatgacagggggagccttttgcactttcctctgtattccctttagtgtgtcatttttctttttaagttattctcttctgtcatccttgtactcatatttatggaaaactatttttaaaattttaagtataggttcctgcttttactacattactatcagcaatgcagaaaacctacaaaagaaaggacagagaaaatacatttaatgcaatatgcgttattgcta

SEQ ID NO: 14878 - DNA, 1829 bp, Glycine max
ccataataaaagccacgttaaacatccaatttcccttgaacccaaaagaaagccacgttaaactctaatgtcttgaaacttttcaaactgtttctactcaactgtgcagagcacatcactttgcttttccaaaccagcttgctttcccacgtttgtcataacttctactctaaattgactcatacagaactttaacttaaatttaccaaagtatttaatagtttctagagagaacaaaatgacaaaacaacaataagaaaagaaaaaatcaaaaacaaagatacaaatgaatgaatggaagggagtggtagggaggtggtggtgtagtaaaagtgaggtcaaggtcggccaaagcgagactcaaaccaaaaggtttattgctattaatatttggctctgtttttcagtgtcaaattgcattattgcaataatcaaatgcactaaccacactccatcacccccatatataccccttctcctctcacactaattaacacactcatcaaaaaacccttctttctttcaggttcattacttgatcagtgtcaaaagggtagttgcaaattgcaatggctaagcatgatgttgagggtggttccttctcagcaaaggactaccatgatcctcctccagcacctttgattgatgctgaggaactcacacagtggtccttctacagggctttgattgctgaattcattgccacattacttttcctttacatcacagtgctcactgtgattggttacaagagccagagtgatgtcaaggccgggggtgatgtgtgtggtggagttggcattcttggcattgcttgggcctttggtggcatgatcttcatccttgtttactgcactgctggaatctccgggggtcacataaacccagcagtgacatttgggctcttcttggctcgcaaggtatctttgattagagccataatgtacatggtggctcaatgcttgggagccatgtgtggagttgggttggttaaggcattccaaaaggcatactacaacaggtatggtggtggtgccaatgaactcagtgaagggtacagcacaggtgttggattgggtgctgagattattggaaccttcgttttggtctacactgtcttctctgcaactgacccaaagaggaatgctagagattctcatgtgccggttctggctccacttccaattggttttgctgtgttcatggttcacttggcaaccatcccagtcactggcactggtattaaccctgctaggagttttggagccgctgtgatgtacaaccaaaagaaggcttgggatgaccaatggatcttttgggttggaccgtttattggagcagccattgcagccttctaccaccaattcatcttgagagcaagtgctgctaaggctgttggatcattcaggagcaaccccactatttgagtcaatttcctcttcatggggggatagtggaaatggaaaaaaaatcatgggaagtgtttgtgctttgatcctctgtagattgaaggttctttaagacaatgaagcctttagtaaatagtaaaaaccctttagtatttgcaagcactttcctatgtatttccttgttagaattaagctttttcttgagatattggaagtaaaatctattagatgtcttgttttaatattttgtgatgtgtaataagttcgacatgttgttggtgaactagtttggtaacccatattttgagggatgctaggccaatgtcacactttttgcttgtgatattgtattttcaccaaaaacaagtcactgtatgtatgtttggaaaattaagaacgaaaatacactttcattccacc

SEQ ID NO: 14879 - DNA, 1406 bp, Populus trichocarpa
agctagctctccccactctcatcaccatatatacccatactctctcgctcaaaccttcgctcagctcttaaaaccaaaagaccaaaacctctctctccctttctttctaagaagaacctatcttcctttctctccgagaagtttaatacagcaagtttaggttttcggtatggcaaaggacatggaagtagcagaggcaggatcattctctgcaaaggactaccatgacccaccaccagcaccattgtttgatgctaaagagttaacaaagtggtcattttacagggccttgattgctgagtttatagcaacactgctctttctttatatcactgttttgactgttattggttacaagagccagattgatggaagtgctgattcttgtggtggggttggtattcttggtattgcctgggcctttggtggcatgatctttgttcttgtatactgcactgctggtatttcagggggtcacattaacccagcagtgacatttgggcttttcatagccaggaaggtctctttgatccgggctgtgatgtacatggtggctcaatgcttaggagccatatgtggcgttgggcttgttaaggccttccaaaagtcttactacaagaagtatggtggtggagccaacactttggccgatgggttcagcaccggcactggattgggtgctgagatcattggcacttttgtcctggtctacactgttttctctgctacagatccaaagaggagtgctagggactcccatgtgcctgttttggctcctcttccaattggatttgctgtgttcatggttcacttggccaccatccccatcactggaactggcatcaaccctgctaggagtctgggagccgctgttatctacaaccaagacaaggcctgggatgaccattggatcttctgggttggacccttcgctggtgcagccattgcagctttctaccaccaattcatcttgagagcaggagctgtcaaggctcttggatcattcaggagcgcccaacggttttaaatctcaggtccttctcaacttgaataatgaagaagtgcttgctgctccagctagtgcgtgcatggtggtttccctttattatccctttcggtctgggaatcatggaatttgtagataaagtctctttgaaaaggggaggcttttattatcccttttgtcattttcaggcgcttgccttagaattcacttcaatgttatgttctctctttctttgcacctattgtgcttccaagtaaagcctagcctaccttttctttctcctttgcttgttatcatcacatcacttttagctgcatgcaccactactcttggcattgcaaatgtagaaatatatgtatatatataattacttaatcagaagctcccaattgggtccaaa

SEQ ID NO: 14880 - DNA, 2272 bp, Glycine max
aaaaaaccacgttaaacacgctaatgtcttgaaacttttcaaacggtttctaagcaactgtgtagagcacagcacatcactttgcttttctaaaacagcttgcttttccacgtctgtgataacttctaccctaaattgactcatacgcaacttcaaattaaattaacttactatactgtgtcctgcataactgttgagtttaatcttggaaatttctgcacaaaagcttctctgggatttggtgtagagtttaatctacattttttatattagtgtttttaatatattttttaattatttcaaaatgttgttcactcaagcacagacttggaaatataattttttttcttacttagatatgttttgttttaaaagatagattcatccactctagacagaacaaaatgacaaaacaaacaaagatacaaatgaatggaagagagtggtagggaggtggtggtgtagtaaaagtgaggtcaaggtcggtgaaatagagactcaaaaccaaatagtttattgctattattatttggccttgttttttcagtgtcaaattgcattattgaaataatcaaatgcactaaccacactccatcacccccatatataccccttctcctctcatactaattaacacactcatccaaacaaccttctttctttttctgtgagcctttctttcaggttcttaacttgatcagtgtgcagtgtccaaatcataagggtagttgcaaattgcaatggctaagcatgatgttgagggtggttccttctctgcaaaggactaccatgatcctcctccagcaccgttgattgatgctgaggaactcacacagtggtccttctacagggctttgattgctgagttcattgccacaatgctcttcctttacatcacagtgctcactgtgattggttacaagagccagagtgatgtaaaggctgggggtgatgtgtgtggtggagttggcattcttggcattgcttgggcctttggtggcatgatcttcattctggtgtactgcactgctggaatctcagggggtcacataaacccagcagtgacatttgggctcttcttggctcgcaaggtgtctttgattagagcaataatgtacatggtggctcagtgcttgggagccatatgtggagttgggttggttaaggccttccaaaaggcttactacaacaggtatggtggtggggccaatgagctcagtgaagggtacagcacgggtgttggattgggtgctgagatcattggaacctttgttttggtttacactgtgttctctgcaactgatcccaagaggaatgctagagattctcatgtgccggttttggctccacttccaattggctttgctgtgttcatggttcacttggcaaccatcccagtaacaggcactggcattaaccctgctaggagtctaggagctgctgtcatgtacaaccaacagaaggcctgggatgaccattggatcttttgggttggaccatttattggagcagccattgcagccttctaccaccaattcatcttgagagcaggtgctgctaaggctcttggatcattcaggagcaaccccgctatttgagtcaatttaatttcttcttcatgatgagttcaaaatgaagaggaaattataagaataataaaaatattgtcaataatggcaattgcttgtgcttttattgcaaccttttctttgatcctattatgtagattaaaggttcttttcaagacaagagccattggtaaataccctttagtattttcaagcactttcctttctttcagtgtgtgatattttcttttaggtaatttaatctcttgtactcaacgtggaaaaaaatatatataaatccatgcttttacttaaaatgtctctgttgccattttttcttaattgcgtttgaggttacactagtaattattttccacttatcaacaaacgcgaaacagctaacatggcgatgggtaaaaaaacaatgaacaaagggacaaagaaatccctgcaatagtggaaagatatgtaacggtctttaatgtaatcagcataagaacaagacagtgttacagtgcacccctacttggttacactcaagaggtatggcaaacggtaaagttacttacgtaagcattttaaatacggaggacaccttttcgtcgaaagaaacaaaagtacgaaccattggccacagtacagcgcacatgcatcatgaatggatcgatgttgttgaggaaagaatggaaaagggtgcaaacaag

SEQ ID NO: 14881 - DNA, 1168 bp, Glycine max
cttctttctttttctgtgagcctttctttcaggttcttaacttgatcagtgtgcagtgtccaaatcataagggtagttgcaaattgcaatggctaagcatgatgttgagggtggttccttctctgcaaaggactaccatgatcctcctccagcaccgttgattgatgctgaggaactcacacagtggtccttctacagggctttgattgctgagttcattgccacaatgctcttcctttacatcacagtgctcactgtgattggttacaagagccagagtgatgtaaaggctgggggtgatgtgtgtggtggagttggcattcttggcattgcttgggcctttggtggcatgatcttcattctggtgtactgcactgctggaatctcagggggtcacataaacccagcagtgacatttgggctcttcttggctcgcaaggtgtctttgattagagcaataatgtacatggtggctcagtgcttgggagccatatgtggagttgggttggttaaggccttccaaaaggcttactacaacaggtatggtggtggggccaatgagctcagtgaagggtacagcacgggtgttggattgggtgctgagatcattggaacctttgttttggtttacactgtgttctctgcaactgatcccaagaggaatgctagagattctcatgtgccggttttggctccacttccaattggctttgctgtgttcatggttcacttggcaaccatcccagtaacaggcactggcattaaccctgctaggagtctaggagctgctgtcatgtacaaccaacagaaggcctgggatgaccattggatcttttgggttggaccatttattggagcagccattgcagccttctaccaccaattcatcttgagagcaggtgctgctaaggctcttggatcattcaggagcaaccccgctatttgagtcaatttaatttcctcttcatgatgagttcaaaatgaagaggaaattataagaataataaaaatattgtcaataatggcaattgcttgtgcttttattgcaaccttttctttgatcctattatgtagattaaaggttcttttcaagacaagagccattggtaaataccctttagtattttcaagcactttcctttctttcagtgtgtgatattttctttta

SEQ ID NO: 14882 - DNA, 914 bp, Glycine max
caaaaccaaaagggtggttgcaaattgcaatggctaagcatgatgttgagggtggttccttcgctgcaaaggactaccatgatcctcctccagcaccattgattgatgctgaggaactcacacagtggtccttctacagggctttgattgctgagttcattgccacaatgctcttcctttacatcacagtgctcactgtgattggttacaagagccagagtgatgtaaaggctgggggtgatgtgtgtggtggagttggcattcttggcattgcttgggcctttggtggcatgatcttcattctggtgtactgcactgctggaatctcagggggtcacataaacccagcagtgacatttgggctcttcttggctcgcaaggtgtctttgattagagcaataatgtacatggtggctcagtgcttgggagccatatgtggagttgggttggttaaggccttccaaaaggcttactacaacaggtatggtggtggggccaatgagctcagtgaagggtacagcacgggtgttggattgggtgctgagatcattggaacctttgttttggtttacactgtgttctctgcaactgatcccaagaggaatgctagagattctcatgtgccggttttggctccacttccaattggctttgctgtgttcatggttcacttggcaaccatcccagtaacaggcactggcattaaccctgctaggagtctaggagctgctgtcatgtacaaccaacagaaggcctgggatgaccattggatcttttgggttggaccatttattggagcagcaattgcagccttctaccatcaattcatattgagagcaagtgctgctaaggctcttggatcattcaggagcaaccccactatttgagtcaatttcctcttcatggggggttag

SEQ ID NO: 14883 - DNA, 1461 bp, Vigna unguiculata
gaaagccaaaccgaaaccaaaaagtttattgcgtttattatttgtctttgttttgcggtgaaaatggcactaatcaaatgctccaacgtcactctatcacctcaatatataccccttcgcatctcacactaatcaaatcaaacacaagcttgcttctttttctgtgagcttctctttcaggttcttgatcagagtgaaaagggtggttgcagattgcaatggcgaagcatgatgttgagggtggttccttctctgcaaaggactaccatgaccctcctccagcacccttgatcgatggtgaagaactcacacagtggtccttctacagggccttgattgctgagttcattgccacactcctcttcctttacatcacagtcctcactgtcattggttacaagagccagagtgatgtcaaggctggtggtgatctctgtggtggggttggcattcttggcattgcttgggccttcggtggcatgatcttcatccttgtttactgcactgctggaatctcagggggtcacataaacccagcagtgacatttggactgttcttggctcggaaggtgtctctgataagggctataatgtacatggtggctcagtgtttgggggccatatgtggagttgggttggtgaaggccttccaaaagggttactacaacaggtatggtggtggggccaatgagctcagtgaaggctacagcacaggtgttggattgggtgctgagatcattggaaccttcgttttggtctacactgtcttctctgctactgaccccaagaggaatgctagagattctcatgttccggttttggctccacttccaattggttttgctgtgttcatggttcacttggcaaccatccctgtaactggcaccggtattaaccctgctagaagttttggagctgctgtcatatacaacaaagagaaggcctgggatgatcattggatgttttgggttggaccattcattggagcagccattgcagccttctaccaccaattcatcttgagagcaggtgctgctaaggctcttggatcattcaggagcaaccccaccatttgagttattactcaatatcctctcatgggttcaaaaggaacataattggaagcaaaatgagttaatattgcaacaacgacatagtaataggaaatgtctgtcctttgaccctatgtagatcgaaggttcttttaagacaagggatcctttggtaaatagtaagcacccttagtatttctagaactttcactagttgtcatgaataagtcaagtcagaatggagtaggtgaaattgcaggataacccatgttttaagggagaggttatgctaattcaatgtcacctgcaaccttttgcttgtaactatgtatttttgcaaaagcatgtccctatatctatgttggaaaattctgaatcatgaaacactttctgatgcactgtagaaaaa

SEQ ID NO: 14884 - DNA, 1397 bp, Vigna unguiculata
ttcttgttctgtgagcttctctttcaggttcttgatcagtgtcaaaagggtggttgcagattgcaatggcgaagcatgatgttgagggtggttccttctctgcaaaggactaccatgaccctcctccagcacccttgatcgatggtgaagaactcacacagtggtccttctacagggccttgattgctgagttcattgccacactcctcttcctttacatcacagtcctcactgtcattggttacaagagccagagtgatgtcaaggctggtggtgatctctgtggtggggttggcattcttggcattgcttgggctttcggtggcatgatcttcatccttgtttactgcactgctggaatctcagggggtcacataaacccagcagtgacatttggactgttcttggctcggaaggtgtctctgataagggctataatgtacatggtggctcagtgtttgggggccatatgtggagttgggttggtgaaggccttccaaaagggttactacaacaggtatggtggtggggccaatgagctcagtgaaggctacagcacaggtgttggattgggtgctgagatcattggaaccttcgttttggtctacactgtcttctctgctacagaccccaagagaaacgctagagattctcatgtcccggttctggctccactgccaattggttttgctgtgttcatggttcacttggcaaccatcccagtgactggcactggtattaaccctgctagaagttttggtgctgctgtcatatacaacaaagagaaggcctgggatgatcattggatgttttgggttggaccattcattggagcagccattgcagccttctaccaccaattcatcttgagagcaggtgctgctaaggctcttggatcattcaggagcaaccccaccatttgagttattactcaatatcctctcatgggttcaaaaggaacataattggaagcaaaatcagttaatattgcaacaacatagtaataggagatgtttgtcctttgacccatgtagatcgaaggttctttcaagacaagggatcctttggtaaatagtaagcagcacccttagtatttcttgaactttcactagttgttatgaataagtcatgtcagaatggagtaggtgaaattgcatgataacccatgttttaagggagaggttatgctaattcattgtcacctgctactttttgcttgtaactatgtatttttgcaaaatcaaatgtccctatatgtatgttggaaaattctgaatcatgaaacactttctgatgcaccgtagaaaaattattaatggcacaaatgtcatcaaatcttttttcttcttcgtgaacatgttttgtattatacccaccaactaggtaggtattgtttt

SEQ ID NO: 14885 - DNA, 1211 bp, Gossypium hirsutum
cttcacatctttttggcaatcaattttgtaagcaagtatggctaaggacgttgaggttggtggtgagttccaagccaaggactaccatgatcctccaccagctccattggtggacggggaggagttgacaaagtggtcattttatagggctgtaatagccgagtttattgccacgctcttatttttatacatcactgtgttgacagtgatcggatacaagagtcaggttgaccctgataagggcagtgacgaatgcggtggtgttggcattcttggcattgcttgggcttttggtgggatgatctttatccttgtttactgcactgctggtatctctggaggacacatcaacccagcagtgacctttgggcttttcttggctaggaaggtgtccttagttcgagccatattttatatggctgctcaatgtttgggagccatatgtggatgtgggctagtgaaggcattccaaaagtcatattacaacaagtatggaggaggagccaacagcctcgctgatggatacagcactggaactggtttggcagctgaaatcattggtacctttgttcttgtctacactgttttctctgcaactgatcccaagaggaatgcaagagattctcatatccctgtcttggcaccacttcctattggatttgctgtgttcatggttcacttggcaactattccaatcaccggcaccggtatcaaccctgctcgtagttttggggccgctgttatctacaaccaggacaagccatgggatgatcattggatcttctgggttggaccattcattggtgcagccattgctgcaatctatcaccagtttatcctgagggcagctgctgttaaagctcttggatccttcaggagcagctctgccatgtaattaagcaatcattctccagccacaagtttaaacaaaaaaaaaaacgggacggttgccatggaggattggattaagttttatcaatgtggtcaagaggctttttcagaccactcaatttgtaaattataatggaggatgtcatgcttttatgtatgtggcacttattttcaatgtgccccatcattatccctgcttttctttccttttttatggtctttctttgtttggcttggtgtttctaagttatctttgaaaattttataaaaatcaagtactttgtgttgctttatttacacaagtttaattcaaaaaagaa

SEQ ID NO: 14886 - DNA, 1341 bp, Eschscholzia californica
gagtaatgggtaatggagttggacccacaaaacgaaattactcgaaccagtgattagtgggagggcatggtcggcaaaaaagtttccaagtgaaatgacctaatctttctcttacacctctcatttttcaagtctgattacaccataaatacccctcttctaccttcttcttcttccataccaacaacaacaaacccatctctctttctctctctagaacttgtttttcttcttctgggtatcaatcatatcatggggaaggatattgaagtgagtgaacaaagtgggtttacaacaaaggattactctgacccaccaccagctccattattcgatcttgaagaactctcaaaatggtcattttacagagctttaatagctgagtttatagctactcttttgtttctttacattacagttttgactgtgattggttacaaaagtcaagtagccattagtggtgatgaatgtggtggtgttggtattcttggaattgcttgggcttttggtggtatgatctttgttcttgtttactgcaccgccggtatctcaggaggacacattaacccagcagtgacatttgggttgttcttggcaaggaaggtttcattgatcagagcggttctgtatatggtggctcagtgtttgggagcgatttgtggtgttgggttggtgaaggcgtttcaaaaggcttactacgtccgatacggcggtggagcgaacgagttggcccacggatacagcaaaggaaccggtttggctgctgaaatcatcggaactttcgttcttgtttacaccgttttctccgccactgacccaaagagaagcgctagagactcccatattccggtattggcaccactaccaattgggtttgccgtattcatggttcaccttgcaactatccccattaccggaactggtatcaacccagctaggagttttggagctgctgttatctacaacaaagacaaagcttgggatgatcagtggatattctgggtaggaccatttattggagcagcaattgctgctttttaccatcagttcatcctaagagcagcagcagttaaggcacttgggtcattcaggagcaatgctcacaactaaatcactccattatcagttctatattatggatgtttgaagagaaagagagatctatttgattaaggaattgaagaacccccatgaagaactgtagatatgaattgagaaaaagggtttttctttaaatgtgtgaaatctcttcttttctttgttatttagtgtcattgataatttattgtactttagtgtggggatgatttcatgtttaatattattattaattattattat

SEQ ID NO: 14887 - DNA, 1263 bp, Gossypium raimondii
tatatattcacacacaactcctccacttccccatcacaaaaaatatattcttcacttcacatcttttgggcaatcaattttgtaagcaagtatggctaaggacgttgaggttggtggtgagttccaagccaaggactaccatgatcctccaccagctccattagtggacggggaggagttgacaaagtggtcattttatagggctgtaatagccgagtttattgccacgctcttatttttatacatcactgtgttgacagtgatcggatacaagagtcaggttgaccctgataagggcagtgacgaatgcggtggtgttggcattcttggcattgcttgggcttttggtgggatgatctttatccttgtttactgcactgctggtatctctggaggacacatcaacccagcagtgacctttgggcttttcttggctaggaaggtgtccttagttcgagccatattttatatggctgctcaatgtttgggagccatatgtggatgtgggctagtgaaggcattccaaaagtcatattacaacaagtatggaggaggagccaacagcctcgctgatggatacagcactggaactggtttggcagctgaaatcattggtacctttgttcttgtctacactgttttctctgcaactgatcccaagaggaatgcaagagattctcatatccctgtcttggcaccacttcctattggatttgctgtgttcatggttcacttggcaactattccaatcaccggcaccggtatcaaccctgctcgtagttttggggccgctgttatctacaaccaggacaagccatgggatgatcattggatcttctgggttggaccatttattggtgcagccattgctgcaatctatcaccagtttatcctgagggcagctgctgttaaagctcttggatccttcaggagcagctctgccatgtaattaagcaatcattctccagccacaagtttaaacaaaaaaaaaaggggggggggtgggttgccatggaggattggattaagttttatcaatgtggtcaagaggctttttcagaccactcaatttgtaaattataatggaggatgtcatgcttttatgtatgtggcacttattttcaatgtgccccatcattatccctgcttttctttccttttttatggtctttctttgtttggcttggtgtttctaagttatctttgaaaattttataaaaatcaagtactttgtgttgctttatttatacaagtttaattcaa

SEQ ID NO: 14888 - DNA, 1277 bp, Papaver somniferum
cagaaaccaaacaaacatctctcattctctcactacttgctcttagtttttcaagtatgggtaaagatatagaaccaagtcatgaacaaggaggaggatatgcagcaaaagattaccatgatccaccaccagcaccattttttgacatggatgaacttacgaaatggtcattttacagagctttgatagctgagttcattgctactcttttgtttctttacattactgttttgactgttattggttacaagagccaaattgctggtggtgatgactgtggtggtgttggtattcttggtattgcttgggcttttggtggtatgatcttcgttcttgtttactgcactgctggtatctctggaggacacatcaacccagcagtaacatttgggttgttcttggcaagaaaagtgtcactaattagggcagtactctacatggtagctcagtgtttaggtgcaatctgtggggtcggcctagttaaagccttccaaaaatcttactacgttcaattcggtggtggagccaacgaattaaacgatggatacagcacaggaacaggattagctgctgaaatcatcggtacattcgttcttgtctacaccgtcttctcagccactgacccaaagagaagcgccagagattctcatatcccggttttggcacctctacccattggatttgctgtgttcatggtgcatcttgcaactatccccattactggaactggtattaacccagctagaagtttcggagctgctgtgatttacaacaaaaacaaagcttgggatgatcagtggatattctgggtgggaccattcattggagctgccattgctgcattttaccatcagttcattctcagggctgcagctgttaaggctcttgggtccttcagaagcaatgcccacaactaaatttccctttctggcagtgttttgtgagagagatgaaaattaatgaaggcaggagagtgagaaaggcttgaagagtggaactatagatatgaatcatttggaaatgaggaagaaaaggaagggctttattgattaattctctcttcactcctttgtgttttcatttcaattagttatctctcttttggtaatttaatgtatgtatctatttatgttggtgttgtgatctttcattttcctactttattaatgaattatgagttccatctaatttcagaaaatgaaaagagatctatctttattgtctatcatttactctatgctttggcttgcttggagtagcagctaagtttattctga

SEQ ID NO: 14889 - DNA, 1482 bp, Glycine max
ggtttattgctattaatatttggctctgtttttcagtgtcaaattgcattattgcaataatcaaatgcactaaccacactccatcacccccatatataccccttctcctctcacactaattaacacactcatcaaaaaacccttctttctttcaggttcattacttgatcagtgtcaaaagggtagttgcaaattgcaatggctaagcatgatgttgagggtggttccttctcagcaaaggactaccatgatcctcctccagcacctttgattgatgctgaggaactcacacagtggtccttctacagggctttgattgctgaattcattgccacattacttttcctttacatcacagtgctcactgtgattggttacaagagccagagtgatgtcaaggccgggggtgatgtgtgtggtggagttggcattcttggcattgcttgggcctttggtggcatgatcttcatccttgtttactgcactgctggaatctccgggggtcacataaacccagcagtgacatttgggctcttcttggctcgcaaggtatctttgattagagccataatgtacatggtggctcaatgcttgggagccatgtgtggagttgggttggttaaggcattccaaaaggcatactacaacaggtatggtggtggtgccaatgaactcagtgaagggtacagcacaggtgttggattgggtgctgagattattggaaccttcgttttggtctacactgtcttctctgcaactgacccaaagaggaatgctagagattctcatgtgccggttctggctccacttccaattggttttgctgtgttcatggttcacttggcaaccatcccagtcactggcactggtattaaccctgctaggagttttggagccgctgtgatgtacaaccaaaagaaggcttgggatgaccaatggatcttttgggttggaccgtttattggagcagccattgcagccttctaccaccaattcatcttgagagcaagtgctgctaaggctgttggatcattcaggagcaaccccactatttgagtcaatttcctcttcatggggggatagtggaaatggaaaaaaaatcatgggaagtgtttgtgctttgatcctctgtagattgaaggttctttaagacaatgaagcctttagtaaatagtaaaaaccctttagtatttgcaagcactttcctatgtatttccttgttagaattaagctttttcttgagatattggaagtaaaatctattagatgtcttgttttaatattttgtgatgtgtaataagttcgacatgttgttggtgaactagtttggtaacccatattttgagggatgctaggccaatgtcacactttttgcttgtgatattgtattttcaccaaaaacaagtcactgtatgtatgtttggaaaattaagaacgaaaatacactttcattccaccatagaagcttcgtgttctgttttt

SEQ ID NO: 14890 - DNA, 1748 bp, Glycine max
aaaagtgaggtaaaggtcggtgaaagcgagactcaaaccaaaaagtttatagctgttattaatttgtctttgtttttcagtgtcaaattgcactaatcaaatgcactaaccacactcaatcactcccatatatacataccccttctctcagtctctcacactaattaacacacatcaaaacaaccttctttctttcaggttcttgatcagtgtcaaaaccaaaagggtggttgcaaattgcaatggctaagcatgatgttgagggtggttccttcgctgcaaaggactaccatgatcctcctccagcaccattgattgatgctgaggaactcacacagtggtccttctacagggctttgattgctgagttcattgccacaatgctcttcctttacatcacagtgctcactgtgattggttacaagagccagagtgatgtaaaggctgggggtgatgtgtgtggtggagttggcattcttggcattgcttgggcctttggtggcatgatcttcattctggtgtactgcactgctggaatctcagggggtcacataaacccagcagtgacatttgggctcttcttggctcgcaaggtgtctttgattagagcaataatgtacatggtggctcagtgcttgggagccatatgtggagttgggttggttaaggccttccaaaaggcttactacaacaggtatggtggtggggccaatgagctcagtgaagggtacagcacgggtgttggattgggtgctgagatcattggaacctttgttttggtctacactgtgttctctgcaactgaccccaagaggaatgctagagattctcatgtgccggttttggctccacttccaattggctttgctgtgttcatggttcacttggcaaccatcccagtaacaggcactggcattaaccctgctaggagtctaggagctgctgtcatgtacaaccaacagaaggcctgggatgaccattggatcttttgggttggaccatttattggagcagcaattgcagccttctaccatcaattcatattgagagcaagtgctgctaaggctcttggatcattcaggagcaaccccactatttgagtcaatttcctcttcatggggggttagtggaaatggaaaaaaaaagataattggaggcaaaaaaagttgatattgcaacaataataataataatatggaactgtttgtgctttgatcctctgcagattgaaggttctttcaagaaaaggaagcctttggtaaatagtaaagaccctttagtacttcgaagcactttcctttgtatttccttgttagaattgatgagcttttttttgatatattggaagtaaaatctattagatatcttgttttaatattttgtgatatgtaataagtcgacttgttggtgaactagtgtggtaacccatgttttgagggatgctaggccaatgtcacactttttgcttgtgatattgaattttcacaaaaaaaaaaaaaaaatcaagtcactgtatgtatgttggaaaattcagaacgaaaatacactttcattccaccatagaagctttgtattctgttttttctctcttctcttgctattatttttctacatggtatcaagattcaattgagggtgagaaaatcagctagaataacttatacaaaccagaaaaaaaaaaaaaaaaaaacacaaacagtatgacatgcagtagcaattccttgcttccgcctccattatttgtaaga

SEQ ID NO: 14891 - DNA, 1228 bp, Fragaria vesca
tcatcacaaacactaacaatctttttcaaagccaacacaacactcactcactactctcttcctccgtctgattctacctcgatcaaccaagcttgttattatagccatgggccgcgatattgaagttggagggtttgctgccaaggactaccaagacccaccgccaacaccattaatcgatccggaggagttcggaaaatggtcgttttatagagccatcattgctgagttcgtcgctacgctcttgttcttgtacatcactgtgctcactgtgattggatacaaaagccagagtgacactctcaaaggtggagaccaatgtggtggtgttggcattcttggcattgcttgggcctttggtggcatgatctttgtccttgtctactgcactgctggaatctctggagggcacataaaccctgctgtcacatttgggttgtttttggcaaggaaggtgtcactacccagagctgtattgtatattgtggctcaatgcttgggagcaatatgtgggtgtgggcttgtgaaatcattccagagtgctttgtacagcaactacggtggtggagctaatggactagctgatgggtacagcgaaggcactggattggctgctgagattataggcacctttgttcttgtctacactgtcttctctgccaccgatcccaagagaaatgcaagggactcccatgtcccagtattggcaccactaccaattgggtttgctgtgttcatggttcaccttgccacaatcccaatcactggcacaggtatcaacccggctcgaagtttcggagctgcagtgatatacaacaatgagaaggcttgggatgaccattggatcttctgggttggaccctttattggcgcagccattgcagctttgtatcaccaaaacatattgagagcaggagctgctaaggcttcgggttcttttaggagctcttccaacgtataattctatcaaggagaattgaagcgttttctattggtgtggccgtgtggccgtgtgggagacttcggaagtttgaaccatggaatttgtaaattgttgtgctgatatgtccctatgtgaacaaatccaggcactcgttctaaatgtgccttagttatgctctgttttcctctgttctttctacctttcagtttttgtgcattcattttgtttaccaagaaatgaatgatctaggtttgtctcttttccttttggttcttatattatgca

SEQ ID NO: 14892 - DNA, 1283 bp, Citrus clementina
ctggttcactcatcttcatcactaaaaaaagtccacacatctctctcttctctgcaaaaactcttaaaattatcagtgaagagcaatctctagcaatggccaaggacattgagattggtgggcaaggcgagttccatgccaaggattaccacgaccctcctccagctccattgatcgatgccgaggagctcacccaatggtcattttacagggctactatagctgagttcatcgccacgctcttgtttttgtacattactgtgctgacagtgattggttacaagagccagactgacgccaaccacggcggtgatggatgtggtggtgttggcattctgggcatcgcttgggcctttggtggcatgatctttgttcttgtttactgcactgctggtatctctggtggacacattaacccggcggtgacatttgggctgttcttggcgcggaagttgtcactggtgcgagccgtaatgtacatggtggctcagtgtttgggagccatatgtggctgcgggctcgttaaggctttccagaagtcttactacacgagatacggcggtggagccaatgagctcgctgatgggtacagcactggcactggattgggtgctgagatcatcggtacctttgttcttgtctacactgttttctccgccactgatcccaagagaaatgctagggactcccacgttcccgtcttggcgccattgccaattggatttgctgtgttcatggttcacttggctacgatccctgtcactggaactggcatcaaccccgttagaagggagctgcagtgatttacagcaaggagaaggcttgggatgatcaatggatcttctgggttggccccttcattggtgctgcaattgctgcattttaccaccaattcatcctcagagcatctgcttctaaagctcttggatccttcaaaagctcctccaacatttaattaacttttaaaataattactggaggattaatcaatggctgtcaagcggcttcgcgactatagaatttgtacattgttttatttgcatcagtatttagtatagctggtgtagatcccgcagcactttgtgtgtgtcttttgtttacctgaggacactcgtttttagtgtgccccaaaaattgttatttgctttgctttccttcccctttcgacttctgtactcgtggttttatctgaaatttcaatattgagtgctttatggtatacaaatgtgcccattaaataaaaggtgagggtgattcccttcaaatagaacatagtttatgtt

SEQ ID NO: 14893 - DNA, 906 bp, Ambrosia trifida
aaagcctttaaagagtaactaaaagactatacttactcttgactaatattatacgacaatgggcaaagaatgttgaggttggcgagcacgagtatggagcaagagattaccaagaccctccaccggctgacctcttcgacgcggaggaactcaccaaatggtctttttattagagccattattgctgaattcgtcgctactctccttttcctttacatcactgtcttgactgtcatcgggtacaagtcccaaaccgaccccaagcatagtgttgaccaatgcggtggtgttggcattcttggcattgcttgggcctttggtggcatgatctttgtcctcgtctattgcactgccggcatctcgggtggacacattaaccccgcggtgacatttgggctatttttggctagaaaggtgacactccctagggcgttcatgtatatcgtggctcagtgcttgggtgccgtatgtgggtgtggtctggttaaagctttccaaaagacttactaccatacttatggtggtggtgctaatgagctcgcagatggctacagtaaaggcaccggcttgggtgctgaaatcattggcacatttgtccttgtttacaccgtcttctctgccactgaccccaagagaaatgcacgagattctcatgtcccagtattggcacctctccctatcggatttgccgtattcatggttcacttggccaccatcccaatcactggcaccggaatcaacccagctcgtagttttggtgcggccgtcatgtacggaaagacaaagcttgggatgatcaatggttatctggtgggccgatgatcggagccgccatcgctgccttctaccaccagttcatattgagggcaggcgcagtcaaagctcttggatcctctaggagcatat

SEQ ID NO: 14894 - DNA, 897 bp, Taraxacum officinale
gcggggatcctcccacttccccaccacccaactctctctctctctacaaaataaagcaacatgacgaaagatgtgccggagcaaggttcgctctccgcaaaagactaccacgacccaccgccggcgccgttcatagacccggaggagctgacaaaatggtccttctacagagctctcatcgctgagttcatcgccacccttctattcctttatatcactgttttgacggttattggctacaagagccaaaccgacccagccctgaacgccgaccagtgcggcggagttggtatcctcggtatcgcctgggctttcggcggcatgatctttgttcttgtttactgcaccgccggtatctccggtggtcacattaacccggcagtgacttttggtctgttcttggctcgaaaagtgtcattgatccgtgcaatcatgtacatggtggctcagtgtttaggagccatttgtggtgtgggtttggtgaaggctttccacaaaagctactacgtcaggtacggcggaggagccaacgaactcgccgacggctacaacaccggcaccggactaggcgctgagatcatcggaacttttgtcctcgtctacaccgtcttctccgccaccgaccccaagaggagtgcccgtgactcccatgttccggttttggcaccactccccatcgggtttgcggtgttcatggtgcaccttgccactattccgatcaccggtaccggaatcaacccggctagaagtcttggagctgctgtcatctacaacaaggctaaagcttgggatgatcagtggatattctgggtggggcccttcatcggagcagccattgcagccttctaccaccagtttatattgagagcaggtgcaatcaaagcccttggatctttc

SEQ ID NO: 14895 - DNA, 1467 bp, Eucalyptus grandis
atgaaagagttggggaaggagggagagagaggtgatgatgatgggtgggaggtcgcgtggggaagtcagtcagcaggggtcggtgcgggaaagcgaaacgcaacgaaaagattgtcgattggcgttttcaggggggcgcaatttgcagtaaaatacacttcacgggatcaacattcacaaaaaagagcaatccccttttgcccgaaaaacgtgataccttcacttcccacagacaagtggacaagagaaaactctctctctctctctctctctctgcgattcgccaagaacaccagcatgacgaagcacgcggcggagcacggctcgttctcggccaaggactaccaagaccccccgccggcgccgctgatcgacccggtggagctgggcaagtggtcgttctacagggccctcatcgccgagttcatcgccaccctcctcttcctctacatcaccgtgctgaccgtgatcggttacaagagccagaccgacgacaagaagcccggcaccgacgcctgcggcggcgtcggcatcctcggcatcgcctgggccttcggcggcatgatcttcgtcctcgtctactgcaccgccggcatctcaggtggtcacatcaacccggcggtgacattcgggctgttcctggcgcggaaggtgtcgctggtgcgggccataatgtacatggtggctcagtgcctgggggccatctgtggagtcggcctggtgaagctcttccagaagtcgtactacgagcagtacggcggcggggccaacatgctcgccgaggggtacaagacccgcgtcgggctgggcgcggagatcatcggcacgttcgtgctagtctacaccgtcttctcggccaccgaccccaagaggagcgccagagactcccatgttccggttttggctcctctgccaattggatttgcggtgttcatggttcacttggccaccattcccatcaccggaaccggcatcaacccagcgaggagtctcggcgctgctgttatctacaacaaggataaggcctgggatgatcagtggatcttctgggtaggaccattcattggggcagccattgcagctttctaccaccagttcatactgagggcaggagcagttaaagctcttggatcattcaggagcaacccttagtctattttcacagcttgttactgcccttctccttctattttgttctctcatgagggaaaacaaaaaagacaaaagagagggggaaagagagagagagagagaagagagagaagagacttggaaggagattgtgataaagtcacatggtggtggggggattttctttaatcataaactgtagagagatggaaaatcctttgtgttatggtgcgagggggggccgtatgtaactgtgtcttttgttctttgtatgctgtgcactacattcatatgtgaattctctcttctgtttcgttgctatcttctgttggtgct

SEQ ID NO: 14896 - DNA, 1250 bp, Castanea mollissima
ggggcatcaacattcaacaacaacactagcttaggactctctctcacttgctcatcatctcctagctctctctcccttcttctgtcactactactcaccctagcttttagctatggctgccaaggatattgaagggttcccatctaaggactaccatgacccaccaccagcaccattggttgatgctgaggagcttacacagtggtccttctacagggctataattgctgagttcattgccactctcttgttcttgtacatcactgtgttgactgtaattggatacaagagccaagttgaccattctactgatccgtgtactggtgttggaattcttggcatagcttgggcctttggtggcatgatctttgtgcttgtttactgcacagctggaatctcaggtgggcacattaaccctgcggtgacattcgggctattcctggctagaaaggtctcgctggttagagccatattgtacatggtagctcagtgcttgggagccatatgcggatgtgggcttgtgaaggcattccagagggctttctacagcaagtacggtggtggagccaacgagctcgctcttggatacagcaagggcaccggattggccgccgagatcatcggtacctttgtgcttgtttacactgtgttctctgccactgatccaaagagaaatgcaagggattcccatgttcccgtcttggcaccacttccaattgggtttgctgtcttcatggttcaccttgccaccattccaatcactgggactggtatcaaccctgctagaagtttcggggctgcagtcatctacaacgagaagaaggcatgggatgaccaatggcttttctgggtcggaccattcatcggtgctgccattgctgcattctatcaccagtacattttgagagcaggagctattaaagctctagggtccttcaggagctcttcggccatgtaaactacctaatggtgtttctggtaatgaggttggttcaaagaggaatggcattttctatggtcatggagggaggcttttggaaccgtggaatttgtacattgtaatgtctaaggcaaagaatgccctgtttttctttctttcgtttcctgggtactcgttttttatgtgcccaaagtgttgttgtctatcctatattccgtttgacaaatgtgtactcgtaatgttgaattttatgagcaactgctttatgttactttctgtttatcactctttttataacttcatttggaaa

SEQ ID NO: 14897 - DNA, 1065 bp, Cichorium intybus
acagcgcaaaagattaccaagaccctccacctgctcaactctttgacgccgaagaactcacgaaatggtctttttacagagccatcattgccgagttcattgccaccctcttgtttctttacatcaccgtcttgactgtcatcggctacaaggcccaaaccgatccagctcacagctccgaccagtgcggtggcgtaggaatcctaggcatcgcttgggccttcggtggcatgatcttcgtccttgtttattgcaccgccggcatctctggaggacatatcaaccctgcggtcacatttgggctgttcttggctagaaaggtgacactccccagggcagtcttgtacattgtagctcaatgcctgggtgctatctgtggttgtggtctggttaaggctttccagaagacctactatcatacttatggtggtggcgccaacgagctcgccgatggctacagtaaaggaactggactgggtgcagaaatcatcggcacatttgtcctcgtatacaccgtcttctccgccactgacccaaagagaaatgctcgcgattcccatgtccccgtgttggcacctcttcctatcggatttgctgtgttcatggttcacttggccacaatcccaatcaccggcaccggaatcaaccctgctcgtagttttggtgcagccgtgatgtatggaaaagacaaagcctgggatgatcaatggatattctgggtgggacctatgatcggagctgccatcgccgccttctaccaccagtacgtattaagagcaggggcggtcaaagctcttggatccttcaggagcaatgcctagggcataaacatgaaccttgcaatagtttccaagaaattgtacaaatttgcgttgcttttattagagtttatctctaaaatgtatttggtaattggggccattggtttttgaatgtgcccaataaagtccctctactatatttttatgtgcattttgtcccttttgttttcaatgtaattggtcgaagggtttatttgctacccaaatgctaatatccaaagcgaggggttgtatcatcgtttta

SEQ ID NO: 14898 - DNA, 1185 bp, Eucalyptus grandis
atggggaaggacatggaatctggggagccgccgttcggcgccagggactaccaggacccgccccccgcccctttggtcgacccggaggagctgggcaagtggtcgttctaccgcgccctcatcgcggagttcatcgccacgatgttgttcctctacatcaccgtcttgaccgtgataggttacaagagtcaggtcgacccggccttgaacggcaccgagtgtgacggtgtcggtattcttggcatcgcatgggccttcggaggcatgatttttgtcctcgtttattgtaccgctggtatttctggagggcacattaacccggcggtgaccttcggtctcttcctggcgcgcaaggtgtcgctcgttcgggctgtgatgtacatggtagcgcagtgccttggcgccatttgcgggtgtggactggtgaaggcgttccagaaggcgcgctacacccggtacggtggcggcgcaaacgagctgtccgatgggtacagcaagggcgtggggctaggggcggagatcatcggcaccttcgtcctggtgtacaccgtgttctcggccactgatccaaagcgaaacgccagggactctcacgtccctgtgttggcaccgttgcccatagggtttgcagtcttcatggttcatctggcaacaatccccgtaacgggcactggcataaatccagcaaggagcttaggagctgctgtgatgtacaacaaggacaaggcttgggacgaccagtggatgttctgggttgggccattcattggggctgcgattgctgcattctactaccagtacatcttgagagctggagccgtcaaggcctttggttcctccaggagcaacgcgtgaaactcaggataagttttttaattcctccgtttcaagggccagagctggatcaaggggagggtcacagcaaaatgtggataaaaaatttgcccttttggagtgtgtcttgcttcttgtcttctgatttttcttttttgttttcccaactctctgatcttttagctgtattcccgagtgctggttgttgtggtcatttgctgttctcttctcttttcgactttgcaagtggtgtgatgggttgcaacaatgcaaatatgttaattttctagtaacttctctctttgcattgtgctatatataagccatgctcttaatggtaagttttcgtaa

SEQ ID NO: 14899 - DNA, 1015 bp, Valeriana officinalis
tgaagttgcagagttcactgctaaggattaccaagatccgcctccggtcagtttgtttgactccgaggagttgactaaatggtcgttttatagagcgataatcgcagagtttatcgccactcttttattcctttacattacggtgttgactgtcatcggatacaaaagtcaaactgatccattaaaaggaactgatcaatgtggcggtgttggtattctcggtattgcttgggcttttggtggcatgatctttgttcttgtttactgtacagccggtatttccggtggtcatattaatccggctgtgacattcgggttgttcttggctcggaaagtgtcgttatgtagagcagttctgtacatgatagctcagtgtttgggagccatttgtggatgcggattagtcaaagctttccaaaaaacgtactacaactcatacggtggtggtgcaaacgagcttgctctcggttatagtaaaggcaccggtctggctgctgagatcatcggaacttttgttcttgtctacaccgtcttctctgctaccgatcccaaaagaaacgctcgtgattctcatgttcctgttcttgcaccacttccgatcgggttcgctgtttttatggttcatttggccacaatcccaatcaccggaaccggcattaaccctgcacgtagttttggagctgcagtgatttatggaagagagaaagcatgggatgatcaatggatattctgggttggaccatttattggagcagcaatagcagcaatttaccatcagttcatattgagagcagcagctcttaaagctcttggatcattcaggagcaatgcttgatttgttgttatttcttgaatttcaaatttaagttatccaaagggatttgaaaaaaaaaaagttgtaattaagtgttgtatttcaaattttaggatgtgagtttggcaaatgttgcatcttttgtttttttcagttgggtatgatgcttttcagttttggcatcaaaataataaaattttt

SEQ ID NO: 14900 - DNA, 956 bp, Rosa hybrid cultivar
gaatctccatccacacacaaacacaaccacttcttcttctcctcccttgtttatttgtaactacagccactcacagctaaggccatggcgaaagatgttgagggagctgagcacagtgagtttgcggcaaaggactaccatgaccctcctcctactcctctttttgacgccgaggagctgaccaaatggtcattttacagagctctcatcgcagagttcattgctacgcttctgttcctttacatcacggttttgactgtgattgggtacaaagaacagagcaaactcgaccagtgcggcggtgttgggattctcggtatcgcttgggccttcggtggcatgatcttcgtccttgtttactgcaccgccggtatctccggaggacacatcaacccagctgtgactttcgggctattcttggcacgcaaggtgtcgctcctcagggctgtgctctacatagttgcacagtgtctgggtgctatcagtggtgtagggttggtcaaggcctggcagaagaccttgtacgtcgagcatggtggtggagccaatgagttgtcccctgggtacagcaagggcatcggattggcggctgagatcatcggcacctttgttcttgtatacactgttttctctgccactgaccctaagagaaacgccagagactcccatgttcctgtcttggcaccacttcccattggatttgctgttttcatggttcacttggccaccattcccattactggcactggtatcaaccctgctagaagttttggagctgctgtcatctacaaccaagacaaagcctgggatgaccaatggatgttctgggttggacctttcattggagctgccattgctgccttttaccaccaatttgttctgagagcaggagcaattaaggccctagggtctttcaggagcaatgcttaattaagcatgatttccacccatgcttg

SEQ ID NO: 14901 - DNA, 1549 bp, Eucalyptus grandis
taatcatgtcattagccacacataatccctcccttctttattccccaagtcccctctcctttcaatcttaaataccctcttttcgccctccactttccctcactcccactctctaatcaacaagcctagccaaaacccaccccagcttttctctcgttctatccattcccccatcttccacaccacaggaggaaagaggtcagtctccgatggcgaaggacgtcgaggtggcggagccagccgagtttgccgccaaggactaccacgacccgcccccggcaccgctcttcgacgccgaggagctgacaaagtggtccttctacagggccctcatcgcggagttcatcgccacgctgctcttcctgtacatcacggtgctgacggtgatcgggtacaagagccagaccgatcccgccctcaagggcaccgactgcgacggcgtcggtattctcggcatcgcctgggcctttggcggcatgatcttcatccttgtttactgcaccgccggcatctccggagggcacatcaacccagcggtgacgttcgggctgttcttggctcgcaaggtgtcgctcatccgggcggtgtcgtacatggtcgcgcagtgcttgggcgccatctgcggttgtgggttggtgaaggccttccagaaggcatactacaccaggtacggcggtggagccaacgaagtgcaacccggctacagcaaggggactgctctcggcgcagagatcatcggcactttcgtcctggtctacaccgtcttctctgccaccgaccccaagagaaacgccagagactcccatgtccccgtgttggcaccacttccaatcgggtttgctgtgttcatggttcacttggccacaatcccggtcaccggcaccggcattaacccggccagaagttttggtgctgcagtcatgtacggccatgacaaggcctgggatgaccagtggatcttctgggttggacctttccttggggcagcagccgctgcattctactaccagttcgtcctcagagcagctgccatcaaagcccttggatccttcaggagcaatgcttaaatcattagctcccgtgttgagttcttttaaaaaatgatgaagaggggaaaccatgaagaaagaaaaaagaaaaaaaagaaaaagaataacattgaagggggataaagcatgtatcttttagatcctttgcatgatctctagctgtttctttatccctttcctgggtttgagatgtagcaagaaatgggctgcaaggagaaagaaaactgtaaataaaaattcaatgtggggggcaagagtcaagggtcaagagagtgtggtttggaagtacccatcttctggttttctttttcaagctttgctttgtatgtattttattagagggtgttgttgtctgcttctgctgtcaagtttctgttatccttcttatctattcttctttacccaattggcgtgcttggtgttaattctattcatatagagtgaatttatgttttctatcaaccataattaattcacccattcagagatctttcttacgc

SEQ ID NO: 14902 - DNA, 1361 bp, Cannabis sativa
caaatatttatgttttatttcgtaagaattaaaaaacatttataaaaaaaataataatgacgaaaattctcacatatatatagggctttcgagtggttcaattaccacaaatcaaaacgacttgactatctcagtagcctgggcttagcaggaaacgacgctatttttgcttctttttttctttctttctttgttcttttgtgtgttaacaacaatggtgaaggacgttgaagtgggaggacagcaagggtactcggccaaggactaccaggacccgccaccagcaccattattcgacgccgaagagcttggtcagtggtccttttacagggctatcattgctgagtttgtggccacgcttttgttcttgtacatcacagttttgacagtcatcggttacaaaagccagactgatccagccaaaagcgccgatgcctgtggtggcgtcggaattttgggtattgcttgggccttcggtggcatgatcttcgtgctagtttactgcacagccggaatctctggaggacacattaacccagctgtgacttttggactgttcttggcaaggaaggtgtctttggtacgaaccattttgtacatagtggctcagtgtttgggagccatctgcggatgtgggctagtgaaggctttccagagtgcttactacgataaatacggcggaggagccaactcccttgccgatggatacagcaccggtactggacttgctgctgagataatcggcacctttgttcttgtctacactgtcttctctgctactgaccccaaaagaagcgcaagagactcccatgttcccgtcctggcaccacttccaattgggttcgccgtgttcatggttcatcttgccaccatccccatcactggtactggtatcaacccagctagaagtttcggagctgcagtgattttcaaccaggagaagccatggaatgaccactggatcttctgggtgggaccattcattggagctgccattgctgctttctaccaccaatttgtattgagagcagccgctgtcaaagctcttggatcattcagaagcaccaataccatgtaatctggaacagagagcaatcaaagtatcagtttttctcttatctgggcactagtatatttcaaaaacgaaaagatcaattacatgttctaaattctcacaaggaggtttcatttggatcgagcttggtgtttatgtatatgatttttaagtatctgttgtaattttctgtcttggggacctgttttagatgtgccccttttctttgttttttctttctgctttgtttcttcttcttcttctttttcatctccttttacgagtgtctgtatccttatattatcag

SEQ ID NO: 14903 - DNA, 1008 bp, Ricinus communis
aagcaaattatttatctattaaagcaagcaatggcaaaggatgttgaagttgcagaggctactggaggagaattctcagcgaaagactaccatgaccctccgccagcaccattgattgatgttgacgaactgggtaaatggtccttttacagggctcttattgcagagttcattgctacacttcttttcctttatatcacagtgttgactgtgattggttacaagagccagactgatcctgacaagaacgctgatgcttgtggtggtgttggtattcttggtattgcttgggcttttggtggcatgatctttattcttgtttactgcactgctggtatttctggaggacacatcaatccagcagttacctttggactattcttgggtcgcaaggtgtccctaatcagagcccttggatacatggtagcacagtgtttgggtgcaatctgtgggtgtggattggtgaaggcattccaaaaagcttactacaacaggtatggtggtggagcaaacgagctagccgatggatacaacaaaggaactggattgggtgcagaaattattggtacttttgttcttgtctacactgtcttttctgctactgatcctaagaggagtgctagagactctcatgttcctgttttggcacctctccccattggatttgctgttttcatggttcatcttgctactattccaattactggcactggcatcaaccctgctaggagttttggagctgctgttatctataacaaagaaaaggcctgggatgatcagtggatcttctgggttggaccatttattggagctgccattgctgctttctaccaccaatacattcttagagcagcagccattaaagctctaggatcattcaggagcaatgcttaagctaatttcttggattaaagatggtgatgatgatgatgcttgagaagaataacaatggatggtgaatgcaagttgtttttctttaagggttccttttatcaaatttctcttttc

SEQ ID NO: 14904 - DNA, 1265 bp, Populus trichocarpa
acattagtaatagcctttctctacatttgaagttgaggtagctaagtatggcgaaggatattgaggttgcagagcatggagagactgtgaaggactaccaggacccacctccagctccattgattgatgctgaggagctaggacaatggtccttttacagggctcttattgcagaattcatcgccacccttctcttcctttatgtcacagtcttgactgttattggatacaaaagccagacagacccagacaagggtctggatgcttgtggtggtgttggcattcttggtattgcttgggccttcggtggcatgatctttgtccttgtttactgcactgctggtatctctggaggacacatcaacccagcagtgacctttggtctgtttctggcgaggaaggtgtcgctcatcagggctgttttgtacatggtggcacagtgcttgggtgcgatatgcggctgtggtttggtgaaggccttccaaaagtcttattacaatcactatggaggcggagccaacgagctgcaggaagggtacaacaagggcactggattgggtgctgaaatcatcggtacttttgttcttgtctacactgtcttctccgccactgatcccaagaggaatgctagagactcccatgttcctgtattggcacctctccccattggatttgctgtgttcatggttcacctcgccacaatcccaattactggtactggcatcaaccctgctaggagcttcggagctgctgttatctttaaccaaagcaaggcctgggatgaccattggctcttctgggttggacccttcattggagctgccattgctgctttctaccaccagttcattcttagagcagcggctattaaggctctaggatccttcaggagcaatgcttaaagccttctcaaattaatcaagggtcccttgtgcaattgggaaaactctctctttgccttctcatgggaaatttagatggcagtggaattataaataataataattattaaaaaaaaaaaaaagtcttctcaatccctgttggtttttgctattattgtatttctcagttgggtcatgttatgtctatccttaatctttctcttcctttttaaccatcttttcttgtcgtggttcctgttatttcaacatcattaatctggtgaaacgaactggtcttcttctctgtctgcttgattgtctatgttttccacgtaattatggtgaaatgcatagttgtcttaccggcttaaacatagcttgtct

SEQ ID NO: 14905 - DNA, 1246 bp, Taraxacum officinale
ctcacaaacacagagaaacacacaaatcattgagaaatgggcaaagatgtcgaggttggtggtggtcatgaatacaccgcaaaagattaccaagaccctccgcctgctgccttctttgacgccgaggaactcaccaaatggtctttctacagagccatcattgcggaattcgtcgcagccctcttgttcctttacatcaccgtcttgactgtcatcggctacaaggcccagaccgatcccctccacagcgacgaccagtgcggcggcgtaggaattctcggcatcgcgtgggcctttggtggcatgatcttcgtcctcgtttactgcactgccggcatctccggaggacacattaaccctgcagttacttttgggctgtttttggcaaggaaagtgacattcccaagggcagtcttgtacatcgtagctcaatgcttaggtgctatttgtggttgcggtctggtcaaggctttccagaagacatactataatacttatggcggtggcgccaacgagctcgccgacggatacaataaaggaacaggattgggtgctgaaatcatcggaacatttgttcttgtatacaccgtcttctccgccactgaccccaaaagaaatgcgcgcgattcccatgtccctgtgttggcacctcttcctatcggatttgctgtgttcatggttcatttggccacaattccaatcaccggcaccggaatcaaccctgctcgtagttttggtgctgccgtcatgtatggaaaagacaaagcctgggatgatcagtggatattctgggtgggaccgatgatcggagccgccatcgctgccttctaccacatgttcgtattcagagcagcggctgttaaagctcttggatccttcaggagcaatgcctaattaggcaagagcatgaagttcgcaatatcatccatgtttccaagacattgtacaaatttcttttgtttttatttggtaattagggcccatggtttttcaatgtggccaataaggtctcttgacaatggtttatgtacatttagtcccttttgtttgttgtaattgttcgaagggtttatttgctacccaaatgttaagataccaaggaaggggttttgtcatcgattttcacacgcttcctaacggaccattacatgattgttggagtggtatagtttctgagagttgtttgcaaatggttaaaaatagattgtaaatgcgcaaagaaagttcgaaaaaaaaaaaaaaaaaa

SEQ ID NO: 14906 - DNA, 1366 bp, Fragaria vesca
tctgtttatataaccccacttctcctcactctctcccacacccaaaaccaaagctctatcttcatcttcttcttctctgaaactctgtgctttcttgtttaagctttaatggcgaaagacgttgaagttgccgagaggggttccttctcagccaaggactaccaggaccctcctccagctccgctcttcgactcagttgagctgaccaaatggtcgttttacagagctgtcatagctgagttcattgctactcttctgtttctctacatcactgtgctgactgtgatcgggtacaagtcccaaatcgacctcggcggcgacgcttgcggcggagttgggattcttggtattgcctgggcctttggaggcatgatcttcatccttgtttactgcactgccggaatctcagggggtcacattaacccagctgtgacttttggactgttcttggctcggaaggtgtcgttggtccgagctgtgatgtatattgttgctcagagtttgggtgccatagccggagttgggctagtcaaggctttccagaagtcttactacaccaagtatggtggaggagccaatgagcttgctgaagggtacagcaccggagttggattggctgctgagattattggaacctttgtcctggtttacactgtgttctctgctactgacccaaagaggagtgcaagagattcccatgttccggttttggcaccacttccaattgggtttgctgtgttcatggttcacttggccaccatcccaatcaccggcactggtatcaaccctgcaagaagtcttggagctgcagtaatctacgacaagaagaaagcttgggatgaccaatggatcttctgggttggacccttcatcggtgccgcaattgcagccttctaccaccaattcatcttgagagcaggagctgttaaagcgctcgggtcattcaggagcaacccccataattgaacattttcagagtcacaatgaaagatgttgcttccacttcatcatggtttcaggcctttcaggttgggaaacaatgaagaagagtctatgcactttggaaagaataacggggtagtacttgtggtagctagcttattatgcttgtgtatggaggttaaatttcttttcctggtatctcaatttggtccagtagagggattgagtgagcctttgaattgtagatataatcagggtggagaagggggagctttttgtgtacccctgatgtttgtttaagcactttcctttcaatctactttcaatgttattgtcatcagtctttctccatgattcttctttatggctattattatgctttcaaggaaagtttataactatggggtcagtttggatttgaatt

SEQ ID NO: 14907 - DNA, 1159 bp, Panax ginseng
ttctattgccaaaactcctctgcttatttctccacctctatatatcatttctatatacacatatctcttgttaatatgacaaaagacgtagaggtggcggagcacggctcattctccaccaaggactaccacgagccgccaccggtggcgctgtttgacccggatgagctaacacagtggtctttctacagagctctcattgcagagttcattgccacctttttgttcctttacattacggtattgaccgtgattggttacaagagccagattgatccaaccaatgatggggaccaatgcggaggtgtcggaattctgggtattgcttgggcttttggcggcatgatctttgtccttgtttattgcaccgccggtatctctgggggtcacataaacccagcagtaacatttgggttgtttttggcccggaaagtgtcactggtccgagccattatgtacatggtagcccagtgcttaggggccatatgtggagttgggcttgttaaggctttccagaagtcttactaccagaggtacggaggtggggccaatgggctgaacgatggatacagcacaggcaccggattggcggccgagatcatcggaacgtttgttcttgtctacactgttttctcagctactgatcccaagaggaacgccagagattcccatgttccggtactggctcctctcccaattggatttgcggtgttcatggttcatttggccaccatccccatcaccggcaccggcattaaccctgcaaggagttttggagctgctgtgatttacaacgaggacgaggcttgggatgaccaatggctattttgggttggtcccttcattggtgcagccattgcagcattctatcaccaattcatattgagagcaggtgccattaaagccctcggctctttcaggagcaatgcttgattttaatatttaagagccgttttcgtcttttttatttgtcaatttggcaagaaaaatagttatgagagagaaggcaatagtattttcataagaataagcaaggaatatgtgtttgtgtatgaagtttccttgtctttcactatctcaactgttcttcaaggttgaaagggggatggatggggaattaagtgatagtcatggaaactagtgtagatatcattaatgt

SEQ ID NO: 14908 - DNA, 1083 bp, Guizotia abyssinica
aggcaacaatgactaaagacgttgaagtggcggagcaccacggcggaaaagactaccatgacccacctccggcgccgttgatcgacgcggaagagctgactaaatggtctttctacagagctctcatcgccgaattcattgccacactcctcttcctttacgtgacggtgttgacagttatcggttacaagagccagagtgcgacggatgaatgcggcggcgttggcatcctgggcatcgcttgggccttcggtggcatgatcttcatcctcgtttactgcaccgccggaatctctggaggacacattaacccggctgtaacattcggactatttttggcaagaaaggtgtcattgattagggcattgggctacatggtagcacaatgtttgggtgccatatgcggtgtgggtttggtcaaagcttttcaaagttcatactacaacaagttcggtggtggggccaacgagttatccgcggactacaacaaaggcactggtctaggtgctgaaattatcggcacctttgttcttgtgtacactgtcttttcggctactgatcctaagagaagtgctcgtgactctcatgtccctgtattggcaccactgcccatagggttcgcagtcttcatggtacatttggccaccattccaatcaccggcaccggaatcaaccccgccagaagctttggcgccgctgtgatttacaacaacgagaaggcatgggatgatcaatggattttctgggttggaccctttgtgggcgcagcgatagcggcgttctaccaccagtttgtactgagagcggcggccattaaggcacttggttctttcagaagcaatgcataatttggaagatgatgaatatatccatgcaaaaagaataagattgatcggtcattagaaattgaaatgaatggatatatatgagtgtggaagtgtttaattgtagatacatgtttttaatattccgtaattttatcttgttttctatttattttcactttttgttgtgaatcttgaatgtttaataagtggtctttttttatcccttcatttatgtggttttacgttattttataaa

SEQ ID NO: 14909 - DNA, 1337 bp, Quercus alba
cttctttcccttctaaaactctctatttctagctcatactacttgtaaagcttaagtgatcactatggcaaaggacgttgaagttgcagagcgaggagagtactcagctaaagactaccatgacccacctccagcacctttgatcgaccctgaggagctaacccagtggtccttttacagagctcttattgcagagttcattgccacgcttcttttcctttacatcacagttttgactgtgattgggtacaagagccagactgaccccctcaagaacgcagaccaatgtggtggggttggtattcttggtattgcttgggccttcggtggcatgatcttcgtccttgtttactgcaccgccggtatctctggaggacacataaatccggctgtgacattcgggctgttcttggcgaggaaggtgtctctgatccgagcagtgttgtacatggtagcacagtgcttgggagcaatctgcggtgttgggctggtgaaggcgttccagaagtcactctacaccaggtatggaggtggagccaatgagctggcagctgggtacaacaagggaactggactgggggcagagataattggtacctttgttcttgtctacactgtcttctcagccaccgaccctaagaggaacgctagagactcccatgttcctgtattggcaccccttcccattggatttgctgtattcatggttcacctagccacaatcccaatcactggtactggtatcaacccagctagaagctttggagccgcagtgatcttcaaccaaagcaaggcctgggatgaccattggatattctgggttggaccttttgttggagctgccattgctgccttctaccaccaattcattcttagagcagcagctattaaggctctaggatccttcaggagcaatgcttaagttttaagcttttcaaaccaattatgtattaagatggagatgggtgtttcaaagtgaataacaatactaaggagtgcaagtctgtctgagggtccctttagcaatcctcaatagtcatggaggtccatggaattgtagataaacgtgtctgtgggacaggacagggggggctgccttttgtgtatccctttcctttttctcttttcttttctttcatgtatttatgtggtgatagttgtccttgtttatccttgaatcatcttttactttttgctttttctatgtggttgtgtattcgtgttgtttcctcacaaaagctagtgaaaatggaattgtgttcatcagtctcaatctcaaattctcagtcacctttcatttgctttatagtcaagtcttcttcatacttgcaaattac

SEQ ID NO: 14910 - DNA, 1156 bp, Tabernaemontana elegans
acaattcttcttcttctgctactcctcctctcctcctcattgcaatcagattaactagcatttttcttgttcaaatcttgtgcgagggcaaatggcgaagaacattgaggttggcggccccgagtatgctacaaaggactaccaagatccgcctccagagcctcttattgaccccgaggaactcaccaagtggtcattctatagggccgtcattgctgaattcattgccacgctcttgtttctctacgttacagttctgacggtcattggatacaagagccaaaccgacttgaaaagtggaggagatcaatgtggtggtgttggcatcctcggcattgcctgggcttttggcggcatgatctttgtccttgtttactgcactgctggtatttctggtggacacattaacccggctgtgacatttgggctgttcttggcacgtaaagtctcgctaattcgagcaatcatgtatattgtggctcagtgcttgggggcaatctgtggttgtggcctggtgaaggctttccaaagggcttactatgtcaggtacggtggtggtgccaacggggtcagtgctgggtacagcagaggcaccggattggcagttgagatcattggcacattcatccttgtttacaccgttttctctgccacagaccccaagagaaatgcacgagactcccacgttcctgtactggctccactcccaattgggtttgctgtattcatggttcacttggctacaattccaattactggcaccggtattaaccctgctcgaagctttggagcttctgtgatctacagcaaagcttgggataatcactggatcttttgggttggacccttcatcggagctgccatcactgctttataccaccagtacgttttgagggcaggagcagtgaaagctcttggatcattcaagagcacaacatactaaaggatcatcctggaaacgttgcaggaaaactcaaggggcttttcatttgcaagttgtatatagggagttgttcctctgcagctgggagtcttgggacttgttttagtttgtgcccaaaggaggtcactttgttggaagtgattttctctctgcttttgttttctatttttggtctatcgtgattcctggtgtcatcaataatgtattatcagc

SEQ ID NO: 14911 - DNA, 1222 bp, Helianthus annuus
ggccggggacaccaaaacacacccaaagcatttgatcatcaacaacaatcatgaccaaagacgttgaagtggcggagcaccacggcggcaaagactaccatgatccacctccggcaccgttgatcgacggcgaagagctcaccaaatggtctttctacagagctcttattgctgaattcattgccacactactctttctttatgtgaccgttttgacagttattggctacaaggtccagactgaccctaagttggacactgatcagtgtggtggtgttggtatccttggtatcgcatgggctttcggtggcatgatctttgttcttgtttactgcaccgccggtatctctggaggacacattaacccggctgtgacattcgggctattcttggcaagaaaggtgtcattgatcagggcattagggtacatggtagcacaatgtttgggtgccatttgtggtgtgggtttggtcaaagctttccaaagctcatactacaataggtatggcggtggggccaatgagttagctgatggctacaacaaaggcactggactaggtgccgaaatcatcggcacctttgttcttgtgtacactgttttttcggctaccgatcctaagagaagcgcccgcgactctcacgtccctgtgttggcaccattgcccatagggtttgcagtcttcatggtacatttggcaactattccaatcaccggtaccggaatcaaccccgccagaagctttggcgccgcggtgatttacaacaacgaaaaggcctgggatgatcaatggattttctgggttggaccgttcattggcgcagccgcagcagcgttctaccaccagtttgtactaagagcaggggccattaaagcacttggttcattcagaagcaatgcatgatcgagagatgaaaaatttatccaataaaatttgatcagtcgttaaaatggatggatatatgagggtcgatgatcaagtgttaaattgtagatacatgtttttatttcccgttgggatgtgtaatttttttttttctatttatttttcattttcattgtgaatcttgagtgtttaatgtaagtggtcttttttctttcttctgttatgtttttctccaaaaaaaattatgggtttcttatttttttttttcaaaggtgtccttttaattaaccttaattttgcaaaattgtggatgtttttggccttataattataaccct

SEQ ID NO: 14912 - DNA, 946 bp, Helianthus annuus
aaagcatttgatcatcaacaataatcatgaccaaagacgttgaagtggcggagcaccacggcggaaaagactaccatgatccacctccggcaccgttgatcgacggcgaagagctcaccaaatggtctttctacagagctcttattgctgaattcattgccacactactctttctttatgtgaccgttttgacagttattggctacaaggtccagactgaccctaagttggacactgatcagtgtggtggtgttggcatccttggtatcgcatgggctttcggtggcatgatctttgttcttgtttactgcaccgccggtatctctggaggacacattaacccggcagtgacattcggactattcttggcaagaaaggtgtcattgatcagggcattagggtacatggtagcacaatgtttgggtgccatttgtggtgtgggtttggtcaaagctttccaaagctcatactacaataggtatggcggtggggccaatgagttagctgatggctacaacaaaggcactggactaggtgccgaaatcatcggcacctttgttcttgtgtacactgttttttcagctaccgatcctaagagaagcgctcgcgactctcacgtccctgtgttggcaccactgcccataggatttgcagtcttcatggtacatttggcaactattccaatcaccggtaccggaatcaaccccgccagaagctttggcgccgcagtgatttacaacaacgaaaaggcctgggatgatcaatggattttctgggttggaccgttcattggcgcagccgcagcagcgttctaccaccagtttgtactaagagcaggggccattaaagcacttggttcattcagaagcaatgcatgatcgagagatgaaaaatttatccaataaaatttgatcagtcgttaaaatggatggatatatgaaggtcg

SEQ ID NO: 14913 - DNA, 1110 bp, Cichorium intybus
aagattaccaagaccctccacctgctcaactctttgacgccgaagaactcacgaaatggtcgttttacagagccatcattgctgagttcattgccaccctcttgttcctttacatcaccgtcttgactgtcatcggctacaaggcccaaaccgatccagctcacagctccgaccagtgcggtggcgtaggaatcctaggcatcgcttgggccttcggtggcatgatcttcgtccttgtttattgcaccgccggcatctctggaggacatatcaaccctgcggtcacatttgggctgttcttggctagaaaggtgacactccccagggcagtgatgtacattgttgctcaatgcttgggtgctatctgtggttgtggtttggttaaggctttccagaagacttactatcatacttatggtggtggcgccaacgagctcgccgatggttacagtaaaggaactggattgggtgctgaaatcatcggcacatttgttctcgtatacaccgtcttctccgccactgacccaaagagaaatgctcgggattcccatgtccccgtgctggcacctcttcccatcggatttgctgtgttcatggttcacttggccacaatcccaatcaccggcaccggaatcaaccctgctcgtagttttggtgcggcagtcatgtacggaaaagacaaagcctgggatgatcaatggatattctgggtgggacctatgatcggagctgccatagccgccttctaccaccagtacgtattaagagcagcggcggtcaaagctcttggatccttcaggagcaacgcctagggcataagcatgaaacttgcaatagtttccatgaaattgtacaaatttgccttttgcttttattagagttcatctctaaaatgtattcgctatttagggccagtggtttttgaatgtgcccaataaagtcctttcactatatttttctgtgtactttgtccctttttgttttcgatgtaattggtaaaagggtttagttgctacccaaatgctaatatccaaagcgaggggttttgtctactggtggcaatcgggtcttgttgggtcgggtcggcttcaggtttgttggttgcggctt

SEQ ID NO: 14914 - DNA, 1059 bp, Flaveria ramosissima
acaccaaacacttgatccccttcaatctcttagcctttgatcatccatccatcagcagcaatgacaaaagacgttgaagtggctgagcaccacagcggaaaagactaccaagacccgcctccggcaccgcttatcgaccccgaagagctcaccaaatggtctttctacagagctgtcatagcagaattcattgccacactcctgtttctttatgttacggtcttgaccgttatcggatacaagagccagaccgacccgaacctcaacaccgatcagtgcggtggcgttggcatcctcggcatcgcgtgggcattcggtggcatgatcttcatccttgtttactgcaccgccggtatctcgggaggacatattaacccggctgtgacgttcgggctctttttggcaagaaaggtgtcattgatcagggcattgttgtacatggttgcccaatgtttgggtgcaatttgtggtgtgggtttggtcaaagccttccaaagctcatactacaataggtacggaggtggtgctaacgagttagccgatggctacaacaaaggcacaggactaggtgccgagatcatcggcacctttgttcttgtctacactgtcttttcggctactgatcctaagagaagtgctcgcgactcacacgtccctgtgttggcaccactgcccatagggtttgcagtcttcatggtacatttggccaccattccaatcaccggcaccggaatcaacccggctaggagcttcggggccgcagtgatttacaacaacgagaaggcgtgggatgatcaatggattttctgggtcggaccgtttgtgggtgcagcagcagccgcgttctaccaccagttcgtactgagagcagcggccattaaagcacttggttcgttcagaagcaatgcatgatcaaaagatgatgaattcatccatgcaaacagaataaaatttggatggatatttgaatgtggaagtgtttattgtagataagtgttttaaatttattctttggtaatattattattttttttctgtttgttttcctttctattgtga

SEQ ID NO: 14915 - DNA, 1669 bp, Mimulus guttatus
ctccaatttaattttttttcccttaggggcggctataaaaaaataaactttaaattaattaattaattaattaattaattaatccaggcactcttaatcatttaacgttcatctccccactcctcttctcccataaataccgaacccctttctactgactactcactaaaaccaccaccaccaccaccaccaccggccaccggaatttcttttttcacacacattttcggagatcggaattttttgatggcaaaggaagttgaatgtgctgagccagcggcggagttcgccgccaaggactaccacgaccctccgccggcgccgctcatcgactacgacgagctcacgaaatggtcgttttacagggcgctgattgcggagttcatcgccaccctcctcttcctgtacatcaccgttctgactgtcatcggctacaaaagccagagcgagtacgaccagtgcggcggcgttggaatcctcggcatcgcctgggctttcggcggaatgatcttcgtacttgtctactgcaccgccggtatctccggagggcatattaacccggcggtgacgtttgggttatttttggcgaggaaagtatcactgataagagcagtgctgtacatggtagcacagtgcttgggtgctatctgcggtgtaggttttgtaaaagcattccaaaagtcacactacaacaagttcggcggtggagctaacacgctggcactcggctacaacaagggcactggtttgggtgccgagattatcggtacctttgttttggtctacactgttttctccgccaccgatcccaaaagaagcgccagagattcccacgtccctgttttggccccgcttccgattggatttgcggtgttcatggttcacctggccaccataccgatcaccggaacgggtatcaaccccgcaaggagtttcggagctgcagtgatcttcaacaatgaaaaggcttgggatgaccattggatattctgggttggaccgttcatcggagctgccatcgctgcaatctaccaccaattcgtccttagagcaggtgccattaaagctctcggatctttcaggagcaatgcatgaagaaaataatggagaatatgaaaaattgtatatatattcctgtgtgtattgcagatgtgtggtactctttcatatatccttttggtttttaattgtttcttttgttctacttgagtgattgtgtattcatcatcatgttctcgtaatttaaggaaatggtttgtgtatttctaattgttctgccatttttattttctagctatacagtgtgagtcagtgatgcattgaaaattttgatttacacttgtttccacgttttacaaatcgaaactccatggcatctgtcggaaatgttttgaggccattttcgtacgtgcttaaaagtttcggggacattttattttctagctacatagtgtgtgtgatgcatgtaaacttctatctacacgtgtttccacgttttagaaattgatactccatgacatctatgggaaatgtcggaaacgtttcgaggctgcttttgtaaatagttaaaagtttcggaaacatttctaggaataatgaaaatcagctggaaacacgtttccaccaaagttacacgttatagtatttaaaaaaaaaattatgaatgtac

SEQ ID NO: 14916 - DNA, 1397 bp, Papaver somniferum
gcacaaccactgaagcttatcactgatatcactataatataaataccctcatttcctctcatctcaaacacaaaaacaaactcactctcctcttccttctctccacagtactcaactcttcttattttcagtactctattctgaatttgtactgtttcttgagaaatcagatatgggaaaagacgaagtagcagaacatggtgaattctcagccaaggattatcacgacccaccaccaacaccattttttgacgcagatgagcttaagaaatggtctttctacagagctattattgctgaatttgtagctactcttttgttcctctacatcactgttttgactgttatcggttacaaggctcagagtgaaactgatgattgtggtggtgttggtattttgggtatcgcttgggcttttggtggtatgatcttcgtcctggtttactgcaccgccggtgtctccggaggacacatcaacccagcagtaactttcgggctatttttggcaagaaaagtttcactaccaagagcagtcttgtacatggtggctcagtgtttaggagcaatctgtggtgttggattagtcaaagctttccaatcagcttactacgttaaatttggtggtggtgccaatacactttcccttgggtacagcaaaggaactggtttagcagctgaaatcatcggaactttcgttcttgtgtacacagttttctcagccactgaccccaagagaaacgccagagactcccatgttcccgttttggcaccacttccaatcgggtttgccgtgttcatggtccacttagccactatccccgttaccggtaccggtattaacccagctagaagtttcggagctgccgttatcttgaacgacgagaaggcatgggatgaccagtggatcttctgggtcggacctttcattggtgccgcaatcgctgctatttaccaccaatttatcctaagggctggtgctattaaagctttgggctcatttaggagcagtgctcgtgtctaataagacttgaagaattattgttggatagagataagggtgatgtttttttttatgtttggaagatggtgatgatgtttgcaaggaataataataatggagctcctcctctaggggtccatataggggtggtggatttgtgacttgtctatctatctaaaaaagtttacatttattctatctctgtctgtctccctccacttcttgaaaaaaaaaaagagaaaagaaaagagagggtgaaaaacgagaagatgattgataaattggaagtttgtagatataatctctctatttattagtgtattttcccttttgtttcatgaaagtctttcaagtgtcaactgtaatattatctgctcttttgctatttctctctagt

SEQ ID NO: 14917 - DNA, 1241 bp, Papaver somniferum
cagtactcaactcttcttattttcagtactctattctgaatttgtactgtttcttgagaaatcagatatgggaaaagacgaagtagcagaacatggtgaattctcagccaaggattatcacgacccaccaccaacaccattttttgacgcagatgagcttaagaaatggtctttctacagagctattattgctgaatttgtagctactcttttgttcctttacatcactgttttgactgttatcggttacaaggctcagagtgaaactgatgattgtggtggtgttggtattttgggtatcgcttgggcttttggtggtatgatcttcgtcctggtttactgcaccgccggtgtctccggaggacacatcaacccagcagtaactttcgggctatttttggcaagaaaagtttcactaccaagagcagtcttgtacatggtggctcagtgtttaggagcaatctgtggtgttggattagtcaaagctttccaatcagcttactacgttaaatttggtggtggtgccaatacacttgcccttgggtacagcaaaggaactggtttagcagctgaaatcatcggaactttcgttcttgtgtacacagttttctcagccactgaccccaagagaaacgccagagactcccatgttcccgttttggcaccacttccaatcgggttcgccgttttcatggtccacttggccactatccccgttaccggtaccggtattaaccctgctagaagtttcggagctgctgttatcctcaacgatgagaaggcatgggatgaccagtggatcttctgggtcggaccattcattggtgccgcaattgctgctatttaccaccagtttatcctaagggcaggtgcaattaaagctttgggctcgtttaggagcagtgctcgtgtttaagacttgaagaattattgttggatagagataaggggtgatgtgttgtttttctttttttatgtttggaagatggtgatgatgtttgcaaggaataataataatggagctccctcctctaggggtccatataggggtggtggatttgtgacttgtctatctatctaaaaaatgtacatttattctatctctgtctgtcacccttcaagttcttaaaaagagaaaagaaagaaagggtgaaaaatgagaagatgatggataaattggaagtttgtagataaaatctctctctatttattagtgtattttcccttttgttttcatgaaa

SEQ ID NO: 14918 - DNA, 1609 bp, Papaver somniferum
ctcactcctctcctttcctctccacagtactcaactcttcttattttcagtactctgttctgaatttgtaccgtttctttagaaatcaaatatgggaaaagacgaagtagcagaacatggtgaattctcagccaaagattatcacgacccaccaccaacaccattttttgatgcagatgagtttaagaaatggtctttctacagagctattattgctgaatttgtagctactcttttgttcctttacatcactgttttgactgttattggttacaagagccaaagtgaaactgatgattgtggtggtgtcggtattttgggtatcgcttgggcttttggtggtatgatctttgtcctggtttactgcaccgctggtgtctccggaggacacatcaacccagcagtcacttttggattatttttggcaagaaaagtttcactgccaagagcagtcttgtacatggtggctcagtgtttgggagcaatctgtggtgttggattagtcaaagctttccaatcagcttactacgttaaatttggtggtggtgccaatacacttgccgctgggtacagtaaaggaactggtctagcagctgaaatcatcggaactttcgttcttgtgtacacagttttctcagccactgaccctaagagaaacgccagagactcccacgttcccgttttggcaccacttccaatcgggtttgccgtattcatggttcacttggctaccattcccgttaccggtaccggtattaacccagctagaagtttcggagctgctgttatcttcaacgaagagaaggcatgggatgaccagtggatcttctgggtcggacctttcattggtgccgcaattgctgctatttaccaccagtttatcctaagggctggtgctattaaagctttgggttcatttaggagcagtgctcgtgtctaagactcgaagaattattgttggatagagataagggtgatttgctgttctttcttttttttcttttttatgtttggacgatggtgatgatgtttgcaaggaataataataatggagctcctcctctaggggtccatataggggtggtggatttgtgacttgtctatctatctaaaaaatgtacatttattctatctctatctgtctcccttcattcacttttttaaaagagaaaagaaaagagagggtgaaaaatgagtagatgatggataaattggaagtttgtagataaaatctctctatttattagtgtattttcccttttgttttcatgaaagtctttcaagtatcaagtgtaatattatccgctctttcgctatttctctctagtactcttgttttttcaataatgtattaatgtctttagccaacaaaaaaaaaaagaaaaaaaaagaacagcaaatacaccttactctctatccaacaactaattcttcgtagtcttagtacacgacgacactgctacctaaatagaacccaaagtactttaatacgcaccacgcccttacggataaactgggtggtaaatagcagcaattgcggtaccatagaagtaccgaccaggaagatccatcggctagacccgtagacgtctccttcttcggttataag

SEQ ID NO: 14919 - DNA, 1462 bp, Papaver somniferum
agtgatatcactataatataaataccctcatttcctctcatctcaaacacaaaaacaaactcactcctcttccttcctctccacagtactcaactcttcttattttcagtactctgttctgaatttgtaccgtttctttagaaatcaaatatgggaaaagacgaagtagcagaacatggtgaattctcagccaaagattatcacgacccaccaccaacaccattttttgatgcagatgagtttaagaaatggtctttctacagagctattattgctgaatttgtagctactcttttgttcctttacatcactgttttgactgttattggttacaagagccaaagtgaaactgatgattgtggtggtgtcggtattttgggtatcgcttgggcttttggtggtatgatctttgtcctggtttactgcaccgctggtgtctccggaggacacatcaacccggcagtcacttttggattatttttggcaagaaaagtttcactaccaagagcagtcttgtacatggtggctcagtgtttgggagcaatctgtggtgttggattagtcaaagctttccaatcagcttactacgttaaatttggtggtggtgccaatacacttgccgctgggtacagtaaaggaactggtctagcagctgaaatcatcggaactttcgttcttgtgtacacagttttctcagccactgaccctaagagaaacgccagagactcccacgttcccgttttggcaccacttccaatcgggtttgccgtgttcatggttcacttggctaccattcccgttaccggtaccggtattaacccagctagaagtttcggagctgctgttatcttcaacgaagagaaggcatgggatgaccagtggatcttctgggtcggacctttcattggtgccgcaattgctgctatttaccaccagtttatcctaagggctggtgctattaaagctttgggttcatttaggagcagtgctcgtgtctaagaagaattattgttggatagagataagggtgattgaagtcttgttgtttttctttttttgttttgtttggaagatggtgatgatgtttgcaaggaataataataatggagctcctcctctaggggtccatataggggtggtggatttgtgacttgtgtatctatctaaaaaatgtacatttattctatctctatctgtctcccttcattcacttttttaaaagagaaaagaaaagagagggtgaaaaatgagtagatgatggataaattggaagtttgtagataaaatctctctatttattagtgtattttcccttttgttttcatgaaagtctttcaagtatcaagtgtaatattatccgctctttcgctatttcttcgcttagtactcttgtttttcaataatgtattaactgtctttagcacatttttcaattcttattcctagtctatgtggttgactt

SEQ ID NO: 14920 - DNA, 1259 bp, Papaver somniferum
tccacagtactcaactcttcttattttcagtactctgttctgaatttgtaccgtttctttagaaatcaaatatgggaaaagacgaagtagcagaacatggtgaattctcagccaaagattatcacgacccaccaccaacaccattttttgatgcagatgagtttaagaaatggtctttctacagagctattattgctgaatttgtagctactcttttgttcctttacatcactgttttgactgttattggttacaagagccaaagtgaaactgatgattgtggtggtgtcggtattttgggtatcgcttgggcttttggtggtatgatctttgtcctggtttactgcaccgctggtgtctccggaggacacatcaacccggcagtcacttttggattatttttggcaagaaaagtttcactaccaagagcagtcttgtacatggtggctcagtgtttgggagcaatctgtggtgttggattagtcaaagctttccaatcagcttactacgttaaatttggtggtggtgccaatacactttccgctgggtacagtaaaggaactggtctagcagctgaaatcatcggaactttcgttcttgtgtacacagttttctcagccactgaccctaagagaaacgccagagactcccacgttcccgttttggcaccacttccaatcgggtttgccgtgttcatggttcacttggctaccattcccgttaccggtaccggtattaacccagctagaagtttcggagctgctgttatcttcaacgaagagaaggcatgggatgaccagtggatcttctgggtcggacctttcattggtgccgcaattgctgctatttaccaccagtttatcctaagggctggtgctattaaagctttgggttcatttaggagcagtgctcgtgtctaagacttgaagaattattgttggatagagataagggtgatttgctgttctttcttttttatgtttggacgatggtgatgatgtttgcaaggaataataataatggagctcctcctctaggggtccatataggggtggtggatttgtgacttgtctatctatctaaaaaaatgtacatttattctatctctatctgtctcccttcattcacttttttaaaagagaaaagaaaagagagggtgaaaaatgagtagatgatggataaattggaagtttgtagataaaatctctctatttattagtgtattttcccttttgttttcatgaaagtctttcaagtat

SEQ ID NO: 14921 - DNA, 1302 bp, Arachis hypogaea
acacttacccatctcatctctttctttcttatctcaattttgagaaacccaagaaatgacgaaggaccttgaagttaccgagagaggctctttctccggcaaggactaccatgacccgccacccgcacccctcatcgacgccgaggagctcaccaagtggtctttctatagagctctcattgctgagttcattgccaccctcctcttcctctacatcaccgtcctcaccgtcattggctacaagagccagagcgaccccaaagccggcggtgatatgtgcggcggcgttggcattcttggcattgcttgggcctttggcggcatgattttcatccttgtttactgcaccgccggcatctcaggaggacacatcaacccggcagtgacgttcgggttgttcttggcgcgcaaggtgtcgttgataagagcaatattgtatatggtggctcagtgcttgggtgctatctgcggtgttggcttggtcaaggccttccagacatccctctacgtcaggtacggcggcggcgccaactccctcgccgacggttacagcaagggcaccggtttgggtgctgagatcattggtacctttgttttggtctacaccgtgttctccgccaccgatcccaagagaaatgccagagactctcatgtccctgttttggcaccacttcccattggatttgctgtgttcatggttcacttggctaccatcccggtcaccggcaccggcatcaaccctgctaggagtcttggtgctgctgttatctacaacaaatccaagccatgggatgaccattggatcttctgggttggaccattcattggagcagccattgcagccttctaccaccaattcatcttaagggcaggagcagctaaggctcttggatcattcaggagcaaccccaatgtctaagtttgattaatgaatgatcaacaatgcaatgcaagtgcttgattattgtgctattgtatttttctatttatatttatattttattttattttaaccctctctctttgaattagttatctctctaaatttggtggtgtatgaagaagatttgtggataagtgtagatttaaaaaagtccctttcatgacagtgggggagggaggccttttgcactttcctctgtgtattccctttagtgtgtgtcatgccatctgtcttcttttgttattctcttctgtcatctttgttctcattatatatttatggaaaacctttatactttatttgacaaaaaaaaaaaaaaaaaaaaaaaaaaaaaaaaaaaaaaaacaaaaaaaaaaaaa

SEQ ID NO: 14922 - DNA, 1152 bp, Amaranthus tuberculatus
attattattatttcttccttccttgcaagcaagctaattagttaaaaatgggtaaggacatggatgttggaggagcaatggtgaaggattaccaagacccacctccatctcctttgattgatgcagaagaattgggaaaatggtcattttatagagcagttatagctgagtttattgcaacattattgtttttgtatattactgtcttaactgtgattggacataaagcccagaatgaagctgatcaatgtaatggtgttggtttacttggtattgcttgggcttttggtggcatgatctttgttcttgtttactgtactgctggtatttctggtggacacataaacccagcggtgacatttgggctattattggcaagaaaagtgacactaataagggcaattctatacatggtggctcaatgtttaggggccatatgtggtgttgggctagttaaggcattccaaagtggatactatactaaatatggaggtggggccaacaccttagcagatgggtatagtaagggcactggtttgggtgctgagattattggcacttttgttttggtctacacagttttctctgccactgatcccaagcgtaatgccagggattctcatgttccagtgttggcgccacttccaattggatttgcagtatttatggtacacttagctacaatcccagttacagggactggtatcaaccctgcacgtagttttggtgctgctgttattttcaattcttcccaggcctgggatgatcattggattttctgggtgggaccatttatcggagctgcaattgctgccatttatcaccaatacatattgcgtgccggttttgttaaggctcttgggtcgtttaggagctcatcaaatgtgtgatgtcttcttaagttcatattaatcctcatcttaagcatggtttttggctacaatgaggattataagctgatttatcctacaaatttgcttaaagagtaaagagagatccttaagatgtatataaccttttattcttaagtcattgttggtgtcttggcacttattttcactttgtgcctttagatgtctgtttgctttcttttttcccactcctttgttgtattctgcactttaagtaataataaatgtcagtattctgaac

SEQ ID NO: 14923 - DNA, 1220 bp, Panax ginseng
ttctgcacaaattaaaagagctttaatcacttgttttaactagctaattatgggtaaggacggggaagtgacggagcatgcggagtacggcgccaaggactaccaagatccacctccggcagccttcatcggcaccgacgagctctctaaatggtcattatacagggctgttatcgccgagttcatagccaccctcctattcctgtatatcactgtattgaccgttatcggttacaagagccaatctgccaccgatgaatgcggcggcgttggactccttggcatcgcatgggccttcggcggcatgatctttattcttgtttactgcaccgccggaatctctggaggacacattaacccggctgtgacgtttgggttgttcttggccaggaaagtgtcgctaataagggctttgttgtacatggtagcacagtgtttgggtgcaatcagtggggtagggttggtaaaggccttccaaaagtcgttatataataggtatggtggtggggccaacgagctggctgatggttacaacaaaggcactggattaggggctgagatcattggtacctttgtgcttgtgtacactgtattttcagctactgatcctaaaaggaatgctagagactcccatgtccctgttttggccccacttcccattggattcgcggtgttcatggttcacctagccacaattcccatcaccggcaccggtatcaaccctgctagaagctttggagccgctgtcatctacaacaaagaaaaggcctgggatgaccaatggatcttctgggttggacctttcattggtgctgccattgctgcattctaccaccagtacattcttagagcagcagcaattaaagctcttgggtccttcagaagcaatgcctagagtgaaggacttgtgtacgtacgtctctatgaagctagctagctatcccattatattggacaatcttaagggtgtcaaaatggagaaggaaggccatggaattgttaataaatgttctctttgcatgggaaattaagattgtaatttatatctttgttgtatttctatcccttgtggtgttgtgatcatctttcatttctttttcttttaatttttaccttttaatagtattttcttttctctttttctttttcataaattatgcatgtactcggaattgaatgtttcttcataaagcaaacaaatggtttatcttgatgtcaaa

SEQ ID NO: 14924 - DNA, 1138 bp, Panax ginseng
tctaaatcttctttctgcacaaaagagctttaatcacttgttttaactagctaattatgggtaaggacggagaagtgacggagcatgcggaatacggctccaaggactaccaagatccacctccggcagccttcatcggcaccgacgagctctctaaatggtcattatacagggctgttatcgccgagttcatagccaccctcctattcctgtatatcactgtattgaccgttatcggttacaagagccaatctgccaccgatgaatgcggcggcgttggactccttggcatcgcatgggccttcggcggcatgatctttattcttgtttactgcaccgccggaatctctggaggacacattaacccggctgtgacgtttgggttgttcttggcaaggaaagtgtcgctaataagggctttgttgtacatggtagcacagtgtttgggagcaatcagtggggtagggttggtaaaggccttccaaaagtcgttatataataggtatggtggtggggccaacgagctagctgatggttacaacaaaggcactggattaggggctgagatcattggtacctttgtgcttgtgtacactgtattttcagctactgatcctaaaaggaatgctagagactcccatgtccctgttttggctccacttcccattggattcgcggtgttcatggttcaccttgccacaattcccatcaccggcaccggtatcaaccctgctagaagctttggagccgctgtcatctacaacaaagaaaaggcctgggatgaccaatggatcttctgggttggacctttcattggtgctgccattgctgcattctaccaccagtacattcttagagcagcagccattaaagctcttgggtccttcagaagcaatgcctagagtgaaggacttgtgtacgtacgtcgctatgaagctagctagctatcccattatattggacaatcttaagggtgtcaaaatggagaagcaaggccatctctttgcatgggatattaagattgtaatttatatctttgttgtatttctatcccttgtggtgttgtgatcttctttcatttctttttctttttctttttaccttttaatagttattttcttcttctctttttcttttt

SEQ ID NO: 14925 - DNA, 1148 bp, Panax ginseng
tctaaatcactagaaaaatttgtgtgcaaaaacagtactgtatatttttttatatagtgttgttgtgtagttatgggaaaggacggagaagtaacggagcagagtgagttctcagccaaggactaccatgatccgccaccggcagcctttatcggcaccgatgagctaaccaaatggtcactttacagggctgtcattgctgagttcatagccaccctcctcttcctttatatcactgtcttgacggtcatcggctacaagagccagtcagccaccgatgagtgtggcggcgttggcctcctcggcatcgcctgggcctttggtggcatgatcttcgtccttgtttactgcaccgccggtatctctggaggacacattaaccctgcggtgacgttcgggttgttcttggcaaggaaagtgtcgctaataagggcggtgttttacatggttgcacagtgtttgggtgcaatctgtggagtagggttggtgaaggccttccaaaagtcattatataacaggcatggtggtggagccaacgagctggctgatggttacaacaaaggcactggcttgggagctgagatcattggcacttttgttcttgtctatacagttttctcagccactgatcctaagaggaatgctagagactcccatgtccctgttttggctccacttcccatcggattcgcggtgttcatggttcacctagccacaatcccaattactggaaccggtatcaaccctgctaggagctttggagctgcagtcatctacggcaaacagaaggcctgggatgaccaatggatcttctgggttggacctttcattggtgctgccattgctgcattctaccaccagtatattctgagagcagcagcaattaaggctcttggatccttcaggagcaatgcttaataaattatgtttcaacaattacaatgaaggacataaatgcttaaatgcttcattcgtctatgaagtaattaagaagacaattaattaaggaggatatatgttaaaatatggagatcaggcaggcaattaaggacggacatatatggagttaattgtagatataataataataataataataataataataataataataataataataatataataataataataataaa

SEQ ID NO: 14926 - DNA, 1168 bp, Panax ginseng
ctcccctgtgtgccttgcctcccacgactcactccctctctctctctaaatcttctttctgcacaaaagagctttaatcacttgttttaactagttaattatgggtaaggacggagaagtgacggagcatgcggaatacggcgccaaggactaccaagatccacctccggcagccttcatcggcaccgacgagctctctaaatggtcattatacagggctgttatcgccgagttcatagccaccctcctattcctgtatatcactgtattgaccgttatcggttacaagagccaatctgccaccgatgaatgcggcggcgttggactccttggcatcgcatgggccttcggcggcatgatctttattcttgtttactgcaccgccggaatctctggaggacacattaacccggctgtgacgtttgggttgttcttggcaaggaaagtgtcgctaataagggctttgttgtacatggtagcacagtgtttgggagcaatcagtggggtagggttggtaaaggccttccaaaagtcgttatataataggtatggtggtggggccaacgagctggctgatggttacaacaaaggcactggattaggggctgagatcattggtacctttgtgcttgtgtacactgtattttcagctactgatcctaaaaggaatgctagagactcccatgtccctgttttggctccacttcccattggattcgcggtgttcatggttcaccttgccacaattcccatcaccggcaccggtatcaaccctgctagaagctttggagccgctgtcatctacaacaaagaaaaggcctgggatgaccaatggatcttctgggttggacctttcattggtgctgccattgctgcattctaccaccagtacattcttagagcagcagccattaaagctcttgggtccttcagaagcaatgcctagagtgaaggacttgtgtacgtacgtctctatgaagctagctagctatcccattatattggacaatcttaagggtgtcaaaatggagaaggaaggccatggaattgttaataaaagttctctttgcatgggaaattaagattgtaatttatatctttgttgtatttctatcccttgtggtgttgtgatcatctttcatttctttttcttttaatttttaccttt

SEQ ID NO: 14927 - DNA, 1297 bp, Panax ginseng
atttctctctaaaccttcttctaaatcactagaaaaatttgtgtgcaaaaacagtactgtatattttttttatatagtgttgttgtgtagttatgggaaaggacggagaagtaacggagcagagtgagttctcagccaaggactaccatgatccgccaccggcagcctttatcggcaccgatgagctaaccaaatggtcactttacagggctgtcattgctgagttcatagccaccctcctcttcctttatatcactgtcttgacggtcatcggctacaagagccagtcagccaccgatgagtgtggcggcgttggcctcctcggcatcgcctgggcctttggtggcatgatcttcgtccttgtttactgcaccgccggtatctctggaggacacattaaccctgcggtgacgttcgggttgttcttggcaaggaaagtgtcgctaataagggcggtgttttacatggttgcacagtgtttgggtgcaatctgtggagtagggttggtgaaggccttccaaaagtcattatataacaggcatggtggtggagccaacgagctggctgatggttacaacaaaggcactggattgggagctgagatcattggcacttttgttcttgtctatacagttttctcagccactgatcctaagaggaatgctagagactcccatgtccctgttttggctccacttcccatcgggttcgcggtgttcatggttcacctagccacaatcccaattactggaaccggtatcaaccctgctaggagctttggagctgcagtcatctacggcaaacagaaggcctgggatgaccaatggatcttctgggttggacctttcattggtgctgccattgctgcattctaccaccagtatattctgagagcagcagcaattaaggctcttggatccttcaggagcaatgcttaattaattatgtttcaacaattacaatggaggacgtacatgctagatactactgcagcaagcttaattgctctgtcgtcgtctatgaattaattaaggaggatatctatatgttaaaatatggagatcaggcaggcaattaaggacggacataaatggagttaattgtagatataataataatcaagatttgtagtaatttctatctgtgttgtatttactttctctcccaactgttgctcatcttaatttcattttttaaaattatctccttttcttttttaattaaatattactcaatgtactcagagatcgatgtttgttcataataaatcaaggaaatggtttgtgttccttatata

SEQ ID NO: 14928 - DNA, 1099 bp, Panax ginseng
atttgtgtgcaaaaacagtactgtatatttttttatatagtgttgttgtgtagttatgggaaaggacggagaagtaacggagcagagtgagttctcagccaaggactaccatgatccgccaccggcagcctttatcggcaccgatgagctaaccaaatggtcactttacagggctgtcattgctgagttcatagccaccctcctcttcctttatatcactgtcttgacggtcatcggctacaagagccagtcagccaccgatgagtgtggcggcgttggcctcctcggcatcgcctgggcctttggtggcatgatcttcgtccttgtttactgcaccgccggtatctctggaggacacattaaccctgcggtgacgttcgggttgttcttggcaaggaaagtgtcgctaataagggcggtgttttacatggttgcacagtgtttgggtgcaatctgtggagtagggttggtgaaggccttccaaaagtcattatataacaggcatggtggtggagccaacgagctggctgatggttacaacaaaggcactggattgggagctgagatcattggcacttttgttcttgtctatacagttttctcagccactgatcctaagaggaatgctagagactcccatgtccctgttttggctccacttcccatcgggttcgcggtgttcatggttcacctagccacaatcccaattactggaaccggtatcaaccctgctaggagctttggagctgcagtcatctacggcaaacagaaggcctgggatgaccaatggatcttctgggttggacctttcattggtgctgccattgctgcattctaccaccagtatattctgagagcagcagcaattaaggctcttggatccttcaggagcaatgcttaataaattatgtttcaacaattacaatggaggatgtaaatgcttaatactactgcagcaagcttaattgctctgtcgttgtctatgaagtaattaaggaggatatctatatgttaaaatatggagatcaggcaggcaattaaggacggacataaatggagttaattgtagatataataataatcaagatttgtagtaaaa

SEQ ID NO: 14929 - DNA, 1105 bp, Panax ginseng
agtactgtatattttttttatatactgttgttgtgcagttatgggaaaggacggagaagtaacggagcagagtgagttctcagccaaggactaccatgatccgccaccggcagcctttatcggcaccgatgagctaaccaaatggtcactttacagggctgtcattgctgagttcatagccaccctcctcttcctttatatcactgtcttgacggtcatcggctacaagagccagtccgccaccgatgagtgcggcggcgttggcctcctcggcattgcctgggcctttggtggcatgatcttcgtccttgtttactgcaccgccggtatctctggaggacacattaaccctgcggtgacgttcgggttgttcttggcaaggaaagtgtcgctaataagggcggtgttttacatggtagcacagtgtttgggtgcaatctgtggagtagggttggtgaaggccttccaaaagtcattatataacaggcatggtggtggagccaacgagctggctgatggttacaacaaaggcactggcttgggagctgagatcattggcacttttgttcttgtctatacagttttctcagccactgatcctaagaggaatgctagagactcccatgtccctgttttggctccacttcccatcggattcgcggtgttcatggttcacctagccacaatcccaattactggaaccggtatcaaccctgctaggagctttggagctgcagtcatctacggcaaacagaaggcctgggatgaccaatggatcttctgggttggacctttcattggtgctgccattgctgcattctaccaccagtatattctgagagcagcagcaattaaggctcttggatccttcaggagcaatgcttaataaattatgtttcaacaattacaatggaggatgtaaatgcttaatactactgcagcaagcttaattgctctgtcgttgtctatgaagtaattaagaagacaattaattaaggaggatatatgttaaaatatggagatcaggcaggcaattaaggacggacatatatggagttaattgtagatataataataataataataataataataataataataa

SEQ ID NO: 14930 - DNA, 1228 bp, Panax ginseng
tctaaatcttctttctgcacaaattaaaagagctttaatcacttgttttaactagctaattatgggtaaggacggggaagtgacggagcatgcggagtacggcgccaaggactaccaagatccacctccggcagccttcatcggcaccgacgagctctctaaatggtcattatacagggctgttatcgccgagttcatagccaccctcctattcctgtatatcactgtattgaccgttatcggttacaagagccaatctgccaccgatgaatgcggcggcgttggactccttggcatcgcatgggccttcggcggcatgatctttattcttgtttactgcaccgccggaatctctggaggacacattaacccggctgtgacgtttgggttgttcttggcaaggaaagtgtcgctaataagggctttgttgtacatggtagcacagtgtttgggagcaatcagtggggtagggttggtaaaggccttccaaaagtcgttatataataggtatggtggtggggccaacgagctagctgatggttacaacaaaggcactggattaggggctgagatcattggtacctttgtgcttgtgtacactgtattttcagctactgatcctaaaaggaatgctagagactcccatgtccctgttttggctccacttcccattggattcgcggtgttcatggttcaccttgccacaattcccatcaccggcaccggtatcaaccctgctagaagctttggagccgctgtcatctacaacaaagaaaaggcctgggatgaccaatggatcttctgggttggacctttcattggtgctgccattgctgcattctaccaccagtacattcttagagcagcagccattaaagctcttgggtccttcagaagcaatgcctagagtgaaggacttgtgtacgtacgtcgctatgaagctagctagctatcccattatattggacaatcttaagggtgtcaaaatggagaagcaaggccatggaattgttaataaaagttctctttgcatgggatattaagattgtaatttatatctttgttgtatttctatcccttgtggtgttgtgatcttctttcatttctttttctttttctttttaccttttaatagtattttcttctctctttttctttttcataaattatgtactcagaattgaatgtttcttcataaagcaaacaaatggtttatcttgatgtcaaa

SEQ ID NO: 14931 - DNA, 1126 bp, Panax ginseng
aaaaatttgtgtgcaaaaacagtactgtatatttttttatatactgttgttgtgcagttatgggaaaggacggagaagtaacggagcagagtgagttctcagccaaggactaccatgatccgccaccggcagcctttatcggcaccgatgagctaaccaaatggtcactttacagggctgtcattgctgagttcatagccaccctcctcttcctttatatcactgtcttgacggtcatcggctacaagagccagtccgccaccgatgagtgcggcggcgttggcctcctcggcattgcctgggcctttggtggcatgatcttcgtccttgtttactgcaccgccggtatctctggaggacacattaaccctgcggtgacgttcgggttgttcttggcaaggaaagtgtcgctaataagggcggtgttttacatggtagcacagtgtttgggtgcaatctgtggagtagggttggtgaaggccttccaaaagtcattatataacaggcatggtggtggagccaacgagctggctgatggttacaacaaaggcactggcttgggagctgagatcattggcacttttgttcttgtctatacagttttctcagccactgatcctaagaggaatgctagagactcccatgtccctgttttggctccacttcccatcggattcgcggtgttcatggttcacctagccacaatcccaattactggaaccggtatcaaccctgctaggagctttggagctgcagtcatctacggcaaacagaaggcctgggatgaccaatggatcttctgggttggacctttcattggtgctgccattgctgcattctaccaccagtatattctgagagcagcagcaattaaggctcttggatccttcaggagcaatgcttaataaattatgtttcaacaattacaatgaaggacataaatgcttaaatgcttcattcgtctatgaagtaattaagaagacaattaattaaggaggatatatgttaaaatatggagatcaggcaggcaattaaggacggacatatatggagttaattgtagatataataataataataataataataataataataataataataataataataataataataa

SEQ ID NO: 14932 - DNA, 1193 bp, Panax ginseng
aaaagagctttaatcacttgttttaactagttaattatgggtaaggacggagaagtgacggagcatgcggaatacggcgccaaggactaccaagatccacctccggcagccttcatcggcaccgacgagctctctaaatggtcattatacagggctgttatcgccgagttcatagccaccctcctattcctgtatatcactgtattgaccgttatcggttacaagagccaatctgccaccgatgaatgcggcggcgttggactccttggcatcgcatgggccttcggcggcatgatctttattcttgtttactgcaccgccggaatctctggaggacacattaacccggctgtgacgtttgggttgttcttggccaggaaagtgtcgctaataagggctttgttgtacatggtagcacagtgtttgggtgcaatcagtggggtagggttggtaaaggccttccaaaagtcgttatataataggtatggtggtggggccaacgagctggctgatggttacaacaaaggcactggattaggggctgagatcattggtacctttgtgcttgtgtacactgtattttcagctactgatcctaaaaggaatgctagagactcccatgtccctgttttggccccacttcccattggattcgcggtgttcatggttcacctagccacaattcccatcaccggcaccggtatcaaccctgctagaagctttggagccgctgtcatctacaacaaagaaaaggcctgggatgaccaatggatcttctgggttggacctttcattggtgctgccattgctgcattctaccaccagtacattcttagagcagcagccattaaagctcttgggtccttcagaagcaatgcctagagtgaaggacttgtgtacgtacgtctctatgaagctagctagctatcccattatattggacaatcttaagggtgtcaaaatggagaagcaaggccatggaattgttaataaaagttctctttgcatgggaaattaagattgtaatttatatctttgttgtatttctatcccttgtggtgttgtgatcatctttcatttctttttcttttaatttttaccttttaatagtattttcttttctctttttctttttcttttttctataaattatgtcatgtactcggaattgaatgtttcttcataaagcaaac

SEQ ID NO: 14933 - DNA, 1130 bp, Panax ginseng
gcaaaaacagtactgtatatttttttatatagtgttgttgtgtagttatgggaaaggacggagaagtaacggagcagagtgagttctcagccaaggactaccatgatccgccaccggcagcctttatcggcaccgatgagctaaccaaatggtcactttacagggctgtcattgctgagttcatagccaccctcctcttcctttatatcactgtcttgacggtcatcggctacaagagccagtcagccaccgatgagtgtggcggcgttggcctcctcggcatcgcctgggcctttggtggcatgatcttcgtccttgtttactgcaccgccggtatctctggaggacacattaaccctgcggtgacgttcgggttgttcttggcaaggaaagtgtcgctaataagggcggtgttttacatggttgcacagtgtttgggtgcaatctgtggagtagggttggtgaaggccttccaaaagtcattatataacaggcatggtggtggagccaacgagctggctgatggttacaacaaaggcactggattgggagctgagatcattggcacttttgttcttgtctatacagttttctcagccactgatcctaagaggaatgctagagactcccatgtccctgttttggctccacttcccatcgggttcgcggtgttcatggttcacctagccacaatcccaattactggaaccggtatcaaccctgctaggagctttggagctgcagtcatctacggcaaacagaaggcctgggatgaccaatggatcttctgggttggacctttcattggtgctgccattgctgcattctaccaccagtatattctgagagcagcagcaattaaggctcttggatccttcaggagcaatgcttaattaattatgtttcaacaattacaatggaggacgtactactgcagcaagcttaattgctctgtcgtcgtctatgaattaattaaggaggatatctatatgttaaaatatggagatcaggcaggcaattaaggacggacataaatggagttaattgtagatataataataatcaagatttgtagtaatttctatctgtgttgtatttactttctctcccaactgttgctcatcttaatt

SEQ ID NO: 14934 - DNA, 1224 bp, Panax ginseng
ccctctctctctctaaatcttctttctgcacaaaagagctttaatcacttgttttaactagttaattatgggtaaggacggagaagtgacggagcatgcggaatacggcgccaaggactaccaagatccacctccggcagccttcatcggcaccgacgagctctctaaatggtcattatacagggctgttatcgccgagttcatagccaccctcctattcctgtatatcactgtattgaccgttatcggttacaagagccaatctgccaccgatgaatgcggcggcgttggactccttggcatcgcatgggccttcggcggcatgatctttattcttgtttactgcaccgccggaatctctggaggacacattaacccggctgtgacgtttgggttgttcttggcaaggaaagtgtcgctaataagggctttgttgtacatggtagcacagtgtttgggagcaatcagtggggtagggttggtaaaggccttccaaaagtcgttatataataggtatggtggtggggccaacgagctggctgatggttacaacaaaggcactggattaggggctgagatcattggtacctttgtgcttgtgtacactgtattttcagctactgatcctaaaaggaatgctagagactcccatgtccctgttttggctccacttcccattggattcgcggtgttcatggttcaccttgccacaattcccatcaccggcaccggtatcaaccctgctagaagctttggagccgctgtcatctacaacaaagaaaaggcctgggatgaccaatggatcttctgggttggacctttcattggtgctgccattgctgcattctaccaccagtacattcttagagcagcagccattaaagctcttgggtccttcagaagcaatgcctagagtgaaggacttgtgtacgtacgtctctatgaagctagctagctatcccattatattggacaatcttaagggtgtcaaaatggagaagcaaggccatggaattgttaataaaagttctctttgcatgggatattaagattgtaatttatatctttgttgtatttctatcccttgtggtgttgtgatcatctttcatttctttttctttttctttttacctttgaatagtattttcttctctctttttctttttcataaattatgtactcagaattgaatgtttcttcataaagcaaacaaatggtttatct

SEQ ID NO: 14935 - DNA, 1311 bp, Panax ginseng
ccccccccctatccccctgtgtgccttgcctcccacgactaatcactccactaatttctctctaaacttcttctaaatcactagaaaaatttgtgtgcaaaaacagtactgtatatttttttttatactgttgttgtgcagttatgggaaaggacggagaagtaacggagcagagtgagttctcagccaaggactaccatgatccgccaccggcagcctttatcggcaccgatgagctaaccaaatggtcactttacagggctgtcattgctgagttcatagccaccctcctcttcctttatatcactgtcttgacggtcatcggctacaagagccagtccgccaccgatgagtgcggcggcgttggcctcctcggcattgcctgggcctttggtggcatgatcttcgtccttgtttactgcaccgccggtatctctggaggacacattaaccctgcggtgacgttcgggttgttcttggcaaggaaagtgtcgctaataagggcggtgttttacatggtagcacagtgtttgggtgcaatctgtggagtagggttggtgaaggccttccaaaagtcattatataacaggcatggtggtggagccaacgagctggctgatggttacaacaaaggcactggcttgggagctgagatcattggcacttttgttcttgtctatacagttttctcagccactgatcctaagaggaatgctagagactcccatgtccctgttttggctccacttcccatcggattcgcggtgttcatggttcacctagccacaatcccaattactggaaccggtatcaaccctgctaggagctttggagctgcagtcatctacggcaaacagaaggcctgggatgaccaatggatcttctgggttggacctttcattggtgctgccattgctgcattctaccaccagtatattctgagagcagcagcaattaaggctcttggatccttcaggagcaatgcttaattaattatgtttcaacaattacaatggaggacgtacatgctagatactactgcagcaagcttaattgctctgtcgtcgtctatgaattaattaaggaggatatctatatgttaaaatatggagatcaggcaggcaattaaggacggacataaatggagttaattgtagatataataataatcaagatttgtagtaatttctatctgtgttgtatttactttctctcccaactgttgatcatcttaatttcatttttaaaattatctccttttctttttaattaaatattactcaatgtactcagagatcgatgtttgttcat

SEQ ID NO: 14936 - DNA, 1426 bp, Panax ginseng
cctatcccctgtgtgccttgcctcccacgactaaaccttcttctaaatcactagaaaaatttgtgtgcaaaaacagtactgtatatttttttatatagtgttgttgtgtagttatgggaaaggacggagaagtaacggagcagagtgagttctcagccaaggactaccatgatccgccaccggcagcctttatcggcaccgatgagctaaccaaatggtcactttacagggctgtcattgctgagttcatagccaccctcctcttcctttatatcactgtcttgacggtcatcggctacaagagccagtcagccaccgatgagtgtggcggcgttggcctcctcggcatcgcctgggcctttggtggcatgatcttcgtccttgtttactgcaccgccggtatctctggaggacacattaaccctgcggtgacgttcgggttgttcttggcaaggaaagtgtcgctaataagggcggtgttttacatggttgcacagtgtttgggtgcaatctgtggagtagggttggtgaaggccttccaaaagtcattatataacaggcatggtggtggagccaacgagctggctgatggttacaacaaaggcactggattgggagctgagatcattggcacttttgttcttgtctatacagttttctcagccactgatcctaagaggaatgctagagactcccatgtccctgttttggctccacttcccatcgggttcgcggtgttcatggttcacctagccacaatcccaattactggaaccggtatcaaccctgctaggagctttggagctgcagtcatctacggcaaacagaaggcctgggatgaccaatggatcttctgggttggacctttcattggtgctgccattgctgcattctaccaccagtatattctgagagcagcagcaattaaggctcttggatccttcaggagcaatgcttaattaattatgtttcaacaattacaatggaggacgtacatgctagatactactgcagcaagcttaattgctctgtcgtcgtctatgaattaattaaggaggatatctatatgttaaaatatggagatcaggcaggcaattaaggacggacataaatggagttaattgtagatataataataatcaagatttgtagtaatttctatctgtgttgtatttactttctctcccaactgttgctcatcttaatttctatttttaaattatctccttttcttttttaattaaatattactcaatgtactcagagatcgatgtttgttcataataaatcaaggaaatggtttgtgttccttaaaataaaaaaaaaaaaaaacaaaaaaaaaaaagaaaaaaaaaaagaaaaaaaaataaaagtacgtaggaggagaagacgacacaggaagaggaggaggggggggggggggggg

SEQ ID NO: 14937 - DNA, 1245 bp, Vitis vinifera
atcctcacatcaaagctttctctctcttgtgtaaaagtttgccgagacagcggtggtaatcaatgacgaaagacgttgaaacctcgggacaagagttttcgaacaaggactaccatgatccacctccggcgccgctgatcgacccagatgaattaacacaatggtccttatacagagccatcatcgccgagtttatcgccaccctgcttttcctctacatcactgtcctaacagtgatcggatacaagagccagtccgacaccgacccatgcgggggcgtgggcatcttgggtatcgcctgggccttcggcggaatgatcttcatcctagtctactgcaccgccggcatctccggaggacacataaacccggcggtgacctttgggctgttcttggcgaggaaggtgtcgctggtgagggctctcatgtacatgatagctcagtgcctgggtgcagtctgcggtgtgggcttggtgaaggcgtttcagtcttcgctctacaataggtacggtgggggagcaaacgagctggctggtggctacaacaagggcgtgggattgggtgctgagatcatcggcacctttgttcttgtctacaccgtcttctctgccactgaccccaagaggaacgcccgagactcccatgttcctgttttggcaccactgcccatcggatttgcggtgttcatggttcacctggcaacaattcccatcaccggcaccggtatcaacccggctagaagcttcggagctgctgtcatctataacaacgacaaggcctgggatgaccattggatgttctgggtcggaccattcattggagctgccattgctgcattctaccaccagtatattctgagagcagcggctattaaagctctaggatctttcaggagcaatgcctaggttttggacgctagctggtgatggtgatggtgatggtttctgcaacaagaataacatcaatggtggaggagtattagtacatgcaaatcggtctcaatctctttccagtgttttttctcttctatctgccccctctctctccctctctccctctctccctcccttggaaccatggaattgtagataaatttggcttttatctggccatgtctctttaaatatatttcaagtgctgtatgttgtcatcttttttcttttccctcctctctctctctctttctacttggtgtattcataatgatgcttccacattattctagtaaatggctatgctcctcaa

SEQ ID NO: 14938 - DNA, 1142 bp, Cichorium intybus
atcactccaccaccgtccatcttctctctagcaaattaacatgacgaaagatgtgccggagcaaggttcgttctccgccaaggactaccacgacccaccaccggcgccgttgatagacccggaggagctgaccaagtggtccttctacagagctcttatcgctgagttcattgccacccttctcttcctgtatattactgtattgacggttattggctacaagagccaaaccgaccccgccctgaacctcgaccagtgcggcggagttggtatcctcggcatcgcctgggccttcggcggcatgatctttgttcttgtttactgcaccgccggtatctccggaggtcacattaacccagcagtgacttttggtctgttcctggctcgtaaagtgtcattgatccgtgcaatcgggtacatggtggctcagtgtttaggagccatttgtggtgtgggtttggtcaaggctttccacaaaagctactacatgaggtacggcggaggagccaacgaactcgccgacggctacaacaaaggcaccggactaggcgctgagatcatcggaactttcgtccttgtctacaccgtcttctccgccaccgaccccaagaggagtgcccgtgactcccatgttccggttttggcaccacttcctattgggttcgcggtgttcatggtacaccttgccaccattccgatcaccggtaccggaatcaacccggctaggagtttgggagctgctgtcatctacaacaaggacaaagcttgggatgatcagtggatattctgggtgggaccgttcatcggagcagccattgcagctttctaccaccagtttatattgagagctggtgcaatcaaagcccttggatcattcagaagcagcacccaagtttgatgagatttcagttattttattgtattttctaaattgaaaaatgaaataatatttatgttcgaatttacatttagcccacaacacgcagttaaatgtggaatggctggaagggtataagagccatttcgtcctataaattcttttttcacatggcaaaatttaaccgacgagtattgcatacttactgatttaagacatgaaagatgattgatcaattaatatgaaaattttataattagtaagt

SEQ ID NO: 14939 - DNA, 1260 bp, Cucumis melo
caactcttctgttttctaactcccaatcccttccaaaacttcacccacgaccaccacaagctaacatgtctaaggatcttgaagccggtggattcgccgtcaaggattaccaagacccacctccagctccattgatcgacgccgaagagttaactcaatggtctttttacagagctatcattgccgagttcgtcgccactcttttgttcttgtacgtcaccgttctcactgtcattggctacagtagccaatccgacaccaaaagcggcggccaaatctgtggcggcgtcggcattctcggcattgcttgggcatttggtggcatgatcttcgtcctcgtttactgcactgctggaatttccggagggcatattaacccggcggtgacatttgggttgttcttggctcggaaagtatctttaattagagcaattctttacatggtggctcaatgtttgggcgccatttgtggctgcgctttggtgaaatcattccagaaggctctttacaatggatacggaggtggagccaattctctcgccgatgggtacagcaccggcaccggcttagccgcggagattatcggaactttcgttcttgtttacaccgtcttctccgccaccgatcccaagagaaatgctagagattctcacgttcctgttttggctccactcccaattgggttcgcggtgtttatggttcatttggccaccattccgatcaccggaactggaatcaacccagctcgaagttttggagctgccgtgatctataacaaagacaaggcatgggatgaccagtggatattttgggttggacccttcattggagctgcgattgctgcaatttatcatcagatagtgttgagggcaggagcagttaaagctctgggttctttcagaagttcgactgccgtatgaatgtgatataaatctgcatgaatgaatgtggaagttgtttagaaaaaatcccaaaggcacttggttttttgaagtgtgcccttgttctatccttccagttgctgtgtttctgttttgcttttactctgttattcgtcccccacaagttatatgtaatattgggctctgttttaatgcaaagtttgatccaatcaagtgggtcagtttctatgtgccattttgcactctctttcctttcaaatggtatttgtgttgttccaattcaaagtgggtttacatgataatttatgattctactcacaactttgaattacaaaatcaaacaccaaatgtttatact

SEQ ID NO: 14940 - DNA, 1143 bp, Populus trichocarpa
cgtcaataatagcaagcaaacctctttagctttgtcactcaagtctcatcgaaagatatgggcaaggacattgaagttggaggcgaattcattgccaaggactatcatgaccctccaccagcaccattgattgatgccgaggagctcacccagtggtctttgtatagggctatcattgccgagttcattgccacgctcttgtttctctacatcactgtgttgactgtgataggttacaagagccagactgacacgaccaagaacagcgatggatgtggtggggttggcattcttggcatcgcttgggcctttggtggcatgatctttgttcttgtctactgcactgctggtatctcaggtggacacattaacccggctgtgactttcggtttgttcttggctaggaaggtgtccctggtgcgtgccgttctatacatggtggctcagtgcttgggggccatatgtggatgtggactcgtgaaagctttccaaaagtcgtattacacaaagtacggtggtggagtcaatgaacttgctacaggattcagcaagggcactggattaggtgctgagatcatcggtacctttgttctcgtctacactgtcttctctgctactgacccaaagaggaacgcaagggactcccatgttcctgtgttggcaccacttcccatcggatttgctgtcttcatggttcacctggccactattccaatcactggaactggtatcaacccagctaggagctttggagctgctgtgatatacaacaaagacaaggcatgggatgaccattggatcttctgggtcgggcctttcattggggccgcaattgctgcattgtatcaccaatacgtcctgagagcagctgctgttaaagcccttgggtccttcaggagctcttccaacatttaattttaaagaccgtataatatatggtcactgaaatacttccatcaagttattgaatggtgtaacgcaaagattcaagtagtccaaaagggcttggaactggggaatgtgtacattatggtgtcgtggtcacgtttgtacgcgtattgggcacttgttttgtttgtgctcaaacgttttcatcttatctgtcttttaatttgtctcaggtagtgctgcttctttgtacat

SEQ ID NO: 14941 - DNA, 1003 bp, Fagus grandifolia
taattaagagcttcaaagcttaagtgagtatgactaaggacgttgaggttgcggagcagggtgagtattctgctaaagactaccatgatccacctccggcgcctttgatcgacgctgaggagctaacccagtggtccttttacagagctcttatagccgagttcattgccactcttcttttcctttacatcacagtactcactgtgattggctacaagagccagattgacacagccaatggccccgacgccgcatgtggtggcgtcggcatccttggcattgcttgggcctttggcggcatgatcttcgtccttgtttactgcaccgctggtatctctggaggacatattaacccggctgtgactttcgggttgttcctggcgaggaaggtgtcgctcgttcgagccgtgttgtacatggtcgcacagtgcttgggtgcaatcagtggtgttgggttggtgaaggcgttccaaaagtctcactacaacaggtacggtggtggagccaacgagctacaagctgggtacaacaagggcgttggattgggggctgagatcatcggtacctttgttcttgtctacactgtcttctcagccactgatcctaagaggaacgcaagagactcccatgttcctgtattggcacccctccctattggattcgctgtattcatggttcacttggccacaatcccaatcactggcacgggtatcaacccagctagaagttttggagccgcagtgatctacaaccaagacaaggcctgggatgaccaatggattttctgggttggaccttttattggagctgccattgctgccttctaccatcaattcattcttagagcagcagctattaaggctctaggatccttcagaagcaatgcttaagcttttcatcaattatttcccaaagatggagatgatgtttccaaaaagataacaatattgaggagtgctagtctgtctgagggtcctttagcaatccctcatggtttgatgga

SEQ ID NO: 14942 - DNA, 1221 bp, Castanea mollissima
tctagctcatactacttgtaaagcttaagtgatcactatgacaaaggacgttgaagttgtagagcaaggaggagagtactcagctaaggactaccatgacccgcctccagcacctttgatcgaccctgaggagctaacccagtggtccttctacagagctcttattgcagagttcattgccacacttcttttcctttacatcacagttttgactgtgattgggtacaagagccagactgaccccgccaagaacgcagaccaatgtggtggggttggtattcttggtattgcttgggcctttggtggcatgatcttcgtccttgtttactgcactgccggtatctctggaggacacataaacccggccgtgacattcgggctgttcttggcgaggaaggtgtctctgatccgagcggtgttgtacatggtagcacagtgcttgggagcaatctgcggtgttgggctggtgaaggcgttccagaagtcactctacactaggtatggaggtggagccaatgagcttcaagctgggtacaacaagggaactggattgggggcagagataattggtacctttgttcttgtctacactgtcttctcagccaccgaccctaagagaaacgctagagactcccatgttcctgtattggcaccccttcccattggatttgctgtattcatggttcacctagccacaatcccaatcactggtactggtatcaacccagctagaagccttggagccgcagtgatctacaacaaaaccaaggcctgggatgaccaatggctattctgggttggaccttttattggagctgccattgctgccttctaccaccaatacattcttagagcagcagccattaaggctctaggatccttcaggagcaatgcttaagttttaagcttttcaaaccaattatgtattaagatggagatgggtgtttcaaagtgaataacaatactgaggagtgcaagtctgtctgagggtccctttaccaatcctcaatagtcatggaggcccatggaattgtagataaacgtgtctgtgggacaggacaggggggctgccttttgtgtatccctttcctttttctcttttcttttctttcatgtatttatgtggtgattgttgtccttgtttatccttgaatcatcttttactttttgctttttctatgtggttgtgtagtcgcgttgtttccacataaaagctagtga

SEQ ID NO: 14943 - DNA, 1043 bp, Gerbera hybrid cultivar
cagtttctctctctagaaaacatgacgaaagacgtgccggagcaaggatcgttctcggcgaaggactaccacgaccccccgccggcgccgttcatcgatccagcggagctgacgaagtggtcgttttacagagctataattgctgagtttatagccacgcttttgtttctttacattactgtgttgactgtaatcggctacaagagccagacggatccggcgaagaatcttgaccagtgcggcggcgttgggattctcggcatcgcctgggcgttcggcggcatgatttttgttctggtttactgcaccgccggtatctccggtggtcacattaacccagcagtgacatttggtctgttcctggctcgtaaggtctcactcattcgagccttgatgtacatggtggctcagtgcctaggagccatttgtggtgtgggcttggtcaaggctttccacaaaacctactacaacaactacggcggtggagccaacgagctagccgacggctacaacaaaggcactggactaggtgctgagattatcggcactttcgttcttgtttacaccgttttctccgccaccgaccccaaaaggagtgcccgagactcccatgttccggttttagctccacttccaatcgggtttgccgtgttcatggtgcatctagccaccatccctatcaccggaactgggatcaacccggctaggagtcttggagccgccgtcatttataacaaggataaagcctgggatgatcagtggatattctgggtgggacccttcattggagcagccatagcagcgttctaccaccaatttatactgagagctggtgctgtcaaggcccttggatcattcagaagcagcactcaagtttaagatttttttttacctttattttatttttttagcccaaaaaaaccaaaaaataaaataaaaatatttgtatttgaatatttatttatgttgtagatcttaaaactaaatgcaatgttgaaggctttcaagagcaatttgagttatgtatcattcctactcataaa

SEQ ID NO: 14944 - DNA, 1225 bp, Panax ginseng
actccactcccaccttcaccttctattgccaaaactcctctgcttatttctccacctctatatatcatttctatatacacatatctcttgttaatatgacaaaagacgtagaggtggcggagcacggctcattctccaccaagtactaccacgagccgccaccggtggcgctgtttgacccggatgagctaacacagtggtctttctacagagctctcattgcagagttcattgccacctttttgttcctttacattacggtattgaccgtgattggttacaagagccagattgatccaaccaatgatggggaccaatgcggaggtgtcggaattctgggtattgcttgggcttttggcggcatgatctttgtccttgtttattgcaccgccggtatctctgggggtcacataaacccagcagtaacatttgggttgtttttggcccggaaagtgtcactggtccgagccattatgtacatggtagcccagtgcttaggggccatatgtggagttgggcttgttaaggctttccagaagtcttactaccagaggtacggaggtggggccaatgggctgaacgatggatacagcacaggcaccggattggcggccgagatcatcggaacgtttgttcttgtctacactgttttctcagctactgatcccaagaggaacgccagagattcccatgttccggtactggctcctctcccaattggatttgcggtgttcatggttcatttggccaccatccccatcaccggcaccggcattaaccctgcaaggagttttggagctgctgtgatttacaacgaggacgaggcttgggatgaccaatggctattttgggttggtcccttcattggtgcagccattgcagcattctatcaccaattcatattgagagcaggtgccattaaagccctcggctctttcaggagcaatgcttgattttaatatttaagagccgttttcgcttttttatttgtcaatttggcaagaaaaaatagttatgagagagaaggcaatagtattttcataagaataagcaaggaatatgtgtttgtgtatgaagtttccttgtctttcactatctcaactgttcttcaaggttgaaagggggatggatggggaattaagtgatagtcatggaaactagtgtagatatcattaatgtattttgaaaaggaaatctttttttattattattttaggaaattgat

SEQ ID NO: 14945 - DNA, 785 bp, Solanum phureja
aattccactgattgttcattttacagagccataattgctgaattcatagctactcttttatttctctacataactgtcctgactgttattgggtacaaaagccagaattctactgaccaatgtggtggtgttggtattcttggaattgcttgggcatttgggggtatgatttttgtacttgtttattgtactgctggtatttctggtggacacattaaccctgctgttacattcggccttttcttggcccgaaaagtatcgttggttcgggccataatgtacattgtagctcagtgtttaggagccatttgtggttgtggattggttaaatcttttcaaaaagcttattatgttcagtatggtggtggtgctaataagttgaatgatggatatagtactggtaccggtttgggtgcggagattattggaactttcattcttgtttacactgtttttgctgctactgatcctaagaggaatgccagagactcacacgttcctatattggcgccacttccaattggatttgcggtgtttatggttcacttggctacaattcctgttactggaactggtattaatcctgctaggagttttggggctgctgttatttatggagatcacaaggcttggaatgaccaatggatattttgggttggaccatttattggtgctgcaattgctgcattttatcatcagtttattttgagggctggagctgtgaaagcacttggttcattcaggagcaatgcctaataattatcatcaagaattgaaaattgtat

SEQ ID NO: 14946 - DNA, 1184 bp, Tripterygium wilfordii
actctcactctctttctctttctagcactctcagtttgcccctctgtcttgcaatggcgaaggacatagcagagcaaggctcgttctcggccaaggactaccacgacccaccacccgcgccgttgttcgacgcggtggagctcacaaagtggtctttctacagagccttgattgccgaattcatagcaactctcctcttcttgtatattacagtcttgactgtgattggttacaagagccaaaccgaccatgccctgaatgccgacgcctgcggtggtgttggaatcttgggtatcgcttgggccttcggtggcatgattttcgttctcgtttactgcaccgccggtatttcagggggtcacattaaccccgcggtaacttttgggctgttcctggcccggaaggtgtcgttggtccgagccgtgatgtacatggtggctcagtgcttgggtgccattagtggtgttgcgcttgtgaaggccttccagaaatccttctacaagagatatggtggtggtgctaacacacttgctgatggttacagcactggtactggattggctgcagagattattggtacttttgttctggtctacactgtgttctccgccactgatcccaagagaaatgccagagactcccatgtccctgttttggctccacttccaattgggtttgctgtgttcatggttcatttggctaccattcccatcaccggcaccggaatcaacccggctaggagtctaggagctgctgttatctacaaccaagacaaggcctgggatgaccaatggatattctgggtaggacccttcattggtgcagcaatagcagcattctaccaccaatttattctgagagcaggagctgccaaggctcttgggtcattcaggagcaacccaagtgtctaagaattcatgataattatgtcaagtaataattagcccaattgtcttatggatatgttgggttggagaattctcgatttacgaaaaaaaattatgttgtgtatgatctatatgatggatggggtgtgagaggatcaatgtagataacaagtctctttgtccttttttcaaattacttggcttagaaatcactccaaaatgtaatcgtgtcttccaatttctctcttttttaatgtcttttgtactcaatgggttatattatctttagtaaaaaaa

SEQ ID NO: 14947 - DNA, 939 bp, Rosmarinus officinalis
tctctacacatttccacttctctctcgttctctctgtctcaccgcagatgacgaaggaggtggaggagcacggctcccacggcgcgaaggactaccacgatccaccgccggcgccactgatcgacgcggaggagctgacaaaatggtcgttctacagagctctcattgctgagtttatcgcaactctgctgttcctctacatcaccgtgcttacggtaatcgggtacaagagccagtcggcgacggacgagtgcggcggcgttggaattctcggcattgcatgggccttcggcggcatgattttcattctcgtctactgcaccgctggaatctccgggggtcacataaacccggccgtgacattcgggcttctcttggcccggaaagtgtcgttgattcgggccgtgatgtacatggtagctcaatgtttgggggccatttgtggagtcgggctggtgaaggccttccaaagctcctactacaaaaagtacggcggcggcgccaacgagctcagcctcggctacagcaccggagtcgggctcggcgcggagatcatcggcaccttcgtcctcgtctacaccgtcttctccgccaccgatcccaagaggaacgcaagagattctcacgttccggtgttggcgcctctcccgattgggtttgcagtgttcatggttcatctggcgacgatcccgatcaccggcaccggcatcaaccctgctcggagtcttggagctgcagtcatatacaatcaggacaaggcttgggatgatcattggatattctgggtggggcccttcattggtgcagccattgcagctttctaccatcagttcatattgagggcaggagcagctaaagcccttggctcgttcaggagcagtacttcccaccatgtttaattattttaatttctatgatgaattgtcaggaaaagagaaa

SEQ ID NO: 14948 - DNA, 1328 bp, Lactuca sativa
tccctcactatccccataaatagcaggctttcaataccacacatttcacaccaaacaccttacttctctctccaaaaagtaaaagccctactactactactagcttactgctaattggatcgacagccatgacaaaagacgttgaagtggcggagcaccatggcggcaaagactaccatgacccacctccggcgcccttgatcgacgccgaggagctcaccaagtggtctttctacagagctgtcatcgccgaattcattgccaccctcctcttcctttacgtgaccgtcttaacagtcatcggctacaaaagccagactgacccggccttagaccttgatcagtgcggcggcgttggcatcctcggtatcgcatgggccttcggtggcatgatcttcattctcgtttactgcaccgccggaatctctggaggacacattaaccctgcggtgacattcggtctgttcttggcaaggaaggtgtcgttgattagggcagtgttgtacatgatagcacagtgtttgggagcaatttgtggtgtgggtttggtgaaagctttccaaagctcctactacaacagatacggcggtggtgccaacgaattagccgacggctacaacaaaggcacaggcctcggtgctgagatcatcggcacctttgttcttgtctacaccgtcttctccgctactgatcctaagagaagtgctcgagactctcacgttcctgtattggcaccactacccatagggtttgcagtcttcatggtacacttggccactatcccgattaccggtaccggaatcaacccagccagaagcttcggcgctgccgtgatttacaacaacgagaaggcctgggacgaccaatggatcttctgggttggaccgtttatcggagcagcaatagctgcgttctaccaccagtttgtattgagagcaggagccattaaagcacttggttctttcagaagcaatgcataatctgaaagaatgtttattcatcaattatcatcatccatccaacaaaataaaactgatcgatatgcatggagaacaagaatttcatcattcgtttgagcgtggttttctggtcattgtaaatggatggatgtgacatatgagtgtggaagtgttcaattgtagataatattttaatttctctttgaggaatattgcatattgtatttcgttttttttttcttttctgaatcttcagtcatgtttaatgtatgtggtctttttattatgctatttcaataaaatgtagggtttctttcatttatgtcattttagttttattttctagtattctggttctttttggtggat

SEQ ID NO: 14949 - DNA, 1256 bp, Aquilegia formosa
ctctctttctctactcttcatcttatcaagttatcaactcaactcaacacaacacaacacaacacaacacaaaaacattccttcacttcacataaacaactaaagaagtgtgtttcaagaaatgggcaaagatgttgaagttgctgagcatggtgagttctctgccaaggactaccatgatccaccacctgcacctttgtttgatgccaaggaacttgctagttggtctttttatagagctatcatagctgaattcatcgctactcttctctttctctacattactgtcttgactgttattggttacaagagtcaaagtcttaatgatccatgtggtggtgttggtattcttggtattgcttgggcttttggtggtatgatctttgttcttgtttactgcaccgccggtatctctggaggacatattaacccagcagtgacgtttgggctatttttggcacgaaaagtgtcgttgattcgagctgtgatgtacatgattgctcaatgtttaggagccatatgtggtgtaggatttgttaaggcctttcaaaagacttactatgaaacctatggtggtggtgcaaacgaactagctcaaggttacaacaagggaactggattagcagctgagattattgggacttttgttctagtatacacagtcttctctgcaactgacccaaagagaagtgcaagagattctcatgtccctgtcttggcaccacttcccattggatttgccgtgttcatggttcacttggccacaatcccaatcactggcactggtattaacccagctaggagttttggagctgctgtaatctacaacaaggagaaggcatgggatgaccagtggatattctgggttggaccattcattggtgctgccattgccgcgttttaccatcagttcattcttagagcggccgccatcaaggctcttgggtcctttaggagcaatgctcacaactaaatttcaaggtgcctcactcaatatcgcagaggacatgaaatttccgatcaataaatatgaatgagtgcaagtctgtgtgtgaagggtctctctgccatttgtttctcctagagttagtgagaagcatagggttaagaaaccatggaaatgtagatatttcaatttgaaggaagggcgggtttttattatcatcccttttgttgttgtttatcttctttagacttttgttgaatgtaagttatttaagtgtttgtgtcatcttaatctatttccttttctctct

SEQ ID NO: 14950 - DNA, 872 bp, Flaveria ramosissima
ttgaagtcgccggtggccatgagtacggcggaagagactaccaagacccgccaccggcagacctcttcgacgctgaggagctgactaaatggtcgttttaccgagccgtcatcgctgagttcatcgccaccctcttgttcctttacatcaccgtcttgaccgtcattggctacaagtcccaaaccgacccagcccacgcctccgaccaatgtggcggtgtcggcatcctcggtatcgcgtgggccttcggtggcatgatcttcgtcctcgtctattgcactgctggcatctcaggtggacacattaaccctgcggtgacattcgggttgtttttggctaggaaagtgacgctcccgagggcgttcatgtacatcgtggctcaatgcttgggtgccgtatgtggttgcggtctggttaaagcgttccaaaagacttactacaacacttatggtggcggcgccaatgagctcgccgacggctatagtaaaggcaccggcttgggtgctgagatcatcggcacatttgttcttgtctacaccgtcttctccgccactgatcccaagagaaatgcacgagattcccatgtccccgtattggcacctcttcctattggatttgctgtattcatggttcacttagccaccatcccgatcaccgggaccgggatcaacccggctcgtagctttggtgccgcggttatgtgtggaaaagacaaagcctgggatgatcaatggttgttctgggtgggaccgatgatcggggcggccatcgccgccttctaccaccagtatgtactgagagcaggtgcagtcaaggctcttggatcccacaggagcaatgcttaagctatgagtggaagaaattgtacaaag

SEQ ID NO: 14951 - DNA, 1386 bp, Papaver somniferum
aactattcaatggtcggtgaaaagttacatcaaaattttgtattcagagaatggccgggggggtgggcaatgacatccatccaatacccaaaaaccaatagaaaacgaagcaaaaatagaaaatatatctgtggggataaggggcggcaatatttagttaataaaaacctaatcaccacttctattttatcatctctacacaaccactgaagcttatcactgatatcactataatataaataccctcgtttcctctcatctcaaacacaaatacaaactcactcctcttccttcctctccacagtactcaactcttctttatttccggtactatcctattctgaatttgtactgtttcttgagaaatcaaaaatatgggaaaagacgaagtagcagaacatggtgaattctcagcaaaggattatcacgacccaccaccaacaccattttttgatgcagatgagcttaagaaatggtctttctacagagctattattgctgaatttgtagctactcttttgttcctttacatcactgttttgactgttatcggttacaaggctcagagtgaagctgatgattgtggtggtgttggtattttgggtatcgcttgggcttttggtggtatgatcttcgtcctggtttactgcaccgccggtgtctccggaggacacatcaacccagcagtaactttcggactatttttggcaagaaaagtttcactaccaagagcagtactgtacatggtggctcaatgtttaggagcaatctgtggtgttggattagtcaaggctttccaatctgcttactacgttaaacatggtggtggcgccaatacactttccgctgggtacagcaaaggaactggtctagcagctgaaatcatcggaactttcgttcttgtgtacacagtcttctcagccactgaccccaagagaaacgccagagactcccatgttcccgttttggcaccacttccaatcgggtttgccgtgttcatggtccacttagccactatccccgttaccggtaccggtattaacccagctagaagtttcggagctgccgttatcttgaacgacgagaaggcatgggatgaccagtggatcttctgggtcggacctttcattggtgccgcaatcgctgctatttaccaccaatttatcctaagggctggtgctattaaagctttgggctcatttaggagcagtgctcgtgtctaataagacttgaagaattattgttggatagagataagggtgatgttttttttttatgtttggaagatggtgatgatgtttgcaaggaataataataatggagctcctcctctagggggtccatataggggtggtggatttgtgacttgtgtatctatctaaaaaa

SEQ ID NO: 14952 - DNA, 1322 bp, Papaver somniferum
caaactcactcctcttccttcctctccacagtactcaactcttctttatttccggtactatcctattctgaatttgtactgtttcttgagaaatcaaaaatatgggaaaagacgaagtagcagaacatggtgaattctcagcaaaggattatcacgacccaccaccaacaccattttttgatgcagatgagcttaagaaatggtctttctacagagctattattgctgaatttgtagctactcttttgttcctttacatcactgttttgactgttatcggttacaaggctcagagtgaagctgatgattgtggtggtgttggtattttgggtatcgcttgggcttttggtggtatgatcttcgtcctggtttactgcaccgccggtgtctccggaggacacatcaacccagcagtaactttcggactatttttggcaagaaaagtttcactaccaagagcagtactgtacatggtggctcaatgtttaggagcaatctgtggtgttggattagtcaaggctttccaatctgcttactacgttaaacatggtggtggcgccaatacactttccgctgggtacagcaaaggaactggtctagcagctgaaatcatcggaactttcgttcttgtgtacacagtcttctcagccactgaccccaagagaaacgccagagactcccatgttcccgttttggcaccacttccaatcgggtttgccgtgttcatggtccacttagccactatccccgttaccggtaccggtattaacccagctagaagtttcggagctgccgttatcttgaacgacgagaaggcatgggatgaccagtggatcttctgggtcggacctttcattggtgccgcaatcgctgctatttaccaccaatttatcctaagggctggtgctattaaagctttgggctcatttaggagcagtgctcgtgtctaataagacttgaagaattattgttggatagagataagggtgatgtttttttttatgtttggaagatggtgatgatgtttgcaaggaataataataatggagctcctcctctaggggtccatataggggtggtggatttgtgacttgtctatctatctaaaaaagtttacatttattctatctctgtctgtctccctccacttcttgaaaaaaaaagagaaaagaaaagagagggtgaaaaacgagaagatgattgataaattggaagtttgtagatataatctctctatttattagtgtattttcccttttgtttcatgaaagtctttcaagtgtcaactgtaatattatctgctcttttgctatttctctcta

SEQ ID NO: 14953 - DNA, 962 bp, Valeriana officinalis
agttgcagagttcactgctaaggattaccaagatccgcctccggtcagtttgtttgactccgaggagttgactaaatggtcgttttatagagcaataatcgcagagtttatcgccactcttttattcctttacattacggtgttgactgtcatcggatacaaaagtcaaactgatccattaaagggaactgatcaatgtggcggtgttggtattctcggtattgcttgggcttttggtggcatgatctttgttcttgtttactgtacagccggtatttccggtggtcatattaatccggctgtgacattcgggttgttcttggctcggaaagtgtcgttatgtagagcagttctgtacatgatagctcagtgtttgggagccatttgtggatgcggattagttaaagctttccaaaaaacgtactacaacacatacggtggtggtgctaacgagcttgcgtcaggttacagtaaaggcaccggtctggctgctgagatcatcggaacttttgttcttgtctacaccgtcttctctgctactgatcccaaaagaaacgctcgtgattctcatgttcctgttcttgcaccacttccgatcgggttcgctgtttttatggttcatttggccacaatcccaatcaccggaaccggcattaaccctgcacgtagttttggagctgcagtgatttatggaagagagaaagcatgggatgatcaatggatattctgggttggaccatttattggagcagcaatagcagcaatataccatcagttcatattgagagcagcagctcttaaagctcttggatcattcaggagcaatgcttgatttgttgttatttctagcttgaatttcaaatttaagttatccaaatggattagagtgtatttgcaaaaaaaaaaaagttgtaattaagtgttgtatttcaaattttaggatgtgagtttggcaaatgttg

SEQ ID NO: 14954 - DNA, 1307 bp, Euonymus alatus
tcatcgatcctactccaccattccaagtcctctccacaactctgtgagactgagcagaagtgaagctatggcaaaggacattgaagcttcaggtccaggatcaggattccaatccaaggactaccaagatccaccaccagcacctctaattgacgttgatgagctcacccagtggtccttatacagagccgtaatcgccgagttcatagccacactcttattcttgtacataaccgttttaacagtaattggctacaagagccaaactgacccagccttgaacaccgatcaatgcggtggcgttggaatcctcggcatcgcttgggccttcggtggcatgatcttcgttctagtctactgcaccgcaggaatctcaggaggccatattaacccggcggtgacgtttgggcttttcttggcgaggaaggtgtcaatgatccgggccatattgtacatggcggcccagtgtttgggggccatatgcggttgtgggcttgtgaaggctttccagaaggcctactacaccagatacggcggtggagctaacgagctcgctgatgggtacagcacaggcactggattgggtgcagagattattggcacttttgttcttgtttacactgtcttctccgctactgaccccaagaggaatgcaagagactcacatattcctgtgttggcaccacttccaattgggtttgctgtattcatggtgcatttggccacaattcccatcactggcactggtattaaccctgcgaggagttttggagctgcagttatatacaacaaggagaaagcttgggatgaccaatggttgttctgggttggacccttcattggtgccgcaatcgctgcaatctatcaccagtacatcttgagagctggtgcagttaaggcccttggttccttcaggagttcctccaaagtctgaatttgagaacatacttcacaccagctttcatcccttgaccattggaactcaaataatcaatggtgttatggtggaagtacttcagttccattatgtatattaatgttagtggttggatcatgtcaattgtcatctttgtgtgataggcactggttttatttgtgcctaatgttgttgtctgctctgtttccttcttaattaaagatcttatcctttttgttttgttgttgtcttttgctgtgtcaatggcaagtttacagatgattgatatagtaatctttttttgtgtgacattgagatgggcccaaaaggcccatgtagtctcttcttgggctttgagctcttttggcaatgcaactttgagactttgagt

SEQ ID NO: 14955 - DNA, 961 bp, Euonymus alatus
cggccgggggactccaccattccaagtcctctccacaactctgtgagcctgagcagaagtgaagctatggcaaaggacattgaagcttcaggtccaggatcaggattccaatccaaggactaccaagatccaccaccagcacctctaattgacgctgatgagctcacccagtggtccttatacagagccgtaatcgccgagttcatagccacactcttattcttgtacataaccgttttaacagtgattggctacaagagccaaactgacccagccttgaacaccgatcaatgcggtggcgttggaatcctcggcatcgcttgggccttcggtggcatgatcttcgttctagtctactgcaccgcaggaatctcaggaggccatattaacccggcggtgacgtttgggcttttcttggcgaggaaggtgtcaatgatccgggccatattgtacatggcggcccagtgtttgggggccatatgcggatgtgggcttgtgaaggctttccagaaggcctactacaccagatacggcggtggagctaacgagctcgctgatgggtacagcacaggcactggattgggtgcagagattattggcacttttgttcttgtttacactgtcttctccgctactgaccccaagaggaacgcaagagactcacatattcctgtgttggcaccacttccaattgggtttgctgtattcatggtgcatttggccacaattcccatcactggcactggtattaaccctgcgaggagttttggagctgcagttatatacaacaaggagaaagcttgggatgaccaatggttgttctgggttggacccttcattggtgccgcaatcgctgcaatctatcaccagtacatcttgagagctggtgcagttaaggcccttggttccttcaggagttcctccaaagtctgaatttgagaacatacttcacaccaacttt

SEQ ID NO: 14956 - DNA, 1297 bp, Glycine max
cacacacacttgcccatcatcaaagttttttcctttctctgctctttgccttctctgacacatttggtgccttgtagagcgtgttttggcaggaaggtggtatggcgaaggacgttgaggttgctgagcgtggctccttctctgggaaggactaccaggaccctccaccagcaccactcattgatgctgaggagctcacaaagtggtccttttacagggctctcattgctgaattcattgccactttgctcttcctctacattactgtgctcacagtcatagggtacaatcaccagactgacctcaaggaaaatggtgaaatctgtggtggggttggcattcttggcattgcatgggcctttggtggcatgatcttcatccttgtctactgcactgctgggatttcagggggtcacattaacccagcggtgacatttgggctgtttttggctcgcaaggtgtctttgatccgagccatcatgtacatggtggctcagtgcttaggtgctatctgtggagttggtttggttaaggctttccaaaagtcttacttcaacaagtatggtggtggggctaattccctcgctgctgggtacagcacaggtactggattgggtgctgagattattggaacctttgttttggtctacactgtcttctctgccactgaccccaagaggaatgccagagattcccatgtgccggttttggctccacttcccattggatttgctgtgttcatggttcacttggccaccatcccagtcactggtactggtatcaaccctgctaggagtcttggagctgctgttatctacaaccaagataagccatgggatgaccattggatcttttgggtaggaccatttattggggcagccattgcagccttctaccatcagttcatcttaagagcaggtgcagctaaggctcttggatcattcaggagtaacccccataattgagttgtctttctcttccttatgatggctctagtggaaagaagataattggagagatgggggttgatatggcaagtttaataataattgggaatgcttttggcttgtgttttgcaacgtttctttgaccctctcgattatgtcttcaagattgtggataagtgtagattaaagtctctttcatgacagggggagccttttgcactttcctctgtggtgttcttccctttagtgtgtcatttttttcttttaagttattctcttcagctgtcatctctgtactcaaaatatatttatggaaaatgttaaattttaattttaattacattcctgct

SEQ ID NO: 14957 - DNA, 1388 bp, Glycine max
tcttctctttttttccattttaaaaaaaaatggtaagtactactacatgccagagtgtgcaccaggctgcaccagcatatataccccttctcttctcactctcttccacacacacttgcccatcatcaaagttttttcctttctctgctctttgccttctctgacacatttggtgccttgtagagcgtgttttggcaggaaggtggtatggcgaaggacgttgaggttgctgagcgtggctccttctctgggaaggactaccaggaccctccaccagcaccactcattgatgctgaggagctcacaaagtggtccttttacagggctctcattgctgaattcattgccactttgctcttcctctacattactgtgctcacagtcatagggtacaatcaccagactgacctcaaggaaaatggtgaaatctgtggtggggttggcattcttggcattgcatgggcctttggtggcatgatcttcatccttgtctactgcactgctgggatttcagggggtcacattaacccagcggtgacatttgggctgtttttggctcgcaaggtgtctttgatccgagccatcatgtacatggtggctcagtgcttaggtgctatctgtggagttggtttggttaaggctttccaaaagtcttacttcaacaagtatggtggtggggctaattccctcgctgctgggtacagcacaggtactggattgggtgctgagattattggaacctttgttttggtctacactgtcttctctgccactgaccccaagaggaatgccagagattcccatgtgccggttttggctccacttcccattggatttgctgtgttcatggttcacttggccaccatcccagtcactggtactggtatcaaccctgctaggagtcttggagctgctgttatctacaaccaagataagccatgggatgaccattggatcttttgggtaggaccatttattggggcagccattgcagccttctaccatcagttcatcttaagagcaggtgcagctaaggctcttggatcattcaggagtaacccccataattgagttgtctttctcttccttatgatggctctagtggaaagaagataattggagagatgggggttgatatggcaagtttaataataattgggaatgcttttggcttgtgttttgcaacgtttctttgaccctctcgattatgtcttcaagattgtggataagtgtagattaaagtctctttcatgacagggggagccttttgcactttcctctgtggtgttcttccctttagtgtgtcatttttttcttttaagttattctcttcagctgtcatctctgtactcaaaatatatttatggaaaatgttaaattttaatttt

SEQ ID NO: 14958 - DNA, 1235 bp, Manihot esculenta
ctcctctctctccctctccctctcgcgttctctctgtacagagaacttctattttgttttctcagaaactcatttaagcacaaggatcgatcatggcaaagggcattacagagccaggatcattctcttccaaagattaccatgatccacctccggctccattgattgatccggctgagctcacccagtggtcgttttacagagctctgattgctgaatttatagctactttgctcttcctttacatcactgttttgactgtgattggatacaaaagccagactgatccttcacttaagaattctgactcttgtggcggagttggaattctaggcatcgcttgggctttcggcggcatgatctttgttcttgtttactgcactgctggtatttccggagggcacattaacccagcagtgacattcgggttattcctggcccgaaaggtctcgttggtacgggctgtgatgtacatggtggcccagtgcttaggagccatatcgggtgtgggattggtgaaggcgttccaaaggtcccactataagaggtatggtggtggggccaacactttagctgatgggtacagcacaggcgttggattaggtgctgagattatcgggacctttgttttagtgtacacagtgttctctgccacagatcccaagaggagtgccagagactcccatgtgcctgttttggctccacttccaattggatttgctgtattcatggttcacttggccaccattccaatcactggcactggcatcaatccagccaggagtctaggagctgctgttatctacaaccaggacaaggcctgggatgaccaatggatattttgggttggacccttcattggtgcagccattgcagcattctatcaccaattcatcttgagggctggtgcagtgaaggctcttgggtcattcaggagcaaccccactgtttaagagaagactttttgtcaaaaggaaataataatgagatgaagcaagagcatatgttggttggttggtttgttaaaaatcatgaaaaggagagagagttgaaattaaaggattatggaatatttggttttgtagtaaggttatgatggtttcctagttagttcatcctctattgtctatttttttttttccatgcaattattatgcttgtaagaaaatttagggtatttggtcaagtcttttgttgcttgtcttaaaagattaagatgtgcatgtgttattatg

SEQ ID NO: 14959 - DNA, 1336 bp, Juglans hindsii x Juglans regia
cttgcataaataccccctcaacctttctgcattttctcatcaatcaccctcccacccccctctcatcttctctagcagagctgatctctttcactttgattactcagcttcctcacgagtgatatatactatggccaaggacattgaagctgccggtcaaggtgggttctccgccaaggactaccacgacccaccgccggcgccattgatcgatgccgaagagttcactcagtggtccttctacagggctatcattgccgagttcattgccacgcttttgttcttgtacatcactgttttgaccgtgattggatacaagagccagaccgacaaggccaagggcggcgacgattgtggcggcgttgggattctcggtatagcttgggcctttggtggcatgatcttcgtcctcgtttactgtacagccggcatttcaggaggacacattaacccggcggtgacattcgggctgtttcttgcgagaaaggtgtcgctggtccgagcggttttctatatggcagctcaatgcttgggagccgtgtgcggatgtgggcttgtgaaggcattccagaaagcttactacagcaagtacggtggtggagcaaacgagctcgctgatgggtacagcaagggcactggattggccgctgagatcatcggcacctttgtccttgtctacaccgtcttctctgccaccgatcccaagagaaatgccagagattcccatgtacctgtcttggcaccacttccaatcgggtttgctgtgtttatggttcatctggctaccattccaatcaccggaactggtatcaatccggctcgaagcttcggagctgctgtcatctacggcaaggacaaggcatggaatgaccaatggattttctgggttggaccattcattggagctgctattgctgcattctatcaccagtacatcttgagagctggcgctgctaaagctctaggatccttcagaagctcttccaccatataaattaaaaaggaaaagtaaaagtgtctctcctcaccaatttctggaaagagaagcagcactttgatgtggtttgggagtgtttagagcaagctggatgtcctgtctttcttcttctttaagttctgggcactcgttttaaatgtgccctaatgtcccattttcctatgtaatttttgtcttctcattctgttcactgtgtactcgtgatgttatgggtgaatttgtcggctaaggctaagtgctctgtattacctctggctaagtgctctgtattacctctgtccattcgtgcatgggtttcctataatttcttttttaattagattttctaatttataacca

SEQ ID NO: 14960 - DNA, 1079 bp, Vaccinium corymbosum
gggactcccaccacaaactctctctctgtctccaacccaacaaaccctttttctctctctagaaaactttagcacttccacatggccaaggacatggaagtggcagagcaggggtctttctccgccaaggactaccacgatccgccaccggcgccgctcatcgacgcggtggaactagccagttggtccttttacagggccctgatcgctgagttcatcgccactctcttgttcctttacattacggtcttgaccgtgatcggctacaagagccagtctgacccgaccaagaccaccgatccctgctccggcgtgggtattttgggaatcgcgtgggcttttggtggcatgattttcgttcttgtttactgcacagccggaatttctggtggtcacattaacccagctgtgacattcggattgttcttggcccgaaaggtatccttaatccgggctgtgatgtacatggtggcccagtgcttgggggccatctgcggtgtgggcctcgtcaaggccttccagaagtcttattacgaccagtacggcggcggagcgaacacgctcgccctcgggtacagcaaaggcaccggattggcggccgagatcatcggaactttcgtcctcgtttacaccgtcttctccgccaccgatcctaagaggagcgcgagagactcccatgttcccgtgttagcaccacttccaatcgggttcgcggtgttcatggttcacctggccaccatcccaatcaccggcacgggaatcaaccccgcgagaagccttggagctgcagtcatctacaacaaggaaaaggcttgggatgatcagtggatgttctgggttggacccttcatcggagcagcaatagcagcgttctaccaccaattcatattgagagctggggcaatcaaggctctgggttcattcaggagcaacccccacgcttgattgagtgtttgtttcagagatcaatgatcaccttctctttgtttggcttaattagtgaaagagtgtaataatttgtattaaggagtgctttgtttcttcttgtgtctgaagggtttcttttcatgacacgcgag

SEQ ID NO: 14961 - DNA, 1054 bp, Vaccinium corymbosum
ccaccacaaactctctctctgtctccaacccaacaaaccctttttctctctctagaaaactttagcacttcctcatggccaaggacatggaagtggcagagcaggggtctttctccgccaaggactaccacgacccgccaccggcgccgctcatcgacgcggtggaactagccagttggtccttttacagggccctgatcgctgagttcatcgccactctcttgttcctttacattacggtcttgaccgtgatcggctacaagagccagtctgacccgaccaagaccaccgatccctgctccggcgtgggtattttgggaatcgcgtgggcttttggtggcatgattttcgttcttgtttactgcacagccggaatttctggtggtcacattaacccagctgtgacattcggattgttcttggcccgaaaggtatccttaatccgggctgtgatgtacatggtggcccagtgcttgggggccatctgcggtgtgggcctcgtcaaggccttccagaagtcttattacgaccagtacggcggcggagcgaacacgctcgccctcgggtacagcaaaggcaccggattggcggccgagatcatcggaactttcgtcctcgtttacaccgtcttctccgccaccgatcctaagaggagcgcgagagactcccatgttcccgtgttggcaccacttccaatcgggttcgcggtgttcatggttcacctggccaccatcccaatcaccggcacgggaatcaaccccgcgagaagccttggagccgcagtcatctacaacaaggaaaaggcttgggatgatcagtggatgttctgggttggacccttcatcggagcagcaatagcagcgttctaccaccaattcatattgagagctggggcaatcaaggctctgggttcattcaggagcaacccccacgcttgattgagtgtttgtttcagagatcaatgatcaccttctctttgtttggctttagtagtgaaagagtgtaataatttgtattaaggagtgctttgtttcttcttgtgtctgaagggttt

SEQ ID NO: 14962 - DNA, 1053 bp, Vaccinium corymbosum
cccaccacaaactctctctctgtctccaacccaacaaaccctttttctctctctagaaaactttagcacttccacatggccaaggacatggaagtggcagagcaggggtctttctccgccaaggactaccacgacccgccaccggcgccgctcatcgacgcggtggaactagccagttggtccttttacagggccctgatcgctgagttcatcgccactctcttgttcctttacattacggtcttgaccgtgatcggctacaagagccagtctgacccgaccaagaccaccgatccctgctccggcgtgggtattttgggaatcgcgtgggcttttggtggcatgattttcgttcttgtttactgcacagccggaatttctggtggtcacattaacccagctgtgacattcggattgttcttggcccgaaaggtatccttaatccgggctgtgatgtacatggtggcccagtgcttgggggccatatgcggtgtgggcctcgtcaaggccttccagaagtcttattacgaccagtacggcggcggagccaacacgctcgccctcgggtacagcaaaggcaccggattggcggccgagatcatcggaactttcgtccttgtttacaccgtcttctccgccaccgatcctaagaggagcgccagagactcccatgttcccgtgttagcaccacttccaatcgggttcgcggtgttcatggttcacctggccaccatcccaatcaccggcaccggaatcaaccccgcgagaagccttggagccgcagtcatctacaacaaggaaaaggcttgggatgatcagtggatgttctgggttggacccttcattggagcagcaatagcagctttctaccaccaattcatattgagagctggggcaatcaaggctctgggttcattcaggagcaacccccacacttgagtgtttgtttcagagataaatgatcaacttctctttgtttggcttaagtgaaaagagtgtaataatttgtattaaggagtgctttgtttcttgtgtctgaagggtttcttttca

SEQ ID NO: 14963 - DNA, 1297 bp, Manihot esculenta
cacacagtctccactatctcagagctcactatctatctatctatcagagacaacaagctcctaaaaagaaaaaaaaaaacatattctccgatggctaaggacgtagaagttgcagagaatccaggagaattctcggccaaagactaccatgatcctccacctgcgcctttgatcgatatagaggaactgggtcaatggtctttgtacagagctcttattgcagagttcattgcaaccctgctcttcctttacatcactgtgttgacagtcatcggatataagagccagactgatcctgctaagaattctgatgcttgtggcggtgttggtattctcggtattgcatgggccttcggcggcatgatcttcattcttgtttactgcaccgccggtatctctggaggacacattaacccagctgtaaccttggggctgttcttgggacgcaaggtgtcactaatacgggcacttttgtacatggtagcacagtgcttgggtgcaatctgtgggtgtggtttggtgaaggccttccaaaaagcttactacaacaggtatggaggtggggccaatgaactctcttctggctacagcaagggcactggtttaggtgctgagattattggtacctttgttcttgtctacactgtcttctctgccactgatcctaagagaaatgcaagagactcccatgtccctgtgttggcacctctccccattggatttgctgtgttcatggttcatcttgccactattccaatcactggcactggcatcaacccagctaggagttttggagctgctgttatctacaatgaagacaaggcctgggatgatcattggatcttctgggttggacctttcattggagctgctattgctgctttctaccaccaatacattcttagagcagcagcaattaaggctctaggatccttcaggagcaatgcttagttaattaattaagcttcttttttttttttcaatttagttgataatttgaagaaaatggtggtggtggtgatgatgatgatgctcaagaacaataacaatggatggtgatggatgcataccatatttctctcctttactctttcaagggttttgagggtgaaatttggaaaaagcccatttgaattgtaaataataaattatggtcaagtgtgtcttttctatcccttttgcttttgttacgttttgtatttcaagtcatgtcccttgtgtttatccattgagccttatcttatgatcttatgctcttttcctttgttttttttttaatctattatcttttgggtgt

SEQ ID NO: 14964 - DNA, 1170 bp, Linum usitatissimum
ccacgcgtccgaacacaacagagcttcttcatctcccccaatctctaatctctttgacaagaatggccaaggacgtagaaggacaagtacccggattccaaaccaaggactaccaagatccaccccctgccccactcatcgacgcagaggagctaacccaatggtcactctacagagcagtcatcgccgagttcatcgccactctcctcttcctttacatcaccgtcttgacagtcatcggctacaaatcccaggtcgatcccaacaagccctccgtcgacccttgcggcggcgtcggcattctgggaatcgcctgggccttcggcggaatgatcttcgtcctcgtctactgtaccgccggaatctccggcggccacatcaacccggcggtgacgttcgggctttttttggccaggaaagtgtctttagtcagagccgtcttgtacatggtggctcagtgccttggagccatatgcgggtgtgggctagtcaaggctttccagaagtcttactacacaaggtacggcggtggagccaatgagcttagcgcagggtacaacaagggaactggattgggtgctgaaatcattggcactttcgtacttgtctacactgttttctctgccactgaccccaagagaaacgccagagactcccatgtccctgtgttggcaccacttccaattgggttcgcagtgttcatggtccacctggctacgatcccagtgactggaacagggatcaacccggcaaggagcttcggagcagctgtgatctacaaccaagacaaggcatgggatgatcagtggatgttctgggtcggaccattcattggagcagcaattgcagcaatataccaccagtatatactcagagctggtgccatcaaggcactagggtccttcaggagctcagccaacaactaaaaccctttctccatccaatccatccattgagttccagtcagtgccaatggaaacaattgtaaattgttgtatcagtaaaattatgggttcgtcatcgtcctcttgaatgttcttctctgtatatgagtgcattttgggtggccatctggttttatcattttgtgtggccagaatgaagtgtgtggtttgttttttcttttctttttacgttattttggaatgagaagggtaataatggcaatac

SEQ ID NO: 14965 - DNA, 1278 bp, Platanus occidentalis
ttttgccctccctccctccctctctatcttccctcctcttgtgaactagggctttgagctatctttctctccggcaaattttgtgaagcttttctaccgacggtatggggaaggacgttgaggtcactgagcagagcgagttttcagccaaggactaccacgacccaccgccggcgccgttgatcgacgccgaggaattgaccaagtggtccttctacagggctctcatcgccgagtttattgcaactcttttgtttctatatattactgtgttgaccgtgattgggtacaagagccagagtgacactacaatgaacggcgatgaatgtggtggggttggcatcctcggcatcgcttggtcttttggtggcatgatcttcatccttgtttactgcaccgccggtatctctggtgggcacattaacccggcggtgacgtttgggctattcctggcccgcaaggtgtcgctgatccgggcggttatgtacatggtggctcagtgcctgggcgccatatgcggcgtgggcctggttaagggtttccagaagtcttactatgtcaggtacggtggtggtgcgaacgagctcgcctccggctacagcaagggcgtagggttggcggcggagatcatcggcaccttcgtcctggtctacaccgtcttctcggccactgatcccaagaggagtgccagagactcccatgttccggtattggcaccactgcccattgggtttgcggttttcatggttcacctggccaccatcccaatcaccggcaccggcatcaacccagctaggagttttggagctgctgtcatctacaacaaagataaggcctgggatgaccagtggatcttctgggttggaccattcattggtgccgccatcgccgccttctaccaccagttcattctgagagcgggagccattaaagcccttggatccttcaggagcaaccctcgcgtctagtttcctcggagttctttctttggtgtgtctgggaaagatgatgttttcaaagaataattatggaggagtgcaaagtctgtctgaaggttccgttagctctcttgagagttctaacaacctgaggacacccacgaaattgtagataataaaaaaaaaaaaaaaaaactctttgggagtgtcttataaatcccttttggttcttctctcagcattttctttgggtttgtatttaaagtgttctagtccctttttccccctttcttctattttctttggtttgttattaagtgttctagttcttttccatact

SEQ ID NO: 14966 - DNA, 1209 bp, Papaver somniferum
tcagaaaccaaacaaacatctctcattctctcggtagttgctctctagttttcaagtatgggtaaagatatagaaccaagtcatgagcagggaggaggatattcagcaaaagattaccatgatccaccaccagcaccatttttgggtattgaagaactaacgaaatggtcattttacagagctttgatagctgagtttattgctactcttttgtttctttacattactgttttgaccgttattggttacaagagccaaattgctggtggtgatgactgtggtggtgttggtattcttggtattgcttgggcttttggtggtatgatcttcgttcttgtttactgcactgccggtatctctggaggacacattaacccagcagtaacatttgggttgttcttggcaagaaaagtatcactaattggggcagtattgtacatggtagctcagtgtttaggtgcaatctgtggggttggcttagttaaagccttccagaaatcttactacgttcgattcggaggtggagccaacgaactaagcgatggatacagcacaggaacaggattagctgctgaaatcatcggtacattcgttcttgtctacaccgtcttctcagccactgacccaaagagaagcgccagagactcccacatcccggttttggcacctctaccaatcggatttgctgtgttcatggtacatctcgcaactatccccattactggaactggtattaacccagctagaagtttcggagctgctgtgatttacaacaaaaacaaagcttgggatgatcagtggatattctgggtgggaccattcattggagctgccattgctgcattttaccatcagttcattctcagggctgcagctgttaaggctcttgggtccttcagaagcaatgcccacaactaaatttccttttatggcagtgttttgtgagagagatgaaaattaatgaaggcaagagagtgagaaaggcttgaagagtccttttagtggaactgtagatatgaatcatttggaaaagaggaagaaaaggaagggcgttattgattaattctctcttcactcctttgtgtttcatttcaattagttatctctcttttggtaatttaatgtatgtatctatttatgttggtgttgtgatctttttattttcgtactttgttaatcaatgatgagttccatctaatttgagaaaaa

SEQ ID NO: 14967 - DNA, 1399 bp, Lactuca sativa
gtgaattgtaatttttttgttgtaaggtggtgggacaacgtcaaatgggtcggtgaaaacgaaatttacaaaatgtagtgtgttttggacggcaatttttcccgttcttcataattacaatccacctaccccaaaaatagccgttgtacactctacacccttcttatcttcaatccctttatatatacatacactccccacttctcccttcatcactccgactccaccaccatcagccgactttctctctgctgccaaattaacatgacgaaagatgtgcaggagcaaggttcgttttccgccaaggactaccacgacccaccgccggcgccgttgatagacccgggggagcttaccaagtggtccttctacagagctctcatcgctgagttcattgccacccttctcttcctttatattactgttttaactgttatcggctacaagagtcaaaccgaccccgccctgaacctcgaccagtgcggcggagttggtatcctcggtatcgcctgggccttcggaggcatgatctttgttcttgtttactgcaccgccggtatctccggaggtcacattaacccagcagtgacgtttggtttattcttggctcgtaaagtgtcattgatccgtgcaatcatgtacatggtggctcagtgcttaggagccatttgtggtgtgggtttggtcaaggctttccacaaaagctactacatgcggtacggcggaggagccaacgaactcgccgacggctacaacaaaggcaccggactcggcgctgagatcatcggaactttcgtcctggtctacaccgtcttctccgccaccgaccccaagagaagcgcccgtgactcccatgttccagttttggcgccacttccgattgggtttgcggtgttcatggttcaccttgccaccattcctatcaccggtaccggaatcaacccggctaggagtcttggagctgctgtcatttacaacaaagccaaagcttgggatgatcagtggatattctgggtgggaccattcatcggagcagccattgcagctttctaccaccaatttatattgagagctggtgcaatcaaagcccttggatcattcagaagcaccaccaataactgatgagatttcaattattgtattttctcaattgaaaaatgaaataatatttatgttccaattttcattttagccttcaaaagcaagttaagtgtataataatgtctggcaggaagggtataagagtaagttcgtccaatagatcacttttcatatcgcaaaatcaaccaaccattttttcatagacggaacatgtgggaattaaaagttagtggataaatcaactaatagtttaaaaaaatttcaaaacaaattcatgtttatctataaaagattgaat

SEQ ID NO: 14968 - DNA, 1673 bp, Populus trichocarpa
ttttgatggaatcgataacattgttcatgcctttctgattgagaaagaaaagaaaattacaccgtaaaagttgggtcatttatttcatggtcaaaagtgattatctcttggaaattcaatccgacaggttatgtagtaaaaacccatgtgaagctcgaagaattgagtgaaggctggaaccatctttacagcaggccggaaaaagcacacccatgaagtccaacgtggggtcacggaaagtttaagaaatcatagattgtgaggtggggcggcgaagctaagttaatttaacactcactcctctccaacacatcgcatgcataaatagcacagcatttctccacacttccaccacaaaacattttgttagtgaattataataccaaccataccgctttagctttgtctctcaccaaactcatcaacagctatgggcaaggacattgaagttggaggcgaattcagtgccaaggactatcatgaccctccgccagcgccattgatcgatgctgaggaaataacccagtggtctttttatcgggctattattgctgagttcgttgccacgctcttgtttctgtacatcactgttttgaccgtgataggttacaagagccagactgacgttaataaaaacggtgatgaatgtggtggggttggcattcttggcatcgcttgggcctttggtggcatgatttttattcttgtttactgcactgctggtatctcaggtggacatattaacccggctgtgactttcggtttgttcttggctaggaaggtctccttggtgcgtgccattctatacatggtggctcagtgcctgggggccatatgtggatgtggacttgtgaaagcattccaaaagtcttattacacaaactatggtggtggagccaatggacttgctaacggatacagcaagggaactgggttaggtgctgagatcattggcacctttgttcttgtctacactgttttctctgctaccgaccccaagaggaatgcaagggattctcatgttcctgtactggcaccacttcccattggatttgctgttttcatggttcacttggccactattccaatcaccggtactggtatcaaccctgctaggagcttcggagctgcagtgatcttcaacaaggaaaaggcatgggatgaccattggattttctgggttggacctttcattggtgctgcaattgctgccttatatcaccagttcatcttgagagcagctgctgttaaatcccttggatccttccggagctctcccaacatataatatttccattcagttatggaacgtacgccaaagatttaactagtccaaaagggtctgggactggccaatatgtacattattcagtccaggtctaagatatcaacgttatgtcatggttgtgtgcttgggcacttgttttatttatgctcaaatattttcaccttctctgtcttgagtttttctttttggtcaatatgtagtcaatatgtagtgttgatgaatcaatcagcaagtgctctgtgttagtctttaataatttcgatccctctgatctcttttcttgatatctcactgttatgtcagggaaggaaattcacgactcattatggcatatatacctgtcgtaattatatacaaataaatcatttcaaataattaaaaaaaa

SEQ ID NO: 14969 - DNA, 1553 bp, Populus trichocarpa
gcaaagcgaagttaatttcaacctcactctcctcccctgcttcccataaataccaccacatttctcctcgcttccaccataacacttaccaaccaaaactctttagctttgtctctcgccaaactctctcataaaggagccgcagctatgggcaaggacgttgaagttagaggcgaattcattgccaaggactatcatgaccctccaccagcaccattgattgatgccgaggagctcacccagtggtctttgtatagggctatcattgccgagttcattgccacgctcttgtttctctacatcactgtgttgactgtgataggttacaagagccagactgacacgaccaagaacagcgatgcatgtggtggggttggcattcttggcatcgcttgggcctttggtggcatgatctttgttcttgtctactgcactgctggtatctcaggtggacacattaacccggctgtgactttcggtttgttcttggctaggaaggtgtccctggtgcgtgccgttctatacatggtggctcagtgcctgggggccatatgtggatgtggactcgtgaaagctttccaaaagtcgtactacacaaactacggtggtggagccaatgaacttgctgctggattcagcaagggcactggattaggtgctgagatcatcggtacctttgttctcgtctacactgtcttctctgctactgacccaaagaggaacgcaagggactcccatgttcctgtgttggcaccacttcccatcggatttgctgtcttcatggttcacctggccactattccaatcactggaactggtatcaacccagctaggagctttggagctgctgtgatatacaacaaagacaaggcatgggatgaccattggatcttctgggtcgggcctttcattggggccgcaattgctgcattgtatcaccaatacgtcctgagagcagctgctgttaaagcccttgggtccttcaggagctcttccaacatttaattttaaagaccgtataatatatggtcactgaaatacttccatcaagttattgaatggtgtaacgcaaagatttaagtagtccaaaagggcttggaactggggaatgtgtacacagtcgtggtcaagatgtctatattgggtcacggtcgtgtgcgtattgggcacttgttttgtttgtgctcgaacgttttcatcttgtctgtcttttaatttctccctatctcataatcaactggtgctgcatcttgcttgtcttagccaatctctttaccttctctttgttactacatcttgtaaaataaaaggaaaatagagacgagtgggaaccaatctttaacacgagtgatttcgggataaaaagataacaagagtgatacgaaatatgtgctgtgttacatctcatcacttccttgctgctgtcgtctttcgagtactaatttcaatcaaattcacaccagcccttcttaatccctggtcgttgaagcaaaaagtgtgaagatttgggggcagtttacaatcttgaaatgatgaaaactcttattgcctct

SEQ ID NO: 14970 - DNA, 1200 bp, Gossypium hirsutum
ccccacaccatttctcaacacttcccatcaccacaatattcttcacctatctctttcacaaaggagagcacagaaaaaaggggttcttgttcttgctcaagttattgatcaatggctaaggatgttgaggttggtggtgagttccaagccaaggactaccatgatcctccaccagctccattggtagatgcccaagagttaactcagtggtccttttacagggctataatagctgagttcattgccacccttttgtttttatacatcactgtgttaacagtgatcggatacaagagccaagttgatccagataagggtggtcaagattgtgatggtgttggcattcttggtattgcttgggcctttggtggcatgattttcatccttgtttactgcactgctggtatctcagggggacatatcaacccagcagtgacctttgggcttttcttggctcgtaaggtatcattggttcgagccatactttatatggctgctcaatgtttaggagccatttgtgggtgtgggttagtcaaggctttccaaaagagttattacaacaagtatggtggaggagctaatagcttggctgatggatacagcactggcactggtttggctgctgaaattattggcacatttgtgcttgtttacactgttttctctgcaactgatcccaaaagaaacgcaagagattctcatgttcctgtgttggcaccacttcccattgggtttgctgtgtttatggttcatttggcaactattccgatcaccggaaccggaatcaaccctgctcgtagtttcggagctgctgttatgttcaaccaggacaagccatgggatgaccattggatattctgggttggaccattcattggagctgccattgctgcaatttatcaccagtatatcctcagagcaggagctgctaaagctcttggatccttcagaagcagctcagccatgtaaaacaaaggggttgccattgaagaatggatcaagttttatctatgattgtgaagagaatttttcagagcattgaatttgtaaatcataatggaaatgtgacatgcttctttatatttggcacttcaatttttaaagtgccccaagtgtagtcatcatccctgtttttctttctgtttttggctttgtcttggtgtctgtatgttgaaaatttaatagaatctacgcctttta

SEQ ID NO: 14971 - DNA, 1194 bp, Euonymus alatus
atcctcatcatcacaagttcacaactcccacacaacaagaagaagaagcctttcctactctctctctctaaaacaagtagttctgtagaaatggcaaaagatgtcgaagtacaagaaaatccagagttttctgccaaggactacactgatccgcctccgacgccgctttttgacttggaagagctgacgaaatggtctttttacagagctgctattgcagagttcgttgctactcttctcttcctttatatcacagttttgactgtgattggctacaagagccaaaccgaccctaacctgaacaccgaccagtgtggtggtgttggaattctcggcatcgcttgggccttcggtggcatgatcttcatcctcgtttactgcactgccggtatttctggtggacacattaacccggctgtgacctttggactgttcctggcgcgcaagctgtcgctaatccgggcagttacatacatggtagcacagtgtttgggtgcaatctgcggttgtgggcttgtgaagggcttccaaaagtcttactacaccaggtacggaggtggagccaacgagctagctgatgggtacaacaagggcgttggattgggtgctgagatcatcgggacctttgttcttgtctacactgtcttcgcagccactgatcctaagaggaacgccagagactcccatgttcctgttttggcaccattgcccatcggattcgctgtgttcatggtccacctggctaccatccccatcactggtactggtatcaacccggctaggagtttcggagctgctgtcatctacaacaaagagaaggcctgggatgaccaatggatgttctgggttggaccatttattggagctgccattgctgcgttctaccaccagttcattctgagggctgcagccattaaggccctgggttccttcaggagcaactcttaactgatcaagcagtttgtgatgagcgagcgttgttggtttaaagaaattaataaaaaggactcctccatctccatggatgctttttaaggtttggaaaggttgatcaatctagagggcctggacggaattgtaaatagaaaactattcatggacaagggtgtcttttcaatccttttgttttcggtatctcactatgatcagtgtattttatgtggagctgtctgcctgtttgttcatgtttatcct

SEQ ID NO: 14972 - DNA, 1191 bp, Gossypium raimondii
cccatcaccacaatattcttcacctatctctttcacaaaggagagcacagaaaaaaggggttcttgttcttgttcaagttattgatcaatggctaaggatgttgaggttggtggtgagttccaagccaaggactaccatgatcctccaccagctccattggtagatgcccaagagttaactcagtggtctttttatagggctataatagctgagttcattgccacccttttgtttttatacatcactgtgttaacagtgattggatacaagagccaagttgatccagataagggtggtcaagattgtgatggtgttggcattcttggtattgcttgggcctttggtggcatgattttcatccttgtttactgcactgctggtatctcagggggacatatcaacccagcagtgacctttgggcttttcttggctcgtaaggtatcattggttcgagccatactttatatggctgctcaatgtttaggagccatttgtgggtgtgggttagtcaaggcattccaaaagagttattacaacaagtatggtggaggagctaatagcttggctgatggatacagcactggcactggtttggctgctgaaattattggcacatttgtgcttgtttacactgtattctctgcaactgatcccaaaagaaacgcaagagattctcatgttcctgtgttggcaccacttcccattgggtttgctgtgtttatggttcatttggcaactattccgatcaccggaaccggaatcaaccctgctcgtagtttcggagctgctgttatgttcaaccaggacaagccatgggatgaccattggatattctgggttggaccattcattggagctgccattgctgcaatttatcaccagtatatcctcagagcaggagctgctaaagctcttggatccttcagaagcagctcagccatgtaaaacaaaggggttgccattgaagaatggatcaagttttatctatgattgtgaagagaatttttcagagcattgaatttggcacttcactttttaaagtgctccaagcgttgtcagcatccctgtttacctttcaattttctttctgtttttaccttttttggctttgtcttggtgtctgtatgttgttgaaaattttatagaatctatcttttacattatttaaatgagttcaattcaatgtctaa

SEQ ID NO: 14973 - DNA, 1706 bp, Petroselinum crispum
ctccgatatataccccatctttcctcctctcatttcccacaaattatccataccaactctgtttcctcccctgctctctcacttttagcatatcacattttcactccttatattttacactgtgttgttgataaaatatcaccagttatcatgacaaaagacgtggaagtggctgagaaaggttcattctctggcaaagactacgttgagccaccaccagtaccacttgtagacccccatgagctcactaaatggtcattttacagagcactcatagctgagttcattgcaactcttctcttcctttacataactgtcttgactgttattggctacaaaagccagacagatttagatgctggtggtgaccagtgtggtggcgttggcattctcggtattgcttgggctttcggtggcatgatcttcgttcttgtctactgcactgccggtatctctgggggtcatattaatccagcagtgacattcgggctattcttggctcgaaaagtgtcactaattcgagcattgatgtacatggtggctcagtgtctaggagccatatgtggtgttggtttagtgaaggcttttcagcagccgtactacaagaggtatggcggaggagccaatgagctagccgacggctacagcaaaggcactggattagccgctgagattatcggaacttttgttcttgtctacactgttttctcagccactgaccccaagagaaacgctagagactcccacgttcctgttttggcacctctccctattggatttgctgttttcatggttcatcttgccaccattccgatcaccggcaccggtatcaaccctgccaggagtcttggagctgctgtaatttacaaccaggacaaggcttgggatgatcattggctattttgggttggacccttcattggtgcagcaatagcagcattttatcatcaattcatcctcagagcaggtgcagtgaaagctctggggtcattcaggagcaatgcttgattttaatgtgaaagagatattttgtatcttcttgatttgttaagttagcaagaaagtatttatggaacaagtgtatttttaaggagaataatgttgtaatgtttgttgtgtttgtttttgttaatggagtagtttttcagtgtttcatagtattgttctttaaggtttgtgaaatcaagtgagaccatgtgaagttttgcttttgtccttggcccttgtatttgaatctacccacttcttgtattgatcatgtctatgagttatttatggatgagttgttgtattgttttatttgagattttaaagacaaatgcaaatatgcaagtcacatacctctcagagttacattcacatcattttgtcagaagaaaaacttattgtgacatttaggtgcagaatctcaacttttctagtttaagatctacctctccattgttcatatgcagttgctatatttctgactcagcatggagtggacatatattggactctaaccaaatacatcaaaataatgtactttgtgtatatgtatggccgactcgcatcatgacagatgattgttacattatacgtcctctcgatgatagccataagcgagtaatgtggaaattctagaagtttgtcccgagcgccataaggatgaatgacccccttgcattcacataaaaaagaagtgttattcttgtaacaagcaggat

SEQ ID NO: 14974 - DNA, 1208 bp, Platanus occidentalis
tctctctctctctttctcattttgataactttcttttaaaggttatggggaaagacattgaagtttctgagttaccggcgaaggactaccaagacccgcctccggcgccgttgattgacgccgaggaattgaccaagtggtccttctacagggctctcatcgccgaattcattgcaacccttttatttctgtacattactgtgttaacagtgatcgggtacaagagccaggtcgatccggccaagaacggcgatgagtgtggtggggtaggaatcctcggcatcgcttggtcttttggcgggatgatcttcatccttgtttactgtaccgccggtatctccggagggcacataaacccagcagtgacgtttgggttgttcctggcgcgtaaggtgtcgctggtgcgggccgtgatgtacatggtagctcagtgcctgggtgcgatctgcggcgtggggctggtgaaagccttccagaagtcatactacgtaaactacggtggtggtgccaacgagctcgccccgggctacagcaagggcgtggggttggcggcggagatcatcggcaccttcgtccttgtctacaccgtcttctcggccactgatcccaagaggagcgccagagactctcatatccctgtattggcgccactgcccattgggttcgcggttttcatggttcatttggctacgatcccaatcaccggcaccggtatcaacccggctaggagtctaggagctgctgtgatctacaacaaggagaaggcctgggatgatcagtggatcttctgggttggaccattcatcggtgctgccatcgctgcaatctaccaccagttcattctgagagcgggcgccattaaggctcttggttccttcaggagcaacccccacaactaattttctcggagtggctttggtttatgggaaagatggaggaaaatatgatggtttccaaggaacaataatggaggagtgctgcatgtctgtctgaaagtcaccttagccctctttcatcccctgaatttgtagataaaaaactactttttgggtaaagaaaaggaaggagggaggggggagggaggggtgtcttttgtaaccctttttggtcttcccagcactttttgtttttcttttcttttctttgccatgttatttttagttcatgatgatgctttcagataaaatctatcaaggtgtttgttgtct

SEQ ID NO: 14975 - DNA, 1368 bp, Cucumis melo
ccccactccttaaatacccttttcttcccccttcttcctcctcactaccactttcccactcccaatatttctcatccccaaattctccacacccaacaactccaaatccacaacaatggggaaagacgttgaagttgctgagcaaggtgaattccaaagcaaagactaccaagacccacctcccgcccctctcatcgatcccgaagagctcactaaatggtctctttacagagccgccatcgccgagttcatcgccactctcctcttcctttacgtcaccgttttgaccgttatcggttactcccaccagagggactctacccccgacccctgtagcggtgttggcattctcggtatcgcttgggccttcggtggtatgatctttatccttgtttactgcaccgccggtatctccggtggccacattaaccctgctgtcactttcggccttttcttggctcgtaaagtctctctggttcgtgctgtattgtacatgcttgctcaatgtgccggtgctatttgcggctgtggcttggttaaagccttccaatctgcttattatgttagatataacggtggtgctaacatgcttagtgatggttacaacaaaggaactgggttgggtgctgaaattattgggacttttgttctagtttacactgttttctctgctactgatcccaagagaaacgccagagattctcacgttcctgttttggctcctctcccaattgggtttgctgtgtttatggttcacttggctacaatccccattaccggaactggaattaaccctgctagaagtttcggagctgctgtcattttcaacaaagagaaagcctgggatgatcaatggatcttctgggttggaccattcattggagctgcaattgctgcaatttaccatcagtatgtgctcagagctggcgccattaaagctcttggatctttcaggagcaacgcttgaaaatccttcaatggaaatatatttaattggtttctctcagattgtgttttgttttttgtttttttgtttttggggttctcctttttctctcttctcaatagactttcgatggttgaatcggaactcaattcttgcggctgctctgctctcgtctgctttggtccgtcgtggaattaagttctacaagaagttttaattgttggccctggaaattgtacatatttccatttctctcccctaaaagaagaaaaagagaaaaaaaagaaagaaaaagaaattggggctcattctcatcctatgtattcatgtatttttctttttgtgtttcatccttatcctttgttttttatttaataaaggaatctcctctattatgatgttcaaaaaaaaaaaaaaaaaaa

SEQ ID NO: 14976 - DNA, 1120 bp, Ambrosia trifida
ctcactatcccattaaataccaagctatcaccaccacacatttcacaccaaacacacacatctcttcaaaacacttgatcatcaatcatgaccaaagacgttgaagtggctgagcaccagggtggcaaagactaccatgacccaccaccagcaccgttgatcgacggtgaagagctaaccaaatggtccttttatagagctcttattgctgagtttattgccaccctattgttcttgtacgttactgttttaacagttattggttacaaggtacagacggaccctaagttgaacactgaccagtgtggtggtgttggtatccttggtattgcatgggctttcggtggcatgatctttgttcttgtttactgcactgctggtatctctggaggacacattaacccggctgtgacattcgggctattcttggcaagaaaggtgtcattgatcagggcattagggtacatggtggcacaatgtttgggtgcaatatgtggtgtgggtttggtcaaagctttccaaagttcatactacaataggtatggtggtggcgccaatgagttagccgatggctacaacaaaggcaccggactaggtgccgaaatcattggaacctttgttcttgtgtacactgttttctcggctactgatcctaagagaagtgcccgtgactctcatgtccctgtgttggcaccactgcccatagggtttgcagtcttcatggtacatttggcaaccatcccaattactggtaccggaatcaaccccgctagaagcttgggcgccgcggtgatttacaacaatgaaaaggcctgggatgatcaatggattttctgggttggaccgttcttgggtgcagcggcagcagcattctaccaccagtttgttctgagagccggggctattaaagcacttggttctttcagaagcaatgcataaccgagagatgataaattaatccaataaacttgatcagttgttacaatggatggatatgagtgtggatgatcaagtgttcaattgtagatatatgttgttaatttcctgttgagatatgcaactttttttttccttatttattctccattttctttgtgaatctagagtgtttaatgcaagt

SEQ ID NO: 14977 - DNA, 1299 bp, Theobroma cacao
ctctttgtttctgtctttctctctgttttcctctctagcttttgcaaatccttttctttttggttccttgagctttatctctgttgctaggcatggcgaaggaaggagagcatggctttcatgctaaggactatgtcgaccctccaccagcacccttgattgatgcagcagagctgaagaaatggtcattttacagggctttgatagctgagttcattgcaactttgctcttcctttacatcacagtcttgactgtgataggcaacaagagccaggttggcacctccaatgactcctgtgctggtgttgggattcttggtattgcttgggcctttggtggcatgatcttcattcttgtttactgcaccgctggtatttctggtggtcacattaacccagcagtgacatttgggctgttcgtggcccgcaaggtctcattgatccgagccattgcatacatggtggctcagtccttgggagccatctgtggggtagggctggtcaaggctttccaaaaatcattctacaacaggtatggaggtggagccaacactctttcagatggctacagcactggtactggcttgggtgctgagattattggaacctttgttttggtttacactgttttctctgctactgatcccaagaggaaggctagagactctcatgtcccagtcttggctccccttccaattggttttgctgtgttcatggttcacttggctaccatcccagtcactggcactggcattaaccctgctaggagtttcggagctgctgttatctacaacaacaagaaggcctgggatgatcattggattttctgggttggtcccatgattggagcagccattgcagctttctaccaccaattcatcttgagagcaggagctgctaaggctcttgggtcattcaggagccagacccatgtttgatgatcttgacaaactcttttgccttccttcatgcttttttttagaggacaaaaaaatatgtaggcaaaaaatgtgaataatgaaggaagttgctttatgctttgtgtctggctattgtccccaaacctcctcctttcaacttccctttgtggatgttgaaaattataggaactttagggtcatggaaatgtagataaagtctgtttgagaagtggagggggccttttaagtatcccttttgtcatttcaagcactttccttagaatttacttcacctctctctctctctcccttctctttgttttctttcttctcatcctcttatttgtgctcatttatgctttaagaaaagtattggaca

SEQ ID NO: 14978 - DNA, 1030 bp, Chrysanthemum coronarium
accaagaccctccacctgctgcccttttcgactccgaagaactcaccaaatggtctttttaccgagccattatagccgagttcattgccacaatgttgttcctttacatcactgtcttgactgtcattggttacaagtcccaagtagaccctgcccacagcaaggaccaatgtggtggtgttggaatccttggtatcgcatgggcttttggaggcatgatttttgttcttgtttattgcactgctggtatctcaggtggacacattaaccctgctgtcacattcgggctgtttttggctaggaaagtgacattaccaagggcatttatgtatattgtggctcaatgtttgggtgctatttgtggttgtggtcttgttaaggctttccaaaagacttactatcataattatggtggtggtgctaatgagcttgctgatggttacagtaaaggcaccggcttaggtgctgaaatcattggtacctttgttcttgtttacacggtcttctcggctactgaccctaagagaaatgcacgcgattcccatgtcccagtgttggcacctcttcctatcggatttgcggtgttcatggttcacttggccacaatcccaattactggaactggaatcaacccggctcgtagttttggtgctgctgtcatgtatggtaaagaaaaagcatgggatgatcaatggttattctgggtgggaccaatgattggagccgcgattgcagccttttaccaccagtacgtattgagagcaggtgcagttaaggctcttggatcgttcaggagcaacgcctgagctaagatcgagtagtttcaatgtcgatccctttggaagaaattgtacaaatttgtttctctgttaaatgtgtgaggtcctttggtcgctatattttttaatgtgcccaaaagggtttaattactttcaagtcctatttaaattcagtctcttttgcttgttgtaattgattaatgggaatgggtgatcttccgacccacattgaataaaaatcacaaaaactt

SEQ ID NO: 14979 - DNA, 1363 bp, Cucumis sativus
actcaaatccatctccttccttctggtactttcttccccactccttaaatacccttttcttcccccttcttcttcctcactactactctcccactccaaatatttctcatccccaaattctccataccctaaaaactctaaatcctctacaatggggaaagacgttgaagttgctgagcaaggtgaattccaaagcaaagactaccaagacccacctcccgcccctcttatcgatcccgaagagctcaccaaatggtccctttacagagccgccatcgccgagttcatcgccactctcctcttcctttacgtcaccgttttgaccgttattggttactcccacggaagggccactgacgctgatccctgtagcggcgttggcatcctcggtatcgcttgggccttcggtggtatgatcttcattcttgtttactgcaccgccggtatctccggtggccacattaaccctgctgtcactttcggccttttcttggctcgtaaagtctctctggttcgtgctctgttatacatcattgctcaatgtgccggtgctatttgcggctgtggcttggttaaggccttccaatctgcttattatgttagatataatggtggtgctaacatgcttagcgatggttacaacaaaggaactgggttaggtgctgaaattattgggacttttgttcttgtttacactgttttctctgctactgatcccaagagaaacgccagagattctcacgttcctgttttggctcctctcccaattgggtttgccgtgtttatggttcatttggctacaatccccattaccggaactggaattaaccctgctagaagtttcggagctgctgtcattttcaacaaagagaaagcctgggatgatcaatggatcttctgggttggaccatttattggagctgcaattgctgcaatttaccatcagtatgtgctcagagctggcgccattaaagctctgggatctttcaggagcaacgcttgaaaatccttcaatggaaatatatttaattggtttctcccagattgtgttttgttttcttcttgtttttggggttctctttttttctctcttctcaatagactttcaatggttgaatcagaactcaattcttgctgctgctctgctctcatcttgcctttgttcgtcatggaattgagctctacaagaagtttaaattattggccctggaaattgtacatatttccatttctctcccctaaaaaaaagaaagaaaaagaaaaaaagaaaagaattggggctcctgttattcatgtatttttctttcgtgtttcatccttatcctttgttttttatttaataaaagaatctcctctattatgt

SEQ ID NO: 14980 - DNA, 1131 bp, Echinacea purpurea
cagacaccaaacacacttcatcacctctccatctccatctccatctctatctctatactaaaaaattcatttttaccgacgatgacgaaagacgtcgaagtggcggagcaccacagcggaaaagactaccatgacccacctccggcaccgttgatcgacggtgaagagctcaccaaatggtccttttacagagctctcatcgccgaattcattgccaccctactattcctttatgtcaccgtgttgacggttatcggttacaagagccagaccgaccctaacttgaacaccgatcagtgtggcggtgttggcatccttggtatcgcatgggcttttggtggcatgatctttattctcgtttactgcaccgccggtatctctggaggacacattaacccggctgtgacattcgggctattcttagcaagaaaggtgtcattgatcagggccttagggtacatgatagcacaatgtttgggtgcaatatgtggtgtgggtttggtcaaggctttccagagctcctactacaacaggtatggtggtggagccaataccttggcggacggctacgacaaaggcaccggactaggtgccgaaattatcggcacttttgttcttgtctacaccgtcttctcggctaccgatcctaagcgaaatgctcgagactctcatgttcctgtgttggcaccactgccaataggatttgcagtcttcatggttcatttggctaccattccgatcaccggcaccggaatcaacccagccagaagctttggtgctgccgtgatttacaacgacgagaaggcctgggatgatcattggcttttctgggtcggaccgtttttgggcgcagctgcagcggcgttctaccatcagtttatacttagagcagcggccgctaaagcgcttggttctttcagaagcaatgcatgattgaaagacgatgaatttatttatatatccatgtaaaagaataagattgtacggacgacacaattgtcgacgttaaaatgtatggatatgtgatgagcttcagtgtgttgatttttagatgaatttctatttagaaatgtaatttcatattttttctgtaatccttttcactgtgaatctaagatgtgtgtatgtagc

SEQ ID NO: 14981 - DNA, 1334 bp, Cajanus cajan
aataaaatgctcaaaccacactccatcacccccatatataccccttctcttctcacaccaattaacacacacaagcacacatcaaagccttgttcttgttcttgttcttttgttgggcctttctttgagaatcaagttcattgtttgatcagtgttggaaattgcaatggctaagcatgatgttgaggtggctgagcgtggttccttctctgccaaggactaccatgaccctcctccagcacccttgattgatgctgaggagctcacaaagtggtccttctacagggctctgattgctgagttcattgccacactgctcttcctttacatcactgtgctcactgtgattggttacaagagccagagtgatgtcaaggctgggggtgatgtgtgtggtggtgttggcattcttggcattgcttgggcctttggtggcatgatattcatccttgtttactgcactgctggaatctctgggggtcacataaacccagcagtgacatttgggctgttcttggctcgtaaggtgtctttgattagagctatattgtacatggtggctcagtgcttgggggccatatgtggagttgggttagttaaggccttccaaaaggcttactacaacaggtatggtggtggggccaatgagctcagtgcagggtacagcactggtgttggattgggtgcagagatcgttggaaccttcgttttggtgtacactgtgttctctgcaactgaccccaagaggagtgctagagattctcatgtgccggttttggctccacttccaattggttttgctgtgttcatggttcacttggccaccatccctgtcactggcactggtattaaccctgctaggagtcttggagcagctgtcatgtacaaccaacagaaggcctgggatgaccattggatcttttgggttggaccatttattggagcagccattgcagccttctaccaccaattcatcttgagagcaggtgctgctaaggctcttggatcattcaggagcaaccccagtactctttgagtcaatttcctcttcagaaaagaacatataacgggaagcaaaatgggttgatatcgcaagaaaatagtataattatgattatgacaagtacttgtgcttttatgtgaaggttcactttgatccaatgtagattgaaggttctttcaagcctttggtaaataccctttaattagtatcttcaagcactttcccttgtattgtgtgtgatcttttcttttagctaatttaatcttttgtactcaacgtattcatggaaaaaagaattaaaaattacaatatccatgcttttaaccaaaat

SEQ ID NO: 14982 - DNA, 1477 bp, Papaver somniferum
taccaccctatagtactttaaaattttagtttaaattaaactaattaataaacaagaattagggaagaaaactaacccctaaactttaactactagtaaacccttaacttttaacttacggttacgaaaacaaacttacaaattaaaggaatagaacaaagaatagtatacaatacaaacaacaaaaacaaactcactcctctcctttccttctccgcagtactcaactcttcttattcagtactctatttttaatttgtaccgtttcttgagaaatcaaaaatatgggaaaagacgaagtagcagaacatggtgaattctcagccaaagattatcacgacccaccaccagcaccattttttgatgcagatgagtttaagaaatggtctttctacagagctattattgctgaatttgtagctactcttttgttcctttacatcactgttttgactgttattggttacaagagtcagagtgaagctgatgattgcggtggtgttggtattttgggtatcgcttgggcttttggtggtatgatctttgtcctggtttactgcaccgccggtgtctccggaggacacatcaacccagcagtcacttttggattatttttggcaagaaaagtttcacttccaagagcagtcttgtacatggtggctcagtgtttgggagcaatctgtggtgttggattagtcaaagctttccaatcagctcactacgttaaatttggtggtggtgccaatacacttgccgctgggtacagtaaaggaactggtctagcagctgaaatcatcggaactttcgttcttgtgtacacagttttctcagccactgacccaaagagaagcgcaagagactcccatgttcccgttttggcaccacttccaatcgggtttgccgtgttcatggttcatttggctaccattcccgttaccggtaccggtattaacccagctagaagtttcggagctgctgttatcttcaacgaggagaaggcatgggatgaccagtggatcttctgggtcggacctttcattggtgccgcaattgctgctatttaccaccagtttatcctaagggctggtgctattaaagctttgggttcatttaggagcagtgctcgtgtctaagaagaattattgttggatagagataagggtgattgaagtcttttttcttttctcttttatgtttggaagatggtgatgatgtttgcgaggaataataataatggagctcctcctctaggggtccatatagggtggtggatttgtgacttgtctatctatctaaaaaatgtacatttattccatctctgtctgtctcccttcacttcttgaaaaagaaaaagaaaagcgagggtgaaaaatgataagatgatggataaattggaagtttgtagataaaatctctctatttattagtagtgtattttcccttttgttttcatgaaagtctttcaagtgtcaattgt

SEQ ID NO: 14983 - DNA, 893 bp, Papaver somniferum
atatgggaaaagacgaagtagcagaacatggtgaattctcagccaaagattatcacgacccaccaccaacaccattttttgatgcagatgagtttaagaaatggtctttctacagagctattattgctgaatttgtagctactcttttgttcctttacatcactgttttgactgttattggttacaagagccaaagtgaaactgatgattgtggtggtgtcggtattttgggtatcgcttgggcttttggtggtatgatctttgtcctggtttactgcaccgctggtgtccccggaggacacatcaacccagcagtcacttttggattatttttggcaagaaaagtttcactgccaagagcagtcttgtacatggtggctcagtgtttgggagcaatctgtggtgttggattagtcaaagctttccaatcagcttactacgttaaatttggtggtggtgccaatacacttgccgctgggtacagtaaaggaactggtctagcagctgaaatcatcggaactttcgttcttgtgtacacagttttctcagccactgacccaaagagaagcgcaagagactcccatgttcccgttttggcaccacttccaatcgggtttgccgtgttcatggttcatttggctaccattcccgttaccggtacaggtattaacccagctagaagtttcggagctgctgttatcttcaacgaggagaaggcatgggatgaccagtggatcttctgggtcggacctttcattggtgccgcaattgctgctatttaccaccagtttatcctaagggctggtgctattaaagctttgggttcatttaggagcagtgctcgtgtctaagaagaattattgttggatagagataagggtgattgaagtttc

SEQ ID NO: 14984 - DNA, 1318 bp, Papaver somniferum
ctcctttcctctccgcagtactcaactcttcttattcagtactctattttgaatttgtaccgtttcttgagaaatcaaaaatatgggaaaagacgaagtagcagaacatggtgaattctcagccaaagattatcacgacccaccaccagcaccattttttgatgcagatgagtttaagaaatggtctttctacagagctattattgctgaatttgtagctactcttttgttcctttacatcactgttttgactgttattggttacaagagtcagagtgaagctgatgattgcggtggtgttggtattttgggtatcgcttgggcttttggtggtatgatctttgtcctggtttactgcaccgccggtgtctccggaggacacatcaacccagcagtcacttttggattatttttggcaagaaaagtttcacttccaagagcagtcttgtacatggtggctcagtgtttgggagcaatctgtggtgttggattagtcaaagctttccaatcagctcactacgttaaatttggtggtggtgccaatacacttgccgctgggtacagtaaaggaactggtctagcagctgaaatcatcggaactttcgttcttgtgtacacagttttctcagccactgacccaaagagaagcgcaagagactcccacgttcccgttttggcaccacttccaatcgggtttgccgtgttcatggttcacttggctaccattcccgttaccggtaccggtattaacccagctagaagtttcggagctgctgttatcttcaacgaagagaaggcatgggatgaccagtggatcttctgggtcggacctttcattggtgccgcaattgctgctatttaccaccagtttatcctaagggctggtgctattaaagctttgggttcatttaggagcagtgctcgtgtctaagaagaattattgttggatagagataagggtgattgaagtcttgttgtttttctttttttgttttgtttggaagatggtgatgatgtttgcaaggaataataataatggagctcctcctctaggggtccatataggggtggtggatttgtgacttgtgtatctatcttaaaaaatgtacatttattctatctctatctgtctcccttcattcacttttttaaaagagaaaagaaaagagagggtgaaaaatgagtagatgatggataaattggaagtttgtagataaaatctctctatttattagtgtattttcccttttgttttcatgaaagtctttcaagtatcaagtgtaatattatccgctctttcgctatttctctctagtac

SEQ ID NO: 14985 - DNA, 1249 bp, Pteridium aquilinum
ccatttctctacaaagacaaacaaagaacgtctctttgtttctgtctttctctctgttttcctctctagcttttgcaaatccttttctttttggttccttgagctttatctctgttgctaggcatggcgaaggaaggagagcatggctttcatgctaaggactatgtcgaccctccaccagcacccttgattgatgcagcagagctgaagaaatggtcattttacagggctttgatagctgagttcattgcaactttgctcttcctttacatcacagtcttgactgtgataggcaacaagagccaggttggcacctccaatgactcctgtgctggtgttgggattcttggtattgcttgggcctttggtggcatgatcttcattcttgtttactgcaccgctggtatttctggtggtcacattaacccagcagtgacatttgggctgttcgtggcccgcaaggtctcattgatccgagccattgcatacatggtggctcagtccttgggagccatctgtggggtagggctggtcaaggctttccaaaaatcattctacaacaggtatggaggtggagccaacactctttcagatggctacagcactggtactggcttgggtgctgagattattggaacctttgttttggtttacactgttttctctgctactgatcccaagaggaaggctagagactctcatgtcccagtcttggctccccttccaattggttttgctgtgttcatggttcacttggctaccatcccagtcactggcactggcattaaccctgctaggagtttcggagctgctgttatctacaacaacaagaaggcctgggatgatcattggattttctgggttggtcccatgattggagcagccattgcagctttctaccaccaattcatcttgagagcaggagctgctaaggctcttgggtcattcaggagccagacccatgtttgatgatcttgacaaactcttttgccttccttcatgctttttttagaggacaaaaaatatgtaggcaaaaaatgtgaataatgaaggaagttgctttatgctttgtgtctggctattgtccccaaacctcctcctttcaacttccctttgtggatgttgaaaattataggaactttagggtcatggaaatgtagataaagtctgtttgagaagtggagggggccttttaagtatcccttttgtcatttcaagcactttccttagaatttacttcacctctctc

SEQ ID NO: 14986 - DNA, 1006 bp, Helianthus annuus
aactaagctattcaatcgccggccggttgcaatgacaaaagaagttgaagtggcggcgcaccacagcggcaaagactaccatgacccgcctccagcaccgttgatagacgccgaagagttaaccaaatggtcgttctacagagctctcattgctgaatttgttgccacacttctgtttttgtatgtaaccgtgttgacggttatcgggtacaagagcacgactgacccgaacttggatgctgatcagtgtggtggtgttggtatccttgggattgcatgggcatttggtggcatgatttttatccttgtttactgcactgctggtatctctggaggacacattaacccagctgtgacattcgggctattcttggctaggaaggtgtcactgattagggctattatgtacatggttgcacaatgtttgggtgcgatatgcggtgtgggtttggtcaaggctttccagagtgcctactacgataggtatggcggtggagccaatactttggccgacggctacagcaaaggtaccggactaggtgctgaaatcatcggcacctttgttcttgtctacaccgtcttctcggctactgatcctaagagaaatgcccgagactctcatgttcctgtgttggcaccactgccaatagggtttgcagtcttcatggtgcacttggcaaccattccgatcaccggtaccggaatcaacccagccagaagctttggcgctgccgtgatttacaacgacgagaaggcctgggatgatcattggcttttctgggtcggaccgtttttgggcgcagctgcagcggcgttctaccaccagtttgtactcagagcagcggccgctaaagcacttggttctttcagaagcaacgcatgaacaatgcataattgtaagacgatgcattaatatatccatgtaaaagaataagattcgtatggacgacacaattgatcgacgttaaaatggacgtggaattgttgatttgtagttaaatttcga

SEQ ID NO: 14987 - DNA, 1306 bp, Tragopogon dubius
ggggacaccaagtacctcacttttctttctctctatctctagtgttcgatcaacagtcatgacaaaagacgttgaagtggcggagcaccatggcggcaaagactaccatgacccacctccggcacccttgatcgacgccgcagagctaaccaaatggtctttctacagagctctcatcgccgaattcattgccaccctcctcttcctttacgttaccgtcttgacagtcatcggctacaagatccagactgaccccgccttaaacactgatcagtgcggcggcgttggcatcctcggcatcgcctgggccttcggtggcatgatcttcatccttgtttactgcaccgccggtatctctggaggacacattaacccggcggtgacattcgggctgttcttggcaagaaaggtgtcgttgattagggcggtattgtacatggtagcacagtgtttgggtgcaatctgtggtgtgggtttagtgaaagctttccaaagttcatactacaatagatatggtggcggggccaacgaattggccgccggctacagcaaaggcaccggccttggtgctgagatcatcggcacctttgttcttgtctacaccgtcttctcagccaccgatcctaagagaagtgctcgtgactctcatgtccctgtgttggcaccattgcccattgggtttgcagtcttcatggtacacttggccaccatcccgatcaccggcaccggtatcaacccagccagaagcttcggcgccgccgtgatttacaacaacgagaaggcgtgggacgaccaatggattttctgggtcggaccttttatcggagcggcgatagctgcgttctaccaccagtttgtactgagagcagcggccattaaagcccttggttctttcagaagcaatgcctaatctaaacgcggttaattcacccatccaacaacaataaaactggacggacgacaaattttttaccattcgttcgagtgtggttttccagccaaggagaaatgtaaatggatggatctatgagtgtggaagtgttcaactgtagataataatttattttcccttttgagaaacgtaatttcattttattttgtgaatcttgagtgtttaatgtaagtgatcttttttattatgtttatgagtaaattgtattttgtccctatggtttcatttttttgcaaaagaagtccctaaagccaaaaacttgacgttttcgtccctgtggtttgtatttttttctcgtttaggttcttagcgaggtaaatgtctattataccctttctttctcctttggtcaaa

SEQ ID NO: 14988 - DNA, 947 bp, Ambrosia trifida
cggggtactcttctaagttctacaacttgttaccaaatattattattattattattagtttctagcaaacatgacgaaagacgtcccagaacaaggctctttctctgctaaggactaccacgacccaccacccgccccattttatcgacccggctgagctaaccaaatggtcgttctaccgcgccttgatcgctgaatttattgccacacttttgtttctttatattactgtcttgactgttatcggatacaagagcaccactgaccccgccttgaagcttgaccagtgtggcggtgttggtatcctcggtatcgcgtgggcattcggtggcatgatctttgttcttgtttactgcaccgccggtatctctggtggtcacattaacccagccgtgacatttggtctgttcctagctcgtaaagtgtcgttggtccgagccgttatgtacatggtggctcagtgtttaggagccatatgtggtgtgggtttggtcaaggctttcaacaaaagcctatacaacaggtatggcggaggagccaacgagctagcggatggctacaacaccggcactggactaggcgctgaaatcattggaacatttgtacttgtttacaccgtcttctccgccactgaccccaagagaagtgcccgagactcccatgttcccgttttggcgccacttccaatagggttcgccgtgttcatggtgcaccttgccacaattccaatcactggaaccggtattaacccggctaggagtcttggagccgcggttatttacaacaaggataaggcatgggatgatcagtggatattctgggtgggacccttcgttggagcagccattgcagctttctaccaccaatttatattgagagcaggtgcagtcaaagcacttggatcattcagaagcagcactcatgtttgagatttatcaattgttgta

SEQ ID NO: 14989 - DNA, 1037 bp, Centaurea maculosa
catttcacttcttctacctctcttgctagtgtctgatcatccatagccagccatgacaaaggatgttgaagtggcggagcaccacggcggcagcgactacgccgccaaagactaccatgacccgcctccggccccgttgatcgacggtgaagagctgaccaaatggtcgttctacagagccgtgatcgccgaattcgttgccaccctcctcttcctttatatcaccgtgttgacggtgatcgggtacaagagccagacggaccccaccttgaacactgatcagtgcggcggagttggcatcctcggcatcgcctgggcctttggtggcatgatcttcgttctcgtttactgcaccgccggtatctctggaggacacattaaccccgctgtgacattcgggttgttcttggcgcgaaaggtgtcgttgatcagagcagtggcgtacatgatagctcagtgtttgggtgcaatttgcggtgttggtctggtcaaagctttccagagctcttactacaacaggtacggaggtggtgccaacgaattggctgatggttacaacaagggtacaggtctaggtgccgaaatcatcggcacctttgttcttgtttacactgtcttctcagccactgatcccaagagaagcgcacgagactctcatgttcccgtattggcaccactgcccataggatttgcagtgttcatggtccacttggccaccatccccatcaccggtaccggaatcaacccggccagaagcttcggtgccgccgtcatctacaacaacgagaaggcctgggatgatcaatggatcttttgggtgggaccatttattggggcagcagcagctgcattctaccaccagtttgtattgagagcagcagccattaaagcacttgggtctttcagaagcaatgcataattagttaattaattaattaattaattaaattatccatgcaaattaattaaaacaagaaataaagctggacgaatggcaatttattttatgcattcgagtgtggttttccagttgataa

SEQ ID NO: 14990 - DNA, 1095 bp, Amaranthus tuberculatus
aaaagagagaaaaaatggtgaaagacatagaagtgggaggaggaataggaaaagactaccaagaccctccaccatcaccattaatagatggagaagaactaacaaaatggtcattttacagggcagttattgcagaatttatagcaacaatgttatttttgtatataactgtattaactgtcattggtcataaatcccaaaatcaagctgatcaatgtaatggtgttggtttacttggtattgcttgggcttttggtggcatgatctttgttcttgtttactgtactgctggtatttctggtggacacataaacccagcggtgacatttgggctattattggcaagaaaagtgacactaataagggcaattctatacatggtggctcaatgtttaggggccatatgtggtgttgggctagttaaggcattccaaagtggatactatactaaatttggaggtggggccaacaccttagcagatgggtatagtaagggcactggtttgggtgctgagattattggcacttttgttttggtctacacagttttctctgccactgatcccaagcgtaatgccagggattctcatgttcctgtattggcgccgcttccaattggatttgcagtatttatggtacacttagctacaatcccagttacagggactggtatcaaccctgcacgtagttttggtgctgctgttattttcaattcttcccaggcctgggatgatcattggattttctgggtgggaccatttatcggagctgcaattgctgccatttatcaccaatacatattgcgtgccggttttgttaaggctcttgggtcgtttaggagctcatccaatgtgtgatgtcttcttaagttcatactaatcctcatcttaagcatggtttttggctacaatgaggattataagctgatttatcctacaaatttgcttaaagagtaaagagagatccttaagatgtatataaccttttattcttaagtcattgttggtgtcttggcacttattttcactttgtgcctttagatgtctgtttgctttcttttttcccactcctttgttgtattctgcactttaagta

SEQ ID NO: 14991 - DNA, 1218 bp, Cirsium arvense
taccaagctttcaacaccatccacttcacaccaagcatccatttcacttcttctacctctcttgctagtgtctgatcatccatagccagccatgacaaaggatgttgaagtggcggagcaccacggcggcagcgactacgccgccaaagactaccatgacccgcctccggccccgttgatcgacggtgaagagctgaccaaatggtcgttctacagagccgtgatcgccgaattcgttgccaccctcctcttcctttatatcaccgtgttgaccgtgatcgggtacaagagccagacggaccccaccttgaacaccgatcagtgcggcggagttggcatcctcggcatcgcctgggccttcggtggcatgatcttcgttcttgtttactgcaccgccggtatctctggaggacacattaaccctgctgtgacattcgggttgttcttggcgcgaaaggtgtcgttaattagagcagtggcgtacatgatagctcagtgtttgggtgcaatttgcggtgttggtctggtcaaagctttccagagctcttactacaacaggtacggaggtggtgccaacgaattggctgatggttacaacaagggtacaggtctaggtgccgaaatcatcggtacctttgtccttgtttacactgtcttctcagccactgatcccaagagaagcgcacgagactctcatgttcccgtattggcaccactccccatcggatttgcagtgttcatggtccacttggccaccatccccatcaccggtaccggaatcaacccggccagaagcttcggcgccgccgtcatctacaacaacgagaaggcctgggatgatcaatggatcttttgggtgggaccatttattggggcagcagcagctgcattctaccaccagtttgtattgagagcagcagccattaaagcacttgggtctttcagaagcaatgcataattagttaattaattaattaattaattaattaaattatccatgcaattaattaaaacaagaaataaagctggacgaatggcaatttattttatgcattcgagtgtggttttccagttgtataaggtagaattgttgaagttaaaatggatggatatattatgagtgtggaattggaattaagtcttcaattgtaattatcttcaaatttgtaattttcattttattttcctttttcttcattatgttttaatttgtaatgc

SEQ ID NO: 14992 - DNA, 977 bp, Citrus clementina
caaagtccacacatctctcttttctcttagaaaaaaagaaaaaaaaaaagagaaaacaaaaacttaaaattctcagtgaagagcaatctctagcaatggccaaggacattgaggttggtcgggaaggcgagttccatgataaggattaccacgacaatcctccagctccattgatcggcgcggaggagctcactcggtggtcgttttacagggctattatagctgagttcatagccacgctcttgtttttgtacattactgtgctgacagtgattggtcacaaaagccagactgacgccaaacacggcggtgacggatgcggtggtgttggcattcttggcatcgcttgggcctttggtggcatgatctttgttcttgtttactgcactgctggtatctctggtggacacattaacccggcagtgacatttgggctgttcttggcgcggaaggtatcactggtgcgagccgtaatgtacatggtggctcagtgtttgggagccatatgtggctgcgggctcgttaaggctttccagaagtcttactacacgagatacggcggtggagccaatgagctcgctgatgggtacagcactggcgctggattgggcgctgagatcattggtacctttgttcttgtctacactgttttctctgccactgatcccaagagaaaagctagggacccccatgttcccgtcttggcaccattgtcaattggatttgctgtgttcatggttcacttggctacgatcccagtcactggaactggcatcaaccctgctagaagttttggacctgcagtgatttacaacaaggacaaggcttgggatgatcaatggattttctgggttggccccttcattggtgcagcaattgctgcattttaccaccaattcatcctcagagcatctgctgctaaagctcttggatcccgcagaagctcccctaacatttaattaatttttaaaataatt

SEQ ID NO: 14993 - DNA, 1210 bp, Humulus lupulus
acttgactctctcactagccttagtagcaaccagctctctttgcttctttcttcgtatgcttttttttgttttgtgttgagtgttagcagcaatggtgaaggacgttgaagcaggaggacaacatgggtactcggccaaggactaccaggatccaccaccggcgccgttgttcgacgctgaagagcttggtcagtggtccttttacagggctatcattgctgagtttgtggccacgcttttgttcttgtacatcaccattttgacagtcatcggctacaagagccaggttgatccagcgcacagctccgatgcctgtggtggcgtcggaattttgggtattgcttgggccttcggtggcatgatcttcgtcctagtttactgcaccgccggaatctctggaggacacatcaacccagctgtgacgttcggactgttcttggcaaggaaggtgtctttggttcgaaccatcttgtacatagcggctcagtgtttgggagccatctgcggatgtgggctggttaaggctttccagagtgcttactacgacttatacggcggaggagccaactcccttgcccatggatacagcaccggtaccggactagccgctgagataatcggtacctttgttcttgtctacactgtcttctctgctactgaccctaaaagaagcgcaagagattcccatgttcccgtcttggcaccacttccaattgggttcgctgtgttcatggttcaccttgccaccatccccatcactggtactggtatcaacccagctagaagttttggggctgcagtgatttacggcgaggcatggaatggccactggatcttctgggtcggaccattcattggagctgccattgctgctttctaccaccaatttgtattgagagcagccgctgttaaagctcttggatcattcagaagcgctaacaccatgtgatctgggatcaatgtatgagtttttctctcatctgggcaccaatatatgtcgaaaaccaaaagaattacacgttctaagttgtcataatgaggcttttgaacttggtatttatgtatatgattttaatttcaagtatctgtttgtagttttctgtcttggggtctagttttagatgtgccccttttcttcttttccgctttctctcttcttcttacgagtgtttgtgtccttgtgagtttcatcaatgaaaaatcaaagtt

SEQ ID NO: 14994 - DNA, 1073 bp, Scabiosa columbaria
acactcccaccttatcaccaaaactaaaaccactcccaaatctctcactctttctctcaatccacacacacttaactatggccaaggatgcagaggtagcagagcacggctccttttccgccaaggactaccacgatccaccgccggcgccgcttatcgatcgggctgagcttacaaagtggtccttctacagagctatcatcgctgagttcatagcaactctgcttttcctttacattactgtcctcaccgttattggccacaagagccaatctgaccctgccaaaaccgaagatcaatgcaacggcgtcggaattctcggcatagcgtgggcatttggtggcatgatcttcgttctcgtctactgtaccgccggtatctctggggggcatattaacccagcggtgacatttggtctgtttttggctcgtaaagtgtcactgatccgagccgtgatgtacatggtggctcagtgcttaggagccatatgtggagtcgcacttgtaaaggcgtttcaagaaccttactacaagatgtacggtggtggagccaacacgctagccgagggctacagcaaaggcactggtttggcagcagagattatcggaacttttgttctggtgtatacagttttttcagccactgatcccaagaggagtgccagagattcacatgttcctgtattggctccacttcctatcggattcgctgtcttcatggtccacctggccaccattccaatcaccggtactggcatcaaccctgctcgtagtcttggagctgcggttatctacaacaaagagaaggcttgggatgatcaatggctgttttgggttggacccttcattggagcagccattgcggcattctaccaccaatttatcttgagagctggtgcggtcaaggctctgggctcgttcaggagcaatccccataattgattcatagtttcatctcccaaaattaaattccactgcacacttgaaacttagttttaattcaaatgtggataacttttatttggaaagggaaagcttcttgttatttattttcttgtgattattatgtggttg

SEQ ID NO: 14995 - DNA, 1043 bp, Silene vulgaris
aaaaactaaaattaatctcaaaatgtcgaatgaaatggaaggagaagtagtaaaagactatcaagaccctcctccatcaccattgtttgatacagaggagttaacaaaatggtcattttacagggctctaattgcagaatttgtagcaacacttttgttcttgtacattactgtgttgactgtaattgggtacaaaagtcaaagtgctactgatgattgtggtggtgttggcattcttggtattgcttgggcttttggtggcatgatctttatccttgtttactgcaccgctggtatttccggtggacatattaacccagctgtgacttttggcctcctattgggaagaaaactgtcattagtgagggccattctgtacatggtggctcaatgtttaggagccatttgtggtgttgggttggtgaaggccttccaaagtgcatactacgacaggtttggcggtggggccaatgagttagccgtcggttacagcaagggcaccggcttaggtgctgagatcattggcactttcgttcttgtctataccgttttctctgccactgaccctaaacgcagtgctagggactcccatgttcctgtactggcacctcttccaattggatttgctgtgttcatggttcacctagcaactatcccagtcaccggtacaggcattaaccctgcaagaagttttggagctgcggtcatctacaacaacaaaaaggcatgggatgaccactggatattctgggtaggaccattcattggagctgctattgctgcaatctaccatcagtacatcttaagagccggtttcgttaaggcgcttgggtccttcagaagctcatccaatgtgtaagatcatataaaccttaaacaagctagccctcaccaaaactaaagcatgatttttggttaattgggatttttaattgtattcagtttgatttgtaatttgcctaagtggcattgtggctttacaaaggtgtaaataagattttttttggttggaagggtttgtaatggcaattgtaatcagtgtg

SEQ ID NO: 14996 - DNA, 1058 bp, Ambrosia trifida
cagagtacgcgggactccaataattacaatccacctactcacaaaatagccgttgcacattctacacccttcttttcttttcctctttatatacccctctttcctttactacaccatctcactcttctaagttctaaaaacttgtacctaataatattattattagtttctagcaaacatgacgaaagacgtgccagaacaaggctctttctctgccaaggactaccacgacccaccaccagccccgtttatcgacccggctgagctaaccaaatggtcgttctaccgcgccttgatcgctgaatttattgccacacttttgtttctttatattactgtcttgactgttattggctacaagagcaccactgacccagccttgaagcttgaccagtgtggcggtgttggtatcctcggtatcgcgtgggcatttgggggcatgatctttgttcttgtttactgcaccgctggtatctctggtggtcacattaacccagcggtgacatttggtctatttctagctcgtaaagtgtcgttggtccgagccgttatgtacatggtggctcagtgtctaggagccatatgtggtgtgggcttggtcaaggctttcaacaaaagcctttacaacaggtatggcggaggtgccaacgagctggcagacggctacaacaccggcactggactaggcgctgaaattatcgggacatttgttcttgtttacaccgtcttctctgccaccgaccccaagaggagtgcccgagactcccatgttcccgttttggcgccacttccaatagggtttgctgtgttcatggtgcaccttgccacaattcctatcactggaaccggtatcaacccggctaggagtcttggagccgcggttatttacaacaaggataaggcgtgggatgatcagtggatattctgggtgggacctttcgttggagcagcaattgcagctttctaccaccaatttatattgagagcaggtgcagtcaaagctcttggatcattcagaagcagcactcatgtttgagattttatcgattgttggttgt

SEQ ID NO: 14997 - DNA, 994 bp, Arnica chamissonis
accacctccatcgccacacaatttcagtctcgatcgatcgaccaagcatgactaaagatgtgccagagcaaggctctttctccgctaaggactaccacgacccaccgccggcgccgttgatagacccgggggagctcaccaaatggtctttctacagagctgtgatcgctgagttcatcgccacccttctcttcctttatataacagttttgactgttattggctacaagagcaccactgatcccgccttgaacgctgaccagtgcggcggcgttggtatccttggcatcgcttgggccttcggtggcatgatctttgttcttgtttactgcacggccggtatctccggaggtcacattaacccagcggtgacatttggtctgttcctggctcgtaaagtgtcgttgatccgagccattatgtacatggtggctcagtgcttaggagccatctgtggtgtgggcttggtcaaggcttttaacaaaagcctctacaacaggtacggcggaggagccaacgaacttgccgacggctacaacaaaggcaccggacttggcgctgaaatcatcggaactttcgtcctcgtctacaccgtcttctccgccaccgatcccaagaggagtgcccgagactcccatgttcccgttttggcgcctcttccgatagggtttgccgttttcatggtgcaccttgccactattccgatcaccggaaccggtatcaacccggcccggagtcttggagccgcggtcatttacaacaaggataaggcgtgggatgatcagtggatattctgggtgggaccgttcgtgggagcagccattgcagccttctaccaccaatttatattgagagcaggtgcagtcaaagcccttggatcattcagaagcagcacccatgtttgagattcgtcaattattgtattttcgttcaaaccaaaaatatgaaaatgaaatgataataataatatttatgtttacgtctttagccctct

SEQ ID NO: 14998 - DNA, 1241 bp, Daucus carota
cacacattatccttctccaatctcccctgcttcttctcactaaacacacacaattttcactacttatacaactcttgtgatcacataatatcatcagcaatcatgaccaaggacgtggaagtggccgagcaaggttcattctccggcaaagactacgtcgagccaccgccagtgccgcttgtagacccccatgagctgaccaaatggtcattttacagggcactcatagctgagttcgttgctacacttctcttcctctacataactgtcttgactgttattggttacaaaagccagactgatttagacgccggcggtgaccagtgcggtggcgttggcattctcggcattgcctgggctttcggtgggatgatcttcgttcttgtctactgcactgccggtatctccgggggtcatattaacccagcggtgacattcggtttatttctggctcgaaaagtgtcgctgattcgagcgttgatgtacatggtggctcagtgcctaggagccatttgcggtgttggtttagtgaaggctttccagcagccgtactacaagaggtacggcggaggagccaatgagctggccgacggctacagcaaaggcactggactagccgctgagattatcggaacttttgttcttgtctacactgttttctcagccacggaccccaagaggaatgctagagactctcatgttcctgttctggcacctctccccattggatttgctgttttcatggttcatcttgccaccattccgatcaccggaaccggtattaaccctgccaggagtctcggagctgctgtgatctacaaccaggacaaggcctgggatgatcattggctattctgggttggacccttcattggtgcagccatagcagccttttaccatcagttcatcctgagagcaggcgcagtcaaggcccttggatcattcaggagcaatgcttgaattttaatatgaaaatgaaagagatattttgtatcttcttgatttgttgttgcattaggaagacaagtgtattttcaaggagaataatcaagtaatgtctgtttgtttttgttaatgagtaggttttcaatgtttcatagcatcaattgagaccatgggaagattttctcttgtccctggcccttgtatttgaactaccagttattattgtatggatcatgtatttaatttttctgagttatttatggatgagttggtgtattttcatttttagaaattta

SEQ ID NO: 14999 - DNA, 1031 bp, Chrysanthemum coronarium
cggcgctctaaatagtggatccccgggctgcaggaattcgaatccaaaaacattgttctaacgttgtcaaaatgactaaagatgtccccgagcaaggttcattctcagctaaggactaccatgaccctccaccagcacccttgattgaccctggggagttggcaaagtggtctttctacagggctttgattgctgagttcattgctactcttttgtttctttacataactgtcttgactgttattgggtacaaaagtactactgatcctgccttgaacgctgaccagtgtggtggtgttggtattcttggtattgcttgggcttttggtggtatgatctttgttcttgtttactgcactgctggtatctctggaggtcacattaacccagcagtgacattcggtctattcctagcacgtaaagtatcattgatccgagccattatgtacatggtggctcaatgtctaggagccatttgtggtgtgggcttagtcaaggctttcaacaaaagtctatacaacaggtatggcggaggagccaactctctagccgatggttacaacaaaggaaccgggctcggagctgagattatcggcactttcgtccttgtctacaccgtcttttcggccactgatcctaagagaagtgcccgtgactcccacgttccagttttggcaccacttcctatcgggttcgccgtgttcatggttcacttggccactattcctattaccggaaccggtattaacccggcccgaagttttggagccgctgttatctacaacaaggaaaaaatttgggatgaccagtggatattctgggtgggaccctttattggagcagcaattgcagccttttatcaccaatttatattgagagcaggtgcaatcaaggctcttggatcattcagaagcagtacccctaattaatcacttcttttttatttctttttaaattattgtaccctttatttttaagatcccaaaattgtaatttctaataatatttatggttgaagtttagctttttgg

SEQ ID NO: 15000 - DNA, 1306 bp, Chrysanthemum coronarium
attccggcaataatttccactaacaataattacaactcacctacttcaaaaataaccgttacacattctacacccttcttatcttcatttccctttatataaacaccaccacaaacacactcactcacaccattatcatctcaacacaaatcacacacaaaaaaacattgttctaacgttgtcaaaatgactaaagatgtccctgagcaaggttcattctcagctaaggactaccatgaccctccaccagcacccttgattgaccctggggagttggcaaagtggtctttctacagggctttgattgctgagttcattgctactcttttgtttctttatataactgtgttgactgttattgggtacaaaagtactactgatcctgctttgaacgctgaccagtgtggtggtgttggtattcttggtattgcttgggcttttggtggtatgatctttgttcttgtttactgcactgctggaatctctggaggtcacattaacccagcagtgacattcggtctattcctagcacgtaaagtatcattgatccgagccattatgtacatggtggctcaatgtctaggagccatttgtggtgtgggcttagtcaaggctttcaacaaaagtctatacaacaggtacggcggaggagccaactctctagccgatggttacaacaaaggaaccgggctcggagctgagattatcggcactttcgtccttgtttacaccgtcttttctgccactgatcctaagagaagtgcccgtgactcccacgttccagttttggcacctcttcctatcgggttcgccgtgttcatggttcacttggccactattcctattaccggaaccggtattaacccagcccgaagttttggagccgctgttatctacaacaaggaaaaaatttgggatgaccagtggatattctgggtgggaccctttattggagcagcaattgcagccttttatcaccaatttatattgagagcaggtgcaatcaaggctcttggatcattcagaagcagtacccctaattaatcacttcttttttatttctttttaaattattgtactctttatttttaagatcccaaaattgtaatttctaataatatttatggttgaagtttagctttttggtttgcttagttgtctagaataaacttttggttctcgaattggtctagaaaaagaccatgattagagtttttgccaacaatgaaacgacaaagtgacaaagaatgacgcttgtacaacatggataagttgctagctagctagacatagaactagcaaatat

SEQ ID NO: 15001 - DNA, 1223 bp, Euphorbia peplus
tctctctctaaaccacattagcaacgaaacaatgggaaaagacgtcgaagttgcagaaccagctgctgaattctcagcaaaagactaccatgaccctccaccagcacctttgattgacatggaggagttgggtaaatggtctttttacagagctgtaattgcagagttcattgccactcttctctttctttacatcacagtgttgactgtcattggctacaagagccaaactgatcctctcctgaataaggacgcttgtggtggtgttggtattcttggtattgcttggtcttttggtggcatgattttcattcttgtttactgcaccgccggtatttcaggaggacacattaacccagcagtgacattcgggctatttttggggaggaaggtgtcgctaataagggcagtgttgtacatcatagcacagtgtttgggagcaatatgtgggtgtggattggtaaaggcattccagaaatcatactaccatagatacggaggaggagctaacgaattgtccagtggatacagcaagggaactggattgggtgctgagattattggtacttttgttcttgtttacaccgtcttctctgctactgatcctaagagaagtgctagagattctcatgttcctgtgttggcacctctccccattggatttgccgtgttcatggttcatcttgccactattcccatcaccggaactggcatcaaccccgctaggagttttggagctgctgttatctacaacgaggacaaagcctgggatgatcagtggatcttttgggtcggaccattcattggagctgcagttgctgcattctaccaccaatttgttctaagagcagcagcaattaaggcacttggatctttcagaagcaatgcttaattaagtatgcttagagagagtcacatgaataacaatggaatattggtgtcttgatggagaaagaatatgtttgtttgaaggcccattgaattgtaaataatgaaaacatttcatggtcaagggtgtctgtcttttcctttatttatccctctctgtatctgtaattgtttttcttttcctttgtattttaagtttgtgctactagtttatttatcatctctatcttttcatccttatcttcttcatcatcataaaagaaaaaaggaaaaaatatcatttcttgagttgggtgtatgtatcttgttaatttagcatactctgttgaatgaat

SEQ ID NO: 15002 - DNA, 955 bp, Flaveria ramosissima
taccaccaccggattatttgcactctctagcaaccatgactaaagacgtgccggaacaaggttcgttctccgctaaggactaccacgacccgcccccggccccgttgatcgaccccgaggagctctccaaatggtcgttctatagggcgattatcgcggagttcatcgccacacttttgttcttgtatattactgtcttgactgttattggctacaagagcaccactgaccccgccttgaacgctgaccagtgcggtggcgttggtatcctcggtatcgcgtgggccttcggtggcatgatctttgtccttgtttactgcaccgctggtatctctggaggacacattaaccccgcggtgacattcggtttgtttctagctcgtaaagtgtcgttgatccgagcatttatgtacatggtggctcagtgtttaggagccatttgcggtgtgggtttggtgaaggctttcaacaaaagcctctacaacaggtatggcggaggagccaacgagctggccgacggctacaacaaaggcaccggcctgggtgcggaaatcatcggcacttttgttcttgtttacactgtcttttcagccaccgaccccaagaggagtgctagagactcacatgttcctgttttggctcctcttccaattgggtttgcggtgttcatggtgcaccttgcaacaatcccgatcactggaaccggtatcaacccggctaggagtcttggagccgcggtcatctacaacaacgaaaaagcatgggatgatcagtggatattctgggttggaccattcgtgggtgcagccattgcagccttctaccaccaattcatattgagagcaggtgcaatcaaagctcttggatcattcagaagcagctcacatgtttgagatttgtcgatttgttgtattttcttgcaaaccaaaaattggaaaaatggatcaataattat

SEQ ID NO: 15003 - DNA, 977 bp, Flaveria ramosissima
actcttctaccaccaccggaatatttgcactctctagcaaccatgactaaagacgtgccggagcaaggttcgttctccgctaaggactaccacgacccacccccggccccgttgatcgaccccgaggagctcaccaaatggtcgttctatagggctgttatcgcggagttcatcgccacccttttgttcttgtatattactgtcttgactgttattggctacaaaagcaccacggaccccgccttgaacaccgaccagtgcggtggcgttggcatccttggtatcgcgtgggcatttggtggcatgatctttgtccttgtttactgcaccgctggtatctctggaggacacattaaccccgctgtgacattcggtctgtttctggctcgtaaagtgtcgttgatccgagcctttatgtacatggtggctcagtgtttaggagccatttgcggtgtgggtttggtgaaggctttcaacaaaagcctctacaacaggtacggcggaggagccaacgagctggccgacggctacaacaaaggcaccggcctgggtgctgaaatcatcggcacttttgttcttgtttacactgtcttttcagccaccgaccccaagaggagtgctagagactcacacgttcctgttttggctcctcttccaattgggtttgcggtgttcatggtgcaccttgcaacaatcccgatcactggaaccggtatcaacccggctaggagtcttggagccgcggtcatctacaacaacgaaaaagcatgggatgatcagtggatattctgggttggaccattcgtgggtgcagccattgcagccttctaccaccaattcatattgagagcaggtgcaatcaaagcccttggatcattcagaagcagctcacatgtttgagatttgtcgatttgttgtattttcttgaaaaccaaaaataggaaaataggatcaataattattatcattattattat

SEQ ID NO: 15004 - DNA, 1226 bp, Panax ginseng
actcccactcccacccttctctctccctctgtccgaacactagctccttttattctctctatttataaatacatatttttgtataaattagttaatttaaaaatatgacaaaagacgtagaggtggcggagcacggctcattctccggcaaggactaccacgagccgccgccggtggcgctgatagacccggatgagctaacaaagtggtcattctacagggcgctcattgctgagttcattgccacccttctgttcctttacattacggtattgacggtgattggttacaagagccagactgatcccaccaaggttggggtggaccaatgcgggggtgtgggaattctgggtattgcttgggcatttggtggcatgatctttgttcttgtttactgcactgccggtatctctgggggtcacattaacccagcggtgacatttggtctttttctggcccggaaggtgtcactaattagggctgttatgtacatggtggctcagtgcttgggggccatatgtggggttgggcttgttaaggccttccagcagccctactacaagaggtacggcggtggggccaatgagctggccgacggctacagcaaaggcactggattggccgccgagatcatcggaactttcgtccttgtttacactgtcttctccgccactgatccgaagaggaacgccagggattcccatgtacccgtgttggctcctcttccaattggatttgccgtgtttatggttcacctggccaccattccaatcaccggaactggaattaaccccgcaaggagtctcggagctgcagtgatttacaaccaggacaaggcttgggatgaccattggctattctgggttggacccttcattggtgcagctattgcagccttttatcaccagttcattttgagagcgggtgccgttaaagcccttggctcattcaggagtaatgcttgatccttttgaggagttgtttgtcaatttagctagcaacaaaatcatttagaagaataatgaaagtaatgtttgtgtatgaagtttcttttactcgctgtctcaattgctcttcacgaggttggagggggatgggaatttaagtgagaaccaaatgaaaatgtagatatgtgtcaatgtatttagaaaggggaagcttttttgtatgccctttatccttggcacttggaatttgaatctacttgttgttctattattattatt

SEQ ID NO: 15005 - DNA, 1323 bp, Panax ginseng
agggttagggttagggttagggttagggatttgataggtaagcgaattgattcagacaacaaacaatggggagaatggcgaggagttgcgttcagtcgttgctaaagcttgtcaaagcagtggtatcaacgcagagtacatggggactccactcgcactcccacccttctctctccctctgtccgaacactagctccttttattctctctatttatatatacatatttttgtataaattagttaatttaaaaatatgacaaaagacgtagaggtggcggagcacggctcattctccggcaaggactaccacgagccgccgccggtggcgctgatagacccggatgagctaacaaagtggtcattctacagggcgctcattgctgagttcattgccacccttctgttcctttacattacggtattgacggtgattggttacaagagccagactgatcccaccaaggttggggtggaccaatgcgggggtgtgggaattctgggtattgcttgggcatttggtggcatgatctttgttcttgtttactgcactgccggtatctctgggggtcacattaacccagcggtgacatttggtctttttctggcccggaaggtgtcactaattagggctgttatgtacatggtggctcagtgcttgggggccatatgtggggttgggcttgttaaggccttccagcagccctactacaagaggtacggcggtggggccaacgagctggccgacggctacagcaaaggcactggattggccgccgagatcatcggaactttcgtccttgtttacactgtcttctccgccactgatccgaagaggaacgccagggattcccatgtacccgtgttggctcctcttccaattggatttgccgtgtttatggttcacctggccaccattccaatcaccggaactggaattaaccccgcaaggagtctcggagctgcagtgatttacaaccaggacaaggcttgggatgaccattggctattctgggttggacccttcattggtgcagctattgcagcgttttatcaccagttcattttgagagcgggtgccgttaaagcccttggctcattcaggagtaatgcttgatccttttgaggtgttgtttgtcaatttagcaacaaaaatcatttagaagaataatgaaagtaatgtttgtgtatcaagtttctttgactcactgtctcaattgttcttcacgaggttggaggggggtgggaatttaagtgagaaccaaatgaaaatcatgtagatatgtgtcaatgtatttagaaaggggaagcttttttgtatgccc

SEQ ID NO: 15006 - DNA, 1006 bp, Helianthus annuus
tcaccaattttcttcagtctatagcaaccatgacaaaagatgtgcctgagcaaggttctttctccgctaaggactaccacgacccaccgcccgccccgtttatcgacccagaagagctcacgaaatggtcgttctaccgcgccttgatcgcggagtttattgccactcttttgttcctttatattaccgtcttgaccgttatcggctacaagagcaccactgaccctaaattgaacgctgaccagtgcggtggcgttggtatcctcggcatcgcctgggccttcggtggcatgatctttgttcttgtttactgcaccgccggtatctctggtggtcacattaacccagcggtgacatttggtctgttcctggctcgtaaagtgtcattgatccgagccgttatgtacatggtggctcagtgtttaggagccatttgtggtgtgggcttggtcaaggctttcaacaaaagcctctacaacaggtacggcggaggagccaacgagctggcggacggctacaacaccggcacaggactgggcgctgaaatcattggaactttcgtcctcgtttacaccgtcttctccgccactgaccccaagagaagtgcccgagactcacatgttcctgttttggcgccgcttccgatagggtttgccgtgttcatggtgcaccttgccaccattcccatcactggaaccggtatcaacccggccaggagtcttggagccgcggtcatttacaacaaggataaggcgtgggacgatcagtggatcttctgggtgggtccgttcgttggagcagctattgcagctttctaccaccaatttattctgagagcaggtgcagtcaaagctcttggatcattcagaagcagcactcatgtttgagatttatgaatttatcaattgttgcaccccaaaatttgaaaaaaaatgaaataatcttattatttatgtttatttaacaacttatttgcgtttattgatgaaaaaaagaattctgtctt

SEQ ID NO: 15007 - DNA, 1155 bp, Tripterygium wilfordii
caagtagtgctgtgaagaaatggcaaaagatgtcgaagtacaagaaaatccagagttttctgccaaggactacactgatccgcctccgacgccgtttttcgacctggaagagctgaccaaatggtcattttacagagcccttatcgcagagttcatcgctactcttctcttcctttatatcacagttttgactgtgattggctataagagccaaaccgaccctaacttgaataccgaccagtgtggtggggttggaattctcggcatcgcttgggccttcggtggcatgatcttcatcctcgtttactgcactgccggtatttctggtggacatattaacccggctgtgacctttggattgctcctggggcgcaaggtgtcgctaatccgggcagtgttatacatggtagcacagtgtttgggtgcaatctgcggtgttgggcttgtgaagggcttccaaaagtcttactataacaggtacggaggtggggccaacatgctcgctgatgggtacaacaagggcgttggattgggtgctgagatcatcgggacctttgttcttgtctatactgtcttctcagccactgatcctaagaggaacgccagagactcccatgttcctgttttggcaccattgcccattgggttcgctgtgttcatggtccacctggctacgatccctatcactggcactggtatcaacccggctaggagttttggagctgctgtcatctacaacaaagagaaggcctgggatgaccaatggatattctgggttggaccatttattggagctgccattgctgcgttctaccaccagttcattctaagggctgcagccatcaaggccctgggttccttcaggagcaacgcttaaaatgctaaggattgatggtttaaggaaattaataaaaggactacaccatctcccatgtatgcttttaaggtttggaaaggtagatcaatctgcacggaattgtaaataaaaagactattcatggacaagaggggtgtctttgtttttgggtgtttccctatcagtgtattttattatgttatctcttctttctttctttctttctttattgtgtttttaattatataatttccttggtgtatatttactggtaaattaagtaaagttgtattatctta

SEQ ID NO: 15008 - DNA, 1386 bp, Citrullus lanatus
cactcaaatccatctccttccttctggtactttcttcccttctccttaaatacccttttcccccttcgtcttcctcctcatcactaccactttctttttcacttcatttctcttcccaaaaactcctaacccaaaaacaaaacacaaaaatggggaaagacgttgaagttgcagagcaaggcgaattccaaagcaaagactaccaagacccacctcccgctcctctcatcgaccctgaagaactaaccaaatggtctctttacagagccgccatcgccgagttcatcgccactctcctcttcctctatgtcaccgttttgaccgtcatcggttactcccaccaaagcgacccttccgtttccaccgacccctgtaacggcgttggcatcctcggtatcgcttgggccttcggcggtatgattttcatccttgtttactgcaccgctggtatctccggtggccacattaaccccgccgtcactttcggcctcttcttagctcgcaaagtctctctggttcgtgctctgttgtacatcattgctcagtgcgccggtgctatttgcggctgtggcttggttagagccttccaatctgcttattatgttagatacaacggcggtgctaatatgctcagtaatgggtataacaaaggaactggattaggcgctgaaatcatcggtacttttgttcttgtttacactgttttctctgctactgatcccaagagaaacgccagagattctcatgttcctgttttggctccactcccaattgggtttgctgtgttcatggttcatttggctacaatccccatcactggaactggaattaaccctgcaagaagttttggagctgctgtcatcttcaacaaagagaaagcctgggatgaccaatggattttctgggttggaccatttattggagctgcaattgctgcaatttaccatcagtatgtgctcagagctggagctattaaagctcttggatctttcaggagcaatgcttgaaaatcccttatggaaatatatttaattggtttctctcagaagaaaagattgtgttttgttttttggttttggggttttttttttttttttttttttttttttttctctctctctctcaatagacttttgatggtggaattggaactcaattgttgctgctgctgatttcgtctgcttctgtccgtcatcgatttgagttccgcaagaagtttaattattggccctggaaattgtacatatttccatttgtacccctaaaaaaacgaaaaaagaatggggcgcattctcatcttatgtctgttgttgatgtatttttcttttgtgtttcatccttatcctttgtttttcttaataaaagattctcctttattttgttcct

SEQ ID NO: 15009 - DNA, 1214 bp, Lactuca sativa
tctctctctctctctctctctctctctctctctctctctctcaacatgacaaaagacgtggcggaggaggggtctttctcggccaaggactaccacgacccaccaccggcgaagttcatagacccgaaggagctgacaaggtgggctttctacagagctctgatagcggagttcgttgccacccttctcttcctttacattactgtcttgacagttatcggttacaagagccagatcgacaagggctccgacgcctgcggcggcgtcggtatcttgggtattgcgtgggccttcggtggcatgatcttcgttcttgtttactgcaccgccggtatctccggaggccacatcaacccagccgtgaccttcggtctctttctggctcgtaaggtctcactacctcgagccatcatgtacatggtggctcagtgcttaggagccatttgtggtgtgggtttagtcaaagccttccacaagacttactacactaactatggcggtggtgccaacgagctagccgatggctacagcaaaggcaccggcttgggtgcagagatcatcggcaccttcgttcttgtttacaccgtcttctccgccaccgatcccaagagaagtgctcgtgactcccatgttcctgtgttagcacctttacccattgggtttgctgtgttcatggttcacttagccacgattcccatcaccggaactggtattaatccggcgaggagttttggagcggcggttatttacaacaaggagaaagcttgggatgatcaatggatattctgggttggacccttcatcggagcagccatcgccgccttctaccaccagtttatcttgagagccggtgcagccaaggcccttggatctttcaggagcagtggccatgtttgagatacggatgcattatattgttcgcaaaaagattggggaaaaaattgtttaactgtggatgaaagtatgtggtgttttggtgttaagagtgttctgtatgtcttgtttaaggttttattgcgaaccatggaaatgcaatgtaaattcttttttaggggtacccctgcccctcgtgttattcttgccacttcagaaactttgtatttactcaaattatttccaagttttttctgtgttattgagaatgttgtcttatgtaagaattaaatgtttaattctgagaatgttacttattacaatataatatgatattaacc

SEQ ID NO: 15010 - DNA, 1261 bp, Vitis vinifera
acgctctactctcaacttctcccaccttctcctaccttctcctgaacccccctagctcttctctttgcctagtgtttttctgctataacatttatgactaaggacgttgaggttgcggagcatgggtccttctccgccaaggactatcatgacccgccgccggcgccgctgttcgactcagttgagctcactaagtggtccttctacagggctctgattgcggagttcattgccacgctgctcttcctttacattacggtgctgacagtcatcggctacaagagccagactgccgggggtgacccatgcggtggtgttggcattctgggcattgcttggtcttttggtggcatgatctttatccttgtttactgcactgccggcatttctgggggacacattaacccggcggtgacctttgggctgttcctggcccggaaggtgtcgctgatccgagcaatattgtacatggtggctcagtgtcttggagccatttgcggtgtgggtctcgtcaaagccttccaatctgcttactatgatcgctacgggggcggtgccaacgagctctccaccggctacagcaaaggcaccggcttgggcgctgagatcattggaacttttgtccttgtctacaccgtcttctctgcaactgaccccaagaggagtgccagagactcccatgttcctgttctggcacctcttccaattgggtttgccgtgttcatggttcacttggccactattcctatcactggcaccggtatcaaccctgccaggagtttgggggctgctgttatctacaacaatgagaaggcctgggatgaccagtggatcttttgggttggacccttcattggtgcagccattgcagccttctaccaccagttcatattgagagctggagctgtcaaggctcttgggtcattcaggagcaccactcatgtatgatttgcagagccattttgataccttcttccactgtttttgggggtgaagaaaaagaatttggaaggaggagaagtgatcggaattggaagaataattatggaggttgttattgatatggatgagggcatgaaattgtagataccatctctatggaaataggaagctttttgtatccctcccttaagcacttttcttttaatccacttcatgcttatcttttcctagttttctctttcattgtttgcttatgcttgaacaaaattctgtgttgtggctttgtcttgttggaagtaaagggctttattttgttttt

SEQ ID NO: 15011 - DNA, 1077 bp, Ambrosia trifida
acattatctctcttcaaaacaactgatcatcaatcatgaccaaagacgttgaagtggctgagcaccacggtggcaaagactaccatgacccaccaccagcaccgttgatcgacggtgaagagctaaccaaattggtccttttattagagctcttattgctgagtttattgccaccttattgttcttgtacgtgactgttttaacggttattggttacaaggtccagacggaccctaagttggacactgaccagtgtggtggtgttggtatccttggtattgcatgggctttcggtggcatgatctttatacttgtttactgcactgctggtatttctggaggacacattaacccggctgtgacattcgggctattcttggcaagaaaggtgtcattgatcagggcattagggtacatggtagcacaatgtttgggtgcaatatgtggtgtgggtttggtcaaagctttccaaagttcatactacaataggtatggtggtggggccaatgagttagccgatggctacaacaaaggcactggactaggtgccgagatcatcggcacctttgttcttgtgtacactgttttctcggctaccgatcctaagagaagcgctcgcgactctcatgtccctgtgttggcaccactgcccatagggtttgcagtcttcatggtacatttggcaactatcccaattactggtaccggaatcaaccccgctagaagcttgggcgccgccgtgatttacaacaatgaaaaggcttgggatgatcaatggattttctgggttggaccgttcttgggtgcagcggcagcagcattctaccaccagtttgtactgagagccggggctattaaagcacttggttctttcagaagcaatgcatgatctagagatgataaattaatccaataaacttgatcagttgttacaatggatggatggatatatgagtgttggatgatcaagtgttcaattgtagatatgtgttgttagtttcctgttgagatatgtaatttttttctatttattttcctattttcttgtgtaattcttgagtgtttaatgttaagtgg

SEQ ID NO: 15012 - DNA, 1124 bp, Helianthus annuus
ggccggggacccctcttctcttcgtctcaactaagctattcaatcgccagccggttgcaatgacaaaagaagtcgaagtggcggagcaccacagcggcaaagactaccatgacccgcctccagcaccattgatagacgccgcagagttgaccaaatggtcgttctacagagctctcattgctgaatttgttgccacacttctgtttttgtatgtaaccgtgttgacggttatcgggtacaagagcacgactgaccccgacttggatgctgatcagtgtggtggtgttggtatccttgggattgcatgggcatttggtggcatgatttttatccttgtttactgcactgctggtatctctggaggacacattaacccagctgtgacattcgggctattcttggctaggaaggtgtcactgattagggctattatgtacatggttgcacagtgtttgggtgcgatatgcggtgtgggtttggtcaaggctttccagagtgcctactacgataggtatggcggtggagccaatactttggccgacggctacagcaaaggtaccggactaggtgctgaaatcatcggcacctttgttcttgtctacaccgtcttctcggctactgatcctaagagaaatgcccgagactctcatgttcctgtgttggcaccactgccaatagggtttgcagtcttcatggtgcacttggcaaccattccgatcaccggtaccggaatcaacccagccagaagctttggtgctgccgtgatttacaacgacgctaaggcctgggatgatcattggcttttctgggtcggaccgtttttgggcgcagctgcagcggcgttctaccaccagtttgtactcagagcagcggccgctaaagcacttggttctttcagaagcaacgcatgaacaatgcataattgtaagacgatgcattaatatatccatgtaaaagaataagattcgtatggacgacacaattgatcgacgttaaaatggacgtggaattgttgatttgtagttaaatttcgattcgagtaatgtaatttcattttttcaatttttcttttccttctcattgtgaatctaaagtgttttgtaagcagtctttttcttattttt

SEQ ID NO: 15013 - DNA, 1220 bp, Echinacea purpurea
atctccatctccatctccatctccatctctatctctatactaaaaaattcatttttaccgacgatgacgaaagacgtcgaagtggcggagcaccacagcggaaaagactaccatgacccacctccggcaccgttgatcgacggtgaagagctcaccaaatggtccttttacagagctctcatcgccgaattcattgccaccctactattcctttatgtcaccgtgttgacagttatcggttacaagagccagactgaccctaacttgaacaccgatcagtgtggcggtgttggcatcctcggcatcgcatgggcttttggtggcatgatctttattctcgtttactgcaccgccggtatctctggaggacacattaacccggctgtgacattcgggctattcttagcaagaaaggtgtcattgattagagcattagggtacatgatagcacaatgtttgggtgcaatatgtggtgtgggtttggtcaaagccttccaaagctcatactacaataggtacggtggtggggccaatgagttagccgatggttacaacaaaggcactggactaggtgccgaaatcatcggcacctttgttcttgtgtacactgtcttttcggctactgatcctaagagaagcgctcgcgactctcatgttcccgtgttggcaccactgcccattgggtttgcagtcttcatggttcacttagcaaccattccaatcaccggcaccggtatcaacccggccagaagctttggcgccgcggtgatttacaacaaagaaaaagcctgggatgaccaatggattttctgggttggaccgtttgtgggcgcagcggcagcagcgttctaccaccagtttgtactgagagcagcagcccttaaagcacttggttctttcagaagcaatgcttgattgatatgagtgtggatgatcgatcaagtgttcaattgtagatatgtgtttttactttcctgttgagatatgtaattttaatttttgtcccatttgttttccattttctttttgaatcttgagtgtttaatcttcaatgtagtggtcttttcttttttctgttatgtttttccgagaaaatatgggtttcttaattcatgttgttttaatgttatttttgtaatattgtggttgtttttagcataataattcataaactagtgcatcatcgggattatattatagcagaaaagggatagcttttt

SEQ ID NO: 15014 - DNA, 1253 bp, Eschscholzia californica
cgactctaatctgtctgtcttaaaattacaccataatagacaccaccccctctcccattccttactccataactcttcaatcctcagcaacacagagccccattctctctctctctctacttaaactttttttcttcttgccagtaacatgggtaaggacattgaggtaactgatccacaaagtggtggtgggtttaccacaaaagactattctgatccaccaccagctccatttttcgattttgaagaactctcaaaatggtctttttacagagctttaatcgctgagtttgttgctactcttctctttctttacattactgttttaactgtcattggttacaaatcacaagttgccattggtggtgatgaatgtggtggtgtcggtattcttggtatcgcttgggctttcggtggaatgatcttcgttctagtctactgcaccgccggtatctcaggaggacacattaacccagcagtgacattcggattgttcttggcaaggaaggtttcactaattagggcagttctatacatggtggctcaatgtctaggtgcaatttgtggtgttgggttagtgaaagctttccaaaaagcttactatgttagatttggtggtggagcaaatgaattagcagctggatatagtaaaggaactggtttagcagctgaaattattggaacatttgttcttgtttacactgttttctctgctactgaccctaaaagaagtgctagagattcacatatccctgttttagcaccactaccaattggttttgctgtttttatggttcatcttgctactatccccattactggtactggtattaaccctgctagaagttttggagctgctgtcatttacaacaaagacaaagcttgggatgatcagtggattttctgggttggaccatttattggagctgccattgctgctttttaccatcagttcattcttagagctggagcagttaaggctcttgggtcattcaggagcaatgctcacaactgatccatgaaaagagtttgatcatcaaaataatggagcagagagagagagagagaaagagagagggttagtgagagatttggggaagaaggaaggaactgtagatataaattgcttggaaagaagaaagaaagggtttttattttgtgatcatcatcactattctctctcactctcttcttcttcttcttcttgtttgtttgattatttattgtatctaagtgttttaatttcttgtttt

SEQ ID NO: 15015 - DNA, 1290 bp, Eschscholzia californica
cctcagcaacacagagccccattctctctctctctctactttaaactttttttcttcttgccagtaacatgggtaaggacattgaggtaactgatccacaaagtggtggtgggtttaccacaaaagactattctgatccaccaccagctccatttttcgattttgaagaactctcaaaatggtctttttacagagctttaatcgctgagtttgttgctactcttctctttctttacattactgttttaactgtcattggttacaaatcacaagttgccattggtggtgatgaatgtggtggtgtcggtattcttggtatcgcttgggctttcggtggaatgatcttcgttctagtctactgcaccgccggtatctcaggaggacacattaacccagcagtgacattcggattgttcttggcaaggaaggtttcactaattagggcagttctatacatggtggctcaatgtctaggtgcaatttgtggtgttgggttagtaaaagctttccaaaaagcttactatgttagatttggtggtggagcaaatgaattagcagctgggtatagtaaaggaactggtttagcagctgaaattattggaacatttgttcttgtttacactgttttctctgctactgaccctaaaagaagtgctagagattcacatattcctgttttagcaccattaccaattggttttgctgttttcatggttcatcttgctactatccccattactggtactggaattaaccctgctagaagttttggagctgctgtcatttacaacaaagacaaagcttgggatgatcagtggattttctgggttggaccatttattggagctgccattgctgctttttaccatcagtttattcttagagctggagcagttaaggctcttgggtcattcaggagtaatgctcacaactgatccatgaaaagagtttgatcatcaaaataatggagcagagagagagagaaagagagagggttagtgagagatttggggaagaaagaaggaactgtagatataaattgcttggaaagaagaaaggaagggtttttatttgtgatcatcatcactattctttctcactctcttcttcttgtttgtttgataatttattgtatctaagtgttttaatttctgttgtttaaatttcttattttgtatttttcagttgtttttgtttcaattttcctagtttgtttgtttgtttcaaaggtttcattctttaattattgtgtactttgattattaatgttatcaagtagtagttgttttt

SEQ ID NO: 15016 - DNA, 1036 bp, Flaveria ramosissima
caccaacacacttgatctcttcaaagttgaaagttgaaagttgaaagctgaaagccttagcctttgatcatcgagacgatcaccagcaatgacgaaagacgttgaagtggctgagcaccacagcggaaaagactaccatgacccgcctccggcaccgctcatcgactccgatgagctgaccaaatggtcgttctatagagctgttatagcagaattcatcgccacactattgtttctttatgttacggtgttgaccgttatcggatacaagagccagaccgacccgaaccttaatacggatcagtgcggtggcgttggcatcctcggcatcgcctgggctttcggtggcatgatctttatcctcgtttactgcaccgccggtatctctggaggacacattaacccggctgtgacgttcgggttatttttggcgagaaaggtgtcattgatcagggcattgttgtacatggttgcacaatgtttgggtgcaatctgtggtgtgggtttggtcaaagccttccaaagttcatactacaacaggtacggtggtggtgctaacgagttagccgatggctacaacaaaggcacaggactaggtgctgagatcatcggcacctttgttcttgtctacactgtcttttcagctaccgatcctaagaggagtgcccgtgactctcacgtccctgtgttggcaccactgcccatagggtttgcagtcttcatggtacatttggccactattccaatcaccggtaccggaatcaacccggctagaagcttcggggccgcagtgatctacaacaacgagaaggcttgggatgatcaatggattttctgggtcggaccgtttgtgggtgcagcagcagccgcgttctaccatcaattcgtactgagagcagcggccattaaggcacttggttcgttcaggagcaatgcatgatcgaaagatgatgaattcatccattcatccatgcaaacagaataaaatttggatggatatttgaatgtggaagtgtttaattgtagataagtgttt

SEQ ID NO: 15017 - DNA, 1092 bp, Flaveria ramosissima
caccaacacacttgatcccttcaaacccttagcctttgatcatcattcaccaccaatgacaaaagacgttgaagtggctgagcaccacagcggaaaagactaccatgacccgcctccggcaccgctcatcgactccgatgagctgaccaaatggtcgttctatagagctgtcatagcagaattcattgccacactactgtttctttatgttaccgtgttgaccgttatcggatacaagagccagaccgacccgaaccttaatacggatcagtgcggtggcgttggcatcctcggcatcgcgtgggcatttggtggcatgatctttatcctcgtttactgcaccgccggtatctctggaggacacattaacccggctgtgacgttcgggctctttttggcgagaaaggtgtcattgatcagggcattgttgtacatggttgcacaatgtttgggtgcaatttgtggtgtgggtttggtcaaagccttccaaagttcatactacaacaggtacggtggtggtgctaacgagttagccgatggctacaacaaaggcacaggactaggtgctgagatcatcggcacctttgttcttgtctacactgtcttttcagctaccgatcctaagaggagtgcccgtgactctcacgtccctgtgttggcaccactgcccatagggtttgcagtcttcatggtacatttggccaccattccaatcaccggtaccggaatcaacccggctagaagcttcggggccgcagtgatctacaacaacgagaaggcttgggatgatcaatggatcttctgggtcggaccgtttgtgggtgcagcagcagccgcgttctaccatcaattcgtactgagagcagcggccattaaggcacttggttcgttcaggagcaatgcatgatcgaaagatgatgaattcatccatgcaaacagaataaaatttggatggatatttgaatgtggaagtgtttaattgtagataagtgttttaaatttaatgtcctttgggtaatgtgtatctttttttcttgtttattttccctttctattgtgtaatcttgagtgtttaatgtaagtggttctttt

SEQ ID NO: 15018 - DNA, 1092 bp, Flaveria ramosissima
ggttagaaagctgaaagctgaaagaccttagcctttgatcatcgagacgatcagcagcaatgacgaaagacgttgaagtggctgagcaccagagcggaaaagactaccatgacccgcctccggcaccgctcatcgactccgatgagctgaccaaatggtcgttctatagagctgttatagcagaattcatcgccacactattgtttctttatgttacggtgttgaccgttatcggatacaagagccagaccgacccgaaccttaatacggatcagtgcggtggcgttggcatcctcggcatcgcctgggctttcggtggcatgatctttatcctcgtttactgcaccgccggtatctctggaggacacattaacccggctgtgacgttcgggttatttttggcgagaaaggtgtcattgatcagggcattgttgtacatggttgcacaatgtttgggtgcaatctgtggtgtgggtttggtcaaagccttccaaagttcatactacaacaggtacggtggtggtgctaacgagttagccgagggctacaacaaaggcacaggactaggtgctgagatcatcggcacttttgttcttgtctacactgtcttttcagctaccgatcctaagaggagtgcccgtgactctcacgtccctgtgttggcaccactgcccatagggtttgcagtcttcatggtacatttggccactattccaatcaccggtaccggaatcaacccggctagaagcttcggggccgcagtgatctacaacaacgagaaggcttgggatgatcaatggatcttttgggtcggaccgtttgtgggtgcagcagcagccgcgttctaccatcagttcatactgagagcagcggcgattaaggcacttggttcattcagaagcaatgcgtgatcgcaagatgatgaattcatccatgcaaacagaataaaattaatttggatggatatttgaatgtggaagtgtttaattgtagataagtgttttaaatttaatgtcctttgggaatgtgtatttcttttttctgtttattttccctttcttattgtgaatcttgagttgtttaatgtaagtg

SEQ ID NO: 15019 - DNA, 944 bp, Flaveria ramosissima
cacaccaaacacttgatcccctctccatctcttagcctttgatcatccatcagcagcaatgacaaaagacgttgaagtggcggagcaccacggcggaaaagactaccatgacccgcctccggcaccgttgatcgacgccgaagagctgaccaaatggtctttctacagagctgtcatagcagaattcattgccacactcctgtttctttatgttacggtgttgaccgttatcggatacaagagccagactgacccgaacctgaacatggatcagtgcggtggcgttggcatcctcggcatcgcgtgggcattcggtggcatgatctttatccttgtttactgcaccgccggtatctctggaggacacattaacccggctgtgacgttcgggctctttttggcaagaaaggtgtcattgatcagggcattgttgtacatggttgcacaatgtttgggtgcaatttgtggtgtgggtttggtcaaagccttccaaagttcatactacaataggtacggaggtggtgctaacgagttagccgatggctacaacaaaggcacaggactaggtgctgagatcatcggcacctttgttcttgtctacactgtcttttcagctactgatcctaagaggagtgctcgtgactctcacgtccctgtgttggcaccactgcccatagggtttgcagtcttcatggtacatttggccaccattccaatcaccggtaccggaatcaacccggcgagaagcttcggggccgcagtgatttacaacaacgagaaggcttgggatgatcaatggattttctgggtcggaccgtttgtgggtgcagcagcagcggcgttctaccaccagtttgtactgagagcagcggccattaaagcacttggttcgttcagaagcaatgcatgatcgaaagatgatgaattcatccatgcaaacggta

SEQ ID NO: 15020 - DNA, 1097 bp, Flaveria ramosissima
tgtttaactaatcatcagcagcaatgacaaaagacgtcgaagtggcggagcaccacggcggcaaagactaccacgatccgcctccggccccgttgatcgaccccgaagagctgacccaatggtctttctatagagctctcattgctgaattcattgccaccctcctcttcctatatgttaccgtcttaacggttatcgggtacaagagccagacggaccccaacttaaacaccgatcagtgtggtggcgttggcatcctcgggatcgcgtgggctttcggtggcatgatctttgttcttgtttactgcactgctggtatctctggaggacacattaacccggcggtgacattcgggttatttttggcaaggaaggtgtcactaattagggcattattgtacatggtggcacaatgtttgggtgcaatatgtggtgtgggtttggtgaaagcttttcaaagctcctactacaataggtatggtggtggcgccaacgaattggccccgggctacaacaaaggcacgggactaggtgctgaaatcatcggtacctttgttcttgtctacactgtgttttcagctactgatcctaagagaagcgctcgagactctcatgttcctgtgttggcaccactgccaataggatttgcagtcttcatggtacacttagcaaccattccgatcaccggcaccggaatcaaccccgccagaagcttcggcgccgcggtgatttacaacgacgacaaggcctgggatgatcagtggattttctgggtgggaccgtttctgggagctgcggcagcggctttctaccaccagtttgtactgagagcagcggctattaaagcacttggttctttcagatgcaatgcataactggaagaagatgatgaatgttaccatgctagaagaataaattgtacggatgatacggttgattgatcgttaaatggatggatatgagtgtcaaagtgttcaactgtatataaatgttttaattccctatttgagaaatgttattggatttgtttttgtctcccttttcgtttattttgtagaatcttagagttgtaagtggtcttttttcttatgctatga

SEQ ID NO: 15021 - DNA, 966 bp, Gerbera hybrid cultivar
tctctctcccacaaaaccctactaattgcccatttgacacgtcagcatgacaaaagacgtcgaagtggcggagcaccacggcggcgctgagttcgccggaaaagactaccacgacccacctccggcggcgttgttcgacgccgacgagctcggcaaatggtctttctaccgagctctcatcgcagaattcattgccaccctcctgttcctatacgttaccgttttgacagtcatcgggtacaagagccagaccgacccgaacttgaacaccgaccagtgcggcggcgttggcatcctcggcatcgcgtgggccttcggcggcatgatttttatccttgtttactgcaccgcgggtatctcgggaggacacattaacccggcggtgacatttgggttgttcctagcaagaaaggtgtcgttgatcagagcgttaggttacatgatcgcacaatgtttgggtgcgatctgcggtgtgggtttggtcaaagctttccaaagctcgtattacaatagatacggcggtggggccaacgagttggccgatggttacaacaaagggacaggactaggtgccgagatcatcggcacctttgtccttgtctacaccgtcttttcggccactgacccaaagagaaacgctcgagactcccatgttcccgtattggcaccactgcccatagggtttgcagtgttcatggttcacttagccaccatccccattaccggcaccggaatcaaccccgcaagaagcttcggcgccgccgtgatttacaacaatgacaaggcctgggatgaccaatggatcttttgggtcggaccgtttattggcgccgcgatagcggcattctaccaccagtttgtactgcgagccgcggccatcaaagcacttggttcttttagaagcaatgcataaatggaatgatatctaaattttaattcatccatgcaaaaaaaaaaaaaaaaaaa

SEQ ID NO: 15022 - DNA, 1119 bp, Lupinus angustifolius
catactattcccatgactaaggacgttgagattactgaacgtggttccttctctggaaaggactaccatgaccctcctccaacacccttcattgatgttgaagagttcactaagtggtccttctatagggcactcatagctgagtttatagctactttgcttttcctttacattactgtactcactgttattggttacaagagccagagtgatgttaaagctcatggtgatatatgtggtggtgttggtattcttggcattgcatgggcttttggtggcatgatctttgttcttgtttactgcactgctggaatctctggaggtcacattaacccagcagtgacatttggtctattcttggcacgcaaggtgtctttgccaagagctatcttatacatagtggctcagtgtttaggagcaatttctggtgttgggttggtcaaggctttcaacaaatctctttacactaggtatggtggtggggccaattccctcaatgagggttatagcactggtactggattgggtgctgagattattggaacctttgttttggtctacactgttttctctgccactgatcccaagagaaatgctagagattcacatgttccggttttggctccacttccaattggatttgctgtattcatggttcacttagctaccattccagtaactggcactggcattaaccctgctagaagttttggagctgctgttatctacaaccaatctaagccatgggatgatcattggatcttttgggtaggaccatttgttggggcagccattgcagctttctaccaccagttcattttgagagcaggtgctgctaaggctcttggatcattcaggagcaaccctactgtttgagttatcatcatcctcttcaaggttttaatggaaaaaatgattatttgaggataaaataatgggatgttcttgtgcttgtaattgtatttgcaatgtttcttttaacctctctcatatttaagttttcaagattgtggataagtgtattcccattagtatgttatctttattttaagttgttctcttgtgtcatctctctgtactcatttatatttatggaaaaatattctagagtttgaactt

SEQ ID NO: 15023 - DNA, 930 bp, Centaurea maculosa
ctatcttcactcttcaacatccacaaccaccaccactttttctctctctaccaccgcagccatgaccaaagacgtcccggagcaaggctccttctccgccaaggactaccacgacccgccgccggccccgttcatcgaccccgccgaactcaccaagtggtccttctaccgagcaattatcgccgagttcgtcgccacccttctcttcctttacatcaccgtcttaaccgtcatcggctacaaggcccagaccgaccccgccaagaacctcgaccagtgcggcggagtcggcatcctcggtatagcttgggccttcggtggcatgatcttcgttctcgtgtactgcacagccggtatctccgggggtcacattaacccagcggtgacttttggtctgtttctggctcgtaaagtgtcgctgatccgagccttattgtacatggtggctcagtgtctaggagccatctgtggtgtgggtttggttaaggccttccacaagacctactacaacaactacggcggcggagctaacgagctagccgacggctacaacaaggggaccggactcggcgccgagatcatcggaactttcgttctcgtctacaccgtcttctccgccaccgacccgaaaaggagtgcccgagactcccatgttcccgttttggcaccacttccaattgggttcgccgtgttcatggtccacttggccaccattccgatcaccggtaccggaatcaacccggcgaggagtctcggagctgccgtgatttacaacaaggaaaaggcttgggatgatcagtggatattctgggtcggaccctttatcggagcagccattgcggctttctaccaccagtttattttgagggcaggtgcagttaaggctcttggatctttcagaagcagctctcatgtttgatttgagatttt

SEQ ID NO: 15024 - DNA, 1069 bp, Helianthus annuus
attttcttcagtctctagcaaccatgacgaaagatgtcccggagcaaggttctttctccgctaaggactaccacgacccaccgcccgccccgtttattgacccggaagagctcactaaatggtcgttctaccgcgccttgatcgctgagtttattgccactcttttgttcctttatattaccgtcttgaccgttatcggctacaagagcaccactgaccctaaattgaacgctgaccagtgcggcggtgttggtatcctcggcatcgcctgggccttcggtggcatgatctttgttcttgtttactgcaccgccggtatctctggtggtcacattaacccagcggtaacatttggtctgttcctggctcgtaaagtgtcattgatccgagccgttatgtacatggtggctcagtgtttaggagccatttgtggtgtgggcttggtcaaggctttcaacaaaagcctctacaacaggtacggtggaggagccaacgagctagcggatggctacaacaccggcacgggaattggcgctgaaatcattggaactttcgtcctcgtttacaccgtcttctccgccaccgaccccaagagaagtgcccgtgactcgcatgttcccgtcttggcgccgcttccgatagggtttgccgtgttcatggtgcaccttgccaccattcccatcactggaaccggtattaacccggccaggagtcttggagccgcggtcatttacaacaaggataaggcgtgggacgatcagtggatcttctgggtgggtccgttcgttggagcagccattgcagctttctaccaccaatttattctgagagcaggtgcagtcaaagctcttggatcattcagaagcagcactcatgtttgagatttatgaatttaacaattgttgtaccccaaaatttgaaaaaaaatgaaataatattattatttatgtttatttaacaacttatttgcgtttattgatgaaaaaaggaattctgtctttcatgcttttcatcccataacacgtgaaaaaactaattaatgattttctaataagaaaattatatttgt

SEQ ID NO: 15025 - DNA, 1204 bp, Aristolochia fimbriata
cgaggtttttttttagttttgagctaattaaaagcgagatgggtaaagacgtggaggtgggcgagcaacaggggggcgagttcacggccaaggactacacggacccgccgccggctccgctcatcgacgtggaggagctcaccaaatggtccttctacagggcgctcatcgccgagttcatcgccacccttctcttcctctacatcaccgtcgccaccgtcatcggctacaagagccaggtggaccccgccaagaacgccgacggctgcggtggcgtcggcatcctcggcatcgcctgggccttcggcggcatgatcttcatcctcgtctactgcaccgccggaatctccgggggtcacattaacccggcggtgacgttcgggctgttcctggcgcgcaaggtgtctctgatccgagccgtgatgtacatggtggctcagtgtctgggagccatctgcggagttgggctcgtgaaggggttccagaagtcgtactacgtgcggtacggaggtggagcgaacgagctcgccgatggctacaacaagggcacgggcctgggtgcggagatcatcggcaccttcgtcctcgtttacaccgtcttcgccgccaccgacccaaaacggaacgccagagattcccacgtcccggtcttggctcctctcccaattgggttcgctgtgttcatggtccacctggccaccattcccatcaccggcaccggtatcaacccggcaaggagtttcggagctgcagtcatctacaacaaggaaaaagcttgggatgatcagtggatattctgggttgggcccttcatcggagctgccgtggctgcggcgtaccaccagtacgttcttcgggcacaggcgatcaaggcgcttgggtcgttcaggagcaactaagacttttttagctagctacctgcagcctctctgctactagtactacttcgtcgcttgtttctttcctgctcaatagagaagccaagctcggtgtttgaaaatggaagaataaaagtatggcgtgtcttgttgtctactggtctcggctctgtcgtctttttactagagagagagctggttccatgtaattgtagataaaattgctttgtgaatttccaaatagctagctttcccagctgcgtcctttattaatttctttaacttaattatcttcttaaattaattcaattagacttctacttatg

SEQ ID NO: 15026 - DNA, 959 bp, Chrysanthemum coronarium
tcttccgatcttctcaacacaaaacacacacaaaaaaaacattgttctaacgttgtcaaaatgactaaagatgtccctgagcaaggttcattctcagctaaggactaccatgaccctccaccagcacccttgtttgaccctggggagttgacaaagtggtctttctacagggctttgattgctgagttcattgctactcttttgtttctttatataactgtgttgactgttattgggtacaaaagtactactgatcctggtttgaccacagacccgtgtggtggtgttggtattcttggtattgcttgggcttttggtggtatgatctttgttcttgtttactgcactgctggtatctctggaggtcacattaacccagcagtgacattcggtctattcctagcacgtaaagtatcattgatccgagccattatgtacatggtggctcaatgtctaggagccatttgtggtgtgggcttagtcaaagctttcaacaaaagtctatacaacaggtacggcggaggagccaactctctagccgatggttacaacaaaggaaccgggctcggagctgagattatcggcactttcgtccttgtttacaccgtcttttcggccactgatcctaagagaagtgcccgtgactcccacgttccagttttggcacctcttcctatcgggttcgccgtgttcatggttcacttggccactattcctattaccggaaccggtattaacccagcccgaagttttggagccgctgttatctacaacaaggagaaaatctgggatgaccagtggatattctgggtgggaccctttattggagcagcaattgcagccttttatcaccaatttatattgagagcaggtgcaatcaaggctcttggatcattcagaagcagtacccctaattaatcacttcttttttatttctttttaaattattgtactcttta

SEQ ID NO: 15027 - DNA, 908 bp, Chrysanthemum coronarium
cgatctcacacacaaaaaaacattgttctaacgttgtcaaaatgactaaagatgtccctgagcaaggttcattctcagctaaggactaccatgaccctccaccagcacccttgattgaccctggggagttggcaaagtggtctttctacagggctttgattgctgagttcattgctactcttttgtttctttacataactgtcttgactgttattgggtacaaaagtactactgatcctgccttgaacgctgaccagtgtggtggtgttggtattcttggtattgcttgggcttttggtggtatgatctttgttcttgtttactgcactgctggtatctctggaggtcacattaacccagcagtgacattcggtctattcctagcacgtaaagtatcattgatccgagccattatgtacatggtggctcaatgtctaggagccatttgtggtgtgggcttagtcaaggctttcaacaaaagtctatacaacaggtatggcggaggagccaactctctagccgatggttacaacaaaggaaccgggctcggagctgagattatcggcactttcgtccttgtttacaccgtcttttcggccactgatcctaagagaagcgcccgtgactcccatgttcctgtcttggcacctcttcctatcggattcgccgtgttcatggttcacttggccactattcccattaccggtaccggtattaacccagctcgaagtcttggagctgctgtgatctacaacaatgaaaaaatttgggatgaccagtggatattctgggtgggaccttttattggagcagcaattgcagccttttatcaccaatttatattgagagcaggtgcaatcaaggctcttggatctttcagaagcagtacccaagtttaataaatcaca

SEQ ID NO: 15028 - DNA, 974 bp, Panax ginseng
ctgtctgaacactctagctccttttattctctctatttatatatacatatttttgtataaattagttaattttaaaatatgacaaaaggcgtagaggtggcggagcacggatcattctccggcaaggactaccacgagccgccgccggtggcgctgatagacccggatgagcttacaaagtggtcattctacagggctctcattgctgagttcattgccacccttctgttcctttacattacggtattgacggtgattggttacaagagccagactgatcacaccaaggttggggtggaccaatgcgggggtgtgggaattctgggtattgcttgggcatttggtggcatgatctttgttcttgtttactgcactgccggtatctctgggggtcacattaacccagcggtgacatttggtctttttctggcccggaaggtgtcactaattagggctgtgatgtacatggtggctcagtgcttgggtgccatatgtggggttgggcttgttaaggccttccagcagccctactacaagaggtacggcggtggggccaatgagctggccgacggctacagcaaaggcactggattggccgccgagatcatcggaactttcgtccttgtttacactgtcttctccgccactgatcccaagaggaacgccagggattcccatgtacccgtgttggctcctcttccaattggatttgccgtgtttatggttcacctggccaccattccaatcaccggaactggaattaaccccgcaaggagtctcggagctgcagtgatttacaaccaggacaaggcttgggatgaccattggctattctgggttggacccttcattggtgcagctattgcagccttttatcaccagttcattttgagagcgggtgccgttaaagcccttggctcattcaggagtaatgcttgatccttttgaggagttgtttgtcaatttagctagca

SEQ ID NO: 15029 - DNA, 1045 bp, Panax ginseng
tctctctccctctgtctgaacactctagctccttttattctctctatttatatatacatatttttgtataaattagttaattttaaaatatgacaaaaggcgtagaggtggcggagcacggatcattctccggcaaggactaccacgagccgccgccggtggcgctgatagacccggatgagcttacaaagtggtcattctacagggctctcattgctgagttcattgccacccttctgttcctttacattacggtattgacggtgattggttacaagagccagactgatcacaccaaggttggggtggaccaatgcgggggtgtgggaattctgggtattgcttgggcatttggtggcatgatctttgttcttgtttactgcactgccggtatctctgggggtcacattaacccagcggtgacatttggtctttttctggcccggaaggtgtcactaattagggctgtgatgtacatggtggctcagtgcttgggtgccatatgtggggttgggcttgttaaggccttccagcagccctactacaagaggtacggcggtggggccaatgagctggccgacggctacagcaaaggcactggattggccgccgagatcatcggaactttcgtccttgtttacactgtcttctccgccactgatcccaagaggaacgccagggattcccatgtacccgtgttggctcctctcccaattggatttgccgtgtttatggttcacctggccaccattccaatcaccggaactggaattaaccctgcaaggagtctcggagctgcagtgatttacaaccaggacaaggcttgggatgaccattggctattctgggttggacccttcattggtgcagctattgcagcgttttatcaccagttcattttgagagcgggtgccgttaaagcccttggctcattcaggagtaatgcttgatccttttgaggtgttgtttgtcaatttagcaacaaaaatcatttagaagaataatgaaagtaatgtttgtgtatcaagtttctttgactcactgt

SEQ ID NO: 15030 - DNA, 1246 bp, Panax ginseng
acccttctctctccctctgtctgaacactctagctccttttattctctctatttatatatacatatttttgtataaattagttaattttaaaatatgacaaaaggcgtagaggtggcggagcacggatcattctccggcaaggactaccacgagccgccgccggtggcgctgatagacccggatgagctaacaaagtggtcattctacagggctctcattgctgagttcattgccacccttctgttcctttacattacggtattgacggtgattggttacaagagccagactgatcacaccaaggttggggtggaccaatgcgggggtgtgggaattctgggtattgcttgggcatttggtggcatgatctttgttcttgtttactgcactgccggtatctctgggggtcacattaacccagcggtgacatttggtctttttctggcccggaaggtgtcactaattagggctgttatgtacatggtggctcagtgcttgggggccatatgtggggttgggcttgttaaggccttccagcagccctactacaagaggtacggcggtggggccaatgagctggccgacggctacagcaaaggcactggattggccgccgagatcatcggaactttcgtccttgtttacactgtcttctccgccactgatccgaagaggaacgccagggattcccatgtacccgtgttggctcctcttccaattggatttgccgtgtttatggttcacctggccaccattccaatcaccggaactggaattaaccccgcaaggagtctcggagctgcagtgatttacaaccaggacaaggcttgggatgaccattggctattctgggttggacccttcattggtgcagctattgcagccttttatcaccagttcattttgagagcgggtgccgttaaagcccttggctcattcaggagtaatgcttgatccttttgaggagttgtttgtcaatttagctagcaacaaaatcatttagaagaataatgaaagtaatgtttgtgtatgaagttcttttactcgctgtctcaattgctcttcacgaggttggagggggatgggaatttaagtgagaaccaaatgaaaatgtagatatgtgtcaatgtatttagaaaggggaagcttttttgtatgccctttatccttggcacttggaatttgaatctacttgttgttctattattattattattattattattattattattattattatta

SEQ ID NO: 15031 - DNA, 972 bp, Plantago ovata
atacaacattgtttagatctctcggacgctttactacacatactactactacactccagcttgctctgcattttctctacgtcactttttccgaaaatggtgaaggaagaaggatcctatggagccaaggactaccatgacccaccaccggctccgcttttcgacatggaggagctttccaagtggtcgttctacagggccttgattgccgaattcatcgccaccttgttgttcctgtacgtcactgtcttaaccgtgatcggacacagcagccagtcggctggcgaccactgtggtggcgttggaattctaggcattgcatgggcttttggtggcatgattttcgtccttgtctactgcactgctggaatttctggaggacatattaacccggcagtgacgttcgggcttttcctggcccgtaaagtgtcgcttattcgggctgtgatgtacatggtggcccagtgtctaggggccatttgtggagtcgggctggtgaaggcgttccagacttcactgtataccaggtacggtggcggtgccaactccctcaacgccgggtacagcacaggaactggcttggccgctgagatcatcggcaccttcgtgctcgtgtacacagttttctccgccaccgacccaaagaggagtgcaagagactcccatgttcctgtattggcgcctctcccaattggattcgcagtgttcatggttcacctagcgaccatccccattaccggaactggcatcaatccagctaggagtcttggagctgcagttatctacaacaaagacaagccatggagtgatcattggatcttctgggtcggacccttcattggtgcagccatcgcagcgttctaccaccagttcatcttgcgggctggagctgtgaaagccctcggttcgttcagaagcggttctcaaatttgattggtgtaacttgtaaccttatctgtatcatgattgtaa

SEQ ID NO: 15032 - DNA, 1172 bp, Gossypium hirsutum
tcaccacaatattcttcacctatctctttcacaaaggagagcacagaaaaaaggggttcttgttcttgttcaagttattgatcaatggctaatgatgttgaggttggtagtgagttccaagccaaggactaccatgatcctccaccagctccattggtagatgcccaagagttaactcagtggtctttttatagggctataatagctgagttcattgccacccttttgtttttatacatcactgtgttaacagtgatcggatacaagagccaagttgatccagataagggtggtcaagattgtgatggtgttggcattcttggtattgcttgggcctttggtggcatgattttcatccttgtttactgcactgctggtatctcagggggacatatcaacccagcagtgacctttgggcttttcttggctcgtaaggtatcattggttcgagccatactttatatggctgctcaatgtttaggagccatttgtgggtgtgggttagtcaaggcattccaaaagagttattacaacaagtatggtggaggagctaatagcttggctgatggatacagcactggcactggtttggctgctgaaattattggcacatttgtgcttgtttacactgtattctctgcaactgatcccaaaagaaacgcaagagattctcatgttcctgtgttggcaccacttcccattgggtttgctgtgtttatggttcatttggcaactattccgatcaccggaaccggaatcaaccctgctcgtagtttcggagctgttgttatgttcaaccaggacaagccatgggatgatcattggatattctgggttggaccattcattggagctgccattgctgcaatttatcaccagtatatcctcagagcaggagctgctaaagctcttggatccttcagaagcagctcagccatgtaaaacaaaggggttgccattgaagaatggatcaagttttatctatgattgtgaagagaatttttcagagcattgaatttggcacttcactttttaaagtgctccaagcgttgtcagcatccctgcttacctttcaattttctttctgtttttaccttttttggctttgtcttggtatctgtatgtcgttgaaaattttatagaatctatcttttacattatttaaatgagtt

SEQ ID NO: 15033 - DNA, 1161 bp, Panax ginseng
gagtgagttctcagccaaggactaccatgatccgccaccggcagcctttatcggcaccgatgagctaaccaaatggtcactttacagggctgtcattgctgagttcatagccaccctcctcttcctttatatcactgtcttgacggtcatcggctacaagagccagtcagccaccgatgagtgtggcggcgttggcctcctcggcatcgcctgggcctttggtggcatgatcttcgtccttgtttactgcaccgccggtatctctggaggacacattaaccctgcggtgacgttcgggttgttcttggcaaggaaagtgtcgctaataagggcggtgttttacatggttgcacagtgtttgggtgcaatctgtggagtagggttggtgaaggccttccaaaagtcattatataacaggcatggtggtggagccaacgagctggctgatggttacaacaaaggcactggattgggagctgagatcattggcacttttgttcttgtctatacagttttctcagccactgatcctaagaggaatgctagagactcccatgtccctgttttggctccacttcccatcgggttcgcggtgttcatggttcacctagccacaatcccaattactggaaccggtatcaaccctgctaggagctttggagctgcagtcatctacggcaaacagaaggcctgggatgaccaatggatcttctgggttggacctttcattggtgctgccattgctgcattctaccaccagtatattctgagagcagcagcaattaaggctcttggatccttcaggagcaatgcttaattaattatgtttcaacaattacaatggaggacgtacatgcttaatactactgcagcaagcttaattgctctgtcgtcgtctatgaattaattaaggaggatatctatatgttaaaatatggagatcagacaggcaattaaggacggacataaatggagttaattgtagatataataataatcaagatttgttgtaatttctatctgtgttgtatttactttctctcccaactgttgatcatcttaatttcattttttaaaattatctccttttcttttttaattaaatattactcaatgtactcagagatcgatgtttgttcataataaatcaaggaaatggtt

SEQ ID NO: 15034 - DNA, 988 bp, Arnica chamissonis
tagctagggtttaatcatctaccacaataatgacgaaagacgttgaagtggcggagcaccacaccggaaaagactaccacgatccacctccggcaccgttgatcgacggggaagagctgaccaaatggtctttctacagagctctcatcgccgaattcgttgccaccctcctcttcctttacgttaccgtgttgacggttatcggctacaagagccagactgaccctaagttggacctcgatcagtgcggcggcgttggcatcctcggcatcgcctgggccttcggtggcatgattttcatcctcgtttactgcaccgccggtatctctggaggacacattaacccggctgtgacattcgggctatttttggcaagaaaggtgtcactgattagggcattaggctacatgatagcacagtgtttgggtgcgatatgtggtgtgggtttggtaaaagccttccaaagttcctactacaataggtacggtggtggggccaacgagttggccccgggctacaacaaaggtacaggactaggtgccgaaatcatcggcacctttgttctcgtgtacactgtcttttcggctactgatccgaagagaagtgctcgtgactctcatgttcctgtgttggcaccactgcccatagggtttgcagtgttcatggtacacttggccaccattccgatcaccggcaccggaatcaacccagccagaagctttggcgccgccgtgatttacaacaacgacaaggcctgggatgaccaatggattttctgggttgggccgtttttgggcgcagcgatagcagcgttctaccaccagtttgtactgcgagcaggggccattaaagcactcggttctttcagaagcaatgcataattggaagatgatccatgcaaaaagaataaaattggaccgacgacgatacaaaattaagtgatcagtcgttaaaatggggtagatcgataaatgtttttaattaattt

SEQ ID NO: 15035 - DNA, 1260 bp, Fagus grandifolia
ctggaccttggctgtcactcagttaaacaacaacaacactagaactctctcttactcatctctaagcttgctcactttctctctgtcactcaccctagctagctaccaagactgcaagagtattatctgctatggccaaggacattgatgtcggagggcaacctggtgggttctcagccaaggactaccatgatccaccaccagcaccgttgattgatgctgaggagtttgtccagtggtccttttacagggctatcattgctgagttcattgccacgctcctgttcttgtacattactgtgttgactgtaattggatacaagagccaggttgacccaacaaagcctaatgttgatgaatgtggtggtgttggaattcttggcatagcttgggcctttggtggcatgatctttgtccttgtttactgcacagctggtatctcaggtgggcacattaaccctgcggtgacattcgggctgttcctggctaggaaggtctcgttggtccgagccatattgtacatggtagctcagtgtttgggagcaatatgcggatgtgcgcttgtgaaggcattccagaaatcttactacagtaggtacggtggtggagccaacgagctcgctcttggatacagcaagggaactggattggccgctgagatcattggtacctttgtgcttgtttacactgtcttctctgccactgatcccaagagaaatgcaagggattcacatgttcccgtcttggcaccacttccaattgggtttgctgtcttcatggttcacctggccaccattccaatcactggcactggtattaaccccgctagaagttttggggctgcagtgatctacaacgagaagaaagcatgggatgaccaatggcttttctgggtcggaccattcattggtgctgctattgctgcaatatatcaccagttcattttgagagcaggcgctattaaagctctagggtccttcaggagctcttccaacgtataaactaccaaaaactaaaagggtttctggtaatcaggttggttcaaagaggaatggcattttctatgggtcaaggagggtttcgaaccgtggaatttgtacattgttatgtctaaggcaaagatgtcttttgtattacttctgtttcctgggcactcattttaaatgtgtccaaaatgttggtgtctatcctttccgtttgctctttgtgtactcatgatgttatgttgaatttatcatcaagtgctttttgttactttct

SEQ ID NO: 15036 - DNA, 1084 bp, Chrysanthemum coronarium
attcctcactggcaccataaataccaacctttcaacaccacacacttcacaccaaaacacactaacttcttctatccatctctattctttgaacatcatcatcatatcagccatgacaaaagacgttgaagtagctgagcaccatggtggaaaagactacgttgaaccaccaccagcacccttgttcgatgctgatgagctaaccaaatggtctttttaccgagctcttatagccgagtttgttgctacacttctgtttctttacgtgacggttttgaccgttatcgggtacaagagctctactgatcctttgttggatcttgatcagtgtggtggtgttgggattcttggtattgcatgggcttttggtggcatgatctttgttcttgtttattgcactgctggtatctctggaggacacattaaccctgctgtgacatttgggttatttttggcaaggaaggtttcattaattagagcagtgatgtacatggtagcacaatgtttgggtgcaatctgtggtgttggtttagtcaaagctttccaaagttcctactacaataggtatggtggtggggccaacactttggccgatggttacaacaagggcactggactaggtgccgaaattatcggcacctttgtccttgtctacaccgtcttctctgctactgaccctaagagaagtgcgcgagactctcatgttcctgttttggcaccattgcccatagggtttgcagtcttcatggtacacttagccaccattcccatcactggtaccggaatcaaccccgctagaagctttggcgcagccgtgatttacaacaatgaaaaggcttgggatgaccaatggattttctgggtcggaccatttttgggtgctgcagccgcagcattctaccatcagtttgtacttagagccggagccattaaagcacttggttctttcagaagcaatgcatgaatcgaaagatggtgagagtatgtatatccatatgcaaaaataataaacgaacgaagcgataaaagtttcatctagagtccaagtcgaggcgttaaaatggatggatatacgagtgtggaa

SEQ ID NO: 15037 - DNA, 1174 bp, Chrysanthemum coronarium
accattagtctttcaacaataagatctaagctcccacacattaattagaaacacacttacacacacataatgactaaagacatgccagaacaagcttcattgacagcaaaagactaccacgacccaccacctgcaaagttttttgacagcaaagagctgacaaaatggtcattttatagagctttgatagctgagttcatagctaccctgttgtttctttatataactgttttgacagttattggttacaagagtcagattgctcatggaaatgatgcttgtggtggtgttggtgttttgggtattgcttgggcttttggtggcatgatttttgttcttgtttattgcactgctggtatctctggtggccacattaacccagcagtgacgtttggtctatttcttgctcgaaaagtgtcattgccccgagccatcatgtacatggtggctcagtgccttggagccatttgtggtgttggcttagtcaagtctttccataagacttactataacacctttggtggtggtgccaacgagctagcggatggctacaacaaaggcaccgggttgggtgctgagattattggcacctttgttcttgtctacactgtgttctcggctactgatcccaagaggaacgctagagactcccatgttcccgtgttggcaccactaccaatcgggtttgcagttttcatggttcacctagccacgatccccatcactggaaccggaatcaatccagctaggagttttggagcagcagtgatttacaacagggagaaggcttgggatgatcaatggatattttgggtcggaccctttattggagctgcaatcgcagccttctaccaccaattcatcttgagagccggtgccgttaaagcccttggatctttcagaagcactacccatgtttgagatctcgatcgacctgaaggagaaggcatgctgtttcatttttcacgaaaaaataaataaaatcgtttgtatgtatgaaagtttgtggatttaggtgttagaatctcatgtctagcttgtttaagattcatttggaaacaccattgaaatgcaatgtaaattgttttgagaggtgcttacccttcatctaaagcattgtatcatttaattccaataattacgacgagtggtgtggtcggcgtctctcaaggca

SEQ ID NO: 15038 - DNA, 1420 bp, Citrus clementina
ctctttcttaatcattcagcacttaataaataggccactctctacatccttccccattcacccatcattaaactctgtagcaaacacaacagtcgtagctcttgtttctccctctcgtttaattaacaaaacaaaaataaaagggaaaaaatggggaaggatgttgaagttgctgagcagcaaggcggcggcggcgagttctcagccaaggactaccacgacccccctccggcgccgctgatcgatttcgaggagctgggcaagtggtctttttacagagctgtaattgctgagttcatcgctacgcttttgtttctttatgttaccgtcttgactgtgattggatacaagagccagactgatcccaacttgaataccgatcagtgtggtggcgttggcattcttggcatcgcttgggcctttggtggcatgatcttcattctcgtttactgcacagccggtatttctggtggacatatcaacccggctgtgacattcggactgttcttggggcgcaaggtgtcgctcatccgagctcttttgtacatggtagcacagtgcttgggtgcaatctgtggttgtgggtttgtgaaggctttccaaaaatcatactacaacaggtatggaggtggggccaatgagctagctgatggatacaacaagggcaccggactgggtgctgagatcatcggtactttcgttcttgtctacactgttttctctgccactgatcctaagaggagcgcaagagactcccatgttccggtcttggcaccactccccattgggtttgctgtgttcatggttcacttggccaccatccccatcaccggaaccggcatcaacccagctaggagttttggagctgctgtgatctacaacaaggagaaagcctgggatgaccaatggatcttctgggttggaccattcattggagctttcgttgctgcattctaccaccaatacattctcagggcagcagccattaaggctcttggatccttcaggagcaatgcttaagctttaaatatgatgtctggtgcttccaaggtgaaaaatttacagcatgatcaggagtgcaagtctgttacgaaggccctttaagaaatctcttttcaagctctttagagggccattgaatttgagctgaattagagggctattgaattgtagatatttgaacattatgcattttatgcctatgctttatctatgtgtaagggtggattttggtatcccattttaatttttttctttgggtgtgtttataagtggtggtggtgttttttatatatcctatttctctatatttttcttatcctttcctttttctttatttcaagtggtgtatttatgttgttaatgttaattaatccccaactctagtgaataaaactatgacctttttgtagttgcttta

SEQ ID NO: 15039 - DNA, 1088 bp, Flaveria ramosissima
cggccccggaggcgaatactcgggtaaggactaccaagacccgcctccagctccgttgtttgaccccgaagaactcaccaaatggtcattctatcgcgcactaatagccgagtttgttgccactctcctcttcctttatgtaactgtcttaaccgtcatcggttacaaaagccagaccgatcctaatcttaataccgaccagtgcggtggcgtgggcatcctcgggatcgcgtgggccttcgggggcatgatcttcatccttgtgtactgcactgccggtatatccggaggacacattaaccccgcggtgacgttcgggctgtttttggctagaaaggtgtcgttgattagggcgttgggttacatggttgcacagtgtttgggtgcgatttgtggcgtgggtctggtgaaggctttccagagctcgtactacaacaggtacggtggcggagctaatgagttagctgacgggtacaacaagggcacggggctcggtgctgagattatcggcacctttgtccttgtttacactgtcttttccgccaccgatcctaagaggagtgcacgagactcccatgttcctgtattggcaccactgcccataggatttgccgtgttcatggttcacttggccaccatcccgatcactggcactggcatcaaccctgcgagaagctttggcgccgcggtgatctacaacaaagagaaggcttgggatgatcaatggattttctgggtcggaccgttcattggagcctttgccgccgcggtctaccatcagttcattctcagagccgccgcgatcaaagccctcgggtcattcagaagcaatgcttaagcttgaaatatgttcatccatgttggttcttggcgtgtagatatctttggaaaatatttcgtttattgtaattgtattttcttttaagtttcgtttaatttgtaaaattcaagtgtgtggtttttttatatcttttttaagtttgattttgttgtctaatgatttcaagatcaaatggtgtgagatatggaatttaagagcatgtacatgttcgtaaaattcatgaaatatggttgttaatttattgagg

SEQ ID NO: 15040 - DNA, 1266 bp, Setaria italica
atccatttcttgcaagccaacctctgcacccggccggctagtcccgcagctgccaagctaagccaagaccaagccatgggcaaggacgacgtgatcgagagcggcgccggcggcggcgagttcgccgccaaggactacacggaccctcccccggcgccgctgatcgacgcggcagagctgggttcctggtcgctgtaccgcgccgtcatcgccgagttcatcgccacgctgctcttcctctacatcaccgtgctcaccgtcatcggttacaagcaccagacggacccgaacgtggccggcaccgacgcgtgcggcggcgtgggcatcctcggcatcgcgtgggccttcggcggcatgatcttcgtcctcgtctactgcaccgccggcatctcgggggggcacatcaacccagccgtcaccttcggcctcttcctggcgcgcaaggtgtccctggtgcgcgcgctgctctacatcgtggcgcagtgcctgggtgccatctgcggcgtcggcctcgtcaaggcgttccagagcgcctacttcgacaggtacggcggcggcgccaactccctcgcctccggatactcccgcggcaccggcctcggcgccgagatcatcggcaccttcgtcctcgtctacaccgtcttctccgccaccgaccccaagcgcaacgcccgcgactcccacgttccggtgctggctcccctcccaatcggcttcgctgtgttcatggtccacctggccaccatccccgtcactggcaccggcatcaacccggccaggagcctgggcgccgccgtcatctacaacaaggacaagccatgggatgaccactggatcttctgggtcggccccttcgccggcgcggccatcgcggcgttctaccaccagtacatcctccgggccggcgccatcaaggccctcggctccttcaggagcaacgcatgaaactagtcttcagaattaccgtgagagctgctcgcaaaggctgctacgtgtgcgtgttgaagcaatggcgatcgacgctttgtggggagaataagtctgcaatctgccatcatcatcatcagtgaagttcttgccgctggtcgttttgtttcagcagctgcgtgcgtgaatttggcttccttcctccttgtaatcaaccatgtgtcgtaatctgtcaagggattattccatctcccctcctagcatgtatctctatttaattattatgtagcgacgatcatcatcatcatcgtcatcagtgaaaccttgcttctgtctaaa

SEQ ID NO: 15041 - DNA, 1421 bp, Citrus sinensis
actctttcttaatcattcagcacttaataaataggccactctctacatccttccccattcacccatcattaaactctgtagcaaacacaacagtcgtagctcttgtttctccctctcgtttaattaacaaaacaaaaataaaagggaaaaaatggggaaggatgttgaagttgctgagcagcaaggcggcggcggcgagttctcagccaaggactaccacgacccccctccggcgccgctgatcgatttcgaggagctgggcaagtggtctttttacagagctgtaattgctgagttcatcgctacgcttttgtttctttatgttaccgtcttgactgtgattggatacaagagccagactgatcccaacttgaataccgatcagtgtggtggcgttggcattcttggcatcgcttgggcctttggtggcatgatcttcattctcgtttactgcacagccggtatttctggtggacatatcaacccggctgtgacattcggactgttcttggggcgcaaggtgtcgctcatccgagctcttttgtacatggtagcacagtgcttgggtgcaatctgtggttgtgggtttgtgaaggctttccaaaaatcatactacaacaggtatggaggtggggccaatgagctagctgatggatacaacaagggcaccggactgggtgctgagatcatcggtactttcgttcttgtctacactgttttctctgccactgatcctaagaggagcgcaagagactcccatgttccggtcttggcaccactccccattgggtttgctgtgttcatggttcacttggccaccatccccatcaccggaaccggcatcaacccagctaggagttttggagctgctgtgatctacaacaaggagaaagcctgggatgaccaatggatcttctgggttggaccattcattggagctttcgttgctgcattctaccaccaatacattctcagggcagcagccattaaggctcttggatccttcaggagcaatgcttaagctttaaatatgatgtctggtgcttccaaggtgaaaaatttacagcatgatcaggagtgcaagtctgttacgaaggccctttaagaaatctcttttcaagctctttagagggccattgaatttgagctgaattagagggctattgaattgtagatatttgaacattacgcattttatgcctatgctttatctatgtgtaagggtggattttggtatcccattttaatttttttctttgggtgtgtttataagtggtggtggtgttttttatatatcctatttctctatatttttcttatcctttcctttttctttatttcaagtggtgtatttatgttgttaatgttaattaatccccaactctagtgaataaaactatgacctttttgtagttgcttta

SEQ ID NO: 15042 - DNA, 951 bp, Parthenium argentatum
aaccaatcacaactgtttgatcatcatgaccaaagacgttgaagtggcggagcaccacggcggaaaagactaccatgacccacctccggcaccgttgatagacggtgaagagctcactaaatggtctttctatagagctcttattgctgaattcattgccacactactcttcctttatgtgactgttttgacagttattgggtacaagagccagactgaccctaacttgaacgctgaccagtgtggtggtgttggtatactgggtattgcatgggcttttggtggcatgatctttattcttgtttactgcaccgctggtatctctggaggacacattaacccggccgtgacattcgggctattcttggcaagaaaggtgtcattgatcagggcattagggtacatggtggcacaatgtttgggtgcaatatgtggtgtgggtttggtcaaagctttccaaagttcatactacaataggtatggtggtggggccaatgagttagccgatggctacaacaaaggaaccggactaggtgccgaaatcatcggcacctttgttcttgtgtacactgttttctcggctaccgatcctaagagaagcgctcgcgactctcacgtccctgtgttggcaccactgcccatagggtttgcagtcttcatggtacatctggcaactataccaattactggtaccggaatcaatcccgccagaagctttggcgccgcagttatttacaacaacgaaaaggcctgggatgatcaatggattttctgggttggaccattcgtaggcgcagcggcagcagcattttaccaccagtttgtactgagagccgcggctattaaggcacttggttctttcaaaagcaatgcatgatcgagagatgataaatttatccaataaacttgatcagtcgttacaatggatggatatatgagtgtggatgatca

SEQ ID NO: 15043 - DNA, 1069 bp, Thalictrum flavum
acataaaacagttttaagaaatgggcaaagatattgaagtttctgaacctggtgagttctctgccaaggattaccatgatccaccacctgcacctttgtttgatgccaaggaacttgctagttggtctttttatagagctatcatagcagaatttgttgctactcttctctttctctatattactgtcttgactgttattggttacaagactcaaagtgctaaagaccaatgtgatggtgttggtattcttggtattgcttgggcttttggtggtatgatctttgttcttgtttactgcaccgctggtatctcaggaggacacattaacccagctgtgacattcggcttatttttggcacgaaaggtgtctttgattcgagctgttgcatacatggttgctcaatgtttaggagccatttgtggtgtgggatttgttaaggccttccaaaagacttactatcacgtccagggtggtggtgcaaatcaactagctgcaggttacaacaagggaactggattagctgctgagattattggaacttttgttcttgtatacacagtcttctctgcaactgacccaaagagaagtgcaagagattctcatgtccctgtcttggcaccacttcccattggatttgctgtgttcatggttcatttggccacaatcccaatcactggcactggtattaacccagctagaagttttggagctgctgtaatctacaacgaggaaaaggcatgggacgatcagtggatattctgggtcggaccattcattggtgctgccattgccgcgttttaccatcagttcattcttagagcggctgccattaaggccctcgggtccttcaggagcaatgctcacaactaaatttctaggtgtccgcactgaggatatgaagtttccaatcaataagtatggatgagtgcaagtctgtgtgtgaaggatcctctcagccatttgtttctcctagtgtgtgttacattagtgagaagcatagggttgaagaaactattgaaatgtagatatttcactttttgagggaaggacgtttttattatcccttt

SEQ ID NO: 15044 - DNA, 911 bp, Ambrosia trifida
ctcttctaagttctaaaaacttgtacctaataatattattattagtttctagcaaatatgacgaaagacgtgccagaacaaggctctttctctgccaaggactaccacgacccaccaccagccccgtttatcgacccggctgagctaaccaaatggtcgttctaccgcgccttaatcgctgaatttattgctacacttttgtttctttatattactgtcttgactgttattggttacaagagcaccactgacccagccttgaagcttgaccagtgtggcggtgttggtatcctcggtatcgcgtgggcatttggggcatgatctttgttcttgtttactgcaccgccggtatctctggtggtcacattaacccagcggtgacatttggtctattcctagctcgtaaagtgtcgttgctccgagccgttatgtacatggtggctcagtgtctaggagccatatgtggtgtgggcttggtcaaggctttcaacaaaagcctttacaacaggtatggtggaggtgccaacgagctggcggacggctacaacacgggcactggactaggtgctgaaatcattggaacatttgttctggtttacaccgtcttctctgccaccgaccccaagaggagtgcccgagactcccatgttccggttttggcgccactaccaatagggtttgctgttttcatggtgcaccttgccacgattcctattactggaaccggtatcaacccggctaggagtcttggagccgcagttatttacaacaaggataaggcatgggatgatcagtggatattctgggtgggacctttcgttggagcagccattgcagctttctaccaccaatttatattgagagcaggtgcagtcaaagctcttggatcattcagaagcagcactcatgtt

SEQ ID NO: 15045 - DNA, 1296 bp, Rosmarinus officinalis
cggccgggggacttcaccaggaattagctactccgttctcatcatagccctttaggccttagctctctctttctttttccatttccgggcttctcttgcctgcgccagatattcttgtttgagtccacatttttgtgtttgtgtttttaagtgtggtaaatggccaaagacgtgggagcggccgatcacggttctttcactgccaaggactaccatgatccaccaccggcaccgctgattgatcctgaagaattgaccaaatggtcattctacagagctctgattgccgaattcatagcaacccttcttttcctttacattacagtcctcactgttataggctacaagagccagactgatcctcacctgaacactgacccctgcaatggtgtgggagttcttggtattgcatgggctttcggtggcatgatctttgttcttgtctactgcactgctggaatttctggtgggcacatcaatccagcagtgacctttgggctatttttggctcgcaaggtttcgctgattagagctgtgatgtacatggtggctcagtgtctgggagctatatgcggcgtggggctggtgaaggccttccagaatgcttactttcacagatacggcggtggcgcaaatgagctccaagatggctacagcaccggagttggtttggccgcggagatcatcggaacatttgttcttgtctacactgtcttctctgccactgatcccaagaggagtgccagagattctcatgtccctgttttggcaccccttccaattggatttgcagttttcatggtccatttggccacaatcccagtcactggcacaggtattaaccctgctagaagtcttggatctgctgttatctacaaccggagcaaggcttgggatgaccattggattttctgggttggaccattcattggggcagccattgcagccttctatcaccagttcatcttgagagcaggggctgttaaggcacttggttcattcaggagcagctcacatgtttgatgaaatgtcttcctcttcatcttcatctatggttcttagcagatccaaatttcggtcttgagaggggaaaagttgatattttgaattgaagttgagagataagagagagaataatattgttagtgtaatttgtgtttggagaagtctttttgagtgctaaattttctcaataattatgtctctacagaagattatgctttgatgggaattgcaaggtactcaattagagccacacaaagtgtagataaagggtctttgttccaaagggaaagg

SEQ ID NO: 15046 - DNA, 1322 bp, Amsonia hubrichtii
gaaccagatattaacatatcttgtttgtagacacatttttgtgtttgtgtttttgttgagagaggtaaatggcaaaggacatagctgagcatggttcttttacaaccaaggactaccatgatccaccaccagcacctctcattgatcctgcagaattgaccaaatggtcattctacagagctctcattgctgaattcatagcaacccttcttttcctttacatcacagtcctcactgttattggctacaatagacagactaaagctgaccaatgcgatggtgtgggagttcttggtattgcatgggcctttggtggcatgatctttgttcttgtctactgcactgctggaatttctggtggacacattaacccagcagtgacctttggcctatttttggcacgcaaggtttcactgattcgagctgtgatgtacatggtggctcagagtctaggagccatatgtggtgtgggactcgtcaaggctttccagaaggcttactttgatagatacggcggtggcgcaaatgaactcaaggagggttacagtattggagttggtttggccgccgagatcatcggaacatttgttcttgtctacactgtcttctctgctactgatcccaagaggagtgccagagattcccatgtccctgttttggcacccctgccaattggatttgcagttttcatggtccatttggccacaattccagtcactggcactggcattaaccctgctagaagtcttggatctgctgtcatctacaaccacaagaaagcttgggatgaccattggattttctgggttggaccattcataggtgcagctattgcagccttctaccaccagtttatcttgagagcaggagctgttaaggcacttagttcattcaggagcggctcacatgtttgatgaaaaaatgtctctctcttcctacttcatcttctatggttttttagcagatcaaaattgagtcttcagagaggaaaagatgatatttcaaataaagcgatagagtggaataatattattagtatttgtgtttggagaaatctttttgagtggctcattttctcatttattttgtctaaagaagattttgggtgatgggaatgcaatgtactcaatcagagccacacaagtgtagataaagggtcttcatttcaaaagggatgagctttttgtatccctcttgtcctttagctagactttggttcttacatatttatgtgaatttcgtccttttttctgtcttttcaatctacttgtgatgtacatttacttctgttttcacaatgcattctcatttctagaaaaaaa

SEQ ID NO: 15047 - DNA, 989 bp, Chrysanthemum coronarium
accatttatctttaacctaaacacacacataaacaaaaacctagttaaaacattgttcaagatgacaaaggatgtccctgagcaaggttcattctcagcaaaggactaccatgaccctccaccagcacctttgattgaccctgcagagctcacaaagtggtcattctacagggctttgattgctgagtttattgctactcttttgtttctgtacataactgttttgactgttattgggtacaaaagtactactgatcctcatctgaagaacgtagacccgtgtggtggtgttggtattcttggtattgcttgggcttttggtggtatgatctttgttcttgtttactgcactgctggtatctctggaggtcacattaacccagcagtgacattcggtctattcctagcacgtaaagtatcattgatccgagccattatgtacatggtggctcaatgtctaggagccatttgtggtgtgggcttagtcaaggctttcaacaaaagtctatacaacaggtatggcggaggagccaactctctagccgatggttacaacaaaggaaccgggctcggagctgagattatcggcactttcgtccttgtctacaccgtcttttcggccactgatcctaagagaagtgcccgtgactcccacgttccagttttggcacctcttcctatcgggttcgccgtgttcatggttcacttggccactattcctattaccggaaccggtattaacccagcccgaagttttggagccgctgttatctacaacaaggagaaaatttgggatgaccagtggatattctgggtgggaccctttattggagcagcaattgcagccttttatcaccaatttatattgagagcaggtgcaatcaaggctcttggatcattcagaagcagtacccctaattaatcacttcttttttacgtagtatttctttttaaattattgtactctttatttttaagatcccaaaatt

SEQ ID NO: 15048 - DNA, 1273 bp, Trifolium pratense
acacttccccatcaacaaattttcttcctttctctgttctttgtcttctcaaacaacttccattcttgtttgagtgtgttgtttcaaaagggtaatccaaatggcaaaggacgttgaagttactgaacgtggctctttctctaacaaagactaccatgaccctccaccagcaccactctttgatgctgaagaactcacaaaatggtccttttacagagcacttattgctgagttcattgcaactttacttttcctttatgttactgttttaactgttattggttacagtattcaaactgatgttaaagctggtggtgatgtttgtggtggtgttggtattcttggtattgcttgggcttttggtggcatgatctttgtccttgtttactgcactgctggaatctcagggggtcacattaacccagcagtgacatttgggctatttttggctcgtaaggtgtctttgatcagagcaattatgtacatggtagctcaatgtttaggggctattgctggtgttgggttggttaaggcttttcaaaagtcttactttgttagatatggtggtggtgctaattttcttcatgatggttacagtactggtgttggattaggtgctgagatcattggtacctttgttttggtatacactgttttctctgctactgatcctaaaagaagtgctagagattcccatgttccggttttggcaccacttcctattggatttgctgtattcatggttcatttggcaaccatccctgttactggaactggcattaatcctgctagaagtcttggttctgctgttatctacaacaaagataagccctgggatgaccattggatcttttgggttggaccatttattggggcagccattgctgcattctaccatcaattcatcttaagagcaggtgcaattaaagctctaggatcattcagaagtaaccctactgtttaagtgctatgtttatgttcttcctcttcatcatggttttaatggaaaagaagataattgaaggaaaaaatggattaattgatatttgcaccccccaccccctctcaaattgtatcttcaagattgtggataagtgtagattaaagtctctttctttacaggggagcctttttagtttttacactttcctctgtattctctacctttagtgtgtcatcttttttctttaagttattctcttatgttatcctttgtactcatcactaaatatttatggtaaaatattctaagtttaaattatcttctcttctc

SEQ ID NO: 15049 - DNA, 1132 bp, Trifolium pratense
acacttccccatcaacaaattttcttcctttctctgttctttgtcttctcaaacaacttccattcttgtttgagtgtgttgtttcaaaagggtaatccaaatggcaaaggacgttgaagttactgaacgtggctctttctctaacaaagactaccatgaccctccaccagcaccactctttgatgctgaagaactcacaaaatggtccttttacagagcacttattgctgagttcattgcaactttacttttcctttatgttactgttttaactgttattggttacagtattcaaactgatgttaaagctggtggtgatgtttgtggtggtgttggtattcttggtattgcttgggcatttggtggcatgatctttgtccttgtttactgcactgctggaatctcagggggtcacattaacccagcagtgacatttgggctatttttggctcgtaaggtgtctttgatcagagcaattatgtacatggtagctcaatgtttaggggctattgctggtgttgggttggttaaggcttttcaaaagtcttactttgttagatatggtggtggtgctaattttcttcatgatggttacagtactggtgttggattaggtgctgagatcattggtacctttgttttggtatacactgttttctctgctactgatcctaaaagaagtgctagagattcccatgttccggttttggcaccacttcctattggatttgctgtattcatggttcatttggcaaccatccctgttactggaactggcattaatcctgctagaagtcttggttctgctgttatctacaacaaagataagccctgggatgaccattggatcttttgggttggaccatttattggggcagccattgctgcattctaccatcaattcatcttaagagcaggtgcaattaaagctctaggatcattcagaagtaaccctactgtttaagtgctatgtgtatgttcttcctcttcatcatggttttaatggaaaagaagataattgaagaaaatgtattaattgatatttgcacccccctccttcctctcaattgtatcttcaagattgtggataagtgtagattaaagtctctttctttacaggggagccttttta

SEQ ID NO: 15050 - DNA, 1259 bp, Euphorbia peplus
agccaaaaattcttgggtcattggaggctttttcattacaatttctagtttatctctctctgaaactaccatctctccttctctctctaagcaatttcctgaaacacccttatggcgaaggacacggaggtcacggagagagcctccttctcagcaaaggactatcaggaccctcctccagcaccattgtttgatgctggggagctgggtaaatggtcattttacagagccataatagctgaattcatagctacccttttgttcctttacatcactgtgttgactgtcattggctacaaaagccagactgatcctgacttgggtcttgaccagtgtggtggtgttgggattcttggtattgcttggtcttttggtggtatgatcttcattcttgtttactgcaccgctggtatctcaggaggacacataaacccagcagtgacatttggactgttgctagcaagaaaagtatcactggtacgagccgtgatgtacatggtggctcagtgcttaggagccatagctggagttggtctagttaaggcgtttcagagctcgtactacaccagatatggtggtggggccaacactctcgctgatggttacagcaaaggcgttggattaagtgctgagattatcggtacctttgttttggtctatactgtattctcagccactgatcctaagaggagtgcacgcgattctcatgttcctgtattggctccactcccaattggatttgctgtgttcatggttcatttggctactattccaattactggcactggaatcaacccagctaggagtcttggagctgctgttatttataacaaggaaaaggcctgggatgatcaatggatgttttgggtaggaccattcattggagcagcaatagcatcattctatcaccagttcatattgagagcaggagcagcaaaggcacttggatcattcaggagcacccctactgtctaattttctgaatatgagcctttttttaatgaggggttgaggaaatgtagatgaaaaaagggggattttttcttctatttatttgtcattttcttgaagcacttaagttaaaaatgtcatgattcctactttgatctttctcttttctcctttgcaacttaccattattgtcattgttattatttaggtagggtatgtactttggtaaattctgtttcttatgtgataattttaggtatgttgtcttcttcttgctcatttattagaattattatgttttctaaaaa

SEQ ID NO: 15051 - DNA, 1043 bp, Fraxinus spp
gatgacgaaggacgctggggtggcggagcacgggtcattcacggccaaggactatcatgatccaccgccggcgccgctcatcgacgcgaaggagctgacaaagtggtcgttttacagagctttaatagctgagttcgtagccaccttgctatttctttacattacagttttaactgtgattgggtacaagagccagattgatactgacttgaacggcgaccagtgtggtggggtgggaattcttggtattgcatgggcctttggtggcatgatcttcattcttgtctactgcactgctggaatttctggggggcacataaacccagcagtgacctttggcctgttcttggcccggaaagtgtctttgatccgggcagtgatgtacatggtggcacagtgtttgggagccatctgcggcgttggtttggttaaggcatttcagaaatcatactacaagaagtatggaggtggtgccaacgagctggccgatgggatcagcaccggcgtcgggttagctgccgaaatcatcggaacattcgtccttgtttacactgttttctccgccactgatccaaagcgtagtgccagagattctcacgtccctgtattggcacctcttccaattggatttgcagtgttcatggttcatctggccacaattccaatcaccggaacgggcatcaacccagctaggagtcttggagccgcagtaatctacgatcaggacaaggcttgggacgatcattggatattttgggtggggccatttattggtgcagctgttgcagcattctaccaccagtttatattgagagctggagcagtaaaagctcttggttcattcaggagtaatgcttctcatcattgaaattaagaattttccttcataattttcaagttttctcttcaaagatctttagcgattggagagttcttggaaatgtatggataagaaagatagctggaaaagtgggaaactcaacttttatttcattcctttttgtcctttatgttttgatgatgtgggatcgtatgtaattttc

SEQ ID NO: 15052 - DNA, 1294 bp, Mimulus guttatus
ttaattaattaattaacataatcatattatattattactaattattcacttaatcttttccaccacccataaatacccccctccacccccttctttgcttctatactctctcactacaactacactctctctctctctaacttttttctctctctaagcggcgggatggcgaaggacgtggcggagcaaggctctttcggcgcgaaggactaccacgatccgccgccggcgccgctgatcgacgcggaggagctgacgaagtggtccttctacagggctgtcatagctgagttcatagctactcttctcttcctgtacatcaccgtcgcgacggtgatcgggtacaagagccaggcggcggtggacgagtgcggcggcgtcggaattctcggcattgcatgggccttcggcggcatgatcttcgttctcgtctactgcaccgctggaatttccggggggcatataaacccggcggtgacattcgggcttttcttggcccgaaaagtgtcgttggtgagggcggtgatgtacatggtggcgcagtgtttgggggcgatttgtggagttgggcttgttaaggcgttccagagttcgctatacaagaagtacggcggcggcgctaatgggctctccgccgactacagcaccggagttgggctcgccgccgagatcatcggaactttcgttcttgtctacaccgttttctccgccactgaccccaaaaggagcgccagagattctcacgtccctgtattggcacctctacccattggatttgcagtattcatggttcatttggccacaattccgatcaccggcaccggaattaacccagctaggagtcttggagctgcagttatcttgaataacgatgccgggtggaatgaccattggatcttttgggtagggcccttcattggtgcagccattgcagcattctaccaccagttcatattgagggcaggagcagttaaagcacttggttcattcaggagcagcaaccatgtttaattattattaatatttactaattattcctgttattattataatttaaatcccttttttttttcttgtttttcttttttcatgctttgttttcgagtagaagaaaatggaacaagagacgagatccttttcgtgttaattatgaataatcgttttttattttaatcttgtgtttctaggttttatgcatgtgatttgttaatctatatattgtgaaattaatatactaattgtgaatggacaaaagaatattcttaatgataaaagagacaacatatatactaac

SEQ ID NO: 15053 - DNA, 1218 bp, Primula obconica
gaaaaacccctcactagcttttcctccatatatagcaactcctactacctcacttccccatcaaaaaacttctcatacactcaaaacacatacacacactctttgtctctcataacaaagcatgtcgaaggaggtggaaacaaccggaacggagcaaccggaattctcgtcgaaagactaccaagacccgccacctgctcagcttttagacctcgacgagctcaccaaatggtccttctatagggcaatcattgccgagttcatcgcaactctgctcttcctatacatcaccgttctcactgtcatcggatacaagagccagtctgacaccttcgctggtggagaccagtgcggcggcgtgggtctccttggcatctcgtgggcgtttggcggcatgatcttcatcctcgtctactgcaccgccggcatatccggtggacacataaacccggcagtaacatttgggctattcttggctcgtaaagtgtcactaatccgagcactgttctacatggtagcacagtgcctcggtgcaatatgtggcgtcggattagtgaaagcgttccaaaagtcgtactatgaccgctacggtggtggggcgaacgaggttcaactggggtacaataaggggaccgctctaggggctgagattatcgggacctttgttttggtctacactgtcttttcagccactgatcctaaaagaaacgctagagactcacatgttccagtgttggcaccactcccaattgggttcgctgtgttcatggtacatttggccacaatcccagtaactggtaccggtattaaccctgcaaggagctttggagctgctgttatatacaacaaagacaaggcctgggatgatcaatggatcttctgggtgggaccattcattggagcagcagttgcagcattttatcaccagtttgttctaagggcagctgccattaaggctttgggatccttcagaagcaatgcataaattaatattttccatataataaaaaaagggaaagagaaatgggtgataagtgagagggcgatcatctttgatgacggaagtgtaaaaagaatttaaatttttagtatgtaagggtgtgctgtttgtttctggttttcggtttttcgtttccttttctgtttcattgttctgctagcttaattgtaccaatgccttgtgaatcttatgatgatcagtttttattatgaatttct

SEQ ID NO: 15054 - DNA, 1493 bp, Prunus mume
ccctccctctctctctctctctctctctctctctctctctctcaatttcaaaagcgaagactctgtttttctttagcctcagctcccctgcttcttctctgtttctcccaaactctgtgaagctttagctaattaagcttaatggccaaggacgttgaagttgcagagagaggctctttctcagccaaggactaccatgacccacctcctgcaccactcttcgatgcagtggagctcaccaaatggtccttttacagagctctcatagctgagttcatagccactcttcttttcctctatgtcactgtgcttactgtgattgggtacaagagccagacagatacagctgtcaatgctgacgcttgtggtggggttgggattctgggtattgcttgggcctttgggggcatgatctttgtccttgtttactgcactgctgggatttcaggaggtcacattaaccctgcagtgacatttgggctgttcttggctcgcaaggtgtcgctggtcagagctgttttgtacatggtggctcagtctttgggggctatagccggtgttgctttggtcaaggctttccaaaagagctactacaccaagtatggcggtggagccaatgagctcagtcaaggctacagcacaggagttgggttgggtgctgagattattgggacctttgtgctggtttacactgtgttctctgctactgaccccaagaggagtgctagagactcccatgttccggttttggctccactgccaattgggtttgccgtgttcatagttcacttggccacgatcccaatcactggcactggcatcaaccctgctaggagtcttggagctgctgtcatctacaacaaaaaaaaggcttgggatgaccaatggattttttgggttggacccttcattggtgcagccattgcagccttctaccaccaattcatcttgagagcaggagctgtcaaagcccttggatcattcaggagcaacccccatgtttgaatattttcagagactccatgaattgaagatgcttcctttgtcatggtttgggtgggaaacaatggaagaaggctatatatcatgggatttggaaaagaataagttataacggctagtatttattattcgtgcttttagcttctgcgtgtgtatgaaggtttcttttgctcctctctctcaatttcctttagaaagaggggctgagagggccattaatttgtagatatagtcaggctgaaaagggagagctttttgtaccccttactgtttctccaaacacttgccttcgaatttacttaaatgtcattttcatttccatctctcctcctttcttctttgtagtcatcatgctttcaagaaaaattcaaacttatttggtcactgctgcttgctgtatgatgtctcaattagcttgcacaaaagaataatttgcacccaaaaaataagtaaatataataataacaccaccaacaggaccttgatttaca

SEQ ID NO: 15055 - DNA, 1244 bp, Camellia sinensis
ctctctctctctctctctctcactacacacagaggctcttttgttttgaggttagaatggcaaaggaagttgaggaaacagtagtaacagagcaggagttctcagccaaggactaccacgacccacctccagctccgctagtggacgtggtggagctgacaaaatggtccttctacagagctatcattgcagagttcatagccacacttctcttcctctacatcaccgtcctcaccgtcatcggctacaagagccagactgaccccatcaagaacgctgaccagtgtggcggtgtcggcatcctcggcatcgcatgggccttcggcggcatgatcttcgtccttgtttactgcaccgccggtatttctggagggcacataaacccagcagtaacgttcgggctgttcttggcacgtaaggtgtcactcatccgagcgttgttgtacatggtagcacagtgctcgggtgctatctgcggtgtagggttggtgaaggctttccagagagcatactacgacaggtacggtggtggggccaacgaggtcgcaccaggatacaacaaggggaccgctttgggtgcagagatcatcgggacctttgttttggtatacactgtgttctcagccactgaccctaagaggagcgcacgagactcccatgttcctgtgttggccccactccccattggattcgcggtattcatggtccacctagccaccatcccagtcaccggtaccggtatcaacccagctagaagtttcggtgctgctgtcatttacaaccaaaaaaaggcctgggatgatcattggatattctgggtcggaccgttcgttggggcagccattgctgcattctaccaccaattcattctgagagcagcagctattaaagctctgggatccttcagaagcaatgcctgaggagtttgaataacaatggaaggacaagggaaggttcctttgagcaagacaaaagtgatttgataatgaagagaaaaaagggtcttggaattgtagataatatttccttctggtgtcttttgtatttcctgtttgtttcaactttttcttctatctatctcctttcttgattttcttgtcatcatcatccaattttcttttttcttttacccctttttatcttttacattttcttagagtgttgtgtatccatgatgtttccccttaaataaataatcaattacaatatgaaaacaacatgtcggccgcctcggcctatgtgcg

SEQ ID NO: 15056 - DNA, 1183 bp, Tripterygium wilfordii
tccacatcctctccacaactctttgtgagcctcagcagtagcgaagccatggcgaaggacattgaagcttcaggtccaggagcagaatttcaatccaaggactaccaagatccaccaccagcacctctaattgacgctgaggagttcacccaatggtccttatacagagcagtaatcgccgagttcatagccacactcttattcttgtacataacagttttgacagtgattggctacaagagccaaacagacccagccatgaacaccgatgaatgcggcggcgttggaatcctcggaatcgcttgggccttcggtggcatgatcttcgtcctcgtctactgcaccgccggaatctcaggaggccatattaacccggcggtgacgtttgggcttctcttggctaggaaggtctcactggtccgggccgtattgtacatcgccgcccagtgtttgggggccatatgcggatgtgggcttgtgaaggctttccagaagtcctactacaccagatacggtggtggagctaacgagctcgctgatgggtacaacaagggcactggattgggtgctgagattattggcacttttgttcttgtttacactgtcttctctgctactgaccccaagaggaacgcaagagactctcacgttcctgtactggcaccactcccaattgggtttgctgtattcatggtgcatttggccacaattcccatcacaggcactggtattaaccctgcaaggagttttggagcagcagtgatatacaacaaggagaaagcttgggatgaccaatggttattctgggttggacccttcgttggtgctgcaatcgctgcaatctatcaccagtacatcttgagagcgggtgcaattaaggcccttggttccttcaggagctcctccaagatatgaatctgagaacatggttcacaccagctcatccctttgacgaccatttgaaatcaaataagcaatggtgttatggtggaagaacttcagtgtatcgaggccttgtatattaatgttagtggttgaatgtcaattgtctcctctttgtgtgataggcactggttttgtttgtgcttaatgttgtcatatgctctgttttcttcttaattaaggatccttatcctttttgttagacgttgttttttgtgatggctctctttggtgaggcggt

SEQ ID NO: 15057 - DNA, 1134 bp, Euphorbia esula
ctctctctctctctaaacccgaatagcatagtcaaacaaacaatgggaaaagacgtcgaagttgcagaacccgccgcggaattctcagcaaaagactatcatgaccctcccccagcacctttgtttgacatgggggaactgggtaaatggtctttttacagagctgtaattgcagagttcattgctactcttctctttctttatatcacagtattgactgtgattggctacaagagtcaaactgaccctaacctgaataaagatgcttgtggcggcgtcggtattcttggtattgcttggtcttttggtggcatgattttcattctcgtttactgcaccgctggaatttcaggaggacacataaaccccgcagtgacattcgggctatttttggggaggaaggtgtcgctaataagggcagtgatgtacatgatagcacagtgtttgggagcaatatgcgggtgtggattggtaaaggcattccagaaatcatactaccatagatatggaggaggagctaatgaattgtccagtggatatagcaaaggaactggattgggtgctgagattattggtacttttgttcttgtttacaccgtcttctctgctactgatcccaagagaagcgctagagattctcatgttcccgtgttggcacctctcccaatcggatttgctgtgttcatggttcatcttgccactattccaattactggaactggcatcaaccctgctcggagtttcggagctgctgttatctacaacgaggacaaagcctgggatgatcagtggatcttctgggtcggaccattcatcggagctgcggtagctgcattctaccaccaatttgttctaagagcagcagcaattaaggctcttggatctttcagaagcaatgcttaattaatcattgctttgtcacattaataacaatggaatattggtggtcttgatggagaaagagtatgtttgtttgaaaaggcccattgaattgtaaataatgaaaacatttcatggtcaagggtgtttcctttattatcccctctctgtatctgtaattttgttttttgttttttttttcctttgtattttaagtttgtgatgcttatattttatctctatcttttcatcctg

SEQ ID NO: 15058 - DNA, 997 bp, Centaurea maculosa
ctccaccactatcttcactcttcaaccaccaccactttttctctctaccaccaccgcaaccatgaccaaagacgtcccggagcaaggctccttctccgccaaggactaccacgacccgccaccggccccgtttatcgaccccgccgaactcaccaagtggtccttttaccgagcaattatcgctgagtttgtcgccaccctcctcttcctttacatcacggttttaaccgtcatcggctacaaggcccagaccgaccctgccaagaacctcgaccagtgcggcggagtcggcatcctcggtattgcttgggccttcggcggcatgatcttcgttctcgtttactgcaccgccggtatctctgggggtcacattaacccagcggtgacttttggtctgtttctggctcgtaaagtgtcgctgatccgagccgtcttgtacatggtggctcagtgtctaggagccatctgtggtgtgggtttggttaaggccttccacaagacctactacaacaactacggtggcggagccaacgagctagccgacggctacaacaaggggaccggactcggtgccgagatcatcggaactttcgtcctcgtctacaccgtcttctccgccaccgacccgaaaagaagcgcccgagactcccatgttcccgttttggcaccacttccaattgggttcgctgtgttcatggtccacttggccaccatcccgatcaccggtaccggaatcaacccggcaaggagtctcggagctgcggttatctacaacaaggaaaaggcttgggatgatcagtggatattctgggtcggaccctttatcggagcagccattgcagctttctaccaccagttcatattgagggcaggtgcaatcaaggctcttggatctttcagaagcagctctcatgtttgatttgagatttttaattatcgtcacctttttcaatgttacacaaaaaaaaatggaaaaatgaaataacatccatgttgg

SEQ ID NO: 15059 - DNA, 1179 bp, Gossypium hirsutum
ctctttgacaaaggagagcacaaaaaaggtgttcttgttcttgttcaagttcttgatcaatggctaaggatgttgaggttggtggtgagttccaagccaaggactaccatgatcctccaccagctccattggtagatgcccaagagttaactcagtggtctttttatagggctataatagctgaattcattgccacccttttgtttttatacatcactgtgttaacagtgattggatacaagagccaagttgatccagataagggtggtcaagattgtgatggtgttggcattcttggtattgcttgggcctttggtggcatgattttcatccttgtttactgcactgctggtatctcagggggacatatcaacccagcagtgacctttgggcttttcttggctcgtaaggtatcattggttcgagccatactttatatggctgctcaatgtttaggagccatttgtgggtgtgggttagtcaaggcattccaaaagagttattacaacaagtatggtggaggagctaatagcttggctgatggatacagcactggcactggtttggctgctgaaattataggcacgtttgtgcttgcttacactgtattatctgcaactgatcccaaaagaaacgcaagagattctcatgttcctgtgttggcaccacttcccattgggtttactgtgtttatggttcatttggcaactattccgatcaccggaaccggaatcaaccctgctcgtagtttcggagctgctgttatgttcaaccaggacaagccatgggatgaccattggatattctgggttggaccattcattggagctgccattgctgcaacttatcaccagtatatcctcagagcaggagctgctaaagctcttggatccttcagaagcagctcagccatgtaaaacaaagaggttgtcattgaagaatggatcaaactttttctatgattgtgaagagaatttttcagagcattgaatttggcacttcactttttaaagtgctccaagcgttgtcatcaaccctgtttacctttcaattttgtcatcaaccctgtttacctttcaattttctttctgttttttccttttttggctttgtcttggtgtctgtatgttgttgaaaattttatagaatctatcttttacattatttaaatgagttcaa

SEQ ID NO: 15060 - DNA, 990 bp, Euphorbia peplus
aaacaatgggaaaagacgtcgaagttgcagaacccgccgcggaattctcagcaaaagactatcatgaccctcccccagcacctttgtttgacatgggggaactgggtaaatggtctttttacagagctgtaattgcagagttcattgctactcttctctttctttatatcacagtattgactgtgattggctacaagagtcaaactgaccctaacctgaataaagatgcttgtggcggcgtcggtattcttggtattgcttggtcttttggtggcatgattttcattctcgtttactgcaccgctggaatttcaggaggacacataaaccccgcagtgacattcgggctatttttggggaggaaggtgtcgctaataagggcagtgatgtacatgatagcacagtgtttgggagcaatatgcgggtgtggattggtaaaggcattccagaaatcatactaccatagatatggaggaggagctaatgaattgtccagtggatatagcaaaggaactggattgggtgctgagattattggtacttttgttcttgtttacaccgtcttctctgctactgatcccaagagaagcgctagagattctcatgttcccgtgttggcacctctcccaatcggatttgctgtgttcatggttcatcttgccactattccaattactggaactggcatcaaccctgctcggagtttcggagctgctgttatctacaacgaggacaaagcctgggatgatcagtggatcttctgggtcggaccattcatcggagctgcggtagctgcattctaccaccaatttgttctaagagcagcagcaattaaggctcttggatctttcagaagcaatgcttaattaatcattgctttgtcacattaataacaatggaatattggtggtcttgatggagaaagagtatgtttgtttgaaaaggcccattgaattgtaaataatgaaaacatttcatggtcaagggtgt

SEQ ID NO: 15061 - DNA, 904 bp, Flaveria ramosissima
cgggggactcttctaccaccaccgcaaaatttgcactctctagcaacaatgactaaagacgtgccggagcaaggttcattctccgctaaggactaccatgacccgccgccagccccgttgatcgaccccgaggagttctccaaatggtctttctatagagcggtcatcgcggagttcatcgccacccttttgttcttgtatattactgtcttgactgttattggctacaagagcaccactgaccccgcattgaacgctgaccagtgcggtggcgttggtatcctcggtatcgcgtgggcctttggtggcatgatctttgtccttgtttactgcaccgccggtatctctggaggacacattaacccagcggtgacattcggtctgtttctggctcgtaaagtgtcgttgatccgagcctttatgtacatggtggctcagtgtttaggagccatttgcggtgtgggtttggtgaaggctttcaacaaaagcctctacaacaggtacggcggaggggccaacgagctagccgacggctacaacaaaggcaccggcctgggtgctgaaatcatcggcacttttgttcttgtttacaccgtcttttcggccactgatcccaagaggagtgctagagactcccatgttccggttttggctcctcttccgattggatttgcggtgttcatggtgcaccttgcaacaattccgatcactggaaccggtattaacccggctaggagtcttggagctgcggtcatttacaacaacgaaaaagcatgggatgatcagtggatattctgggttggaccattcgtgggagcagccattgcagccttctaccaccaattcatattgagagcaggtgcaatcaaagctcttggatcattcagaagcagctcacatgttt

SEQ ID NO: 15062 - DNA, 981 bp, Flaveria ramosissima
gggactcttctaccaccatcgcaaaattcgcactctctagcaaacatgactaaagacgtgccggagcaaggttcgttctccgctaaggactaccacgacccacccccggccccgttgatcgaccccgaggagctctccaaatggtctttctatagggcagttatcgcggagtttattgccacccttttgttcttgtatgttactgtcttgactgttattggctacaagagcaccaccgaccccgctttgaccaccgaccagtgcggcggcgttggcatccttggtatcgcgtgggccttcggtggcatgatctttgtccttgtttactgcaccgccggtatctctggaggacacattaacccagcggtgacattcggtctgtttctggctcgtaaagtgtcgttgatccgagcgtttatgtacatggtggctcagtgtttaggagccatttgcggtgtgggtttggtgaaggctttgaacaaaagcctctacaacaggtacggcggaggggccaacgagctggcggacggctacaacaaaggcaccggcctgggtgctgaaatcatcggcacttttgttctcgtttacaccgtcttttcggccaccgaccccaagaggagtgctagagactcacatgttcctgttttggctcctcttccgattgggtttgcggtgttcatggtgcaccttgccactattccgatcaccggaaccggtattaacccggctaggagtcttggagctgcggtcatctacaacaacgaaaaagcatgggacgatcagtggatattctgggttggaccattcgtgggagcagccattgcagccttctaccaccaattcatattgagagcaggtgcgattaaagctcttgggtcattcagaagcagctcacatgtttgagaattgtctattgttgtattttcttgctaaaccaaaaattggaaaaatgaaataattattgttattatatttatgttt

SEQ ID NO: 15063 - DNA, 1142 bp, Citrullus lanatus
agttcatccctaacctccatcactcccctctcccaactcctttgttttcaaatctcaattccttcctccatttcacccacaagtaccaccacccagccatgtctaaggatctcgaagccggaggcttcgccgccaaggactaccaagacccacctccagctccattaatcgacgccgaagagttcgctcaatggtctttttacagagccatcatcgccgagttcgtcgccactcttttgttcttgtacgtcactgttctcactgtcattggctacagtagccaatccgacaccaaaaacggcggccaaatctgcggcggcgtcggaattctcggcatcgcttgggcattcggcggcatgatcttcgttctcgtttactgcactgctggaatttccggaggacatattaatccagcggtgacttttgggttgttcttggctcggaaagtgtctttaattcgagcaatcctttacatggtggctcaatgtttaggcgccatttgtgggtgtgcattggtgaaatcattccagaaggctcattacaatgagtacggcggtggagccaattctctcgccgatgggtacggcaccggcaccggcttagccgcggagatcatcggaactttcgttcttgtttacaccgtcttctccgccaccgacccgaagagaaacgctagagattctcacgttccagttttggctccactcccaattggattcgcagtgtttatggttcatttggctaccattccgatcaccggcactggcatcaacccagctcgaagctttggagctgccgtgatctttaacaaagacaagccctgggatgatcagtggatcttttgggttgggccgttcattggagctgccattgctgcaatttatcatcaaatcgtgttgagggcaggggcagttaaagctctgggatcgttcagaagttccactgccgtatgaatcttaatacaaatctccattgtgaagtgtccggagagaaaagaatagccaaaatcccaaaggcactggtttttaagtgtgccttctatccttccaattcctctgtttttcgcccaccaagttatgtaatttagggctctgttttaatgcaaagtttgatccaatcaattttggatcaatgtctatgct

SEQ ID NO: 15064 - DNA, 957 bp, Citrullus lanatus
cttcatccctactctgcatttccacttctctctcctctttctcttcacttttttcagccatggccaaggactctgatgccggagggttcgccgccaaggactaccacgaccctccacctgctcctttcatcgacgccaacgagttcactcagtggtcgttttacagagccatcatcgctgagttcatagccactctcctcttcttgtacgtcactgttcttaccgtcattggctacagtagccagtccgacatcaaaaacggcggccaaatctgcggcggtgttggcattctcggcatcgcttgggctttcggtggaatgatcttcgttctcgtctactgtaccgctggaatttccggtgggcatatcaatccggcggtgacatttgggctgtttttggctcggaaagtgtcgttggtgagagctgttttgtacatggttgctcaatgtcttggtgccatttgtggatgtgctttggtcaaatcgtttcaaaagggtctttacaatcgctacggcggtggagccaattctctcgccgacggctacagtactggcactggcttaggcgctgagattatcggaactttcgttcttgtttacactgtcttctctgctacagatcccaagagaagtgctagagattctcacgttcctgttctagctccactgccaattgggtttgctgtgtttatggttcatctagccaccattccggttaccggcaccggtattaaccccgctcgaagcttcggtgctgcagttgtcttcaaccagagcaagccatggaatgaccattggattttctgggttggacctttcattggagctgcaattgctgcattttatcaccaattcattttgagagctggagctgttaaagctttgggatcattcaggagtacacacagtgtttgattattttgttgatgggaagaaatttgaatttactttttcatgg

SEQ ID NO: 15065 - DNA, 1134 bp, Taraxacum officinale
cggtccggattccgggataccaccaccaccaccgccaccaccaccacatctctttcttttatatttctctctctgtcaacatgacaaaagacgtggcggagcaagggtcgacgttgtcagcgaaggactaccatgacccaccgccggcggcgtttatagacccgaaggagctgaccaagtggtcgttctacagagctctgatcgccgagttcgttgccacccttctcttcctttacattactgtgttgacagttatcggctacaagagtgggatcgacaagggctccgacgcctgcggcggcgttggggtgctgggtattgcgtgggccttcggtggcatgatcttcgttcttgtttactgcaccgccggcatctccgggggtcacatcaatccagccgtgacctttggtctgtttctggctcgtaaggtctcactgccccgagccatcctgtacatggtggctcagtgcttaggagccatttgtggtgtcggtttagtcaaggccttccacaagacttactacaacacctatggtggtggtgccaacgagctagccgatggttacaacaaaggcaccggcttgggtgcagaaattatcggcacttttgtacttgtttacacggtcttttccgccaccgatcccaagagaagtgcacgagactcccatgttcccgtgttggcacctttacccatcgggtttgctgtgttcatggttcacttagctactattcccatcacgggaactggtattaatccggcgagaagttttggagctgcggtcatttacaacaaggcaaaagcttgggatgatcaatggatattttgggttggaccctttatcggagccgccattgccgccttctaccaccagttcatcttgagagcgggtgcagccaaggcccttggatctttcaggagcagtacccatgtttgagatacggatgaaattgttcgcaaatgattggggaaaagtgtttgaatgtgtacggaagtatggtgttttgatgttaagagtgtgtatgcttgtttaacgttttattgggaaccattgaaatgcaatgtaaattcttttcacgggtaggctgcccctcatgttattcttgccacttcaaaaattaactttgtagccactc

SEQ ID NO: 15066 - DNA, 1141 bp, Cichorium intybus
ccacttctctctccccctctatactccagtgtttgatcgtcagccatgacaaaagacgttgaagtggcggagcaccatggcggcaaagactaccatgaccctcccccggcaccattttttgacgccgaagagctcacaaaatggtctttctacagagctctcatcgccgaattcgttgccaccctcctcttcctttacgttaccgtcttgacagtcatcggctacaagagccagactgacccgaccctaccaggcgtcgatgagtgcggcggcgttggcatcctcggcatcgcctgggccttcggtggcatgatcttcatcctagtgtactgcaccgccggtatctctggaggacacattaacccggcggtgacattcggcctgttcttggcgagaaaggtgtcgttgattagagcagtgttgtacatggtagcacagtgtttgggtgcaatctgtggtgtgggtttggtcaaagctttccaaagttcctactacaataggtacggtggtggggccaacgaattggccgacggctacaacaaaggcaccggtctcggtgctgagatcatcggaacctttgttcttgtctacaccgtcttctcggctaccgatcctaagagaagtgctcgagactctcacgttcctgtattggcaccgctgcccatagggtttgctgtgttcatggtacacttggccaccatcccaatcaccggcaccggaatcaacccagcaagaagcttcggcgctgccgtgatttacaacaacgcgaaggcctgggacgaccaatggatcttctgggtcggaccatttatcggtgcagcgatagctgcgttctatcaccagtttgtattgagagcaggggccattaaagcacttggttctttcagaagcaatgcataaattgtaagacggtcaattcatccatccaacaaaaataaaactggacggacgacaagaatttcaacattcgttcgagtgtggatttccagccgaggagaattgcaaatggatggatatttgagtgtggaagtgttcaattgtagataataatttaatttccctttgagaattgtaatttctttttcttgttttgtgaatctttggtgttaatgcaagtggtctttttgtttatggggttttt

SEQ ID NO: 15067 - DNA, 1449 bp, Amorphophallus konjac
aaaaagctacacacacacagcagcggcagcggcagcagctcactctctctcgcagttacttgcctcgtctttctctctctagcttagctactccgtccaggcagctgcgaccatggggaaggaagtggaggagcaccacgggggggagttcacggcgaaggactacacggacccgccgccggccccgctcatcgaccccgacgagctgggcaagtggtccttctaccgcgctctcatcgccgagttcatcgccaccctcctcttcctctacgtcaccgtcctcaccgtcatcggccacaagtcctccaccgaccccgacaaggtctcccctgacgccgccaactgcggcggagtcggcatcctcggcatcgcctgggccttcggcggcatgatcttcatcctcgtctactgcacggccggcatctccggggggcacataaacccggcggtgacgttcgggctgttcctggcgaggaaggtgtcgctggtgcgggcgatactgtacatggtggcgcagtgcctgggggccatctgcggcgtcggcctcgtcaagggcttccagaaggcctactacacccggtacggcggtggtgcgaacacgctgaactccggctactccaagggcaccggcctcgccgccgagatcatcggcaccttcgtcctcgtctacaccgtcttcgccgccaccgaccccaagcgcaacgcccgtgactcccacgtccctgtgttggcccctctgcccatcgggttcgcggtgttcatggttcacctggccaccatccccatcaccggcaccggcatcaaccccgcccggagcttcggcgccgccgtcatctacaacaaggagaaggcctgggatgaccagtggatcttctgggtggggccgttcatcggagctgctattgctgccgcctaccaccagtacgtcctacgtgccggggccatcaaagcccttggctccttccgcagcaacccccacgtctgagatgtggcgacgctccccgccggcgccggcggtggtgttgtgatatggccggaaggaaaggtgggatgtgaataaagaaaggggacccgactgtctctgtgttgttcgaccgatggaggcagcccccccccccctctctctctctgggcataagaggggggtgcgaaagacccatgtcatgatgatgagaattgtagatactttatatgtatctatcgtctcctggaggggaagggagggatttcgcttttatgttcctccacctccacctccatttgcacttgtctaccttatctgaatttcctttaacgttgtgtgatggcatccgagtgtttgtatgtacttttgttttattaccacagcacatccaacaatcccaattgtgtctctcgcgccacttcatttattaatctcgctttgtcgtcattgtcccttgccatatgttggggttattgcccatgact

SEQ ID NO: 15068 - DNA, 1056 bp, Cleome gynandra
ttaagcaaacagagcactctcgaagctttcaccggatccctcaagaaacctccaaatcactcttaaaagccctaatttcaatggcaaaggatgtggaagttcaggaaacaagcgccacggtgaaggattacactgatccaccgccggctccgttgatcgacctggaggagctgaccaagtggtccttctacagagccgtgattgccgagttcatcgccaccttgctcttcctttacgtcaccgttttgactgtcatcggttataatgttcagaccgacaccaaagccggcggcgaagactgtggtggcgtcgggatcctcggaatcgcttgggccttcggcggcatgatcttcatcctcgtctactgcaccgctggaatttctggaggacacataaaccctgcggtcacgtttgggctgttcgttgctcgtaaagtttcgctggtaagagctttgatgtatatggtcgctcagtgtctcggcgctatctgcggttgcggtttggtcaagggtttccaaaaatcctactacaacaggtacggcggtggagcaaacgctttggcctccggctacaacaagggaaccggactcggagccgagattatcggaaccttcgttctcgtctacaccgtcttcgctgccactgaccccaagaggaacgcccgtgattcccacgttcccgtattggcgccacttccaatcgggtttgcggtgtttatggttcacttggcgacaattccgataaccggtaccggtattaacccggcaaggagtttcggagcagccgtgatctacaacaaggataaaccttgggacgaccagtggatattctgggtgggaccattcattggagcactagcggctgctgtgtaccaccaatacgttctacgagcggctgcgattaaggcacttggatccttcaggagcaacgcttaatcttttattttccattattctgtttttatttttttaaatccgattattagtaatacatgtggtaattaatgatcggttaaattggagaaaataaccaaaaaaaagaggaggagggtttgtg

SEQ ID NO: 15069 - DNA, 830 bp, Ambrosia trifida
taataataatataatagggcaaagacgttgaggttggaggccatgaatacggtgcaaaagattaccaagaccctccaccagctgacctcttcgacgcagaggagctaaccaagtggctttttaccgagccatcattgctgagttcattgccacactcttgttcctttacatcaccgtcttgactgtcatcggctacaagtcccaaaccgaccccaaccatagcactgaccaatgcggtggtgttggcattcttggcatcgcttgggcctttggtggcatgatctttgtccttgtttattgcactgccggcatctcaggaggacacatcaaccctgcggtgacatttgggttgtttctagctaggaaggtgacactccccagggcgtttatgtacattgtggctcaatgcctaggtgccgtgtgtgggtgcggtttggttaaagcattccaaaagacttactacaatacttatggcggtggtgccaacgaactcgcagatggctatagcaaaggcactggcttgggtgctgaaatcattggcacatttgttcttgtttacaccgtcttctcagccactgaccccaagagaaatgcacgagattcccatgtccccgtattggcacctctccctattgggtttgctgtgttcatggttcacttggccaccataccaatcactggcactggaatcaacccagctcgaagttttggtgccgcggtcatgtacggaaaagacaaagcctgggatgatcaatggttattttgggtgggaccgatgattggagccgccatcgccgccttctaccaccagtatgtattgagagcagggg

SEQ ID NO: 15070 - DNA, 919 bp, Flaveria ramosissima
accaacatcctcttatcaccaccaccaccggcaaacatgacaaaagacatagcggagcaagggtcgttctccggcaaggactaccaggacccaccgccggagccgttggttgacccggcggagctgaccaaatggtcgttctacagagccctgatcgctgagttcatcgccactcttctgttctttacatcactgtgttgactgttatcggatacaagagcaccaccgaccccgcgttgaacggcgatcagtgcggtggcgttgggatcctcgggatcgcgtgggcctttggggggatgatatttgtgcttgtttattgcaccgctggtatctccggaggtcacattaacccagcggtgacgtttggtctgtttctagctcgtaaagtatcattgatccgagccatcatgtacatggtggctcagtgcttaggagccatttgcggtgtgggcttggtcaaggccttcaacaaaagcctctacaaccgctacggcggtggagccaacgaactagccgacggctacaacaaaggcaccggactcggtgcagaaatcatcggcaccttcgtccttgtctacaccgtcttctcggccaccgaccccaaaagaagcgcccgagactcccatgttcccgttttggcccctcttccgatcgggttcgcggtgttcatggtgcacctcgccacgattccgatcaccggaaccggtatcaaccccgctaggagtcttggagctgcggtgatctacaacaatgagaaagcgtgggatgatcagtggatattctgggtgggaccgatggttggagcagcgattgcagccttctaccaccagtttatcttgagagcaggtgcagtcaaagcccttggatcattcagaagcagtactcatgtttagacttctcaatattgttgtattttatt

SEQ ID NO: 15071 - DNA, 1290 bp, Gossypium hirsutum
cagactctgtatcttctcttcctctctaccatttccttctttaagctaatttattagtttcttgctagctaagcatggcaaaagaaggagagaacagcactttccatgccagggattatgttgaccctccaccagcaccattgattgatgcttcagagcttaagaaatggtcattttacagagcattgatagctgagttcattgcaactatgctcttcctttacatcacagtcttgactgtgattggtcacaagagccaagttgctacctcccctgacgcatgttctggtgttggccttcttggtattgcttgggcctttggtggcatgatcttcatccttgtttactgcactgctggtatttctgggggtcatattaacccagcagtgacatttgggctgtttttggctcgtaaggtctcattgatccgagccattgcatacatggtggctcagtcattgggagccatatgtggggttgggctggttaaggcattccaatcagcatactacaacaggtatggaggtggagccaacactctagcagatggttacagcacaggcactggtttgggtgcagaaattattggaacctttgtgttggtttacactgttttctctgctactgatcctaagaggaaggctagagactcccatgtccctgtattggctcccctccccattggatttgctgtattcatggttcacttggctaccatcccaatcaccggcactggcatcaaccctgctagaagtattggagctgctgttatcttcaacaacaagaaagcttgggatgatcattggattttctgggttggtcccatgattggagcagccatagcagcattctaccaccaattcatcttgagggcaggagctgctaaggctcttggttcattcagaagccaaacccatgtttgattcatttgcctttccttgacacttttctagaagaaccctccaaaaaaacacatatatataaattgtgaaaataatgtgggaatttgcttgttatgatttgtgtatgttttaactgtcccttcagagccctcccttttttcttcaaaatttcccttcgaggaagttggaaaattttatagaaattgaagggtttcatgaaaatgtagataaactactctttgagaagtggtgggggtagaaggggcttttcaagcactttaatttagcttcttattttgtactagtttcaaatcatcgcccatttgttttactttattatgtaacaattggcacttattattcaagcacttctatttagctcttattt

SEQ ID NO: 15072 - DNA, 1151 bp, Artemisia annua
tattctatccatctatacatcatcatcagtcagccatgacaaaagacgtcgaagtagctgagcaccatggtggcaaagactaccatgaaccaccaccagcacccttgttcgatgctgatgagctaaccaaatggtctttttaccgagctcttatagccgagtttgttgctacacttctgtttctttacgtgacggttttgaccgttatcgggtacaaaagtactactgatattactttgaacgcagaccagtgtggtggtgttgggattcttggtattgcatgggcttttggtggcatgatctttgttcttgtttactgcactgctggtatctcaggaggacacattaaccctgctgtgacattcgggttatttttggcaaggaaggtgtcattaattagagcagtaatgtacatggcacaatgtttgggtgcaatctgtggtgttggtttagtcaaagctttccaaagttcctactacaataggtacggtggtggggccaacactttggccgatggttacaacaagggcactggactaggtgccgaaatcatcggcacctttgtccttgtttacaccgtcttctctgctactgaccctaagagaagtgcgcgagactctcacgttcctgttttggcaccattgcccatagggtttgcagtcttcatggttcacttagccaccattcccatcactggtaccggaatcaaccccgctagaagctttggcgcggccgtgatttacaacgacgaaaaggcttgggatgaccaatggattttctgggtcggaccatttttgggggcagccgcagcagcattctaccaccaatttgtacttagagccggagccattaaagcacttggttctttcagaagcaatgcctaaatcgaaagatgatgaatatgtatgtccatgcaaaaataataaacgaacgacgcgacaaaagtttcatctagagtccaagtcgaggcgttaaaatggatggatatacgagtgtggaagtgcttaattgtagataataatttatgttgatctattttagcattgtaatttcagtttttttctcatttcggtttcattgtgaattgaatcttgagtgttaaatgtacgtgctattatcatgttttcttcaatcaaatttagaatttcttc

SEQ ID NO: 15073 - DNA, 1347 bp, Theobroma cacao
atccacagccaccagagccaaaaacccaagctctcttttctgttcttgctcacagtttttcaaaggtttttaggaaagaagaggatatggcaaaggaagttgagactgcagagcaaggtggtggagagttctcagccaaggactaccatgatccgccaccagctccattgattgatgcagaagagctcttcaagtggtcgttttacagggcactgattgctgagttcattgctacccttctctttttgtatgtcagtgtgttgactgtgatcgggtacaaggtccaaaccgacactctgaagaacactgttgatgctgactgtggtggtgttggcattcttggtattgcttgggccttcggtggcatgatctttattcttgtttactgcactgctggtatctctggaggacacatcaacccggctgtgaccttcgggctgttcttgggacgcaaggtgtcactcatccgagccatcatgtacatggtagctcagtgcttgggtgccatctgcggctgtgggttggtcaaggctttccaaaagacttactacaacacctacggtggtggtgccaacgagctccaacctggctacaacaagggcaccggcttgggtgctgagatcattggtaccttcgttcttgtctacactgtcttctctgccaccgaccccaagaggagtgcaagggattcccatgttcctgtcttggctccacttcccattggatttgctgtgttcatggttcaccttgccacaatcccaatcactggcactggtatcaaccctgcaaggagttttggagctgctgtgatttacaacagagagaaggcctgggatgaccaatggatcttctgggttggacctttcattggagctgccattgctgcattctaccaccaatacatcctaagagcagcagccatcaaggcccttggatctttcaggagcaatgcttaaaaaaaatcagctctccttttccatggataattcaagaaaaaattatggtcatgatgaattgtgatggagatgtttcccacagagaataacaaatgaagagtgcaagtctgtctgagggggtttccctcttgcaatcttctttctgtctcttacatggggttggaaggagaagccttgagggagccattgaactgtaaataaattaaaatatatttatggacaagggtgtctcttttgaaccaatccctgtttgttcttatcttttctttttcttttgctttgaatgtatttaattaagtaattgtgttgtcatctttgtttatccttatcatctcctttgtattcaccccttctttttatgcataattctagtagtgaattgtgttgtctt

SEQ ID NO: 15074 - DNA, 889 bp, Chrysanthemum coronarium
ccttctccccttttcgactccgaagaactcaccaaatggtctttttaccgagcaataatagccgagttcattgccacattgttgttcctttacatcactgtcttgactgtcatcggttacaaatcacaagtcgacccggctcacagcactgaccaatgtggtggtgttggaatccttggtatcgcgtgggctttcggaggcatgatttttgtccttgtttattgcactgctggtatctcaggaggacacattaaccctgctgttacattcgggctgtttttggctaggaaagtgacattaccaagggcgtttatgtatattgtggctcaatgtttgggtgctatctgtggttgtggtcttgttaaggctttccagaagacttactatcataattatggtggtggtgctaatgagcttgctgatggctacagcaaaggaaccggtttgggtgctgaaatcatcggtacctttgttcttgtttacaccgtcttctcggctactgaccccaagagaaatgcacgcgattcccatgtcccagtgttggcacctcttcccatcggatttgcggtgttcatggttcacttggccacaatcccaattactggaactggaatcaacccggctcgtagttttggtgctgctgtcatgtatggtaaagaaaaagcatgggatgatcaatggttattctgggttggacccatgattggagcagccatcgcagccttttaccaccagtacgtattgagagctggtgcgatcaaagctcttggatctttcaggagcaatgcctagatcaagagcatgaaatatgaaaatgtatttcatgtttttaagaaaatgtacaaatttgcttgttttcatgaaagagtgttttatttaagggcgctag

SEQ ID NO: 15075 - DNA, 1251 bp, Cirsium arvense
acaccaaattacacttcacttctatctctctttaattctctcaaagtgtttgatcatcgctagccagccatgacaaaagacgttgaagtggcggagcaccatggcggcggtagcgactatgccgctaaggactatcaagacccacctccggcccccttgatcgacggtgaagagctcaccaaatggtctttctaccgagctgttatcgctgaattcgtagccaccctcctcttcctttacgtcaccgtattgaccgtgatcggctacaagagccagacggaccccaccttgaacaccgatcagtgcggaggcgttggcattctcggtatcgcctgggccttcggtggcatgatctttgttctcgtttactgcaccgccggtatctctggtggacatattaaccccgcggtcacatttgggcttttcttggcacggaaggtgtcgttgattagggcagttgcgtacatggtcgcacagtgtttgggtgcaatttgtggtgttggtttggttaaagctttccaaagttcctactacaataggtatggaggtggggccaacgaattagcccccggttacaacaagggtacaggactaggtgccgaaatcatcggcacctttgttcttgtctacaccgtcttctcggctactgatcctaagagaagcgcaagagactctcatgttcccgtattggcaccactgcccatagggtttgcagtgttcatggtacatttggccaccatccccatcaccggcaccggaatcaaccccgccagaagcttgggcgccgccgtcatttacaacaacgaaaaggcctgggatgatcaatggatcttttgggtcggaccgtttctaggggcagcggcggcagcgttctaccaccagtttgtattaagagcagcggccattaaagctcttggttctttcagaagtaatgcataattaaattaaattaaatttatccatgcaattaattaaaacaaggtagaataaaactggacgaatggcattaattatgttgtgcgttcgagtgtggttttccagttgatcaagagaattgttgaagttaaaatggatggatggatatatgagtgtggaagtcttcaattgtagataataagttaatttcaattccctttcagaaatgtaatttcactttcttttctattaaattaatgtgaatcttgagtcttgttaaaaaaaacaacattttatcaattcaaatgcatcaatgctaactgatgaaagtgacaa

SEQ ID NO: 15076 - DNA, 1303 bp, Gossypium hirsutum
agaaaatttttttttctcaaaaaaaagcagactctgtaccttctcttcctctctactatttccttctttaagctaatttcttagtttcttgctagctaagcatggcaaaggaaggagagaacagcactttccatgccagggattatgttgaccctccaccagcaccattgattgatgcttcagagcttaagaaatggtcattttacagagcattgatagctgagttcattgcaactatgctcttcctttacatcacagtcttgactgtgattggtcacaagagccaagttgccacctcccctgacgcttgttctggtgttggccttcttggtattgcttgggcctttggtggcatgatcttcatccttgtttactgcactgctggtatttctgggggtcatattaacccagcagtgacatttgggctgtttttggctcgtaaggtctcattgatccgagccattgcatacatggtggctcagtcgttgggagccatatgtggggttgggctggttaaggcattccaatcagcatactacaacaggtatggaggtggagccaacactctagcagatggttacagcacaggaactggtttgggtgcagaaattattggaacctttgtgttggtttacactgttttttctgctactgatcctaagaggaaggctagagactcccatgtccctgtattggctcccctcccaattggatttgctgtattcatggttcacttggctaccatcccaatcaccggcactggcatcaaccctgctagaagtattggagctgctgttatcttcaacagcaagaaagcttgggatgaccattggattttctgggttggtcccatgattggagcagccatagcagcattctaccaccaattcatcttgagggcaggagctgctaaggctcttggttcattcagaagccaaacccatgtttgattcattttcctttcctcgatgcttttctagaagaaccctccaaaaaaacacatatataaattgtgaaaataatgtgggaatttgcttgttatgatttgtgtatgtttaaccgtcccttcagagccctcccttttttcttcaaagtttcccttcgaggaagttggaaaattttatagaaattggtttcatgaaaatgtagataaactactctttgagaagtggtgggggtggaaggggcttttcaagcactttaatttagcttcttattttgtactagtttcaaatcatcggccatctgttttactttattatgtcacaactggcacttattattcaagcacttcaatttagct

SEQ ID NO: 15077 - DNA, 1212 bp, Echinacea purpurea
ataaatgcttaagaaacatacatctacaaaacgataaactcttatctccctcaccacctcaataaatacaccaacatttcaccaccacacaccccacccctcccctctcatctccatatatctctacaaacaaccactgcagtgaaaccaccggcggcaatgacgaaagacaccgaagtggcggagcaccaccacggcaaggactaccatgacccacctccggcaccgttgatcgacgccaaagagctgaccaaatggtctttctatagagctctcatagccgagtttgttgccaccctcctattcctttatgtcactgtgttgacggttatcgggtacaagagcacgactgaccccgacttagacgcggaccagtgtggtggtgttggtatccttggtattgcttgggcctttggtggcatgatttttatccttgtttactgcactgctggtatctctggaggacacattaacccggctgtgacattcgggctcttcttggctaggaaggtgtcattgattagggctgtatcgtacatggttgcacaatgtttgggtgcaatatgtggtgtgggtttggtcaaggctttccagagctcctactacaacaggtatggtggtggagccaataccttggcggacggctacgacaaaggcaccggactaggtgccgaaattatcggcacttttgttcttgtctacaccgtcttctcagctaccgatcctaagcgaaatgctcgagactctcatgttcctgtgttggcaccactgccaataggatttgcagtcttcatggttcatttggctaccattccgatcaccggcaccggaatcaacccagccagaagctttggtgctgccgtgatttacaacgacgagaaggcctgggatgatcattggcttttctgggtcggaccgtttttgggcgcagctgcagcggcgttctaccatcagtttatacttagagcagcagccgctaaagcgcttggttctttcagaagcaatgcatgattgaaagacgatgaatttatttatatatccatgtaaaagaataagattgtacggacgacacaattgtcgacgttaaaatgtatggatatgtgatgagcttcggtgtgttgttttgtagatgaacttccatttaagaaatgtaatttcatattttttctgtaatccttttcactgtgaatctaagatgtgtgtatgtagcca

SEQ ID NO: 15078 - DNA, 1308 bp, Gossypium raimondii
gctcattttttctcaaaaaaaaccagactctgtatcttctcttcctctctactatttccttctttaagctaatttattagtttcttgctagctaagcatggcaaaggaaggagagaacagcactttccatgccagggattatgttgaccctccaccagcaccattgattgatgcttcagagcttaagaaatggtcattttacagagcattgatagctgagttcattgcaactatgctcttcctttacatcacagtcttgactgtgattggtcacaagagccaagttgccacctcccctgacgcttgttctggtgttggccttcttggtattgcttgggcctttggtggcatgatcttcatccttgtttactgcactgctggtatttctgggggtcatattaacccagcagtgacatttgggctgtttttggctcgtaaggtctcattgatccgagccattgcatacatggtggctcagtcgttgggagccatatgtggggttgggctggttaaggcattccaatcagcatactacaacaggtatggaggtggagccaacactctagcagatggttacagcacaggaactggtttgggtgcagaaattattggaacctttgtgttggtttacactgttttttctgctactgatcctaagaggaaggctagagactcccatgtccctgtattggctcccctcccaattggatttgctgtattcatggttcacttggctaccatcccaatcaccggcactggcatcaaccctgctagaagtattggagctgctgttatcttcaacagcaagaaagcttgggatgaccattggattttctgggttggtcccatgattggagcagccatagcagcattctaccaccaattcatcttgagggcaggagctgctaaggctcttggttcattcagaagccaaacccatgtttgattcattttcctttcctcgatgcttttctagaagaaccctccaaaaaaacacatatataaattgtgaaaataatgtgggaatttgcttgttatgatttgtgtatgtttaactgtcccttcagagccctcccttttttcttcaaaatttcccttcgaggaagttggaaaattttatagaaattggtttcatgaaaatgtagataaactactctttgagaagtggtgggggtggaaggggcttttcaagcactttaatttagcttcttattttgtactagtttcaaatcatcggccatctgttttactttattatgtcacaactggcacttattattcaagcacttcaatttagctcttatttct

SEQ ID NO: 15079 - DNA, 1193 bp, Olea europaea
ttttcttgatacacacaaacgcacacacattttctgtacctatattcacatatgacaaaggacgcaggtgtggcggagcacgggtcgttcacgaccaaggactaccatgatccgcctccggcgccgctcatcgacgcggaggagctgacaaaatggtcattttacagggctataatagctgagttcatagccactttgctgtttctttacattacagttttgactgtaattgggtacaagagccagactgatcccgacttgaagggtgaccagtgtgatggggttggaattcttggtattgcatgggcctttggtggcatgatcttcattctggtttactgcactgctggaatttctggggggcacataaacccagcagtgacctttggcctgttcttggcccggaaagtgtctttgatccgggcagtgatgtacatggtggcacagtgtttgggagccatctgcggcgttggtttggtcaaggcatttcagaaatcatactacaagaaatacggtggcggcgccaacgtgctggccgatgggatcagcaccggcgtcgggttagctgccgaaatcatcggaacattcgtccttgtttacactgttttctccgccactgatccaaagcgtagtgccagagattctcacgtccctgtattggcacctcttccaattggatttgcagtgttcatggttcatttggccaccattccaatcaccggaacgggcatcaacccagctcggagtctcggagccgcagtaatctacgaccagcacaaggcttgggacgatcactggattttctgggtcggaccgtttatcggtgcagccgttgcagcattctaccaccagtttatattgagagctggagcagcaaaggcccttggttcattcaggagtagtgcttctcatcattgaaattaagagtcttactttatcattttcagatgaattttcaggcttaattatgaataattttcaagctttctccatcaatattaattattcttcaaagatccttaatgatgggagagttcttgagaaccttggaaatgtatcgataagaaaggtagctggaaaagtggaagacttttatttcattccttttgtcctttatgttttgatgatatggaatcatgtgtatttttcaagactatctttttatttttatgttctttaacttggttttgacc

SEQ ID NO: 15080 - DNA, 1190 bp, Senecio madagascariensis
aagcagtggtatcaacgcagaagtaacaacggggaacaaccaaacaacaacatcacttctatccatcttatctcttgcccacaaaccctagttgtgtctcatcatcatgacaaaagacgttgaagtggctgagcaccacggtggcaaagactaccaagacccacctccggcaccctttttcgacgccgatgagctaaccaaatggtccttctatagagccatcatcgccgagttcgttgccacccttcttttcctttacgttacggttttgacagttattggttacaaggcaggaaccgatcccacgttgaacactgaccagtgtggcggagttggtatcctcggtatcgcatgggctttcggtggcatgatctttgttcttgtttactgcactgccggtatctctggaggacacattaaccccgcggtaacattcgggttgttcttagcaaggaaggtgtctttgattagggctattgcctacatggtcgcacaatgtttgggtgcaatttgcggtgtgggttttgtcaaagctttccaaagttcctactacaataggtacggtggtggagccaactcgttggccgatggctacaacaagggtactggactaggtgctgaaattatcggcacctttgttcttgtctacaccgtcttctcagctaccgatcctaagagaagtgcacgagactctcacgttcctgtgttggcaccactgcccattgggtttgcagtcttcatggtacacttagcaaccatccccatcaccggcaccggaatcaacccagccagaagctttggcgcagccgtgatattcaacaacgacaaagtctgggatgaccaatggattttctggcttggaccatttattggagcagcgatcgcagcgttctaccatcagtttgtactaagagccggggctatcaaagcacttggttctttcagaagcaatgcctagattgaaaaatgatgaatctatccatccggaaaaaaagaataaaactcgacaaatgactaaagtttcatctatgttccactcgagaagaatcgttaaatggatggatacatgagtgctcgtgtggtcaattgtagataataatttatgttccatttaagacatgtaatttcagttttttctttcttccttttcattgtgaatcttgagtgtttaatgtaagtggtatttttct

SEQ ID NO: 15081 - DNA, 1148 bp, Silene vulgaris
tcttcccttaaaacaaagaagccatgagcaaagacatggaggtagctgagcaacaacccgagtacacaacaaaagactatcatgacccgccaccggcacctctatttgacatggaggagcttagaaaatggtcattttatagggctatcatagcagagtttgttgctactctcctcttcttgtatattaccgtccttacggttattggttataagagcgagactgaccttaatgccggtggtgatcaatgtggcggtgttggtattctcggtattgcttgggcttttggtggcatgatctttatccttgtttactgcaccgctggtatctctggaggacacataaacccggcagtgacattcgggttgttcttagcaaggaaggtgtccttaataagagcgtttgcctacatggtggctcaatgtcttggagcaatatgtggagtaggcctagtgaaagccttccaaaaggcatactatgtaaggtatggtggcggggcaaatgagatggcaccaggatataacaagggtactggcctcggtgctgagatcattggcactttcgttcttgtctacaccgtctttgctgccactgacccgaagcgatccgctagggactcccatgttccggtgttggcaccacttcccataggatttgcagtgttcatggttcacttggccaccatcccaatcaccggtaccggtatcaaccctgctagaagtttcggcgcagccgtgatctacaaccaggaaaagtcatggaatgaacactggattttctgggtgggaccattcattggagcagcaattgcagcattttatcatcaatatattctaagagctggagcaattaaagctcttggatcatttaggagctctgctgctaattaattcaagaactttttatttaattattaaaccatgtttttaattaaaatttagagtgtaaatgtgtgaaaaaatggagggtaaggtaagagtgcatggaattgtagataattatgtggggattgtgtaaagtgtactttaattatttatcaattgtgtgtttgttttgttttcttgtaattttaattttgtctatgacaacttcttaatgtcatatttgggaatgttcctcttgtactcatgttgcttgcaaatattcca

SEQ ID NO: 15082 - DNA, 1128 bp, Valeriana officinalis
aaacctaaccccgccatggcaaaaaccacagaggtagcggagcagggttcattctctgccaaggactaccatgatccgcctccagcgccacttatcgacccggctgagcttaccaagtggtctttctacagagccatcattgccgagttcatcgccacactacttttcctttacattaccgtcctcactgtaatcggctacaacgtccaaaatcaatccgatgattgcggcggcgttggagttctcggcatagcctgggcttttggtggtatgatcttcgttctcgtctactgtaccgccggtatctctggggggcacataaatccggcagtaacatttggactgttcctagcccgaaaagtatcgctgatccgagcggtgatgtacatggtggctcagtgtttgggagccatctgtggagtgggactggtgaaagcacttcaatcggcggagtacaaaaggcacggcggtggagcaaacatgctcaaccccggctacaacaaaggcactgggttagcggcggagattatcggaacatttgttctggtgtacacagtgttctcagccacagatcccaagaggagtgccagagattcacatgttcctgtattggcaccacttccaattggattcgcggtgttcatggtccacctggcaaccattccgatcacgggcacaggcatcaaccctgctcgtagtcttggagctgcagttatctacaacaaagaaaaagcttgggatgaccagtggctattctgggtaggaccattcatcggagcggccattgcagcattctaccaccaatttgtcttgagagccggtgcagtgaaggctctgggttcgttcagaagcaatccccatgtttgattttattttaattctgtgcgactagtacgtgaatgttccataagtatgagttaattctactacacacttgaaacttgtggaagaacaaataagttatggtgggttttgtgtgtaatgaaaatcattgaaatgtggataagggtacgttctttctagtatcatctgttgttgtaacttgtgtgtgttattgtacttgttaattagactatgtaccactattatgcccttccattctactaattattaaatcaatccgcctta

SEQ ID NO: 15083 - DNA, 1180 bp, Medicago truncatula
caaagtctcttcctttctccgttctttgtcttctctaacaacttccattcttgtttgagtgtgttgtttcataagggtaatccaaatggcaaaggatgttgaagttgctgaacgtggctctttctctaacaaagactaccatgaccctccaccagcaccactcattgatgctgaagaactcacaaaatggtccttttatagggctcttattgctgagttcattgcaactttacttttcctttacgttactgttttgactgtgattggttacagtattcaaactgatgttaaagctggtggtgatgcttgtggtggtgttggaattcttggtattgcttgggcttttggtggcatgatctttgtccttgtttactgcactgctggaatttcaggtggtcacattaacccagcagtgacatttgggctatttttggctcgtaaggtgtctttgatcagagcaattatgtacatggtggctcagtgtttaggagctattgctggagttgggttggttaaggcttttcaaagtgcttactttgatagatatggtggtggtgctaattttctccatgatggttacagtactggtgttggattaggtgctgagattgttggtacctttgttttggtttacaccgttttctctgccactgatcctaagagaagtgctagagattcacatgtgccggttttggcaccacttcccattggctttgctgtattcatggttcatttggcaaccatcccagtcactggcactggcatcaatcctgctagaagtcttggttctgctgttatctacaacaaagataagccctgggatgaccattggatcttttgggttggaccattcattggggcagccattgcagccttctaccatcaattcatcttaagagcaggtgctgttaaagctcttggatcattcaggagtaaccctactgtttaagtgcactgttcttcctcttcatcatggttttaatggaaaagaagataattgaagagatggattaattgatgatatttgttttgtatttgcaacacctcttcaattgtgtcttcaagattgtggataagtgtaaattaaagtctctttcgttacagggggagcctttttacactttcctctgtattctctttagtgtgtcatcttttcttttttaagttattctcttctgtg

SEQ ID NO: 15084 - DNA, 1009 bp, Artemisia annua
acgagtgcgtatcaaaacacacacacaaaaacatttgtcaaaaacattgtcaaaatgactaaagatgtccctgagcaaggttcattctcagctaaggactaccatgaccctccaccagcacccttgattgaccctggagagttgacaaagtggtctttttacagggctttgattgctgagttcattgctactcttttgtttctttatataactgtcttgactgttattgggtacaaaagtactactgatcctaagttgaacgcagacccgtgtggtggtgttggtattcttggtattgcatgggcttttggtggtatgatctttgtccttgtttactgcactgctggtatctctggaggtcacattaacccagcagtgacattcggtctattcctagcacgtaaagtgtcactgatccgagccttgatgtacatggtggctcagtgtctaggagccatttgtggtgtgggcttagtcaaggctttcaacaagagtctatacaacaggtacggtggaggagccaactctctagccgatggttacaacaaaggaaccgggctcggcgctgagattatcggcactttcgtccttgtttacaccgtcttttcggccactgatcctaagagaagtgcccgtgactctcacgttccagttttggcaccacttcctatcgggttcgctgtgttcatggttcacttggccactattcccattaccggaaccggtattaacccagctcgaagtcttggagccgctgttatctacaacaaggaaaaaatttgggatgatcagtggatattctgggtgggaccctttattggagcagcaattgcagccttttatcaccaatttatattgagagcaggtgcaatcaaggctcttggatcattcagaagcagtacccctaattaatcactttttaattttctttaattattgtaccctttattttaagatcccaaaattgtaatttcaaataatatttatggttgaattttagctttttgcc

SEQ ID NO: 15085 - DNA, 965 bp, Manihot esculenta
gaaaatccagttgtttgtttctcttctctcaagttcgttttttcaatcgtgagcgtcgaccatggtgaaggacgtgacggaacagggatcattctcggggaaggactaccatgacccaccaccaacaccattgtttgatgcggcggagctgaccaagtggtcattttacagagctttgattgctgaatttatagcaactttgctctttctttacatcactattttgactgtcattggatacaaaagccagactgatcctgccaagaatgccgactcttgtggtggtgttggaattctcggcatcgcttgggccttcggcggcatgatctttattcttgtttactgcaccgctggtatttcaggagggcacattaatccagcagtaacattcgggttattcctggcccgaaaggtctcactggtgagggcggtgatgtacatggttgctcagtgcttaggagccatagccggcgccggattggtgaagggcttccagaattcgtactacaagaggtatggtggtggggccaacagtctggctgatgggtacagcacaggcactggattgggtgctgagatcatcggcacttttgttttggtctatactgtgttctccgccactgatccgaagaggaatgcaagagactcccatgtgcccgttttggctccacttcctattggatttgctgtgttcatggttcacttggccaccattccaatcactggcactggcatcaacccagccagaagtctaggagctgctgttatctacaaccaggacaagccctgggatgaccattggatcttttgggttggacccttcattggtgcagccattgcagctttctatcaccaattcatattaagggcaggagctgtgaaggctcttggctcattcagaagcaaccctactgtttaagggaaggctcattggtcttaataatgaaggagaagcatgtgcctgt

SEQ ID NO: 15086 - DNA, 1255 bp, Actinidia deliciosa
cccactacccccctctctctttacactctcccccatctctctctctctctctctctctctctctctctctccaattaaattctcctagcttccacatgggcaaggatatggaggtggcggagcagggctcgttctctgcgaaggactaccacgaccctccgccagcgcctctggtggacccggcggagctgggcaagtggtcgttctacagggccctgatcgcggagttcatagccacgctcctcttcctctacatcacggtgctgacggtgatcggctacaagagccagaccgaccccgccattaacgccgacgcgtgcggcggcgtcggcattctcggcatcgcctgggcattcggcggcatgatctttgtcctcgtttactgcaccgccggcatctctggtggccacataaacccagcggtgacgttcgggctgttcctggcgaggaaggtgtcgttaataagggcggtgatgtacatggtggcccagtgcctgggggcaatttgcggcgttggactggtgaaaacctttcagaactcttactacgaccgctacggtggcggcgccaacgagctggccgccggatacagtaccggcaccggactcggcgccgagatcatcgggacgttcgtgctggtctacactgtcttctccgccaccgatcccaagcgcagcgccagagactcccatgtccctgtgttggcaccacttccaatcgggttcgcggtgttcatggttcatctagccaccatcccagtcactggcaccggcatcaacccagctaggagccttggagctgctgttatctacaaccagaaaaaagcttgggatgaccaatggatattttgggttggacccttcgttggagcagcccttgcagctttctaccaccagtttgtcctgagagccgcggcggctaaagcccttggctcatttaggagcagctctcatgtctaattttccaaaaaaaaaaaaaactctttcctttgttgattttagccaaaggagatgaatcacatttcaaaaataaattatggagtgcttgtgtcttgagggcaaggaattgtagatgaatagtctattttgtaaggggattttattttttttaagcctttttttatgtttttagtactttagtacctttgaaatttgaatctacttcaatgttgttgtatcctattttgaaatctctccattgttgtttgtagtttatgcttccattgatataaatcatcctctacaaaaaaaaaaaa

SEQ ID NO: 15087 - DNA, 1136 bp, Musa acuminata
gtggtagtggtgtatcgtgtgctggtacgttgcagatggcgaaggacatcgaggtggcggagcagggggagtacaccgccaaggactacaccgacccaccaccggcgccactcgtcgacgtggaggagctgaccaagtggtctctgtaccgggcggcgatcgcggagttcatcgccaccatgctgttcctgtacgtcaccgtgttgactgtgatcgggtacaagcaccagtcggaccccaacgtgaacccgaccgacgcggcctgcagcggcgtcggcatcctcggcatcgcctgggccttcggcggcatgatcttcatcctcgtctactgcaccgccggcatctccggtgggcacatcaaccccgcggtgacgttcgggctgttcctggcgcgaaaggtgtcgttggtgcgcgccttcctctacatggtggcgcagtgcctgggtgcgatctgtggcgtcggcctcgtcaaggggttccagaaggcctacttcgtccgctacggcggcggcgccaacgagctcagcgacggctactccaagggcaccggcctcggcgccgagatcatcggcaccttcgtcctcgtctacaccgtcttcgccgcgaccgaccccaagcgcagtgctcgcgactcccacgtcccggttttggctcccctcccgattggattcgcggttttcatggtccacttggcgacgatcccgatcacgggcacgggcatcaacccggcgaggagcttcggagccgccgtcatctacaacaaggacaaggcctgggatgaccagtggatcttctgggtggggccggccatcggtgctgccatagctgcagcttaccaccaatacgtcctgagagcgagcggtgtcaaggcgttgggttccttcagaagcagtgcgtgaagccctcctcctcctcctcctcctgttcttcttcctcaggctggacgtcactggtggaacatggaaactgtagataagaaaccctctcatgtggaggttgtgccgtatcatcgtcgtcatcatcccattcgttctcctctatgaattaatgcatttgggtgttgtcatacttgtgctgtatgtgtgatcacaatgtattccatatttaagataccaagtgtttccctttgttctctc

SEQ ID NO: 15088 - DNA, 1150 bp, Chrysanthemum coronarium
ccaaaacattcacttctatccatctctattctttgaagtttgaacatcatcaatcatatcagccatgacaaaagacgtagctgagcaccatggtgccaaagactaccatgaccctccaccagcacctttgttcgatgctgatgagctaaccaaatggtctttttaccgagctcttatagctgagtttattgcaacacttttgtttctttacgtgacggttttgaccgttatcgggtacaagagcactactgatccaacgttaccaggcgttgatgagtgtggcggtgttggtatacttggtattgcatgggcttttggtggcatgatttttgttcttgtttattgcactgctggtatctctggtggccacattaacccagcagtgacgtttggtctatttcttgctcgaaaagtgtcattgccccgagccatcatgtacatggtggctcagtgccttggagccatttgtggtgttggcttagtcaagtctttccataagacttactataacacctttggtggtggtgccaatgagctagcggatggctacaacaaaggcaccgggttgggtgctgagattattggcacctttgttcttgtctacactgtcttctcggctactgatcccaagaggaacgctagagactcccatgttcccgtgttggcaccactaccaatcgggtttgcggtgttcatggttcacctagccactatccccatcactggaaccggaatcaatcctgctaggagtttcggagcagcagtgatttacaacaaggagaaggcttgggatgatcaatggatattttgggtcggaccctttattggagctgcaatcgcagccttctaccaccaattcatcttgagagccggtgccgttaaagcccttggatctttcagaagcactacccatgtttgagatctcgatcgacctgaaggagaaggcatgctgtttcatttttcacgaaaaaataaataaaatcgtttgtatgtgtatgaaagtttgtggatttaggtgttagaatctcatgtctagcttgtttaagattcatttggaaacaccattgaaatgcaatgtaaattgttttgagaggtgcttacccttcatctaaagcattgtatcatttaattccaataattacgtgaacaa

SEQ ID NO: 15089 - DNA, 1296 bp, Gossypium raimondii
atcaaatttaaagtctcccagctccctttttgtctctgcatttttcctagtgtaaaaaaagaaagttagatatgggtaaggatatagagagtagtgtagagcaagggtcaggcaaggactaccatgatccgccaccagcaccattgattgatgctgaagagctgactaaatggtcgttttacagagcagtcattgctgagttcattgctacccttctcttcttgtatgtcacagtattgactgtgattggttacaaggtccaaaccgatcctctcaagaacacagttgaccctgactgtggtggtgttggtatcctgggtattgcttgggcctttggtggcatgatctttattcttgtttactgcactgctggtatctctggaggacatatcaacccggctgtgacctttggactgttcttaggacgaaaggtatcactgatccgagccatcatgtacatggtggctcagtgcttgggtgccatatgcgggtgtggattggtcaaagctttccaaaagacttactacaacaactatggaggtggtgctaatgagctccaaagtgggttcaacaagggcaccggtttaggtgctgagatcattggtacctttgttcttgtctacaccgttttctccgccactgatcccaagaggaatgctagggattcccatgttcctgtgttggcaccactccccataggatttgcagtgttcatggttcaccttgccacaataccggtcactgggactggtatcaaccctgctaggagctttggagctgctgtgatatacaacaaagagaaggcctgggatgaccaatggatcttttgggttggacccttcattggagctgccattgctgcattctatcaccaatacatcctaagagcagcagccatcaaagcctttggatcttccaggagcaattaattaaattcagccgaaaaaaaaaaggggtcacggaaataacaaatgaagaagatgtgtgcatatgcaagtttgtctgaggagcttcccttttactcattactagattggggaattgaaggtcaaaccttgaggttgaactgtaaataaaattatatatatatggttatggagagaagctgggtgtattttaagtccctgatattgtttgttgttgatttgaaagatgtaatgtaaagtgttgtgtttctttatccttgtcaactttcatctcttgttttgtcaaatgtttgtgtgtcttcattgatgagttggcttttatgttgctagtatttacaagtgaaacggtgttttctttttcttaaaaaat

SEQ ID NO: 15090 - DNA, 1122 bp, Nicotiana benthamiana
ctgttgtgcccacactcttatcttcctcttctctctctctctctcatagtattagtcaagaaaatagtaatctaaatttagaatagtgagaaaatggcaaagaacgttggtagtgaagggtcgttcacgacgaaagactaccaagatccgccgccagcaccactgattgacccagaagagctaacccaatggtctttttacagagcactcattgctgaattcatagccactcttctcttcctttacataacggttctgaccgtcattggttacaagagccaaagtgctacggcaacggatccttgtgctggtgttgggatccttggtattgcttgggcatttggtggcatgattttcgttcttgtctactgcactgctggtatttctggtggtcatataaatccagctgtcacatttggactattcttggcgaggaaagtatcgctaataagggcagttatgtatatggtggctcagtgtttgggagccatttgtggtgttggattagttaaggctttacaatcagcttactaccaccgctatgacggcggagtcaatatgctctccgacggatacagtcacggcgtcgggttgtcggcggagatcatcggaacttttgttcttgtttacactgttttctctgccactgatcccaagaggaatgctagagattctcatgtccctgtgttggcaccactccccattggatttgcagttttcatggttcacttagccaccattccgatcaccggtaccggaatcaacccggccaggagtcttggcgctgccgttatcttcaaccaacacaaagcctggaaagaccactggatattttgggtaggacctttcattggagcaaccattgcagcattctatcatcaattcatattgagagcaggtgcagctaaagcccttggttcattcaggagcagtacttgtcaagtttgatgattaaatttaagagaaaaagaggaaagggttgttgtactctatttatttatgtcaatgttttagtggtcttaatttctagctctccttatgatggttttgaacatcatgcaccatagtggtgtcgtacttgagagccaaagatgtgtagattacaaatgtattgtctttgta

SEQ ID NO: 15091 - DNA, 1094 bp, Allium cepa
acgcagagtgccattacgggcctaggttacgggggacaacagtttcatatatcataattcattcataaaaagaaagaaaacatgggagtagacgcaggagagaaaggcacggagtttacttcaaaagactatcaagacccaccacctgcacctcttatagacatagaagagttgacaaagtggtcgctttacagagcagtgatcgccgagttcatagcgactttgctgtttctgtacataactgttgcaactgttatcgggtacaaacatcagagcgatacgacgttgcctggcaacactgatggcgcttgcagtggcgttggaattttggggatctcttgggctttcggtggcatgattttcgttctcgtttactgcactgcaggaatatctggtggtcatataaacccagcagtgacattcggactatttctagcaaggaaagtgtcgctagtgcgagcggttttgtacatgattgcacagtgtctaggtgcaatatgcggtgtaggattcgtgaaggccttccaaagtgcatattatagtagatatggaggtggagcaaacgagttgaacagtgggtacacgaaaggaacggggcttgctgcagaaatcattggcactttcgtgttggtgtacactgtttttgctgccactgaccctaaacgaaacgcccgtgactctcatgttccggttttggcgccactgccaattggctttgcagtgtttatggtgcacttggcgactattccaatcactggtaccggaatcaacccagctagaagctttggagctgctgttatatataacaaggacaaagcctgggatgatcagtggatattttgggtaggaccattcataggagcagcaatcgcagcagcttatcaccagtacgtcttgagagctggggctgtgaaagctttgggatcatttaagagcaatccatgagattgatggccactgagtatttgaaaaataaaaactgaattattggaagtttccaagattggatgttgaattgtagatatgaagatttgaatcggaggggaattgtttgctatattcctcctctgaattgttcatattgttgtgtgttt

SEQ ID NO: 15092 - DNA, 1187 bp, Silene vulgaris
atgaaccaagagggaactaaaaaaaagattagaaccacaatccatcaaactaacaatctctagcactcgatttgcactaaacatttctaagcaaataaaaaagaaatgggcaaagaattagaaggagaagtaggaaaagactaccatgaccctccaccatcaccattgtttgacatggcagagatgggaaaatggtcattttacagggcagtaatagcagagtttgtagcaacactactgttcttgtatataacagtgttaactgtaattggatacaagagccaaagcgccacagacgactgcggcggtgttggtattcttggtattgcttgggcttttggtggcatgatctttattcttgtttactgcactgctggtatttctggtggacacataaacccggcagtgacattcgggctgttgttggcaagaaaactatctctggttagggctgttttatacatggtggctcagtgtttaggtgctatctgtggtgttgggctggtcaaggccttccaaagtgcatattacgacaggtttggtggcggggctaacgagttagctgtcggctacagcaagggcactgggttgggtgctgagattattggcacttttgttttggtttacactgttttttcggccactgacccgaagcgcagtgctagggattctcatgttcctgtattggcaccacttccaattggatttgcggtgtttatggttcacttagccacaatcccagtcacaggcaccggtatcaaccctgctagaagtttcggagcagcagtcatctacaacaacaaaaaggcatgggatgaccactggatgttctgggtcggaccattcatcggagctgcaatagccgctatctaccatcaatatatcttgagagccggttttgtcaaggcgcttgggtccttcagaagctcttccaatgtgtgatgatcatggttttgggctaaatgggattttaattatttctagtatgcataaggacaggcgacgaggcttttcaaaagatgtacataaaatgtgtaatctggtgggaagggtttgtcaatcaatgtcattatgattggtgtgtgtcgtggtgcttgctttcattgtttgccttaactgggccgttgtccatttttttccgccttttctctgttgttgtactatgcttttttccttgtatgaataaa

SEQ ID NO: 15093 - DNA, 1190 bp, Cucumis melo
cttctctatctcttcattttctccagccatggccaaagattccgatgccggagccttcgccgccaaggactaccacgaccctccaccggcccctttcatcgacccccacgagtttactcaatggtcattttacagagccatcatcgccgagttcatcgccactctcctcttcttgtacgtcactgttctcactgtcattggctatagtagccagtccgacatcaaacataacggccaaatctgcggtggtgtcggcattcttggcatcgcttgggctttcggtggaatgatcttcgttcttgtctactgtactgctggaatttcaggtggacatatcaatccggcggtgacatttgggctgtttttggctcggaaagtctcgttggtgagggctgttctgtacatggttgctcaatgccttggtgctatttgtggatgtgctttggttaaatcgtttcaaaagggtctttacattcgttacggcggtggagccaattctctcgccgacggctacagtaccggcactggcttagccgctgagatcatcggaactttcgttcttgtctacactgtcttctctgctacagatcccaagagaagcgctagagattctcacattccagttctagctcctctgccaattgggttcgccgtgttcatggttcacctagccaccattccagtcaccggcaccggtatcaacccagctcgaagctttggtgctgcggtggttttgaacgagagcaagccatggaacgaccattggatattctgggttgggccattcatcggagctgcaattgctgcattttatcaccaatttattttgagagctggagctgtcaaagcgttgggatctttcaggagtactcaaagtgtttgatgattttgttgatgagaagaatgggggtttggctttggatctaaaatgtgcgattagggaagacatttgagttttagttttccattttctggcacttcttttttatctgtgcctttactttcttttgctgtgttgttatttatgttgttgttcaatcctttttacttttttaagcacatattttgaaggttttatttttaattattgcaaaagaaagttgtttggtttaagaaatggatgtagggaaattgtgttggttcttctaagaactttaaatccaaggacattggcatcccaaaaaaaaaaa

SEQ ID NO: 15094 - DNA, 1308 bp, Cucurbita pepo
ctcatctccccctctctgcaattcttcctctgttttctctcttcaatttcttcaccctgcaccatggccaaggattctgaagctggtggattcgccgccaaggactaccacgacccacctccggcgccgttgatcgacgtcgaggagttcactcagtggtcattctacagagccatcattgccgagttcatcgccacgcttctgttcttgtacgttactgttctcactgtcattggctacagcagccagtccgacgtcgaccacgggggccatatctgcggcggggtcggcattctcggcatcgcttgggcctttggtggaatgatcttcgttcttgtttactgcaccgctgggatttccggtgggcatatcaatccggcggtgacatttgggttgtttttggcacggaaagtgtcgttggtgagggccgttttgtatatggtggctcagtgtgttggagccatttgtggatgtgcgttggtcaaatcgtttcagaagggtctctacaatcgctacggcggtggagccaattcgctagctgaaggttacagcaccggcaccggcttggccgctgagattatcggaaccttcgttcttgtctacactgtcttctctgctacagatcccaagagaagcgcaagagattctcacattcctgtactagcaccactcccaattgggttcgccgtgttcatggttcacctggccaccattccgatcaccggcaccggtattaacccagctcgaagcttcggcgctgcggtggtgttcaaccacagcaagccctggaatgaccattggattttctgggttggacccttcattggagctctcattgctgcgttttatcaccagttcatattgagagctggagcagttaaagctctgggatccttcaggagtacccacagcgtctaatgatggaagaacaagcaaggttttagatctaaatgttcatcgccatggatgaaatctgagtttccttttagttaaggggcacttcttttatctgtgcccttcttcactgctctttatctgtttcttcttctgctatattttgtgttgctgtagtacttcaattctctctaatttgtgtaaatttgctcttgttttagccaccaatttgaaggttcctgttataaaattgcaaaacaagtaggtttgctttgagaaatgggataatccatatttatatattgatcattcgatacaagttgtgaaattttatgaacttcttgttgttcataaaaaggtaggaggactagggatttacaagcattgtacaaactcaaaccaataataaatgat

SEQ ID NO: 15095 - DNA, 975 bp, Echinacea purpurea
tttctctctctaaaaaccatgacaaaagacgtggcggaacacgggtccttctccgcgaaggactaccatgatccgccacccgcaccgttgatagaccccaaggagctcacaaaatggtcattttatagagcattgatagctgaattcattgcaacccttttgtttctttatattacggtcttgactgtcattgggtacaagagcaccactgaccccgccttgaacgccgaccagtgcggcggcgttggtatcctcggtatcgcgtgggctttcggtggcatgatctttgttcttgtttactgcaccgccggtatctccggaggtcacattaacccagccgtgacgtttggtctatttctggctcgtaaagtgtcattgatacgagccgttatgtacatggtggctcagtgcctaggagccatatgtggtgtggggctagtcaaggctttcaacaaaagtctttacaaccggtacggtggcggagccaacgagctagccgccggctacaacaaaggcaccggactgggtgccgagatcatcggcaccttcgtcctcgtctacaccgtcttctccgccaccgatcccaagagaagtgcccgtgactcccatgttcccgttttggcgcctcttccgatcgggtttgcagtgttcatggtgcaccttgccaccattccgatcaccggaactggtatcaacccggctaggagtcttggagccgcggtcatttacaacaaggagaaagcctgggatgatcagtggatattctgggtgggaccctttgtgggtgcagcaattgcagcattctaccaccagtttatactgagagcaggtgcagtgaaagcccttggatcatttagaagcagcacacatgtttgagatttaattgttgtattttcttgatttaactaccaaatttgaaaaaatgtaataatatttatgttttgagttcccattaaattgaaatcaattcaattt

SEQ ID NO: 15096 - DNA, 1193 bp, Fagopyrum esculentum
ccattagcgactaatcgcctttgtatgagcagcaaggatatggcaggatcaggagagcaaggttctttctcacacaaggactaccacgaccctccacctgctccactcatcgactcagtcgagctcggcaagtggtccttctacagagcactcatcgctgagttcatcgccactttactcttcctctacatcaccgtcctcaccgtcatcggctacaagagccagtcctccaccgatgcttgctccggcgtcggtatcctcggcatcgcttgggctttcggcggcatgatcttcgtcctcgtttactgtaccgccggaatctccggtggacacataaatccggcggtgactttcggactgttcttggcgaggaaggtgtcgctgattagagcgattgcgtacatggtggcgcagtcgttgggagcgatctgcggagttggactggtgaaggcattccaatcctcctactacgacaggtacggcggaggagcaaacgagctagcggcaggatacaacaagggaactggattaggcgctgaaatcatcggaacattcgtgcttgtttacaccgtcttctccgccaccgaccccaagcgtaacgctcgtgactcccatgttcctgtattagcgcctcttccaatcggattcgcggtgttcatggttcacttggccaccatccccatcaccggaaccggcattaacccagccaggagtctcggtgctgccgttatctataaccagaaaaaggcctgggatgaccaatggatcttctgggtgggtccattcatcggagcagcaatagcagcgttctaccaccagttcgtgattcgtggaggcgccaagactctgggttcgttcaggagctcctccgcctaatatcatcctacaaacgatgagcggaaacttgtttcctatttagggtttttcatctcttcatcatttatatatatttatcaaatgttgtattagtgtggatgtactgctttttctgaaacgtgatttaatgggggaaaggtttgttgtttgctttctttcttactagtgcttcatgaaattatttcataatataattaaatttgtttgaagaatctaacatccaaattgaatacaatgttgtagaatgaagacgagaggatacagctaccgtactttaccctcggtagtttgccctttgggtctgttaggtccttttc

SEQ ID NO: 15097 - DNA, 1876 bp, Gossypium raimondii
attaaacaatggaaaatcaaaggtggattggacagctaaaaatgaatcataaaatgatcattaatttaaacttaaacataattactttgtttaatcagtagaatcctccctcctttatatacccttcttctcccactcaactctcttcatctcttcagcttttgctttagacccacaaattccaagccaaaacaagcaaaatatggttaaggatgtagagacggcagcgggaagagactaccatgacccaccaccggcgccattgatagatgctgaagagctcacccaatggtcattttatagggctttgattgctgagttcattgctacccttctcttcttgtatgtcacagtattgactgtgattggctacaaggtccaaaccgaccctttaaagaacaccgtcgatcctgattgtggtggtgttggcatccttggtattgcttgggcttttggtggcatgatctttattcttgtttactgcaccgccggtatctccggaggacatatcaacccggctgtgacctttgggttgttcttaggacgaaaggtgtcactggttcgagccgtgatgtacatggtggctcagtgcttgggtgccatttgtggttgtgggttagtcaagtggttccaaaagagttactacaatacctatggtggtggagccaatgagctacaagatggtttcaataagggaactggtttgggtgctgagatcattgggacttttgttcttgtttacactgtcttctctgcaactgatcccaagaggaatgcaagggattctcacgttcctgtattggcaccacttcccattgggtttgctgtgttcatggttcacctagccacaattccaatcactggcactgggatcaaccctgctaggagctttggtgctgctgttatttacaacaaagacaaggcctgggatgaccaatggatgttctgggttggacctttcattggagctgccattgctgcaaactaccaccaatacatcctaagagcaggagcaatgaaggcacttggatctttcaggagcaatgcttaattaaaatcgatcggcttttatttttcacataaaattcaaggagtcatcatgaattagagatgaagaaaaagatgagttcccttttgcattttgtttctgcaatgtgtttggaggagaaaaatgcttgagaagagccattgaactgtaaatataatatattttaacttgtgttttctttcttaatagtctaaccatatttatcggttgcatattttttaaatacttatatatatacaaggtataattatctacagactaaatttgaagacgtatgtcaatttaagatttcaacacaatttttagcaggttgaatccacattctcaatcaccatacttttttattcatacttctactaccatataacatagtcaacttcaaaaaattcgaatttaaatccacactaatggattgatttcacttttgtttgtttgagctctaacaaattatgtataatataattgatggtcattaataatttttttacaaggtatatttaaaaaaattaattatttgatttagaaattttagtgatgattctttggatttgtctaagatttttgaatttcatttatttctttcaggagtgacttgctttggttttgacacatttcatgtaacagaattgtatggtcctaaaacatgggtgcctgacccttatggactaattgacaagatccaacctgtaaatccagcatagggtgcggaaggttttgatttttttgttttaggaggaatagcctctcatcatattgcagcagggcattgggcatattgaaattgttggtagagttttttagatttcacaagtgagacgaagatgtgac

SEQ ID NO: 15098 - DNA, 1200 bp, Gossypium hirsutum
atgggatccacagcttaatcacaaacccaaatctccaattgatctgtttcatttttcagcaaagctagaaaaacaatgactaaggatatcgagactgcagagcaacatggaggggagttctcggccaaggactaccatgatccaccacctgctccattgattgatgctgaagagttaaccaaatggtcgttttacagggcagtgattgccgagttcattgctacacttctcttcctgtatgtcactgtgttgaccgtgattggttacaaggtccaaaccgaccctgctaagaacactgttgaccccgattgcggtggcgttggtattcttggtattgcttgggctttcggtggcatgatctttattcttgtttactgcaccgctggtatctctggagggcatatcaacccggctgtgacattcggtttgttcgtgggacgcaaggtgtcactcatccgagccctgatgtacatggtggctcagtgcttgggtgccatatgtgggtgtggattggtcaaggctttccagaagacctactacaacaactacgggggtggtgcgaacgagctccaaccagggttcaacaagggcactggactgggtgccgagatcattggtacctttgttcttgtctacactgtcttcgccgccactgatcctaagaggaatgcaagagattcccatgttcctgtgttggcaccactccccattggattcgctgtgttcatggttcaccttgccacaattccagtcactggcactggtatcaaccctgctaggagttttggagctgctgtcatttacaacaaagagaaggcctgggatgaccaatggatcttctgggtcggacccttcattggagctgccgcagctgcattctaccaccaatacattctcagagccgcagccatcaaggctcttggatctttcaggagcaatgcttaagtccagctttcattttcttacgaacttcaaccaaaaaagaaatggagaaccttgagttcagtgtggaccattgaaatgtaaataaatatttatgaacaagggtgtcttattttcttgctttcaatgtattttatttcgtacgtttttgtcatctttgttcatccttatcctctcttctttttcttccggtggtgcttttcatgttattttttaatgcataattctacaagtaaaatatattgtttgttttagtgt

SEQ ID NO: 15099 - DNA, 1458 bp, Cichorium intybus
acccccaaatttatcactcactactatctcaccgatacatttctctctttgaaactctttatctttctctctgtcaacatgacaaaagacctggcggaggaggggtcgttctcggcgaaggactaccacgacccacctccggcggcgttcatagaccctaaggaactgaccaagtggtccctttacagagctgtgatcgccgagttcgttgccacacttctcttcctttacattactgtcttgacagttatcggttacaagagccagatcgacaagggcggcgacccctgcggcggcgttggtgtcttgggtattgcgtgggcctttggtggcatgatattcgttctcgtttactgcactgccggcatctccggtggtcacattaacccagctgtgacctttggtctgtttctggctcgtaaggtgtcgctcccacgagccatcctgtacatggcggctcagtgcttaggagccatttgtggtgtgggcttagtgaaggctttcaacaagacttactacaacaactatggtggcggtgccaacgagcttgccgatggttacaacaaaggcaccggcttgggtgctgagataatcggaactttcgttcttgtttacaccgtcttctccgccaccgatcccaaaagaaatgcccgagactcccatgttcccgtgttagcacctttacccatcggatttgcagtgttcatggttcacttggccacgattcccatcaccggaacaggtattaatccggctaggagttttggagcggcggttatttacaacaaggagaaagcctgggatgatcaatggatattctgggttggaccatttattggcgcagccatcgccgccttctaccaccagttcatcttgagagccgctgcagccaaggcccttggatccttcaggagcagcacccatgtttgagatatattttcagttttcgataaaaggttggggaaaaagtgtttgtatgtttatgaaagtatttggtattttgatgttacgagtgtctatatgtcttaattaaggtttttattgggaacgatggaaatgaaatgtaaatgctgtttaggggtacccccgcccctcatgttattcttgccgcttgaaaactttgtattactcaatttactgacaaatcttttcaatgttcttgagattattgttttgttaaatatttaaatgtttagtaatgcgagtgttacttattacaagacaatactgacattaacctacttatacataaaatataaatctaactacagaaaaatatgtaatgcttaaaacgtctttatcttgtacatgatttgttcttcattggtgctttatggatcaaaattttaattcgtaccccacatttataaatgcataacatttttacaaaaattaatatggaattgaaaggagagtttcttaaaaaaccacgaaaactcaaaacaatatatagataaa

SEQ ID NO: 15100 - DNA, 1168 bp, Taraxacum officinale
caaacaccagttaattacttctctctctaaaaccctatccagtctcgatattccgcagccatgacaaaagacgttgaagtggcggagcaccacggcggcaaagactaccacgacccacctccggcaccatttttcgacgccggagagctcaccaaatggtctttctacagagctgtcatcgccgaattcgtcgccaccctcctcttcctttacgttaccgtcttgacagtcatcggctacaagagccagactgacccggccttaaacctcgacgaatgcggcggcgtcggcatcctcggcatcgcctgggccttcggtggcatgatcttcatcctcgtttactgcaccgccggtatctccggaggacacattaacccggcggtgacattcgggctatttttggcaagaaaagtgtcgctgattagggcggttttgtacatgatagcacaatgtttaggtgcaatttgcggtgtgggtttagtgaaagctttccaaagttcatactacaataggtacggcggtggggccaacgaattggccgacggctacaacaaaggcaccggtctaggggctgagatcatcggaacatttgttcttgtctacaccgtcttctcggccaccgatcctaagagaagtgcaagagactctcacgttcctgtattggcaccactacccatagggttcgcagtcttcatggtacacttggcaactatcccgatcaccggcactggaatcaaccctgccagaagctttggcgccgccgtgatttacaacaacgcgaaggcttgggacgaccaatggatcttctgggtcggaccatttattggggcagcgattgctgcgttctaccaccaatttgtactgagggcaggggccattaaagcacttggttcatttagaagcaatgcataaattgaaagaagttgattcatccatccaagaaaataaaaatggccggagaaggatttcatcattcatttgaggagggttttccgccgggaggaagtgtagatggatgggatatcgagtgtggacgtgttcaattgtagataataatttaatttcgctttgagaattgcttttctttttctatttgtgaatctttgagtgtttagtaatgtatgtcgtctttttcattttgaatttcaataaaggttagggtttcttg

SEQ ID NO: 15101 - DNA, 967 bp, Arnica chamissonis
caccaccaaaaccatgactaaagatgttgaagtggcggagcaccacggcggtggaggcgaatacgccgccaaggactaccaagatccacctccagctccctttttcgacgctgaagaactcacaaaatggtcattctaccgtgcgctaatcgccgagttcgtcgccactctccttttcctatacgtcaccgttttgaccgtcatcggatacaaaagccagaccgatcctagtttgaacaccgatcagtgcggcggcgtcggcatcctcggcatcgcctgggcctttggtggcatgatcttcatccttgtttactgcaccgccggtatctccggtggacacattaacccggcggtgacgttcgggttgtttttggcgagaaaggtgtcgttgattagggctttggggtacatgatagcacagtgtttgggtgcgatttgtggtgtcggtctggtgaaagcttttcaaagctcatactacaaccggtacggcggtggtgctaatgagttggccgacggttacaacaagggcaccgggctcggtgccgagattatcggcaccttcgtccttgtttacaccgtgttctccgccacagatcccaagaggagtgcacgagactctcatgttcctgtattggcaccactgcccataggattcgccgtattcatggtgcatctggccaccattccgatcaccggcaccggcatcaacccggccagaagttttggcgccgccgtgatttacaacaaggacaaggcctgggatgaccaatggatattctgggtgggaccattcatcggagccttcgccgccgcactctaccaccagtttgtactgagagccggggcaatcaaagcccttggttcattcagaagcaatgcttaagcttgaaagatgttcatccatggcggttcatgccttgtagatatcttttaaaaataatttgtaaaattcacgtgtttgtgtgtg

SEQ ID NO: 15102 - DNA, 1518 bp, Fagus grandifolia
aggaaaatgatcaaaggcatagtaagtgcgatgcacaagttttgccaggaaatgcaagacagaggcagtgtagtaagtaagtgggaggtagcgtggtaaagtcaggtagggacgggtccgtgaaagcgaaagaaaccaagaattataattagtagtttttttcacaactcaatttgctataatttaacgttaaacccaaaaatccatgtccttcccatattatatatagcccctacactccttcacatttttccacacccaaaaaaccagaagctctctaactcacgcaccaaagcttcagccttttgctttctctcttattgcttgtattctatttacatggctaaggacgtggaagtagctgagcatggtcatggctcttttccagccaaggattaccacgacccacctccggcaccactaatggatgctgtggagctgaccaagtggtccttttacagggctttgatagctgaatatgtagctactttgctctttctatatgtgacagtgctgactgtgattgggtacaagagccagattgaccctgacttgaaaggtgacgcctgtggtggtgttgggattcttggaattgcttgggccttcggtggcatgattttcgttcttgtttactgcactgctggaatttcagggggtcacattaacccggccgtgactttcgggctgttcttggctcgcaaggtgtctctgccccgggctgtgatgtacatggtggctcagtgcttgggagccatcagtggtgttgggctcgtgaaggcctttcagaaggcctactacatgaagtatggtggtggtgccaacactctctctgatggctacagcacaggcgttggattgggagctgagatcgtagggacctttgtgcttgtgtacaccgtcttctctgccaccgatcccaagaggaacgctagagattcccatgttccggttttggcaccactcccaattggatttgcggtgttcattgttcacttggccacaatcccaattactggcactggcatcaaccccgctaggagccttggagctgctgttatctacaacaaggacacggcctgggatgaccaatggatcttttgggttggaccattcattggtgcagctattgcagctttctaccaccaattcatcttgagagccggtgctgtgaaagctcttgggtcattcaggagcaccactcatgtttgatttctaaagaggcttaattaaccgataccttcttcatggtttttgctgggaacacaacattggaagaaggatttgatatttgaagaataatgggggagtgcttaagttatgattgtgtttaaaggtttctttggctctcttaatctccttagaccttagagagtcaaggagcatcaagttgtgtagataaagcctctttgagaaaccatttttctatccctgttgtacttcaaacccacttgcctttgaatttacttctatgtcatctttttcaacttttctctgtggttctttgtactcgtcatgctt

SEQ ID NO: 15103 - DNA, 1456 bp, Cichorium intybus
acccccaaatttatcactcactactatctcaccgatacatttctctctttgaaactctttatctttctctctgtcaacatgacaaaagacgtggcggaggaggggtcgttctcggcgaaggactaccacgacccacctccggcggcgttcatagaccctaaggaactgaccaagtggtccctttacagagctgtgatcgccgagttcgttgccacacttctcttcctttacattactgtcttgacagttatcggttacaagagccagatcgacaagggcggcgacccctgcggcggcgttggtgtcttgggtattgcgtgggcctttggtggcatgatattcgttctcgtttactgcactgccggcatctccggtggtcacattaacccagctgtgacctttggtctgtttctggctcgtaaggtgtcgctcccacgagccatcctgtacatggcggctcagtgcttaggagccatttgtggtgtgggcttagtgaaggctttcaacaagacttactacaacaactatggtggcggtgccaacgagcttgccgatggttacaacaaaggcaccggcttgggtgctgagataatcggaactttcgttcttgtttacaccgtcttctccgccaccgatcccaaaagaaatgcccgagactcccatgttcccgtgttagcacctttacccatcggatttgcagtgttcatggttcacttggccacgattcccataaccggaacgggtattaatccggcgaggagttttggagcggcggttatttacaacaaggagaaagcctgggatgatcaatggatattctgggttggaccatttatcggcgcagccatcgccgccttctaccaccagttcatcttgagagccgctgcagccaaggcccttggatccttcaggagcagcacccatgtttgagatatggattcagttttcgataaaaggttggggaaaaagtgtttgtatgttaatgaaagtatgtggtattttgatgttacgagtgtctatatgtcttaattaaggttttattgggaacgatggaagtgcaatgtaaatgcttcttagggtacccccgcccctcatgttattcttgccgcttgaaaactttgtattactcaaattgctgacaaatcttttcaatgttattgagattattgttttgttaaatatttaaatgtttagtaatgcgagtgttacttattacaagacaatactgacattaacctacttatacataaaatataaatctaactacagaaaaatatgtaatgcttaaaacgtctttatcttgtacatgatttgttcttcattggtgctttatggatcaaaattttaattcgtaccccacatttataaatgcataacatttttacaaaaattaatatggaattgaaaggagagtttcttaaaaaaccacgaaaactcaaaacaatatatagataaa

SEQ ID NO: 15104 - DNA, 1191 bp, Gossypium hirsutum
atccacagcttaataacaaacccaaatctccaattgatctgtttcatttttcagcaaagctagaaaaacaatgactaaggatatcgagactgcagagcaacatggaggggagttctcggccaaggactaccatgatccaccacctgctccattgattgatgctgaagagttaaccaaatggtcgttttacagggcagtgattgccgagttcattgctacacttctcttcctgtatgtcactgtgttgaccgtgattggttacaaggtccaaaccgaccctgctaagaacactgttgaccccgattgcggtggcgttggtattcttggtattgcttgggctttcggtggcatgatctttattcttgtttactgcaccgctggtatctctggagggcatatcaacccggctgtgacattcggtttgttcgtgggacgcaaggtgtcactcatccgagccctgatgtacatggtggctcagtgcttgggtgccatatgtgggtgtggattggtcaaggctttccagaagacctactacaacaactacgggggtggtgcgaacgagctccaaccagggttcaacaagggcactggactgggtgccgagatcattggtacctttgttcttgtctacactgtcttcgccgccactgatcctaagaggaatgcaagagattcccatgttcctgtgttggcaccactccccattggattcgctgtgttcatggttcaccttgccacaattccagtcactggcactggtatcaaccctgctaggagttttggagctgctgtcatttacaacaaagagaaggcctgggatgaccaatggatcttctgggtcggacccttcattggagctgccgcagctgcattctaccaccaatacatcctcagagccgcagccatcaaggctcttggatctttcaggagcaatgcttaagtccagctttcattttcttacgaacttcaaccgaaaaagaaatggagaaccttgagttcagtgtggaccattgaaatgtaaataaatatttatgaacaagggtgtcttattttcttgctttcaatgtattttatttcgtgtttgtcatctttgttcatccttatcctctcttctttttccttttttttccggtggtgcttttcatgttaattttttaatgcataattctacaagtaaaatatattgtttgt

SEQ ID NO: 15105 - DNA, 1210 bp, Gossypium hirsutum
gcttagcgtggtcgcggccgaggtacgcgctgatccacagcttaatcacaaacccaaatctccaattctgtttcatttttcagcaaagctagaaagacaatgactaaggatattgagactgcagagcaacgtggaggggagttctcggccaaggactaccatgatccaccacctgctccattgattgatgctgaagagttaaccaaatggtcgttttacagggcagtgattgccgagttcattgctacacttctcttcctgtatgtcactgtgttgaccgtgattggttacaaggtccaaaccgaccctgctaagaacactgttgaccccgattgcggtggcgttggtattcttggtattgcttgggctttcggtggcatgatctttattcttgtttactgcaccgctggtatctctggagggcatatcaacccggctgtgacattcggtttgtttgtgggacgcaaggtgtcactcatccgagccctgatgtacatggtggctcagtgcttgggtgccatatgtgggtgtggattggtcaaggctttccagaagacctactacaacaactacgggggtggtgcgaacgagctccaaccagggttcaacaaaggcactggactgggtgctgagatcattggtacctttgttcttgtctacactgtcttcgccgccactgatcctaagaggaatgcaagagattcccatgttcctgtgttggcaccactccccattggattcgctgtgttcatggttcaccttgctacaattccagtcactggcactggtatcaaccctgctaggagttttggagctgctgtcatttacaacaaagagaaggcctgggatgaccaatggatcttctgggtcggacccttcattggagctgccgcagctgcattctaccaccaatacatcctcagagccgcagccatcaaggctcttggatctttcaggagcaatgcttaagtccagctttcattttcttacgaacttcaaccgaaaaagaaatggagaaccttgagttcagtgtggaccattgaaatgtaaataaatatttatgaacaagggtgtcttattttcttgctttcaatgtattttatttcgtgtttgtcatctttgttcatccttatcctctcttcttttttcctttttttttccggtggtgcttttcatgttaattttttaatgcataattctacaagtaaaa

SEQ ID NO: 15106 - DNA, 1248 bp, Echinochloa colona
ctctcctctgctctgctcactctctcctctgctaattaagctactaagctagagaggccggccagccatgggcaaggacgacgtgatcgagagcggcgccggcggcggcgagttcgccgccaaggactacacggaccctccccctgcccctctgatcgacgcggcggagctggggtcctggtccctgtaccgcgccgtcatcgccgagttcatcgcgacgctgctcttcctctacatcaccgtgctcaccgtcatcgggtacaagcaccagaccgacacccagggcgccaacggcgacgcgtgcggcggcgtgggcgtgctgggcatcgcctgggccttcggcggcatgatcttcgtgctcgtctactgcaccgccggcatctccggcggccacatcaaccccgccgtcaccttcggcctcttcctcgcgcgcaaggtctccctggtccgcgccgtcctctacatcgtggcgcagtgcctcggcgccatctgcggcgtcggcctcgtcaaggccttccagagcgcctacttcgacaggtacggcggcggcgccaactccctcgcctccggctactcccgcggcaccggcctcggcgccgagatcatcggcaccttcgtcctcgtctacaccgtcttctccgccaccgaccccaagcgcaacgcccgcgactcccacgttccggtgttggcgcccctccccatcggcttcgccgtgttcatggtccacctcgccaccatccccgtcaccggcaccggcatcaacccggccaggagcctcggcgccgccgtcatctacaacaagtccaagccatgggatgaccactggatcttctgggtcggccctctcgtgggtgcggccattgcggcgttctaccaccagtacatcctccgggccggcgccatcaaggccctcggctccttcaggagcaacgcctgatgaggcttcctgcttgtcgctgtgagcttgcggaatcagcatgttgaagcaatggcgatcgacgacgccggaattgaaggggagaataagtctgcatcgaagttggtcgttttgtttcagcagagctgcgttgcgtgcgtgaatttggcttccatcatcctcctgtaatcaaccgtgtgttcgtgatcttctgtcgagggattattccgtctcctctcctctcctggtagcctgtatgtctatttaattattattatgtagcgacgatcatcatccaccaccatcatcagtggaaaaccttgcttctgtct

SEQ ID NO: 15107 - DNA, 1199 bp, Gossypium raimondii
tcatccacagcttaatcacaaacccaaatctccaattctgtttcatttttcagcaaagctagaaagacaatgactaaggatattgagactgcagagcaacgtggaggggagttctcggccaaggactaccatgatccaccacctgctccattgattgatgctgaagagttaaccaaatggtcgttttacagggcagtgattgccgagttcattgctacacttctcttcctgtatgtcactgtgttgaccgtgattggttacaaggtccaaaccgaccctgctaagaacactgttgaccccgattgcggtggcgttggtattcttggtattgcttgggctttcggtggcatgatctttattcttgtttactgcaccgctggtatctctggagggcatatcaacccggctgtgacattcggtttgttcgtgggacgcaaggtgtcactcatccgagccctgatgtacatggtggctcagtgcttgggtgccatatgtgggtgtggattggtcaaggctttccagaagacctactacaacaactacgggggtggtgcgaacgagctccaaccagggttcaacaagggcactggactgggtgctgagatcattggtacctttgttcttgtctacactgtcttcgccgccactgatcctaagaggaatgcaagagattcccatgttcctgtgttggcaccactccccattggattcgctgtgttcatggttcaccttgccacaattccagtcactggcactggtatcaaccctgctaggagttttggagctgctgtcatttacaacaaagagaaggcctgggatgaccaatggatcttctgggtcggacccttcattggagctgccgcagctgcattctaccaccaatacatcctcagagccgcagccatcaaggctcttggatctttcaggagcaatgcttaagtccagctttcattttcttacgaacttcaaccaaaaaagaaatggagaaccttgagttcagtgtggaccattgaaatgtaaataaatatttatgaacaagggtgtcttattttcttgctttcaatgtattttatttcgtacgtttttgtcatctttgttcatccttatcctctcttcttttttcttccggtggtgcttttcatgttatttttttaatgcataattctacaagtaaaatatattgtttgttttagtgtcaa

SEQ ID NO: 15108 - DNA, 1202 bp, Trifolium pratense
ttcctttctctgttctttgtcttctctaacaacttctattcctgtttgagtctattgtctcaaaagggtaatccaaatggcaaaggatattgaggtttctgagcgtggttctttctctaacaaagactaccatgaccctccaccagcaccactttttgatgctgaagaactcacaaaatggtccttttacagggcccttattgctgagttcattgcaactttacttttcctttatgttactgttttaactgttattggttacagtattcaaactgatgttaaagctggtggtgatgtttgtggtggtgttggtattcttggtattgcttgggcttttggtggcatgatctttgtccttgtttactgcactgctggaatttcagggggtcacattaacccagcagtgacatttgggctgtttttggctcgtaaggtgtctttgatccgagcaattatgtacatggtggctcagtgtttaggggctattgctggtgttgggttggttaaggcttttcaaaagtcttactttgatagatatggtggtggagctaattttcttcatgatggttacagtactggtgttggattaggtgctgagattgttggtacctttgttttggtatacactgttttctctgctactgatcctaaaagaagtgctagagattcccatgttccggttttggcaccacttcctattggatttgctgtattcatggttcatttggcaaccatccctgttactggaactggcattaatcctgctagaagtcttggttctgctgttatctacaacaaagataagccctgggatgaccattggatcttttgggttggaccatttattggggcagccattgctgcattctaccatcaattcatcttaagagcaggtgcagttaaagctcttggatcattcaggagtaaccctactgtttgagtgttatggttttaatggaaaagaagatcattgatatttgcacccccctctcaattgtatcttcaagattgtggataagtgtaggttaaagtctctttctttacaggggagcctttttacactttcctctgtattctatccctttagtgtgtcatcttttttctttttaagttattattctcttctgttatcctttgtactcattactatatatttatggtaaaatattctaagtttaaattatcttttcttctcattctca

SEQ ID NO: 15109 - DNA, 1354 bp, Chelidonium majus
actagctgtgtttgtgtttatatataatagtttgattaattgaagatatggggaaggacgtagaggtagctgaacaaggcgagttctcggccaaggactaccacgacccaccaccaccagctttcatcggaacccatgagctcacgacttggtctttctacagagctatcattgctgaattcgtagcaactcttttgtttctttacattacagtcttgacagtaattggttacaagagtcaaattgatcccaaaaatggtggtgatgaatgtggtggtgttggtattcttggaattgcttgggcttttggtggcatgatcttcatccttgtttactgcaccgccggtatctctggaggacatattaacccggccgtgacctttggtctatttttggctagaaaagtctcattgatcagagcagtcatgtacatagtggctcaatctttgggagccatctgtggtgtcggactggtgaaggctttccagaaggcctactacgtcagatacggtggtggggccaacgaacttgctgctggttacagtaagggtactggattagcggctgagatcatcggtactttcgtacttgtttacaccgtcttctcagccactgatcctaaaaggaacgccagagactcccatgtaccagttttggcaccacttccaatcgggtttgctgtcttcatggttcacttggcaaccatcccaatcacgggtacgggtatcaacccggctagaagtttcggagctgctgttatctacaacaaggaaaaggcatgggatgaccagtggatcttttgggtcggacccttcattggtgctgccattgctgctgcctaccaccagtacattctgagagctggtgcactcaaagctttgggttccttcaggagcactgcccacacctaaatttccaaagatgatcttaatttccatttttttggagatgatggtgttgatggtttgcaaggaataataataatagaggggtgtatgcagggtttgtctgtcaaaaaagtaccatttattctctctctctttctctctctaaaagtctatctctatgtcaatatctgtttgtctctctctctctagctatctcttcaaatagaaaaaaaaaagaagagagggtttgaagatggacccatggagttgtagataaaaatctctttaagttagagtggtggtgggaggggggtaaaagtctttcatttgcatctcccttttcttctattttcttagctagctagcacttatgttcaatcaatgtacctaagtgttgtcatcttttacctttaatttatcttctatgttctatcttttcctttatgtgtgatcatgaatgttttcac

SEQ ID NO: 15110 - DNA, 1491 bp, Citrus clementina
ttgcattcatttctcataccaaaaacaaccaaaaaaaaaaaagaaaaagaaaaaggcttctctctcgttgtgcttgtggctttgcagtgctctcagttttctctgtttctctccaaatcattgttactggttttccaatggcgaaggacactggggtggcagagcacggctcatattcagccaaggactacacggacccaccgccggagccgctattcgacgccgtggagctgaccaaatggtcattctacagagccttgatagctgagttcatagcaaccctgctctttctttacgtcactgtcttgactgtcattggctacaaaagccagaccgatcccgccaagaacgtcgacggctgtgccggcgtcggcatcctcggtatcgcctgggccttcggtggcatgatctttgtcctcgtttactgcaccgccggtatctcaggtggtcacattaacccggcagtgacgttcggactattcttggcccgcaaggtgtcgttggtccgtgctgtgatgtacatggtggcgcagtgccttggtgcaatctccggtgttgggttggtcaaggctttccaaaaatcttactacacaaggtacggaggtggggccaacgagctggccgatgggtacagcacaggcgttggattggccgccgagatcatcggcacctttgtgttggtttacactgtcttctcggccactgatcccaagagaagcgccagagactcccatgtccccgttttggcaccgctccccattggatttgctgtgttcatggtacacttggccacaatcccaatcactggcactggcattaacccagcaaggagtctcggggccgctgttatttacaacaaggacaaggcttgggatgatcaatggctcttctgggttggacccttcatcggtgcagcaattgcggctttctaccaccaattcatcttgagagctggagctgtcaaggctcttggttcattcaggagccaatcccgtgtctgattttagtttcgacaagtggattatccacatcttcatggggttaatgatttaaaattggaaagaaaaaactgggaaggagtagaggtgtgttaagtttcaaaaagtgaataatgagggggggtgtgatttgtgctttcaaggagttgtaggcaaaaagtctcttagacaatgagggggcttgcttttttgtaatcccctctgttgttttcaagcactttccttagaattcacttcttcaatgtttctgtctctttctactttgtattattttctccgtatgtgattattattattattgttgtgctttaaggaaaaaaaaaaaattattagctatgttgtcattttactacctgtttctactagcactcatgcctcgaagataaatgctgctaccatggtaaaagcaatatggcacgccaataaagtaaatgagcaaatgcatgaatgattgttaagagaataaaaagttttcaagttgtagaaggtacta

SEQ ID NO: 15111 - DNA, 1171 bp, Trifolium pratense
ctgttccttgtcttctcaaaccacttccattcttgtttgagtgtgttgtttcaaaagggtaatccaaatggcaaaggacgttgaagttactgaacgtggctctttctctaacaaagactaccatgaccctccaccagcaccactctttgatgctgaagaactcacaaaatggtccttttacagagcacttattgctgagttcattgcaactttacttttcctttatgttactgttttaactgttattggttacagtattcaaactgatgttaaagctggtggtgatgtttgtggtggtgttggtattcttggtattgcttgggcttttggtggcatgatctttgtccttgtttactgcactgctgggatttcagggggtcacattaccccagcagtgacatttgggctatttttggctcgtaaggtgtctttgatccgagcaattatgtacatggtagctcaatgtttaggggctattgctggtgttgggttggttaaggcttttcaaaagtcttactttgttagatatggtggtggtgctaattttcttcatgatggttacagtactggtgttggattaggtgctgagattattggtacctttgttttggtgtacactgttttctctgctactggtcctaaaagaagtgctagagattcccatgttccggttttggcatcacttcctattggatttgctgtattcatggttcatttggcaaccatccctgttactggaactggcattaatcctgctagaagtcttggttctgctgttatctacaacaaagataagccctgggatgaccattggatcttttgggttggaccatttattggggcagccattgctgcattctaccatcaattcatcttaagagcaggtgcagttaaagctcttggatcattcagaagtaaccctactgtttgagtgttatggttttaatggaaaagaagatcattgatatttgcacccccctctcaattgtatcttcaagattgtggataagtgtaggttaaagtctctttctttacaggggagcctttttacactttcctctgtattctatccctttagtgtgtcatcttttttctttttaagttattattctcttctgttatcctttgtactcattactatatatttatggtaaaatattctaagtttaaa

SEQ ID NO: 15112 - DNA, 1505 bp, Citrus sinensis
ttgcattcatttctcataccaaaaacaagccaaaaaaaagaaaaagaaaaagaaaaaggaaaaggcttctctctcgttgtgcttgtggctttgcagtgctctcagttttctctgtttctctccaaatcattgttactggttttccaatggcgaaggacactggggtggcagagcacggctcatattcagccaaggactacacggacccaccgccggagccgctattcgacgccgtggagctgaccaaatggtcattctacagagccttgatagctgagttcatagcaaccctgctctttctttacgtcactgtcttgactgtcattggctacaaaagccagaccgatcccgccaagaacgtcgacggctgtgccggcgtcggcatcctcggtatcgcctgggccttcggtggcatgatctttgtcctcgtttactgcaccgccggtatctcaggtggtcacattaacccggcagtgacgttcggactattcttggcccgcaaggtgtcgttggtccgtgctgtgatgtacatggtggcgcagtgccttggtgctatctccggtgttgggttggtcaaggctttccaaaaatcttactacacaaggtacggaggtggggccaacgagctggccgatgggtacagcaccggcgttggattggccgccgagatcatcggcacctttgtgttggtttacactgtcttctcggccactgatcccaagagaagcgccagagactcccatgtccccgttttggcaccgctccccattggatttgctgtgttcatggtacacttggccacaatcccaatcactggcactggcattaacccagcaaggagtctcggggccgctgttatttacaacaaggacaaggcttgggatgatcaatggctcttctgggttggacccttcatcggtgcagcaattgcggctttctaccaccaattcatcttgagagctggagctgtcaaggctcttggttcattcaggagccaatcccgtgtctgattttagtttcgacaagtggattatccacatcttcatggggttaatgatttaaaattggaaagaaaaaactgggaaggagtagaggtgtgttaagtttcaaaaagtgaataatgaggggggtgtgatttgtgctttcaaggagttgtaggcaaaaagtctcttagacaatgaggggcttgcttttttgtaaatcccctgtgttgttttcaagcactttccttagaattcacttcttcaatgtttctgtctctttctactttgtattattttctccgtatgtgattattattattattgttgtgctttaaggaaaaaaaacaaaattattagctacgttatgttgtcattttgctactcgtttctactagcactcatgcctcgaagataaatgctgctaccatggtaaaagcaatatggcacgccaataaagtaaatgagcaaatgcatgaatgattgttaagagaataaaaagttttcaagttgtagaaggtacta

SEQ ID NO: 15113 - DNA, 1604 bp, Prunus persica
gaagtaagtgggaggtcaggtggccccagtagtcaggccacatagtcggtgaaagccaaagaacacactaaaatagtagggtgggctctgtccagaaatttcaaattgcagtaattactcctaatcccttacccatatataccccccttctcctcactctctcacacaccaacaccctccctctctctctctctctctctctctctctctctctctagaaatttcaaaagcgaagactctgtttttctttagcctcagctcccctgcttcttctctgtttctcccaaactctgtgaagctttagctaattaagcttaatggccaaggacgttgaagttgcagagagaggctctttctcggccaaggactaccatgacccacctcctgcaccactcttcgatgcagtggagctcaccaaatggtccttttacagagctctcatagctgagttcatagccactcttcttttcctctatgtcactgtgcttaccgtgattgggtacaagagccagacagatacaactgtcaatgctgacgcttgtggtggggttgggattctgggtattgcttgggcctttgggggcatgatctttgtccttgtttactgcactgctgggatttcaggaggtcacattaaccctgcagtgacatttgggctgttcttggctcgcaaggtttcgctggtcagagctgttttgtacatggtggctcagtctttgggggctatagccggtgttgctttggtcaaggctttccaagagagctactacaccaagtatggcggtggagccaatgagctcagtcaaggctacagcaaaggagttgggttgggtgctgagattattgggacctttgtgctggtttacactgtgttctctgctactgaccccaagaggagtgctagagactcccatgttccggttttggctccactgccaattgggtttgctgtgttcatagttcacctggccacaatcccaatcactggcactggcatcaaccctgctagaagtcttggagctgctgtcatctacaacaaagaaaaggcttgggatgaccaatggattttttgggttggacccttcattggtgcagccattgcagccttctaccaccaattcatcttgagagcaggagctgtcaaagcccttggatcattcaggagcaacccccatgtttgaatattttcagagactccatgaattgaagatgtttcctttgtcatggttagggtgggaaacaatggaagaaggctatatatcatgggatttggaaaagaataagttataacggctagtatttattatttgtgcttttagcttatgcgtgtgtatgaaggtttcttttgctcctctctctcaatttcctttagaaagaggggctgagagggccattaatttgtagatatagtcaggttgaaaagggagagctttttgtaccccttactgtttctccaaacacttgcctttgaatttacttaaatgtcattttcatttccatctctcctcctttcttctttgtagccatcatgctttcaagaaaagttcaaaccatttggtcactcctgcttgctgtgctctgccattttatgaataagattgatc

SEQ ID NO: 15114 - DNA, 1157 bp, Silene vulgaris
ctccctctcttttccacacaactaaccaccctcaatcctcatcacttccctacacaatcctcctcttaaaacaaagaagccatgagcaaagacatggagctagcagagcaacaacccgagtacacaacaaaagactatcatgacccgccaccggcacctctatttgacatggaggagcttagaaaatggtcattttatagggctatcatagcagagtttgttgctactctcctcttcttgtatattaccgtccttacggttattggttataagagcgagactgaccttaatgccggtggtgatcaatgtggtggtgttggcattctcggtattgcttgggcttttggtggcatgatcttcattcttgtttactgcaccgctggtatctctggaggacacataaacccggcagtgacattcggattgttcttggcaaggaaggtgtccttaataagggcgttcgcctacatggtggctcaatgtcttggagcaatatgtggagtaggcctagtgaaagccttccaaaaggcatactacgttaggtatggtggcggagcaaatgagatggcaccgggatataacaagggcactggcctcggcgctgagattattggcactttcgttcttgtttacaccgtctttgctgccactgaccctaagcgatccgctagggactcccatgttccggtgttggcaccacttcccataggatttgcagtgttcatggttcacttggccaccatcccaatcaccggaaccggtatcaacccggctagaagtttcggcgcagccgtgatctacaaccaggaaaagtcatggaatgaacactggattttctgggtgggaccattcattggagcagcaattgcagcattttatcatcaatatattcttagagctggagcaattaaagctcttggatcatttaggagctctgccgctaattaattcaagaactttttattttaattatttaagcatgtttttaattaaatttggagtgtaaatgtgtgaaaaaatggaagggtaaggtaagagtgcatggaattgtagataattaagtggggattgtttaaagtgtactttaattatttatcaatataatggtgtgtttgtttgtttcttgtattttaatttgtctatgacacttcttaatg

SEQ ID NO: 15115 - DNA, 1043 bp, Cleome gynandra
ggcaacaatggcgaaggacgtggaaggtggagctggcgatggttttcaggcgagggactaccaggacccaccgccggcgccgctggtggatgcggaggagctgacgaagtggtcgttctacagagcactcatcgccgagttcatagcaactcttctcttcctctacataaccgtcttaaccgtcatcggttacaagagccaaaccgataccaccaccggcggtgaagactgcggcggagtcggaatactgggcatcgcttgggcattcggcggtatgatcttcatcctcgtgtactgcaccgccggtatctcaggtgggcacataaacccggcggtgacatttgggctgttcttggcgagaaaagtgtcattggtaagagcagtgttgtatatggtggctcaatgtttaggtgccatctgtggagttggcctcgtcaaggccttccaaagtgcttactatgaccgttacggcggcggagccaactctctctcagacggctacagcaaaggcaccggccttgccgccgagatcatcggcaccttcgtcctcgtctacaccgtcttctctgccaccgatcccaagcgtaacgccagggactcccacgttccggtattggcgccacttccgatagggtttgccgtgttcatggtgcacttggcgacgattccgatcaccggaacgggaattaacccggcgaggagtctaggagcggcggtcatctacaacaaggacaagccatgggatgaccactggatattctgggtgggaccattcattggagctgcgattgctgcattctatcaccaattcgtcttaagggcatcaggatcaaagtccctcgggtccttcaggagtgcctcctaaatcattatgaatgtatcatatttctcgggctcttcattttaatttatgcccttcaatcttcttttctttccttttttagtttgtgtgattataatgccctcttatcctttttcccttcgtgtcaatgtgtacttccgaagaaaaactcaatgaaatcaaagcgtccttttgttgttag

SEQ ID NO: 15116 - DNA, 1126 bp, Ipomoea nil
gaccattaaactctctctctctagtctctttggtgctttggtattgttttcttgtttttctctcagattttggtgctatagcattttgtttgttacatagatgactaaggacatggcggagccggggtcattttcaacgaaggactaccacgatccgccgccggcgccgctcatcgacgcggaggagctgaccaagtggtcgttttacagagctgtgatagctgagttcatagccacacttcttttcctttacattacagtgttgactgtgattgggtacaagagtgagactgccgaccccaaggctgacccttgcggcggcgtgggcattcttggaatagcttgggccttcggtggcatgatcttcatccttgtttactgcaccgccggtatctccggggggcatattaatccggcggtgacatttgggctgttcctagctcggaaagtgtcgctaatcagagcggtgatgtacatggtggcgcagtgtttgggggccatatgcggcgttgggctggtgaaagccttccagaaggcgtactacactaggtacggcggcggagcaaatcagttggcccatgggtacagcaaaggcgtggggctgtcggcggagatcatcggaacttttgttcttgtgtacaccgttttctcggccactgatcccaagaggagtgccagagattcacatgtccccgtattggcacctctcccaattggatttgcggtgttcatggttcaccttgccaccattccgatcaccggcaccggaatcaacccagcaaggagtcttggagctgctgttatctacaacaaggacgaagcatggcataaccattggatcttctgggtaggaccattcattggagctgccattgcagctttctaccaccagttcatcctgagggcaggagcggccaaggctctgggttcattcaggagcggttctcaagtctgatcgagtttgagagattcattattatgttgttgttattttctaattaaaaatgattgaataatttgtgttgtatggttgatgtactgggtgaggaggtcgcactgtgagtgtgagccatgggagtgtgtagatagatagggagtgcgttagtttttacttttataaagggaa

SEQ ID NO: 15117 - DNA, 1275 bp, Mimulus guttatus
actcccacctctcctctgcaacactacacacacactaatcaccctccgaaacacgcacatcaatggcaaaggacgtcgagtgcgctgatccgccggcgggattctcagccaaggactaccacgatccgcctccagcgccgctcttcgattgcggcgagctcacccagtggtccttctacagagctctaatcgccgagttcatcgccactctcctcttcctgtacgttaccgtgttgacggtcatcggctacaaggtccagagcgacgccgtccacggcggcgaccagtgcggcggagtcggaattctcggcatcgcatgggcattcggcggcatgattttcatcctcgtttactgcaccgccggtatctccggagggcacataaatccggcggtgacgtttgggctgtttttggggaggaaggtgtcgctaattagggctgtgctgtacatggtagcacagtgcctcggtgcaatctgcggcgtaggtttggtgaaagcattccagaaatcttactacgtccggtacggcggcggagccaacaccctcgctcatgggtacaacaccggcgtaggtttgggtgcagagatcatcggcaccttcgttttggtgtacactgttttctctgccactgaccccaagaggaacgcacgtgactcccacgtgcctgtgttggccccacttccgattggatttgctgtgttcatggtacacctggcaacaatacccatcaccggcaccggaatcaacccagcccggagtttcggcgccgccgtgatattcaacaatgacaaggcgtgggatgaccagtggatattctgggtcggaccattcgtcggagctgccattgctgccttctaccaccaattcatcttgagggcggccgccattaaagctcttggatctttcagaagccatgcttaagatttaaatgaaaattcagtgatgaataataagaattcccatcaaaattgtagataattttctccctattgttgttgttgctttcattttttttttctcttttttttttctttcaggtttggttgtatttctgtgaggcttgattttaataattatcagtttcttttctcaaatatatatgaagaatccaatataatcattgtcacacaataaatgatgatcattcttcgataaatatttgatggaataatgtaaattatggtgaactatgtcgagcaaccgatcactagttgatcttgacttagtgaaacacaagcaaccgatcattattaaaaattgaaatttcagcact

SEQ ID NO: 15118 - DNA, 1130 bp, Citrullus lanatus
agcaaattctcctctgtttttctagaagaaacactcaattttgaaattgttgatatgtcgaaggatattgaagctggagggcgtggtgggtttagtgggaaggattacgaagatccgccgccggccccattgatcgacgctcaggagtttgcccagtggtcattttatagagccattatagcagagtttgttgctactcttttgttcttgtatgttactgttcttactgtcattgggtataaagttcagagtgatgataagaatggaggcgagatttgtggtggcgtcggtattttgggcattgcttgggcctttggtggcatgatttttgttcttgtttactgcaccgccgggatttctggaggacacataaatccggctgtgacttttgggctatttttggctcggaaggtatcattagtgagagccgttttgtacatggtggctcagtgtctaggcgccatttgtggctgtgcattggtgaaggcattccaaaacgctcactacaacaagtacggcggaggagccaactcgctctccgacggctatagcaccggcaccggattagccgccgagatcatcggaaccttcgttctcgtttacactgtcttttccgctaccgatcccaagagaaatgccagagactctcacgtccccgttttggcgccactcccaattgggttcgcggtgttcatggttcacttggccacgattccgatcaccggtacgggcatcaacccggctagaagctttggagctgcagtagtgttcaaccaatccaagccatgggatgatcaatggatattttgggttggacctttcattggagctgccatagctgcaatttatcaccaattcatattaagagcaggagcagccaaagctctaggatcattctcaacctcctgattaatcatcaattattaagcttaataatatataataatgtatgtgaaatttaataattgttgttgtgttaattaattggcaaaaaggccggtttggtttgtggtccgtataaaagggcattggccttttattttctatgcccatatctactttttgctttctgttttccctctgtttttatgtaattatgggagatctcgtattgtttataaaatgtgaat

SEQ ID NO: 15119 - DNA, 1374 bp, Sorghum bicolor
ctcactccccccacctcacgctctcatccattcccattccttgcaagcgtagccacctctcccactcactctctcgcagctgctaagcgaagccatgggcaaggacgacgtgatcgagagcggcgccggcggcggcgagttcgctgccaaggactacacggacccaccgccagctccactgatcgacgcggcggagctgggttcctggtcgctgtaccgcgccgtgatcgccgagttcatcgcgacgctgctgttcctgtacatcaccgtcgccaccgtgatcgggtacaagcaccagacggacgcgacggcgtcgggcgccgacgccgcgtgcggcggcgtgggcgtgctgggcatcgcgtgggcgttcggcggcatgatcttcgtcctcgtctactgcacggcggggatctccggcggccacatcaacccggccgtcaccttcggcctgttcctggcgcgcaaggtctccctggtgcgcgcgctgctctacatcgtggcgcagtgcctgggcgccatctgcggcgtcggcctcgtcaaggcgttccagagcgcctacttcgacaggtacggcggcggcgccaactcgctcgcctccggctactcacgcggcaccgggctcggcgccgagatcatcggcaccttcgtgctcgtctacaccgtcttctccgccaccgaccccaagcgcaacgcccgcgactcccacgtcccggttctggctcccctccccatcggcttcgccgtgttcatggtgcacctggccaccatccccgtcaccggcaccggcatcaacccggccaggagccttggcgcagccgtcatctacaacaaggacaagccctgggatgaccactggatcttctgggtgggcccattcgtgggcgctgccatcgcggcgttctaccaccagtacatcctccgggcgggcgccatcaaggcactcggctccttcaggagcaacgcgtgagcgcaggagccacccgtgtgtcccgtcgtccaaggctttcaatctgcaaagggctttgcttctgctggagcaatggcgatcgatcttattagggggggagaggctggagaataaagttgcatcaacttgtagtgccggtggtttggtcgctcttgtttcagcagctgcgttgcgcgtgcgtggaatttggtttcgtttccctgtaatgatcaaccatcatcatcatcatgtgtcgtaatctgctgtcccaagggattccgtctcctcctttcctctcctgctcttctagcctctactatttttctatttgattattgttattattatgtagcgacaagaatcatcaatcatcatcagtgagaacctcttgcttctgtctaaatcaaccgacatgtggagtggatggg

SEQ ID NO: 15120 - DNA, 1257 bp, Saccharum officinarum
atgaattacacgcctgccggaccgacccggactgacttgccggatcgacccacgcgtccgtgcaagcggagctagctctcccactcactctctcgcagctgctaagcgaagcgaagctaggatgggcaaggacgacgtgatcgagagcggcgctggcggcggcgagttcgctgccaaggactacacggacccgccgccggcgccgctgatcgacgcggcggagctgggttcctggtcgctgtaccgcgccgtgatcgccgagttcatcgcgacgctgctgttcctgtacatcaccgtcgccacggtgatcgggtacaagcaccagacggacacgacggcgtcgggcgccgacgccgcctgcggcggcgtgggcgtgctgggcatcgcctgggcgttcggcggcatgatcttcgtgctggtctactgcacggcggggatctccggcggccacatcaacccggccgtcacgttcggcctcttcctggcccggaaggtctccctggtgcgcgcgctgctctacatcgtggcgcagtgcctcggcgccatctgcggcgtggggctcgtcaaggcgttccagagcgcctacttcgacaggtacggcggcggcgccaactcgctcgcgtcggggtactcccgcgggacggggctcggcgccgagatcatcggcaccttcgtgctcgtgtacaccgtcttctccgccaccgaccccaagcgcaacgcccgcgactcccacgtcccggttctggctcccctccccatcgggttcgccgtgttcatggtccacctggccaccatccccgtcaccggcaccggcatcaacccggccaggagcctgggcgccgccgtcatctacaacaaggacaagacctgggatgaccagtggatcttctgggtgggccctctggcgggcgctgccatcgcggccttctaccaccagtacatcctccgggcgggcgccatcaaggccctcggctccttcaggagcaacgcgtgagcggaggaggagcctctccaagcttttaatttgcaaagggcgtcttctgctggagcaatggcgatcgatcttactgtagggggggagagacaggcgcgcgcgtgagtgaggagaataatttgccatcatcgatcatcggtcgctcttgtttcagcagccgcgttgcgtgtgcgtgcgtgcgtgaaatttggtcttcgttccctgtaatcatcaaccatcatcatgtgtcgtaatctgctgtcaagggactccgtatcctgctg

SEQ ID NO: 15121 - DNA, 1329 bp, Eucalyptus grandis
acagaccttctcccacccctctcaccccttcgctttttagctgatcagcaaccacgctctccacagattaccagtctctcgtcacgatttccgtcctcggaaagttttaaagggtctttaaggacatggccaaggacgacgaggtggtggagcaacagggcggggagtttcacggcaaggactaccgcgacccgccgccggcgccactggtggacgctgaggagctcgtcaagtggtccttctaccgggccgtcatcgccgagttcgtcgccaccctcctcttcctgtacatcaccgtgctgacggtgatcggctacagcagacagagcgacacgacccacggcggggaccagtgcgacggcgtcggcctcctcggcatcgcctgggccttcggcggcatgatcttcgtcctcgtctactgcaccgccggcatttctggggggcacatcaacccggcggtgacgttcgggctgttcctggcgaggagggtgtcgctggtgcgggccatcctctacatggtggcccagtgcctaggcgcggtgtgcgggtgcggcctcgtgaaggccttccagagggcctactacaagcggtacggcggcggggccaacatgctccaggccggctacagcaagggcaccgggctgggcgccgagatcatcggcaccttcgtcctcgtctacaccgtcctctccgccaccgaccccaagaggagcgcccgggactcccacgtccccgtgttggcgcccctgcccatcgggttcgcggtgttcatggtccacctcgccacgatccccatcaccggcacgggcatcaacccggccaggagctttggggccgcggtgatgtacaacaaggagaaggcgtgggatgaccaatggatattctgggtggggccattcattggtgcggccattgcagccttctatcaccagcacgttctgagagctgcggccatcaaggctctcggttccttcaggagctcttccgccttgtaactccgaataatgccctcaggacatcatcacagaggggatagagagaactttggggttttagttgttgtattgtgtaaattgtttgtgtgtcagtacgtagcgtgcgcttgaggcactgggtttttctccttttgtgtgcctaattaggggtgggttttctgtagttctattttccattagggtcattgtggaaccgtgaagtctgtcaatacgagagtctaatgcacttcctccaaatgctacttactataccttatcaatgtgctgggaatgagccccttgcggggcctaaattccttatccagattgatcttgttatattaatgtaacatcc

SEQ ID NO: 15122 - DNA, 1032 bp, Chrysanthemum coronarium
cgacaccaaaacattcacttctatccatctctattctttgaagtttgaacatcatcaatcatatcagccatgacaaaagacgcagctgagcaccatggtgccaaagactaccatgaccctccaccagcacctttgttcgatgctgatgagcttaccaaatggtctttttaccgagctcttatagctgagtttattgcaacacttttgtttctttacgtgacggttttgaccgttatcgggtacaagagcactactgatccaacgttaccagacgttgatgagtgtggtggtgttggaatacttggtattgcatgggcttttggtggcatgatctttgttcttgtttattgcactgctggtatctctggaggacacattaaccctgctgtgacattcgggttatttttggcaaggaaggtgtcattaattagagcagtaatgtacatgctagcacaatgtttgggtgcaatctgtggtgttggtttagtcaaagctttccaaagttcctactacaataggtatggtggtggggccaacactttggccgatggttacaacaagggcactggactaggtgccgaaattattggcacctttgtccttgtctacaccgtcttctctgctactgaccctaagagaagtgcgcgagactcccacgttcctgttttggcaccactgcccattgggtttgcagtcttcatggttcacttagccaccattcccatcactggtaccggaatcaaccccgctagaagctttggcgcagccgtgatttacaacaatgaaaaggcttgggatgaccaatggattttctgggtcggaccatttttgggtgctgcagccgcagcattctaccaccaatttgtacttagagccggagccattaaagcacttggttctttcagaagcaatgcctaaatcgaaagatgatgaatatgtatatccatgcaaaaataataaacgaacgacgcggtcaaagtttcatctagagtccaattcgaggcgttaaaatggatggatatacgagtgtgg

SEQ ID NO: 15123 - DNA, 1146 bp, Cichorium intybus
gaaactcttatctttctctctgtcaacatgacaaaagacgtggcggaggaggggtcgttctcgtcgaaggactaccacgacccacctccggcggcgttcatagaccctaaggagctgaccaagtggtccctttacagagctgtgatcgccgagttcgttgccacccttctcttcctttacattactgtcttgacagttatcggttacaagagccagatcgacaagggcggcgacccctgcggcggcgttggtgtcttgggtattgcgtgggcctttggtggcatgatattcgttctcgtttactgcactgccggcatctccggtggtcacattaatccagctgtgaccttcggtctgtttctggctcgtaaggtctcactcccacgagccatcctgtacatggcggctcagtgcttaggagccatttgtggtgtgggcttagtgaaggctttcaacaagacttactacaacaactatggtggcggtgccaacgagcttgccgatggttacaacaaaggcaccggcttgggtgctgagatcatcggaactttcgttcttgtttacaccgtcttctccgccaccgatcccaaaaggagtgcccgagactcccatgttcccgtgttagcacctttacccatcggatttgcagtgttcatggttcacttggccacgattcccataaccggaacgggtattaatccggcgaggagttttggagcggcggttatttacaacaaggagaaagcctgggatgatcaatggatattctgggttggaccatttatcggcgcagccatcgccgccttctaccaccagttcatcttgagagccgctgcagccaaggcccttggatccttcaggagcagcacccatgtttgagatatggattcagttttcgataaaaggttggggagaaagtgtttgtatgttaatgaaagtatgtggtattttgatgttacgagtgtctatatgtcttaattaaggttttattgggaacgatggaagtgcaatgtaaatgcttcttagggtacccccgcccatcatgttattcttgccgcttgaaaactttgtattactcaaattgctgacaaatcttttcaatgttattgagattattgttttgttaaatatttaaatgtttagtaa

SEQ ID NO: 15124 - DNA, 1180 bp, Echinochloa colona
ggccatgggcaaggacgacgtgatcgagagcggcgccggcggcggcgagttcgccgccaaggactacacggaccctccccctgcccctctgatcgacgcggcggagctgggctcctggtccctctaccgcgccgtcatcgccgagttcatcgcgacgctgctcttcctctacatcaccgtgctcaccgtcatcgggtacaagcaccagacggacgtgcagggcgccggcggcgacgcgtgcggcggcgtgggcgtgctgggcatcgcctgggccttcggcggcatgatcttcgtcctcgtctactgcaccgccggcatctccggcggccacatcaaccccgccgtcaccttcggcctcttcctcgcgcgcaaggtctcgctggtgcgcgccgtgctctacatcgtggcgcagtgcctcggcgccatctgcggcgtcggcctcgtcaaggccttccagagcgcctacttcgacaggtacggcggcggcgccaactccctcgcctccggctactcccgcggcaccggcctcggcgccgagatcatcggcaccttcgtcctcgtctacaccgtcttctccgccaccgaccccaagcgcaacgcccgcgactcccacgttccggtgttggcgcccctccccatcggcttcgccgtgttcatggtccacctcgccaccatccccgtcaccggcaccggcatcaacccggccaggagcctcggcgccgccgtcatctacaacaagtccaagccatgggatgaccactggatcttctgggtcggccctctcgtgggtgcggccattgcggcgttctaccaccagtacatcctccgggccggcgccatcaaggccctcggctccttcaggagcaacgcctgatgaggcttcttccatgtcgctgtgagcttgcggaatcagcatgttgaagcaatggcgatcgacgacgacgctggaattgaaggggagaattaataagtctgcaacaatcgaagtcgtgccgctggtcgttttgtttcagcagctgcgtgcgtgaatttggcttccatcatcatcatcatcctgtaatcaaccgtgtgttcgtaaccttctgtcgagggattattccgtcgcctctcctctcctcttctgctagtagcatgtatgtctatttaattattattatgtagcgacgatcatcatcatcca

SEQ ID NO: 15125 - DNA, 1100 bp, Tabernaemontana elegans
tctcttggctctttttccatttctgggcttctcttctctgcactcttttctatacacatttttgtgtttgtggtttttgagtgtggtaaatggcaaaagacttgggagtggccgagcatggttcttttactgccaaggactaccatgatccaccaccagaaccgctcattgatcccgaagaattgaccaaatggtcattctacagagccctcattgctgaattcatagcaacacttcttttcctttacgtgacagtcctcactgttattggctacaagagccagattgcgcctcatgactcgctacctgctggagacccctgcggtggtgtgggaattcttggtattgcatgggcctttggtggcatgatctttgttcttgtctactgcactgctggaatttctggtgggcacattaacccggcagtgacctttgggctatttttggctcgcaaggtgtcattgattagagctgtgatgtacatggtggctcagagtctaggagccatatgtggtgtggggctggtgaaggccttccagaaggcttactttgacagatacggcggtggcgcaaatgagctccaacctggctacagcaccggagttggtttggccgccgagatcatcggaacatttgttcttgtctacacagtcttctctgccactgatcccaagaggaatgccagagattctcatgtccctgttttggcaccgcttccaattggatttgcagtattcatggtccatttggccacaatcccagtcacaggcactggtattaaccctgctagaagtcttggatctgctgtcatctacaaccagaagaaagcttgggatgaccattggattttctgggttggaccattcataggtgcagcaattgcagccttctaccaccagtttatcttgagagcaggagctgttaaggcacttggttcattcaggagcagctcacatgtgtgatgaaatgtcttcctcttcctcttcttcatcttcatccatggtttttagcggaccaaatttcagccttgagaggaaaaagatgatatttcaaataaagtgagaaatagagagggtaataatattactagtgtttgggtt

SEQ ID NO: 15126 - DNA, 1139 bp, Musa acuminata
aataaccccactccggctcagggtcgaagcactcactgcacgatccccagctctcctctcgacagatggccaaggacgaggaggcggcagcaggccacggcgagtacgccgtgaaggactacacggaccctccgccggcgcccctcatcgactgggaggagctgaccaagtggtcgctgtaccgcgcggcgatcgccgagttcatcgccaccatgctcttcctgtacgtcaccgtcgccacggtcatcgggtacaagcaccagtccgaccccaacgtcaaccccaccgacgctgcctgcagcggcgtcggcatcctcggcatcgcctgggccttcggcggcatgatcttcatcctcgtctactgcaccgccggcatctccggtggccacataaacccggcggtgacgtttgggctgttcctggcacgaaaggtctccctcatccgcgcgctgctctacatgatcgcccagtgcttgggagcgatctgtggggttgggctggtgaagggattccagaaggccttcttcgtccgctacggcggcggcgccaacgagctcagcgacggctactccaagggcaccggccttgccgcagagatcatcggcaccttcgtcctcgtctacaccgtattctccgccaccgaccccaagcgcagcgcccgcgactcccatgtgccggttctggcgccactcccgatcgggttcgcagttttcatggttcacctcgccacgattcccatcaccggcactggcatcaacccggcgaggagctttggagctgctgtcatctacaacaaggacaaggcttgggacgaccagtggatattctgggtggggcctctcatcggtgccgccattgccgcagcttatcaccaatacatcctaagagcaggagctgtcaaagctttgggttctttccggagcaatgcatgatcacctcgtcgaatggaatgatggttggagtccagtggtggcaaatgccatgtatcatctctctctttctctctctctctgtctcatctgtctttgtactacttccgttttccaatcaaagtgttgccactcgagtcatcaaatcgaaaagtaaaaaaggattgttcgtcttcagccatcttatagctaagaggatgggaatgctcg

SEQ ID NO: 15127 - DNA, 1335 bp, Cannabis sativa
caactccctatactcccctccatatccctacctcttttctttctctatccttatcttttttctctctctctctctgcatagttcagtctttaataattccgccattaaagcggaacctataagctttaaaactttaactaaacaaagaaccagctaaagcatcaccatgaccaaagacatagaagtaacaggaactcacaaggattaccacgacccacctccggcggcatttttcgacactgccgagctcggaaaatggtctttctacagagccttaatagccgagttcgttgctacccttctctttctctacatcactgttttaaccgttatcggttacaaatctcaaatcgaccctaaagccggcggcgaccagtgtggtggagttggtattctcggtatcgcttgggcttttggaggcatgattttcgttctcgtttactgcactgccggaatttcagggggtcacattaacccggcggtgacatttgggttgttgttggctcggaaggtttcgctgattcgagcggtgttgtacatggtggctcagagtttgggagccatagctggagttgggcttgttaaggcctttcaaagtgcttactacgttaggtacggcggcggcgccaatgagctagctgacgggtacagtaccggcgtcggcttgggagctgagattgttgggacctttgttttggtttacacagtcttctccgccactgaccccaagagagttgccagagattctcatgttccggttttggcaccactaccaattgggtttgctgtgttcatggttcacttggccacaattccggtcacgggtacgggcatcaacccggctagaagtcttggagccgccgttatctacaacaatgaaaaggcttgggatgaccattggatgttctgggttggaccctttattggtgcagccattgcagctttctaccatcagtttatcttgagagcaggagctgctaaggctcttgggtcattcaggagtggctctcatcatgtttaattcttaaggctacttaattatattacttccttctatattggggtaatatgatcaatcataatattatcaatagaaaattaaattattattattgttagtgttcttttttcctgcttattaatgtatttgtgcttttattattatgaattatggaaatgtagatacattctattattgaaggggggttgagcttgtagtttgtactttttactgattattattctctctaagcaaactctctcccccctttgaatgtactttttaattctattcttgtctatcgatttcctgagttgtttgtcatgttctcttta

SEQ ID NO: 15128 - DNA, 998 bp, Chrysanthemum coronarium
gacccccacaactcacttccctttatatacaccaccttcccatattcccatcacaccatcatcttcccacacattaattagaaacacacttacacacataatgactaaagacatgccagagcaagagcaaggttcattcacagcaaaagactaccacgacccaccacctgcaaagttttttgacagccaagagctgacaaaatggtcattttatagagctttgatagctgagttcatagcaacacttttgtttctttatataactgttttgacagttattggttacaagagtcagattgctaatggaaatgatgcttgtggtggtgttggtgttttgggtattgcttgggcttttggtggcatgattttcattcttgtttattgcactgctggtatttctggtggccacattaacccagccgtgacgtttggtctatttctggctcgaaaagtgtcattgccccgagccatcatgtacatggtggctcagtgcttaggagccatttgtggtgttggcttagtcaagtcttttcataagacttactataacacctttggtggtggtgccaatgagctagccgatggctacaacaaaggcaccgggttgggtgccgagattattggtacttttgttcttgtctacactgtcttctcagctactgatcccaagaggagcgctagagactcccatgtccccgtgttggcaccactaccaatcgggttcgctgtgttcatggttcacctagccaccattcccatcactggaaccggaattaatcctgctaggagctttggagccgcggttatttacaacaaggagaaggcttgggatgatcaatggatattttgggtcggacccttcattggagctgccattgcggcattctaccaccaattcatcttgagagccggtgcagccaaagcccttggatctttcagaagcgctacccatgtttgagatcttttcagaaggcatgtttcattatttacaaaaattg

SEQ ID NO: 15129 - DNA, 1175 bp, Chrysanthemum coronarium
ttcattcaacctgatattctcaggaagctcacctactccaaaaatagccgttacacactctacacccttcttatcttcattctcctttatataaacaccacatgcaacacactcactctcacaccatttatctttaacctaaacacacacacataaacaaaaacctagttaaaacattgttcaagatgacaaaagatgtccctgagcaaggttcattctcagctaaggactaccatgaccctccaccagcacctttgattgaccctgcagagctcacaaagtggtcattctacagggctttgattgctgagtttattgcaactcttttgtttctgtacataactgttttgactgttattgggtacaaaagtactactgatcctattctgaagaacgtagacccgtgtggtggtgttggtattcttggtattgcttgggcttttggtggtatgatctttgttcttgtttactgcactgctggtatctctggaggtcacattaacccagcagtgacattcggtctattcctagcacgtaaagtatcattgatccgagcctttgggtacatggtggctcagtgtctaggagccatctgtggtgttggtctagtcaaagctttcaacaaaagtctatacaacaggtatggcggaggagccaactctctagccgatggttacaacaaaggaaccggcctcggagctgagatcatcggcactttcgtccttgtttacaccgtcttttcggccactgatcctaagagaagcgcccgtgactcccatgttcctgtcttggcacctcttcctatcggattcgccgtgttcatggttcacttggccactattcccattaccggtaccggtattaacccagctcgtagtcttggagccgctgtgatctacaacaatgaaaaaatctgggatgaccagtggatattctgggtgggaccttttattggagcagcaattgcagccttttatcaccaatttatattgagagcaggtgcaatcaaggctcttggatctttcagaagcagtacccaagtttaataaatcacatttttattgtttcttaaattattgtatcctttatttttaatcccaaaattgtaatttcaaataatatttatggttgaattttagtttttgcccaagtgaaatatggtcattttgattggc

SEQ ID NO: 15130 - DNA, 1035 bp, Chrysanthemum coronarium
tctcaacacaaaacacacacaaaaaaaacattgttctaacgttgtcaaaatgactaaagatgtccctgagcaaggttcattctcagctaaggactaccatgaccctccaccagcacccttgtttgaccctggggagttgacaaagtggtctttctacagggctttgattgctgagtttattgctactcttttgtttctgtacataactgttttgactgttattgggtacaaaagtactactgatcctcttctgaaggcagacccgtgtggtggtgttggtattcttggtattgcttgggcttttggtggtatgatctttgttcttgtttactgcactgctggtatctctggaggtcacattaacccagcagtgacattcggtctattcctagcacgtaaagtgtcattgatccgagcctttgggtacatggtggctcagtgtctaggagccatatgtggtgttggtctagtcaaagctttcaacaaaagcctatacaacaggtacggcggaggtgccaactctctcgccgatggttacaacaaaggaaccggcctcggagctgagattatcggcactttcgtccttgtttacaccgtcttttcagccactgatcctaagagaagtgcccgtgactcccatgttcccgtcttggcacctcttcctatcggattcgccgtgttcatggttcacttggccactattcctattaccggtaccggtattaacccggctcgaagtcttggagccgctgttatctacaacaaggaaaaaatttgggatgaccagtggatattctgggtgggaccttttattggagcagcaattgcagccttttatcaccaatttatattgagagcaggtgcaatcaaggctcttggatcattcagaagcagtacccaagtttaataatcacatttttattgtttcttaaattattgtatcctttatttttaatcccaaaattgtaatttcaaataatatttatggttgaattttagtttttgcccaagtgaaatatggtcattttgattggc

SEQ ID NO: 15131 - DNA, 924 bp, Cirsium arvense
tctttccacaacaaccaccacccagttttctctttctaaacaaccatgactaaagatgtgccggagcaaggctccttctccgccaaagactaccacgatccaccgccggcgccgtttatcgatcccggagaattgaccaaatggtctttctacagagctgtaatcgctgagttcgttgccacccttctctttctttacatcactgttttgaccgttatcggctacaaagctcagaccgaccctgccaaaaacctcgaccagtgcgggggcgttggaattctcggcatcgcttgggccttcggcggcatgatttttgttcttgtttactgcaccgccggtatctccggaggacatattaacccagcagtgacatttggtctatttctggctcgtaaagtgtcactgatccgtgcctttatgtacatggtggctcagtgtttaggagccatttgtggtgtgggtttcgtcaagcttttccacaaaacctactacaacaattacggcggtggagccaatgaactcgccgccggctacaataaaggcaccggacttggcgctgagatcatcggaactttcgtcctcgtctacaccgtcttttccgccaccgatcccaaaagaagcgcacgagactcccatgttcctgttttggcaccacttccaattgggttcgccgtcttcatggtccaccttgccactattccgatcaccggtacaggaattaaccccgccagaagtcttggagctgcggtcatctacaacaaggaaaaagcttgggatgatcagtggatattctgggtgggacccttcatcggagcagccattgcggctttctaccaccagtttatattgagagcaggtgcaatcaaagctcttggatccttcagaagcagctctcatgtttgatttgagattttaaattattgt

SEQ ID NO: 15132 - DNA, 960 bp, Cyclamen graecum
cacacacacacgcaccccaacaaagaagctagacggtacgatgtcgaaagaagtggaggtggccgaggcaggggcggagttctcgggcaaggactacgaggacccgccaccagctgagcttatagacctggaagagatcaccaagtggtccttctaccgagccatcatcgctgagttcgtcgccacgcttctcttcctgtacgtcaccgtcctcaccgtcatcggctacaagagccagtccgacaccaacacgcccactggcgacatctgcgggggagtcggcatcctcggcatagcctgggcctttggcggcatgattttcatcctcgtctactgcaccgctggcatttccggtgggcacatcaacccggccgtgaccttcgggttgttcttggctcgcaaggtgtcactgatccgcgcactattgtacatggtggcgcagtgtgccggtgcaatctgtggcgtaggactggtgaaagcgttccagaagtcgtactataaccgatatggtggcggagccaacgaggtgcaactcgggtacaacaagggcacggctctaggggccgagataatcgggaccttcgttttggtctacaccgtcttctcagccactgatcccaagcggagcgccagagactcccatgttcctgtgttggcaccacttccgattgggttcgcggtgttcatggtgcacttggccacgatcccggtgactggtacgggtattaacccggccaggagcttcggagctgctgttatttacaacgaagagaaggcctgggatgatcaatggatattttgggtgggaccattcataggagcagcggtagcagccttctatcaccagttcatcctaagggctgcagccattaaggctctgggttccttccgaagcaattcctaaattcaaattttgcccacctttgtaaattataatttatcggaaattaaaataattat

SEQ ID NO: 15133 - DNA, 1347 bp, Humulus lupulus
tctcccccaacactctcctccattcctattctctctctctctctctctagagtcttctatacgtacctagttactcttcatcttcaagtttcgccaattaaaacgcagcttataagctttaatttttactgaacaaagaagctaagcatgacgaaagacttagaagtaacagagagaggttccttttctcacaaggactaccacgacccacctccggcggcactctttgataccgccgagcttggcaaatggtctttctacagagccttaatcgccgagttcgttgctacccttctcttcctatacatcactgttttgactgtcatcggttacaaatcccagatcgatcctaaaaacaacgacccctgcggcggagtcggcattctcggcatcgcttgggcttttggaggcatgattttcgttctcgtttactgcactgccggaatttcagggggccacattaacccggcagtgacatttgggctgttgttggctcggaaggtgtccctgattcgagcggtgctgtacatggtggctcagagtttgggagccatcgctggagttgggctggtgaaggcctttcaaagtgctttctacgtcaagtacggcggtggcgccaatgagcttgctgaagggtatagtaccggtgtggggttgggagctgaaattgttgggacctttgttttggtctacacggttttctccgccactgaccccaagagagttgccagagattctcatgttccggttttggcaccactcccaattgggttcgccgtgttcatggttcacttggccaccatcccggtcaccggcaccggcatcaaccctgctagaagtcttggagctgccgttatctacaacaatgaaaaggcttgggatgaccattggatattctgggttggacccttcattggtgcagccattgcagctttctaccatcagtttatcttgagagcaggagctgctaaggctcttgggtccttcaggagcggctccaatgtttaatttttctggcttatatattatattacttccttcttctattgggataaattaagcattaagctaatattgaaggaaggattagacagatcatataatatcggaagaaaaaagtttaaattattattagtagtgttttttttctttctgcttatttatgtatttgtgctttcattattatgaactatgaaaatctagatacattctattatcagagggcaagagctttttgtttgtaccctttactgattattttctctaagccgttatgtaccgtttactgattattttctctaagccgttatgtactttttaattctattcttgtctatcgtttctgag

SEQ ID NO: 15134 - DNA, 958 bp, Ananas comosus
cacacacacgcaccccaacaaagaagctagacggtacgatgtcgaaagaagtggaggtggccgaggcaggggcggagttctcgggcaaggactacgaggacccgccaccagctgagcttatagacctggaagagatcaccaagtggtccttctaccgagccatcatcgctgagttcgtcgccacgcttctcttcctgtacgtcaccgtcctcaccgtcatcggctacaagagccagtccgacaccaacacgcccactggcgacatctgcgggggagtcggcatcctcggcatagcctgggcctttggcggcatgattttcatcctcgtctactgcaccgctggcatttccggtgggcacatcaacccggccgtgaccttcgggttgttcttggctcgcaaggtgtcactgatccgcgcactattgtacatggtggcgcagtgtgccggtgcaatctgtggcgtaggactggtgaaagcgttccagaagtcgtactataaccgatatggtggcggagccaacgaggtgcaactcgggtacaacaagggcacggctctaggggccgagataatcgggaccttcgttttggtctacaccgtcttctcagccactgatcccaagcggagcgccagagactcccatgttcctgtgttggcaccacttccgattgggttcgcggtgttcatggtgcacttggccacgatcccggtgactggtacgggtattaacccggccaggagcttcggagctgctgttatttacaacgaagagaaggcctgggatgatcaatggatattttgggtgggaccattcataggagcagcggtagcagccttctatcaccagttcatcctaagggctgcagccattaaggctctgggttccttccgaagcaattcctaaattcaaattttgcccacctttgtaaattataatttatcggaaattaaaataattat

SEQ ID NO: 15135 - DNA, 1285 bp, Zea mays
actcatccattccatcatcccctttgcaagtatagtctctctgctaagcgaagcgaagcttcaagctagtctcggcggctctagaagacgatgggcaaggacgacgtgatcgagagcggcgctggcggcggcgagttcgctgccaaggactacacggaccctcccccggcgccgctgatcgacgcggcggagctggggtcctggtcgctgtaccgcgccgtgatcgccgagttcatcgccacgctgctgttcctgtacatcacggtggccaccgtgatcgggtacaagcaccagacggacgcgtcggcgtcgggcgccgacgcggcgtgcggcggcgtgggcgtgctgggcatcgcctgggccttcggcggcatgatcttcgtcctcgtctactgcaccgccggcatctcggggggccacatcaaccccgccgtcaccttcggcctcttcctggcgcgcaaggtctccctggtgcgcgcgctgctctacatcgtggcgcagtgcctcggcgccatctgcggcgtcggcctcgtcaaggcgttccagagcgcctacttcgacaggtacggcggcggcgccaactcgctcgcctccggctactcccgcggcaccggcctcggcgccgagatcatcggcaccttcgtgctcgtctacaccgtcttctccgccaccgaccccaagcgcaacgcccgcgactcccacgtcccggttctggctcccctccccatcggcttcgccgtgttcatggtgcacctggccaccatccccgtcaccggcaccggcatcaacccggccaggagcctgggcgccgccgtcatctacaacaaggacaagccctgggacgaccactggatcttctgggtgggccctctcgtgggcgctgccatcgcggccttctaccaccagtacatcctccgggctggcgccatcaaggccctcggctccttcaggagcaacgcgtgatgagcggggcttggctgtggagcaatggcgggcgacctacgggcggggggccgtgagcgaggagaatgccatcattcatcgatcgacttgggtgccggtggttggttcgggtcgccttttttttgtttcagcagctgctgcgttgcgcgcgtgcgtgagatttggtttggtttcgttcccctgcaatgtaatcatgtcgtgactctcaagggattattccgctctgctcttatggtctctgttttctatttaatgattgttattaccatgtagcagtaaccatcgtcatcagtgagaaccttgttgcttctgtctaaatcaa

SEQ ID NO: 15136 - DNA, 1613 bp, Panicum virgatum
cggcatcattggagcagcaaaacaaaacccaaaaggcggaccctctcttaaaaacaagaaaggaaagcccattcaacagaaaccaaaccaagaagaagaagaaaataataaatattcggaattgatggaagctgctcaattttctgttccatcaagcaatatacaatcaggcgggcatggcccacccccagccttgcagcactattgtgttgtcacttacctactctccccctccttccataaataccgccaccctctccctctcactcccccactctcagcccattccttccaagccacctctgctctgctcactctgtcctcctcgcggttgctaagctaagctaagcaaagcttaaggcaagctaggcggcatgggcaaggacgacgtgatcgagggcggcgccggcggcggcgagttcgcggccaaggactacacggacccgcccccggcaccgctgatcgacgcggcggagctggggtcgtggtcgctgtaccgcgccatgatcgccgagttcatcgcgacgctgctcttcctctacatcaccgtggccaccgtcatcgggtacaagcaccagacggatgcggcggcgtcgggcgccgacgcggcgtgcggcggcgtgggcgtgctgggcatcgcctgggccttcggcggcatgatcttcgtgctcgtctactgcaccgccggcatctcgggaggccacatcaacccggccgtcaccttcgggctcttcctggcgcgcaaggtctccctggtccgcgcgctgctctacatggtggcgcagtgcctgggcgccatctgcggcgtcggcctcgtcaaggccttccagagcgcctacttcgaccgctacggcggcggcgccaactcgctcgcctccggctactcccgcggcaccggcctcggcgccgagatcatcggcaccttcgtcctcgtctacaccgtcttctccgccaccgaccccaagcgcaacgcccgcgactcccacgtcccggtgctggcgccgctccccatcgggttcgccgtgttcatggtccacctggccaccatccccgtcaccggcaccggcatcaaccccgccaggagcctcggcgccgccgtcatctacaacaaggacaagccatgggatgaccactggatcttctgggtcggccccttcgtcggcgcggccatcgccgccttctaccaccagtacatcctccgggccggcgccatcaaggccctcggctccttcaggagcaacgcgtgagccgcctgagtagccttcttcctgtgacctgtgagcttgcaaaaggctgcgtgctgaagcaatggcggtcgacgctgggggagaataagatgaaagtactgccgctggtcgtcttgtttcagcagctgcgtgcgtgaatttggcttcctagctccttcctcctgtaatcaaccatgtgtcgtgatctgtctctcgaggggttctatcatctccactcctattctcctagcatgtacctctatttaatcattatgtagcgacgatcaccaccatcatcatcatcagtgaaaaccttgcttctgtctaaatcaacctgtccactgaatcctaaggtctcaagcatcattgcatcttgattgtgcgtct

SEQ ID NO: 15137 - DNA, 1314 bp, Phaseolus vulgaris
tttggcacacagcatatcacacacagttaactagctatagcagtgattgaggcttgagaaatggctaaagatgttgaggttcaagagcaaggagaatacgctgccaaagactatcaggaccctcctccagcacccttgttcgaccctgaagagctcacacagtggtccttctatagagcccttatcgctgagttcatagctacccttctcttcctctatgtcactgtgctaaccattattggctacaaaagacagactgatgccaacgttggtggcaccgaatgtgatggggttggcattttgggcatcgcttgggcctttggtggcatgatcttcatccttgtttactgcactgccggtatttcaggaggacacataaacccggctgtgacttttgggctgttcctaggacgcaaggtgtcgttgataagggcgttgttgtacatagtagcacagtgtgctggtgctatctgtggcactggactggccaaggggttccaaaaggcatactacaacaggtatggaggtggtgctaactctgttgctgatggctacaacaagggtactgctttgggtgctgagattattggtaccttcgttcttgtctacactgtcttctctgccactgatcctaagaggaacgctagggactcccatgttcctgtactagcacccctccccattggctttgctgtgttcatggttcacttggctacaatcccagttactggcactggcattaacccagcaaggagttttggagcagctgtaatctacaacaaagaaaaaatctgggatgatcagtggattttctgggttggaccaattattggagcagcagtggcagcattctaccaccaatacatccttagagcagcagctatcaaggcacttggatcattcaggagcaatgcttaattacttaattaataattaagctacttttgtagcttcttaatctccaacaaggctatggtgtttccacgaagaataataatttgtatgttgaggagtgctagtctccctagtttaggctttttcgtccttcctttcatcagctacagttgttgtggggtttgcaggataaggccaaaaccatatggggggcatcaaattgtagataagcatggttgtgtccaagggtgaattttgcatcccttttgtgtcttttctctttttaacttccttgtatatgtattcccagtgttcatcttttcataattaagtattcatcttttcttaatcatcatcatcatccatgtatgtaatgtaccttgacttgagtaatatcattaagttcctggcttctctaaa

SEQ ID NO: 15138 - DNA, 1102 bp, Amsonia hubrichtii
agagaggtaaatggcaaaggacatagctgagcatggttcttttacaaccaaggactaccatgatccaccaccagcacctctcattgatcctgcagaattgaccaaatggtcattctacagagctctcattgctgaattcatagcaacccttcttttcctttacatcacagtcctcactgttattggctacaagagccagactgatgctgacttgcatcttgaccaatgcggtggtgtgggagttcttggtattgcatgggcctttggtggcatgatctttgttcttgtctactgcactgctggaatttctggtggacacattaacccagcagtgacctttggcctattgttggcacgcaaggtttcactgattcgagctgtgatgtacatggtggctcagagtctaggagccatatgtggtgtgggactcgtcaaggctttccagaaggcttactttgacagatacggcggtggcgcaaatgaactccaaaagggttacagtattggagttggtttggccgccgagatcatcggaacatttgttcttgtctacactgtcttctctgctactgatcccaagaggagtgccagagattcccatgtccctgttttggcacccctgccaattggatttgcagttttcatggtccatttggccacaattccagtcactggcactggcattaaccctgctagaagtcttggatctgctgtcatctacaaccagaagaaagcttgggatgaccattggattttctgggctggaccattcataggtgcagctattgcagccttctaccaccagtttatcttgagagcaggagctgttaaggcacttagttcattcaggagcggctcacatgtttgatgaaaatgtctctctcttcctacttcatcttctatggttttttagcagatcaaaattgagtcttcagagaggaaaagatgatatttcaaataaagcgatagagtggaataatattattagtatttgtgtttggggaaatctttttgagtggctcattttctcatttattgtgtctaaagaagattttgggtgatgggaatgcagtgtactcaatcagagccacacaagtgtaga

SEQ ID NO: 15139 - DNA, 1963 bp, Cocos nucifera
aaaatttagctgcccgggaggatacataggtcgatatagatgaggaaggacatggaggctggggctgagttcacggcgaaggactacacggaccccccgccggcgccgctggtcgacgcggaggagctgaccaagtggtcgctgtaccgggcggtgatcgcggaattcatagcgacgctgctgttcctctacatcacggtggcgacggtgatcgggtacaagcaccagtccgatcccaacgtgaccggtcccgatgcggcctgcagcggtgtcgggatccttggcatcgcgtgggctttcggcgggatgatcttcgtcctcgtctactgcaccgctggaatctccggcggtcacataaacccggcggtgacgttcgggctgttcctggctcgcaaggtctccctgatccgagccctcctctacatgatcgcccagtgcctgggagccatctgtggcgtggggctcgtcaaggccttccagaaggcctactacaaccgctacggcggcggcgtcaacgagctcagttccggctactccaaggggacgggactcgccgccgagatcatcggcaccttcgtcctcgtctacaccgtcttctccgccaccgaccccaagcgcagcgcccgcgactcccatgtcccggttctagctccacttccaatcggctttgcggttttcatggtccatctgggcacaatcccgatcaccgggaccggcattaaccctgccaggagtttcggacctgccgtaatctataataatgacaaggcttgggatgaccagtggatcttctgggtgggtcctttcattggtgccgccatagccacagcttatcatcagtatatcctcagagctggtgctgtcaaggctcttgggtcttttagaagcaatgcttgatcctgaattctgttctcgtccagctttagtggtcgatgaaggaaaaaagaagagtagcgatgcatatcgagtagaatttaatttgatggaccagcgtaccatttcagtttttcgcttatccgttgcgcaaatcaacaaggaggcatcttttttcccattgcccctgcgtctgttgaatatctccacctcctatctatctatgtaatgtactcctggtcttcataagatgtaagagatacgtttgggttaactgcttccttgcaatatatttacatgagagcaactttttccttgcatgcatctttgccaaccgttttgtagttgagttgatggcatgtggttatgcaagtctcacgggggaaatcattggtgatctgttaagatacacgctaacatatcaatcagtggactttatttatctttatttatttatttgagttctgttttaagataaagatttttgataattaagcatgatgattagatttttacgtgtttgttatgatgagggttattgatgcagaatttgattgacgtcgaatcgagttggagtggaaggggatgaggttgccgtcggtgacctacaaaataaagttccgtccagagtcggtgggggtagctctggcaggaccctccaacggtcaagttagctggccaacagaaatggagtactcagtatggagtttgatagagtttcaaggaggagataagagcttagaacctggcgtaagcatgtctggagggtcctttttctaggcggagcttgttataactgccttgattaatgactgtcgtaaccgttctgatcaataccgatcattattgacttgataaatgtcgatcgttattgacttgataaatgttgatcgttattgtcgtataaccatttagtagtgggatcgtcagtaggaatccgtcgacagtctgtaagaagttcgacttctgtagaagttcggccactgaagagttcggtcgctggaggagtctgcaaggaatccgacttccgtagaagcccggtcgctggaggagtccgcaaggagtccgacttccatagaagactgaccgc

SEQ ID NO: 15140 - DNA, 1507 bp, Elaeis guineensis
aaattactccggtagccatttttctgtctatgatctgatttcgatctgaacaaacttttagctgccggggaggatatataggtcgatatagatgcggaaggacatggaggctggggctgagttcatggcgaaggactacacggacccgccgccggcgccgctggtcgacgcggaggagctgaccaagtggtcgctgtaccgggcggtgatcgcggagttcatagcgacgctgctgttcctctacatcacggtggcgacggtgatcgggtacaagcaccagtccgatcccaacgtaagcggacccgatgcggcctgcgacggtgtcgggatccttggcatcgcctgggctttcggcgggatgatcttcgtcctcgtctactgcaccgccggcatctccggcggtcacataaacccggcggtgacgttcgggctgttcctggctcgcaaggtctccctgatccgagccctcctctacatgattgcccagtgcctgggagccatctgcggcgtgggcctcgtcaaggccttccagaaggcctactacaatcgctacggcggcggcgtcaacgagctcagctctggctactccaagggaacgggactcgccgcagagatcatcggcaccttcgtcctcgtctacaccgtcttctccgccaccgaccccaagcgcagcgcccgcgactcccacgtcccggttttagctccacttccaattggctttgcggtattcatggtccatctggccacgatcccgatcaccggcaccggcattaaccctgccaggagtttgggacctgccgtaatctataataatgacaaggcttgggatgaccagtggatcttctgggtgggtcctttcattggggccgccatagccgcagcttatcatcagtatatcctcagagctggcgctatcaaggctcttgggtcttttagaagcaatgcttgatcctgaattctgttgttgtccagctgtagtggtcaatgaaggaataaagaagagtcgcaatgcatatcgagtggaattttgatggggccgcaccatttcagtatttttttttggcttatcaattgtgcaaatcaacaaggaggcatcttttttccattgcccctgcatgcgtttgttgagtatctccacctgatcgtctattcagtcctggtcttcatgcaattaatgtaagaaatatgttcggtttgcttccttgccatatgagagcacatttccatggatgcatgcatctttgccaaccgtttaatttgtagattctgagaattaatgtgctttgggttgagttgattgtgagaagtttgtggttatgcaagtctcacgggggccgggccgggcatcattggggacacctgttccggtcctgatctagttagaacccatcctgatacacgctaacgtatcagtggtagtttatttatttatttgatcagtttctgttttaatgaagataaaggtcttcgaataaaaatggtaattagatttttacgcgtttaagtt

SEQ ID NO: 15141 - DNA, 980 bp, Centaurea maculosa
acccattatcacttcccaccttctcccatccctttccttctctctgcaacaatgactaaagatgtcgaagtggccgagcaacaccacggcgccaaggactatcacgatccacctccttcgccgctcttcgacgccgatgagctcaccaagtggtccttctaccgagctctcatcgccgagttcgtcgccactctcctcttcctctatgtcaccgtactaaccgtcatcggctacaagagccagaccgatcctctcctcaacaccgatcagtgtggcggcgttggcatcctcggtatcgcttgggccttcggcggcatgatcttcatcctcgtctactgcaccgccggtatctcaggaggacacattaatccagcggtgacgttcggtttgtttttggcgcgaaaggtgtcgttgatcagggcggtaggttatatggtagcgcagtgtttgggagcgatttgcggtgtaggtttggtgaaggctttccagagctcgtactacaaccggtacggcggtggtgctaacacgttggccgatggttacaacaaggggaccgggctcggtgctgagataatcggaacgttcgtactggtttacaccgtcttctcggctaccgatcccaagaggagtgcacgagactcccatgttcctgtattggcaccactgcccataggatttgcagtgttcatggtgcacttggccaccattccgatcaccggtaccggaattaacccggccagaagtttcggtgccgccgtgattttcaacgacgagaaggcatgggacgaccaatggatattctgggttggaccattcatcggagcgtttgctgctgccgtctaccaccagttcgtactgagagccgccgcgatcaaagcactgggttctttcagaagcaatgcttaaaacctgaaagatttcatggcttgctttgtagatatctctgaaaacttccaattgtattttgatgtaatttattt

SEQ ID NO: 15142 - DNA, 1319 bp, Cichorium intybus
catcacaactccactcacaaaccatcactcctctcgacctcaaagccatgactaaagacgttgaagtggcggagcaccacggcggcggcagcgagtacgccgccaaggactaccacgatccacctcccgcccctctcttcgacgctgaagaactcaccaaatggtccttctacagagcactcatcgcagagttcgtcgccactctcctcttcctctacgtcactgttttgaccgtcatcggatacaaaagccagacagatcctgctttaaacctcgatcagtgcggcggcgtcggaattctcggcatcgcctgggccttcggtggcatgatcttcatcctcgtctactgcaccgccggtatctccggaggacacattaacccggcggtgactttcggtttatttttggcgagaaaggtatcgttgataagggcggttggatacatgattgcacagtgtttgggtgcaatttgcggtgtaggtttggtgaaagcttttcagagctcatactacgacaggtatggcggcggtgccaacgagttggccgacggttacaacaaaggcaccggactcggagctgaaattatcggtaccttcgtccttgtttacactgtcttctcagccaccgatcccaaaagaagtgcacgagactcccatgttcctgtattggcaccactacccataggattcgccgttttcatggtgcacttggccaccatcccgatcaccggcaccggtatcaacccggcgagaagttttggcgccgccgtgatttacaacaaggctaaggcctgggacgaccaatggatattctgggtgggaccgttcatcggagcgtttgccgccgccgtctaccaccagtttgtactgagagccgccgcaatcaaagcactcggttctttcagaagcaatgcttaagcttgaaagatgttcatccatggcggttcatgccttgtagatatctttggaaattccctttcaaaaatttggggttcatgtaattgttatttattttctttgggtcttgttttatgtgaaaaatgtaagtgtcgtttttttttcttttttctttttttaaatttgattttgtgatctaagtatttcaagatcaaaaggtgtgcagatatgtaatctaagagctcatgttcttatcctaaaatttatgaaaaaatgtttggttcattaaagaattacaatatttttgtgatttgatgtgcaatgaaaaagagtttaccttatcttccttttattgtaacggtatattttgacttttacaaattgtaaattattaatttcagaaacataaatgtgttaagttaa

SEQ ID NO: 15143 - DNA, 1297 bp, Leymus cinereus x Leymus triticoides
ctggaagaattcgcggccgcacacaagctccacctccatttttctagtcagtctcttgcagggctgcagcgagaagaaacacacagacacactgatggcgaaggacgaggtgatggagaccggcggcggcggcgacttcgcggccaaggactacacggacccgccgccggcccctctgatcgacgcggcggagctggcctcgtggtcgctgtaccgcgcggtcatcgccgagttcatcgccacgctgctcttcctctacatcacggtggccaccgtgatcgggtacaagcaccagacggacgcggcggtgaacggcgccgacgcggcgtgcggcggcgtgggcgtcctcggcatcgcgtgggccttcggcggcatgatcttcgtcctcgtctactgcaccgccggcatctccggcgggcacatcaacccggccgtgacgttcgggctcttcctggcgcgcaaggtgtccctggtccgcgcgctgctctacatggtcgcgcagtgcctcggcgccatgtgcggggtcggcctcgtcaaggcgttccagagcgcctacttcgtcaggtacggcggcggcgccaacacgctcgccgccggctactccaagggcaccggcctcgccgcggagatcatcggcaccttcgtgctcgtgtacaccgtcttctccgccactgaccccaagcgcagcgcacgcgactctcacgtcccggtgttggcgcccctcccgatcggcttcgccgtgttcatggtccacctggccaccattccgatcaccggcacgggcatcaacccggccaggagcctgggggccgccgtcatctacaacaaggacaaggcctgggatgatcagtggatcttctgggtcggccccatgatcggcgcggcgatcgcggccttctaccaccagtacatcctcagggccggcgccatcaaggccctcggctccttcaggagcaacgcgtaacaagttatcatccatgtcatctgcgtccaagatggaagcaatggcgacctgtcttgtgtccatccagagagaaaggcgcttttacaacttatcaacagttcagttcgcccgcaacggtcttatgtgtcggcagctgcatatgcgtacgtggttggcttccatgtgctcagctcagtcctgcgtgccgtgtgttgtaattcggtccatgggatcgcttgtcttaaaattagcctgcattccttttcctatttaaatttagcgaccatatgatccatccaacgtcgccaccttctatctaagacatcaatccaccaaaaaaaaaaaacctcgtgc

SEQ ID NO: 15144 - DNA, 1118 bp, Amaranthus tuberculatus
aaaacacacactactttctcactctaactactttctctctctaaaaagtcaaaaagtcaaaggaagccatgactaaggatgtggaagcagtgtcagagcaaccaagatcatctgaatactcagcaaaagactaccatgatcctccaccaactccctttattgatatggaggagtttggaaaatggtctttttatagggctattatagctgaatttgttgctacacttctgtttttatacataactgttcttaccgttattggttacaagagccaaactgataccactgccggcggtgatgattgtggcggtgtcggtatcctcggtatcgcttgggcttttggtggcatgatctttatccttgtttactgcactgccggaatctcaggaggacacatcaacccagcagtgacatttggattattcctagcaaggaaagtgtccctaccaagggcatttttgtacatggtagcacaatgtctaggagccatatgtggagttgggttagtaaaggcattccaaaaagcatactatgttaggtatggtggaggtgttaaccaaatgtcacctggctataacaaaggaactggacttggtgctgaaattattggtacctttgttcttgtttacactgtttttgctgctactgaccctaagaggaatgctagggactcccatgttcctgttttggcaccacttcccattggatttgcagtatttatggttcatttagctaccattccagttactggtacaggcatcaaccctgctaggagttttggagctgcagtcatctttaaccatgaaaaatcatggaatgaacactggattttctgggtgggcccatttgttggagcagcaattgcagcattctatcatcaatacattctaagggctggagcaatcaaagctcttggatcattcagaagcactgcttaaattaattgaagaaaataataaatctttgttttaattaattattatatggggtttttattaaggaaggaaagaggagaaaccattaaaattgtagatataattaaaaatggggtcaacaagggactaaattattatggttcaatttggtttctttctttttattgtttggtgtaagctttt

SEQ ID NO: 15145 - DNA, 1128 bp, Ambrosia trifida
aaactactaaacgataaactcttatctccctacaacgtccattaaataccaacctttcatcaccacaaactccatccctcaatctctaaacacaaccacaatgaccaaagacattgaagtgtctgagcaccaccacagtggcaaagactaccatgacccgcctcctgccccattgttcgacgccaaagagctgaccaaatggtcattctatagagctctcatagctgaatttgttgccacccttctgtttctatatgtcactgtattgacagttattgggtacaagagcacgactgaccccgccttaggcacggaccagtgtggtggtgttggcaccctaggaattgcatgggcctttggtggcatgatcttcatacttgtttactgcactgccggtatctctggaggacacattaacccggctgtgacattcgggctattcttggctaggaaagtgtcattaattagggctgtttcgtacatggttgcacaatgtttgggtgcaatatgtggtgtgggtttggtcaaggctttccaaagctcctactacaacaggtatggtggtggagccaatacgttggccgacggctacaacaagggcaccggactaggtgctgaaatcatcggcacttttgttcttgtctacaccgtcttctcggctactgatcctaagagaaatgcccgagactctcatgttcctgtgttggcaccactgccaataggatttgcagtcttcatggttcacttggcaaccattccaatcaccggcaccggaatcaacccagccagaagctttggcgctgccgtgattttcaacgacgaaaaggcctgggatgatcattggcttttctgggttggaccatttctgggcgcagctgcagcagcgttctaccaccagtttatactcagagcagcggctgctaaagcacttggttctttcagaagcaatgcataattgtaagacgatgaatttatatatccatgtaaaagaataagattgtacggacgacacaattgatcgacgttaaaatagatggatatatgatcagctctgaagtgttgatttgtagatcagtgtgtttaatttccatttgagacatgtaattccattttttatttaaaaaagaa

SEQ ID NO: 15146 - DNA, 1201 bp, Flaveria ramosissima
aacttcactcacacaactattcatcattcacatctactcaccctcacacccattagccaatagcaatgactaaagacgtcgaggtggcagagcaccacggccccgggggtgagtactctggtaaagactaccaggacccgcctccggctccgtttttcgatgccgacgaactgaccaaatggtcattctatcgtgcattaatagccgagtttgttgcaaccctcctcttcctctatgtaaccgttttaaccgtcatcgggtacaaaagccaaaccgatcccgaccttaacaccgaccaatgcggtggcgtgggcatcctcgggatcgcatgggccttcgggggcatgatcttcatccttgtgtactgcactgccggtatatccggaggacacattaaccccgcggtaacgttcgggttgtttttggctagaaaggtgtcgttgatcagggcgttggggtacatggttgcgcaatgtttgggcgcgatttgcggtgtgggtttggtgaaggctttccagagctcgtactacaacaggtacggtggcggagctaatgagttagctgacggctacaacaagggcacagggctcggtgctgagattatcggcacctttgtccttgtttacaccgtcttttccgccaccgatcctaagaggagcgcaagagactcacatgttcccgtattggcaccactgcccatagggtttgcagtgttcatggttcacttagccaccattccgatcaccggcaccggcatcaaccccgccagaagcttcggggccgcggtgatctacaacaacgagaaggcttgggatgatcaatggatattctgggttggaccattcatcggagcctttgccgccgcggtctaccaccagtttgttcttagagccgccgcgatcaaagccctcgggtcattcagaagcaatgcttaagcttgaaagatgttcttctggttcttggcttgtagatatctttggaaaatatttcgtttattgtatttgtattttcttttgtagtttcgttttaatttgtaaaattcaagtgtgtgttgtgtttttttcttagtctttttaaatttgtatttgtctgtctagtgtatttcaagtatctaaatggtgtgagatatggaatttaagagcatgtacatgttcgtaaattactatagaatataggttgtctattattgtagtgttagatt

SEQ ID NO: 15147 - DNA, 962 bp, Ambrosia trifida
ttttcacttcctgtccacccacaaagctagccatgactaaagataccgaagtgaccgagcaccatggtggcagcagtgagtcaccgccaaggactaccacgacccgcctccagccccgttgttcgacgctgaagaactcaccaaatggtcgttctatcgtgcactaatagcagaattcgttgcaactctcctcttcctctacgtgactgttttgactgtcatcggatacaaaagccagaccgatccgaaattgaacctagatcagtgtgggggcgttggaatcctcggcatcgcatgggcctttggtggcatgatcttcatccttgtttactgcaccgctggtatttctggaggacacattaacccggccgtgacgttcgggctatttttggcaaggaaggtgtcgttgatcagggcggtcggatacatggtcgcgcaatgtttgggtgccatttgtggtgttggtttggtgaaggctttccaaagctcgtactacaaccgatacggtggtggtgccaacgagttggccgatggttacaacaaggggactggactcggtgctgagatcatcggcacctttgtacttgtttacaccgtcttctccgccactgatcccaagagaagtgcacgagactcacacgttcccgtattggcaccacttcctattggctttgccgtattcatggtgcacttggctactattccgatcactggcactggcatcaaccccgctagaagctttggcgccgctgtcatttacaacaacgaaaaggcttgggatgatcaatggatattctgggtgggacctttcatcggagcctttgctgccgcggtctaccaccagtttgtgcttagagccgccgcaatcaaagcacttggttcattcagaagcaatgcttaagctttaaagatgttcatcaacggcaattgttgccttgtagatatctttgggaaaaaatggt

SEQ ID NO: 15148 - DNA, 1081 bp, Conyza canadensis
cactcactcactcactctttatcctgccttcatcactccatcaccatttcactataatcataaattttgtttttctctctctttttcccttgcaaaaatgactaaagacgtagtagcggaacaaggttcattttccgccaaggactaccatgacccaccaccggcgccgttaattgacccggcggagctgaccaaatggtcattttacagagctatcattgctgagttcattgcaacacttttgtttctttatataactgttttaactgtgattggctacaagagcacaactgaccctgccttggccgctgaccaatgtggcggtgttggtattcttggtattgcttgggcttttggtggcatgatctttgttcttgtttactgcaccgccggtatctctggaggacacattaacccagcagtgacgttcggactatttttggctcgaaaagtgtcattgataagagcatttatgtacatggtggctcagggtgtgggtttggtcaaggctttaaacaaaggtctatacaacaagtacggcggaggagccaacacacttgccgacggctacaacaaaggcaccggccttggtgctgagatcatcggcacttttgtcctcgtttacaccgttttctcggccaccgatcccaaaagaagtgctcgtgactcccatgttcccgtcttggcaccactacctattgggtttgccgtatttatggttcaccttgcaactattccgatcaccggaaccggtattaacccggctaggagtcttggagctgcagttatttacaacaaggacaaagcgtgggatgatcagtggatattctgcgtgggacccttcattggggcagcaattgcagctttctatcaccaattcatattgagagcaggtgcagtcaaggctcttggatcattcagaagcagtactcatgtttgagattttgctttaaattattgttattgttgtatttttctttcaatcccaaaatttgaaaattgaaataatatttatggttgatttgaatttttagcctttcaagttgtattaatgttaaatgacatggaaactgtacaaccg

SEQ ID NO: 15149 - DNA, 1770 bp, Cicer arietinum
acaaaatgtttgaaattgaaataggcatttcaaaaagtcggagtgtgggtggggaggtggttttgtatgtgacaatgtgtggtcgatgtgaagggtcggtgaaatcaaacacatataaatattcatatcttaaagataaaataaatagtaattaattaattcacacaaagatatttcagtaataaatacttttctattaacatattgatttacttttataataataagaatgaaaagtgaaaatatatattaacaaaaaaaattgttatattttgagtgaccaacagcaaccatatatacccctctcatctcactcacttccacacttcaccattcctttccttctctaagaaatttccattcttagttaactctttttcttccaatggcaaaaaacgttgaggttgcagagcgtggctctttctctaacaaagactaccatgaccctcctccagcaccgttcattgatgctgctgaactaacaaaatggtctttttacagagcactcattgctgagttcattgcaactttgctttttctttatgttactgttttgactgttattggatatagtattcagactgatattaaagcaggtggtgatgtttgtggtggtgttggtattcttggtattgcttgggcttttggtggcatgatttttgtacttgtttattgcactgctggaatttcagggggtcacattaacccagcagtgacatttgggttatttttggctcgcaaggtgtctttaatcagagcaattatgtacatagtagctcagtgtttgggggcaatttgtggagttgggttggtgaaggctttccaaagtgcttactttgacaggtatggtggtggagctaattttctccatgatgggtatagtactggtgttggattaggtgctgagattgttggaacttttgtcttggtatacactgtgttttctgctaccgatcctaagagaagtgctagagattctcatgttccggttttggctccacttcccattggatttgctgtattcatggttcacttggccactatccctgtcactggcactggcattaatcctgctagaagtcttggttctgctgttatcctcaaccaagataagccttgggatgaccattggatcttttgggtaggaccatttgctggggcagccattgcagctttctaccaccaattcatcttaagagcaggtgcagttaaagctcttggatcattcaggagtaaccccactgtttgagtgctaatgttcatgatggttttaatggaaagaaggaaattgaaaaagagatggaattgatttattgcaatgtaatttctttgacatatctcttaattgtgtcttcaagattgtggataagtgtagatttaaagtctctttcgtgacagggggagcctttttacactttcctctgtattccactattccctttagtgtgtcatcttttttctttttaagttattctcttctttcatcctttgtactcattatatatttatggaaaaatattttaagtttaatttatgtattcctctcattttcatctctctggaattttcattgaagataatataagacataagtagtgccatagagttaaaattatactataaggaaacagatgagtaatgatgcactaatgttacatatccaattatgtaaatctaaacatgacagatgttacgtctttttttattagtataattatttattggtgttcacttactaacgaagaattgatccttttgatgtgttgatta

SEQ ID NO: 15150 - DNA, 1039 bp, Cleome gynandra
ttgtcggggtattcctatatactccactccttttctctctctctctatcattctctctcttcactacagaacaagaagaaagaaatcaaacccataaaagcaatgacgaaagacgcggcggagcatggatcattctccggcaaggactaccacgatccaccaccggctccactgttcgacgcggcggagctagggaagtggtctttctacagagcactcatcgccgaattcatcgcaacgcttctcttcctctacatcacagtcttaactgtcatcggctacaagagccaaaccgatgtcaccctcaacgccggcgccgaccagtgcggcggcgtcggaattttgggtattgcttgggccttcggtggcatgatcttcatcctcgtctactgcaccgccggaatctctggaggacacataaatccggctgtaacatttggactgttcttggcgaggaaagtgtcgctggtgagagcggttatgtacattgtggctcagtgtcttggagccatttgcggagtgggtttggtcaaatcttttcaaagctcttactacactcgatatggcggcggtgccaactcactggccgatggttacagcgtcggggttggggtcggggctgagatcatcggtaccttcgtcctcgtctacactgtcttctccgccaccgaccccaagaggaacgcccgtgactctcacgtcccggtattggctccattaccaattgggtttgctgtgttcatggttcacttagccacaattcctataaccggaactggcatcaatcctgctaggagtcttggagccgctgtcatctacaaccatgacaaggcttgggatgatcattggatcttttgggttggtccgttcgccggtgcagccattgctgcgttctaccatcagtttgtgttgagggctgcagctgctaaagctcttggttcattcaggagccaatctcatgtttgactttaaattcttgaggccaaaatgttaaatagaaaaaaatttagaaatgtgaccattgagttggacgaggaga

SEQ ID NO: 15151 - DNA, 1043 bp, Scabiosa columbaria
ctcactcactctgtttctctctctctcagacctaaaacctaaaattcagaatgacgaaagacgtggagacgactcatgagcacggcgagtacgccgccaaggactaccaggatccaccgccggccgccttattcgacgccgatgagttaaccaaatggtccttctacagagcaattattgccgagttcgttgctactcttctcttcctttacataaccgtcgccaccgttatcggctacaagagccagactgatcctaacaagcctggtgtagatccgtgtggaggcgtcggaatcctcggaatcgcttgggctttcggtggaatgatcttcatcctcgtttactgcaccgccggtatctcaggaggacacattaacccagctgtgacatttgggctatttttggcaagaaaggtgtcattagttagagcagtgatgtatatgatagcacagtgcttgggtgcaatctgtggcgtcggatttgtcaaagccttccaaagttcttactatgatagatacggtggtggcgcaaatgagttatctgctggatacaacaaaggcactggtttggctgctgagatcattggaacctttgttctggtctacaccgttttctctgctaccgaccccaagaggaacgcaagagactcccatgttcccgtattggctccacttccaattggatttgctgtgttcatggtgcatttggctacaattccaatcaccggaactggtatcaaccctgctagaagcttcggtgctgctgttatttacaacaaggagaaggcctgggatgaccaatggatgttctgggtgggaccattcatcggagctgcgatagctgcaatctatcatcaatacatattgagggccgctgctcttaaagctcttggatctttcaggagcaatgcctaaataatggacgaaacagagatgagtttcattgtttctcgacttagtaaaaatgggggagtgcggtgcccatttttaaaattgtagataaagttcccagttgtgaaatgtttgtaccgatcgtattttgta

SEQ ID NO: 15152 - DNA, 1105 bp, Gossypium hirsutum
aaaaaaaacaaaggctgtaatccaagcttctattcagttttgtaagagctatggctaaggacattgaggttggtggtgagttccaggccaaggactaccatgatcctccacccgctccattggtcgacgctcaggagttagccaagtggtctttttacagggctgtcatagctgagttcattgccactctcctctttctctacatcactgtcttgactgtgatcggttacaagacccagaccgaccctgctaagggcggtgaagattgtggcggcgttggcattctcggcattgcttgggcttttggtggcatgatctttatccttgtttactgcactgccggtatctctgggggacacatcaacccagcagtaacctttggacttttcttggctaggaaggtgtcgttggttcgagccatattttacatgggtgctcagtgtttgggagccatatgtgggtgtgggctggtcaaggccttccaaaactcgtactacaaccagtatggaggaggagccaacagcctggctgaaggatacagcactggaactggtttggcggctgaaatcatcggcacctttgtccttgtctacactgttttctctgcaactgatcccaagaggaatgcaagagactcccatatccctgtcttggcaccacttcccattgggtttgctgtgttcatggttcacttagccactattcccatcaccggaaccggtatcaacccggctcgtagtttgggggctgctgttatcttcaaccaggacaagatatgggatgaccattggatattctgggtaggaccttttattggagctgccattgccgcaatctatcaccagtttatattgagggcatccggtgctaaagctctgggatccttcaggagcagctctgccatgtaaaatctgttgaagcaagaactgtgcagccatgagttcaaagtaaaggctggcatgcttggatgaatgaaatgaagttttcttcagaccattgaatttgtaaagaataatcaaagtgtaatgcttcttctctatgcatgtggcacttatttttaatgtgcctcaaactttgctttatttaaatggagttcagttccttt

SEQ ID NO: 15153 - DNA, 1103 bp, Gossypium hirsutum
aaggctgtaatccaagcttctattcagttttgtaagagctatggctaaggacattgaggttggtggtgagttccaggccaaggactaccatgatcctccacccgctccattggtcgacgctcaggagttagccaagtggtctttttacagggctgtcattgctgagttcattgccactctcctctttctctacatcactgtcttgactgtgatcggttacaagacccagaccgaccctgctaagggcggtgaagattgtggcggcgttggcattctcggcattgcttgggcttttggtggcatgatctttatccttgtttactgcactgccggtatctctgggggacacatcaacccagcagtgacctttggacttttcttggctaggaaggtgtcgttggttcgagccatattttacatgggtgctcagtgtttgggagccatatgtgggtgtgggctggtcaaggccttccaaaactcgtactacaaccagtatggaggaggagccaacagcctggctgaaggatacagcactggaactggtttggcggctgaaatcatcggcacctttgtccttgtctacactgttttctctgcaactgatcccaagaggaatgcaagagactcccatatccctgtcttggcaccacttcccattgggtttgctgtgttcatggttcacttagccactattcccatcaccggaaccggtatcaacccggctcgtagtttgggggctgctgttatcttcaaccaggacaagatatgggatgaccattggatattctgggtaggaccttttattggagctgccattgccgcaatctatcaccagtttatattgagggcatcgggtgctaaagctctgggatccttcaggagcagctctgccatgtaaaatatgttgaagcaagaattgtgcagccatgagttcaaagtaaaggctggcatgcttggatgaatgaaatgaagttttcttcagaccattgaatttgtaaagaataatcaaagtgtaatgcttcttctctatgcatgtggcacttatttttaatgtgcctcaaactttgctttatttaaatggagttcagttccttttccttttt

SEQ ID NO: 15154 - DNA, 1165 bp, Cucumis melo
atcagcaaattctcctctgttcttctaacactcaaatttgataattgagattgtttgatttatagagctatgccgaaggatattgaagctggagggcgtggtgggtttagtgggaaggattacgaagacccaccgcctgcgccgttgatcgacgcacatgagtttgctaagtggtcattttacagagccattatagctgagtttgttgctactcttttgttcttgtatgttactgttcttaccgttattgggtataaagttcagagtgatgttaagaatggaggggagatttgtggcggcgttggaattttgggtattgcttgggcctttggtggcatgatttttgtcctcgtttactgcaccgcggggatttctgggggacatataaatccggcggtgacttttgggctgtttttggctcgtaaggtgtcgttggtgagagccatattgtacatggcggctcagagtttaggcgccatttgtggctgtgcattggtgaaggcgttccaaaacggtcattacactgagtacggtggtggagccaattccctcgccgacggctacagcaccggcactggattagccgctgagatcatcggaaccttcgttctcgtttacactgtcttttccgccaccgatcccaaaagaaatgccagagactcccacgttcccgttttggcgccacttccaattgggttcgcggtgttcatggttcatttggccacgattccaatcaccggaaccggcatcaacccagctcgaagctttggagctgcagttgttttcaaccgatccaagccatgggatgatcaatggatattttgggttggacctttcattggagctgccatagctgcaatttatcatcaattcgtattaagagcaggagcagcaaaagctctaggatcattctcaagttcttgactaaatccaataattaagcctaataattgtgtgctataagtattttggcaaaaatgccaatttggtttgtgttctgtaaaaaagaaaaaaaagggcattggctttttattttatatgcccatatgatctgcttttgctttcgtggtttttgctctctttttatgtaattacgagatgtttcatgatgtttataattaaagtgtgaatgcatcctcaatttcttgtgatacggaaaaaaaaa

SEQ ID NO: 15155 - DNA, 905 bp, Flaveria ramosissima
cacaacgggaatatttgcagtctctagcaaccatgactaaagacgtgcccgaacaaggttcgttctccgctaaggactaccacgaccctcccccggccccgttgatcgaccccgaggagctctccaaatggtcgttttatagggcggttatcgcggagttcatcgccacacttttgttcttgtatattactgtcttgactgttattggctacaagagcaccactgaccccgccttgaacgccgaccagtgcggtggcgttggtatccttggtatcgcgtgggctttcggtggcatgatctttgtccttgtttactgcactgctggtatctctggaggacacattaaccccgcggtgacattcggtctatttctggctcgtaaagtgtcgttgatccgagcgtttatgtacatggtggctcagtgtttaggagccatttgcggtgtgggtttggtgaaggctttcaacaaaagcctctacaacaggtacggcggaggagccaacgagctggccgacggctacaacaaaggcaccggcctgggtgctgaaatcatcggcacttttgttcttgtttacactgtcttttcggccaccgaccccaaaaggagtgctagagactcacatgttcctgttttggctcctcttcctattgggtttgcggtgttcatggtgcaccttgcaacaatcccgatcactggaactggtatcaacccggctaggagtcttggagccgcggtcatctacaacaacgaaaaagcatgggatgatcagtggatattctgggttggaccattcgtgggtgcagccattgcagccttctaccaccaattcatattgagagcaggtgcaatcaaagctcttggatcattcagaagcagctcacatgtttgtagatttgttcgattg

SEQ ID NO: 15156 - DNA, 1228 bp, Humulus lupulus
tctccagacattttatcaaacacttaacacactagtccactgtaagcaaaaaaacaatgactaaggacgttgaagtgaccgagggaggagagttcccggccaaggactaccacgaccctcctccgacgccgttgttcgacgccgatgaattgaccaaatggtccttctacagagctttgatcgctgagttcatcgccactctcctcttcctctacataactgtcttgaccgttatcgggtacaagagccagaccgaccccaacttacccaacgtcgacgagtgtggtggcgttggaatccttggtatcgcatgggcttttggtggcatgatcttcatccttgtttactgcaccgccggcatctctggaggacatattaacccggcagtgacattcgggctgttcttggcaagaaaagtgtctttgttaagggctgtgttgtacatggtggcgcagtgcttgggtgccatctgcggagttgggctggtgaaggccttccagagctcatactacaacaggtacggaggtggagccaacacgatggccgctggctacagcaagggagtcggtttgggtgccgagatcattggtacctttgttctcgtctacactgtcttctctgccactgatcccaagagaaatgccagagactcccacgtccctgtattggcaccgttgcctattggattcgccgtgttcatggttcacttggccactattccaatcaccggcaccggtatcaacccggctaggagtttcggagctgctgttatcttcaacagcgaaaaggcctggaatgaacactggatcttctgggttggaccattcattggcgctgccattgctgctttctaccaccaatttgttctaagagcagcggccatcaaggctctcggatccttcaggagcaatgcctagtcttaatttaaggctttttacgcatgtgttctctctatggtttccagaagaaataacaatacgaacatcaaagagtgcaaaagtctttgtttgagggttctttcaatgtgctaatgacccttttgtcctcgtatatgggattctagggaaagagaaattggattgccaagtggggattgcagataaaaagaaaatgggcaaaagggttgtattttccatcccattttccttcttctgtactctttgttgctttgcttgtatttatgtggggttattggtcgtaatttgtgtattatccttctttctctttt

SEQ ID NO: 15157 - DNA, 898 bp, Chrysanthemum coronarium
cacaaaacacacacaaaaaaacattgttctaacgttgtcaaaatgactaaagatgtccctgagcaaggttcattctcagctaaggactaccatgaccctccaccagcacccttgtttgaccctggggagttgacaaagtggtctttctacagggctttgattgctgagttcattgctactcttttgtttctttatataactgtgttgactgttattgggtacaaaagtactactgatcctgctttgaccacagacccgtgtggtggtgttggtattcttggtattgcttgggcttttggtggtatgatctttgttcttgtttactgcactgctggtatctctggaggtcacattaaccctgcagtgacattcggtctattcctagcacgtaaagtatcattgatccgagccattatgtacatggtggctcagtgtctaggagccatttgtggtgtgggcttagtcaaggctttcaacaaaagtctatacaacaggtacggcggaggagccaactctctaaccgatggttacaacaaaggaaccggtctcggagctgtagatttattcggtctacttttcgttccttgtttacaccgtcttttcggccactgatcctaagagaagtgcccgtgactcccacgttccagttttggcacctcttcctatcgggttcgccgtgttcatggttcacttggccactattcctattaccggaaccggtattaacccagcccgaagttttggagccgctgttatctacaacaaggaaaaaatttgggatgaccagtggatattctgggtgggaccctttattggagcagcaattgcagccttttatcaccaatttatattgagagcaggtgcaatcaaggctcttggatcattcagaagcagtacc

SEQ ID NO: 15158 - DNA, 1320 bp, Oryza sativa
acaagctctccgctcagctaagctctccaccattgcttgcaaagctggtcgtgtcactcctcccgttaagcttcccgcggcggcgagagcaagctaagctaggtcgggcatggggaaggacgaggtgatggagagcggcggcgccgccggcgagttcgcggccaaggactacacggacccgccgccggcgccgctgatcgacgcggcggagctggggtcgtggtcgctgtaccgcgccgtcatcgccgagttcatcgccacgctgctgttcctgtacatcaccgtggccacggtgatcgggtacaagcaccagacggacgcgtcggcctccggcgccgacgcggcgtgcggcggcgtgggcgtgctcggcatcgcgtgggcgttcggcggcatgatcttcatcctggtctactgcaccgccggcatctccggcgggcacatcaacccggcggtgacgttcgggctcttcctggcgcgcaaggtgtccctggtccgcgccatcctctacatcgtggcgcagtgcctcggcgccatctgcggcgtcggcctcgtcaaggcgttccagagcgcctacttcaacaggtacggcggcggcgccaacaccctcgccgccggctactccaagggcaccggcctcgccgccgagatcatcggcaccttcgtgctcgtctacaccgtcttctccgccaccgaccccaagcgcaacgcccgcgactcacatgtcccggtcttggcgccgctgccaatcggcttcgccgtgttcatggtccacctggcgacgatcccgatcaccggcaccggcatcaacccggccaggagcatcggagcggccgtcatcttcaacaacgagaaggcgtggcacaaccattggatcttctgggtcggcccgttcgtcggcgccgccatcgcggcgttctaccaccagtacatcctccgggccggcgccatcaaagccctcggctccttcaggagcaacgcgtgatatcaaaggagttcgagcagccattgttgggggataatggctggaaggcgttgatgaagcaattggccatgatgatgagttctaccgtgttatgattctccctttttcaaaaaaattaagttcgccgctggtcgttttgtttcagcagctgctcctcctcctgcttgtcgtgtgtgtgaagtgaacatccatgtgtttgtaatctgttttaaatcgagggatgtctcatgtgtttagcctgtactcccatttaatttagcgacgataagcatcgatgcccgcctctcctatctggaatatatcaatcagttttatcaagtggttcgccgtaattaagt

SEQ ID NO: 15159 - DNA, 1300 bp, Oryza sativa
ctcagctaagctctccaccattgcttgcaaagctggtcgtgtcactcctcccgttaagcttcccgcggcggcgagagcaagctaagctaggtcgggcatggggaaggacgaggtgatggagagcggcggcgccgccggcgagttcgcggccaaggactacacggacccgccgccggcgccgctgatcgacgcggcggagctggggtcgtggtcgctgtaccgcgccgtcatcgccgagttcatcgccacgctgctgttcctgtacatcaccgtggccacggtgatcgggtacaagcaccagacggacgcgtcggcctccggcgccgacgcggcgtgcggcggcgtgggcgtgctcggcatcgcgtgggcgttcggcggcatgatcttcatcctggtctactgcaccgccggcatctccggcgggcacatcaacccggcggtgacgttcgggctcttcctggcgcgcaaggtgtccctggtccgcgccatcctctacatcgtggcgcagtgcctcggcgccatctgcggcgtcggcctcgtcaaggcgttccagagcgcctacttcaacaggtacggcggcggcgccaacaccctcgccgccggctactccaagggcaccggcctcgccgccgagatcatcggcaccttcgtgctcgtctacaccgtcttctccgccaccgaccccaagcgcaacgcccgcgactcacatgtcccggtcttggcgccgctgccaatcggcttcgccgtgttcatggtccacctggcgacgatcccgatcaccggcaccggcatcaacccggccaggagcatcggagcggccgtcatcttcaacaacgagaaggcgtggcacaaccattggatcttctgggtcggcccgttcgtcggcgccgccatcgcggcgttctaccaccagtacatcctccgggccggcgccatcaaagccctcggctccttcaggagcaacgcgtgatatcaaaggagttcgagcagccattgttgggggataatggctggaaggcgttgatgaagcaattggccatgatgatgagttctaccgtgttatgattctccctttttcaaaaaaattaagttcgccgctggtcgttttgtttcagcagctgctcctcctcctgcttgtcgtgtgtgtgaagtgaacatccatgtgtttgtaatctgtttttaaatcgagggatgtctcatgtgtttagcctgtactcccatttaatttagcgacgataagcatcgatgcccgcctctcctatctggaatatatcaatcagttttatcaagtggttcgccg

SEQ ID NO: 15160 - DNA, 1314 bp, Triticum aestivum
ccccaagcccccacctccattttttccagtcaggttcacagcgagaagcaacagcaaggcaagctagctacacgccgatggccaaggacgaggtgatggagaccggcggcggcggcgacttcgcggccaaggactacacggacccgccgccggccccgctgatcgacgcggcggagctggcctcctggtcgctctaccgcgccgtcatcgccgagttcatcgccacgctgctcttcctctacatcaccgtggccaccgtcatcgggtacaagcaccagacggacccggccgtgaacaccgccgccgacgcggcgtgcggcggcgtgggcgtgctcggcatcgcctgggccttcggcggcatgatcttcgtcctcgtctactgcaccgccggcatctccgggggccacatcaacccggccgtcaccttcggcctcttcctggcgcgcaaggtctccctggtccgcgcgctgctctacatggtggcccagtgcctcggcgccatgtgcggggtcggcctcgtcaaggccttccagagcgcctacttcgtcaggtacggcggcggcgccaacacgctcgccgccggctactccaagggcaccggcctcgccgcggagatcatcggcaccttcgtgctcgtctacaccgtcttctccgccaccgaccccaagcgcagcgcacgcgactctcacgtcccggtgctggcgcccctcccgattggcttcgccgtgttcatggtccacctggccaccatccccatcaccggcaccggcatcaacccggcccggagcctcggggccgccgtcatctacaacaaggacaaggcctgggatgatcagtggatcttctgggtcggccccatgatcggcgcggcgatcgcggccttctaccaccagtacatcctcagggccggcgccatcaaggccctcggctccttcaggagcaacgcgtaacaagttatcatccatgtgatctgcatgcaagattgaagcaatggcgacccgtgttgtgtccatccatccagagagaaatgcgcttttgcaacttctcgacagttcagttcggccgccgcaatggtcgtgttatttatgtgtcggcagctgcatatgcgtagtacgagtacgtggttggcctccatgtgcccggtcctgcgtgccgtgtcttgtaattcggtccatgggatcgctcgcttgtcttaattagcccgcattgcttttcctattgtatttaaatttagcgaccatatgtatgatcgatccaacgtcgccgcctttctgtctaattcatcaatccaccaagcaagtgatcatcccaaaa

SEQ ID NO: 15161 - DNA, 1134 bp, Brassica rapa
atcataataaccaaaaacacatttttcctaaatagaaatatattaaatggctaaagatgtggaaggagcagagggagtcacggcgagggactacgaagacccaccgcctactccgtttttcgatgcggaggagctcacgaagtggtctttatacagagcagtcatcgccgagttcgtagccactctcctcttcttatatgtcaccgttttgactgtcatcggctacaagatttcctccgacactaaggcaggaggcgacgactgcggaggcgtcggaatcctcggtatctcgtgggctttcggcggcatgatcttcatccttgtctactgcaccgccggtatctcaggtggtcacataaacccggcggtgacgttcggcttattcttggcccggaaggtatcgctggttagagcggttctatacatggtggctcagtgtttaggtgcgatttgcggagttgggtttgtcaaagccttccaaagcgcttactacgtgcgttacggcggaggagccaactctctagccgacggatacagcacagggactggactcgccgcagagatcatcggaacttttgtcctggtctacactgtcttctcagccacagaccccaaaagaaacgcacgagactcccacgttcccgtgttggcgccacttccgatagggtttgcggtcttcatggttcacttggccactattccgatcaccggaacaggaattaacccggcaaggagtttcggagctgcggttatctacaacgagtccaagccgtgggatgaccactggatattctgggttggaccattcattggagctgcgattgctgcattttaccaccaattcgtcctaagagcttccggttccaaatccctcgggtccttcagaagtgcggcctaagaaaaacaattacaaaatggttgttatggtgtgtgtacaaatttggcaagtttcaatttcttattgtctttttctaatttctggcatcagtgtggggatatatgtgaatgaatgtttgtgtgatcggggaaaacaatcttaatgaaatcatattgtttttgcctgcttttaattttccttttttattaccatcatcattttcagaaaataaaatgttacaaagatttagatactct

SEQ ID NO: 15162 - DNA, 1652 bp, Hordeum vulgare
ataaataccaccttcctcccgtcactcccccaccacacacaagctccaactccatttttttccagcgagaagaaaccacacacactgatggcgaaggacgaggtgatggagaccggcggcggcggcgacttcgcggccaaggactacacggacccgccgccggccccgctggtggacgcggcggagctggcgtcgtggtcgctgtaccgcgccgtcatcgccgagttcatcgccacgctgctcttcctctacatcaccgtggccacggtcatcgggtacaagcaccagacggaccccgcggtgaacagcgccgccgacgcggcgtgcggcggcgtgggcgtgctcggcatcgcgtgggccttcggcggcatgatcttcgtcctcgtctactgcaccgccggcatctccgggggccacatcaacccggccgtgaccttcggcctcttcctggcgcgcaaggtctccctggtccgcgcgctgctctacatggtggcgcagtgcctcggcgccatgtgcggggtcggcctcgtcaaggccttccagagcgcctacttcgtcaggtacggcggcggcgccaacacgctcgccgccggatactccaagggcaccggcctcgccgcggagatcatcggcaccttcgtgctcgtctacaccgtcttctccgccaccgaccccaagcgcagcgcacgcgactctcacgtcccggtgttggcgcccctcccgatcggcttcgccgtgttcatggtccacctggccaccatcccgatcaccggcaccggcatcaacccggccaggagcctgggggccgccgtcatctacaacaaggacaaggcctgggatgatcagtggatcttctgggtcggccccatgatcggcgcggcgatcgcggccttctaccaccagtacatactcagggccggcgccatcaaggccctcggctccttcaggagcaacgcgtaacgagttatccatgtgatgtgcatgcaagattgaagcaatggcgacctgtgctgtgtccatccatccaaagagaaagccgcttttgcaacttctcgacagttcagttggccgctgcaatggtcgtgttatttatgtgtcggcagctgcatatgcgtatgtgcccagtcatgcgtgccgtgtgttgtaattcggtccatgggatcgcttgtcttaattagcccgcattccttttcctgttttaatttagcgaccatatgtatgatcgacccaacgtcgccaccttctatccaaatcatcaatccgccaagcaagagattcatcccaaatacgtattccctcttggttgtgccgagtggtggtgaccttgctttctatcttgttgctgctttgccgctctgaatgctcaagcccgaatgatcataagtcgtgtgatgcgccaacccttgttttctgcccttccatgtcctgctgctctacggtctcatccactcgacggagtcgtgtctctttctctcactttcgttccttgattcctatagctatcacttgtatatcatgggatgttgtcatccagcaggattcttttctttggagagagtgttgcatgtctttttcattacgaccgaacgccaaacaatctcttgtcttgtaatggggccgatttgtttcgatcaattccatctaactaatac

SEQ ID NO: 15163 - DNA, 1581 bp, Hordeum vulgare
aatcgaggaaagagatatccgtgaattctggaatctggcgtttgcacctgcgtcgcagcacatgccccaatagcttatccacctcacttcactgcagcaacaaaaacaaaagccaagccccatttggtcttatcagcaaattatatagtcctcctactcgtacaaataaaattcagacgaagaaaatagttcagttttcagttccatcaaggacaccacgagagggtgcggagcctcgtccaccacacaccctcgcctcgttgtattttactacctacctcttctcccccgctccataaataccaccttcctcccgtcactcccccaccacacacaagctccaactccatttttttccagcgagaagaaaccacacacactgatggcgaaggacgaggtgatggagaccggcggcggcggcgacttcgcggccaaggactacacggacccgccgccggccccgctggtggacgcggcggagctggcgtcgtggtcgctgtaccgcgccgtcatcgccgagttcatcgccacgctgctcttcctctacatcaccgtggccacggtcatcgggtacaagcaccagacggaccccgcggtgaacagcgccgccgacgcggcgtgcggcggcgtgggcgtgctcggcatcgcgtgggccttcggcggcatgatcttcgtcctcgtctactgcaccgccggcatctccgggggccacatcaacccggccgtgaccttcggcctcttcctggcgcgcaaggtctccctggtccgcgcgctgctctacatggtggcgcagtgcctcggcgccatgtgcggggtcggcctcgtcaaggccttccagagcgcctacttcgtcaggtacggcggcggcgccaacacgctcgccgccggatactccaagggcaccggcctcgccgcggagatcatcggcaccttcgtgctcgtctacaccgtcttctccgccaccgaccccaagcgcagcgcacgcgactctcacgtcccggtgttggcgcccctcccgatcggcttcgccgtgttcatggtccacctggccaccatcccgatcaccggcaccggcatcaacccggccaggagcctgggggccgccgtcatctacaacaaggacaaggcctgggatgatcagtggatcttctgggtcggccccatgatcggcgcggcgatcgcggccttctaccaccagtacatactcagggccggcgccatcaaggccctcggctccttcaggagcaacgcgtaacgagttatccatgtgatgtgcatgcaagattgaagcaatggcgacctgtgctgtgtccatccatccaaagagaaagccgcttttgcaacttctcgacagttcagttggccgctgcaatggtcgtgttatttatgtgtcggcagctgcatatgcgtatgtgcccagtcatgcgtgccgtgtgttgtaattcggtccatgggatcgcttgtcttaattagcccgcattccttttcctgttttaatttagcgaccatatgtatgatcgacccaacgtcgccaccttctatccaaatcatcaatccgccaagcaagagattcatcccaaa

SEQ ID NO: 15164 - DNA, 1065 bp, Brassica napus
agatcataataaccaaaaacacatttttcctaaatagaaatatattaaatggctaaagatgtggaaggagcagagggagtcacggcgagggactacgaagacccaccgcctactccgtttttcgatgcggaggagctcacgaagtggtctttatacagagcagtcatcgccgagttcgtagccactctcctcttcttatatgtcaccgttttgactgtcatcggctacaagatttcctccgacactaaggcaggaggcgacgactgcggaggcgtcggaatcctcggtatctcgtgggctttcggcggcatgatcttcatccttgtctactgcaccgccggtatctcaggtggtcacataaacccggcggtgacgttcggcttattcttggcccggaaggtatcgctggttagagcggttctatacatggtggctcagtgtttaggtgcgatttgcggagttgggtttgtcaaagccttccaaagcgcttactacgtgcgttacggcggaggagccaactctctagccgacggatacagcacagggactggactcgccgcagagatcatcggaacttttgtcctggtctacactgtcttctcagccacagaccccaaaagaaacgcacgagactcccacgttcccgtgttggcgccacttccgatagggtttgcggtcttcatggttcacttggccactattccgatcaccggaacaggaattaacccggcaaggagtttcggagctgcggttatctacaacgagtccaagccgtgggatgaccactggatattctgggttggaccattcattggagctgcgattgctgcattttaccaccaattcgtcctaagagcttccggttccaaatccctcgggtccttcagaagtgcggcctaagaaaaacaattacaaaatggttgttatggtgtgtgtacaaatttggcaagtttcaatttcttattgtctttttctaatttctggcatcagtgtggggatatatgtgaatgaatgtttgtgtgatcggggaaaacaatcttaatgaaatcatattgtttttgcctg

SEQ ID NO: 15165 - DNA, 1030 bp, Brassica oleracea
atttttcctaaatagaaatatattaaatggctaaagatgtggaaggagcagagggagtcacggcgagggactacgaagacccaccgcctactccgtttttcgatgcggaggagctcacgaagtggtctttatacagagcagtcatcgccgagttcgtagccactctcctcttcttatatgtcaccgttttgactgtcatcggctacaagatttcctccgacactaaggcaggaggcgacgactgcggaggcgtcggaatcctcggtatctcatgggctttcggcggcatgatcttcatccttgtctactgcaccgccggtatctcaggtggtcacataaacccggcggtgacgttcggcttattcttggcccggaaggtatcgctggttagagcggttctatacatggtggctcagtgtttaggtgcgatttgcggagttgggtttgtcaaagccttccaaagcgcttactacgtgcgttacggcggaggagccaactctctagccgacggatacagcacagggactggactcgccgcagagatcatcggaacttttgtcctggtctacactgtcttctcagccacagaccccaaaagaaacgcacgagactcccacgttcccgtgttggcgccacttccgatagggtttgcggtcttcatggttcacttggccactattccgatcaccggaacaggaattaacccggcaaggagtttcggagctgcggttatctacaacgagtccaagccgtgggatgaccactggatattctgggttggaccattcattggagctgcgattgctgcattttaccaccaattcgtcctaagagcttccggttccaagtccctcgggtccttcagaagtgcggcctaagaaaaacaattacaaaatggttgttatggtgtgtgtacaaatttggcaagttttaatttcttattgtctttttctaatttctggcatcagtgtgggatatatgtgaatgaatgtttgtgtgatcggggaaaacaatcttaatgaaatcatat

SEQ ID NO: 15166 - DNA, 1048 bp, Brassica juncea
ataataactaagaacacattttccctcatacaaaaatattaaatggcgaaagatgtggaaggagcagagggagtcacggcgagggactacgaagacccaccgcctactccgtttttcgacgcggaggagctcacgaagtggtctttatacagagccgtcatcgccgagttcgtagccactctcctcttcttatacgtcaccgttttgactgtcatcggctacaagatttcctccgacactaaggccggaggcgacgattgtggaggcgtcggaatcctcggcatctcatgggctttcggtggcatgatcttcatccttgtctactgcaccgccggtatctcaggtggtcacataaacccggcggtgacgttcggcttgttcttggctcgcaaggtatcgctagttagagcggtgctatacatggtggctcagtgtttgggtgcgatatgtggagttgggttcgtgaaggccttccaaagcgcttattacgtgcgttacgggggaggagcaaactctctagccgacggatacagcacaggcactggactcgccgcagagatcatcggaacgttcgttcttgtctacactgtcttctcagccacagaccccaaaagaaacgcacgagactcccacgttcccgttttggcgccacttccgattgggtttgcggtgttcatggttcacttggccactattcccatcaccggaaccggtattaacccggctaggagtttcggagctgcggttatctacaacgagtccaaaccgtgggatgaccactggatattctgggtgggaccattcattggagccgccatagctgcattttatcaccagttcgtcctaagagcttccggttccaagtctctcgggtccttcagaagtgcggcctaaggaaacaattacaaaatggttgttatggtgtgtgtacaaaaaccatgttctatgttttcttctttttctttgcctttcctatagtgtctggcatcagcgtgggataatatgtgaatgtttgtgtgatggggggaaaacaatcttaaatgaaatc

SEQ ID NO: 15167 - DNA, 1029 bp, Brassica napus
cataataaccaaaaacacattttttcctaaacagaaatatattaaatggctaaagatgtggaaggagcagagggagtcacggcgagggactatgaagacccaccgcctactccgtttttcgacgcggaggagctcacgaagtggtctttatacagagcagtcatcgccgagttcgtagccactctcctgtttttgtacgtcaccgttttgactgtcatcggctacaagatttcctccgacactaaggcaggaggcgacgactgcggaggcgtcggaatcctcggtatctcatgggctttcggcggcatgatcttcatccttgtctactgcaccgccggtatctcaggtggtcacataaacccggcggtgacgttcggcttgttcttggcccggaaggtatcgctggttagagcggttttatacatggtggctcagtgtttaggtgcgatttgtggagttgggtttgtcaaagccttccaaagcgcttactacgtgcgttacggcggaggagccaactctctagccgacggatacagcacagggactggactcgccgcagagatcatcggaacttttgtcctggtctacactgtcttctcagccacagaccccaaaagaaacgcacgagactcccacgttcccgtgttggcgccacttccgatagggtttgcggtgttcatggttcacttggccactattccgattaccggaaccggtattaacccggcaaggagtttcggagctgcggttatctacaacgagtccaagccgtgggatgaccactggatattctgggttggaccattcattggagctgcgattgctgcattttaccaccaattcgtcctaagagcttccggttccaagtccctcgggtccttcagaagtgcggcctaagaaaaacaattacaaaatgtttgttatggtgtgtgtacaaatttggcaagttttaatttcttattgtctttttctaatttctggcatcagtgtgagatatatgtgaatgaatgtttgtgtgatcggggaaaa

SEQ ID NO: 15168 - DNA, 1134 bp, Chrysanthemum coronarium
acactactcgtatttctatcaaatgatcaacataaatccatgatcacaatgtgcaaattaacctataataatcccatatacagtatccaatcatcattctcattgcagaagccatgacaaaagacgcagctgagcaccatggtgccaaagactaccatgaccctccaccagcacctttgttcgatgctgatgagctaaccaaatggtctttctaccgagctcttatagctgagtttattgcaacacttttgtttctttacgtgacggttttgaccgttatcgggtacaagagcactactgatccaacgttaccaggagttgatgagtgtggtggtgttggaatacttggtattgcatgggcttttggtggcatgatctttgttcttgtttattgcactgctggtatctctggaggacacattaaccctgctgtgacattcgggttatttttggcaaggaaggtgtcattgattagagcagtaatgtacatgctagcacaatgtttgggtgcaatctgtggtgttggtttagtcaaagctttccaaagttccttatacaataggtacggtggtggggccaacactttggccgatggttacaacaagggcactggactaggtgccgaaattatcggcacctttgtccttgtctacaccgtcttctctgctactgaccctaagagaagtgcccgcgactctcacgttcctgttttggcaccattgcccatagggtttgcagtcttcatggttcacttagccaccattcccatcactggtaccggaatcaaccccgctagaagctttggcgcggccgtgatttacaacgacgacaaggcttgggatgaccactggattttctgggtcggaccatttttgggtgcagccgcagcggcattctaccaccaatttgtacttcgagctggagccattaaagcacttggttctttcagaagcaatgcatgaaacgagagagatgattaatgtgtatgtccatgcaaaaataataaacgaacgacgcgacaaaggtttaatctagagtcgaggttgaggcgttaaaatgggtggatgtacgagtgtggaagtgttcaactgtagataataatttaagttctcttttagcatttgtaatttcata

SEQ ID NO: 15169 - DNA, 975 bp, Cirsium arvense
actcacaacccaacccattatcacttcccaccttctcccatccctttccttctctgtgcaacaatgactaaagatgtcgaagtggccgagcaacaccacggcgccaaggactaccacgatccacctccttcgccgctcttcgacgccgatgagctcaccaagtggtccttctaccgagctctcatcgccgagttcgtcgccacccttctcttcctctacgtcaccgtattaactgtcatcggctacaagagccagaccgaccctctcctcaacaccgatcagtgtggcggcgttggcatcctcggcatcgcttgggccttcggcggcatgatcttcatcctcgtctactgcaccgccggtatctcaggaggacacattaaccccgcggtgacgttcggattgtttttggcgcgaaaggtgtcgttgatcagggcggtaggttatatgatagcacagtgtttgggagcgatttgcggtgtaggtttggtgaaggctttccagagctcgtactacaaccggtacggcggtggtgctaacacgttggccgatggttacaacaaggggaccggactcggtgctgagattatcggaacgtttgtactggtttacaccgtcttctcggctaccgatcccaagaggagtgcccgagactcccatgttcctgtattggcaccactgcccataggatttgcagtgttcatggtgcacttggccaccattccgatcaccggcaccggaattaacccggcaagaagctttggcgccgccgtgattttcaacgacgagaaggcatgggacgaccaatggatattctgggttgggccattcatcggagcgtttgctgccgccgtctaccaccagttcgtactgagagccgccgcgatcaaagcactgggttctttcagaagcaatgcttaaaacctgaaagatttcatggcttgctttgtagatatctctgaaacttccaattgtatt

SEQ ID NO: 15170 - DNA, 1106 bp, Taraxacum officinale
ggtccggattcccgggatcaaaaaccatcatcacttctctcgacctcgaagccatgacgaaggatgttgaagtggctgagcaccacggtggcgccggcgaatacggcgccaaggactaccacgatccacctcccgcccccttcttcgacgctgaagaactcaccaaatggtccttttacagagcactcatcgccgagttcgttgccactctcctcttcctctacatcactgttttaaccgtcatcggatacaaagtccagacagatcctgctttggacactgatcagtgcggcggcgtcggaatcctcggcatcgcctgggccttcggtggcatgatattcattctcgtttactgcaccgccggtatctccggaggacacattaacccggctgtaacattcggtttgtttttggcgagaaaggtgtcgttgattagggcggtagggtacatgattgcacagtgtttgggtgcaatttgtggtgtaggtttggtgaaagctttccagagctcatactacgaccggtacggcggtggtgccaacgagttggccgacggctacaacaagggtaccggacttggtgctgagatcatcggcaccttcgttcttgtttacaccgtcttctcggccaccgatcctaagagaagtgcacgagactcccatgttcctgtactggccccacttcccataggattcgccgttttcatggtgcacttggccaccattccgatcaccggaaccggcatcaaccccgcaagaagttttggcgctgccgtgatttacaacaaggctaaggcctgggatgaccagtggatattctgggtgggaccattcatcggagcttttgccgccgccgtctaccaccagtttgtactgagagctgccgcaattaaggcacttggttctttcagaagcaacgcttaaggttgaaagatgttcatctatggcggttcatgccttgtagatatctttggaaaattcctccttttaaaaaattggttttatgtaattttaatttattttctttgggtcttgtgttatgtaaaattgtaagtgttcttttgtttttccttttaaagtttgatttatgatcaagtatttcgagat

SEQ ID NO: 15171 - DNA, 1200 bp, Echinochloa colona
acaccactcaagcagacaagccgagagcgcgcatagcacgcacgcacgcagcctctgagctgagctagctaattaatcaaggtcggcatggcgaaggacatcgaggcgtcggggcccgaggccggagagttctcggccaaggactacacggaccccccgccggcgccgctgatcgacgcggaggagctgaccaagtggtcgctgtaccgcgcggtcatcgccgagttcatcgccacgctgctcttcctctacatcaccgtggccaccgtcatcgggtacaagcaccagtccgacccggcggcgtcgggcgccgacgcggcgtgcggcggcgtcggcatcctcggcatcgcctgggccttcggcggcatgatcttcatcctcgtctactgcaccgccggcatctcaggtgggcacatcaacccggccgtgacgttcgggctgttcctggcgaggaaggtgtccctcgtccgcgcggtgctctacatcatcgcgcagtgcctgggagggatctgcggcgtggggctcgtcaagggcttccagagcgcctactatgtgcgctacggcggcggcgccaacgagctcagcgccggctactccaagggtaccggcctcgccgcggagatcatcggcaccttcgtgctcgtctacaccgtcttctccgccaccgaccccaagcgcaacgcccgcgactcccacgtcccggttctggcgcccctgcccatcgggttcgcggtgttcatggtgcaccttgccacgatcccggtcaccggcacggggatcaacccggccaggagcctcggcgccgccgtcgtgtacaacaacaacaaggcctggagcgaccagtggatcttctgggtgggtccgttcatcggcgcggcgatcgcggcgctttaccaccagatcgtcctccgcgccagcgccaggggatacggctccttccggagcaacgcctaggccgacctcgtcgtcatcgacatccacggccggccgactggactggacgtagctcatcctcctcctaagtttaaattgaacggagagggagatcgtcctggcgtgatcaatgtagtagcagtagcttcagtcaagtgttgttggaactgccggcatcggcaagagtttgcgtgtgtgtgttgtggaaagcaagtgtaactttgtcttcgtgtgtggaccttgtagacttgaactcaatctcaagtt

SEQ ID NO: 15172 - DNA, 1227 bp, Petunia hybrida
tcgagcactgttggccactggacactcttaatttggctaactctcctctctctatatctctaactcacaaaacaccatttgccatatccacaaatagtgctagagttgaaaaaatggcaaagaatgtgggtagtgaaggatcttttacaacaaaggattaccaagatcctccaccagcaccactcatagacccagcggagctaacccaatggtccttctacagggctctcattgctgagttcatagccacacttcttttcctttacatcacggtgctaacagtgattggttacaaaagtgaaagtgaccctgccaagaatgctgatccttgtagtggagttggaattcttggtattgcttgggcctttggtggcatgatctttatccttgtctactgcactgctggtatttctggtggtcatataaatccagcagtgacatttggactattcttggcaaggaaggtatccctaataagggcagtgatgtatatggtggctcaatgtttgggagccatttgtggtgttggcttggttaaagctttccaatcagcttactaccaccgctacgacggcggagccaacatgctctccgatggctacagtaaaagcgtggggttatcagcggagatcatcggaacatttgttttagtttacactgttttctcggccaccgatcccaagaggaatgctagagactctcatgtccctgtgttggcaccacttccaattggatttgcagtgttcatggttcacttagccaccattccgattaccggcaccggcatcaacccagcaaggagtcttggagctgccgttatcttcaaccaagacaaagcttggaaagaccattggatcttttgggtaggacctttcattggggcagccatagcagcattctaccatcaattcatattgagagcaggtgcagctaaagctcttggttcattcaggagcagtacttctcaagcttgatgattatgtatgattgaatttgaaaaagagaaggaaagagctttagtttccaataattattgttgttgtactatttatgttagtatgtcgtgttagtggtacttttagctctcattgtcccaagttagttatgatggtcttgaagaacaatgcgaaatggtggggtagtgcttgagactttgagagccatgcatggatgtgtagataaaaaagtgatttgtctttgggagggggaaagcttttccgtattccc

SEQ ID NO: 15173 - DNA, 1375 bp, Malus domestica
aacacagagagagagagagagagagagagagagagttgaagtaaatttagtggaaggtgatgaggtgggctgtgtagtaaaaaggcaggtcacacagagtcggtggaagcgaaaagaagacacaaaaatagtaggtgggttaactccacatgtttcaaattttccagtaaatctaattcctaatctctcaccacaccatatataccccctctctcctcactccctctcccacaccaaaaaagactctgtttttctctgtttctcccaaactctgtgaagcttaagctttgttaatggccaaggacatggaagttgcagagaggggctccttcccagccaaggactaccacgacccgccgcctgcgccgctcttcgacccggctgagctcgccaaatggtccttctacagagctctcatagctgagttcgtagccactcttctctttctctacgtcactgtgctcactgtgattggctacaagagccagaccgaactagacaattgcggtggggttgggaccctggggattgcttgggcctttgggggcatgatctttgtccttgtttactgcactgctgggatttcagggggtcacattaacccggcagtgacatttgggctgtgcctggctcggaaggtgtcgccggtgagagctgtgctgtacatggtggctcagtcgttgggggccatagccggtgttgcgctggtgaaggctatccagaagagctactacaccaagtacggcggcggtgccaactcacttagcgatgggtacagcaccggagttggattggctgctgagattattggcacctttgtgctcgtttacaccgttttctctgccactgaccccaagaggagtgctagagactcccatgttccggttttggctccactgccaatcgggtttgctgtgttcattgttcacttggccaccatcccaatcactggcactggcatcaaccctgctagaagtcttggacctgctgttatcttcaaccaagacaaggcttgggatgaccaatggattttctgggttggacccttcatcggagcagcaattgcagccttctaccaccaatttatcttgagagcaggagctgccaaggcccttggatcattcaggagccacccgagtgtttgaattgaaatattttctgagaatgtgatgggatttggaaaacaatgttaattattatgaagggtaatatttatatttaattgtgcttaacttatgctttgtgtatgaaggtttcatttggtcatctctcaattaaatttccatcagaaaaaggggctgagaggccatgaatttgtagatattgtcacgtacttgcctttgaatttacttcaatgtcattgccattttctcaa

SEQ ID NO: 15174 - DNA, 1288 bp, Zingiber officinale
gtgagcttacataatccttagattcctccctgctctgctctcatccagatcgagagctcggcttgtccagcaattaatcatggcgaaggacgttgaagggacggagcaagcggagtacagcgccaaggactacaccgacccaccgccggcgccgctgatcgacgcggaggagctcaccaagtggtcgctctaccgcgccgtcatcgccgagttcatcgccaccttgctcttcctctacgtcaccgtcctcaccgtcatcgggtacaaacaccagtccgacacccagatcaacaaccccgacgcggagtgtaacggcgtcggcgtgctcggcatcgcctgggccttcggcggcatgatcttcatcctggtttactgcaccgccggcatctccggtgggcatataaatccggcggtgacgttgggactgttcctggcgcgcaaggtttcgctggtgcgggcgctgctgtacataatagcgcagtgcctgggggccatctgcggggtggggctggtgaagggattccagcgatcgttctacgtgcgctacggaggcggcgccaacgagcttcaacccgggtactccaagggcaccggcctcggcgcagagatcatcggcaccttcgtcctcgtttatactgtcttctcggccaccgaccccaagcgcagcgcccgcgactcccacgtcccggttttggctccgcttccgattgggttcgcggtgttcatggtacacctggcgacgattccgatcaccggaacaggcattaacccggccaggagtttcggagccgcagtcatctacaacaaggacaaggcttgggacgaccagtggatcttctgggtgggaccagtcatcggagctgcgatcgcagcggcctatcaccagtacattttgagggcgagcggtgccaaggctttgggttctttccgcagcaacgcttgaaatcgatcgtctatctcagtgttgatcgagtatggaattgtttagataagaaaataataaaaatatggggggaaaacaaagtcaaatggtttcgttctcatgacaattccgtttcagctgcatcgaagcagacattctgagtgttgcgatttgtgtgtgtactcgatcgttgttgtatcctcgtttatttaagatgcatcaagtgtttcatttttcgtacgctagctaccatatatctgattcatgccatctattgatttggtaattttttttttgttaatgtcattagtgcatgctcatgataataagtgttaccttaattatttaccatgcaagcttctttca

SEQ ID NO: 15175 - DNA, 1181 bp, Centaurea maculosa
ccaccaccaccacttcatctctctctcaaataatcatctttactctctctacaaacatgacaaaagaagccgtgacgaaagaaccggtgacggatcccgagctagagccgacctccaagaaggactacagcgacccaccgcccgtggctttcatcgacccaaaagaattgaccaagtggtcattctacagagccatcattgccgagttcatcgccacccttctctttctgtacattactgtcttaactgttatcggttacaagagctcgacggacacaactaaggccgatgtcgacccgtgtggtggcgtcggaatcctcggtattgcttgggcctttggtggcatgatcttcgttctcgtttactgcaccgccggtatctccggtggtcacattaacccagctgtgacctttggtctgtttctggctcgcaaggtctcattgttccgagccatcttgtacatggtggctcagtgcctaggagccatatgtggtgtgggtttggtcaaggctttccacaagacttattacaacacctacggcggtggtgccaacgagctagccgaaggctacaacaaaggcaccgggttgggtgctgaaatcatcggtactttcgttcttgtctacactgtcttctctgctaccgatcccaagagaaatgcccgagactcccatattccggtgttagcacctctaccaattgggtttgctgtgttcatggttcacttagccacgattcccatcaccggaaccggtattaatccagcgaggagttttggagccgcggttatttacaacaaggagaaagcttgggatgatcaatggatattttgggtcggacccttcatcggtgcagccatcgcagccttctatcacgagtttgtcttgaaagccggtgcagtgaaagctctcggatctttcagaagcagtacccatgtttgagattgattcgatcttcaaaaccctcggtttcgttttaatttgatttcatgaaaaattgggggaaaaaaataagtaattaaaatgttgtatgtgtgaattataagtatgtggcttataggggttggaatgtgttcaagagttgtggcaggcatggaagttcgatgtaaattgttttttagagggggggttagtaaccctcatgttattgtttgttgcttaattaaagcttgagtgaactac

SEQ ID NO: 15176 - DNA, 1248 bp, Cirsium arvense
ctttctctctctacaaacatgacaaaagaagccgtgacaaaagaaccggtgacggatcccgagctagagccgacctccaagaaggactacagcgacccaccgcccgtggctttcatcgacccaaaagaattgaccaagtggtcgttctacagagccatcattgccgagttcatcgccacccttctctttctgtacattactgtcttaactgttatcggttacaagagctcgacggacacaactaaggccgatgtcgacccgtgtggtggcgtcggaatcctcggtattgcttgggcctttggtggcatgatcttcgttctcgtttactgcaccgccggtatctccggtggtcacattaacccagctgtgacctttggtctgtttctggctcgcaaggtctctttgttccgagccatcttgtacatggtggctcagtgcctaggagccatatgtggtgtgggtttggtcaaggctttccacaagacttattacaacacctacggcggtggtgccaacgagctagccgaaggctacaacaaaggcaccgggttgggtgctgaaatcatcggtactttcgttcttgtctacaccgtcttctctgctaccgatcccaagagaaatgcccgagactcccatattccggtgttagcacctctaccaattgggtttgctgtgttcatggttcacttagccacgattcccatcaccggaaccggtattaatccggcgaggagttttggagccgcggttatttacaacaaggagaaagcttgggatgatcaatggatattttgggtcggacccttcatcggtgcagccatcgcagccttctatcacgagtttgtgttgaaagccggtgcagtgaaagctctcggatctttcagaagcagtacccatgtttgagattgatttcgatcttcaaaaccctcgtttcgttttaatttgatttcatgaaaaattgggggaaaaataagtaattaaaatgttgtatgtgtgaattataagtatgtggcttataggggttggaatgtgttcaagagttgtggcaggcatggaagttcgatgtaaattgtttttttagaggggggttataaccctcatgttattgtttgttgcttaattaaagcttgagtgaactaccattttcgtttctgaatttttaaaagttgccttttaggttattgtaatttccattttattttggttttcgtttatgaaactaaaaaacaagttcgtgttaaaaaagaa

SEQ ID NO: 15177 - DNA, 1080 bp, Brassica napus
ataaaacccatttgtggaaagacagaaaacaaagaaactagttatggcgaaggacgtggaagctgtttccggagaagggtttcagacaagagactatcaagatccaccgccggcgcctctgtttgatccggaggagctgaccaagtggtctttttacagagctgtcattgccgagttcgtagctactctcctcttcttatacatcaccgttttgacagtcatcggttacaagattcagaccgatagtaccgccggcggcgttgactgcggtggagttgggatccttggtatcgcttgggcttttggtggcatgatcttcatccttgtctactgcaccgccggtatctctggtggtcacattaacccggcagtgacattcgggctactcttggcacgtaaagtgtcgttggttagagccatattgtacatggtagctcagtgtttgggtgcgatatgtggagttgggttcgtcaaagccttccaaagctcttactacgttcgttacggcggtggagccaactctctagccgacggctacagcacaggaacaggcctcgccgcagaaatcatcggtactttcgttcttgtctacaccgtcttctccgccactgaccctaaacgtagtgccagagactcccacgtcccagtgttggcgccacttcccattggatttgcggtgttcatggtgcacttggctaccattcccatcaccggaactggaatcaacccggcaaggagtttcggagcagccgttatcttcaatgagagcaagccatgggatgaccactggatattttgggtgggaccattcgttggagctgcgatagctgcattctaccaccagttcgttctgagggcttcaggttccaaatctctcggatctttcagaagtgctgccaacgtctaaatactctctcattcaccaagcagattctgaaataataaagatgatatgtacaaattatccaaatcagtttcagtttgttatcttatctgtgtgttttctacttgctctttactgtgttttcgttgagtgtaattgttattattttacgccaatgtcaagtttatcaagtgatt

SEQ ID NO: 15178 - DNA, 1240 bp, Brassica rapa
acaaatcaagagctaactctatataaagaaccatttgctctagcttattctcacaaccagaagcaaaagtaaaacagttcctaagaagaaacatccattacatataataatactacatggctaaagacgtggaaggagcagaggggttcgctgcgagggactacgaagatccgccgccaacaccgttcttcgatgcggaggagctgaccaagtggtctttgtacagagccgtcatagccgagttcgtagccactctcctcttcttgtatgtcactgttttgactgtcatcggctacaagatttcgtccgacactaaggccggaggcgacgagtgcggaggcgtcggaatcctcggcatctcatgggccttcggtggcatgatcttcatccttgtctactgcaccgccggtatctcaggtggtcacataaaccctgcggtgacgttcggcttgttcttggcaaggaaggtatcgttggttagagcagtgctatacatggtggctcagtgtttgggtgcgatttgtggagttggtttcgtcaaagccttccaaagcgcttactacgtacgttacggtggaggagcaaactctctagccgatggatacagcacagggactggactcgctgcagagatcattggaacattcgtcctggtctacactgttttctccgccactgaccccaaaagaaacgcacgagactcccacgttcccgtgttggcgccactcccaattggatttgccgtgttcatggtacacttggccactattccaatcactggaaccggtattaacccggccaggagtttcggagctgcggtgatctacaacgagtccaagccgtgggatgaccactggatattctgggtgggaccattcatcggagctgccatagctgcattttatcaccaattcgttctaagggcctctggttccaaatccctcggatccttcagaagtgcagccaacgtttgagtttagccacacaaaacaaaacaaaaaaagtggttactgttatgtataaattgggcacgtgattttaaaatgtgtcctcttatgtcttttcttttcatctgcttctatttgtgtgaattccaattattgaagttttagtgttttgcgtgttttcatcatggcaatgtcagtgagtttgtttattgagaaaaagccgaccacattgtttcgcttatttgatctcatcctcctctaaacaatgtctaaattgtaacgttcaatcctca

SEQ ID NO: 15179 - DNA, 1334 bp, Festuca arundinacea
accaccacacatccacaagctcaccgagctcgttcttgtttcaacaaagcctgttcactctcttgcagcagcaagctagagaaaaaagagatggcgaaggacgaggtggtggagagcggcggcgacttcgcggccaaggactacacggaccctcctccggcgccgctcatcgacgcggctgagctcgcgtcgtggtcgctgtaccgcgcggtcatcgcggagttcatcgccacgctgctgttcctgtacatcacggtggcgaccgtgatcgggtacaagcaccagacggacgtgtccgtgaacggcaccgacgcgccctgcggcggggtgggcatcctcggcatcgcgtgggccttcggcggcatgatcttcgtgctcgtctactgcaccgccggcatctccggcggccacatcaacccggccgtcaccttcgggctcttcctggcccgcaaggtgtccctcgtgcgcgcgctgctgtacatgatcgcgcagtgcctgggcgccatgtgcggcgtggggctggtcaaggccttccagagcgcctacttccagcgctacggaggcggcgccaacacgctggccgccggctactccaagggcacggggctcgccgcggagatcatcggcaccttcgtgctggtgtacaccgtcttctccgccaccgaccccaagcgcagcgcccgtgactcgcacgtcccggtgttggctcccctccccatcggcttcgccgtgttcatggtccacctcgccaccatccccatcaccggcaccggcatcaaccctgcaaggagcctcggagctgccaccatctacaacaatgagaaagcatgggatgaccagtggatcttctgggtcgggccaatggtgggcgcggccatcgctgccttctaccaccagtacatcctcagggccggggccatcaaggctctcggctccttcaggagcaacgcctaagcgttccatttcatgaacaagatgatgagtgtgctgaagcaatggcgacctgtcttcttcttcttcatcttcagggaggacgaggaggctgcggaacaaaaataagacatttcaaagagtttgccgctgcatcactggtcgtgctttgtttcagcagcttcatgcgtgcgtgcgtgtctgccttcttccgtgtaatccatccatcagtcgtgcgtgcgtgcgggcggatgtgttgtaattctgtcaaaatgggatcccttgtcttaattaattactagcatgtacaaaaaaaaaaaaaaaaaaaaaaaaaaaaaacattgtccccccccccccccccccccccccccccccccccccccccccccccccccccccccccc

SEQ ID NO: 15180 - DNA, 1060 bp, Brassica juncea
caagagaaagtagttatggctaaggacgtggaagccgtttccggagaagggtttcagacaagagactatcaagatccacccccggcgcctctgtttgatccgaaggagctgaccaagtggtctttttacagagcagtcattgccgagttcgttgctactctcctcttcttgtacatcactgttttgacggtcatcggttacaagattcagaccgatagtactgccgggggagttgactgcggtggagttggtatcctaggtatcgcttgggcttttggtggcatgatcttcattcttgtctactgcaccgccggtatctctggtggtcacattaacccggcagtgacatttggactattactagcgcgtaaagtgtcgttggttagagccatattgtacatggtggctcagtgtttgggtgcgatttgtggagttgggtttgtaaaagccttccaaagctcttactacgtccgttacggcggtggagccaactctctagcagatggctacagcacaggaaccggcctcgctgcagagattattggtactttcgtccttgtttacaccgtcttctccgctactgaccctaaacgaagcgccagagactcccacgttccagtgttggcgccacttcccattggatttgcggtgttcatggtgcacttggctaccattcccatcaccggaactggaatcaacccggcaaggagtttcggagcagccgttatcttcaacgagagcaagccatgggatgaccactggatattttgggtgggaccatttatcggagctgcgattgctgcattctaccaccagttcgttctgagggcttcaggttccaagtctctcggatctttcagaagtgctgccaatgtttaaatactctctcctccaccatgcagattctgaattaataaagatgataattggttctctatgtacaaattatctaaaatcagtttcagtttgttatcttatttgtgtgtttcttctacttgctcttttctacgttttcgttgagtgtagttgttcttatttttagccaatgccaagtttatcg

SEQ ID NO: 15181 - DNA, 1168 bp, Brassica juncea
aaccggaagcaaaagtaaaacagttcctaagaagaaacatccattacatataataatactacatggcaaaagacgtggaaggagcagagggattcgcggcgagggactacgaagatccgccgccaacaccgttcttcgatgcggaggagctgaccaagtggtctttgtacagagccgtcatagccgagttcgtagccactctcctcttcttgtatgtcactgttttgactgtcatcggctacaagatttcgtccgacactaaggccggaggcgacgagtgcggaggcgtcggaatcctcggcatctcatgggccttcggtggcatgatcttcatccttgtctactgcaccgccggtatctcaggtggtcacataaaccctgcggtgacgttcggcttgttcttggcaaggaaggtatcgttggttagagcagtgctatacatggtggctcagtgtttgggtgcgatttgtggagttggtttcgtcaaagccttccaaagcgcttactacgtacgttacggtggaggagcaaactctctagccgatggatacagcacagggactggactcgctgcagagatcattggaacattcgtcctggtctacactgttttctccgccactgaccccaaaagaaacgcacgagactcccacgttcccgtgttggcgccactcccaattggatttgccgtgttcatggtacacttggccactattccaatcaccggaaccggtattaacccggccaggagtttcggagctgcggtgatctacaacgagtccaagccgtgggatgaccactggatattctgggtgggaccattcatcggagctgccatagctgcattttatcaccaattcgttctaagggcctctggttccaaatccctcggatccttcagaagtgcagccaacgtttgagtttagccacacaaaacaaaacatggctgttatgtataaattgggcacgtgattttaaaatgtgtcctcttatgtcttttcttttcatctgcttctatttgtgtgaattccaattattgaagttttagtgttttgcgtgttttcatcatggcaatgtcagtgagtttgtttattgagaaaaagccgaccacattgtttcgcttatttgatctcatcctcctctaaacaatgtctaaattgtaacgttc

SEQ ID NO: 15182 - DNA, 1136 bp, Brassica juncea
agcaaagacaaaaacattggttggaacgaaaaaaaaaagcaaagaaagtagttatggcgaaggacgtggaagccgtttccggagaagggtttcagacaagagactatcaagatccacccccggcgcctctgtttgatccgaaggagctgaccaagtggtctttttacagagcagtcattgccgagttcgttgctactctcctcttcttgtacatcactgttttgacggtcatcggttacaagattcagaccgatagtactgctggcggcgttgactgcggtggagttggtatccttggtatcgcttgggcttttggtggcatgatcttcattcttgtctactgcaccgccggtatctctggtggtcacattaacccggctgtgacatttggactattactagcgcgtaaagtgtcgttggttagagccatattgtacatggtggctcagtgtttgggtgcgatttgtggagttgggtttgtaaaagccttccaaagctcttactacgtccgttatggcggtggagccaactctctagccgacgggtacagcacaggaaccggcctcgctgcagagatcatcggtactttcgttctagtctacaccgtcttctccgctactgaccctaaacgaagcgccagagactcccacgttccagtgttggcgccacttcccattggatttgcggtgttcatggtgcacttggctaccattcccatcaccggaactggaatcaacccggcaaggagtttcggagcagccgttatcttcaacgagagcaagccatgggatgaccactggatattttgggtggggccatttattggagctgcgattgctgcattctaccaccagttcgttctgagggcttcaggttccaagtctctcggatctttcagaagtgctgccaacgtctaaatactctctcattcaaccaagcagattctgaaataataaagatgataatcttttttctctatgtacaaattatccaaatcagtttcagtttgttatcttatttgtgtgttgttatctacttgctcttttctacattttcgttgagtgtagttgttcttattttaggccaatgccaagtttatcgagtgattggaattgaaaatcaagagtttatatcgt

SEQ ID NO: 15183 - DNA, 1209 bp, Chrysanthemum coronarium
gttctctagtaattggattacatatgtaagtgttatcaactcttggaccacactcccacaagcagatcaaaccattaccacttaaagcagccatgactaaagatgttgaagtagctgagcaccatggtggcgagtacacttccaaggactaccacgacccgcctccagccccttttttcgacgctgaggaactcactaaatggtcattttatcgtgcacttattgctgagtttgttgctactcttctgtttctgtatgtcacggttttgactgttatcggatacaaaagccagactgatccaaagttaaaccttgatcagtgtggtggtgttggtatccttggtattgcatgggcctttggtggcatgatctttatccttgtttactgcactgctggtatctctggaggacacattaaccctgccgtgacattcgggctctttgtggcacgaaaagtgtcattgatcagggctttgggttacatgatagcacaatgtttgggtgcaatctgtggtgttggtttggttaaagctttccaaagctcatactacaaccggtatggtggtggtgccaacactttggctgatggttacaacaagggtaccggactaggtgctgagattatcggcacctttgttcttgtctacactgtcttttcggccactgaccccaagaggagtgcacgagactcccatgttcctgtattggcacctctacccataggatttgcagtgttcatggtgcacttggccaccattccaatcaccggaaccggtatcaacccagccagaagttttggagccgctgttatctttaacgacgacaaggcatgggatgatcaatggatattctgggttggaccattcattggagctttcgccgcagcactataccaccaatttgtactaagagccgccgcaatcaaggcgcttggttcattcagaagcaatgcttaagcttaagatgtttatccatggctatatttattatgccttgtagatatctttggcaaatttgagtttgatgtaattgtaatttctttccttggatttgtttttctatgtacattgtaagtgtggtttcttttctttatttttggttttgtgatcaaagtatatcaagatcaaaaggtgtgaattatgtaatttaagagctcatgttcgtaaactgaaatcgtttagttcaatctatatttaaaccatgttgccg

SEQ ID NO: 15184 - DNA, 1185 bp, Chrysanthemum coronarium
ttttcatgccacaacacaccacacttcactctcaaaccatcaccactttaacaacacttaaaagcagccatgactaaagacgttgaagtagctgagcaccatggtggcgagtacacttccaaggactaccacgacccgcctccagccccttttttcgacgctgaggaactcactaaatggtctttttatcgtgcacttattgctgagtttgttgctactcttcttttcctatatgtcacggttttgactgttatcggatacaaaagccagactgatccaacgttaaaccttgatcagtgtggtggtgttggtatccttggtattgcatgggcctttggtggcatgatctttatccttgtttactgcactgctggtatctctggaggacacattaacccggcagtgacattcgggctctttgtggcacgaaaagtatcattgatcagggcgttgggttacatgatagcacaatgtttgggtgcaatctgtggtgttggtttggttaaagctttccaaagctcatactacaaccggtatggtggtggtgccaacactttggctgatggttacaacaagggtaccggactaggtgctgagattatcggcacctttgttcttgtgtacactgtcttttcggccactgaccccaagaggagtgcccgagactcccacgttcctgtattggcacctctacccattggatttgcagtgttcatggtacacttggccactattccaattaccggaaccggtatcaacccagccagaagttttggtgctgctgttatcttcaacgacgacaaggcatgggatgatcaatggatattctgggttggaccattcattggagctttcgccgcagcactataccaccaatttgtactaagagccgccgcaatcaaggcgcttggttcattcagaagcaatgcttaagcttaagatgcacatcaatggctatatttattatgccttgtagatatctttggcaaatttgagtttgatgtaattgtaatttctttccttggatttgtttttctatgtacattgtaagtgtggtttcttttctttatttttggttttgtgatcaaagtatttcaagatcaaaaggtgtgaattatgtactttaagagctcatgttcgtaaactgaaatcgtttagttcattctatatctaaaccgtgttgcc

SEQ ID NO: 15185 - DNA, 1058 bp, Chrysanthemum coronarium
ttttcatgccacaacacaccacacttcactctcaaaccatcaccactttaacaacacttaaagcagccatgactaaagatgttgaagtagctgagcaccatggtggcgagtacacttccaaggactaccacgacccgcctccagccccttttttcgacgctgaggaactcactaaatggtctttttatcgtgcacttattgctgagtttgttgctactcttctgtttctgtatgtcacggttttgactgttatcggatacaaaagccagactgatccaacgttaaaccttgatcagtgtggtggtgttggtatccttggtattgcatgggcctttggtggcatgatctttatccttgtttactgcactgctggtatctctggaggacacattaacccggcagtgacattcgggctctttgtggcacgaaaagtatcattgatcagggctttgggttacatgatagcacaatgtttgggtgcaatctgtggtgttggtttggttaaagctttccaaagctcatactacaaccggtacggtggtggtgccaacaccttggctgatggttacaacaagggtaccggactaggtgctgagattatcggcacctttgttcttgtctacactgtcttttcggccactgaccccaagaggagtgcacgagactcccatgttcctgtattggcacctctacccattggatttgcagtgttcatggtacacttggccaccattccaatcaccggaaccggtatcaacccagccagaagttttggagccgctgttatcttcaacgacgacaaggcatgggatgatcaatggatattctgggttggaccattcattggagctttcgccgcagcactataccaccagtttgtactaagagccgcggcaatcaaggcacttggctcattcagaagcaatgcttaagcttaagatgcacatcaatggctatatttatttatgccttgtagatatctttggcaaatttgagtttgatgtaattgtaatttctttcttggatttgttttctatgtacattgtaagtgtggtttc

SEQ ID NO: 15186 - DNA, 1007 bp, Cucumis sativus
atcagcaaattctcctttgtttttctaacactcaaattttgagaattgagattgtttgatttagagatatgccgaaggatattgaagctggagcgcatggtgggttcagtggaaaggattatgaagatccaccgcctgctccattgatcgacccacatgagtttgctcagtggtcattttacagagctattatagccgagtttgttgctactcttttgttcttgtatgttactgttcttactgttattgggtataaagttcagagtgatgttaagaatggaggggagacttgtggcggcgttggaattttgggtattgcttgggcttttggtggcatgatttttgtccttgtttactgcaccgctgggatttctgggggacatataaatccggcagtgacttttgggctatttttggctcgtaaggtgtctttggtgagagccatattgtacatggcggctcagagtttaggggccatttgtggctgtgcattggtgaaggcattccaaaacgctcactatactgagtacggtggtggagccaattccctcgccgacggctacagcacgggcactggattagccgctgagatcatcggaaccttcgttctcgtttacactgtcttttccgctaccgatcccaagagaaatgccagagactcccacgtccccgttttggctccactcccaattgggttcgcggtgtttatggttcatttggccaccattcctatcaccggcaccggaatcaacccagctcgaagttttggagctgccgtgatctttaacaaagacaagccatgggatgaccagtggatattttgggttggaccattcattggagctgcgattgctgcaatttatcaccaggttgtgttgagggcaggagcagttaaagctctgggatcgttcagaagttcgactgccgtatgaatgtaatacgaatctccatgaatggatgtggaagttgtttagaaaaaaatcccaaaggcacttgttttttaaaaa

SEQ ID NO: 15187 - DNA, 1267 bp, Lolium multiflorum
ccaacaagctcacctccttcttgcaacaaagcctgttcactctctcggagcagcaagccaaagaaaaaaagggatggcgaaggacgaggttgtggagagcggcggcgacttcgcggccaaggactacacggacccgccccccgcgccgctcatcgacgcggcggagctggcgtcgtggtcgctgtaccgcgcggtcatcgccgagttcatcgccacgctgctgttcctgtacatcacggtggccacggtcatcgggtacaagcaccagacggacgtgtccgtgaacggcaccgacgcgccgtgcggcggcgtgggcatcctcggcatcgcgtgggccttcggcggcatgatcttcgtgctcgtctactgcaccgccggcatctccggcggccacatcaacccggccgtcaccttcggcctcttcctggcgcgcaaggtctccctggtgcgcgcgctgctgtacatgatcgcgcagtgcctgggcgccatgtgcggcgtggggctcgtcaaggccttccagagcgcctacttccagcgctacggaggcggcgccaacacgctcgccgccggctactccaagggcacggggctcgccgccgagatcatcggcaccttcgtgctggtgtacaccgtcttctccgccaccgaccccaagcgcagcgcccgtgactcgcacgtcccggtgctggctcccctccccatcggcttcgccgtgttcatggtccacctcgccaccatccccatcaccggcaccggcatcaaccctgcaaggagcctcggagctgccaccatctacaacaatgagaaagcatgggatgaccagtggatcttctgggtcgggccaatggtgggcgcggccatcgcggccttctaccaccagtacatcctcagggccggcgccatcaaggcactaggctccttcaggagcaacgcctaagcgttcaatttccatgtctcatctgcaagctgaagcaatggcgacctgtcttcttcttcttcagggaggaggaggctgcgggacaaaaataagacatttcaaagagtttgccgctgcatcagtcgtcgtgctttgtttcagcagcttcatgcgtgcgtgcgtgtctgccttcttccatgtattcgatccatcgtgcgtgcgtgcgaatgtgttgtaattctgtcaaaatgggatcccttgtcttaattaattactagcatgtactcatgtcctgctttatctggccaccctatcatccaccttggcttctatctatcagctaaatccaat

SEQ ID NO: 15188 - DNA, 1289 bp, Lolium multiflorum
accaccacacatccaacaagctcacctccttctccttgcaacaaagcctccctgttcactctctcgcagcagcaagctagagaaaaaagagatggccaaggacgaagtggtggagagcggcggcgacttcgcggccaaggactacactgaccctcctccggcgccgctcatcgacgcggctgagctcgcgtcgtggtcgctgtaccgcgcggtcatcgcggagttcatcgcgacgctgctgttcctgtacatcacggtggcgaccgtgatcgggtacaagcaccagacggacgtgtccgtgaacggcaccgacgcgccgtgcggcggcgtgggcatcctcggcatcgcgtgggccttcggcggcatgatcttcgtgctcgtctactgcaccgccggaatctccggcggccacatcaacccggccgtcaccttcggcctcttcctggcccgcaaggtgtccctggtccgcgcgctgctctacatgatcgcgcagtgcctgggcgccatgtgcggcgtggggctcgtcaaggccttccagagcgcctacttccagcgctacggaggcggcgccaacacgctcgccgccggctactccaagggcacggggctcgccgccgagatcatcggcaccttcgtgctggtgtacaccgtcttctccgccaccgaccccaagcgcagcgcccgtgactcgcacgtcccggtgctggctcccctccccatcggcttcgctgtgttcatggtccacctcgccaccatccccatcaccggcaccggcatcaaccctgcaaggagcctcggagctgccaccatctacaacaatgagaaagcatgggatgaccagtggatcttctgggtcgggccaatggtgggcgcggccatcgcagccttctaccaccagtacatcctcagggccggcgccatcaaggcactaggctccttcaggagcaacgcctaagcgttcaatttccatgtctcatctgcaagctgaagcaatggcgacctgtcttcttcttcttcagggaggaggaggctgcgggacaaaaataagacatttcaaagagtttgccgctgcatcagtcgtcgtgctttgtttcagcagcttcatgcgtgcgtgcgtgtctgccttcttccatgtattcgatccatcgtgcgtgcgtgcgaatgtgttgtaattctgtcaaaatgggatcccttgtcttaattaattactagcatgtactcatgtcctgctttatctggccaccctatcatccaccttggcttctatctatcagctaaatccaatccgc

SEQ ID NO: 15189 - DNA, 875 bp, Lippia dulcis
tctctctgtgcatatacgtacgcaagcccctgtatctacacattccctctctctagaaatgacgaaggatcaggtgtcggagcacggctcttacggggcgaaggactaccacgaccctccgccggcgccgctgttcgacggggaggagctgacgaagtggtcgttttacagagcattgatagctgagttcatagcgacgctcttgtttctctacatcacagtgtgtactgtgattgggtacaagagccagacggtgactgatgagtgcggcggagtggggattctcggcattgcatgggcttttggcggcatgattttcatcctggtctactgcaccgctgggatttcgggtggtcacattaacccggcggtgacattcgggctgtttcttgcccgtaaggtgtcattggtgcgggccgtgatgtatatggtggcgcagtgtttgggtgccatttgtggagttgggctcgttaaggccttccaaagttcttactacaagaggtttgatggcggtattaatggcctctccgatggttacagcaccggagtcggattggcagctgagataattggcactttcgtccttgtctacaccgtcttctccgccaccgaccctaagaggagtgcaagagactctcatgtccctgtgttggcacctctcccaattggatttgcagttttcatggttcatttggccacaatcccgatcaccggcactggcatcaaccccgcccggagtcttggagctgccgttattttgaacaacgacaaggcctgggacaaacactggattttctgggttggacccttcattggtgcagccattgcagccttctaccaccagttcattttgagggcaggagcagttaaagccc

SEQ ID NO: 15190 - DNA, 1781 bp, Triticum aestivum
cacacaccacacaccctcgccttgttgtcttttacctaccgcttctccccgctccataaataccaccttcctctcctctcctctcgtcactcccccaccacacaccgcaagccccacctccattttttccagtcaggtttgcagcgagaaggaacagcaaggaaggctagctacacgccgatggccaaggacgaggtgatggagaccggcggcggcggcgacttcgcggccaaggactacacggacccgccgccggccccgctgatcgacgcggcggagctggcctcctggtcgctgtaccgcgccgtcatcgcggagttcatcgccacgctgctcttcctctacatcaccgtggccaccgtcatcgggtacaagcaccagacggacccggcggtgaacgccgccgccgacgcggcgtgcggcggcgtgggcgtgctcggcatcgcctgggccttcggcggcatgatcttcgtcctcgtctactgcaccgccggcatctccgggggccacatcaacccggccgtcaccttcggcctcttcctggcgcgcaaggtctccctggtccgcgcgctgctctacatgattgcgcagtgcctcggcgccatgtgcggggtcggcctcgtcaaggccttccagagcgcctacttcgtcaggtacggcggcggcgccaacacgctcgccgccggctactccaagggcaccggcctcgccgcggagatcatcggcaccttcgtgctcgtctacaccgtcttctccgccaccgaccccaagcgcagcgcgcgcgactctcacgtcccggtgctggcgcccctccccatcggcttcgccgtgttcatggtccacctggccaccatccccatcaccggcaccggcatcaacccggccaggagcctgggcgccgccgtcatctacaacaaggacaaggcctgggatgatcagtggatcttctgggtcggccccatgatcggcgcggcgatcgcggccttctaccaccagtacatcctcagggccggcgccatcaaggccctcggctccttcaggagcaacgcgtaacaagttatcatccacgtcagctccatgcaagattgaagcaatggcgacctgtgttgtgcccatccagagagaaatgcgcttttgcaacttctcaacagttcagttggcccgcaatggtcgtgttatttatgtgtcggcagcagcatatgcgtagtgcgagtacgtggttggcctccatgtgcccggtcctgcgtgccgtgtcttgtaattcggtccatgggatcgctttgtcttaattagcccgcattgcttttcctactgtatttaaatttggcgaccatatgatcgatccaacgtcgccacctttctgtctaagtcatgaatccaccaagcaagtgatcatcccaaataagtgctctattgtcttgtttgtgacgagtggtggtactcttgctttctatcttgttgcttctttgccgatgtgaatcctcaagcctgaatgatcatatgtcgggtgatgcgccaactcttgttttctgcccttgcatgtcctgctgctctacggtctcatccactcgcggagctgtctctttctctcgcttttgttccttgattcctatagttatcacttgtcatgatccttacacctatcatgggatgttgtcatccagcaggattcttgtctttggagagagtgttgcatgtctttttcattacgaccgaagaccatacaaactcttgtgttgtaatgggggtgattgtttcgatcaattccaccctaagtaata

SEQ ID NO: 15191 - DNA, 1294 bp, Brachypodium distachyon
accacacaccacacacaacacaccgctcgcaccctttcttacaaggctagtcacactctctcttgcatccgcggcaagtaacggcaacacccatggccaaggacgaggtgatggagagcggcggcggccaccaggacttcgcggccaaggactacacggaccctccgccggcgcccctcatcgacgccgcggagctcgcctcctggtcgctctaccgcgccgtcatcgccgagttcatcgccacgctgctgttcctctacatcaccgtggccaccgtcatcggctacaagcaccagacagacgtctcggcgtccggccccgacgcggcgtgcggcggcgtggggattctcggcatcgcgtgggccttcggcggcatgatcttcgtgctcgtctactgcaccgcgggcatctctgggggacacatcaacccggccgtgaccttcgggctcttcctggcccggaaagtctccctggtccgggccctgctctacatgatcgcgcagtgcctcggcgccatgtgcggcgtcgggctcgtcaaggcgttccagagcgcctacttcgtgaggtacgggggcggagcgaacacgctcgctgcggggtactccaaggggactggacttgccgcggagattattgggaccttcgtgctcgtctacaccgtcttctccgccaccgaccccaagcgcagcgcccgcgactctcacgtgccggtgttggctcccctcccaatcggcttcgccgtcttcatggtccacttggccaccatcccaatcaccggcactggcatcaacccggccaggagccttggagctgccgtcatcttcaacaaggacaaggcctgggatgatcagtggatcttctgggtcggcccaatggtcggcgcggcgatcgcggccttctaccaccagtacatcctcagggccggcgccatcaaggccctgggctccttcaggagcaacgcctaagttacaatctgcaagctgagtagtgagctgaagcaacggcggccagtgccgggggagagaataagcgcctttaccacctttcgaagagtttgccgctgcaatatggtcgtttctgttgttttcagcagctgcatgcgtgtccgtgttccgcttcttccctgtaatcgaatcatgcgtgcaatgtgtttgttgtactcctgtccaccatggggatcatttccttgtgtcttaatcagccagtactcctgttcctatttaatttagcgactatatgaatgatcgatcgagtgcattgccgccttctgtctgaatcaatccgccaattaagc

SEQ ID NO: 15192 - DNA, 1138 bp, Gossypium hirsutum
agctatggctaaggacattgaggttggtggtgagttccaggccaaggactatcatgatcctccacccgctccattggtagacgctcaggagttagccaagtggtctttttacagggctgtcatagctgagttcattgccactctcctctttctctacatcactgtcttgactgtgatcggttacaagacccagaccgaccttgctaagggcggtgaagattgtggaggcgttggcattctcggcattgcttgggcttttggtggcatgatttttatccttgtttactgcactgccggtatctctgggggacacatcaacccagcagtgacctttggacttttcttggctaggaaggtgtcgttagttcgagccatattttacatgggtgctcagtgtttgggagccatatgtggatgtgggctggtcaaggccttccaaaactcatactacaaccagtatggaggaggagccaacagcctggctgaaggatacagcactggaactggtttggcggctgaaatcatcggcacctttgtccttgtctacactgttttctctgcaactgatcccaagaggaatgcaagagactcccatatccctgtcttggcaccacttcccattgggtttgctgtgttcatggttcacttagccactattcccatcaccggaaccggtatcaacccagctcgtagtttgggggctgctgttatcttcaaccaggacaagatatgggatgaccattggatattctgggtaggacctttcattggagctgcaattgccgcaatctatcaccagtttgtattgagggcatcgggtgctaaagctctgggatccttcaggagcagctctgccatgtaaaatatgttgaagcaagaattgtgcagccataagttcaaagtaaattaaggctggcatgcatggatgaatgaaatgaagttttcttcagaccgttgaatttgtaaagaataatcaaagtgtaatgcttcttctctatgtatctggcacttatttttaacgtgcctcaaactttgctttatctaaatggagttcagttccatttcctaagaatatggaaaatagatttgagttgtctacaaatgtgttaatccgagtatataatagttttaagattaa

SEQ ID NO: 15193 - DNA, 1106 bp, Arabidopsis lyrata
tacaaatctgaacaaatattaaagctcatctctctcatctttggccatggcaaaagatgatgatgttcaagagggtggagcaccggcggcgagagactacagggatccgcctcccgcaccattgttggacatggaggaaattcggaagtggtcgctctatagagcggtcatagctgagttcgtggcgacacttctgttcctctacgtctcagtcctaaccgtaatcggctacaaagctcaaaccgatgcaaccgccggaggagtagattgcggcggcgtaggaatattgggaattgcgtgggcgttcggtggaatgatctttgttctcgtttactgtaccgccggtatctccggtggtcatataaatccggctgtgacggtgggactattcctggctcgtaaagtgtcattggtgcggacagtgttatacattgtggctcagtgccttggtgccatctgcggttgtggtctcgtcaaagcattccaaagttcttactacaccagatatggaggtggagccaacgagctcgccgacggctacaacaaaggtaccggacttggtgccgagatcatcggaacttttgtccttgtttacaccgtcttctcggccaccgatcccaagcgaagtgctcgtgactctcacgtgccagtgttggcgccacttcccattggatttgccgtcttcatggttcatttagccaccattccaatcaccggaaccggtatcaacccggctcgtagctttggagctgccgttatttacaacaacgaaaaggcctgggacgaccaatggatattttgggttggaccgatgatcggagcagcagcggcagcgttttaccatcagtttattttaagagcggctgcgattaaagctcttggctcctttaggagctttgcttaatttatatttattttaaattaaaccacaagttattaatctttaatcaaatgatgcttaccaatgtattaagcggaagttacatgtatcttctttacatgtttctgttcttttttcttcacttcatggaatattttcccattcgtgtaattgtaaatgtggttttaattaatgttgcgttaagataaaatctcaagtttgcttt

SEQ ID NO: 15194 - DNA, 908 bp, Chrysanthemum coronarium
aaagtaaagagctagaaaatgagcaaagacgtagaggttggcggacatgatcactacggtgctaaagactaccaagaccctccaccttctccccttttcgactccgaagaactcaccaaatggtctttttaccgagccattatagccgagttcattgccacaatgttgttcctttacatcactgtcttgactgtcatcggttacaagtcccaagtcgaccccacccacagcactgaccaatgtggtggtgttggaatccttggtatcgcatgggcttttggaggcatgatttttgtccttgtttattgcactgctggtatctcaggaggacacattaaccctgctgttacattcgggctgtttttggctaggaaagtaacactaccaagggcatttatgtacattgtggctcaatgtttgggtgctatttgtggttgtggtcttgttaaggctttccaaaagacttactatcatacttatggtggtggtgctaatgagcttgctgatggctacagcaaaggaaccggtttgggtgctgaaatcatcggtacctttgttcttgtttacaccgtcttctcggctactgaccccaagagaaatgcacgcgattcccatgtcccagtgttggcacctcttcctatcggatttgcggtgttcatggttcacttggccacaatcccaattactggaactggaatcaacccggctcgtagttttggtgctgctgtcatgtatggtaaagaaaaagcgtgggatgatcaatggttattctgggttggacccatgattggagcagccatcgcagccttttaccaccagtacgtattgagagctggtgcggtcaaaggctgcgagatctttcaggagcaatgcctagatcaagagcatgaaatatgcaaatgtatttc

SEQ ID NO: 15195 - DNA, 979 bp, Flaveria ramosissima
cgtcttcatcatcattcaccaccaatgacaaagacgttgaagtggctgagcaccacagcggaaaagactaccatgacccgcctccggcaccgctcatcgactccgatgagctgaccaaatggtcgttctatagagctgttatagcagaattcattgccacactactgtttctttatgttaccgtgttgaccgttatcggatacaagagccagaccgacccgaaccttaatacggatcagtgcggtggcgttggcatcctcggcatcgcgtgggcattcggtggcatgatctttatcctcgtttactgcaccgccggtatctctggaggacacattaacccggctgtgacgttcgggctctttttggcgagaaaggtgtcattgatcagggcattgttgtacatggttgcacaatgtttgggtgcaatttgtggtgtgggtttggtcaaagccttccaaagttcatactacaacaggtacggtggtggtgctaacgagttagctgatggctacaacaaaggcacgggactaggtgctgagatcatcggcacctttgttcttgtctacactgtcttttcagctaccgatcctaagaggagtgcccgtgactctcacgtccctgtgttggcaccactgcccatagggtttgcagtcttcatggtacatttggccaccattccaatcaccggtaccggaatcaacccggctagaagcttcggggccgcagtgatctacaacaacgagaaggcttgggatgatcaatggattttctgggtcggaccgtttgtgggtgcagcagcagccgcgttctaccatcaattcgtactgagagcagcggccattaaggcacttggttcgttcaggagcaatgcatgatcgaaagatgacgaattcatccatgcaaacagaataaaatttggatggatatttgaatgtggaagtgtttaattgtagataagtgttttaatttaatgtccttt

SEQ ID NO: 15196 - DNA, 1134 bp, Gossypium raimondii
aaaaacaaaggctgtaatccaagcttctattcagttttgtaagagctatggctaaggacattgaggttggtggtgagttccaggccaaggactaccatgatcctccacccgctccattggtcgacgctcaggagttagccaagtggtctttttacagggctgtcatagctgagttcattgccactctcctctttctctacatcactgtcttgactgtgatcggttacaagacccagaccgaccctgctaagggcggtgaagattgtggcggcgttggcattctcggcattgcttgggcttttggtggcatgatctttatccttgtttactgcactgccggtatctctgggggacacatcaacccagcagtgacctttggacttttcttggctaggaaggtgtcgttggttcgagccatattttacatgggtgctcagtgtttgggagccatatgtgggtgtgggctggtcaaggccttccaaaactcgtactacaaccagtatggaggaggagccaacagcctggctgaaggatacagcactggaactggtttggcggctgaaatcatcggcacctttgtccttgtctacactgttttctctgcaactgatcccaagaggaatgcaagagactcccatatccctgtcttggcaccacttcccattgggtttgctgtgttcatggttcacttagccactattcccatcaccggaaccggtatcaacccggctcgtagtttgggggctgctgttatcttcaaccaggacaagatatgggatgaccattggatattctgggtaggaccttttattggagctgccattgccgcaatctatcaccagtttgtattgagggcatcgggtgctaaagctctgggatccttcaggagcagctctgccatgtaaaatatgttgaagcaagaattgtgcagccatgagttcaaagtaaaggctggcatgcttggatgaatgaaatgaagttttcttcagaccattgaatttgtaaagaataatcaaagtgtaatgcttcttctctatgtatctggcacttatttttaacgtgcctcaaactttgctttatttaaatggagttcagttccttttcctaagaatatggaaaatagatttgagttgt

SEQ ID NO: 15197 - DNA, 1608 bp, Panicum virgatum
tttgttttagaaggcaaagtacgtaagcacgaaacctatagaacagggtgaatagcccctccggttgatcactggccaccagtttgggtttggctctggcgtgacataatgatgagggtttagtcggttgtgggcggcaaaaattataagcgaaaaaactgtaaccagaaatggaacccttatccctcactaaaaatgtaatcaggcggtcgctaagcaagccatcattgaggcgacgagctcgtcatctcccctgcacgagctactagctgtgtcttcccgaggcccatatataccatgcctctcccgtcccctcacaccactcaacaagtaagcaagcttcagaagcaagtgccggcggcatagcattctgagagctgagctagcagctggttggccggcatggcgaaggacatcgaggcgtcggggcccgaggcgggcgagttctcggccaaggactacacggaccccccgccggcgccgctgatcgacgcggaggagctgaccaagtggtcgctgtaccgcgcggtcatcgccgagttcattgccacgctgctcttcctctacatcaccgtggccaccgtgatcgggtacaagcaccagacggacgcggcggcgtcgggccccgacgcggcgtgcggcggcgtgggcgtcctcggcatcgcgtgggccttcggcggcatgatcttcatcctcgtctactgcaccgccggcatctcgggcgggcacatcaacccggccgtcaccttcggactgttcctggcgaggaaggtgtcgctggtgcgcgcgctgctctacatcgtggcgcagtgcctcggcgccatctgcggcgtggggctcgtcaagggcttccagagcgcctacttcgtgcgctacggcggcggcgccaacgagctcagcgacggatactccaagggcacggggctcgccgccgagatcatcggcaccttcgtgctcgtctacaccgtcttctccgccaccgaccccaagcgcaacgcccgcgactcccacgtcccggtgttggctcctctcccaattgggttcgccgtgttcatggtgcacctggccaccatcccgatcaccggcactggcatcaacccagccaggagcctgggagccgcggtcatctacaacaaggacaaggcctgggatgaccaatggatcttctgggtgggcccgctgatcggcgccgccatcgccgccgcgtaccaccagtacgtgctcagggccagcgccgccaagctcgggtcctaccggagcaacgcctaggtccggccggccgccggcgaggaggggggccccaccgaagtgtagatatgcgcgcacaaccgacgcccgcttcccgatcgatccgttcatctgctgtcgcagttcgtagtagtcgtgtaatcgtgtcatgctcgcggggtctccgcgccgtgtttcgatgtgttccggagtccgccgccacgttcgcttgctgtgttttgcttcgaaaaaaagtgtgatataatctttgctatttttttctgtatgtatgtatttggtatggagaatttggaaactgagttatgtgagcttttatctatcgtctatggagcagtgcggcgtatatatctttgcatacgg

SEQ ID NO: 15198 - DNA, 1025 bp, Amaranthus tuberculatus
atcccattcccatattctctaaaacaaagaaacaatacaatgactaaggatgtggaagcagtaacagagcaatctgcacagccagaattctcagcaaaagattaccatgatccaccaccagctcctctaattgacttagaggagcttacaaaatggtcattttacagggctattatagctgagtttgtggctacactccttttcctttatattactattcttactgttattggttataaaagccagactgatactactgctggtggtgatgattgtggtggtgttggtatcctcggtatcgcttgggcttttggtggcatgatctttatccttgtttactgcaccgccggaatctcaggaggacacataaacccagcagtgacctttggactgttcttggcaaggaaagtgtcactaccaagggcatttttgtacatggtagctcaatgtcttggtgccatttgtggtgttgggttagtgaaaggcttccaaaaggcttactatgttaggtatggtggaggtgttaaccagatgtcccctggttacaacaagggaactggtcttggtgctgaaattattggtacttttgttcttgtttacactgtctttgctgctactgaccctaagaggagcgctagggactctcatgttcctgtattggcaccacttcccattggtttcgcagtatttatggttcaccttgctaccatcccaatcactggtaccggtatcaaccctgctaggagtttcggtgctgccgtgatctacaaccacgagaaatcatggcatgaacactggattttctgggtgggaccatttgttggagcagcaatagcagcattctaccaccagtacattcttagggctgcagcaatcaaggctttgggatctttcagaagcactgcttaatccaaaaatctatgtttttatttatggggttaatgaagggaccattaaactgtagatattaaaaatgggcttaattattaaagtaggggttgggttttggtttcgacttccctaac

SEQ ID NO: 15199 - DNA, 970 bp, Ambrosia trifida
gtggcgccggagcaccacagcggcaaagactaccatgacccgcctcctgcgccattgttcgacgccaaagagctgaccaaatggtcattctatagagctctcatagctgagtttgttgccacccttctgtttctctatgtcacagtgttgactgttattgggcacaagagcaccactgaccccgccttagacgccgaccagtgtggcggtgttggcatccttggaattgcatgggcctttggtggcatgatcttcatacttgtttactgcactgccggtatctctggaggacacattaacccggctgtgacattcgggctattcttggctaggaaagtgtcattaattagggctgtttcgtacatggttgcacaatgtttgggtgcaatatgtggtgtgggtttggtcaaggctttccaaagctcctactataacaggtatggtggtggagccaatacgttgtccgatggctacaacaaaggcaccggactaggtgctgaaatcatcggcacttttgttcttgtctacaccgtcttctcggctactgatcctaagagaaatgcccgagactctcatgttcctgtgttggcaccactgccaataggatttgcagtcttcatggttcacttggcaaccattccaatcaccggcaccggaatcaacccagccagaagctttggcgctgccgtgatttacaatgacgacaaggcgtgggatgatcattggcttttctgggtcggaccatttctgggcgcagctgcagcagcgttctaccaccagtttatactcagagcagcagctgttaaagcacttggttctttcagaagcaatgcataattgtaagacgatgaatttatatatccatgtaaaagaataagattgtactgacgacacaattgatcgacgttaaaatggatggatatatgataagcatggaagtgttgattcgtagatcagtatgtttaatttc

SEQ ID NO: 15200 - DNA, 1084 bp, Brassica oleracea
aacaaacactaaaactcatttatctttctctctccctctcatcatcatctttggccatggcgaaggacttggaggtgcaagagggaagagcagcgagggattaccaggatccacccccggccccattgtttgacatggaggagcttgggaagtggtcgctctatagagcggtcatagctgagtttgtggctacacttctcttcctttacgtctcaatcctcaccgtaatcgggtacaaagctcagaccgacgcaagcgccggaggagctgattgcggcggtgttgggatattggggattgcgtgggctttcggtggaatgatctttgttctcgtttactgtaccgccggtatctccggtggtcatataaatccggctgtgacgttcggactgttcttagctcgaaaagtgtcattagtgaggacagtgttatacattgtggctcagtgccttggtgccatatgtggttgcggtctggtgaaagcattccaaagttcttactacaacagatatggaggtggagccaaccagcttgccgacggctacaacaaaggtaccggactaggtgccgagatcatcggaacatttgtccttgtctacaccgttttctcggccaccgatcccaagcgaagtgcacgtgactctcacattccagttttggcgccacttcccattggttttgccgtcttcatggttcacttggccaccattcccatcactggaaccggaatcaaccccgcccgtagcttcggagccgcagttatctacaaccaagaaaaggcctgggacgaccaatggatattttgggtgggaccgatgatcggagcagcagcggctgcgttataccatcagtttgttctaagagcggctggaattaaatctcttggctcctttaggagctctgcttaacttgaattgtttgaattaagccacaagttaatctttcataaaatgatgatgattacctgtattaagcgtaagctacccaaagttcaaaaaaaaagaagcgtaagctacctgtatcttttatttatttatatgttctgtttttataatttcttggaattttcccattggtcgcaaac

SEQ ID NO: 15201 - DNA, 1169 bp, Chrysanthemum coronarium
cagcatgtactaaaaataattgaacaactctatctcaaccctcagtagcaccataaatagcaacctttcaacaccacacacttcacaccaaaacattcacttctatccatctctattctttgaagtttgaacatcatcaatcatatcagccatgacaaaagacgcagctgagcaccatggtgccaaagactaccatgaccctccaccagcacctttgttcgatgctgatgagctaaccaaatggtctttttaccgagctcttatagctgagtttattgcaacacttttgtttctttacgtgacggttttgaccgttatcgggtacaagagcactactgatccaacgttaccaggcgttgatgagtgtggcggtgttggtatacttggtattgcatgggcttttggtggcatgatttttgttcttgtttattgcactgctggtatctctggaggacacattaacccagctgtgacattcgggttatttttggcaaggaaggtgtcattaattagagcagtaatgtacatgctagcacaatgtttgggtgcaatctgtggagttggtttagtcaaagctttccaaagttccttatacaataggtacggtggtggggccaacactttggccgatggttacaacaagggcactggactaggtgccgaaatcatcggcacctttgtccttgtttacaccgtcttctctgctaccgaccctaagagaagcgcccgagactctcatgttcctgttttggcaccattgcccatagggtttgcagtcttcatggttcacttagccaccattcccatcactggtaccggaatcaaccccgctagaagctttggcgcggccgtgatttacaacaacgacaaggcttgggatgaccactggatgttctgggtcggaccatttttgggggcagccgcagcagcattctaccaccaatttgtacttcgagctggagccattaaagcacttggttctttcagaagcaatgcataaatcgagagatgattaatgtgtacgtccatgcaaaaataataaacgaacgatgcgacaaaggtttaatctagagtcgaggttgaggcgttaaaatgggtggatgtacgagtgtggaagtgttcaattgtagatagtaatttaagttcttttttagcattgtaatttcata

SEQ ID NO: 15202 - DNA, 1159 bp, Chrysanthemum coronarium
gtactaaaaataattgaacaactctatctcaaccctcagtagcaccataaatagcaacctttcaacaccacacacttcacaccaaaacattcacctctatccatctctatagtctttgaacatcgtcatatcatatcagccatgacaaaagacgcagctgagcaccatggtgccaaagactaccatgaccctccaccagcacctttgttcgatgctgatgagctaaccaaatggtctttctaccgagctcttatagctgagtttattgcaacacttttgtttctttacgtgacggttttgaccgttatcgggtacaagagcactactgatccaacgttaccaggcgttgatgagtgtggcggtgttggtatacttggtattgcatgggcttttggtggcatgatttttgttcttgtttattgcactgctggtatctctggaggacacattaaccctgctgtgacattcgggttatttttggcaaggaaggtgtcattgattagagcagtaatgtacatgctagcacaatgtttgggtgcaatctgtggtgttggtttagtcaaagctttccaaagttccttatacaataggtacggtggtggggccaacactttggccgatggttacaacaagggcactggactaggtgccgaaattatcggcacctttgtccttgtctacaccgtcttctctgctactgaccctaagagaagtgcccgcgactctcacgttcctgttttggcaccattgcccatagggtttgcagtcttcatggttcacttagccaccattcccatcactggtaccggaatcaaccccgctagaagctttggcgcggccgtgatttacaacaacgacaaggcttgggatgaccactggatgttctgggtcggaccatttttgggtgcagccgcagcagcattctaccaccaatttgtacttcgagccggagccattaaagcacttggttctttcagaagcaatgcataaatcgagagatgattaatgtgtacgtccatgcaaaaataataaacgaacaatgcgacaaaggtttaatctagagtcgaggttgaggcgttaaaatgggtggatgtacgagtgtggaagtgttcaattgtagatagtaatttaagttcttttttagcattgtaatttcata

SEQ ID NO: 15203 - DNA, 850 bp, Flaveria ramosissima
taccaccaccggagtatttgcactctctagcaaccatgactaaagacgtgcccgaacaaggttcgttctccgctaaagactaccacgacccgcccccggccccgttgatcgaccccgaggagctctccaaatggtcgttctatagggcgattatcgcggagttcatcgccacacttttgttcttgtatattactgtcttgactgttattggctacaagagcaccactgaccccgccttgaacgctgaccagtgcggtggcgttggtatcctcggtatcgcgtgggcctttggtggcatgatctttgtccttgtttactgcactgctggtatctctggaggacacattaaccccgcggtgacgttcggtctgtttctggctcgtaaagtgtcgttgatccgagcgtttatgtacatggtggctcagtgtttaggagccatttgcggtgtgggtttggtgaaggctttcaacaaaagcctctacaacaggtacggcggaggagccaacgagctggccgacggctacaacaaaggcaccggcctgggtgctgaaatcatcggcacttttgttcttgtttacactgtcttttcagccaccgaccccaagaggagtgctagagactcacacgttcctgttttggctcctcttccaattgggtttgcggtgttcatggtgcaccttgcaacaatccccatcactggaaccggtatcaacccggctaggagtcttggagccgcggtcatctacaacaacgaaaaagcatgggatgatcagtggatattctgggtgggaccattcgtgggtgcagccattgcagccttctaccaccaattcatattgagagcaggtgc

SEQ ID NO: 15204 - DNA, 1307 bp, Linum usitatissimum
agtttcggagctgctgtcatcttcaacgagtcgaagccatgggatgaccattggatcttctgggttggaccactcccatctctctctctctctctctgtatctctctacctcactgcttccaactacttcattattaaggatgacgaaagaaggggtagtagcggagcgaggctccttctcggccaaggactaccacgacccgccaccagctccattctttggcgccgccgagctcggcaaatggtccttctacagagccttaatcgccgagttcatcgccactcttctcttcctctacatcaccgtcctcaccgtcattggctacaaattccaatccgacggcgacgcctgtggtggcgtaggcattctcggcatcgcctgggccttcggcggcatgatcttcgtcctcgtctactgcaccgccggcatctccgggggccacattaacccggcggtgacgttcgggctgtttctggcgaggaaggtgtcgttgattagggcggtgatgtacatggtggcgcaatgcttaggagcaatctgtggggtgggattagtgaaggcttttcagaagtcccactacaccaggtacggcggtggagccaactcccttagcaccgactacagcaccggcaccggagttggtgcggagatcatcggcactttcgttttggtgtatacagttttctccgccaccgatcccaagagaagcgctcgtgattcccatgtccccgtattagcgccactgccaattggatttgcagtgttcatggttcatttggctaccattccgatcacgggcactggtatcaacccagcgaggagtttcggagctgctgtcatcttcaacgagtcgaagccatgggatgaccattggatcttctgggttggaccattcgcgggagcagctctggcggcattctttcaccagttcatattgagagcaggagctgtcaaggcacttgggtccttcaggagcagcgcaagtgctgtataattaattagattaatggcagagatagaactctctggttcaagtgtagccatcgaaaatgaaaatgtttagattgaacttgaaccatggcagagagagctccttttgttttgcctttaaagctcagctttcaacttgaacctgaacttggaccatcatcatcatcatcatgatgttgttgctgttgtatctttctttctacgtctgctagcttatttatgatgcatttataatgtaatgtagccaaggccattattctcttctatagctttctaccatcacatcatatcaatttatgcatatgtagttttgttt

SEQ ID NO: 15205 - DNA, 1145 bp, Helianthus annuus
cacaactattcacctcttctcatctctcctcaccaccacaaccatgactaaagatgttgaagtggcggagcaccacggcggcggaagcgagtacgccgctaaggactaccacgacccgccgcctgctccgttttttgacgcggacgagctcaccaaatggtcattctaccgtgcattgatcgccgagtttgtcgccacactccttttcctctatgtcaccgttttgaccgttatcgggtacaaaagccagactgatcctaaattggaccttgatcagtgcgggggtgttggcatcctgggcatcgcctgggcctttggtggcatgatctttattcttgtttactgcactgccggtatctctggaggacacattaacccggctgtgacattcgggttgtttttggcgagaaaggtgtctttgattagggcgttagggtacatgatagcacagtgtttgggtgcgatttgtggtgtgggtctagtgaaggctttccaaagctcgtactacaacaggtacggtggtggtgcgaacgagttggctgacggttacaacaagggtactggacttggtgctgagattatcggaacctttgtccttgtttacactgtcttctctgccaccgatcctaagaggagtgcacgagactcccatgttcctgtattggcaccactgcccataggatttgccgtattcatggtgcacttggccaccattcccatcaccggaaccggtatcaacccggccagaagttttggcgccgcggtgatctacaacaacgaaaaggcctgggatgatcaatggatattctgggttggaccattcatcggagcattcgccgccgcagtctaccaccagtttgtgcttagagccgccgcgatcaaagcacttggttcattccgaagcaatgcataagcttgaaagatgttcatccagccatggtggttcttggcttgtagatatctttgaaaaaaatcgtttattgtaattgtattttcttttgagtttcgttaatatgtatgcaagtgtgtttttttatttctttctttttttttttttaaatttgattttgatatctaatgttttcaagatcaaatggtgtgagatatgaaatttatgttatcaaaagttcacgaaaatggttgcc

SEQ ID NO: 15206 - DNA, 1046 bp, Helianthus annuus
tattgtttgccacaaactaagattccataaaataatacaattacaaacacataacaccgaccacacctactcaaaacatcaaaccacacaaaacatcaaactaaactaatcttttattattcccgatcccctaaacactccactcacaaaaccatttaccacttttcacttcccacccacaaaaccagccatgactaaagacatagaagtaacggagcaccatggtggcagcagcgagtacgctgccaaggactaccatgacccgcctccggccccgttattcgacgccgaagagctcaccaagtggtcattctaccgtgcacttatagccgaattcgtcgccactctcctcttcctctacgtcaccgttttgaccgtcattggctacaaaagccagaccgatccgaagttggacctcgatcagtgcggcggcgttggcatcctcggcatcgcttgggcctttggtggcatgatcttcattcttgtttactgcaccgctggtatttctggaggacacattaacccggccgtgacattcgggctgtttttggcgagaaaagtgtcgttggtcagggcggttggctacatggtcgcgcaatgtttgggtgccatttgtggtgtaggtttggtgaaggctttccaaagctcgtactacaaccgatacggtggtggtgccaacgaattggccgatggttacaacaaggggaccggacttggtgctgagatcatcggtacctttgttcttgtttacaccgtgttctctgccactgaccctaagagaagtgcacgagactcccatgttcctgtattggcaccattgcctataggctttgccgtattcatggtgcacttggccaccatcccgatcaccggcaccggcatcaacccggccagaagttttggcgccgccgtgatttacaacaacgaaaaggcttgggatgatcaatggatattctgggtcggaccattcatcggagcctttgccgctgcggtctaccaccagtttgtgcttagagccggcgcaatcaaggcacttggttcattca

SEQ ID NO: 15207 - DNA, 942 bp, Ambrosia trifida
gaagtgacggagcaccatggtggcagcagtgagtacaccgccaaggactaccacgacccgcctccagccccattgttcgacaccgaagaactcaccaaatggtcgttctatcgtgcactaatcgcagaattcgttgcaactctcctcttcctctacgtgactgttttgactgtcatcggatcaaaagccagaccgatccgaaattgaacctagatcagtgtgggggcgttggaatcctcggcatcgcatgggcctttggtggcatgatcttcatccttgtttactgcaccgctggtatttctggaggacacattaacccggccgtgacgttcgggctatttttggcaaggaaggtgtcgttgatcagggcggtcggatacatggttgcgcaatgtttgggtgccatttgtggtgttggtttggtgaaagctttccaaagctcgtactacaaccgatacggtggtggtgcaaacgagttggccgatggttacaacaaggggactggacttggtgctgagatcatcggcacctttgtacttgtttacaccgtcttctccgccactgatcccaagagaagtgcacgagactcacacgttcctgtattggcaccacttcctattggctttgccgtattcatggtgcacttggctactattccgatcactggcactggcatcaaccccgctagaagctttggcgccgctgtcatttacaacaacgaaaaggcttgggatgatcaatggatattttgggtgggacctttcatcggagcctttgctgccgcggtctaccaccagtttgtgcttagagccgccgcaatcaaagcacttggttcattcagaagcaatgcctaagcttgaaagatgttcatcaatggcagttgttgccttgtagatatctttaggaaaaaatggtagtgaaatgtaattgtgttttttctct

SEQ ID NO: 15208 - DNA, 3032 bp, Brassica rapa
acatgcaaaataacaagaggagctctcagtctcttactataaaaccagagcacatgttcctctcactaaccacacaacagagaagtaataaaacccatttgtggaaagaaagaaaacaaagaaactagttatggcgaaggacgtggaagccgtttccggagaagggtttcagacaagagactatcaagatccaccgccagcgcctctgtttgacccggcggagctgaccaagtggtctttctacagagcagtcatcgctgagttcgtagctactctcctcttcctgtacatcaccgttttgacagtcatcggttacaagattcagaccgatagtactgccggcggcgttgactgcggtggagttggtatcctaggtatcgcttgggcttttggtggcatgatcttcatccttgtctactgcaccgccggtatctctggtggtcacattaacccggcagtgacattcgggctactcttggcacgtaaagtgtcgttggttagagccatattgtacatggtagctcagtgtttgggtgcgatatgtggagttgggttcgtcaaagccttccaaagctcttactacgtccgttacggcggtggagccaactctctagccgatggttacagcacaggaaccggactagccgcagagatcattggtactttcgttcttgtctataccgtcttctccgctactgaccctaaacgtagtgccagagactcccacgtcccagtgttggcgccacttcccattggatttgcggtgtttatggtgcacttggctaccattcccatcactggaactggaatcaacccggcaaggagtttcggagcagccgttatcttcaacgagagcaagccatgggatgaccactggatattttgggtgggaccattcgttggagctgcgatagctgcattctaccaccagttcgttttgagggcttcaggttccaagtctctcggatctttcagaagtgctgccaacgtttaaatactctctcatttccaccaatcagattctgaaataataaagatgataatcttttactctatgtacaaattatccaaatcagtttcagtttgttatcttatttgtgtgttttccacttgctctttagtgtgtgtttcgttgagtgcaattgttcttattttacgccaatgccaagtttatgaagtgactagaattgaaaatcaaagaggttatggtttgagtttggttttttcataagttaacagagtactatttatagtaagcaataccattaggcgacttggtactgttattagttgaataaacggagcactaaaactagtaaaaacacataaacatagcaacttcattgaaaagaacatacacaaaggtggttcatagtgacaactgcttattttaggtagaaccgaacaaagattttatcaaagatagaaaaacaacataacttatcaaacaagatagttttcgtttttaagcttcatatagctgagctctttagtcttcccaccactgatgaacaaagacgccgctgtttcttagactccttatgatactggtgcagtctctgtaccctttgcagtttagaaacagttcatcaactgagcagatcgcaccgctctttatcaactcatagagaaacttcagttcagcgtcacttgtgctcatcttcagaaccacaaaatcagcaaagcttgctgtttccttgaaccattctagaaaatcaaaactatcatcttccacaaaaggttcttcttgatctctagctactgtctcctttgttgatgctagtcccgggtgatagatgaaggttacaccaggactcttgacataagaagtcaagaccgatgcgttgtgatgcacaaagtagctattaaaagctgccttctcgattggatacgaagggaagaaccagttcgatatagttgttagatgatccgctgctcctatatcaatataaaccagcctcttcttagaagagagatcaatgaactcaggcaagtaatgaatatcagaatgcttcttctcctcgagaagaggctctaataatccaatgtatggacggttgttgagtacggatgatgagcaattcaaacggaaactaccttcaccgtttctcctgaagacaaccaaaacatgttcaccaaaggaagcaacatgaacaacactcgacttcttcagcagtgaagaaacaggagacactgagtcagaccccacaagcatagctccggttccacttggtttaagtaaacgctccatctcattaacaagaggcacagggacagaaactatctcgagatcaatagagaagacagaatccaaaggaagcgtcttcatactttacctcacttacaaacttcctgtgcttgaaagcgagaacctttggtgacacgtaagccacacgagcatcagagatcccttataacttcaacgcaagaagagctgaaaccgatcttgtcccaaaacagagagctttaacatcgttactcagcaagtttaaacctttaagctctttaacgacttgagtagttaacttaatattgttgtccttgcatctctccgattcaagatagttccaaaccggtttgaggaacctggtggatagcagcaaaccgttgcctagaaacgtgaagttcacagcgcactcgtcgaccttacacgggtgagtctctcctccgttgaggcttcgcagtagagatacaacggagaaagcgaagacgatcacgagggcgcgacggagagagggtttaggggtgagtttgagcttgagatcttcatcaacgcccatggcggaaagttatgaactttgagcagcagaaggttgaacaagatcggaatggaattgaatttgattaaagaaggaaactttttagcgagtgcaaaacctggaggaggtatggtttccacccacgaggagaactgttttgttttgtaaacctaaccacaccctcctcggttcgcgtctctgcatctgatccattgaagttccttttgagatttgaactacatagtacgatgaactctctttctcagggaagat

SEQ ID NO: 15209 - DNA, 1060 bp, Brassica oleracea
ccatttgtggaaagaaagaaaacaaagaaactagttatggcgaaggacgtggaagccgtttccggagaagggtttcagacaagagactatcaagatccaccgccagcgcctctgtttgacccggcggagctgaccaagtggtctttctacagagcagtcatcgctgagttcgtagctactctcctcttcctgtacatcaccgttttgacagtcatcggttacaagattcagaccgatagtaccgccggcggcgttgactgcggtggagttgggatcctaggtatcgcttgggcttttggtggcatgatcttcatccttgtctactgcaccgccggtatctctggtggtcacattaacccggcagtgacattcgggctactcttggcacgtaaagtgtcgttggttagagccatattgtacatggtagctcagtgtttgggtgcgatatgtggagttgggttcgtcaaagccttccaaagctcttactacgtccgttacggcggtggagccaactctctagccgacggctacagcacaggaacaggcctcgccgcagagatcatcggtactttcgttcttgtctacaccgtcttctccgccactgaccctaaacgtagtgccagagactcccacgtcccagtgttggcgccacttcccattggatttgcggtgttcatggtgcacttggctaccattcccatcaccggaactggaatcaacccggcaaggagtttcggagcagccgttatcttcaatgagagcaagccatgggatgaccactggatattttgggtgggaccattcgttggagctgcgatagctgcattctaccaccagttcgttttgagggcttcaggttccaagtctctcggatctttcagaagtgctgccaacgtctaaacactctctcattcaccaagcagattctgaaataataaagatgatatgtacaaattatccaaatcagtttcagtttgttatcttatttgtgtgtattccacttgctctttagtgtgttttcgttgagtgtaattgttattattttacgccaatgtcaagt

SEQ ID NO: 15210 - DNA, 1172 bp, Artemisia annua
acaccacacttcactctcaacccattaccactttaaaacaacacttaaaaagcagccatgactaaagatgttgaagtagctgagcaccatggtggcgagtacacttccaaggactaccacgacccgcctccagccccttttttcgacgctgatgaactcactaaatggtcattttatcgtgcacttattgctgagtttgttgctactcttcttttcctatatgtcacagttttgactgttatcggatacaaaagccagactgatccagacttaaaccttgatcagtgtggtggtgttggtatccttggtattgcctgggcatttggtggcatgatctttatccttgtttactgcactgctggtatctctggaggacacattaacccggcagtgacattcgggctctttgtggcacgaaaagtgtcattgatcagggctttgggttacatgatagcacaatgtttgggtgcaatctgtggtgttggtttggttaaagctttccaaagctcatactacaaccggtatggtggtggtgccaacactttggctgatggttacaacaagggtaccggactaggcgctgagattatcggcacctttgttcttgtttacactgtcttttcggccactgaccccaagaggagtgcacgagactcccatgttcctgtattggcacctctacccattggatttgcagtgttcatggttcacttggccaccattccaatcaccggaaccggtatcaacccagccagaagttttggtgctgctgttatcttcaacgacgacaaggcatgggatgatcaatggatattctgggttggaccattcattggagcttttgccgcggcgctataccaccaatttgtactaagagccgccgctatcaaggcacttggttcattcagaagcaatgcttaagcttaagatgcacatcaatggctatatttattatgccttgtagatatctttggcaaatttgagtttgatgtaattgtaatttcttatcttggatttgtttttctatgtacattgtaagtgtggtttcttttctttatttttggttttgagatcaaagtatttcaagatcaaaaggtgtgatttattatgtaatttaagagctcatgttcgtaaactgaaatcgtttagttcatgaaaaaaaaaaaaaaaaa

SEQ ID NO: 15211 - DNA, 1051 bp, Brassica juncea
tagttatggctaaggacgtggaagccgtttccggagaagggtttcagacaagagactatcaagatccaccgccggcgcctctgtttgatccggaggagctgacgaagtggtctttctacagagcagtcatcgccgagttcgtagctactctcctcttcttatacatcacagtcttgacagtcatcggttacaagattcagaccgatagcaccgccggcggcgttgactgcggtggagttggaatccttggtatcgcttgggcttttggtggcatgatcttcatccttgtctactgcaccgctggtatctctggtggtcacattaacccggcagtgacatttgggctactcttggcacgtaaagtatcgttggttagagccatattgtacatggtagctcagtgtttaggtgcgatatgtggtgttgggttcgtcaaagccttccaaagctcttactacgtccgttacggcggtggagccaactctctagccgaaggctacagcacaggaacgggcctcgccgcagagatcatcggtactttcgttcttgtctacaccgtcttctcagccactgaccctaaacgcagtgctagagactcccacgttccagtgttggcgccacttcccattggatttgcggtgttcatggtgcacttggctaccattcccatcactggaactggaattaacccggcaaggagtttcggagcagccgttatcttcaatgagagcaagccctgggatgaccactggatattttgggtgggaccattcgttggagctgctattgctgcattctaccaccagtttgttctgagggcttcaggttccaagtctctcggatctttcagaagtgctgccaacgtttaaatactgtctcatctccaccaagcagattctgaaataataaagatgataatcttttttctctatgtacaaattatccaaatcagtttcagtttgttatcttatttgtgtgtttctacttgctcttttctgcattttggttgagtgtaactgtttctattttacgccaatgccaagtttatacg

SEQ ID NO: 15212 - DNA, 1121 bp, Raphanus sativus
aaccacacaacatagaagcaaaacaaaaaccatttgctggaaaggaaaaaaagcaaagaaataagtaatggccaaggacgtggaagccgttgccggagaagggtttcagacaagagactatcaagacccgccgccagcgcctctgtttgatccggaggagctgacgaagtggtctttttaccgagcagtcatcgccgagttcgtagctactctcctcttcctatacatcaccattttgacagtcatcggttataaggttcagacagatagtactgctggcggcgttgactgcggtggagttggcatccttggtatcgcttgggccttcggtggcatgatcttcattctcgtctactgcaccgccggtatctctggtggtcacataaacccggcagtgacatttgggctactcttggcccgaaaagtatccttggttagagccatattgtacatggtagctcagtgtttgggtgcaatttgtggagttgggttcgtcaaagccttccaaagtgcttactacgtccgttacggcggtggagccaactctctagccgatggctacagcacgggtactggcctggccgcagagatcatcggtactttcgttcttgtctacacagtcttctcggccactgaccctaaacgcagtgccagagactcccacgttccagtgttggctccacttcctattggatttgcggtgttcatggtacacttggctaccattcccatcaccggaactggaataaatcctgcgaggagtttcggagcagccgtcatcttcaacgagagcaagccatgggatgatcactggatcttttggctgggaccattcattggagctgcgattgctgcagtctaccaccagtttgttcttagagcttcaggttccaagtctctagggtctttcagaagtgctgcaaacgtctaataaacgcttttgcccaccaaaacgcattctgaaataataagatgataactacaaatagttatcttttctttatgtacaaattatctaaatcaaatctctgttttcttatttatgtcttctacttgctcttgcaatttcattcggtgtaattgttttttcttacaccactgccaagtttatcgagtgactg

SEQ ID NO: 15213 - DNA, 1130 bp, Arabidopsis thaliana
actccaacagagaagcaaaagaaaaaaaagctattgtttgaaagaagaagaagttaactatggcaaaggatgtggaagccgttcccggagaaggatttcagacaagagactatcaagatccgccaccagctccgtttattgatggagcggagctaaagaagtggtctttctacagagcagttatcgccgagttcgtagccactctcctcttcttatacatcaccgttttgacagtcatcggttacaagattcagtccgatactgatgccggtggcgtagattgcggcggagttggaatcctcggtatcgcttgggcctttggtggtatgatcttcatcctcgtctactgcaccgccggtatctctggtggtcacattaacccagcggtgacatttgggctattcttggcacgtaaagtgtcgttacctagggccctattgtacataatcgctcagtgtttgggtgcgatttgtggagttggttttgtcaaagccttccaaagctcttactacacccgttacggaggtggagccaactctctagccgatggctacagcacagggaccggtttagccgcagagatcattggtactttcgttcttgtctacaccgtcttctctgccactgaccccaaacgtagtgccagagactcccacgttccggtgttggcgccacttccaatcggatttgccgtgttcatggtacatttggctaccattcccattaccggaaccggaattaacccggcaaggagtttcggagctgccgtaatctacaacaagagcaagccatgggatgaccactggatattttgggttggaccattcattggagctgcgatagctgcattctaccaccaattcgttctgagagcttcaggttctaagtctcttggatcattcagaagtgctgccaacgtctaaacacatcaaaccagatttctcaagaataaatgaagttgtgatctctctgtacaaatctaaatcagtcacttgcagttttcatttccctttcttatatttgtgttttccacttgctcttttgtgaattttccttcggtgtaattgttttttctttcgcttttaaacgagtgattggaattataatcaatgaaatcaaagaggttctta

SEQ ID NO: 15214 - DNA, 1095 bp, Artemisia annua
cataatgactaaagacacgccagagcaagagcaagagcaaggttcattcactgcaaaagactaccacgacccaccacctgcaaagttttttgatagcaaagagttgacaaaatggtcattttatagagcattgatagctgagttcatagcaacacttttgtttctttatataactgttttgacagttattggttacaagagtcagattgctaatggaaatgatgcttgtggtggtgttggtattttgggtattgcttgggcttttggtggcatgatttttgttcttgtttattgcactgctggtatttctggtggccacattaacccagccgtgacgtttggcctatttctggctcgaaaagtatcattgccccgagccatcatgtacatggtggctcaatgcttaggagccatttgtggtgttggcttagtcaagtcttttcataagacttactataacacctatggtggtggtgccaatgagctagccgatggctacaacaaaggcaccgggttgggtgccgagattattggtacttttgttcttgtctacaccgtcttctcggctactgatcccaagaggaacgctagagactcctatgtccctgtgttggcaccactaccaatcgggttcgctgtgttcatggttcacctagccaccattcccatcactggaaccggaatcaatcctgctaggagctttggagctgcggttatttacaacaaggagaaggcttgggatgatcaatggatattttgggtcggacccttcattggagctgccattgcagcgttctaccaccaattcatcttgagagccggtgcagccaaagcccttggatctttcagaagcgctacccatatttgagatctattcagaaggcatgaatcactttttacgaaaattgcggaaaaataaataaaaatgtttgtatgtgtatgaaagttaatttgtggtatttaggtgttaaatctcatgccttgtttaagattcatttaagaaccattaaaatgcaatgtaaatgcttttcagaggtggtacccttcgtctaaactctaaagcattgtatcgtttcagattaattccaatggact

SEQ ID NO: 15215 - DNA, 1168 bp, Brassica juncea
acaacagggaagtaataaaaaccatttgtggaaagaaagaaaacaaagaaactagttatggcgaaggacgtggaagccgtttccggagaagggtttcagacaagagactatcaagatccaccgccagcgcctctgtttgacccggcggagctgaccaagtggtctttctacagagcagtcatcgctgagttcgtagctactctcctcttcctgtacatcaccgttttgacagtcatcggttacaagattcagaccgatagtactgccggcggcgttgactgcggtggagttggtatcctaggtatcgcttgggcttttggtggcatgatcttcatccttgtctactgcaccgccggtatctctggtggtcacattaacccggcagtgacattcgggctactcttggcacgtaaagtgtcgttggttagagccatattgtacatggtagctcagtgtttgggtgcgatatgtggagttgggttcgtcaaagccttccaaagctcttactacgtccgttacggcggtggagccaactctctagccgatggttacagcacaggaaccggactagccgcagagatcattggtactttcgttcttgtctataccgtcttctccgctactgaccctaaacgtagtgccagagactcccacgtcccagtgttggcgccacttcccattggatttgcggtgtttatggtgcacttggctaccattcccatcactggaactggaatcaacccggcaaggagtttcggagcagccgttatcttcaacgagagcaagccatgggatgaccactggatattttgggtgggaccattcgttggagctgcgatagctgcattctaccaccagttcgttttgagggcttcaggttccaagtctctcggatctttcagaagtgctgccaatgtttaaatactctctcctccaccatgcagattctgaattaataaagatgataattggttctctatgtacaaattatctaaaatcagtttcagtttgttatcttatttgtgtgtttcttctacttgctcttttctacgttttcgttgagtgtagttgttcttatttttagccaatgccaagtttatcgagttattggaattgaaaatcaagagtttatattgtgtttgcgttttcatgtataaacccacatttc

SEQ ID NO: 15216 - DNA, 1101 bp, Brassica napus
agctcatctgttcgctgtcttccaaggcttcctcaaaatgcttgctggtctcgacacaacagagaagtaataaaaaccatttgtggaaagaaagaaaacaaagaaactagttatggcgaaggacgtggaagccgtttccggagaagggtttcagacaagagactatcaagatccaccgccagcgcctctgtttgacccggcggagctgaccaagtggtctttctacagagcagtcatcgctgagttcgtagctactctcctcttcctgtacatcaccgttttgacagtcatcggttacaagattcagaccgatagtactgccggcggcgttgactgcggtggagttggtatcctaggtatcgcttgggcttttggtggcatgatcttcatccttgtctactgcaccgccggtatctctggtggtcacattaacccggcagtgacattcgggctactcttggcacgtaaagtgtcgttggttagagccatattgtacatggtagctcagtgtttgggtgcgatatgtggagttgggttcgtcaaagccttccaaagctcttactacgtccgttacggcggtggagccaactctctagccgatggttacagcacaggaaccggactagccgcagagatcattggtactttcgttcttgtctacaccgtcttctccgccactgaccctaaacgtagtgccagagactcccacgtcccagtgttggcgccacttcccattggatttgcggtgttcatggtgcacttggctaccattcccatcactggaactggaatcaacccggcaaggagtttcggagcagccgttatcttcaacgagagcaagccatgggatgaccactggatattttgggtgggaccattcgttggagctgcgatagctgcattctaccaccagttcgttttgagggcttcaggttccaagtctctcggatctttcagaagtgctgccaacgtttaaatactctctcatttccaccaatcagattctgaaataataaagatgataatcttttactctatgtacaaattatccaaatcagtttcagtttgttatcttatttgtgtgtattccacttgctcttt

SEQ ID NO: 15217 - DNA, 1425 bp, Catharanthus roseus
cggtaatcctatcaattaaccgttttgtcatccagtagcttctgattatctgttgccttcccctgctaggccttagttctctctcttcctctgtctcttctctgtttctttttccatttctgggcttctctctttggcacctgcagcagatagatattctctttgtgtgtgtgtttctttttttttttgtaagtttttagtaatggcaaaagaatcaggggtggctgaacatggttcatttacgacaaaagactatcatgatccaccaccagcggcactaattgatccagaagaattgacaaaatggtcattttacagagctcttatagctgaattcatagctacacttctttttctttacattactgtccttactgttattggtcataagcgccaaactgatcctgaccttgcaaattttgacccttgtaatggtgttggaattcttggtatttcttgggcttttggtggcatgatttttgttcttgtatattgcactgctggaatttcgggtgggcacataaacccagcagtgacatttgggctatttttagctcgcaaagtctcactgattcgagcagttatgtatatggtggctcaatgtttaggagccatttgcggtgtcggactcgttaaagcctttcagaaatcttacttccacaaatatggcggcggtgcaaatgaactccaagccggtcattccgtcggtgttggattagcggcagaaatcatcggaacttttgttcttgtctacacagtcttctccgcaacagatcccaaaaggaatgccagagattctcatgtccccgtattggcaccacttccaattggatttgcagtatttatggtgcatttggcaacaatacctgtaactgggactggaattaaccctgctagaagtcttggatctgctgtcatttacaacgatagcaaagcttgggatgaccattggatattctgggttggaccattcattggtgcagcaattgcagcattctaccaccagtttatcttaagagcaggagctgttaaggcacttggttctttcagaagcagctcacatgtttgatcaaatgtctcttcctcttcatcatctatctatgcttgctttttatcacatctaaatttcagtcttcacaagacaaataactttatatttccaaataaaaaagttgaagttattattattattagttgtaatttgtgtttggagaagtcctttttttaaattttctcagctagaaaaagttgtcaaaagtattattatataatatgctttgagatgagaggggattgattgagtgatgaatgtgtacaagaacaagtgtagataaaggcaggggtctttgtttcaaaagggaaaagccttttattttgtatcccttttgtcctttacctagacttcttgttgttgtttgtcctttc

SEQ ID NO: 15218 - DNA, 1027 bp, Echinacea purpurea
actcttccaactagttcttaccataattcagcaaacatgaccaaagatgtgccggaagaacaaggttcatactccgctaaggactaccaggacccaccgcccgccccgttggtcgacccggtagagctcaccaaatggtcgttctaccgggccttgatcgcggagttcattgctacacttttgtttctttatatcactgtcttgactgttattgggtacaagagctcgaccgaccccgccttggacgctgaccagtgtggcggggttggtattctaggcatcgcctgggcctttggtggcatgatctttatcctcgtttactgcaccgcgggtatctcgggtggtcacattaacccagcggtgacatttggtctgttcctggcgcgtaaagtgtcattgttccgagccgttgggtacatagtggctcagtgcttaggagccatttgtggtgtgggcttggtcaaggctttcaacaaaagcctctacaacaggtacggcggaggagccaatgagctggcggacggctacaacaccggcactggacttggcgctgaaatcatcggaactttcgtcctcgtttacaccgtcttctccgccaccgaccccaagaggagcgcccgcgactcccatgttcccatattggcgcctcttccgatagggtttgccgtgttcatggtgcaccttgccaccattccgatcacgggaaccggtatcaacccggccagaagccttggagccgctgtcatttacaacaaagctaaagcctgggatgatcagtggatcttctgggtgggaccattaattggagcaaccattgcagctttctaccaccaatttgttctgagagcaggtggatataaagctcttgaatcatacagaagcagcacccatgtttgagatttattaattgttgtattttgtttcaaacccaaaattaataataatttttatgtttatttaacatactcctttcatgtttcatgtttataatcacataaattatctaataataactataaaattgctg

SEQ ID NO: 15219 - DNA, 1096 bp, Vicia sativa
gttccaaaagggtaatcccaatggcaaaagacattgaagttgctgaacgtggctctttctctaacaaagactaccatgaccctcctccagcacctctcattgatgcagaagaactcacaaaatggtccttttacagggcccttattgctgagttcattgcaactttgcttttcctttacgttactgttttgactgtgattggttacagtatccaaactgatgttaaagctggtggtgatgagtgtggcggtgttggtattcttggtattgcttgggcttttggtggcatgatctttgttcttgtttactgtactgctggaatttcagggggtcacattaacccagcagtgacatttgggctattattggcgcgtaaggtgtctttggtgagggcagttatgtacatggtggctcaaagtttgggggctatttgtggagttgggttggttaaggcttttcaaagtgcttactttgttagatatggtggtggagctaattttcttcatgatgggtatagtactagtgttggaataggtgctgagattgttgggacttttgttttggtttacactgttttctctgctactgatcctaagagaagtgctagagattctcatgtgccggttttggctccactccccattggatttgctgtattcatggttcatttggcaaccatcccggtcaccggaactggcattaaccccgctagaagccttggttctgctgttatcctcaacgaagagaagatctggaatgaccattggatattttgggttggaccatttgtcggggcggcgattgcggccttctaccatcaattcatcttaagagcaggtgctgctaaagctcttggatcattcaggagtagcaatgctaactgatactatttcctttgtatttgcaattgtgtaatcaagatttgtggataagtgttaggttaaaaagtctctttcgttacagagggagcctttttacactttcctctgtattctctttagtgtgtcatctttttcttttcaagttattctcttctgtcatcctttgtactcattaaatatttatggacaaatgtttcatgtttattactgaagat

SEQ ID NO: 15220 - DNA, 1097 bp, Brassica juncea
gacaaaacaggaacaataaccaaaaacacattttcttgatatattaaaaaaattaaatggcgaaagaagtggaaggagcagagggattcgcgacgagggactacgaagatccgccgccaactccgtttttcgatgcggaggagctgacaaagtggtcgttgtacagagccgtcatagccgagttcgtagccactctcctcttcttgtatgtcactgttttgactgtcatcggctacaagatttcgtccgacactaaggccggaggcgacgagtgcggaggcgtcggaatcctcggcatctcatgggccttcggtggcatgatcttcatccttgtctactgcaccgccggtatctcaggtggtcacataaaccctgcggtgacgttcgggttgttcttggcacggaaggtatcgttggttagagcggtgctatacatggtggctcagtgtttgggtgctatttgtggagttggtttcgtcaaagccttccaaagcgcttactacgtccgttacggtggaggagcaaactctctagccgatggatacagcacagggactggactcgctgcagagatcattggaacctttgtccttgtctacactgtcttctccgctacagatcccaaaagaaatgcacgagactcccacgttcccgtgttggcgccacttccaattgggtttgccgtgttcatggtacacttggccactattccaatcaccggaaccggaattaacccggccaggagtttcggagccgcggttatctacaacgagtccaagccgtgggatgaccactggattttctgggtgggaccattcatcggagctgcgatagctgcattttatcaccaattcgtcctaagggcctctggttccaagtccctcgggtcattcagaagtgcggccaacgtttaaatttagccacacaaaaacaaaatagcaattacaaaaatgattgttattatgtatgtacaaaattggcaactttggttttaaaatctatgctctgttttattcctttctctttcttaatttctggcttcactgtgggatatgtgtatgcttgtgtattcggggaaaacaatcaatgaaatcaaa

SEQ ID NO: 15221 - DNA, 1049 bp, Brassica oleracea
aacacattttcttgatatattaaaatattaaatggcgaaagaggtggaaggagcagagggattcgcttcgagggactacgaagacccgccgccaactccgtttttcgatgcggaggagctgaccaagtggtctttgtacagagccgtcatagccgagttcgtagccactctcctcttcttgtatgtcactgttttgactgtcatcggctacaagatttcctccgacactaaggccggaggtgatgagtgcggaggcgtcggaatcctcggcatctcatgggccttcggtggcatgatcttcatccttgtctactgcaccgccggtatctcaggtggtcacataaaccctgcggtgacgttcggcttgttcttggcaaggaaggtatcgttggttagagcggtgctatacatggtggctcagtgtttgggtgcgatttgtggagttggtttcgtcaaagccttccaaagcgcttactacgtacgttacggtggaggagcaaactctctagccgatggatacagcacagggactggactcgctgcagagatcattggaacattcgtcctggtctacactgttttctccgctacagatcccaaaagaaatgcccgagactcccacgttcccgtgttggcgccactcccaattggatttgccgtgttcatggtacacttggccactattccaatcaccggaacggggattaacccagccaggagtttcggagctgcagttatctacaacgagtccaagccgtgggatgaccactggattttctgggtgggaccattcatcggagctgccatagctgcattttatcaccaattcgtcctaagggcctctggttccaagtccctcggttccttcagaagtgcggccaacgtttgaatttagccacacaaaacaaaatagcaattacaaaatgattgttattatgtatgtacaaatttggcaactttggttttaaaatctatgctctgttttattccttttgtctttcctaatttctggctttattgtgggatatgtgaatgttcgtgtactcggg

SEQ ID NO: 15222 - DNA, 1114 bp, Brassica napus
aacagttcctaagaagaacatccattacatataataatactacatggctaaagacgtggaaggagcagaggggttcgcggcgagggactacgaagatccgccgccaacaccgttcttcgatgcggaggagctgaccaagtggtctttgtacagagccgtcatagccgagttcgtagccactctcctcttcttgtatgtcactgttttgactgtcatcggctacaagatttcgtccgacactaaggccggaggcgacgagtgcggaggcgtcggaatccttggcatctcatgggccttcggcggcatgatcttcatccttgtctactgcaccgccggtatctcaggtggtcacataaaccctgcggtgacgttcggcttgttcttggcaaggaaggtatcgttggttagagcggtgctatacatggtggctcagtgtttgggtgcgatttgtggagttggtttcgtcaaagccttccaaagctcttactacgtccgttacggtggaggagcaaactctctagccgatggatacagcacagggactggactcgctgcagagatcattggaacattcgtcctggtctacactgttttctccgccactgaccccaaaagaaacgcacgagactcccacgttcccgtgttggcgccactcccaattggatttgccgtgttcatggtacacttggccactattccaatcaccggaaccggtattaacccggccaggagtttcggagctgcggtgatctacaacgagtccaagccgtgggatgaccactggatattctgggtgggaccattcatcggagctgccatagctgcattttatcaccaattcgttctaagggcctctggttccaaatccctcggatccttcagaagtgcagccaacgtttgagtttagccacacaaaacaaaacaaaaaaagtggttactgttatgtataaattgggcacgtgattttaaaatgtgtcctcttatgtcttttcttttcatctgcttctatttgtgtgtattccaattattgaagttttagtgttttgcgtgttttcatcatggatatgtcagtgagtttgtttattgagaaaaagccgaccacattgtttcgctt

SEQ ID NO: 15223 - DNA, 1070 bp, Brassica napus
atttagaaacatcatacatacatggcgaaagacgtggaaggagcagaaggatttgcggcgagggattaccaagacccgccgcctacaccatttttcgacgcggaggagttgacaagatggtccttatacagagccgtcatcgccgagtttgtagccactcttctcttcttgtacgtcaccgttttgactgtcattggctacaagatttcgtccgacacaaccgccggtggagttgaatgcggcggcgtaggaatcctcggcatcgcttgggcttttggtggcatgatcttcatccttgtgtactgcaccgccggtatttcaggtggtcacataaacccggcggtgacgttcggcttgttcttggcccggaaggtaacgttggttagagcgcttctatacatggtggctcagtgtttgggtgctatatgtggagttgggttcgtaaaggcctttcaaagcgcttactacgtgcgttacggcggaggagcaaactctctagccgacggatacagcacagggacaggactcgccgcagagattatcggaacttttgttcttgtctacactgtcttctcagccacagaccccaaaagaaacgcacgtgactcccacgttcccgtgttggcgccacttccgattgggtttgcagtgttcatggttcatttggcaactattccgatcaccggaaccggtattaacccggcaaggagtttcggagctgcggttatctacaacgagtccaagccgtgggatgaccactggatattctgggtgggaccattcattggagctgcgattgctgcattttatcaccaattcgtcctaagagcttccggttccaagtcactcggatccttcagaagtgcggccaacgtttgaattcaaccacacacacacaacagaagtagttactctttgtgtagtatttcggcacatgatttttaaaatatgccctccttttcctcatgcgtttttctttttttttggttcctctacttctatttgtatgaattccaatcaacggagtctagtgttttacgttttcatcttcgcaatgtaagttcgtttac

SEQ ID NO: 15224 - DNA, 1059 bp, Brassica napus
cacattttcttgatatattaaaaaaattaaatggcgaaagaagtggaaggagcagagggattcgcgacgagggactacgaagatccgccgccaactccgtttttcgatgcggaggagctgacaaagtggtcgttgtacagagccgtcatagccgagttcgtagccactctcctcttcttgtatgtcactgttttgactgtcatcggctacaaaatttcatccgacactaaggccggtggtgatgagtgcggaggcgtcggaatcctcggcatctcatgggccttcggtggcatgatcttcatccttgtctactgcaccgccggtatctcaggtggtcacataaaccctgcggtgacgttcggcttgttcttggcaaggaaggtatcactggttagagcagtgctatacatggtggctcagtgtttgggtgcgatttgtggagttggtttcgtcaaagccttccaaagcgcttactacgtacgttacggtggaggagcgaactctctagccgatggatacagcacagggactggactcgctgcagagatcattggaacattcgtcctggtctacactgttttctccgccacagatcctaaaagaaacgcaagagactcccacgttcccgtgttggcgccactcccaattggatttgccgtgttcatggtacacttggccactattccaatcactggaaccggtattaacccggccaggagtttcggagctgcagttatctacaacgagtccaagccgtgggatgaccactggattttctgggtgggaccattcatcggagctgcgatagctgcattttatcaccaattcgtcctaagggcctctggttccaagtccctcgggtccttcagaagtgcggccaacgtttgaatttagccacacaaaacaaaatagcaattacaaaatggttgttattatgtatgtacaaatttggcaactttggttttaaaatctatgctctgttttattccttttgtctttcctaatttctggctttattgtgggatatgtgaatgttcgtgtactcgggaaaaacaatta

SEQ ID NO: 15225 - DNA, 1197 bp, Brassica rapa
ttcatccctccacaatcacaaaacaggaacaataaccaaaaacacattttcttgatatattaaaaaaaattaaatggcgaaagaagtggaaggagcagagggattcgcttcgagggactacgaagacccgccgccaactccgtttttcgatgcggaggagctgaccaagtggtcgttgtacagagccgtcatagccgagttcgtagccactctcctcttcttgtatgtcactgttttgactgtcatcggctacaagatttcgtccgacactaaggccggaggcgacgagtgcggaggcgtcggaatcctcggcatctcatgggccttcggtggcatgatcttcatccttgtctactgcaccgccggtatctcaggtggtcacataaaccctgcggtgacgttcggcttgttcttggcaaggaaggtatcgttggttagagcagtgctatacatggtggctcagtgtttgggtgcgatttgtggagttggtttcgtcaaagccttccaaagcgcttactacgtacgttacggtggaggagcaaactctctagccgatggatacagcacagggactggactcgctgcagagatcattggaacattcgtcctggtctacactgttttctccgccactgaccccaaaagaaacgcacgagactcccacgttcccgtgttggcgccactcccaattggatttgccgtgttcatggtacacttggccactattccaatcactggaaccggtattaacccggccaggagtttcggagctgcagttatctacaacgagtccaagccgtgggatgaccactggattttctgggtgggaccattcatcggagctgcgatagctgcattttatcaccaattcgtcctaagggcctctggttccaagtccctcgggtccttcagaagtgcggccaacgtttgaatttagccacacaaaacaaaatagcaattacaaaatggttgttattatgtatgtacaaatttggcaactttggttttaaaatctatgctctgttttattccttttgtctttcctaatttctggctttattgtgggatatgtgaatgttcgtgtactcgggaaaaacaattaatgaaatcaaattgtttttgccttgtttaacttttttttactaccatcaacattttcaaaaataaaatgttagaagtaatacaatttcagataaa

SEQ ID NO: 15226 - DNA, 1195 bp, Brassica rapa
gtaacactaatcaatagctcactctatataaagagaaccttttactcatcttctcacaaccacaacaacaacaattcataagaaaatttagaaacatcatacatacatggcgaaagacgtggaaggagcagaaggatttgcggcgagggattaccaagacccgccgcctacaccatttttcgacgcggaggagttgacaagatggtccttatacagagccgtcatcgccgagtttgtagccactcttctcttcttgtacgtcaccgttttgactgtcattggctacaagatttcgtccgacacaaccgccggtggagttgaatgcggcggcgtaggaatcctcggcatcgcttgggcttttggtggcatgatcttcatccttgtgtactgcaccgccggtatttcaggtggtcacataaacccggcggtgacgttcggcttgttcttggcccggaaggtaacgttggttagagcgcttctatacatggtggctcagtgtttgggtgctatatgtggagttgggttcgtaaaggcctttcaaagcgcttactacgtgcgttacggcggaggagcaaactctctagccgacggatacagcacagggacaggactcgccgcagagattatcggaacttttgttcttgtctacactgtcttctcagccacagaccccaaaagaaacgcacgtgactcccacgttcccgtgttggcgccacttccgattgggtttgcagtgttcatggttcatttggcaactattccgatcaccggaaccggtattaacccggcaaggagtttcggagctgcggttatctacaacgagtccaagccgtgggatgaccactggatattctgggtgggaccattcattggagctgcgattgctgcattttatcaccaattcgtcctaagagcttccggttccaagtcactcggatccttcagaagtgcggccaacgtttgaattcaaccacacacacacaacagaagtagttactctttgtgtagtatttcggcacatgatttttaaaatatgccctccttttcctcatgcgtttttctttttttttggttcctctacttctatttgtatgaattccaatcaacggagtctagtgttttacgttttcatcttcgcaatgtaagttcgtttacttaagaacaagtcactttgcttaagcttatttgatcttcc

SEQ ID NO: 15227 - DNA, 1088 bp, Raphanus sativus
atggccaaagacgtggaaggagcagagggattcgcggcgagggactaccaagatccgccgccaactccgtttttcgatgcggaggagctgaccaagtggtcttcgtacagagccgtcatcgccgagttcgtagccactctcctcttcttgtacgccactgttttgactgtcatcggctacaagatttcgtccgacactaaggccggaggcgacgagtgcggaggtgtcggaatcctcggcatctcatgggctttcggtggcatgatcttcatccttgtctactgcaccgccggtatctcaggtggtcacataaaccctgcggtgacgttcggcttgttcttggcaaggaaggtatcgttggttagagcggtcctatacatggtggctcagtgtttgggtgctatttgtggagttggtttcgtcaaagctttccaaagctctcactacgtccgttacggtggaggagcaaactctctagccgatgggtacagcacggggacaggactcgcagcagagatcatcggaacattcgtcctggtctacactgttttctccgctacagatcccaaaagaaacgcacgagactcccacgttcccgtgttggcgccacttccaattggatttgccgtgttcatggttcacttggccactattccaatcaccggaaccgggattaacccagctaggagttttggagctgcggttatctacaacgagtccaagccgtgggatgaccattggatattctgggtgggaccattcatcggagctgcgattgctgcattttatcaccagttcgttctaagagcttctggctccaaatccctcggatccttcagaagtgctgccaacgtttgagttactgttctgtttaaatgcggcacctgattttaaaatgtgtccagtcctctgtctttttttttttctttcttcctctgcttttatatgtgtggattctagttaatcgagtttgagtggttttcgttttcaatgtcagtgagtttgtttattgattaaaaaagttgaacacattgcttggcttattgatctccttctcctctataaaaaaatgttttataaacttgata

SEQ ID NO: 15228 - DNA, 1122 bp, Helianthus annuus
cgctagtttacttgtctctctctagaaagaaaccatgacaaaagatgattctggttcctcccccgccaaggactaccatgatccgccatcggtaccattgatggacccccatgagctcacaaaatggtctttttatagagcattgatagctgagtttattgctacatttttgtttctttatattacggtgttgactgttattggctacaagagcactactgaccctgctgcgttgaatgctgaccagtgcggtggtgttggtattcttggtattgcttgggcttttggtggcatgatctttgtgcttgtttactgcaccgctggtatctctggaggtcacattaacccagcggtgacgtttggtttattcctggctcgtaaagtgtcattgatccgagccattatgtacatggtggctcaatgtttaggagccatttgtggtgtgggcttagtcaaggctttcaacaaaagcctctacaaccggtacggtggaggagccaacgaactagccgctggctactccaaaggcactggactgggtgccgaaatcatcggcactttcgtcctcgtctacaccgtcttctccgccaccgatcccaagaggagtgcccgagactcgcatattcctgttttggcgcctcttccgattgggttcgcggtgttcatggtgcaccttgccactattccgatcactggaaccggtattaaccctgctcggagtcttggagccgcggtcatctacggcaaggagaaagcttgggatgatcagtggatattctgggtgggaccgttggtgggtgcaacgattgcagccttctaccaccagtttatattgagagctggtgctgtcaaagcttttgcttcattcagaagcagcactcatgtttgagattttatttcccaattgttggtattgtattatctttcaaacacaaaattttaagaatttatgtttggatttacgctttttagtattgaaaccaatgtttaatgttgtgtggatggaagggttttgagtgctagactatatatatttatgttgatactttaaatatgtgatataaatcatgcagtcactcgtttgttcagattatataataaaaccgtgaatcaaatactaag

SEQ ID NO: 15229 - DNA, 1079 bp, Brassica juncea
atggcgaaagaagtggaaggagcagagggattcgcggcgagggactacgaagacccgccgccaactccgtttttcgatgcggaggagctgacgaagtggtctttgtacagagccgtcatagccgagttcgtagccactctcctcttcttgtatgtcactgttttgactgtcatcggctacaagatttcgtccgacactaaggccggaggcgacgagtgcggaggcgtcggaatcctcggcatctcatgggccttcggtggcatgatcttcatccttgtctactgcaccgccggtatctcaggtggtcacataaaccctgcggtgacgttcggcttgttcttggcaaggaaggtatcgttggttagagcagtgctatacatggtggctcagtgtttgggtgctatttgtggagttggtttcgtcaaagccttccaaagcgcttactacgtacgttacggtggaggagcaaactctctagccgatggatacagcacagggactggactcgctgcagagatcattggaacattcgtcctggtctacactgttttctccgccactgaccccaaaagaaacgcacgagactcccacgttcccgtgttggcgccactcccaattggatttgccgtgttcatggtacacttggccactattccaatcactggaaccggtattaacccggccaggagtttcggagctgcagttatctacaacgagtccaagccgtgggatgaccactggattttctgggtgggaccattcatcggagctgccatagctgcattttatcaccaattcgtcctaagggcctctggttccaagtccctcgggtccttcagaagtgcggccagcgtttgaatgtagccacacaaaacaaaatagcaattacaaaatgattgttattatgtatgtacaaatttggcaactttggttttaaaatctatgctctgttttattccttttgtctttcctaatttctggctttattgtgggatatgtgaatgttcgtgtactcgggaaaaacaattaatgaaatcaaattgtttttgccttgtttaaaacgtaagccttagatctga

SEQ ID NO: 15230 - DNA, 1105 bp, Brassica napus
caaaaacacattttcttgatatattaaaatattaaatggcgaaagaggtggaaggagcagagggattcgcttcgagggactacgaagacccgccgccaactccgtttttcgatgcggaggagctgaccaagtggtctttgtacagagccgtcatcgccgagttcgtagccactctcctcttcttgtatgtcactgttttgactgtcatcggctacaagatttcctccgacactaaggccggaggtgatgagtgcggaggcgtcggaatcctcggcatctcatgggccttcggtggcatgattttcatccttgtctactgcaccgccggtatctcaggtggtcacataaaccctgcggtgacgttcggcttgttcttggcaaggaaggtatcgttggttagagcggtgctatacatggtggctcagtgtttgggtgcgatttgtggagttggtttcgtcaaagcgttccaaagcgcttactacgtacgttacggtggaggagcaaactctctagccgatggatacagcacagggactggactcgctgcagagatcattggaacattcgtcctggtctacactgttttctccgctacagatcccaaaagaaatgcccgagactcccacgttcccgtgttggcgccactcccaattggatttgccgtgttcatggtacacttggccactattccaatcaccggaacggggattaacccggccaggagtttcggagctgcagttatctacaacgagtccaagccgtgggatgaccactggattttctgggtgggaccattcatcggagctgccatagctgcattttatcaccaattcgtcctaagggcctctggttccaagtccctcggttccttcagaagtgcggccaacgtttaaatttagccacacaacacaaaatagcaattacaaaatgattgttattatgtatgtacaaaattggcaactttggttttaaaatctatgctctgttttattccttttgtctttcctaatttctagcttcattgtgggatatgtgaatgtttgtgtactcgggagtcttctcctacacttcatctctcacacgaaaagctaagcttgctttaaac

SEQ ID NO: 15231 - DNA, 1026 bp, Brassica napus
gctgcatataaatacaaaaagcaatcaaatcattagaatcaaaacaaataactaaaatcacattttcttgatatattaaaaaaaatggcgaaagaagtggaaggagcagagggattcgcttcgagggactacgaagacccgccgccaactccgtttttcgatgcggaggagctgaccaagtggtcgttgtacagagccgtcatagccgagttcgtagccactctcctcttcttgtatgtcactgttttgactgtcatcggctacaaaatttcatccgacactaaggccggtggtgatgagtgcggaggcgtcggaatcctcggcatctcatgggccttcggtggcatgatcttcatccttgtctactgcaccgccggtatctcaggtggccacataaaccctgcggtgacgttcggcttgttcttggcaaggaaggtatcgttggttagagcagtgctatacatggtggctcagtgtttgggtgctatttgtggagttggtttcgtcaaagccttccaaagcgcttactacgtacgttacggtggaggagcaaactctctagccgatggatacagcacagggactggactcgctgcagagatcattggaacattcgtccttgtctacactgtcttctccgccactgatcccaaaagaaacgcacgagactcccacgttcccgtgttggcgccactcccaattggatttgccgtgttcatggtacacttggccactattccaatcaccggaaccggtattaacccggccaggagtttcggagctgcagttatctacaacgagtccaagccgtgggatgaccactggattttctgggtgggaccattcatcggagctgcgatagctgcattttatcaccaattcgtcctaagggcctctggttccaagtccctcgggtccttcagaagtgcggccaacgtttgaatttagccacacaaaacaaaatagcaattacaaaatggttgttattatgtatgtacaaatttggctaactttggtttaaaatct

SEQ ID NO: 15232 - DNA, 1340 bp, Quercus alba
acacccaaacaccaaacaccaaaaccataaactctctctctcaccaaagcttcatcctttgcttttttctattaaccatgactaaggatgttgcagagcatggctcatttccagccaaagactaccacgacccacctccagcaccgttgttcgatcctgtggagctaaccaaatggtccttttacagggctttgatagctgagtttgtagctactttgctctttctatatgtcacggttctgaccgtgattggctacaagagccagattgaccctgccttgaaaggtgatgcctgtggtggtgttggtattcttgggattgcttgggcctttggtggcatgattttcgttcttgtttactgcactgctgggatttcagggggtcacattaacccagcagtgaccttcgggctcttcttggctcgtaaggtgtcgctgattcgggccgtgttgtacatggtggctcagtgcttgggagccatatgtggtgttgcgctcgtcaaggcctttcagagtgcctattatgtaaagtatggtggtggcgccaactctctctcagatgggtacagcactggcgttggattgggcgccgagatcgtagggacctttgtgcttgtgtacaccgtcttctctgccactgatcccaagaggaaagctagagattcacacgttcctgttttggcaccactccccattggatttgcggtgttcattgttcacttggccacgatcccagtcactggcactggcatcaaccccgctaggagtcttggtgcagctgttatctacaacaatgacacggcctggaaagaccattggctcttttgggttgggccattcattggtgcagctttagcagctttctaccaccaattcatcttgagagctggtgctgcgaaagctcttgggtcattcaggagcaactcctcccatgtttgattaacaaagagggttaattatttgattccttcttcgtggttctactgagaaatgacattggaagaaggatttgatgtgtttagaaaagaatagtagggttgtgcttatgcttgtgtatgaatgtttctttggctctcttgatttccttaagagggttaaggagcataaaagtgtaggttaaagtctctttgagaaaaggggccgattttttttatccctcttgttcttctagaatttacttatatgttgtccttttcaacttatgtctttggcacattgtactcgtttatgcttttaagtgaagtttgagctatgtggatgttggtcagtgttcactttctattgtctgaaagactgaaattgctcaatactcaatagtagtgcctagtggtataatgaaag

SEQ ID NO: 15233 - DNA, 1411 bp, Quercus alba
tttaaactttaaaccaaaactccttgacctttcaatgctctcctctattcctctcccattatatataacccctacactctctcacatttcgacacccaaacaccaaacaccaaaaccataaactctctctctcaccaaagcttcatcctttgcttttttctattaaccatgactaaggatgttgcagagcatggctcatttccagccaaagactaccacgacccacctccagcaccgttgttcgatcctgtggagctaaccaaatggtccttttacagggctttgatagctgagtttgtagctactttgctctttctatatgtcacggttctgaccgtgattggctacaagagccagattgaccctgccttgaaaggtgatgcctgtggtggtgttggtattcttgggattgcttgggcctttggtggcatgattttcgttcttgtttactgcactgctgggatttcagggggtcacattaacccagcagtgaccttcgggctcttcttggctcgtaaggtgtcgctgattcgggccgtgttgtacatggtggctcagtgcttgggagccatatgtggtgttgcgctcgtcaaggcctttcagagtgcctattatgtaaagtatggtggtggcgccaactctctctcagatgggtacagcactggcgttggattgggcgccgagatcgtagggacctttgtgcttgtgtacaccgtcttctctgccactgatcccaagaggaaagctagagattcacacgttcctgttttggcaccactccccattggatttgcggtgttcattgttcacttggccacgatcccagtcactggcactggcatcaaccccgctaggagtcttggtgcagctgttatctacaacaatgacacggcctggaaagaccattggctcttttgggttgggccattcattggtgcagctttagcagctttctaccaccaattcatcttgagagctggtgctgcgaaagctcttgggtcattcaggagcaactcctcccatgtttgattaacaaagagggttaattatttgattccttcttcgtggttctactgagaaatgacattggaagaaggatttgatgtgtttagaaaagaatagtagggttgtgcttatgcttgtgtatgaatgtttctttggctctcttgatttccttaagagggttaaggagcataaaagtgtaggttaaagtctctttgagaaaaggggccgattttttttatccctcttgttcttctagaatttacttatatgttgtccttttcaacttatgtctttggcacattgtactcgtttatgcttttaagtgaagtttgagctatgtggatgttggtcagtgttcactttctattgtctgaaagactgaaattgctcaatactcaatagtagt

SEQ ID NO: 15234 - DNA, 1264 bp, Quercus alba
acaccaaaaccataaactctctctctcaccaaagcttcatcctttgcttttttctattaaccatgactaaggatgttgcagagcatggctcatttccagccaaagactaccacgacccacctccagcaccgttgttcgatcctgtggagctaaccaaatggtccttttacagggctttgatagctgagtttgtagctactttgctctttctatatgtcacggttctgaccgtgattggctacaagagccagattgaccctgccttgaaaggtgatgcctgtggtggtgttggtattcttgggattgcttgggcctttggtggcatgattttcgttcttgtttactgcactgctgggatttcagggggtcacattaacccagcagtgaccttcgggctcttcttggctcgtaaggtgtcgctgattcgggccgtgttgtacatggtggctcagtgcttgggagccatatgtggtgttgcgctcgtcaaggcctttcagagtgcctattatgtaaagtatggtggtggcgccaactctctctcagatgggtacagcactggcgttggattgggcgccgagatcgtagggacctttgtgcttgtgtacaccgtcttctctgccactgatcccaagaggaaagctagagattcacacgttcctgttttggcaccactccccattggatttgcggtgttcattgttcacttggccacgatcccagtcactggcactggcatcaaccccgctaggagtcttggtgcagctgttatctacaacaatgacacggcctggaaagaccattggctcttttgggttgggccattcattggtgcagctttagcagctttctaccaccaattcatcttgagagctggtgctgcgaaagctcttgggtcattcaggagcaactcctcccatgtttgattaacaaagagggttaattatttgattccttcttcgtggttctactgagaaatgacattggaagaaggatttgatgtgtttagaaaagaattgtagggttgtgcttatgcttgtgtatgaatgtttctttggctctcttgatttccttaagagggttaaggagcataaaagtgtaggttaaagtctctttgagaaaaggggccgatttttttttatccctcttgttcttctagaatttacttatatgttgtccttttcaacttatgtctttggcacattgtactcgtttatgcttttaagtgaagtttgagctatgtggatgttggtcagtgttcactttc

SEQ ID NO: 15235 - DNA, 1424 bp, Cajanus cajan
agtttaattattcgattcattctcatagtctctctctttctttcattacttaaataccacctctctccactcaccccctcaatccactccaacagcacacaactagcaatagtgttgagcctgtgagagaaaatatggctaaagatgttgaggttcaagagcaaggagaatactcctccaaagactatcaagaccctcctccggcacccttgatcgaccctgaggagctcacaaagtggtccttctggcgagccctcattgctgagttcatagcaacccttctcttcctttatatcactgttctcaccattattggctacaaaagccaaactgatcctagcaaaaagggcaccgagtgtgatggggttggcattttgggcattgcttggtcctttggtggcatgatcttcatccttgtttactgcaccgccggtatttctggaggacacataaacccggcggtgacattcgggctgttcctaggacggaaggtgtcgctgataagggcgttgttgtacatggtagcacagtgtgccggtgctatctgtggcgctggacttgccaagggcttccaaacagcatactacgacagatatggaggtggtgccaactctgttgcagatggctacaacaagggcactgctttgggtgctgagattattggtaccttcgttcttgtttacactgtcttctctgccactgaccccaagaggaacgctagggactcccatgttcccgtgctagcaccactacccattggatttgctgtgttcatggttcacttagctacaatcccaattactggtactggcattaacccagcaaggagttttggagcagctgtaatctacaacgaagacaaaatctgggatgaccagtggattttctgggttggacccattgttggagcagcagtggctgcattctaccaccaatacatccttagagcagcagctatcaaggctcttggatcattcaggagcaacgcttaattagcttcttaatttgctagccaacatggtgtttttccgaagaattgataataataagaatttctatgttgagggagtgctagtgtgtctctggggttccctaatttaaggtttttcgtctttttctttcatcagctacagttgttggaggataaggccaaaaccatggggggcatcaaattgtagataaccatgcttgtgtccaagggtctattttctatccctttttttatatattttattttaatttccttgtatgtattcctaaagtgttcccttcctgtcttgtgcatcctcaatcattaatttatcattttacttttcttgtttcttaattatcatctatatatgtaatgtaccttacttgagtaatattatctacatgtattaagttgctggtttttcgtattcatggttaaggttaatatagag

SEQ ID NO: 15236 - DNA, 1216 bp, Cajanus cajan
ctttgcattgcatatatactcatactcgcttcattcctctcaagtctaaaccaaccttctctctctctctctctcttcaatggcgaaagacatggaaggcgagggtcacgttgggttggcgcacaaggactaccaagatccaccgcccgcacccttcttcgaccccgccgagctccgcaagtggtccttctacagagccctcatcgcggagttcgtcgccaccctcctcttcctctacatcaccatcctcaccgtcatcggctacaaccaccagaccgactccaccgccgacctctgcaacggcgtcggcatcctcggcatcgcctgggccttcggcggcatgatcttcgtcctcgtctactgcaccgccggcatttcaggaggtcacataaacccggcggtgacgtttgggttgtttctagcgaggaaggtgtcgctggtgagagcggttgcgtacatggtggctcagtgcttgggggccatatccggcgttggccttgtcaagggctttcagtccagctactacaacaggtacaaaggtggcgccaacactctctctcatggctacagcaaaggcactggcttgggcgctgaaatcatcggcacctttctccttgtctacaccgtcttctccgccaccgatcccaagagaaaagccagagactcccatgttcccgtgttggcaccccttccaattggctttgcggtgttcatggttcacttggccaccatacccatcaccggcactggcatcaaccctgctagaagccttggacctgctgtcatatacaacaaccagaaagcatgggatgaccagtggatcttctgggttgggcccttcattggtgctgccattgctgcgatttaccaccagtacgtgttgagggcccatgcggtgaaggcgctcggctctttcaggagctccacaaacctgtaacttgatccggcaaagcttgctaggagaggaactatgtcctttaatttaatttaatttaatttaatttaatttgcttatacatatatggtggattggaatttgtatatcctcgtcactatgtgtgtatttatgtttaattgctatttgtgggaacatccatctcgaaagacatgttaatgttaacgttaatgttaatttgtgtatgtattttgaagtgttatgttacattgtgtgatcctcttgtctatcttaattcatgtcctgtggctctggttgtcg

SEQ ID NO: 15237 - DNA, 1375 bp, Secale cereale
cacaccctcgccttgttgtcttttacctaccacttctcccccgctccactaaataccaccttcctcttcctctcgtcactcccccaccacacacaagctccacctccattttttctactcaggtttgcagcgagaagaaacagcaaagccgatggcgaaggacgaggtgacggagaccggcggcggcggcgacttcgcggccaaggactacacggacccgccgccggccccgctgatcgacgcggcggagctggcctcgtggtcgctgtaccgcgccgtcatcgccgagttcatcgccacgctgctcttcctctacatcaccgtggccaccgtcatcgggtacaagcaccagacggaccccgcggtgaacagcgccgccgacgcggcgtgcggcggcgtgggcgtgctcggcatcgcctgggccttcggcggcatgatcttcgtcctcgtctactgcaccgccggcatctccgggggccacatcaacccggccgtcaccttcggcctcttcctggcgcgcaaggtctccctggtccgcgcgctgctctacatgatcgcgcagtgcctcggcgccatgtgcggggtcggcctcgtcaaggccttccagagcgcatacttcgtcaggtacggcggtggcgccaacacgctcgccgccggctactccaagggcaccggcctcgccgcggagatcatcggcaccttcgtgctcgtctacaccgtcttctccgccaccgaccccaagcgcagcgcacgcgactctcacgtcccggtgctggcgcccctcccgatcggcttcgccgtgttcatggtccacctggccaccatcccgatcaccggcaccggcatcaacccggccaggagcctcggggccgccgtcatctacaacaaggagaaggcctgggatgatcagtggatcttctgggtcggcccgatgatcggcgcggcgatcgcggccttgtaccaccagtacatcctcagggccggcgctatcaaggccctcggctccttcaggagcaacgcataacaagttaccgtccatgtgatctgcatgcaagattgaagcaatggcgacctgtgttgtgtccagagagaaaaaaaggcacttttacaacttctcaacagttcagttggcccgcaatggtcgtgttatttatgtgtcggcaggcagctgcatatgcgtagtacgttgttggccaccatgtgcccggtcctgcgtgccgtgtcttgtaattcggtccatgggatcgctcgcttgtcttaattagcccgcattccttttcctatttaaatttagcgaccatatgattatgatcgatccaacgtcaccacctttctatctaagtcatcaatccatcaagcaagtgatcatcccgaa

SEQ ID NO: 15238 - DNA, 1396 bp, Secale cereale
ttttctactcaggtttgcagcgagaagaaacagcaaagccgatggcgaaggacgaggtgacggagaccggcggcggcggcgacttcgcggccaaggactacacggacccgccgccggccccgctgatcgacgcggcggagctggcgtcgtggtcgctgtaccgcgccgtcatcgccgagttcatcgccacgctgctcttcctctacatcaccgtggccaccgtcatcgggtacaagcaccagacggaccccgcggtgaacagcgccgccgacgcggcgtgcggcggcgtgggcgtgctcggcatcgcctgggccttcggcggcatgatcttcgtcctcgtctactgcaccgccggcatctccgggggccacatcaacccggccgtcaccttcggcctcttcctggcgcgcaaggtctccctggtccgcgcgctgctctacatgatcgcgcagtgcctcggcgccatgtgcggggtcggcctcgtcaaggcgttccagagcgcatacttcgtcaggtacggcggcggcgccaacacgctcgccgccggctactccaagggcaccggcctcgccgcggagatcatcggcaccttcgtgctcgtctacaccgtcttctccgccaccgaccccaagcgcagcgcacgcgactctcacgtcccggtgttggctcccctcccgattggcttcgccgtgttcatggtccacctggccaccatcccgatcaccggcaccggcatcaacccggccaggagcctcggggccgccgtcatctacaacaaggagaaggcctgggatgatcagtggatcttctgggtcggcccgatgatcggcgcggcgatcgcggccttgtaccaccagtacatcctcagggccggcgctatcaaggccctcggctccttcaggagcaacgcataacaagttaccgtccatgtgatttgcatgcaagattgaagcaacggcgacctgtgttgtgttcatccaaagagaaaagcgcttttacaacttctcaacagttcagttggcccgcaatggtcgtgttatttatgtgtcggcaggcatgcgtagtacgtacgtggttggcctccatgtgccccagtcctgcgtgccgtgtcttgtaattcggtccatgggatcgctcgcttgtcttaattagcccgcattccttttcatatttaaatttagcgaccatatgattatgatcgatccagcgtcaccaccttcctatcaagtcatcaatccatcaagcaagtgatcatcccgaatacagtattctctcttgctttgtactagtactctcttgttgctgctttggcgctgtggatcctcaagcccgaatgatcatatgtcgtgtgatgtgccaaaaaagtcgtaggggagacgacgacacaggaggaggg

SEQ ID NO: 15239 - DNA, 1240 bp, Secale cereale
gaagaaacagcaaagccgatggccaaggacgaggtgacggagaccggcggcggcggcgacttcgcggccaaggactacacggacccgccgccggcgccgctgatcgacgcggcggagctggcctcgtggtcgttgtaccgcgccgtcatcgccgagttcatcgccacgctgctcttcctctacatcaccgtggccaccgtcatcgggtacaagcaccagacggaccccgcggtgaacagcgccgccgacgcggcgtgcggcggcgtgggcgtgctcggcatcgcctgggccttcggcggcatgatcttcgtcctcgtctactgcaccgccggcatctccgggggccacatcaacccggccgtcaccttcggcctcttcctggcgcgcaaggtctccctggtccgcgcgctgctctacatgatcgcgcagtgcctcggcgccatgtgcggggtcggcctcgtcaaggcgttccagagcgcatacttcgtcaggtacggcggcggcgccaacacgctcgccgccggctactccaagggcaccggcctcgccgcggagatcatcggcaccttcgtgctcgtctacaccgtcttctccgccaccgaccccaagcgcagcgcacgcgactctcacgtcccggtgttggctcccctcccgattggcttcgccgtattcatggtccacctggccaccatcccgatcaccggcaccggcatcaacccggccaggagcctcggggccgccgtcatctacaacaaggagaaggcctgggatgatcagtggatcttctgggtcggcccgatgatcggcgcggcgatcgcggccttgtaccaccagtacatcctcagggccggcgctatcaaggccctcggctccttcaggagcaacgcataacaagttaccgtccatgtgatctgcatgcaagattgaagcaacggcgacctgtgttgtgttcatccaaagagaaaagcgcttttacaacttctcaacagttcagttggcccgcaatggtcgtgttatttatgtgtcggcaggcagctgcatatgcgtagtacgtggttggcctccatgtgcccggtcctgcgtgccgtgtcttgtaattcggtccatgggatcgctcgcttgtcttaattagcccgcattccttttcctatttaaatttagcgaccatatgattatgatcgatccaacgtcaccacctttctatctaagtcatcaatccatcaagcaagtgatcatcccg

SEQ ID NO: 15240 - DNA, 1137 bp, Secale cereale
tcgcacaagctcacctccatttttctactcaggtttgcagcgagaagaaacagcaaagccgatggccaaggacgaggtgacggagaccggcggcggaggcgacttcgcggccaaggactacacggacccgccgccggccccgctgatcgacgcggcggagctggcgtcgtggtcgctgtaccgcgccgtcatcgccgagttcatcgccacgctgctcttcctctacatcaccgtggccaccgtcatcgggtacaagcaccagacggaccccgcggtgaacagcgccgccgacgcggcgtgcggcggcgtgggcgtgctcggcatcgcctgggccttcggcggcatgatcttcgtcctcgtctactgcaccgccggcatctccgggggccacatcaacccggccgtcaccttcggcctcttcctggcgcgcaaggtctccctggtccgcgcgctgctctacatgatcgcgcagtgcctcggcgccatgtgcggggtcggcctcgtcaaggcgttccagagcgcatacttcgtcaggtacggcggcggcgccaacacgctcgccgccggctactccaagggcaccggcctcgccgcggagatcatcggcaccttcgtgctcgtctacaccgtcttctccgccaccgaccccaagcgcagcgcacgcgactctcacgtcccggtgttggctcccctcccgattggcttcgccgtgttcatggtccacctggccaccatcccgatcaccggcaccggcatcaacccggccaggagcctcggggccgccgtcatctacaacaaggagaaggcctgggatgatcagtggatcttctgggtcggcccgatgatcggcgcggcgatcgcggccttgtaccaccagtacatcctcagggccggcgctatcaaggccctcggctccttcaggagcaacgcataacaagttaccgtccatgtgatctgcatgcaagattgaagcaacggcgacctgtgttgtgttcatccaaagagaaaagcgcttttacaacttctcaacagttcagttggcccgcaatggtcgtgttatttatgtgtcggcaggcagctgcatatgcgtagtacgtggttggcctcatgtgcccggtctgcgtgccgtgtcttgta

SEQ ID NO: 15241 - DNA, 1316 bp, Lactuca sativa
tggtttttctctcactaccttccataaataccacctatcacaacacactccactcacaaaaccattatcacttctcagttctctcgacctgaaagccatgactaaagacgttgaagtggcggagcaccacggcggcggcggcgaatacaccgccaaggactaccacgatccacctcctgcccccttctttgacgctgacgaactcaccaaatggtccttctacagagcactcattgccgagttcgtcgccactctcctcttcctctacgtcactgttttaacagtcatcggttacaaaagccagaccgatcctgctttggacctcgatcagtgcggcggcgtcggaattctcggcatcgcctgggccttcggcggcatgatcttcatcctcgtctactgcaccgccggtatctccggaggacacattaaccctgctgtgacattcggtttgtttttggcgagaaaggtgtcgttgattagggctgtaggttacatgattgcacagtgtttgggagcaatttgtggtgtagggttagtgaaagctttccagagctcatactacgaccggtacggcggcggagccaacgaattggccgacggttacaataagggcaccggactcggtgctgagatcatcggcaccttcgtccttgtttacactgtcttctctgccaccgatcccaagaggagtgcacgagactcccatgttcctgtattggcaccacttcccatcggtttcgctgttttcatggtgcacttggccaccattccgatcaccggcaccggcatcaacccggcgagaagttttggcgccgccgtgatttacaacaaggcgaaggcatgggatgatcaatggatcttctgggtgggaccattcatcggagcattggccgccgccgtctaccaccagtttgtactgagagccgccgcaatcaaggcacttggctctttcagaagcaatgcttgagcttgaaagatgttcatccatggctgttcatgccttgtagatatctttgcaaattccccttaaaagaattgggtttcatgtaattgttatttattttcttcgtgtcttatttatgtgaattgtaagcgttcgtttttttttttttttcttttttaattttgattttgtgatccaagtatttcaagatcaaaaggtgtggaaatatgtaatttaagagctcgtgttcttatcataaaatttatgaaaaaaaaaatgtttggttcattcaacatttgaaaaggctcacaactaattaatacggttatatttatgatttaacaaaaaactaagatacattttcttctttaag

SEQ ID NO: 15242 - DNA, 1186 bp, Helianthus annuus
gggacttcctccacactattccctcttctcatctctcctcaccaccaccacaaccatgactaaagatgttgaagtggcggagcaccacggcggcggaagcgagtacaccgccaaggactaccacgacccgccgcctgctccgttttttgacgcggacgagctcaccaaatggtcattctaccgtgcattgatcgccgagtttgtcgccactctccttttcctttatgtcaccgttttgaccgttatcgggtacaaaagccagactgatcctaaattggaccttgatcagtgcgggggtgttggcatcctcggcatcgcctgggcctttggtggcatgatcttcatccttgtttactgcaccgccggtatctctggaggacacattaacccggctgtgacattcgggttgtttttggcgagaaaggtgtcgttgattagggcgttggggtacatgatagcacagtgtttgggtgcgatttgtggtgtgggtctagtgaaggctttccaaagctcgtactacaacaggtacggtggtggtgcgaacgagttggctgacggttacaacaaaggtactggacttggtgctgagattatcggcacctttgtccttgtttacaccgtcttctctgccaccgatcctaagaggagtgcacgagactcccatgttcctgtattggcaccactgcccataggatttgccgtattcatggtgcacttggccaccattcccatcaccggcaccggtatcaacccggccagaagttttggcgccgccgtgatctacaacaacgaaaaagcctgggatgatcaatggatattctgggttggaccattcatcggagcattcgccgccgcagtctaccaccagtttgtgcttagagccgccgcgattaaagcgcttggttcattccgaagcaatgcttaagcttgaaagatgttcatccagccatggtggttcttggcttgtagatatctttgaaaaaatcgtttattgtaattgtattttcttttgagtttcgttaatatgtatgcaagtgtgttttttttttctttcttttttttttttttaaatttgattttgatatctaatggtttcaagatcaaatggtgtgagatatgaaatttatgttatcaaaagttcacgaaaatggttgttaatttattgaggttaaatatgtgatgcgga

SEQ ID NO: 15243 - DNA, 1224 bp, Amorphophallus konjac
cggccgggggacagaagaacaaaaagctacacacacacagcagcggcagcggcagcggcagcagctcactctctctcgcagttacttccctcgtctttctctctctagcttagctactccgtccaggcagctgcgaccatggggaaggaagtggaggagcaccacgggggggaattcacggcgaaggactacacggacccgccgccggccccgctcatcgaccccgacgagctgggcaagtggtccttctaccgcgctctcatcgccgagttcatcgccaccctcctcttcctctacgtcaccgtcctcaccgtcatcggccacaagtcctccaccgaccccgacaaggtctcccctgacgccgccaactgcggcggagtcggcatcctcggcatcgcctgggccttcggcggcatgatcttcatcctcgtctactgcacggccggcatttccggtgggcacatcaacccggcggtgaccttcgggctcttcctggcgaggaaggtgtcgctggttcgggcagtgctgtacatggtggcgcagtgcctgggggccatctgcggggttggcctcgtcaagggcttccagaaggcctactacaaccggtacggcggcggggccaacttcctcgccgacggctactccaagggaacgggtctggcggcagagatcatcggcaccttcgtcctcgtctacactgtcttcgccgccaccgaccccaagcgcaacgcccgagactcccacgtcccggtgttggccccgctgcccatcgggttcgcggtgttcatggttcacctggccaccatccccatcaccggcaccggcatcaaccctgcccggagcttcggcgccgccgtcatctacaacaagtccaagccctgggatgaccactggatcttctgggtggggccattcctcggcgctgccatcgccgccgcctaccaccagtacgtcctccgagctggggccatcaaagccctggggtcctacaggagcaacccccacgtctgagcccagctcgatcggccctcgatcccacaccggcagggagaagaggtgcgaagaagaagaagaagaagtcctgggaggccgggtcgcgcgtcacggggctccttttgaagagggggagtaacgtcacgccggaagaactgtagataaaatattattatgcatctgttctgtcctagaaggtcatcatcatgggtggggtgggggggggggttc

SEQ ID NO: 15244 - DNA, 1119 bp, Cirsium arvense
actcatctttctctctctacaaacatgacgaaagatccggtgacggaaccagagcaggagccaccttccggcaaggactaccacgacccaccgccggtggcgttcgttgacccaacagaattgactaagtggtcgttctacagagctctcatcgctgaattcatcgccacccttctcttcctttacattaccgtcttaactgttatcggttacaagagccagacagacatggataagcccggagccgacgcctgcggtggcgtcggaatccttggaattgcttgggcctttggtggcatgatcttcgtactcgtttactgcaccgccggtatctccggtggtcacattaacccagctgtgacctttggtctgtttctggctcgaaaggtctcattgttccgagccatcttgtacatggtggctcagtgcttaggagccatatgtggtgtgggtttagtcaaggctttccacaagacttactacaacgactatggtggtggtgctaacgagctagctgaaggctacaacaaaggcactggattgggtgctgagatcatcggaactttcgttcttgtctacaccgtcttttcggccaccgatcccaagagaaatgcccgagattcccatattccggtattagcacctttacccattgggtttgctgtgttcatggttcacttagccacgattccgatcaccggaactggtatcaatccggctaggagttttggagcagcggtcatttacaacaaggagaaagcttgggatgatcaatggatattctgggtcggaccgtttattggtgcagccatcgcagccttctatcacgaattcgtcttgaaagctggtgcagtgaaagcccttggatctttcagaagcagcacccatgtttgagatttcgatcttttagggaaaaccatcgtttcgtttcattttgatttcattaaaatttgaagggaaaaaaataagtatgtgaaatgtttgtatgtgtgtgaaattatgtgggttttaggtcttggaattgaatctgttcaagagtgatgagagccatggaaatgcaatgtaaatgctttttagagggggggttgtatccctcatgttattgttgtatgttgacgc

SEQ ID NO: 15245 - DNA, 1199 bp, Linum usitatissimum
ccacgcgtccgttctcacttaacccaacacaaaaatatggcaaaggacgtcgaagccgccgataaaccagccgccgagttctctgccaaggactaccacgacccacccccggcgcccatcttcgacctcgaagagctcaccagatggtccttctacagagccctcatcgccgagttcatcgccaccctcctcttcctctacatcaccgtcctcaccgtcatcggctacaagtcccagactgacccgctcaccaacaaagcctccgacgctgcctgcggcggcgtcggagtcctcgggatcgcttgggcctttggaggcatgatcttcattcttgtctactgcaccgccggtatctccggcgggcacattaacccggcggtcaccttcggacttttcttaggccggaaggtgtcgttgatacgggccttgggctacatgatggcccaatgcttgggggcaatctgcgggtgtgggcttgtgaaggggttccaaaaggcttactatgttaggtatggtggtggagctaatgagctggctagtgggtataataagggaaccggtctgggtgctgagattatcggaacgttcgttttggtttataccgttttctcggctactgaccccaagagaagcgccagagactcccatgttcctgtattggcaccacttccaattgggtttgcagtgttcatggtccacttggcaacaatcccaatcactgggactggaatcaaccctgccaggagttttggtgctgctgttatctacaaccaagacaaggcttgggatgatcagtggatattttgggtggggccattcattggagcagcaatagctgctttataccaccaatacatcctaagagcagcagcaatcaaggctttgggttcattcaggagcaatgcttgaaatcaaaaagtatttcaaggaatttggggtttgagaatgaataacacaaaaagggtttcaatggagtttgggagaagagggtttgtctgtaaatggttccaattaattagggttttggaattctctctaattaattgttttccccccctttcaatctgtatttaaacttgtgtcatttcgatgaatttggtgttttctttgttgaaaatctatctatgtattatgtggtgtttgttgtatttatgggctggcttccactgcaaactccactgaatttggtctggcttcac

SEQ ID NO: 15246 - DNA, 1110 bp, Helianthus annuus
tctcctcaccaccacaaccatgactaaagatgttgaagtggcggagcaccacggcggcggaagcgagtacaccgccaaggactaccacgacccgccgcctgctccgttttttgacgcggacgagctcaccaaatggtcattctaccgtgcattgatcgccgagtttgttgccactctccttttcctttatgtcaccgttttgaccgttatcgggtacaaaagccagactgatcctaaattggaccttgatcagtgcgggggtgttggcatcctcggcatcgcttgggcctttggtggcatgatcttcatccttgtttactgcaccgccggtatctctggaggacacattaacccggctgtgacattcgggttgtttttggcgagaaaggtgtcgttgataagggcgttgggttacatgatagcacagtgtttgggtgcgatttgtggtgtgggtctggtgaaggctttccaaagctcgtactacaacaggtacggtggtggtgcgaacgagttggctgacggttacaacaagggtactggacttggtgctgagattatcggcacctttgtccttgtttacaccgtcttctctgccaccgatccgaaaaggagtgcacgagactcccatgttccagtattggcaccactgcccataggatttgccgtattcatggtgcacttggccaccattcccatcaccggcaccggtatcaacccggccagaagttttggcgccgcggtgatctacaacaacgaaaaggcctgggatgatcaatggatattctgggttggaccattcattggagcattcgccgctgcagtctaccaccagtttgtgcttagagccgccgcgattaaagcgcttggttcattccgaagcaatgcttaagcttgaaagatgttcatccagccatggtggatcttggcttgtagatatctttgaaaaaaattgtttattgtaattgtattttcttttgagtttcgttaatatgtatgcaagtgtgttttttatttctttcttctttcttctttttttttaatttgattttgatatctaatgttttcaagatcaaatggtgtgagatatgatatttatgttatcaaaagttc

SEQ ID NO: 15247 - DNA, 837 bp, Flaveria ramosissima
tatttgcactctctagcaaccatgactaaagacgtgcccgaacaaggttcgttctccgctaaggactaccacgacccgccccggccccgttgatcgaccccgaggagctctccaaatggtcgttctatagggcgattatcgcggagttcatcgccacacttttgttcttgtatattactgtcttgactgttattggctacaagagcaccactgaccccgccttgaacgccgaccagtgcggtggcgttggtatcctcggtatcgcgtgggccttcggtggcatgatctttgtccttgtttactgcaccgctggtatctctggaggacacattaaccccgcggtgacattcggtctgtttctggctcgtaaagtatcgttgatccgagcatttatgtacatggtggctcagtgtttaggagccatttgcggtgtgggtttggtgaaggctttcaacaaaagcctctacaacaggtacggcggaggagccaacgagctggccgacggctacaacaaaggcaccggcctgggtgctgaaatcatcggcacttttgttcttgtttacactgtcttttcggccaccgaccccaagaggagtgctagagactcacatgttcctgttttggctcctcttccgattgggtttgcggtgttcatggtgcaccttgcgacaatcccgatcactggaaccggtatcaacccggctaggagtcttggagccgcggtcatctacaacaacgaaaaagcatgggatgatcagtggatattctgggttggaccatttgtgggtgcagccattgcagctttctaccaccaattcatattgagagcaggtgcaa

SEQ ID NO: 15248 - DNA, 1159 bp, Chrysanthemum coronarium
tgaccacacttcactctcattccattaaagcaacaatgactaaagatgtcgaagtagctgagcaccatggtggcgaatacggtgccaaggactaccacgaccctcctccagccccttttttcgacgctgaggaactcactaaatggtctttttatcgtgcacttattgccgagtttgttgccactcttcttttcctatatgtcacagttttgactgttatcggatacaaaagcacgactgatccaaatataccagacgttgatcagtgtggtggtgttgggatccttggtattgcttgggcttttggtggcatgatctttgtccttgtttactgcactgctggtatctctggaggacacattaaccctgcagtgacattcgggctctttgtggcacgaaaagtctcattgatcagggctgtgggttacatgatagcgcaatgtttgggtgcaatctgtggtgttggtttggttaaagctttccaaagctcacactacaaccgatacggtggtggtgccaacactttggctgatggttacaataagggtaccggactaggtgctgagattattggcacctttgttcttgtttacaccgtcttttcggccactgaccccaagaggagtgcacgagactctcacgttcctgtattggcacctctacctatcggattcgcagtgttcatggtacacttggccaccattccaatcacaggaaccggtattaaccctgctagaagttttggtgctgctgttatcctcaacgacgacaaggcatgggatgatcaatggatattctgggttggaccattcattggagcttttgccgcggcactttaccaccaattcgtactaagagccgccgcaatcaaggcacttggctcattcagaagcaatgcttaagcttaagatgttcatcaatggctatattaatttatgccttgtagatatctttggcaaatttgagtttgatgtaattgtaatttcttttcttggatttgtttttctatgtacattgtaagtgtggtttcttttctttatttttggttttgtgatcaaagtatatcaagatcaaaaggtgtgaattatcatgtaatttaagagctcgtgttcgtaaactgaaatcgtttagttcaatctatatttaaaccatgttgccg

SEQ ID NO: 15249 - DNA, 1031 bp, Chrysanthemum coronarium
actaacttcttctatccatctctgttctttgaacatcatcatcatatcagccatgacaaaagacgtcgaagtagctgagcaccatggtggaaaagactacgttgaaccaccaccagcacccttgttcgatgctgatgagctaaccaaatggtctttctaccgagctcttatagctgagtttgttgctacacttctgtttctttacgtgacggttttgaccgttatcgggtacaagagttctactgatcctttgttggatcttgatcagtgtggtggtgttgggattcttggtattgcatgggcttttggtggcatgatctttgtccttgtttactgcactgctggtatctctggaggacacattaaccctgcagtgacattcgggctctttgtggcacgaaaagtctcattgatcagggctgtgggttacatgatagcgcaatgtttgggtgcaatctgtggtgttggtttggttaaagctttccaaagctcacactacaaccgatacggtggtggtgccaacactttggctgatggttacaacaagggtaccggactaggtgctgagattatcggcacctttgttcttgtttacaccgtcttttcggccactgaccccaagaggagtgcacgagactcccacgttcctgtattggcacctctacctatcggattcgcagtgttcatggtacacttggccaccattccaatcacaggaaccggtatcaaccctgccagaagttttggtgctgctgttatcctcaacgacgacaaggcatgggatgatcaatggatattctgggttggaccattcattggagctttagccgcggcactttaccaccaattcgtactaagagccgctgcaatcaaggcacttggctcattcagaagcaatgcttaagcttaagatgttcatcaatggctatattaatttatgccttgtagatatctttggcaaaatttgagtttgatgtaattgtaatttctttcttggattcttgtcttgatatgtaaaattgcaagtgtgg

SEQ ID NO: 15250 - DNA, 1140 bp, Chrysanthemum coronarium
accacacttcactctcaaaccattatcacttcacaacacttaaagcagccatgactaaagacgtcgaagtagccgaacaccatggtggcgaatacggtgccaaggactaccacgacccgcctccagccccttttttcgacgctgaggaactcactaaatggtctttttatcgtgcacttattgccgagtttgttgctactcttcttttcctatatgtcacagttttgactgttatcggatacaaaagcacgactgatccgaatataccagatgttgatcagtgtggtggtgttggtatccttggtattgcttgggcttttggtggcatgatctttgtccttgtttactgcactgctggtatctctggaggacacattaaccctgcagtgacattcgggctctttgtggcacgaaaagtctcattgatcagggctgtgggttacatgatagcgcaatgtttgggtgcaatatgtggtgttggtttggttaaagctttccaaagctcacactacaaccgatacggtggtggtgccaacactttggctgatggttacaacaagggtaccggactaggtgctgagattatcggcacctttgttcttgtttacaccgtcttttcggccactgaccccaagaggagtgcacgagactcccacgttcctgtattggcacctctacccattggattcgcagtgttcatggtacacttggccaccattccaatcacaggaaccggtatcaaccctgccagaagttttggtgctgctgttatcctcaacgacgacaaggcatgggatgatcaatggatattctgggttggaccattcattggagctttagccgcggcactttaccaccaattcgtactaagagccgctgcaatcaaggcacttggctcattcagaagtaatgcttaagcttaagatgttcatcaatggctatattaatttatgccctgtagatatctttggcaaatttgcgtttgatgtaattgtaatttcttttcttggtgtttctttatgtacaattgtacatttaagcaattaagcgtggtctcgttttctttaaatttggttattgtgattaacagtctctttctggagtcttatattttaaaagctaatgatcgtctgaataagg

SEQ ID NO: 15251 - DNA, 1181 bp, Chrysanthemum coronarium
ttccctcactattttctttaaataccaacattttcaagccacaacataccacacttcactctcaaaccattatcacttcacaacacttaaagcagccatgactaaagacgtcgaagtagccgaacaccatggtggcgaatacggtgccaaggactaccacgacccgcctccagccccttttttcgacgctgaggaactcactaaatggtctttttatcgtgcacttattgccgagtttgttgccactcttcttttcctatatgtcacagttttgactgttatcggatacaaaagcacgactgatccgaatataccagacgttgatcagtgtggtggtgttgggatccttggtattgcttgggcttttggtggcatgatctttgtccttgtttactgcactgctggtatctctggaggacacattaaccctgcagtgacattcgggctctttgtggcacgaaaagtctcattgatcagggctgtgggttacatgatagcgcaatgtttgggtgcaatctgtggtgttggtttggttaaagctttccaaagctcacactacaaccgatacggtggtggtgccaacactttggctgatggttacaataagggtaccggactaggtgctgagattattggcacctttgttcttgtttacaccgtcttttcggccactgaccccaagaggagtgcacgagactcccacgttcctgtattggcacctctacctatcggattcgcagtgttcatggtacacttggccaccattccaatcacgggaaccggtattaaccctgccagaagttttggtgctgctgttatcctcaacgacgacaaggcatgggacgatcaatggatattttgggtcggaccattcatcggagctttggccgcggcactctaccaccaattcgtactaagagccgctgcaatcaaggcacttggctcattcagaagcaatgcttaagcttaagatgttcatcaatggctatattaatttatgccttgtagatatctttggcaaatttgagtttgatgtaattgtaatttcttttcttggagtttctttatgtacaattgtacattgaagcaattaagcgtggtctcgttttctttaaatttggttttgtgattaacagctctttctaggagcttatattttaaaagctaatgatcgtctgatg

SEQ ID NO: 15252 - DNA, 1002 bp, Cyclamen graecum
cctcaaccaaactctctacacactcaaagctttccttcttttctcagcatggcaaaaggtgcggacgtgccggagtcgggtttctcggggaaggattaccaggaccctccaccggcaccattcatcgacccgggggagctgaccaagtggtcattcttccgggctctcatcgcggagttcatagcaactctcctcttcctttacataggcaccacgaccgtcatcggctacagcagccagtccgaacatgacatgtgtggcggtgtcgggatcctcggtattgcctgggccttcggcggcatgatcttcgtcctcgtgtactgcaccgccgggatctccgggggccacattaaccctgccgtgacgttcgggctgttcttggcgcggaaagtgtcccttataagggcggtcgggtacatggttgcccagtgtggtggagccatttgtggcgtcggcctcgccaagtccttccaaaaatcctacttcaacacgttcggtggcggtgcaaacttcctccaagacgggtacagcaagggaaccggcttgggcgcggagatcatcgggacgttcgtgctggtatacacggttttctcggctaccgatccgaagaggagcgctagagactcccacgtccctgtattggccccacttccaatagggtttgcagtgtttttaattcacttggcaaccattccaattaccggaaccggcattaaccctgctcgtagcttcggagctgctgttataatcaaccgggaaaacatctgggatgatcagtggatattctgggtcggaccgttcattggagcagccattgcggccttctaccaccagttcatattgagagccggggcggtgaaagctctaggatcattcaggagtagctctcatgcttaatcgttacgagaaaaaagaattagagatttaataatgtgatgggtgagtgttctaagtttatttcgtgtatcgtgatttatttctctgtttttgttgctagttttt

SEQ ID NO: 15253 - DNA, 1079 bp, Nicotiana benthamiana
gaagtgagagccgttgtgtgacaacggtggccgtgggaccaattccacaattataatatgtattgggcggcttaaattttaatttaaataattaatcgtcccctctttgctgttccgcttcattctagtctaatataaatagctgccccctcacctctgacttctcatcacacctagaaacagagcagcaacagagtgttgaacagttagtgatgggaaaagacgtagaagcagcaacagagttttcagcaaaggactacacagacccgccaccagcaccgttgattgattttgaggagctgaaacaatggtccttttacagagctgctattgctgagtttattgccactttgttatttctgtatgtaactgtactgactgtcattggatacaagcaccaatcggacgttgatgctaatggcgatgtctgtggcggcgttggcatccttggtattgcctgggcatttggtggcatgatctttgttcttgtttactgcacggccggtatctctggaggacacattaacccggcagtgacatttgggttgttcttggcaaggaaagtgtcacttatcagggccttggtgtatatggtagcacagtgcttgggtgcaatatgtggtgtgggttttgtgaaggcttttcagagcgcttactatgacagatatggtggaggtgctaatcagatggctcctggccatacaaagggtgttggtcttgctgctgagatcattggtacctttgttttggtctacgttgtcttctctgccactgaccccaaaagaagcgcccgagactcccatgttcccgtattggctccacttccaattggattcgcagtattcatggtccacttagccaccattccaatcaccggaaccggtatcaatccggctaggagtttcggagcagccgtgatttacaaccaggacaaggcatgggatgagcactggatcttctgggttggtccatttatcggagcctttgccgctgccgcctaccaccagtatattctccgagctggtgccgcaaaagctctcggttccttcaggagcaatgcctaagacttctcattgttc

SEQ ID NO: 15254 - DNA, 997 bp, Ananas comosus
ctcaaccaaactctctacacactcaaagctttccttcttttctcagcatggcaaaaggtgcggacgtgccggagtcgggtttctcggggaaggattaccaggaccctccaccggcaccattcatcgacccgggggagctgaccaagtggtcattcttccgggctctcatcgcggagttcatagcaactctcctcttcctttacataggcaccacgaccgtcatcggctacagcagccagtccgaacatgacatgtgtggcggtgtcgggatcctcggtattgcctgggccttcggcggcatgatcttcgtcctcgtgtactgcaccgccgggatctccgggggccacattaaccctgccgtgacgttcgggctgttcttggcgcggaaagtgtcccttataagggcggtcgggtacatggttgcccagtgtggtggagccatttgtggcgtcggcctcgccaagtccttccaaaaatcctacttcaacacgttcggtggcggtgcaaacttcctccaagacgggtacagcaagggaaccggcttgggcgcggagatcatcgggacgttcgtgctggtatacacggttttctcggctaccgatccgaagaggagcgctagagactcccacgtccctgtattggccccacttccaatagggtttgcagtgtttttaattcacttggcaaccattccaattaccggaaccggcattaaccctgctcgtagcttcggagctgctgttataatcaaccgggaaaacatctgggatgatcagtggatattctgggtcggaccgttcattggagcagccattgcggccttctaccaccagttcatattgagagccggggcggtgaaagctctaggatcattcaggagtagctctcatgcttaatcgttacgagaaaaaagaattagagatttaataatgtgatgggtgagtgttctaagtttatttcgtgtatcgtgatttatttctctgtttttgttgctagc

SEQ ID NO: 15255 - DNA, 1219 bp, Ananas comosus
ccatcctcctcaaaccttaacctgctccgatcgaactgcttccttttgtcaatgctgttacgtctactagcaccaggctctaaaactttctccttcattctcttttcatcaatattatcatattcgtcgaactcaaacacatccaatcttctcttcctctcattctcatccctcaaccaaactctctacacactcaaagctttccttcttttctcagcatggcaaaaggtgcggacgtgccggagtcgggtttctcggggaaggattaccaggaccctccaccggcaccattcatcgacccgggggagctgaccaagtggtcattcttccgggctctcatcgcggagttcatagcaactctcctcttcctttacataggcaccacgaccgtcatcggctacagcagccagtccgaacatgacatgtgtggcggtgtcgggatcctcggtattgcctgggccttcggcggcatgatcttcgtcctcgtgtactgcaccgccgggatctccgggggccacattaaccctgccgtgacgttcgggctgttcttggcgcggaaagtgtcccttataagggcggtcgggtacatggttgcccagtgtggtggagccatttgtggcgtcggcctcgccaagtccttccaaaaatcatacttcaacacgttcggtggcggtgcaaacttcctccaagacgggtacagcaagggaaccggcttgggcgcggagatcatcgggacgttcgtgctggtatacacggttttctcggctaccgatccgaagaggagcgctagagactcccacgtccctgtattggctccacttccgataggttttgcagtgtttttaattcacttggcaactattccaattaccggaactggcattaaccctgctcgaagcttcggtgccgctgttataatcaaccgagaaaagatctgggatgaccagtggatattttgggttggaccattcattggagcagccatcgcggccttctaccaccagttcatactgagggccgctgcggttaaagctctcggatcattcaggagtggctctcgtgtttaataattatcatcatatttctacaccgtcgtgagagaaaagagttaacaacgaaaatgaataaggtgatggttgaatgttttatttcgcgtattgtaatatattttctccattgttattgttgttttaaattattggagaaaatatggtgtgac

SEQ ID NO: 15256 - DNA, 1498 bp, Glycine max
ttaaataccaccctctttccactcaccccttcaatccactccactctagcacacaaaacttgctatagcagtaagctataactcatttgaggctctgtgagaattgagaaatggctaaagatgttgaggttcaagagcaaggaggagagtactctgccaaagactaccatgaccctcctccagcacctttgttcgacccagaggagctcacacagtggtccttctatagagccctcatcgctgagttcatagcaacccttctcttcctttatgtcactgtgctcaccattattggctacaaaaggcagactgatacaacggtaggtggcaccgactgtgatggggttggcattttgggcatcgcttgggcctttggtggcatgatcttcatccttgtttactgcaccgccggtatttcaggaggacacataaacccggcggtgacattcgggttgttcctaggacgcaaggtgtcgttgataagggcgttgttgtacatggtggcacagtgtgccggtgctatctgtggtactggattggccaaggggttccaaaaagcatactacaacaggtatggaggtggtgccaactctgttgctgatggctacaacaatggtactgctttgggtgctgagattattggtaccttcgttcttgtctacactgtcttctctgccactgaccctaagaggaacgctagggattcccatgttcctgtactggcgccacttcctattggatttgccgtgttcatggttcacttggctacaatcccaattactggtactggcattaacccagcaaggagtttcggagcagctgtaatctacaacgaagacaaaatctgggatgatcagtggatattctgggttggaccaattgttggagcagcagtggctgcattttaccaccaatacatccttagagcagcagctatcaaggctcttggatccttcaggagcaacgcttaattaattaatcaattaagctagctaccttgattaatttgccaacaagggctatgcatggtgtttcccccgaagaataataatttctatgttgaggagtgctagtgatctgtctatgcagttccctaatttaggctttttcgtcttttcctctcatcagctacagttgttgggggtgtttggaagagaaggccaaaaccatgggggcatgcatcaaattgtagataagcatgcttgtgtccaagggtgtattttgtatcccttttgtgtcttttctttttctttttcttttttttaatttccatgtatgtattccttgagtgttccttttctgtcttgtgcatccttagtcatttctcattttactcttcataattaagtactcatcttctcttgtttattaaagctttattaatcatcatctatgaatgtaatgtaccttgacttgagtaatatttatatatattatgttgcaggttttttattcacacggataagcttaatataagataaaataataagtgaaacca

SEQ ID NO: 15257 - DNA, 1302 bp, Glycine max
acaaaacttgctatagcagtaagctataactcatttgaggctctgtgagaattgagaaatggctaaagatgttgaggttcaagagcaaggaggagagtactctgccaaagactaccatgaccctcctccagcacctttgttcgacccagaggagctcacacagtggtccttctatagagccctcatcgctgagttcatagcaacccttctcttcctttatgtcactgtgctcaccattattggctacaaaaggcagactgatacaacggtaggtggcaccgactgtgatggggttggcattttgggcatcgcttgggcctttggtggcatgatcttcatccttgtttactgcaccgccggtatttcaggaggacacataaacccggcggtgacattcgggttgttcctaggacgcaaggtgtcgttgataagggcgttgttgtacatggtggcacagtgtgccggtgctatctgtggtactggattggccaaggggttccaaaaagcatactacaacaggtatggaggtggtgccaactctgttgctgatggctacaacaatggtactgctttgggtgctgagattattggtaccttcgttcttgtctacactgtcttctctgccactgaccctaagaggaacgctagggattcccatgttcctgtactggcgccacttcctattggatttgccgtgttcatggttcacttggctacaatcccaattactggtactggcattaacccagcaaggagtttcggagcagctgtaatctacaacgaagacaaaatctgggatgatcagtggatattctgggttggaccaattgttggagcagcagtggctgcattttaccaccaatacatccttagagcagcagctatcaaggctcttggatccttcaggagcaacgcttaattaattaatcaattaagctagctaccttgattaatttgccaacaagggctatgcatggtgtttcccccgaagaataataatttctatgttgaggagtgctagtgatctgtctatgcagttccctaatttaggctttttcgtcttttcctctcatcagctacagttgttgggggtgtttggaagagaaggccaaaaccatgggggcatgcatcaaattgtagataagcatgcttgtgtccaagggtgtattttgtatcccttttgtgtcttttctttttctttttcttttttttaatttccatgtatgtattccttgagtgttccttttctgtcttgtgcatccttagtcatttctcattttactcttcataattaagtactca

SEQ ID NO: 15258 - DNA, 972 bp, Brassica oleracea
taaaaaaactagaaacatcatacatacatggcgaaagacgcggaaggagcagaaggatttgcggcgagggattaccaagacccgccgcctacaccatttttcgacgcggaggagttgacaagatggtccttatacagagccgtcatcgccgagtttgtagccactcttctcttcttgtacgtcaccgttttgactgtcattggctacaagatttcgtccgacacagccgccggtggagttgaatgcggcggcgtaggaatcctcggcatcgcttgggcttttggtggcatgatcttcatccttgtgtactgcaccgccggtatttcaggtggtcacataaacccggcggtgacgttcggcttgttcttggctcgcaaggtatcgctgattagagcggtgctatacatggtggctcaatgtttaggtgcgatttgtggagttgggtttgtcaaagcctttcagagctcttactacgtccgttacggaggcggagccaactctctagctgacggatacagcacagggactggactagctgcagagatcatcggaacatttgttcttgtgtatactgtcttctcagccacagaccccaaaagaaacgcacgtgactcccacgttcccgtgttggcgccacttccgattgggtttgcggtattcatggtacacttggctactattccgatcaccggaacaggaattaacccggcgaggagtttcggagctgcggttatctacaacgagtccaagccgtgggatgaccactggatattctgggtgggaccattcattggagctgcgattgctgcattttatcaccaattcgtcctaagagcttccggttccaagtcactcggatccttcagaagtgcggccaacgtttgaattctgccccacacacatacatacaacaaaagtggttactctttgtgtagtatttcggcaaatgatttttaaaatatgccctccttt

SEQ ID NO: 15259 - DNA, 1224 bp, Brassica juncea
aaccagagaaagtagtaaaacagttcctgcagaaacactcattacatataataatcctatatggccaaagacgtggaaggagcagagggattcgcggcgagggactacgaagacccgccgccgactccgtttttcgatgcggaggagctgacgaagtggtctttgtacagagccgtcatcgccgagttcgtagccactctcctcttcttgtacgttactgttttgactgtcatcggctacaagatttcttcagacaccaaggccggaggcgacgagtgcggaggtgtcggaatccttggcatctcatgggctttcggtggcatgatcttcattcttgtctactgcactgctggtatctcaggtggtcacataaaccctgcggtgacgttcgggttgttcttggcaaggaaggtatcgttggttagagcggtgctatacatggtggctcagtgtttgggcgctatctgtggagttggttttgtcaaagccttccaaagctcttactatgtccgttacggtggaggagcaaactctctagccgatggatacagcacggggacaggactcgctgcagagatcatcggaacattcgtcctggtctacactgttttctcagcaacagatcccaaaagaaacgcacgagactctcacgttcccgtgttggcgccacttccgattgggtttgccgtgttcatggtccacttggccactattccaatcaccggaaccgggattaacccggccaggagtttcggagctgcagttatcttcaacgagtccaagccttgggatgaccactggattttttgggttggaccattcattggagctgccatagctgcattttatcaccaattcgttctaagagcttctggttccaaatccctcggatccttcagaagtgctgccaacgtttgaatttagccacacaaaacaaaacaaaaaggtggttactgttatgtataaattgggcacgtgattttaaaatgtgtcctttgatgtcttgttttcttcctctgcttctatttgtgtggattccggtttgagtgtttagcgtttcaatgtcagtaagtttgtttattgagaaaaaaagatgactacattgcttcgcttattgatctccttctcctcgaaacccactcctcatcgaaatctccactaatcattaagtgatagatcacagaattggatcttcaatgtaacgaggaagatagcataaataag

SEQ ID NO: 15260 - DNA, 1220 bp, Vitis vinifera
atcccaacatttctcactcttgctcaagctcactgagaagctagaaaacacatctctctgtgtttccctcactagaagaggtgggttgctatggccaaggacattgaggttgcagggcacggagacctcacattgaaggactaccacgacccaccaccggcgccactggtcgaccctgaggaattggggtcctggtccttttacagggccatcattgccgagttcgtggccacccttttgttcctctacgttactgtgttgacggtgattgggtacaagaaccagactgatccctaccatcacggaaatgaatgcaacggggttggtattcttggcattgcttgggcctttggtggcatgatcttcatccttgtttactgcaccgccggcatctctggagggcatattaatcctgcagtgacgttcgggctattcctggctagaaaggtgtcgctggtccgagccgtgatgtacatggtggcccagtgcgggggagccatctgcggctgtggcctggtcaagctattccaggatatttactacatcagatacggtggtggcgccaatgagctcgcctctggatacagtataggaacggggttggctgctgagattattggcaccttcgttcttgtctacaccgtcttctctgctactgatcccaaaagaaatgcaagagattcccatgtacctgttttggcaccactccccattggatttgctgtgttcatggttcacttagccacgatccccatcaccggtaccggaatcaacccggctcgaagtctcggagctgctgtcatctacaaccaacccaaagcctggagtgaccattgggtattttgggctggacccttcattggtgcagccattgcagcattctatcaccagttcatattgagagctggagctgttaaagctctagggtctttcaagagcagttcccacatgtaatggggtaatgcatttcaatccatatggtccgacaggctctggattatatgagttgtacatttaggtgtataatagtggtgaggatgtgtgacgaatttgtggccctgtaggagcttggcacttgttttgaatgtgccccgggatcatcatctgctctgttttctttcctttcctttcccttttttgcctcgttttgtagtagtgatgttgttgagattaatttatcaacaactctgctctaataaactcctttatcagttcatcca

SEQ ID NO: 15261 - DNA, 1157 bp, Arabidopsis lyrata
agagcacatgttcttatcactaaccactcaacagagaagcaaaagaaaaaaagctactgtttgaaagaagaagataactatggcaaaggatgtggaagccgttcccggagaaggatttcagacaagagactatcatgatccgccgccagctccgtttatcgatggagcggagctaaagaagtggtctttttacagagcagtcatcgccgagtttgtagccactctcctcttcttatacatcaccgttttgactgtcatcggttacaagattcagtccgatactacggccggcggcgtagactgcggcggagttggaatcctcggtatcgcttgggcctttggtggtatgatcttcatcctcgtctactgcaccgccggtatctctggtggtcacattaacccagcggtgacatttgggctattcttggcacgtaaagtatcgttgcctagggctatattgtacattgtggctcagtgtttgggtgcgatttgtggagttggatttgtcaaagccttccaaagctcctactacgaccgttacggcggtggagccaactctcttgccgatggctacagcacagggaccggtctagccgcagagatcattggtactttcgttcttgtctacaccgtcttctctgccaccgaccccaaacgtagtgccagagactcccacgttccggtgttggcgccacttccaatcggattcgccgtgttcatggtacatttggccaccattcccatcaccggaaccggaattaacccggcaaggagtttcggagctgccgtaatcttcaacaagagcaagccatgggatgaccactggatattttgggttggaccattcattggagctgcgatagctgcattctaccaccaattcgttctgagggcttcaggttctaagtctctcggatctttcagaagtgctgccaacgtctaaacccaccaaaaccagatttctcaataataaatgaagttgtaatctctgtacaaatctaaatcaatccaaatcaatcacttgcagttttcttttctttcttatttgagttttctgcttgctcttttgtgaattttcctttggtgtaattgtttttcctttcgttttttaatcgagtgattggaactaaaatcaatgaaatcaaagaggttcttat

SEQ ID NO: 15262 - DNA, 1044 bp, Brassica juncea
atggcgaaagaagtggaaggagcagagggattcgcggcgagggactacgaagatccgccgccaactccgtttttcgatgcggaggagctgacgaagtggtctttgtacagagccgtcatagccgagttcgtagccactctcctcttcttgtatgtcactgttttgactgtcatcggctacaagatttcctccgacactaaggccggaggcgacgagtgtggaggcgtgggaatccttggcatctcgtgggctttcggtggcatgatcttcatccttgtctactgcaccgccggtatctcaggtggtcacataaaccctgcggtgacgttcgggttgttcttggcacggaaggtatcgttggttagagcggtgctatacatggtggctcagtgtttgggtgctatttgtggagttgggttcgtcaaagccttccaaagctcttactacgtccgttacggtggaggagcaaactctctagccgacggatacagcacagggaccggactcgcagcagagatcattggaacctttgtccttgtctacaccgtcttctccgctacagatcccaaaagaaatgcacgagactcccacgttcccgtgttggcgccacttccaattggatttgccgtcttcatggtacacttggccactattccaatcactggaaccgggattaacccggccaggagttttggagccgcggttatctacaacgaatccaagccgtgggatgaccattggattttctgggtgggaccattcattggagctgccattgctgcattttatcaccaattcgtcctaagggcttctggttccaagtccctcgggtcattcagaagtgctgccaacgtttgaatttagccacacaaaaacaaaatagcaattacaaaaatgattgttattatgtatgtacaaaattggcaactttggttttaaaatctatgctctgttttattcctttctctttcctaatttctggcttcactgtgggatatgtgtatgtttgtgtattcggggaaaacaatcaatgaaatcaaattg

SEQ ID NO: 15263 - DNA, 990 bp, Brassica oleracea
aaaacaaatccatttgttggacagaaagaaaacaaagatatcagatatggcgaaggacgtggaagccgttgccggagaagggtttcagtcaagagactatcaagacccgccgccggcgcctctgtttgatccggaggagctgacgaagtggtctttttaccgagcagtcatcgccgagtttgtagctactctcctcttcttatacatcaccgttttgacagtcatcggttataagattcagaccgatagtacagctggtggtgttgactgcggtggagttggaatcctcggtatcgcttgggccttcggtggcatgatcttcattctcgtctactgcaccgctggtatctctggtggtcacataaacccggcagtgacatttgggctactcttggcccgaaaagtatccttggttagagccatattgtacatggtagctcagtgtttgggtgcaatttgtggagttgggttcgttaaagccttccaaagctcttactacgtccgctacggtggtggagccaactctctagccgatggctacagcacaggtactggcctcgccgcagagatcatcggtactttcgttcttgtctacacggtcttctcggccactgaccctaaacgcagtgccagagactcccacgttccagtgttggctccacttcctattggatttgcggtgttcatggtacacttggctaccattcccatcaccggaactggaattaacccggcgaggagtttaggagcagctgtgatcttcaacgagagcaagccatgggatgaccactggatcttttggttgggaccattcattggagctgctattgctgcagtctaccaccaattcgttctgagggcttcaggttccaagtctctagggtctttcagaagtgctgcaaacgtctagtaagcgctttcatccacccaaacgcattctgaaatgataagatgataacttcaaatagttgtcgtctttttttctatgta

SEQ ID NO: 15264 - DNA, 1120 bp, Brassica napus
caaaagtaaaacagttcctaagaagaaacatccattacatataataatactacatggctaaagacgtggaaggagcagaggggttcgcggcgagggactacgaagatccgccgccaacaccgttcttcgatgcggaggagctgaccaagtggtctttgtacagagccgtcatagccgagttcgtagccactctcctcttcttgtatgtcactgttttaactgtcatcggctacaagatttcttccgacactaaggccggaggcgacgagtgcggaggcgtcggaatcctcggcatctcatgggccttcggtggcatgatcttcatccttgtctactgcaccgccggtatctcaggtggtcacataaacccggcggtgacgttcggcttgttcttggcaaggaaggtatcgttggttagagcggtgctatacatggtggctcagtgtttgggtgcgatttgtggagttggtttcgtcaaagccttccaaagcgcttactacgtacgttacggtggaggagcaaactctctcgccgatggatacagcacggggacaggactcgctgcagagattattggaacattcgtccttgtgtacactgttttctccgctacagatcctaaaagaaacgcaagagactcccacgttccggtgttggcaccacttccgattgggtttgcggtgttcatggtacacttggccactattccaatcaccggaaccggtattaacccggccaggagtttcggagctgcggttatcttcaacgagtccaagccgtggaatgaccattggatattctgggtgggaccattcatcggagctgccatagctgcattttatcaccaattcgttctaagggcctctggttccaaatccctcggatccttcagaagtgcagccaacgtttgagtttagccacacaaaacaaaacaaaaagtggttactgttatgtatacattgggcacgtgattttaaaatgtgtcctcttatgtcttttcttttcatctgcttctatttgtgtgtattccaattattgaagttttagtgttttgcgtgttttcatcatggatatgtcagtgagtttgtttattgagaaaaaaccgaccacattgtttcgc

SEQ ID NO: 15265 - DNA, 1132 bp, Gossypium hirsutum
tagacttaaacgaacattttcacagcttaaaacacaatatgactaaggatattgagaccacggcggagcaaggcggcggagcggagttctcagcgaaggactaccaggacccaccaccggcaccgttgattgacttggaagaactcaccaaatggtcgctttatagggcggcgatcgctgagttcattgccacccttcttttcttgtatgtcacggtgttgactgtgatcgggtataaagtccaaaccgacccggtaaagaatactgttgacccggattgtggtggtgttggtatacttggtattgcttgggcttttggtggcatgatctttatccttgtttactgcactgctggtatctctggaggacacatcaacccggcggtgacgtttggactgttcgtggggcggaaggtgtcactgatccgagccctgttgtacatggtggctcagtgcttgggtgcaatctgtgggtgtgggttggtgaaggctttccaaaagacttactacaatagctatggaggtggtgccaacgagctccaagatgggttcaacaagggcaccggcttgggtgctgagatcattggcaccttcgttcttgtctacactgtcttctcagccactgatcccaagaggagtgcaagggattcccatgttcctgtgttggcaccacttcccattggatttgccgtgttcatggttcaccttgccactatccctatcactggcactggcatcaatccagcaaggagctttggagctgctgtgatttacaaccaagaaaaagcttgggatgatcaatggatattctgggttggacccttcattggtgctttcgttgcagccttttaccaccaatacatcctaagagcagcagccattaaagcccttggatctttcaggagcaatgcttaaaaacatttcaccttcattacaataagaaaacaatgatgtaataacaaatgaggaatgagagcaagtttatgtcttgtgggaggggttcccttttgcagtttattttctataccattgagaaggggggccattgaaatgtaaataataaaagaaaaaaaaattatggataagggtgtcttttcaatccctgtttgtttttaatttttgttgctttttaa

SEQ ID NO: 15266 - DNA, 1179 bp, Gossypium raimondii
tcacccctcttcacccatagcttaaacgaacattttcacagcttaaaacacaatatgactaaagatattgagaccacggcggagcaaggcggcggagcggagttctcagcgaaggactaccaggacccaccaccggcaccgttgattgacttggaagaactcaccaaatggtcgctttatagggcggcgatcgctgagttcattgccacccttcttttcttgtatgtcacggtgttgactgtgatcgggtataaagtccaaaccgacccggtaaagaatactattgacccggattgtggtggtgttggtatacttggtattgcttgggcttttggtggcatgatctttatccttgtttactgcactgctggtatctctggaggacacatcaacccggcggtgacgtttggactgttcgtggggcggaaggtgtcactgatccgagccctgttgtacatggtggctcagtgcttgggtgcaatctgtgggtgtgggttggtgaaggctttccaaaagacttactacaatagctatggaggtggtgccaacgagctccaagatgggttcaacaagggcaccggcttgggtgctgagatcattggcaccttcgttcttgtctacactgtcttctcagccactgatcccaagaggagtgcaagggattcccatgttcctgtgttggcaccacttcccattggatttgccgtgttcatggttcaccttgccactatccctatcactggcactggcatcaacccagcaaggagctttggagctgctgtgatttacaaccaagaaaaagcttgggatgatcaatggatattctgggttggacccttcattggtgctttcgttgcagccttttaccaccaatacatcctaagagcagcagccattaaagcccttggatctttcaggagcaatgcttaaaaacatttcacctttattacaataagaaaacaatgatgtaataacaaatgaggaatgagtgcaagtttatgtcttgtgggaggggttcccttttgcagtttattttctataccattgacaaggggggccattgaaatgtaaataataaaagaaaacaaaattatggataagggtgtcttttcaatccctgtttgtttttaatttttgttgctttttaattaagttgtattgtcatcttttatcatctcc

SEQ ID NO: 15267 - DNA, 1382 bp, Quercus alba
atggggtcctctattcctctcccattatatataacccctacactctctcacattttcacacccaaacaccaaacaccaaacaataaactctctctctcaccaaagcttcatcctttgcttttttctattaaccatgactaaggatgttgcagagcatggctcatttccagccaaagactaccacgacccacctccagcaccgttgttcgatcctgtggagctaaccaaatggtccttttacagggctttgatagctgagtttgtagctactttgctctttctatatgtcacggttctgaccgtgattggctacaagagccagattgaccctgccttgaaaggtgatgcctgtggtggtgttggttatcttgggattgcttgggcctttggtggcatgattttcgttcttgtttactgcactgctgggatttcagggggtcacattaacccagcagtgaccttcgggctcttcttggctcgtaaggtgtcgctgattcgggccgtgttgtacatggtggctcagtgcttgggagccatatgtggtgttgcgctcgtcaaggcctttcagagtgcctattatgtaaagtatggtggtggcgccaactctctctcagatgggtacagcactggcgttggattgggcgccgagatcgtagggacctttgtgcttgtgtacaccgtcttctctgccactgatcccaagaggaaagctagagattcacacgttcctgttttggcaccactccccattggatttgcggtgttcattgttcacttggccacgatcccagtcactggcactggcatcaaccccgctaggagtcttggtgcagctgttatctacaacaatgacacggcctggaaagaccattggctcttttgggttgggccattcattggtgcagctttagcagctttctaccaccaattcatcttgagagctggtgctgcgaaagctcttgggtcattcaggagcaactcctcccatgtttgattaacaaagagggttaattatttgattccttcttcgtggttctactgagaaatgacattggaagaaggatttgatgtgtttagaaaagaatagtagggttgtgcttatgcttgtgtatgaatgtttctttggctctcttgatttccttaagagggttaaggagcataaaagtgtaggttaaagtctctttgagaaaaggggccgattttttatccctcttgttcttctagaatttacttatatgttgtccttttcaacttatgtctttggcacattgtactcgtttatgcttttaagtgaagtttgagctatgtggatgttggtcagtgttcactttctattgtctgaaagactgaaattgctcaatactcaatagtagtgcctagtg

SEQ ID NO: 15268 - DNA, 1283 bp, Quercus alba
atgggacccaaacaccaaacaccaaaaccataaactctctctctcaccaaagcttcatcctttgctttttctattaaccatgactaaggatgttgcagagcatggctcatttccagccaaagactaccacgacccacctccagcaccgttgttcgatcctgtggagctaaccaaatggtccttttacagggctttgatagctgagtttgtagctactttgctctttctatatgtcacggttctgaccgtgattggctacaagagccagattgaccctgccttgaaaggtgatgcctgtggtggtgttggtattcttgggattgcttgggcctttggtggcatgattttcgttcttgtttactgcactgctgggatttcagggggtcacattaacccagcagtgaccttcgggctcttcttggctcgtaaggtgtcgctgattcgggccgtgttgtacatggtggctcagtgctcgggagccatatgtggtgttgcgctcgtcaaggcctttcagagtgcctattatgtaaagtatggtggtggcgccaactctctctcagatgggtacagcactggcgttggattgggcgccgagatcgtagggacctttgtgcttgtgtacaccgtcttctctgccactgatcccaagaggaaagctagagattcacacgttcctgttttggcaccactccccattggatttgcggtgttcattgttcacttggccacgatcccagtcactggcactggcatcaaccccgctaggagtcttggtgcagctgttatctacaacaatgacacggcctggaaagaccattggctcttttgggttgggccattcattggtgcagctttagcagctttctaccaccaattcatcttgagagctggtgctgcgaaagctcttgggtcattcaggagcaactcctcccatgtttgattaacaaagagggttaattatttgattccttcttcgtggttctactgagaaatgacattggaagaaggatttgatgtgtttagaaaagaatagtagggttgtgcttatgcttgtgtatgaatgtttctttggctctcttgatttccttaagagggttaaggagcataaaagtgtaggttaaagtctctttgagaaaaggggccgatttttttatcctcttgttcttctagaatttacttatatgttgtcctttctaacttatgtctttggtcacattgtactcgtttattgcttttaagttgaagtttgagctatgtggatgttggtcagtgttcactttact

SEQ ID NO: 15269 - DNA, 1587 bp, Quercus alba
atgggggacataccatatagtaagtgctatgcacaagactttgccagaaaatgcaagacagaggcagagaaaagtttctcttaagaaacgaggaaaatggttaagtttaagtgggaggtagcgtagtaaagtcaagtggggtctgtgaaagcgaaagaaaccaaagcatttagtagcatatttcagtacccaaattgctgtaattaaatcctaatcctttctgtttaaactttaaaccaaaactccttgtcctttcaatgctctcctgtattcctctcccattatatataacccctacactctctcacatttcctacacccaaacaccaaacaccaaaaccataaactctctctctcaccaaagcttcatcctttgcttttttctattaaccatgacaaaggatgttgcagagcatggctcatttccagccaaagactaccacgacccacctccagcaccgttgttcgatcctgtggagctaaccaagtggtccttttacagggctttgatagctgagtttgtagctactttgctctttctatatgtcacggttctgaccgtgattggctacaagagccagattgaccctgccttgaaaggtgatgcctgtggtggtgttggttatcttgggattgcttgggcctttggtggcatgattttcgttcttgtttactgcactgctgggatttcagggggtcacattaacccagcagtgaccttcgggctcttcttggctcgtaaggtgtcgctgattcgggccgtgttgtacatggtggctcagtgcttgggagccatatgtggtgttgcgctcgtcaaggcctttcagagtgcctattatgtaaagtatggtggtggcgccaactctctctcagatgggtacagcactggcgttggattgggcgccgagatcgtagggacctttgtgcttgtgtacaccgtcttctctgccactgatcccaagaggaaagctagagattcacacgttcctgttttggcaccactccccattggatttgcggtgttcattgttcacttggccacgatcccagtcactggcactggcatcaaccccgctaggagtcttggtgcagctgttatctacaacaatgacacggcctggaaagaccattggctcttttgggttgggccattcattggtgcagctttagcagctttctaccaccaattcatcttgagagctggtgctgcgaaagctcttgggtcattcaggagcaactcctcccatgtttgattaacaaagagggttaattatttgattccttcttcgtggttctactgagaaatgacattggaagaaggatttgatgtgtttagaaaagaattgtagggttgtgcttatgcttgtgtatgaatgtttctttggctctcttgatttccttaagagggttaaggagcataaaagtgtaggttaaagtctctttgagaaaaggggccgattttttttatccctcttgttcttctagaatttacttatatgttgtccttttcaacttatgtctttggcacattgtactcgtttatgcttttaagtgaagtttgagctatgtggatgttggtcagtgttc

SEQ ID NO: 15270 - DNA, 1201 bp, Avena sativa
aggctcacctcattctccttgcaaggctggtctggtcaatcccagtctcttcgcagctgcgagcaagctaaagatggcgaagggcgaggtggtggagagcggcggcgacttcgcggccaaggactacacggaccctcccccggctccgctcatcgacgcggccgagctcgcgtcgtggtctctgtaccgcgccgtcatcgccgagttcatcgccacgctgctcttcctttacatcacggtggccaccgtcatcgggtacaagcaccaggcagacgcaacagtcaacggcaccgacgcggcgtgcggcggggtgggaatcctcggcatcgcgtgggccttcggcggcatgatcttcgtgctggtctactgcaccgccggcatctccggtggccacatcaacccggccgtgacgttcggcctcttcctggcccgcaaggtgtccctggtgcgcgcgctgctctacatgatcgcgcagtgcctcggcgccatgtgcggtgtcggcctcgtcaaggcgttccagagcgcctacttccacaggtacggaggcggcgccaactcgctcgccaccggctactctaagggcaccggcctcgccgccgagatcatcggcacgttcgtgcttgtgtacaccgtcttctccgccaccgaccccaagcgcagcgcccgtgactcccacgtccccgtgctggctcctctcccaatcggcttcgccgtgttcatggtccacttggccaccatccccatcaccggcaccggtattaacccggccaggagcttgggagctgcggtcatctacaacaatgacaaggcctgggacgatcagtggatgttctgggtcggcccgatggtgggcgcggccatcgcggcgttctaccaccagtacatcctcagggccggtgccatcaaggccctcggctccttcaggagcaacgcctaagctatccatgtaagtgatatgcaagatgagtgccgaagcaatggcacttgagggaaggccgcggaaggaaaataaggggcgattttatctttcaagagtttgccgctgcaatggtcgtgtcgtatcttgtcttgtttcggcagctgcatgcgttcgtgtgtgttggcttcttcctccatgtaattcatcgatcatccgtccagtgtgttgtagtaattatgtccatgggatcgatccccttatctttattaattttagcatgta

SEQ ID NO: 15271 - DNA, 1291 bp, Avena sativa
acaggctcaccttattctccttgcaagtctggtctggtcagtctcttggcagctgcgagcaaagctaaagagatggcaaaggacgaggtggtggagagcggcggcgacttcgcggccaaggactacacggaccctcccccggctccgctcatcgacgcggccgagctcgcgtcgtggtctctgtaccgcgccgtcatcgccgagttcatcgccacgctgctcttcctctacatcacggtggccaccgtgatcgggtacaagcaccagacagacgccacagtcaacggaaccgacgcggcatgcggcggggtgggaatcctaggcatcgcgtgggccttcggcggcatgatcttcgtgctggtctactgcaccgccggcatctccggtggccacatcaacccggccgtgacgttcggcctcttccttgcccgcaaggtgtccctggtgcgcgcgctgctctacatgatcgcgcagtgcctcggcgccatgtgcggtgtcggcctcgtcaatgcgttccagagcgcctacttccacaggtacggaggcggcgccaactcgctcgccgccggctactccaagggcaccggcctcgccgccgagatcatcggcacgttcgtgcttgtgtacaccgtcttctccgccaccgaccccaagcgcagcgcccgtgactcgcacgtcccggtgctggctccactcccaatcggcttcgccgtgttcatggtccacttggccaccatccccatcaccggcaccggtattaacccggccaggagcttgggagctgcggtcatctacaacaatgacaaggcctgggacgatcagtggatgttctgggtcggcccgatggtgggcgcggccatcgcggcgttctaccaccagtacatcctcagggccggtgccatcaaggccctcggctccttcaggagcaacgcctaagctatccatgtaagtgatatgcaagatgagtgccgaagcaatggcacttgagggaaggccgcggaaggaaaataaggggcgattttatctttcaagagtttgccgctgcaatggtcgtgtcgtatcttgtcttgtttcggcagctgcatgcgttcgtgtgtgttggcttcttcctccatgtaattcatcgatcacccgtccagtgtgttgcagtaattatgtccatgggatcgatcatccgtccaggagtattaattttagcatgtagtattcacgttcctattttatttagccatggtatatagtatgatctttgccttctttatagtagtatcttggtgctgcatgccgctac

SEQ ID NO: 15272 - DNA, 1132 bp, Eutrema halophilum
aaagaaagctcatttggtggaaagcaaagagattgaagaaaagtaactatggcaaaggacgtggaagccgttcccggagaaggatttcagacaagagactatcaagatccgccgccggcgccgctgtttgacccggaggagctaacaaagtggtctttttacagagcagtcatcgccgagttcgtagccactcttctcttcttatacatcaccgttttgacagtcatcggttacaagattcagtccgatactactgccggcggcgtcgattgcggcggcgttggaatcctcggtatcgcttgggcctttggtggcatgatcttcatcctcgtctactgcaccgccggtatctctggtggtcacataaacccagcagtgacatttgggctactcttggcccgtaaagtgtcgttagtgagagccatattgtacatggtggctcagtgtttgggtgcaatttgtggagttgggttcgtcaaagccttccaaagctcgtactacatccgttacggtggtggagccaactctctagccgaaggctacagcacaggcactggcctcgctgcagagatcatcggtactttcgttctcgtctacaccgtcttctctgccaccgacccaaaacgtagcgccagagattcccatgttccggtgttggcgccacttccgatcggatttgcggtgttcatggtacatttagctaccattccgatcaccggaaccggaattaacccggcaaggagtttcggagcagccgttatcttcaacgagagcaagccatgggatgaccactggatattttgggtgggaccattcattggagctgcgattgctgcaatctatcaccaattcgttctaagggcttcaggttccaagtctctcggatcattcagaagtgccgccaacgtctaaaaacactcttatccaccaccaaattaaagcagatcctgaaataaaataaaaggataactgcaaaatagtttgttatcttctatatgtatgtacaaatccacatcagtcacttgcactactcttttcttttcttaatgcttttttacttgctctttgttgtgaattttcttcccgcgtaattgtgtttatttcgccaatgccaagtttatcgagtgattgg

SEQ ID NO: 15273 - DNA, 1191 bp, Eutrema halophilum
aagagctcactctatataaagaatcctttattcttcttcttacaaccacaacaaccagcaccaaaagcaatttccaagaaattccagaaacatccatttcataaatggctaaagacgtggaaggagcagagggatttccggcgagggactacgaagatccaccgcctactccgttcttcgacgcggaggagctgaccaagtggtctttatacagagccgtcatcgccgagttcgtagccactctcctcttcttgtacgtcaccgttttgactgtcatcggctacaagattcagtccgacacaaccgccggcggagtcgactgcggcggcgtcggaatcctcggcatcgcctgggctttcggtggcatgatcttcatccttgtctactgcaccgccggtatctcaggtggtcacataaaccctgcggtgacgttcggcttattcttggcacggaaggtatcgctgattagggcggttctttacatggtggctcagtgtttgggtgcgatttgtggagttgggtttgtgaaggcctttcaaagctcttactacgttcgttacggtggaggagccaactctctcgccgagggatacagcacagggactggactcgccgcagagatcatcggcacattcgttctcgtctacactgtcttctccgccactgatccaaaacgcaacgctcgagactcccacgttcccgtgttggcgccacttccgattgggtttgcggtgtttatggttcacttggccactattccgatcaccggaaccggaattaacccggctaggagtttcggagctgccgttatctataacgagtccaagccatgggatgaccactggatattctgggtgggaccattcatcggagctgccattgctgcattttatcatcagttcgttctaagggcctcaggttccaagtccctcggatccttcagaagtgcggccaacgtttgaatttagcctcacacacacaaaaactgtggctgctattatgtagaaattgggcacgtgattatataaacatgccctgtttccccttgtgtctttcgtttttttcctctgcttatatttgtgtgaattccaattattggggagttttagtgttttacgctttcatcttggcaatgtcactgagtttgggtattgagaaaaaaatcgaccactttgcttcgcttattgatct

SEQ ID NO: 15274 - DNA, 1468 bp, Trigonella foenum-graecum
ctttaaacagttttaattccctgtttcatacgcaacgcaacagatcacagatcacatgtactgttgtataaaaaacactaacttcattccctcaacgttatcttgaacagaacaacactcacaaacaccactctctctaacttcaatggcaaaagacattgaaaccgaacctcaaggtggtgtaccacacaaggactaccaagatccaccaccagctccactctttgacaccgctgaacttcgcctgtggtccttctacagagccctcatcgccgagttcgtcgccactctcctcttcctctatgtcaccgttttaaccgtcattggctacaactcccaaaccgatccagctcataatggcaccaactgtgacggtgtcggtatcctcggcatcgcttgggccttcggtggcatgatttttgtcctcgtctactgcactgccggcatatctgggggacacataaatccggcggtgacatttgggctatttctagctagaaaggtatcattgattagagctgtattatacatggtggctcaatgtttaggagcaatatgtggtgttgggttagtaaaagcttttcagaaaggttactacaataggtacaaaggtggtgctaatatgttaaatgatggttatagtaaaggaactggtttaggtgctgagataattggaacctttgttcttgtttacaccgttttctctgccacagatccaaaaagaagtgctagagactctcatgttccagttttggcaccacttccaattggatttgcagtgtttatggttcaccttgctactattcctatcactggaactggtatcaaccctgctagaagctttggagctgctgtcatttacaacaatcagaaagcatgggatgaccaatggatcttctgggttggaccctttattggtgctgccattgctgcaatctaccaccagtttgtgttgagagctcaagcagcaaaggctttaagttctttcaggagctcttcaaacctgtaatggaatttccttcaagttagccaagttaaattggcttgaattgtattatggtagattggaatttgcgtatccttatcactatgtatcgacattgcttaattatggtttaattaattgatttatgtactttaatttttgttgttaaatttgatttcatttgttggtgaatttgaataaggatgttgttgagaattgagatgacgtgtagtagtctatagtaataagaccgttgtgttgtgtctggttttagttgtgttgcatttattggatttatctaatggttgtcactatacatctatgtggtccattcttgattaatttttctgttggaattgaaggtggtcccatggtgatagttatggggttgaagatatcttcttgaggatgatgtctatctttgttaatatgcatttattatgaatgagtatgagtaggggaccgaagtccatatataaggac

SEQ ID NO: 15275 - DNA, 1347 bp, Zea mays
agcaaagcgaagcgcgcgcacagagatctagctgagctactagctatagcagcagctgctgcaggtctcctgacatggcgaagcaggacatcgaagcatcggggcccgaggccggcgagttctcggccaaggactacacggaccctccgccggcgccgctcatcgacgcggatgagctcaccaagtggtccctctaccgcgcggtcatcgccgagttcatcgccacgctgctcttcctctacatcaccgtggccaccgtcatcgggtacaagcaccagacggacgcggcggcgtcgggccccgacgcggcgtgcggcggcgtgggcatcctcggcatcgcgtgggccttcggcggcatgatcttcatcctcgtctactgcaccgccggcatctcaggtgggcacatcaacccggccgtgaccttcggcctgttcctggcgaggaaggtgtccctcgtccgcgccctgctctacatcatcgcgcagtgcctgggcgccatctgcggcgtcggcctcgtcaagggcttccagagcgcctactacgtgcgctacggcggcggcgccaacgagctcagcgacggctactccaagggcaccggcctcgccgccgagatcatcggcaccttcgtgctcgtctacaccgtcttctccgccaccgaccccaagcgcagtgcccgtgactcccacgtcccggtgttggcccctcttccgattgggttcgccgtgttcatggtgcacctggccaccatccccatcaccggcaccggcatcaacccggcgaggagcttgggagccgcggtcatctacaacaaggacaaggcctgggacgaccaatggatcttctgggtgggcccactgatcggcgccgccatcgccgccgcctaccaccagtacgtgctgagagccagcgccaccaagctcgggtcctaccggagcaacgcctaataagtccggcggcgggagctgtgggcgccaccgatcgatccaagtgtagatacgtacgctcccccgactccgtccagtatatgacgccctgtggtcgtccacatctgccaccacagtcccgtccgcttggtgctgttttctttctttccttgacggggaaaaaaagtgtgatatatctttgctttctgtatatgtgacaaaatgcattctgtaagccagtcatgtgagtttttatttaaccacagtctacttttagaacgatttaaacggccctgaatcttacttgcaactttagaggaaagtacgggaaaagaacctcacaagtcaccaagggacttgacagttggttggtatgtgttaggcctgcggcccaaataagcaagcccatcggcgggctccgttt

SEQ ID NO: 15276 - DNA, 1220 bp, Brassica rapa
tacttataccaaacctttgcatagcatctgtgtatatatatacacacaactaaactagagagttacaacaaacatcaaaatacatccatcttttctctctctcatcatcatctttagccatggcaaaggacttggaggtgcaagagggcggagcaatggcggcgagagattaccaggatccgcctccggccccattgtttgacatggaggagcttgggaagtggtcgctctatagagcggtcatagctgagttcgtggcaacacttctcttcctttacgtctcaatcctcaccgtaattggctacaaagctcagaccgacgcaaatgccggaggagttgattgcggcggcgttgggatattgggtattgcgtgggctttcggtggaatgatttttgttctcgtttactgcaccgccggtatctctggtggtcatataaatccggctgtgacggtgggactgttcttagctcgaaaagtgtcattagtgcggacagtgttatacattgtggctcagtgccttggtgccatatgtggttgcggcctggtcaaagcattccaaagttcttactacaacagatatggaggtggagccaaccagcttgccgacggctacaacaaaggtaccggactaggtgccgagatcatcggaacatttgtccttgtctacaccgttttctcggccaccgatcccaagcgaagtgcacgtgactctcacattccagttttggcgccacttcccattggttttgccgtcttcatggttcacttggccaccattcccatcactggaaccggaatcaaccccgcccgtagcttcggagccgcagttatctacaaccaagaaaaggcctgggacgaccaatggatattttgggtgggaccaatgatcggagcagcagcagctgcgttataccatcagtttgttctaagagcggctggaattaaatctcttggctcctttaggagctctgcttaattttaattgtttgaattgagccacaagttgatcttaaaccaaaatgatgattaccactatatattaagcggaagctacgtgtatcttttatttaattttatgttctgtttttaaatttcaaggaatttcccattggttgtaaatgtggttttaattaatgttgctttaagataaatctcttctttgcttttattttattttctttatattgctgttccttcaagcttacaacctcttcatgca

SEQ ID NO: 15277 - DNA, 1301 bp, Vigna unguiculata
ggagacctaagtatagtagtgattgagggttgagaaataatggcgaaagatgttgaggttcaagagcaaggagaatactctgcaaaagactatcatgaccctcctccggcacccttgttcgaccccgaagagctcacacagtggtccttctacagagcccttatcgctgagttcatagcaacccttctcttcctctatgtcactgtgctaaccataattggctacaaaagacagaccgacgccaacgttggtggcaccgaatgtgatggggttggcattctcggcatcgcttgggcctttggtggcatgattttcatcctcgtttactgcaccgccggtatttcaggaggacacataaacccagctgtgacattcgggttgttcctaggacgcaaggtgtccttgataagggcgttgttgtacatggtagcacagtgtgctggtgctatctgtggcactggactggcgaaggggttccagaaagcgtactacaacaggtatggaggcggtgctaactctgttgctgatggctacaacaagggcactgctttgggtgctgagattatcggtaccttcgttcttgtctacactgtcttctctgccaccgaccctaagaggaacgctagagactcccatgttcctgttctagcaccactccccattgggtttgccgtgttcatggttcacttggctacaatcccagttactggcactggcattaacccagcaaggagttttggagcagctgtaatctacaatgacgaaaaaatctgggatgatcagtggatattctgggttggaccaattgttggagcagcagtggctgcattttaccaccaatacatcctcagagcagcagctatcaaggctcttggatcgttcaggagcaatgcttaattaattaattaattaagctaggttcttaatttccaacaaggctatggtgtttgaggaagaataataatttccatgttaaagagtgctggtcttgtcttgcagctccctaatttaggttttctggtcttttcctttgatcagctacagtggttgctgttgtggggtttggaggataaggcctgaaccatatggggagcatcaaaattgtagataagcatgcttgtgtctaagggtgtattttgtatcccttttctgtctttttctttttcttttcttcttttttttaacttccttgtaagtgtttccttttcatttctcatgttacttaaatattcatcttttcttaatcatgatttatgtaatgtaccatgactccagtaatattatcatgattaagcttttca

SEQ ID NO: 15278 - DNA, 1202 bp, Liriodendron tulipifera
acaggcactctctctcccccaaaagctctagcatttttcgcagctccttttttcggggattttcttgggaatcgtgccaaatgggaaaggacgttgagggagcggagcacggagagttcacgaccaaggactacacggaccctcctccggcgccgttgatcgacgtcgatgaactgacccagtggtccttctacagggccctgatcgccgagttcatcgcgacgcttctcttcctgtacatcaccgtggcgacggtgatcggttacaagagcgaggtggaccccaccaagaaccccgcccctgatgcgtgcagtggagtcggcatcctcggcatcgcgtgggcctttggtggaatgatcttcatcctcgtctattgcacggctgggatctcaggtgggcacataaacccggcagtgacgttcggcctgttcctagcgaggaaggtctccttgatccgggccgtgctgtatatggtggcccagtgcctgggtgccatctgcggcgtcggtttggtgaagggcttccagaagtcttactaccagaagtacggtggtggggccaacgagctagcccccggctacaacaaaggcacgggcttgggcgcggagatcatcgggacctttgtgctcgtctacaccgtcttctccgccaccgatcccaagaggaacgccagggattcacacgtcccggtcttggcgccgcttcccatcggatttgccgttttcatggtccacctagcgacgatccctatcacaggcaccggcatcaacccagctagaagttttggggccgctgtcatctacaacaaagataaggcttgggatgatcagtggatcttctgggtgggcccattcatcggcgccgccattgctgctgcatatcaccagtacatcctcagggcggcggccatcaaagcccttggctccttcagaagcaatccccatgtttgattctcccctcagaagaaataatcgtgtgaatgtctatggaaggtctgtcagtcggtctgtcagggcagctggtctgttgaagtgtctgggtctttacaagagagaactgagggaccatgaattgtagataaatccgtttggatgggttttgtattaccgtttgactagtcactttgtgttcagcattttcctttgaatgtaccaagtgttgttgacttttctcatcactacataaactagtcttttgcgttt

SEQ ID NO: 15279 - DNA, 952 bp, Brassica oleracea
taaaactcatctatctctttctcttcctctctctcatcatcatcatctttggccatggcaaaggacttggaggtgcaagaggggggaccaacggcggcgagagattacgttgatccacctccggcgccattgttggacatggaggagcttgggaagtggtcgctctacagagcggtcatagctgagtttgtggcgacacttctcttcctttacgtctctgtcctcacagtaatcggttacaaagctcagaccgacgcaaacgctggaggagttgattgcggcggcgttggaatattggggattgcgtgggctttcggtggaatgatttttgttctcgtttactgtaccgccggtgtctccggtggtcatataaatccggctgtgacgttcggattgttcttagctagaaaagtgtcattggtgcggacattgttatacattgtggctcagtgccttggtgctatctgcggttgcggtctggtcaaagcattccaaagttcttactacaccagatatggaggtggagccaacgagctagctgacggctacaacaaaggaaccggactaggtgcggagatcatcggcacatttgtcctagtctacaccgttttctcggccacagatcctaagcgaagtgcacgtgactctcacattccagttttggcgccacttcccattggctttgctgtcttcatggttcacctagccaccattcccatcaccggtaccggaatcaacccggcccgaagcttcggtgccgcagttatctacaaccaagaaaaggcctgggacgaccaatggattttttgggtgggaccaatgatcggagcagcagctgctgcattataccatcagtttgttctaagagcggctggaattaaaagtcttggctcctttaggagctctgcttaattttaattgtctgaattaagaatcttcaataaaaaatgat

SEQ ID NO: 15280 - DNA, 896 bp, Gossypium hirsutum
ggaagagactaccatgacccaccaccggcgccattgatagattctgaagagctcacccaatggtcattttatagggctttgattgctgagttcattgctacccttctcttcttgtatgtcacagtattgactgtgattggctacagggtccaaaccgaccctttaaagaacaccgtcgatcctgattgtggtggtgttggtatccttggtattgcttgggcttttggtggcatgatctttattcttgtttactgcaccgccggtatctccggaggacatatcaacccggcagtgacctttgggttgttcttaggacgaaaggtgtcactggttcgagccgtgatgtacatggtggctcagtgcttgggtgctatttgtggttgtgggttagtcaaggggttccaaaagagttactacaatacctatggtggtggagccaatgagctacaagatggtttcaataagggaactggtttgggtgctgagatcattgggacttttgttcttgtttacactgtcttctctgcaactgatcccaagaggaatgcaagggattctcacgttcctgtactggcaccacttcccattgggtttgctgtgttcatggttcacctagccacaattccaatcactggcactggtatcaaccctgctaggagctttggtgctgctgttatttacaacaaagacaaggcctgggatgaccaatggatgttctgggttggacctttcattggagctgccattgctgcaatctaccaccaatacatcctaagagcaggagcaatgaaggcacttgggtctttcaggagcaatgcttaattaaaatcgatgggcttttattttcacataaaattcaaggagtcatcatgaattagagatgaagaaaaagatga

SEQ ID NO: 15281 - DNA, 1450 bp, Gossypium raimondii
aaaaaaagcagactctgtatcttctcttcctctctaccatttccttctttaagctaatttattagtttcttgctagctaagcatggcaaaagaaggagagaacagcacttcccatgccggggattatgttgtccctccaccagtaccatatgttgaccctccaccagtaccattgattgatgcttcagagcttaagaaatggtcattttacagagcaatgatagctgagttcactgcaactatgctcttcctttacatcacagtcttgactgtgattggtcacaagagccaagttgctacctcccctgacgcatgttctggtgttggccttcttggtattgcttgggcctttggtggcatgatcttcatccttgtttactgcactgctggtatttctgggggtcatattaacccagcagtgacattcgggctgtttttggctcgtaaggtctcattgatccgagccattgcatacatggtggctcagtcattgggagccatatgtggggttgggctggttaaggcattccaatcggcatactacaacaggtatggaggtggagccaacactctagcagatggttacagcacaggcactggtttgggtgcagaaattattggaacctttgtgttggtttacactgttttctctgctactgatcctaagaggaaggctagagactcccatgtccctgtattggctcccctccccattggatttgctgtattcatggttcacttggctaccatcccaatcaccggcactggcatcaaccctgctagaagtattggagctgctgttgtcttcaacaacaagaaagcttgggatgatcattggattttctgggttggtcccatgattggagcagccatagcagcattctaccaccaattcatcttgagggcaggagctgctaaggctcttggttcattcagaagccaaacccatgtttgattcatttgcctttccttgacacttttctagaagaaccctccaaaaaaacacatatatataaattgtgaaaataatgtgggaatttgcttgttatgatttgtgtaaaaaacacatatatatatatataaattgtgaaaatattgtggggatttgcttgttatgatttgtgtaaaaaacacatatatataaattgtgaaaataatgtgggaatttgcttgttatgatttgtgtatgtttaactgtcccttcagagccctcccttttttcttcaaaatttcccttcgaggaagttggaaaattttatagaaattgaagggtttcatgaaaatgtagataaactactctttgagaagtggtgggggtagaaggggcttttcaagcactttaatttagcttcttattttgtactagtttcaaatcatcgcccatttgttttactttattatgtcacaattggcacttattattcaagcacttctatttagctcttatttc

SEQ ID NO: 15282 - DNA, 1190 bp, Ananas comosus
ctccctccgcgattcgtactcgtctccaccgaaaccctaaccctaaccctgaccctaaccgaggcgatcggccatggcgaaggacgctggggaggggggcgagttcgcggcgaaggactacgcggacccgcccccggcggcgctggtggacgcggcggagctggggcggtggtcgctgtaccgcgcggcgatcgccgagttcgtcgccacgctcctcttcctctacgtcaccgtcgccaccgtcatcggctacaagcaccagtccgatcccaacctgagccccgacgccgcgtgcgccggggtcgggatcctcgggatcgcctgggccttcggggggatgatcttcatcctcgtctactgcacggccgggatctcgggtggtcacattaacccggcggtgacgttcgggctgttgctggcacggaaggtgtcgctggtgcgggcgctgctgtacatggtcgcgcagtgcctgggtgctgtctgcggcgtggggctggtcaagggcttccagaaggccttcttcgtccggtacggcggcggcgccaacgagctcgccgccggctactccaagggcacggggctcgccgctgagatcatcggaacgttcgttctcgtctataccgttttctccgccaccgaccccaagcgcagcgctcgcgactcccacgtcccggttttggctccccttccgatcggcttcgccgtgttcatggtccacctggcgactattccgatcaccggaaccgggatcaacccggcgcggagcttcggcgccgccgtgatctacaaccaagacaaagcctgggatgatcagtggatcttctgggcggggccgttcatcggggcggcgatcgcggcggcgtatcaccagtacgtgctgagggccggggcagtgaaggccttgagctccttccggagcttcaatgcatgagtttttttttgttctctttcgacgagaggggggaaacgaaaagtagaatttagttttaatggagagttcgaattgtcgatctatacataaatctaaggccgcttaaaatcttattgcaatgttgttggtcttatttttgtgtttcttctactctcatttgtttctccaacttaagatgttaatgtttccatctggtgcatcgttaatgtatgtctctctgtttatctcccactttgctaatgcatcaattatctagact

SEQ ID NO: 15283 - DNA, 1013 bp, Utricularia gibba
gggagtgtcgaggtgggaactccctacgccgccagggactactcggatccgcccccggcgctgctcctcgatccggaggagctggggaagtggtcgttgtacagagcagctattgcggagttcgttgcgacgcttctcttcttgtacatcaccgtgttgactgtgattggatacaagagacagagctccggtgacgcctgcggcggcgttgggattctgggtattgcctgggccttcggtggcatgatcttcgttcttgtttactgcaccgccggaatttccggggggcacataaaccctgccgtgacatttgggcttttcctggcacgaaaggtgtctctggttcgggcggttctgtacatgattgctcagtgttcgggcgccatatgcggctgcggccttgtgaaagcgtttcagagaacctactacgacgattacgggggcggcgctaacggtctatcctcggcttacagcgccggcgccggcctcggggcggagataatcggaactttcgtgcttgtctacacagtattctccgccactgatcccaaaagaaacgctagagactcacatgttccagtattggctccacttcccatcggattcgctgttttcatggtgcacctggcgacaattccggtaaccggcacggggatcaacccggcaagaagcttaggagctgccgtcgtgtatggcagagcatggcatgatcattggattttctgggttgggccattcacaggagcaggcatcgctatgctgtttcaccagtgcatcttgagggcgggtgccgcgaatgctctggggtcccactcccaaaggagcgccgcctcctcctcctactgatggaaggaagcaacaaagcggaagagaaaccccccggtctccagatgtcgcctttatgtgctccatgtaccaaaaaggaaataaaaatgtgtcttatttggcgcctcatctctctcccaccctcgacatggaaatctattatgacataataaaaatacaaatttact

SEQ ID NO: 15284 - DNA, 1603 bp, Oryza sativa
atatacagtggctttgctgaagttcagttcagaccaatttgttttttcccggaacagtatatgtaagcacatcacttagaataatccctccgattgatcactagccaccagttaggttcatgagtgacataatgatgaggctaagtcggttgtggtcggcaaattctaacacaaaaaaccctaaccagaaaccattaatccccttatccttgactaatctggcactaatcaatccctaaaccagccatcattgagcatatgagctcgacctgtccgtggcacgagtcatcctctcgcccccccatatatacctctcctacctcttgacaccacactcaaccgcagcaagctgcacagagctagcgttagcttggttagttgttcttagcattctagctagctcaatggcgaaagacattgaggcgtcggcgccggagggcggcgagttctcggcgaaggactacaccgacccgccgccggcgccgctgatcgacgtggaggagctgaccaagtggtcgctgtaccgcgcggtgatcgcggagttcatcgcgacgctcctcttcctgtacatcacggtggccaccgtgatcgggtacaagcaccagtcggacgccaccgtcaacaccaccgacgccgcctgcagcggcgtcggcatcctcggcatcgcctgggccttcggcggcatgatcttcatcctcgtctactgcaccgccggcatctcaggtgggcacatcaacccggcggtgacgttcgggctgttcctggcgaggaaggtgtcgctgatcagggcggtgctgtacatcatcgcgcagtgcctgggcgccatctgcggcgtggggctcgtcaagggattccagagctcgtactacgcgcggtacggcggcggagccaacgagctcagcgacggctactccaagggcaccggcctcggcgcggagatcatcggcaccttcgtgctcgtctacaccgtcttctccgccaccgaccccaagcgcaacgcccgcgactcccacatcccggtgttggctcctctcccaattggattcgcggtgttcatggtccatctggccaccatccccatcaccggcaccggcattaacccggcgaggagcttgggagccgcggttatctacaacaaggacaaggcctgggatgaccaatggatcttctgggtgggccccctgatcggcgccgccatcgccgccgcctaccaccagtacgtgctgagggccagcgccgccaagctcgggtcctaccggagcaacgcctgagatcggcggcggcggcgcgcgcgaggtggcgctgaagtgtagatacgcgtacaagatggccgcctctgtccagcactagatcaacgaattcagccttcgcatcctgcatttcgcctcgtggatagattctactgcactattatgtactatgtatccatgcatatggtctccattcctttgaactatgtccgccatatgttgcttcccgctggtgcttccaagtttggttaattttccttcacattctgcatgtatgtaatattcatatggagaatttgtgaatttgaagatcatagttactattatgtgcgatttattaagtactttctgca

SEQ ID NO: 15285 - DNA, 1178 bp, Zea mays
ccggcctcacaccgcaaccgcaagcaagcgaagcgcagagcctgcctgaccagagctagctgagctacagccaacagcagctggtctgactgacatggcgaaggacatcgaggcatcggggcccgaggcgggcgagttctcggccaaggactacaccgaccctccgccggcgccgctggtcgacgcggaggagctcacccagtggtcactgtaccgcgcggtcatcgccgagttcatcgccacgctgctcttcctctacatcaccgtggccaccgtgatcgggtacaagcaccagacggacgcgtcggcgtcgggccccgacgcggcgtgcggcggcgtcggcatcctcggcatcgcttgggccttcggcggcatgatcttcatcctcgtctactgcaccgccggcatctcaggtgggcacatcaacccggccgtgaccttcggcctgttcctggccaggaaggtgtccctcgtccgcgcgctgctctacatcatcgcgcagtgcctgggcgccatctgcggcgtgggcctcgtcaagggcttccagagcgcctactacgtgcgctacggcggcggcgccaacgagctcagcgacggctactccaagggcaccggcctcgccgccgagatcatcggcacgttcgtgctcgtctacaccgtcttctccgccaccgaccccaagcgcagtgcccgtgactcccacgttccggtgctagctcctctcccaattgggttcgccgtgttcatggtgcacctggccaccatccccatcaccggcaccggcatcaacccggcgaggagcctgggagccgcggtcatctacaacaaggacaaggcctgggacgaccaatggatcttctgggtgggcccactgattggcgccgccatcgccgccgcctaccaccagtacgtgctgagggccagcgccaccaagctcgggtcctaccggagcaacgcctaagttccgcccggacgcgccaggagctgggcaccgttccgattctgttcctccacatgacgccctgttctgtttccgtgtggccaggactccgctcgctcgctgctgttttctacttcggaccaaagtgtgacatatctttgctttctgtatatgtatgtaggaatgcatcatgtaaggagaatttggaatacaattgcgtgagtttttatccgatcac

SEQ ID NO: 15286 - DNA, 929 bp, Brassica rapa
aacaaacactaaaactcatttatctttctctctccctctcatcatcatctttggccatggcgaaggacttggaggtgcaagagggaagagcagcgagggattaccaggatccacccccggccccattgtttgacatggaggagcttgggaagtggtcgctctatagagcggtcatagctgagtttgtggctacacttctcttcctttacgtctcaatcctcaccgtaatcgggtacaaagctcagaccgacgcaagcgccggaggagctgactgcggcggtgttgggatattggggattgcgtgggctttcggtggaatgatctttgttctcgtttactgtaccgccggtatctccggtggtcatataaatccggctgtgacgttcggactgttcttagctcgaaaagtgtcattggtgaggacagtgttatacattgtggctcagtgccttggtgccatctgcggttgcggtctggttaaagcgttccaaagttcttactacaacagatatggaggtggagccaaccagcttgcggaaggctacaacaaaggtaccggactaggtgccgagatcatcggaacatttgtccttgtctaccccgtcttcgcggccaccgacccgaagcgaagtgcacgtgactctcatattcctgttttggcgccacttcccattggttttgccgccttcatggttcatttagccaccatccccatcaccggaactggaatcaacccggcccgtagcttcggagccgcagttatctacaaccaagaaaaggcctgggacgaccaatggatattttgggtgggaccgatgatcggagcagcggcggctgcgttataccatcagtttgttctacgagcggctggaattaaatctcttggctcctttaggagctctgcttaacttgaattgtttgaattaagc

SEQ ID NO: 15287 - DNA, 1260 bp, Setaria italica
tagctgtgcacaaagcaagcgcgctcatagcctgagccctgagctgagcaagctaaggtactgatcggcatggcgaaagacatcgaggcgtcggggcccgaggccggcgagttctcggccaaggactactcggaccctccgccggcgccgctgatcgacgcggaggagctgaccaagtggtcgctgtaccgcgcggcgatcgccgagttcgtggcgacgctgctcttcctctacatcaccgtggccacggtcatcgggtacaagcaccagacggacgcggcggcgtcgggccccgacgcggcgtgcggcggcgtgggcatcctcggcatcgcctgggccttcggcggcatgatcttcatcctcgtctactgcaccgccggcatctcgggcgggcacatcaacccggccgtcacgttcggcctcttcctggcgaggaaggtgtccctcgtccgcgcggtcctctacatcatcgcgcagtgcctgggcgccatctgcggcgtggggctcgtcaagggcttccagagcgcctacttcgtgcgctacggcggcggcgccaacgagctcagcgccggctactccaagggcaccgggctcgccgccgagatcatcggcaccttcgtcctcgtctacaccgtcttctccgccaccgaccccaagcgcagcgcccgcgactcccacgtcccggtgttggctcctctcccaattgggttcgctgtgttcatggtgcacctggccaccatccccatcaccggcaccggcatcaacccggccaggagcctgggagccgcggtcatctacaacaacgacaaggcctgggatgaccaatggatcttctgggtgggcccgctgatcggcgccgccatcgccgccgcctaccaccagtacgtgctgagggccagcgccgccaagctcgggtccttccggagcaacgcctaagtccggccggccgcggcgaggaggggggcaccgaagtgtagatacgcgcgcacaaccgacgcccgcctccatccactccatgacgccctgttccgatcaggatctgctgccacaatctccgtcgctcgtagtaatcgtgtcatgcacgcgggctccgcgccgtgcttcgatgtgtcccggagtccgccgccacgtccgcttgccgctgtttttcttcgaaaagaagtgtgatatatctttgcttcctgtatgtatgtattccgtatggagaatttggaaacgagttatgtgaggttttatttagttataatcatcatatgaagc

SEQ ID NO: 15288 - DNA, 1085 bp, Tabernaemontana elegans
gttgttagctttgatggcgaaggacgttgaagcagtggttgcggcggagcagactgagttctctgcgaaggactaccatgatccgccaccagcaccatttctggacatggaagagctgaccaaatggtcattttacagagctctgattgcagagtttgttgccactcttctcttcctctacgtctgtgtcttgactgtcattggctacaagcaccagacagaccccaccgcaggtggcgacgactgtggcggcgtcggaatactcggcatcgcctgggcatttggtggcatgattttcattcttgtttactgcactgccggtatctctggaggacacattaacccggctgtgacctttgggctgttcttggcaagaaaggtgtcactgttgagagccttcttttacatggtagctcagtgccttggtgccatctgtggtgtggggttggtgaaggctttccagaaggctttctacaacaggtataatggtggggcaaacgtggtggctcccggatacacaatcggtgtcggattggctgctgagattatcggaacctttgtcttggtttacacagtcttctcagccactgatcctaagagaaatgccagagactcccatgttcctgtcttggctccactccccattggatttgctgtgttcatggttcaccttgctaccattccaatcactggcactggcatcaaccctgctaggagctttggagctgctgtcatctatggtgcagacaaggcctgggatgaccaatggattttctgggttgggccattcattggagctgccattgctgcattataccatcagtacattcttcgagcatccgcccttaaagctcttggatccttcaggagcaacgcctaaatcttgattagagcccatttctctttctcaagtttgaagaacccttttgcatgatcatagcgtgaaattggagagggccatgtaattgtaaataaatttgcagtttggaaaagggggtgtcatttgccgatccctgctgtcccctgtgttttctcttttcctattgctttccatgtatttaaaaggtgttgtcatcttgttttcc

SEQ ID NO: 15289 - DNA, 1166 bp, Brassica juncea
tggaagcagttgccggagaagggtttcagacaagagactatcaagatccgccgccggcgcctctgtttgatccggaggagctgacgaagtggtctttttaccgagcagtcattgccgagttcgtagctactctccttttcttatacatcaccgttttgacagtcatcggttataaagtacagacagataatactgccggcggcgttgactgtggtggagttggaatcctcggcatcgcttgggccttcggtggcatgatcttcattcttgtctactgcaccgccggtatctctggtggtcacataaacccggcagtgacatttgggctactcttggcccgaaaagtgtcattggttagagccattttgtacatggtggctcagtgtttgggtgcaatttgtggagttgggttcgtcaaagccttccaaagcgcttactacgtccgttacggcggtggagccaactctttagcagatggctacagcacaggtactggcctcgccgcagagatcatcggtactttcgttcttgtctacacggtcttttccgccaccgaccctaaacgcagtgccagagactcccacgttccagtgttggctccacttcctattggatttgcggtgttcatggtacacttggctaccattcccatcaccggaactggaatcaacccggcaaggagtttcggagcagccgtcatcttcaacgagagcaagccgtgggatgaccactggatcttttggctgggaccattcattggagctgcgattgctgcagtctaccaccaatttgttctgagggcttcaggttccaagtctctagggtctttcagaagtgctgcaaacgtctaataaacgcttttatccaccaaaatgcattatgaaataagaagatgataacttcaaatagttgttatgttttctgtgtgtacaaatgtatccaaatcaaatatctgttttcttatttatgtcttctacttgcgtttttgtgcaatctcattcggtgtaactgttttttcttacaccaaatgccaagtttatcgagtgactagaattaaaatcagtgaggttatattcttgcgtttgcgtttatgtttatgtttctgtttccaagcataaccagcatttttggtaatatattaaaatgaaaaaacagttacaccgaat

SEQ ID NO: 15290 - DNA, 1084 bp, Medicago truncatula
atccttgaacataacaacactcacaaactccactctctgtgtcacaatggcaaaagacattgaagccgaacctcaaggtggtgtaccacacaaggactaccatgacccaccaccagctccactctttgacaccgctgaacttggtcagtggtctttctacagagccctcatcgcagagttcgtcgccactctcctcttcctctatgtcaccgttttaaccgtcattggctacaacgctcaaactgatccagctcataatggcaccaactgtgacggtgtcggcatcctcggcatcgcttgggcctttggtggcatgatctttgttcttgtctactgcactgccggcatatctggaggacacataaatccggcggtgacatttgggctatttctggcgaggaaggtgtcattgattagagctgtattatacatggtagctcagtgtttaggagcaatatgtggtgttggactggttaaggcttttcagaaaggttactataataggtacaaaggtggtgctaacatgttaagtgctggttatagcaaaggaactgggttaggtgctgaaataattggaacctttgttcttgtttacaccgtgttctctgccacagatcccaaaagaaatgctagagactctcatgttccagttttggcaccacttccaattgggtttgcagtgtttatggttcaccttgctactattcctatcactggaactggtattaaccctgctagaagctttggagctgctgtgatttacaacaatgagaaagcatgggatgaccaatggatcttctgggttggaccctttattggtgctgccattgctgcaatctaccaccagtttgtgttgagagcacaagctgcaaaggctttgggttctttcaggagctcttcaaatctgtaatggaatttcctgcaagttgccaagtaacataggcttgaataattaattgtatggttagacatatcctcatcattatgtatcgacattgtttaattaattgatttatgtactttaatttttgtgttaaatttgatttcatttcttggtaaatttgaataaggatggatgttgttg

SEQ ID NO: 15291 - DNA, 1235 bp, Nicotiana benthamiana
actctaaaatcaatcattaaaagtcctctcttttctcccataaatacctatccatttttcactcacttctcatcatccatatcccctgtttaaaagcttctttccttttggttagccatgactaaagaagttgaggtcgcaacagagcaaccaacagagttttcagcaaaagactatactgaccctcctccagctcctttagtagactttgaggagctgacacaatggtcactttacagagctgttatagctgagttcattgccactttgcttttcctttatgttactgttttgactgtgattgggtacaaggtccagtcagatgtcaaagccgacggtgatatctgtggcggcgttggtattcttggtattgcttgggcttttggtggcatgattttcattcttgtttactgcaccgccggtatctccggaggacacataaacccagcagtgacatttgggctgtttttggcaagaaaagtatcattgatcagagcagtattgtacatggtggcacagtgtttgggtgcaatatgtggtgtgggttttgtgaaggcattccagagtgcttattatgttaggtatggtggaggtgctaatgtcatggctcctggccataccaaaggtgttggattagctgctgaaattattggtacttttgttttggtttacactgttttctctgctactgaccctaagagaaatgctagagactcccatgtccctgtgttggcaccacttccaattggatttgcggtgttcatggttcacttagccaccataccaattactggaactggcatcaatcctgctaggagttttggtgctgcagttatttacaatcatgacaaagcttgggatgaacactggattttctgggtgggtcccttcatcggagccttcgctgccgccgtctaccaccagttcatcctccgtgctggtgctatcaaagctcttggttccttcaggagcaatgcctaaaaaaatttcaatccaattgaataaaatcagccatgaaaaattgtagatatttccctatgggaaaagtaaaaaaaagtattgtactgtctgtttttcctatgaatttccctcttttgtgtatttttctacttgtaatcttcatttcacttttttatttttacttccttgctcccttttgcttttttcaaaatctagtctcttgtatctttgaattattgttgcttccttgtaatttaaattaatgtttcgcttct

SEQ ID NO: 15292 - DNA, 1245 bp, Triphysaria pusilla
attcctcactccatcatcttctctttcctctttacactctaatatcttctcttttcacctcaaaataatgacgaaagacgttgagtatgcgccgcaggcagcaccggaatactcagccaaggactaccacgacccgccgccggcaccgctcttcgacttcgacgagctgaccaaatggtccttctacagagctgtcatcgctgagttcattgccacacttctgttcctatacgtcaccgttttgactgtcatcgggtacagccaccagaccgacgccgcacagggcggcgagccgtgcggcggcgttggcatcctcggcatcgcctgggccttcggcggcatgatattcatccttgtttactgcaccgccggtatctctggaggacacataaatccggcggtgacatttgggctgtttttggggcggaaagtgtcgcttataagagcagtgttgtacatggtagcccagtgcttgggtgctgtgtgcggtgttggtttcgtaaaagcattccaaaagacgtactacaatagttatggtgggggtgccaacatgctagccgcagggtatagcaagggcgtagggttgggtgcagagattattggtacctttgttttggtctacactgttttctcagccactgatcccaagaggagtgcacgagactcccatgtccctgttttggccccacttcccattgggttcgcggtgttcatggtccacctggcgacaatccctatcacaggcaccggaataaaccctgcccggagttttggtgccgcagtcatctacaacaatgataaagcatgggatgaccactggattttctgggttggaccttttgtcggagccgccatcgccgccttctaccaccagtttatccttagggcagcagccattaaggccctcggatctttcagaagcaacgcttgaaaaattgaatctgaagaaaacaatgaattagttcttggagagggccatcaaagctgtagatattgttgttattcctttttttaatgtattggaatttgctgttcacttttctccttttccaaataaacatttgtttcttttctttccctttttctgttcaattaatgtgctttgtgttaatttcgattatttaaaggatgaactttttgttattttttttgtttggcccagaaaaacaaaaaaaaatataaaaaaaacctgcccgggctgtcgctcgaaagggcaaatttggacccgggttttttgtccaaaat

SEQ ID NO: 15293 - DNA, 983 bp, Acacia harpophylla
gacaactcacagtacagttctctgttctctctctgctcacacacacacagaataaggaagtggtagtgaggaagaaaagatgacgaaggacgtggaggttcaagaacaaggagagttctcggcgaaggactaccacgagccaccgccggcgccgttgatcgacccggaggagctggggaagtggtcgttttacagggcgttgatagcagagttcgtggcgactctgcttttcctgtacgtaactgtgttgacgattattggccagaacagctccacggaccctaacaaaggcaagaccgactgtgacggcgtcggtatcttgggcatcgcctgggccttcggtggcatgatcttcatcctcgtttactgcaccgccggtatctctggaggacacataaacccggcggtgacattcgggctgtttcttgggcggaaggtgtcgctcataagagcgttcttgtacatggtggcacagtgcgccggagcaatctgtggtaccggactcgccaaggccttccaaaaagcctactacgaccagtacgggggcggcgccaacgtcgtccagcagggctacagcaagggcaccgccctgggcgctgagatcatcggcaccttcgtcctcgtctacaccgtcttcgccgccaccgatcccaaacgtaacgcccgtgactcccatgttcccgtgttggctccacttcccattggattcgccgtgttcatggttcacttggctacaattccggtcaccggcaccggtatcaatcctgcaaggagttttggagctgctgtaatttataaccgtgacaaagcctggaatgatcaatggattttctgggttggtccagcaattggagccttagctgctgccatataccaccagtatatcctcagagccggggccattaaagctcttggatccttcaggagcaacaactaaattaatcaatctcagctctgtggtctgttgtgcatggtttgtggaa

SEQ ID NO: 15294 - DNA, 1278 bp, Cicer arietinum
ccccctcgtgtgccttgcctcccacgactctaacacacacacttgcagaagaagaaaaaatgggaaaagatgttgaagttcaagaacaaggtggtgaatattcagctaaggattatcaagatccaccaccagcacctttgtttgatccagcagagttaacaaagtggtctttgtatagagctgtgatagcagagttcatagcaacacttctgttcctttacatcactgtgttgaccattattggttatagtagacaaactgataccactattacaggtaacactgaatgtgatggtgttggagttttgggtattgcttgggcttttggtggtatgatcttcgtccttgtttactgcaccgccggtatctctggaggacacataaatccagcagtgacatttgggctgtttttgggacgcaaggtgtctttaataagggctgtactatacataatagcacaatgtttaggtgcaatttgtggtgctggtcttgcaaaagggttccaaaaatcatactacaataggtaccatggaggtgttaatttggtgtctgatggttatagtaaaggcactgctttgggtgctgaaattattggtacctttgttttagtttacactgttttctcagccactgatcctaagagaagtgctagggattcacatgttcctgtattggcaccacttcctattggatttgctgtcttcatggttcatttggcaacaatccctgttaccggtaccggaattaaccctgctaggagttttggacccgctgttatctacaacaacgacaaagcttgggatgatcagtggatttactgggttggaccatttattggagctgcaatagctgcattctatcaccaatttattctaagagcaacagcaataaaggctcttggatccttcaggagcaacccttaatcaattcacctcaattattatcacttgttattgtcctctaagaataataataataataataatagtagtagtaccatataattcaactctatcaatctactgttccctgttggagttttgtcctctttttttcattccatgttcctaatggccttatatgtttggaatcattggtttggataaagaagccaaaattacatggggtccataaattgttgataaacatgcttatgtctaaagcctgtatttctatcccttccttttaccctttagtttttgttttatttaattttatccctcatgtgttatcttttttaatttatgtgatatgatatgatatgagatgatgcactct

SEQ ID NO: 15295 - DNA, 2701 bp, Cicer arietinum
aacttaagttttgtgttttaataaatatatgaaatttgaagtttgaaaaaaacaaagaatgggatggacccaaaagaaaagggatgacgagtcgttgggtcgggtagtagccacagagtgggtgggtccttgctagcgaaaccaagctaataatggtcggcaaaaatagtataacgttaataatgatgttatttttgatatatacgtacaaacaaaaaactttataataaaaaatataatttaatttgtttgtataataaaaactcaatttaattccataaataccaatgtttgaagtcactcttcattccacaaaagtagccacctaacacacacacttgcagaagaagaaaaaaatgggaaaagatgttgaagttcaagaacaaggtggtgaatattcagctaaggattatcaagatccaccaccagcacctttgtttgatccagcagagttaacaaagtggtctttgtatagagctgtgatagcagagttcatagcaacacttctgttcctttacatcactgtgttgaccattattggttatagtagacaaactgataccactattacaggtaacactgaatgtgatggtgttggagttttgggtattgcttgggcttttggtggtatgatcttcgtccttgtttactgcaccgccggtatctctggaggacacataaatccagcagtgacatttgggctgtttttgggacgcaaggtgtctttaataagggctgtactatacataatagcacaatgtttaggtgcaatttgtggtgctggtcttgcaaaagggttccaaaaatcatactacaataggtaccatggaggtgttaatttggtgtctgatggttatagtaaaggcactgctttgggtgctgaaattattggtacctttgttttagtttacactgttttctcagccactgatcctaagagaagtgctagggattcacatgttcctgtattggcaccacttcctattggatttgctgtcttcatggttcatttggcaacaatccctgttaccggtaccggaattaaccctgctaggagttttggacccgctgttatctacaacaacgacaaagcttgggatgatcagtggatttactgggttggaccatttattggagctgcaatagctgcattctatcaccaatttattctaagagcaacagcaataaaggctcttggatccttcaggagcaacccttaatcaattcacctcaattattatcacttgttattgtcctctaagaataataataataataataatagtagtagtaccatataattcaactctatcaatctactgttccctgttggagttttgtcctctttttttcattccatgttcctaatggccttatatgtttggaatcattggtttggataaagaagccaaaattacatggggtccataaattgttgataaacatgcttatgtctaaagcctgtatttctatcccttccttttaccctttagttttttgtttttatttaattttatccctcatgtgttatcttttttaatttatgtgatatgatatgatatgagatgatgcactctcaatccaaattttcattttggttttatttgtttctttaataagtgctctgttttaattcaattatcttttgcttccaaaaattgcttattactttatcactcatttcttgtttgtgtttctaaaattcaacctagctttagtaattgagatcccacaccaaattattgggggtactttctcataactgattaactagtcttagctgtttatttttattttactctagaggtcacaatcatacaaggaaatacatgtaaatttcactcacgaggctttacatgtgtcataaccttaatggctaaatcctgacaaatattttctaaacatttatttaattatataatgtatgattggatgcttaacgtgattataataaaaaaggttagcatcattattaaattatcattgacgtcaaaatcttctagcttatattatattatctagctgataccgtatcaaagcagagaagagagaaaataatttctgaataatacttccatcactttcattaaaataaaaatagtaattgcaattgatcttgaaataagactcaaggtgagttttaatacaagataataatctaaccaactaacctaaataactaactaagcagactaatagcaacagataaacagacagaaccagaactaattatctatgcttaataacctaaacaaaaagtgacatgttgaaaatatacttagcagtaaaatgcaattataatgttcatggaaattgtagaaaatattatagtgttttctttggacataaataacaatcataattaaatcgacaatgtaaaatgcgaatgctactttatggacctacttgataggttctgtggtaagacaatttctcttcccttcaatgtatttaaatatatgtttgaattgtttaacaaaaaaaaaaaataaaaatttgaattgattaattcaaatacacgttgaaggaactgtaagtccatgttaagagatctaaaacagaacaatgggcttgggcttctcgagttctggagcccatatagtggccttgtctacaaacaaattgaaacttctagacacaccattttcacatatttatcttctgcaatttaatttttgacttaattgtagttttagtcccc

SEQ ID NO: 15296 - DNA, 1192 bp, Cicer arietinum
aatcaattaagtagccacctaacacacacacttgcagaagaagaaaaaatgggaaaagatgttgaagttcaagaacaaggtggtgaatattcagctaaggattatcaagatccaccaccagcacctttgtttgatccagcagagttaacaaagtggtctttgtatagagctgtgatagcagagttcatagcaacacttctgttcctttacatcactgtgttgaccattattggttatagtagacaaactgataccactattgcaggtaacactgaatgtgatggtgttggagttttgggtattgcttgggcttttggtggtatgatcttcgtccttgtttactgcaccgccggtatctctggaggacacataaatccagcagtcacatttgggctgtttttgggacgcaaggtgtctttaataagggctgtactatacataatagcacaatgtttaggtgcaatttgtggtgctggtcttgcaaaagggttccaaaaatcatactacaataggtaccatggaggtgttaatttggtgtctgatggttatagtaaaggcactgctttgggtgctgaaattattggtacctttgttttagtttacactgttttctcagccactgatcctaagagaagtgctagggattcacatgttcctgtattggcaccacttcctattggatttgctgtcttcatggttcatttggcaacaatccctgttaccggtacaggaattaaccctgctaggagttttggacccgctgttatctacaacaacgaaaaagcttgggatgatcagtggatttactgggttggaccatttattggagctgcaatagctgcattctatcaccaatttattctaagagcaacagcaataaaggctcttggatccttcaggagcaacccttaatcaattcacctcaattattatcacttgttgttgtcctctaagaataataatagtagtagtaccatataattcaactctatcaatctactgctccctgttggagttttgtcctcttttttcattccatgttcctaatggccttatatgtttggaatcattggtttggaataaagaagccaaaattacatggggtccataaattgttgataaacatgcttatgtctaaagcctgtatttctatcccttccttttaccctttagttttttgttttttgttttt

SEQ ID NO: 15297 - DNA, 921 bp, Eutrema parvulum
aagcaaagaagaaaacccaaaaaactagttatggcgaaggacgtggaagccgtttccggagaagggtttcagacaagagactatcaagatccgccgccggcgccgctgtttgatccggaggagctgacgaagtggtctttttacagagcagtcatcgccgagttcgtagccactctcctcttcttatacatcaccgttttgacagtcatcggttataagattcagaccgatgatactgccggcggcgttgactgcggcggagttggaatccttggtatcgcttgggctttcggtggcatgatcttcatcctcgtctactgcaccgccggtatctctggtggtcacataaacccagcagtgacatttgggctactcttggcccgtaaagtgtcgttagtgagagccatattgtacatggtggctcagtgtttgggtgcaatttgtggagttgggttcgtcaaagccttccaaagctcgtactacatccgttacggtggtggagccaactctctagccgaaggctacagcacaggcactggcctcgctgcagagatcatcggtactttcgttctcgtctacaccgtcttctctgccaccgacccaaaacgtagcgccagagattcccatgttccggtgttggcgccacttccgatcggatttgcggtgttcatggtacatttagctaccattccgatcaccggaaccggaattaacccggcaaggagtttcggagcagccgttatcttcaacgagagcaagccatgggatgaccactggatattttgggtaggaccattcattggagctgcgattgctgcattttaccaccaattcgttctaagggcttcaggttctaagtctcttggatctttcagaagtgcagccaacgtctaaaagaaactctctcatcagatttctgaa

SEQ ID NO: 15298 - DNA, 1136 bp, Centaurea maculosa
ctcatacaaacatgacgaaagaacccgtgacgaaagaaccggtgacggatcccgagctagagccaacctccaagaaggactacagcaacccaccgcccgtggctttcgtcgacccaaaagaattgaccaagtggtcgttctacagagccatcatcgctgagttcatcgccacccttctctttctttacattactgtcttaaccgttatcggttacaagagcacgatagacacaactaaggccgatgccgacccgtgtggtggcgtcggaatcctcggtattgcttggtcctttggtggcatgatcttcgttctcgtttactgcactgctggtatctccggtggtcacattaacccagctgtgacctttggtctgtttctggctcgcaaggtctcgttgttccgagccatcttgtacatggtggctcagtgcctaggagccatatgtggtgtgggtttggtcaaggctttccacaagacttattacaacacctatggcggtggtgccaacgagctagccgatggctacaacaaaggcaccgggttgggtgctgaaatcatcggcactttcgttcttgtctacaccgtcttctctgctaccgatcccaagagaaatgcccgagactcccatatcccggtgttagcacctctacctattgggtttgctgtgttcatggttcacttagccacgattccgattaccggaaccggtattaacccagcgaggagttttggagcggcggttatttataacaaggagaaagcttgggatgatcaatggatattttgggtcggacccttcatcggtgcagccatcgcagccttctatcacgagtttgtgttgaaagccggtgcagtgaaagctcttggatctttcagaagcagtacccacgtttgagattgatttcgacctctaaaccctcgtttcgttttaatttggtttcatgaaaaattggaaaaaaaataagtactcaaaatgtttgtatgtgtgtgaattacaagtatgtggtttataggtgttggaatctgtttaagagttgtggcaggcatggaaattcgatgtaaatggttttttagaggggggttgtattgtaaccctcatgttattgttgttgcttaattaaagcttgagtgaact

SEQ ID NO: 15299 - DNA, 1300 bp, Gossypium hirsutum
tcacattaatcactatcatcatcatgatgtcgcctcctctatgtctccctctccctctccctctcaccactcttcacccatagcttaaacgaacattttcacagcttaaaacacaatatgactaaagatattgagaccacggcggagcaaggcggcggagcggagttctcagcgaaggactaccatgacccaccaccggcaccgttgattgacatggaagaactcaccaaatggtcgctttatagggcggcgatcgctgagttcattgccacccttcttttcttgtatgtcacggtgttgactgtgatcgggtataaagtccaaaccgacccggtaaagaatactattgacccggattgtggtggtgttggtatacttggtattgcttgggcttttggtggcatgatctttatccttgtttactgcactgctggtatctctggaggacacatcaacccggcggtgacgtttggactgttcgtggggcggaaggtgtcactgatccgagccctgttgtacatggtggctcagtgcttgggtgcaatctgtgggtgtgggttggtgaaggctttccaaaagacttactacaatagctatggaggtggtgccaacgagctccaagatgggttcaacaagggcaccggcttgggtgctgagatcattggcaccttcgttcttgtctacactgtcttctcagccactgatcccaagaggagtgcaagggattcccatgttcctgtgttggcaccacttcccattggatttgccgtgttcatggttcaccttgccacaatccctatcactggcactggcatcaacccagcaaggagctttggagctgctgtgatttacaaccaagaaaaagcttgggatgatcaatggatattctgggttggacccttcattggtgctttcgttgcagccttttaccaccaatacatcctaagagcagcagcaattaaagcccttggatctttcaggagcaatgcttaaaaacatttcacctttattacaataagaaaacaatgatgtaataacaaatgaggaatgagtgcaagtttatgtcttgtgggaggggttcccttttgcagtttattttctataccattgacaaggggggccattgaaatgtaaataataaaagaaaacaagaattatggataagggtgtcttttcaatccctgtttgtttctaaatttttgttgctttttaaatgtatttttatataagtgttgtcatctttttatcatctccatttcttttaatcttgttgtattttgtaagtataatactattgttt

SEQ ID NO: 15300 - DNA, 1310 bp, Lotus japonicus
cacttgcaacagtgcctagtgagtgagtatagagcacaaaccaaagatggcgaaggatactgaggttcaagaacagggtgaatactctgcaaaagactaccaggatccacctccgactccgcttttcgacccggaggagctgacaaagtggtccttctacagagctctcatagctgagttcatagccacacttctcttcctttatgtaacggttttaactgtcattggccacagcaggctcaacagtgctgatccttgtgatggtgctggcatcttgggtattgcttgggcctttggtggcatgatcttcatccttgtttactgcaccgccggtatctctggaggacacataaaccctgcagtgacatttgggctgttcataggacgcaaggtgtctttgataagggcacttctatacatagtagcacagtgtttaggtgcaatcagtggtgttggattggccaaggccttccaaaaatcattctacaacaggtacggtggcgctgccaattttgtgcaacctggttacagcaacggcaccgctttgggtgctgagattattggcaccttcgttcttgtctacactgttttctctgccactgatcctaagagaaacgctagggattcccatgttcctgttttggctccacttcctattggatttgctgtgttcatggttcacttggctacaatccctgttactggtactggaattaacccagcaaggagttttggagctgctgtcatctacaacgaagacaaaatctgggatgaccattggattttctgggttggaccatttattggagctctagcagctgcaatctaccaccaatacattctcagagcagcagctatcaaagctcttggatccttcaggagcaacaattaagcacttaaattaagctatggtgttaatttcccccaaaagaataatgattcccatggtattatgctgaggagtgcaagcctgtccctgctggtccctttaggccttatctaagtcttttcctgttcagctgcagctgtgtagagaaaaaaggctaaacacaagggaccatgaaattgtagataagaatgcttgtgtccaagggtgtatttttatcccttttgtgtcttttcttaaattttaatgtatgtatttgtcaagtgttgattttctcttgtgcatccttgctcatatttcattttgcacttcttgattgttatgtggtatattcctcgttccctgtttcaaatttcgcatcaaaaatttgcttgattctcaaaactttatcagttatctatgtacaatgcacaatgacatgagt

SEQ ID NO: 15301 - DNA, 1136 bp, Brassica juncea
acaaaacagaaataataaccaaaacacacattttcttgaattactaaatggcgaaagaagtggaaggagcagagggattcgcgacgagggactacgaagaccctccgccaactccgtttttcgatgcggaggagctgaccaagtggtctttgtacagagccgtcatagccgagttcgtagccactctcctcttcttgtacgtcactgttttaacagtcatcggctacaagatttcgtccgacactaaggcgggaggtgacgagtgcggaggtgtcggaatccttggcatctcatgggctttcggcggcatgatcttcattcttgtctactgcaccgccggtatctcaggtggtcacataaaccctgccgtgacgttcggcttgttcttggcacggaaggtatcgttggttagagcggtgctatacatggtggctcagtgtttgggtgctatttgtggagttggtttcgtcaaagccttccaaagctcttactacgtccgttacggtggaggagcaaactctctagccgacggatacagcacagggactggactcgcagcagagatcattggaacctttgtccttgtctacactgtcttctccgctacagatcccaaaagaaacgcacgagactcccacgttcccgtgttggcgccacttccaattggatttgccgtgttcatggttcacttggccactattccaatcaccggaaccgggattaacccggccaggagtttcggagctgcggttatcttcaacgagtccaagccgtgggacgaccactggattttttgggtgggaccattcatcggagctgcgattgctgcattttatcaccaatttgtcctaagagcttccggttccaagtccctcggctccttcagaagtgcggccaacgtttgaatttagccacacaaaacaaaatagcaattacaaaatgattgttattatgtatgtacaaaattggcaactttggttttaaaatatatgctctgttttattccttttgtctttcctaatttctggcttcattgtgggatatgtgaatgtttgtgtactcgagggaaaaacaatcaataaaatcaaattgtttttgcctctttaaaaaagcataattagcttctaattctgctc

SEQ ID NO: 15302 - DNA, 1045 bp, Brassica napus
tagaaacatcatacatacatggcgaaagacgcggaaggagcagaaggatttgcggcgagggattaccaagacccgccgcctacaccatttttcgacgcggaggagttgacaagatggtccttatacagagccgtcatcgccgagtttgtagccactcttctcttcttgtacgtcaccgttttgactgtcattggctacaagatttcgtccgacacagccgccggtggagttgaatgcggcggcgtaggaatcctcggcatcgcttgggcttttggtggcatgatcttcatccttgtgtactgcaccgccggtatttcaggtggtcacataaacccggcggtgacgttcggcttgttcttggctcgcaaggtatcgctgattagagcggtgctatacatggtggctcaatgtttaggtgcgatttgtggagttgggtttgtcaaagcctttcagagctcttactacgtccgttacggaggcggagccaactctctagctgacggatacagcacagggacaggactagctgcagagatcatcggaacatttgttcttgtgtatactgtcttctcagccacagaccccaaaagaaacgcacgtgactcccacgttcccgtgttggcgccacttccgattgggtttgcggtattcatggtacacttggctactattccgatcaccggaacaggaattaacccggcgaggagtttcggagctgcggttatctacaacgagtccaagccgtgggatgaccactggatattctgggtgggaccattcattggaggtgcgattgctgcattttatcaccaattcgtcctaagagcttccggttccaagtcactcggatccttcagaagtgcggccaacgtttgaattctgccccacacacatacatacaacaaaagtggttactctttgtgtagtatttcggcaaatgatttttaaaatatgccctcctttcccctcatgcgtttttcttttttttttggttcctctacttctatttgtgtggaatccaatcaatggagtctagtgttttacg

SEQ ID NO: 15303 - DNA, 1251 bp, Allium cepa
acccaacccatacacacacctcgcccgctcctataaagccaactcatttcttctccattcctctactttacgcaactcacccaaatattaatcaacaaataatggcaaacaaggaagtagatgtacctgaaacaaaagatactcagttcactgcaaaagactacacagacccgcccccagcgccgcttttcgacatgggtgagctcaccaagtggtcactgtaccgtgcagtcatagcagagttcgtcgccactctattgttcctctacatcacagtagccacggttatcgggtacagtcaccagagcgatgcaaccatacccggaaataccgatgctcactgcagcggtgttggcgtgcttggaattgcctgggctttcggtggcatgatcttcgttctcgtttactgcactgctggaatttccggtggacacataaacccagctgtgacgttcgggcttttcctagcaagaaaagtatctttaataagagcgcttctgtacatgatagcacagtgtttaggtgcaatatgcggtgttgggtttgtcaaagcgttccagtctgcctactattctagatacggaggtggtgccaacactctgaacgctgggtacagtaaaggaaccgggcttgcagctgaaattataggcacttttgtgttggtctacactgtgtttgctgctaccgaccctaaacgtagtgctagagattctcatgtgccggtactggctccacttccaattgggtttgctgtgttcatggttcatttggcaaccattccaattactggtactgggattaatcctgctagaagttttggagctgctgttatttacaacaaggataaagcttgggacgatcagtggatattctgggttggtccattcattggtgcagcaattgcagcagcttaccatcagtatgtgctaagagcaggagctgtgaaggctcttggttcttttaggagcaatgcttgattgatactagtcaaactgcatgcagtgaagtccctgtaataattatcagaaacagtttgaattggttcatgttgtgattgtgttgaaaagagacagagaaatctaatatttgatttctttgttgttttttctctcatttgtagattttgtctttgtcttccaatgtagaatgtgaatctgtgatggagtgttttttcttccactatttgccatgtcttaagaaaaaaatggctttttatgtcttaattggaactgtgccaactatgtaatgtaa

SEQ ID NO: 15304 - DNA, 1059 bp, Allium cepa
catcacttataaattctcacttaatttccacaccttagcacgaaataaaacacaagtcagcagaaaaccatgactaaagacgtcgaggcatcctacgcagcaaaggactacacggacccgccacccgcaccactgatcgacagccacgagctgacaacatggtccctgtaccgggccgtgatagccgaattcgtcgccacgctcctcttcctctacatcacagtcgcgaccgtgatcgggtacaaacaccaatccgacgcaaccctacccgacaacgtggacgcggcctgcagcggcgtcggcgtcctcggaatcgcgtgggccttcggcggcatgatcttcatcctcgtctactgcaccgccggcatctccgggggccacatcaacccggcggtcaccttcgggctgttccttgcccggaaggtgtccctggttcgagcggtgctgtacatgtgcgcgcagtgcttgggcgcgatatgtggggtggcgctggtgaaggcgtttcagagtgggttttatgacaagtatggcggtggggctaacgggctgagtgacgggtattctactgggaccgggcttgctgcggagattattgggacgtttgttttggtttataccgttttctctgccactgacccgaaacgaaatgcacgggattcgcatgtgcctgtgctggctccgctgccaattgggttcgccgtgtttatggtgcacttggctacgattccgattaccgggaccgggattaatcctgctaggagtttaggggcagctgctgtttataataaagccaaagcttgggatgatcagtggatattttgggttgggccatttattggggctgcaattgctgctgcttatcatcaaattgtgcttagagctggggctgtcaaagcattgggttcatcaaggagcgtgtcatgattaaatattcagtccctgcataggactttggtcacagtttgatcagcgttgaatatatgtgcttgtatttatgctctgtgtatgatattatgtctacaactgaatcaatgaaaaaataaaataaaaatccttttg

SEQ ID NO: 15305 - DNA, 1103 bp, Brassica oleracea
acaacaaacatcaaaatacatccatcttttctctctctcatcatcatctttagccatggcaaaggacttggaggtgcaagagggcggagcaatggcggcgagagattaccaggatccgcctccggccccattgtttgacatggaggagcttgggaagtggtcgctctatagagcggttatagctgagttcgtggcaacacttctcttcctttacgtctcaatcctcaccgtaattggctacaaagctcagaccgacgcaaacgccggaggagttgattgcggcggcgttgggatattgggtattgcgtgggctttcggtggaatgatctttgttctcgtttactgtaccgccggtatctctggtggtcatataaatccggctgtgacggtgggactgttcatagctcgaaaagtgtcattagtgcggacagtgttatacattgtggctcagtgccttggtgccatatgtggttgcggtctggtcaaagcattccaaagttcttactacaacagatatggaggtggagccaaccagcttgccgacggctacaacaaaggtaccggactaggtgccgagatcatcggaacatttgtccttgtctacaccgttttctcggccaccgatcccaagcgaagtgcacgtgactctcacattccagttttggcgccacttcccattggttttgccgtcttcatggttcacttggccaccattcccatcactggaaccggaatcaaccccgcccgtagcttcggagccgcagttatctacaaccaagaaaaggcctgggacgaccaatggatattttgggtgggaccaatgatcggagcagcagctgctgcgttataccatcagtttgttctaagagcggctggaattaaatctcttggctcctttaggagctctgcttaattttaattgtttgaattgagccacaagttgatcttaaaccaaaatgatgattaccactatattaagcggaagctacgtgtatcttttatttaattttatgttctgtttttaaatttcaaggaatttcccattggttgtaaatgtggttttaattaatgttgctttaagataaatctcttctttgctttta

SEQ ID NO: 15306 - DNA, 1090 bp, Echinochloa colona
cggccaaggactacagcgacccgccgccggcgccgctgatcgacgcggaggagctgaccaagtggtcgctgtaccgcgcggtcatcgccgagttcatcgccacgctgctcttcctctacatcaccgtggccaccgtcatcgggtacaagcaccagtccgacccggcggcgtcgggcgccgacgcggcgtgcggcggcgtcggcatcctcggcatcgcctgggccttcggcggcatgatcttcatcctcgtctactgcaccgccggcatctcaggtgggcacatcaacccggccgtgacgttcgggctgttcctggcgaggaaggtgtccctcgtccgggcggtgctctacatcatcgcgcagtgcctgggagggatctgcggcgtggggctcgtcaagggcttccagagcgcctactacgtgcgctacggcggcggcgccaacgagctcagctccggctactccaggggcaccgggctcgccgccgagatcatcggcaccttcgtgctcgtctacaccgtcttctccgccaccgaccccaagcgcaacgcccgcgactcccacgtcccggttctggcgcccctgcccatcgggttcgcggtgttcatggtgcaccttgccacgatccctgtcaccggcacgggaatcaacccggcgaggagcctcggcgccgctgtcgtgtacaacaacaacaaggcctggagcgaccagtggatcttctgggtgggtccgttcatcggcgcggcgatcgcggcgctgtaccaccagatcgtcctccgcgccagcgccaggggctacggctccttccggagcaacgcctaggccgacctcgtcgccatcgacatccacggccggccgattggactggacgtagctcatcctcctcctaagtttaagttgaacggagagggagatcgtcccggcgtgattaatgtagtagcagtagcttcagtcaagtgttggaactgccggcaacggcaagtgtttgcgtgtgtgtattgtggaaagcaagtgtgactttgtgttcgtgtgtggactgtggaccctgtagacttgaactcaatctcaagttaataaagatggaggaatat

SEQ ID NO: 15307 - DNA, 1245 bp, Elaeis guineensis
atataaatagaccccctcatcctcacctcagtccgcaccgaggccccatatctctccaccgccgcaagctagctccctccctcttttttattttctcattttcacgatttaaagaaagaagagttggtaaatttaatcagcggtcgatggggaaggacgtggaggccgagttcaccgcgaaggactacacggacccgccgccggcgccgctgatcgatgcggaggagctggccaagtggtcgctttaccgggcggtgatcgccgagtttatcgcgacgctgctgttcctctacatcactgtggcgacggtgataggctacaagcaccagtcggaccccaacgtgggtggcaccgacgcggcctgcagcggtgtcgggatcctcggcatcgcctgggctttcggagggatgatttttatcctcgtctactgcaccgccggcatctctggcggtcacataaacccggcggtgacgttcgggctgttcctggctcgcaaggtctccctgatccgggcccttctctacatgatcgcccagtgcctgggagccatctgcggcgtgggccttgtaaagagcttccagaaggcctactacaaccgctacggcggcggtgccaacgagctcagctccggctactccaaggggacgggactcgcggcggagatcatcggcaccttcgtcctcgtttacaccgtcttctccgccaccgaccccaagcgcaacgcccgcgactcccacgtcccggttttggctccactccctatcggttttgcagtgttcatggtccatctagccacaattcctatcaccgggactggcattaaccctgccaggagcttcggagctgctgtgatctataacgaggataaggcctgggatcatcagtggatcttctgggtggggcctttcattggtgccgcgattgctgcagcttattaccaatacgtcctgagagctagtgctgggaagcctttgggatcctaccgtagcggctgatctctcttcttcttgaactgaagaagaacagttatggagcataaaattgtagataaaaggcctgcctctactactgggggtgttgctttgtgctgctacattgttcgcaaccattgggatttcatttaccggcgtgtacgagtgcttctgggtgttgtcatcttctagctaatcgcttctccctcttccacttctctttgcatctgtaattaaattactacgtaaggctatgaaatttctatcctttgtc

SEQ ID NO: 15308 - DNA, 1224 bp, Allium cepa
tagttacgggggatttattaccctaaccctattactactactaccttcgtcccgctcctataaagccaactcatttcttctccattcctctactttacgcaactcacccaaatattaatcaacaaataatggcaaacaaggaagtagatgtacctgaaacaaaagatactcagttcactgcaaaagactacacagacccgcccccagcgccgcttttcgacatgggtgagctcaccaagtggtcactgtaccgtgcagtcatagcagagttcgtcgccactctattgttcctctacatcacagtagccacggttatcgggtacagtcaccagagcgatgcaaccatacccggaaataccgatgctcactgcagcggtgttggcgtgcttggaattgcctgggctttcggtggcatgatcttcgttctcgtttactgcactgctggaatttccggtggacacataaacccagctgtgacgttcgggcttttcctagcaagaaaagtatctttaataagagcgcttctgtacatgatagcacagtgtttaggtgcaatatgcggtgttgggtttgtcaaagcgttccagtctgcctactattctagatacggaggtggtgccaacactctgaacgctgggtacagtaaaggaaccgggcttgcagctgaaattataggcacttttgtgttggtctacactgtgtttgctgctaccgaccctaaacgtagtgctagagattctcatgtgccggtactggctccacttccaattgggtttgctgtgttcatggttcatttggcaaccattccaattactggtactgggattaatcctgctagaagttttggagctgctgttatttacaacaaggataaagcttgggacgatcagtggatattctgggttggtccattcattggtgcagcaattgcagcagcttaccatcagtatgtgctaagagcaggagctgtgaaggctcttggttcttttaggagcaatgcttgattgatactagtcaaactgcatgcagtgaagtccctgtaataattatcagaaacagtttgaattggttcatgttgtgattgtgttgaaaagagacagagaaatctaatatttgatttctttgttgtttttctctcatttgtagattttgtctttgtcttccaatgtagaatgtgaatctgtgatggagtgttttttcttccactatttgccatgtcttaag

SEQ ID NO: 15309 - DNA, 1321 bp, Secale cereale
ccaaggacgaggtgacggagaccggcggcggaggcgacttcgcggccaaggactacacggacccgccgccggccccgctgatcgacgcggcggagctggcgtcgtggtcgctgtaccgcgccgtcatcgccgagttcatcgccacgctgctcttcctctacatcaccgtggccaccgtcatcgggtacaagcaccagacggaccccgcggtgaacagcgccgccgacgcggcgtgcggcggcgtgggcgtgctcggcatcgcctgggccttcggcggcatgatcttcgtcctcgtctactgcaccgccggcatctccgggggccacatcaacccggccgtcaccttcggcctcttcctggcgcgcaaggtctccctggtccgcgcgctgctctacatgatcgcgcagtgcctcggcgccatgtgcggggtcggcctcgtcaaggccttccagagcgcatacttcgtcaggtacggcggtggcgccaacacgctcgccgccggctactccaagggcaccggcctcgccgcggagatcatcggcaccttcgtgctcgtctacaccgtcttctccgccaccgaccccaagcgcagcgcacgcgactctcacgtcccggtgttggctcccctcccgattggcttcgccgtgttcatggtccacctggccaccatcccgatcaccggcaccggcatcaacccggccaggagcctcggggccgccgtcatctacaacaaggagaaggcctgggatgatcagtggatcttctgggtcggcccgatgatcggcgcggcgatcgcggccttgtaccaccagtacatcctcagggccggcgctatcaaggccctcggctccttcaggagcaacgcataacaagttaccgtccatgtgatttgcatgcaagattgaagcaacggcgacctgtgttgtgttcatccaaagagaaaagcgcttttacaacttctcaacagttcagttggcccgcaatggtcgtgttatttatgtgtcggcaggcatgcgtagtacgtacgtggttggcctccatgtgccccagtcctgcgtgccgtgtcttgtaattcggtccatgggatcgctcgcttgtcttaattagcccgcattgtttttcctatttaaatttagcgaccatatgattatgatcgatccaacttcaccacctttctatcaagtcatcaatccatcaagcaagtgatcatcccgaataagtattttctcttcacgtgtttgtgccgagtggtactactctttatcttgttgctgctatgccgatgtgaatcctcaagcccgaatgatcatatgtcgtgtga

SEQ ID NO: 15310 - DNA, 1207 bp, Eutrema halophilum
taattagaccaaacctttgcaacagtctctgtgtatataaacacaatccacacaaacacaagaactacaaatctcaaacaaacattaaaactcatctctctttctctctctctcaccatcatctttgggagccatggcaaaggacttggaggtgcaagagggcggagcaacggcggcgagagattacgcagatcctcctccggcgccattgttggacatggaggagcttcggaagtggtcactctatagagcggtcatagctgagttcgtggcgacacttctcttcctttacgtctctatcctcaccgtgatcggttacaaagctcagaccgacgcatccgccggaggagttgattgcggcggcgtagggatacttgggattgcgtgggctttcggtggaatgatctttgttctcgtttactgcacagccggtgtctccggtgggcatataaatccggctgtgacgtttggactgttcctagctcgaaaagtgtccttggtgcggacagttttatacattgtggctcagtgccttggtgctatctgcggttgcggtttcgtcaaagcatttcaaagttcttactacaccagatatggaggtggagccaacgagctcgccgacggctacaacaaaggtaccggacttggtgcggagatcatcggaacatttgtcctcgtttacactgttttctcggccaccgatcctaagcgaagtgcacgtgactctcacattccagttttggcgccacttcccattggttttgccgtcttcatggttcacttagccaccattcccatcaccggaaccggaatcaacccggcccgtagcttcggagccgcggttatctacaaccaagaaaaggcctgggacgaccaatggattttttgggtgggaccgatgatcggagcagcagcggctgcgttataccatcagtttgttctaagagcggctgcgattaaagctcttggttcctttaggagctctgcttaaatttaactgtttattttttgattaagttacaagtcaacctttaatcaaaaatgatgattaccgcatagtatttcactacgattgttaagtggaagttacctgtatctttttctatttatatattcgatctgttttttttcccttctttttcatggaatttcccattcgtgtaaatgtggttttaattaatgttgctttaagataagtctcagtttc

SEQ ID NO: 15311 - DNA, 1249 bp, Oryza sativa
cgcagcaagctgcacagagctagcgttagcttggttagttgttcttagcattctagctagctcaatggcgaaagacattgaggcgtcggcgccggagggcggcgagttctcggcgaaggactacaccgacccgccgccggcgccgctgatcgacgtggaggagctgaccaagtggtcgctgtaccgcgcggtgatcgcggagttcatcgcgacgctcctcttcctgtacatcacggtggccaccgtgatcgggtacaagcaccagtcggacgccaccgtcaacaccaccgacgccgcctgcagcggcgtcggcatcctcggcatcgcctgggccttcggcggcatgatcttcatcctcgtctactgcaccgccggcatctcaggtgggcacatcaacccggcggtgacgttcgggctgttcctggcgaggaaggtgtcgctgatcagggcggtgctgtacatcatcgcgcagtgcctgggcgccatctgcggcgtggggctcgtcaaggggttccagagctcgtactacgcgcggtacggcggcggagccaacgagctcagcgacggctactccaagggcaccggcctcggcgcggagatcatcggcaccttcgtgctcgtctacaccgtcttctccgccaccgaccccaagcgcaacgcccgcgactcccacatcccggtgttggctcctctcccaattggattcgcggtgttcatggtccatctggccaccatccccatcaccggcaccggcattaacccggcgaggagcttgggaaccgcggttatctacaacaaggacaaggcctgggatgaccaatggatcttctgggtgggccccctgatcggcgccgccatcgccgccgcctaccaccagtacgtgctgagggccagcgccgccaagctcgggtcctaccggagcaacgcctgagatcggcggcggcggcgcgcgcgaggtggcgctgaagtgtagatacgcgtacaagatggccgcctctgtccagcactagatcaacgaattcagccttcgcatcctgcatttcgcctcgtggatagattctactgcactattatgtactatgtatccatgcatatggtctccattcctttgaactatgtccgccatatgttgcttcccgctggtgcttccaagtttggttaattttccttcacattctgcatgtatgtaatattcatatggagaatttgtgaatttgaagatcatagttactattatgtgcgatttatt

SEQ ID NO: 15312 - DNA, 868 bp, Helianthus annuus
gcttggcggggatcctctccccacttcatctctctcttctcattttatacacacgtacatcagcagccagttttctaaaagaaaatggcaaaagacattgaagtagcaagccatgaatacggtgcaaaagactaccaagaccctccaccagctgacctcattgacccagaggagctcaccaaatggtccttttaccgagccatcattgccgagttcgtcgccaccctcttgttcctttacatcactgtcttgactgtcatcggctacaagtcccaaaccgaccccgaccacagcactgaccagtgcggtggcgtcggcattctcggcatcgcttgggctttcggtggcatgatctttattctcgtttactgcactgccggtatctctggtggacacattaaccctgcggtcacattcgggctgtttttggcaaggaaggtgaccctcccaagggcggttatgtatatggtggctcagtgcttgggtgcggtctgtggctgtggtctggtaaaagctttccaaaagtcttactacaccaattatggcggtggtgccaatgagcttgcagatgggtacaacaaaggcaccggtttgggtgcggaaatcattggcacattcgtccttgtctacaccgtcttctctgctactgacccaaagagaaacgcacgtgactctcatgtccccgtgttggcgcctcttcctatcggattcgccgtattcatggttcacttggccaccatcccaatcaccggcactggaatcaaccctgctcgtagttttggggccgcagtcatctacggaaaagaaaaggcttgggatgatcaatggatattctgggtgggaccgatgatcggagcggcgatagcgg

SEQ ID NO: 15313 - DNA, 1806 bp, Trifolium pratense
ttatattttagacctcttttcctaaaaagtggaggattaaaaccaaaaataaaactaagtactagtattaaacagttcaattccctgtttcatacgcaaagcaacatttcacatgtattgttgtataaaaaaccacacttacttcactccctcaacattatcctaaaaacagagcaacccttacaaacaccactctctaacttcaatggcaaaagactttgaaaccgaacctcaagctggtggtggtttaccaaacaaggactaccaagatccaccaccagctccactcttcgacactactgaattcagccaatggtccttctatagagccctcattgccgaattcgtcgcgactctcctcttcctctatgtcaccattttaaccgtcattggctacaactcccaaactgatccagctcataatggcacccattgtgacggtgtcggtatcctcggcatcgcttgggccttcggtggcatgatttttgtccttgtctactgcaccgctggtatatctgggggacacataaatccggcggtgacatttgggctatttctggcaaggaaggtctcattgatcagagctgtgttatacatagtggcacagtgtttaggagcaatatgtggggttggattagtaaaagcttttcagaaaggttactataacagatacaaaggtggtgcaaacatgttaaatgatggttacagtaaaggaactggtttaggtgctgagataattggaacttttgttcttgtttacacagtattctctgccaccgatccaaaaagaaatgctagagattctcatgttcctgttttggcaccacttccaattggatttgctgtgtttattgttcaccttgctacaattcctatcactggaactggtatcaatcctgctagaagctttggtgctgctgtgatttacaacaatgagaaagcatgggatgaccaatggattttctgggttggaccctttattggtgctgccattgctgcaatttaccaccagtttgtgttgagagcacaagcagcgaaggctttgggatcttttaggagttcttcaaatctgtaatgcaatttcatgtggccaaattacagaggtttaatcacttaattgtatgcttagacatggtggattggaatctcatcattatgtatcgacattgtttaattatggtttaacaaattaatgtatgcactttaaattttgtgttgaatttgatttcatcatttgtcttaaatttgaatgtgttgaaattcgaactctgattactctcgttatgagtctaatttcttcagttacaactgagttgttgcccgttggtgtttttctagttagttagttgctcactatttcattttttggtaaatttgaaatgatgttactaaactaatagcaagaccgttgtgctgtgtctgtttatggttgtgttgtatttaatggatttatctaactttggtcactgtacattgatgtggtccatgcatgataaatttttctgtttgaattgaaggtggtcctatgggtttgagggtatcctattgaggatgtgtctatctttgttactactatatgcatttattataaatgagtattcgtgaactgagtagaattggtgtgtttaactgtttatgggagagattttggggtcatgtgaaggtgtttgaatttgaaatcatcacgcatattctcttatatgaactaatgagattaaatgccatgaaaggtaggagtaacaaaattgcatactactactagggaaatagatttcctactgtgtttattcacacagttttgatgtt

SEQ ID NO: 15314 - DNA, 1069 bp, Vigna unguiculata
gacgccgctgaaacttgctaactctcacaaccatggccaaggacatagaaaccgaggtacgaactgagttgacccacaaggactactacgacccacccccaaccccattctacgacgccgcagagctccgcaagtggtccttctacagggccctcatcgccgagttcgtcgccaccctcctcttcctctacgtcaccatcctcaccgtcatcggctacaaccaccagatccacgtcggcgactcctgcgaaggcgtcggcattctcggcatcgcctgggccttcggcggcatgatcttcgtcctcgtctactgcaccgcgggcatttccgggggtcacgtaaaccccgccgtcacgttcgggttgtttctggccaggaaggtgtcgctggtgagagcaatcgcctacatggtggctcagtgcttgggagctatatgtggcgtggggctggtaaaggcgtttcagaagagttactacaacaggtacaagggtggcgtgaacttgctctctgatgggtacagtaaaggcgctggcttgggcgctgagattattggcacctttgttcttgtctacaccgtcttctccgccaccgatcccaagagaaaagccagagattcccatgttcccgttttggcaccacttccaattgggttcgcggtgttcatggttcacttggccaccatccctgtcaccggcaccggcatcaaccccgccagaagcttcggccctgctgtcatattcaacaacgagaaagcatgggatgaccagtggatcttctgggttggacctttcatcggtgcagccattgctgcagtctaccaccagtacgtattgagagcacaagcggcaaaggctctcgggtcattcaggagctccccacacctgtaatatggagacagccttaattaattgtgttcgatggatgttggatttgggatttgtacatcctcgtcactgtgtgtatttatttatgtttactatttgcagtaacgtccttcaacagacatgcatgtccatgttaatttgtgtatgcatttttttaagcgttacattacaaaaaaaaaaaaaaa

SEQ ID NO: 15315 - DNA, 834 bp, Arnica chamissonis
tctctctctagcaaacatgacgaaagatgtaccggagcaaggttcgttctccgccaaggactaccacgacccaccgccggcgccgttcattgaccccgaggagctgaccaaatggtctttctacagagccctgatcgctgagttcattgccacccttctgtttctatatattacagtcctgactgttattggctacaagagcacaactgaccccgccttgaacgccgaccagtgcggcggcgttggtatcctcggcatcgcgtgggccttcggcggcatgatctttgttcttgtttattgcactgctggtatctccggaggtcacattaacccggcggtgacgtttggtctgttcttggctcgtaaggtgtccttgattcgagcctttatgtacatggtggctcagtgcttaggagccatttgtggtgtgtgtttggtcaaggctttcaacaaaagcctctacaacaggtacggcggaggggccaacgaactagccgccggctacaataaaggcaccggactgggcgctgaaatcatcggcacgttcgtccttgtatacaccgtcttctccgccaccgatcccaagaggagcgcccgagactcccatgttcccgtcctggcgcctcttccgattggatttgccgtgttcatggtgcaccttgcaaccattccgatcaccggaaccggtatcaaccccgccaggagtcttggagccgcggtcatttacaacaaggacaaagcgtgggatgatcagtggatattctgggtgggaccgtttgtcggagcagcgattgcagccttctaccaccagtttatattgagagcaggtgcagt

SEQ ID NO: 15316 - DNA, 1247 bp, Trifolium pratense
ttatattttagacctcttttcctaaaaagtggaggattaaaaccaaaaataaaactaagtactagtattaaacagttcaattccctgtttcatacgcaaagcaacatttcacatgtattgttgtataaaaaaccacacttacttcactccctcaacattatcctaaaaacagagcaacccttacaaacaccactctctaacttcaatggcaaaagactttgaaaccgaacctcaagctggtggtggtttaccaaacaaggactaccaagacccaccaccagctccactcttcgacactaccgaattcgcccaatggtccttctacagagccctcattgccgaattcgtcgccactctcctcttcctctacgtcaccgttttaaccgtcattggctacaactcccaaactgatccagctcataacggcacccattgtgacggtgtcggtatcctcggcatcgcttgggcctttggtggcatgatttttgtcctcgtctattgcactgccggcatatcagggggtcacataaatccggcggtgacatttgggctatttctggcaaggaaggtatcattgataagagctgtattatacatggtggcacagtgtttaggagcaatatgtggggttggattagtaaaagcttttcagaaaagttactataacagatacaaaggtggtgctaacatgttaaatgatggttatagtaaaggaactggtttaggtgctgagattattggaacttttgttcttgtttacaccgttttctctgcaaccgatccaaaaagaagtgctagagattctcatgttcctgttttggcaccacttccaattgggtttgctgtgtttatagttcatcttgctacaattcctatcactggaactggtatcaatccggctagaagttttggtgctgctgtgatttacaacaatgagaaagcttgggatgaccaatggattttctgggttggaccctttattggtgctgccattgctgcaatttaccaccagtttgtgttgagagcacaagcagttaaggctttgggttctttcaggagttcttcaaatctgtaatacaatttcatgtgcccaaattacaaagaagtttaatcacttaattgtatggttagacatggtttgtattggaattctattactatgtatgacattgtttaattatggtttaattaattaatttatgtactttaattttgtgttaaatttgatttcatcatttgtcttaaat

SEQ ID NO: 15317 - DNA, 1126 bp, Solanum lycopersicum
atcaaatcaaaacaatttcattttttctttagcaaaggaaagatgactaaagaagtaacagatttttcagcaaaagactatactgaccctccaccagcgccattagtagactttgaagaattaagacaatggtcattttacagggctattattgctgaatttatagccactttgttgttcctttatgttactattttgacagtaattggttacaaacaccaagcagatgtagatgctggaggtgatgtttgcggtggagttggtattcttggtattgcttgggcttttggtggcatgattttcattcttgtctactgcaccgccggtatctctggaggacacatcaacccagcagtgacatttgggctgtttttggcaagaaaagtatcactaatcagagcagtattgtacatggtagcacaatgtttgggtgccatttgtggtgttgggtttgtcaaagcttttcaatcagcttattataatagatatggtggtggtgttaatgtcatggctggtggtcatagcaagggtgttggattaggtgctgaaatcattggtacctttgttttggtctacactgtcttctctgccactgaccccaagaggaatgccagagactcccacgtacccgtgttggcacctcttccaattggatttgctgtgttcatggtacatttagccactataccagttactggaactggcattaatccagctaggagttttggtgctgctgttattttcaatggtgacaaggcgtgggacgaacattggattttctgggttggtccatttattggagcgttcatcgcggccttctaccaccagtttgtcctccgtgcaggcgcaattaaagctctaggttcattcaggagcactgcctgatttctaatttcatcaatccaatgaataagaagaagaaaaaaaaatgtacataataaggacaaaaaagtgtttgtttttttatcctatgaattcgccttctcttttgtgtatttgttttcccatcaaatcttgtttgtatctattattaaacttaaatgttgtgttacaaagtttaagttcgatcaatagtttcaactcacattgttgtaactgaaatcgtctctttaaaattttcaaattt

SEQ ID NO: 15318 - DNA, 1420 bp, Cajanus cajan
cgactccatccccactccacagagaaagacagagtgctagtagaatttagtagaaatggcgaaagacgttgagcaagtgacggagcaaggtggcgagtactcggccaaggactacacggacccacctccggcgcccttgatcgaccccgaggagctcaccaagtggtccttgtacagagccgccatagccgagttcatagccaccctcctcttcctctacatcaccgtcttgaccatcattggctacaagagacagaccgacaccaacattcccggcaacacggaatgcgacggcgtcggcattctgggcatcgcttgggccttcggcggcatgatcttcatcctcgtttactgcaccgccggcatctctgggggacacatcaaccctgcggtgacgttcgggttgttcttgggacgcaaggtgtcgcttgtgagggcgttgttgtacataatagcgcagtgcgccggtgctatcagcggtgctgggttggcgaaggggttccagaaatcctactacaacaggtacggaggtggggttaacctcgtcagcgatggctacaacaaaggaaccgccttgggtgccgaaatcattggtaccttcgttcttgtctacactgttttctccgccactgatcctaagaggaacgctagggactctcatgttcctgtgttagcaccacttcccattgggtttgccgtcttcatggttcacttggcaacaatccctgtcacgggtaccggaattaaccccgcaaggagtttcggtccagctgtcatcttcaacgaggacaaagcctgggacgaccaatggatttactgggttggaccgtttattggagctgccgtggctgcattctaccaccaatatattcttagagctgcagcgatcaaagctcttggatccttcaggagcaacgcttagttaagatcatgacttgttctatgtgtcacccaaattaaaagaataacgtacagttccacttcaagtctgtctacagctcccatccctttggcttttgtgcttactgcttacttacccctgggtttggggcaaaagccgaataccatgggctcttgaatttgtagataagagtgcttttatttatcatgtctagtcaagggtgtatttctatcccttttgttttcaatttcttgtgttatccaatgtgctgctgcatccacattacccaatttttcttttcgtaaatgctgtattttcatcatcatctgctcccgcataaaattcaccacttctcaatgcctccttaattatcacccaccttcaccttagtaatcgacttttacgcacttaattattaattgctgcttctctctcacgccgacacgtttaatcaaatactataactattgctccactcctatttttcaaacacttgaatgtacgtcactacaaaaacca

SEQ ID NO: 15319 - DNA, 1088 bp, Solanum tuberosum
aacaatttctctctctttagcaaaggaaagatgactaaagaagttgaatcagtaacagaaagaggagagttttcagcaaaagactatactgaccctccaccagcaccattagtagactttgaagaactaacacaatggtcattttacagggcaattattgctgaatttatagccactttgttgttcctttatattactattttgacagtaattgggtaccaacaccaagctgatgtagatgctggaggtgatgtatgtggtggagttggtattcttggtattgcttgggcttttggtggcatgattttcattcttgtctactgcaccgccggtatctctggaggacacatcaacccagcagtgacatttggactttttttggcaagaaaagtatcactaatcagggcagtattgtacatggtagcacaatgtttgggtgctatttgtggtgttggttttgtcaaggctttccaatcagcttactacaatagatatggtggtggtgttaatgtcatggctgctggtcataacaagggtgttggattaggtgctgaaatcattggtacctttgttttggtctacactgtcttctctgccaccgaccccaagagaaacgccagagactcccacgtacccgtgttggcaccacttccaattggatttgctgtgttcatggtacatttagccactatcccaattactggaactggcattaatccagcaaggagttttggtgctgctgttatttacaatggtgataaggcgtgggacgaacactggattttctgggttggtccatttattggagcgttcatcgctgccttctaccaccagtttgtcctccgtgcaggcgcaattaaagctctaggttcattcaggagcaatgcctgatttcaaatttcatcaatccaatgaataagaagaagaaaaaaatttgtacataattaagaagaagaaaaaaaagtgtttgtttctttatcctatgaattcccctttctcttttgtgtatttgttttttcatctaatcttgtttgtatctttgaattattattaaagttaatgttgtcttacaaagtttaagtttgatc

SEQ ID NO: 15320 - DNA, 1418 bp, Glycine max
ctttccactcaccccttcaattcactccactttggcacacaacactagctatagtaagctacacttatttgaggttggagaaatatggctaaagatgttgaggttcaagagcaaggaggagagtactctgcaaaagactaccatgaccctcctccagcacccttgttcgacccagaggagctcacacagtggtccttttatagagccctaatcgctgagttcatagcaacccttctcttcctttatgtcaccgtgctcaccattattggctacaaaaggcagactgatgccacgctaggtggcaccgagtgtgatggggttggcattttgggcatcgcttgggcctttggtggcatgatcttcatccttgtttactgcaccgccggtatttcaggaggacacataaacccggcggtgacattcgggctgttcctaggacgcaaggtttcgttgataagggcgttgttgtacatggtagcacagtgtgccggtgctatctgtggcactggattggccaaggggttccaaaaatcatactacaacaggtatggaggtggtgccaactctgttgctgatggctacaacaatggtactgctttgggtgctgagattattggtaccttcgttcttgtctacactgtcttctctgccactgaccctaagaggaacgctagggactcccatgttcctgtactggcaccacttcctattggatttgccgtgttcatggttcacttggctacaatcccaattactggtactggcattaacccagcaaggagtttcggagcagctgtaatctacaacaaggacaaaatctgggatgaccagtggatattctgggttggaccaattgttggagcagcagtggctgcattctaccaccaatacatccttagagcagcagctatcaaggctcttggatccttcagaagcaacgcttaattaattaatcaattaagctaccttaatttgccaacaaggctagctatgagtggtgtttccccggaagaataataatttctatgttgaggagtgccagtgatctgtctctgcagttccctaatttaggctttttcgttttttcctttcatcagctacaattgttggagggtttggaggataaggccaaaaccatagggtcatgcatcaaattgtggataagcatgcttgtgtccaagggtgtattttgtatcccttttgtgtcttttctttttcctttttataatttccatgtatgtattcctcaagtgttccttttcggtcttgtgcatccttagtcatttctgattttactcttcataattaagtattcatcttttcttgtttattatagctttattaatcatcatctatgtatgtaatgtaccttgacttgagtaatatttatatatattaagttgctggtcttttattca

SEQ ID NO: 15321 - DNA, 1002 bp, Glycine max
cacaacactagctatagtaagctacacttatttgaggttggagaaatatggctaaagatgttgaggttcaagagcaaggaggagagtactctgcaaaagactaccatgaccctcctccagcacccttgttcgacccagaggagctcacacagtggtccttttatagagccctaatcgctgagttcatagcaacccttctcttcctttatgtcaccgtgctcaccattattggctacaaaaggcagactgatgccacgctaggtggcaccgagtgtgatggggttggcattttgggcatcgcttgggcctttggtggcatgatcttcatccttgtttactgcaccgccggtatttcaggaggacacataaacccggcggtgacattcgggctgttcctaggacgcaaggtttcgttgataagggcgttgttgtacatggtagcacagtgtgccggtgctatctgtggcactggattggccaaggggttccaaaaatcatactacaacaggtatggaggtggtgccaactctgttgctgatggctacaacaatggtactgctttgggtgctgagattattggtaccttcgttcttgtctacactgtcttctctgccactgaccctaagaggaacgctagggactcccatgttcctgtactggcaccacttcctattggatttgccgtgttcatggttcacttggctacaatcccaattactggtactggcattaacccagcaaggagtttcggagcagctgtaatctacaacaaggacaaaatctgggatgaccagtggatattctgggttggaccaattgttggagcagcagtggctgcattctaccaccaatacatccttagagcagcagctatcaaggctcttggatccttcagaagcaacgcttaattaattaatcaattaagctaccttaatttgccaacaaggctagctatgagtggtgtttccccggaagaataataatttctatgttgaggagtgc

SEQ ID NO: 15322 - DNA, 1106 bp, Arabidopsis thaliana
acaaacacaacatatccacaatacaaaacacaactttcatatataacaaaaaaagttatagaaatggccaaagacgtggaaggacctgagggatttcagacaagagactacgaagatccgccaccaactccgtttttcgatgcggacgagcttaccaagtggtctttatacagagccgtcattgccgagttcgtagccactctcctcttcttgtacatcaccgttttaactgtcatcggttacaagattcagtccgacacaaaagccggtggagttgactgcggcggcgtcggaatccttggcatcgcgtgggcttttggtggcatgatcttcatccttgtctactgcaccgccggtatctcaggtggtcacataaaccctgcggtgacgtttggtttgttcttagcccggaaggtatcgctgattagggcggtgctttacatggtggctcagtgtttgggtgctatttgtggagttggtttcgtcaaagcctttcaaagctcttactatgatcgttacggtggaggagccaactctctagcagacggctacaacacaggcaccggactagccgcagagatcattggaacattcgttctcgtctacacagtcttctccgctactgatcccaaacgtaacgctagagactcccacgttccggttttggcgccacttccgattgggtttgcggtgtttatggtacatttggccactattccgatcaccggaaccggcatcaacccggctaggagtttcggagctgccgtaatctataacaagagcaagccatgggatgaccactggatattctgggtgggaccattcattggagctgcgatagctgcattttatcaccaatttgtcctaagggcttcaggttccaagtcacttggatccttcagaagtgcagccaacgtttgagtttttgccacacaaaaaaaaacctatcataataacaacaattacaaaatggttgtgttattatgtatgtacaaaaattggcaactttgcttgtaaaactatgcactatatttcttcttgtttttctgttttcattgtggtgtaatactttgatatgtgccaatgccaatgtttgtgtactcggg

SEQ ID NO: 15323 - DNA, 1188 bp, Brassica napus
agtggacgctgaggaccggtccggaatctcgggtcgacccacgcgtccgtagttcctaagaagaaacatccattacctataataatacgatatggctaaagacgtggaaggagcagagggattcgcggcgagggactacgaagatccgccgccaactccgtttttcgatgcggaggagctgactaagtggtctttgtacagagccgtcatagccgagttcgtagccactctcctcttcttgtatgtcactgttttgactgtcatcggctacaagatttcctccgacactaaggccggaggcgacgagtgcggaggcgtcggaatcctcggcatctcatgggccttcggtggcatgatcttcatccttgtctactgcaccgccggtatctcaggtggtcacataaacccggcggtgacattcggcttgttcttggcacggaaggtatcgttgattagagcggtgttatacatggtggctcagtgtttgggtgctatttgtggagttggtttcgtcaaagctttccaaagctcttactatgtccgttacggtggaggagcaaactctctagcagacggatacagcacagggactggactcgcggcagagatcatcggaacattcgttttggtctacacggtgttctccgctacagatcccaaaagaaacgcacgagactctcacgttcccgtgttggcaccacttccgattgggtttgcggtgttcatggtacacttggccactattccaatcaccggaaccgggattaacccggccaggagtttcggagctgcggttatcttcaacgagtccaagccgtggaatgaccattggatattctgggtgggaccatttattggagctgccatagctgcattttatcaccaattcgttctaagagcttctggttccaaatccctcggatccttcagaagtgctgccaacgtttgagtttagccacacaaaacaaaacaaaaaagtggttactattatgtctaatttgggcacgtgattttaaaatgtgtcctcctatgtctttttttttgcttctgcttctatttgtgtgaattcaagtcaatggagtgttttatgttttcatcctggcaatttcagtgagtttgttccctgataaaaagtcgattactctgcttctctttattgatctccttttctaaacgatgtgtaaattt

SEQ ID NO: 15324 - DNA, 1257 bp, Phaseolus vulgaris
cctcactcaaacaactacactaccatcttcctcccacattcattctaccaccaatggccaaagacgttgagcaggtcacagagcaacccgaatactccgccaaggactaccacgacccacctcccgcgccgttgttcgaccccgatgagctcaccaagtggtccttgtacagagccgccatagccgaattcatagccaccctcctcttcctttacatcaccgtcttgaccattatcggctacaagagacagaccgacaccagtattcccggtaacaccgagtgtgacggcgttggcattttgggcatcgcgtgggccttcggtggcatgatcttcatcctcgtttactgcaccgctggcatctccgggggacacatcaaccctgcagtcacactggggttgttcctggggcgcaaggtgtcgctggtgagggcgttgttgtacatagtagcacagtgcgccggtgcaatctccggtgctgggttggcgaaggcgttccaaaaatccttctacaacaggtacggtggaggagccaacactgtgagcgatggctacaacaaaggcactgccttgggtgctgaaatcatcggtacctttgttcttgtctacacagttttctccgccaccgatcctaagagaaacgctagggactctcatgttcctgtactagcaccccttcccattgggtttgccgtcttcatggttcacttggctacaatccctatcactggaaccggcattaacccggcaaggagtttcggaccagctgtgatcttcaacaacgacaaagcctgggacgaccaatggatttactgggttggaccgtttattggagctgcggtggctgcattttaccaccagtacattctgagagctgcagcaataaaggctcttggatccttcaggagcaacgcataagaaaattgtccggttaaattatgatttgtcctgtgtcacccaaaacaataacagtgtttcaattcaagtctgtctacaggtccctctcttggagttccttttggcttcttcccttacccgtgggttttgggaaaaccagataccgtggcctcttgaatttgtagataagaatgcttttattatgtcaaccctgtatttttatccctttttcttttccctcatgtattctcttctattctatcatatcaattttctctttgcttgttcatcaaatttaccacttgttacctctgttcccaatgcgttatcaaaaataaatcatcacttgctttctttcacg

SEQ ID NO: 15325 - DNA, 1050 bp, Brassica oleracea
gttcctaagaagaaacatccattacctataataatacgatatggctaaagacgtggaaggagcagagggattcgcggcgagggactacgaagatccgccgccaactccgtttttcgatgcggaggagctgactaagtggtctttgtacagagccgtcatagccgagttcgtagccactctcctcttcttgtatgtcactgttttgactgtcatcggctacaagatttcctccgacactaaggccggaggtgacgagtgcggaggcgtcggaatcctcggcatctcatgggccttcggtggcatgatcttcatccttgtctactgcaccgccggtatctcaggtggtcacataaacccggcggtgacgttcggcttgttcttggcacggaaggtatcgttgattagagcggtgctatacatggtggctcagtgtttgggtgctatttgtggagttggtttcgtcaaagctttccaaagctcttactatgtccgttacggtggaggagcaaactctctagcagacggatacagcacagggactggactcgcggcagagatcatcggaacattcgttttggtctacacggtgttctccgctacagatcccaaaagaaacgcacgagactctcacgttcccgtgttggcaccacttccgattgggtttgcggtgttcatggtacacttggccactattccaatcaccggaaccgggattaacccggccaggagtttcggagctgcggttatcttcaacgagtccaagccgtggaatgaccattggatattctgggtgggaccatttattggagctgccatagctgcattttatcaccaattcgttctaagagcttctggttccaaatccctcggatccttcagaagtgctgccaacgtttgagtttagccacacaaaacaaaacaaaaaagtggttactattatgtctaatttgggcacgtgattttaaaatgtgtcctcctatgtctttttttttgcttctgcttctatttgtgtgaattcaagtcaatggagtgttttatgttttcatcctg

SEQ ID NO: 15326 - DNA, 1355 bp, Musa acuminata
ctgcgatgatgatccaccgatgaggatttggtcggtcaggggcggcatattataaccctaaacctcaatccatcggtagcaagattgcacggagagaaccagctctcctgctgctactgttcgtcacccatggcccataaatagctccaagtctccctccttccaagcgcacagcttacaagtgctactacttgtcctctggttcgcaactgcatcgatggcgaaggataccgaggtggcaggacgcggcgagtacggaggcaaggactacaccgacccaccgccggcgccgctcatcgacgcggaggagctgaccaagtggtcgttgtaccgcgcggcgatcgcggagttcgtcgcgacgatgctgttcctgtacgtcacggtggcgacggtgatcgggtacaagcaccagtcggaccccaacgtgaacccggccgacgccgcgtgtagcggcgtcgggatcctcggcatcgcgtgggccttcggcggcatgatctttattctcgtctactgcaccgccggcatctccggtgggcacatcaacccggcggtgacgctggggctgttcttggcgcgcaaggtctcgctggtccgcgcgttcctctacatggtggcgcagtgcctgggagccatatgcggagtcggcctcgtcaagggattccaggaggcctacttcgtccgctacggtggcggcgccaacgagctcagcgccggctactccaagggcaccggcctcgccgccgagatcatcggtaccttcgtcctcgtctacaccgtcttcgccgccaccgatccgaagcgcaacgcccgtgattcccacgtgccggttttggctcctcttccaattgggttcgcagttttcatggtgcacttggccacgatcccgatcaccggcaccggcatcaaccctgcgaggagcttgggagctgccgtcatctacaaccaggacaaggcctgggatgaccagtggatcttctgggtggggcctttcgtcggtgctgccattgctgcagcctatcaccagtacgtcctgagagcgagcggtgccaaagctatggggtccttcgggagcaatgcatgacgacacctccgtttcctcttctacctcaaccagaagaacaagcctcatctgatgttgatgtcgttgggcatcaactcatttcttcaccttcatgaacgcatttgggtgctgtgtcatgtttctctgcatttctcttccacttcaccttgtttgcatcatcaagaatgtactcctaaagtgaagatctatcaagtgtcgtcctttttgtcatcttcacacgctctggtgattgataggctcaatcaataaaaaggggtcatttctagcttctcca

SEQ ID NO: 15327 - DNA, 946 bp, Cirsium arvense
actcaaatttagagttttggacatggccaaagaatagatgttgtggtaatgaatacagtgcaaaagattaccaagaccctccaccggcagccttttttgacgcccaagagctcaccaaatggtcattttacagagccatcattgctgagttcattgccaccctcttgttcctttacgtcatcgtctccactatcatcggccacaaatcccagtccgtctccgaccaatgtggtggcgttggaatcctcggcatcgcctgggccgtcggtggaatgatcttcgtcctagtttattgcaccgccggcatctccggaggacacattaaccctgccgtcacatttggtttgttcttggcaaggaagatcacccttccaagggcggtgatgtacattgtggctcaatgcttaggtgccatctgtggttgtggtctggtgaaggctatccaaaacactaactatgataatcacggtggtggtgccaacgagctcgcagatggctatagtaaaggcacaggtttgggtgccgaaatcatcggcacctttgtcctcgtctacaccgtcttctcagccactgatcctaaaagaaatgcccgcgattcccatatccccgtgttggcacctctccctatcgggtttgctgtgttcttggttcacttggccacaatcccaatcactggcacaggaatcaacccagctcgtagtttgggtgccgccgtcatctatgggaaagacaaagcctgggatgatcaatggttattctgggtgggaccgatgatcggtgcagccatcgcggccttgtaccaccagtatgtattaagagcgggagcagtaaaagctcttggatccttcaggagtaatgcctaaaagagatctagatctagatagagaatatggagaggttacagaattttccatgttacgatgagacttttctataagatgatcct

SEQ ID NO: 15328 - DNA, 1107 bp, Nicotiana benthamiana
gactaaagaagtagaggtagcaacagagcagccaacagagttttcagcaaaagactatactgaccctccaccagctcctttagtagacttcgaggagctgacacaatggtcactttacagagctgttatagctgagttcattgccactttgcttttcctttatgttactgttttgactgtgattgggtacaaggtccagtcagatgtcaaagccgacggtgatatctgtggcggcgttggtattcttggtattgcttgggcttttggtggcatgattttcattcttgtttactgcaccgccggtatctccggaggacacataaacccagcagtgacatttgggctgtttttggcaagaaaagtatcattgatcagagcagtattgtacatggtggcacagtgtttgggtgcaatatgtggtgtgggttttgtgaaggcattccagagtgcttattatgttaggtatggtggaggtgctaatgtcatggctcctggccataccaaaggtgttggattagctgctgaaattattggtacttttgttttggtttacactgtcttctctgctactgaccctaagagaaatgctagagactcccatgtccctgtgttggcaccacttccaattggatttgcggtgttcatggttcacttagccaccataccaattactggaactggcatcaatcctgctaggagttttggtgctgcagttatttacaatcatgacaaagcttgggatgaacactggattttctgggtcggtcccttcatcggagcattcgccgccgccgtctaccaccagttcatcctccgtgctggtgctatcaaagctcttggttccttcaggagcaatgcctaaaaattttcaatccaattgaataaaatcagccatgaaaaattgtagatatttccctatgggaaaagtaaaaaaaaatgttgtgctgtttgttttcctatgaatttccctcttttgtgtatttttctacttgtaatcttcatttccctttttttttatttttacttgctctcttttttcaatctagtctcttgtatctttgaattattgttgtttcctagtaatttaaactaatgtttcggcttctc

SEQ ID NO: 15329 - DNA, 1253 bp, Allium cepa
taacagcacaaactccgtctctttcccatcctacccatccatacactgatacacacaactcacgctcctataaagccaattactcatttctcttccattattctactttactcaactcacctaattaattaaccaacaatggcaaacaaggaagtagatgtacccgagacaaaagacacccagttcaccgcaaaagactacacagacccgccacccgcgccgcttttcgacatgggtgagctcactaagtggtcactctaccgtgcagtcatagcagagttcgtcgccactctgctgttcctctacatcacggtagccacggttatcgggtacagtcaccagagcgatgctaccatacccggtaacactgatgctcactgtagcggtgtcggcgtgcttgggattgcctgggctttcggtggcatgatcttcgttctcgtttactgcactgctggaatttctggtgggcacataaacccagcagtgacgttcgggcttttcctagcaagaaaagtgtccttaataagggcgcttctgtacatgatagcacagtgtttaggtgcaatatgtggtgttgggtttgtcaaagcgttccagtctgcctactattctaaatatggaggtggtgccaatagtctaaaagatggttacaataaaggaactgggcttgcagctgaaattataggaacttttgtgttggtctacactgtgttcgctgctactgaccctaaacgtagtgctagagattctcatgtgccggtgctggctccacttccaatcggatttgctgtattcatggttcatttggcaaccattccaattactggtactgggattaatcctgcaagaagttttggagctgctgttatttacaacaaggataaagcttgggatgaccagtggatattctgggttggtccattcattggggcagcaattgcagcagcttaccatcagtatgtgctaagagcaggagctgtgaaggcacttggttcttttaggagcaatgcttgattgtttccggtcaaactgcatgcagtgaatcccctgtaataattatcagaaacagtttgaattggttcatgttgtgattgtgttgaaaacagacatagaagtctaatatttgatttctttgttgtttttcctttcatttgtagagtttgtctttgccttccagtgtagaatgtgaatctgtaatggagtgttttttcccccactatttgtcatttctaatcaagaaaaaaatggctttt

SEQ ID NO: 15330 - DNA, 1240 bp, Podocarpus macrophillus
caactctctcttttactagaattttcttctgctttctgggcataaatccaagggcacagacgtcaaagaaagtgccctttaatcactttagtagttagtaatcaatctgtgagatttttttctcagagccaggctttttgcaatggccaaagaaggagggaaagaagtggagcagcaaggatttgcagccaaggactacacagatcctccaccggctccttttttggattttggagagttcaaattgtggtctttctaccgtgctgtaattgctgagttcattgcaacattgcttttcttgtatataactgttgcaactgtaattggccataaaagaaacagtgatggctgtggtagtgttgggcttttgggaattgcttgggcttttggtggaatgatcttcgttttggtgtactgtactgctggcatctcaggtgggcatatcaatccggcagtgacatttgggctatttttggcaagaaaagtgtccttcccaagggcagttctgtacatggtagcacagtgtttgggagcaatttgtggttgtgggcttgtgaagggattccagaaatcattctacgagagatatggaggaggagccaacactgtagcccatggctatacaaagggtgtaggactgggtgctgagataattggcacatttgtgttggtatacacagtgttctctgccacagatcccaagcgcagtgctcgagactctcatgttcctgtgttggctccattgccaatagggtttgcagtgtttatggtgcacttggccacaataccaattacaggaacaggtatcaaccctgcaagaagttttggggcagctgttgtttatggccaccaacaaccctgggatgaccaatggatattttgggtaggaccatttgttggagcagctgtggcagcattttatcatcagcagatattgagggcagcagccataaaggcactgggatcgttccgtagcaacccataaaaaaatgtagcttggtttttcagttcatgtatttgttattttaggtcaataaaagtaaccaacaattcctaaaagtcacagtggatcctgttgcgtttaagaggtggattgtttgggcccataggtttatgaaggtttctgtagatctgtaaatgtaaatgggctttgaatttgggcttcagatgcaacgctagtatttgtgtaaaggacatcttttcgtttattggaaggtaatttttattattagcaagtacc

SEQ ID NO: 15331 - DNA, 1404 bp, Taxus baccata
ccagttcaatcagtgcagagtttagtttttccgttgtttgaagggttttgattgattgtgagccatggccaaggaagtggatcagccagggtttgcaccaaaggattatgtagacccacctcctgcagctctggtggatttcaacgagttcaagctctggtctttctacagggctctgattgcagaattcattgcgacattgttgtttttgtatatcactgttgccactgtgatcggtcacaaaagaaatgctgataattgtggaagtgttgggcttctcggtattgcctgggcttttgggggtatgatctttgtactggtttactgcactgctggtatttctggtggacatattaaccctgctgtgacttttggtctgtttttggccaggaaggtgtccttgccaagggctgttctgtacatggtagctcagtgcctaggtgccatctgtgggactgggcttgtaaaggcattccagaagtctttctatgatacttatggaggtggggctaactctgtggctcctggttactctaagggcgtggggttggctgctgaaatcatcggcacctttgtgttagtgtacactgttttctctgcaactgaccctaagcgcagtgccagagactcccatgttcctgttttggctccattgcctattgggtttgctgttttcatggttcacttggccaccatccccatcactggaactggcatcaaccctgcaaggagctttggagctgctgtgatttatggtcatcagaagacctgggatgaccattggattttctgggtaggtcccttcattggagctgcagtagctgctttataccaccagttcattctaagggcaggagccatcaaggctttgggatcgttccgcagcaaccccaatgtgtaatttagtatcactgttgcagtaacagttgcttgtgttagtctgtaggtctagaataagtaattgccatgaaagggtatgtaaaccactggatgagaaccagggagcagtatatggacaagggagttatgggtacaagcttgtaaagttttctcacaaactcttagttggtattagtagtagtagtagttgttctgaattgcagcaggacagcaacattggtggaaggtttttctgctctctggattggatctagtgctgcagcagcagcaccacatgagtctattgaagaaccagcaaccccctctttaacagagatgggggaattgttcatgaaccatatgtttcttccttccctgttttacttcagcttagcaggggaatccagtgtagttttttttttcaatcactgtaattatactgttcggtgtgtcctcttcttctacaagcaggaatatgtggacaggtgtgtataagtgattcatctggaattagaaacctctttc

SEQ ID NO: 15332 - DNA, 1143 bp, Eutrema parvulum
acaaaccaagagctagctcactctatataaagaggcattttattcttcttctcacaaccacaacaaccagaagcaaaacagttattaagaaagttcagaaacatcatccattacatacatggcgaaagacgtggaaggagcagaaggattcacggcgagggactacgaagatccgccgcctacaccgtttttcgacgcggaggagctgacgaagtggtctttatacagagcggttattgctgagttcgtagccactctcctcttcttatatgtcaccgttttgactgtcatcggctacaagattcagtccgacacaaccgccggtggagtcgactgcggcggagtcggaatcctcggcatcgcgtgggctttcggtggcatgatcttcatccttgtctactgcaccgccggtatttcaggtggccacatcaaccctgcggtgacgttcggcttgttcttggcacggaaggtatcgctgattagggcggttctttacatggtggctcagtgtttgggtgcgatttgtggagttggatttgtgaaggcctttcaaagctcttactacgttcgttacggtggaggagccaactctctcgccgatggatacaacacaggcactggcctcgccgcagagatcatcggaacattcgttctcgtctacactgtcttctccgccactgatcccaaacgcaatgctcgagactctcacgttcccgtgttggcgccacttccgatagggtttgcggtgtttatggtacacttggccactattccgatcaccggaaccggaattaacccggcgaggagtttcggagctgcggttatcttcaacgagtccaagccgtgggatgaccactggattttctgggtgggaccattcatcggagctgcgattgctgcattttatcaccagttcgttctaagggcctcaggttccaagtccctcggatccttcagaagtgcggccaacgtttgaatttagccacaaaaacaaaaactgtggctgctattatgtagaaattgggcacgtgattatataaacatgccctgtttccctcttttgtctttttccgtcttatcttctgcttatatttgtgtgaattccaattaatcaagttttaaggattgcatctctagcagcgt

SEQ ID NO: 15333 - DNA, 1191 bp, Festuca arundinacea
cacacagcgctagcttctgccatggcaaaggacgtcgaggcggcgacaggggagtacacggcaaaggactactcggacccgccgccggcgccgctcttcgacgcggaggagctgaccaagtggtccctgtaccgggcggtgatcgccgagttcgtggcgacgctcctcttcctctacaccacggtggcgaccgtaatcgggtacaagcaccagtcggacccgaccgcgacacccacggacgcggggtgcagcggcgtgggcatcctgggcatcgcgtgggcgttcggcggcatgatcttcgtgctcgtctactgcaccgccggcgtgtccggcgggcacatcaacccggccgtgacgttcgggttgttcctggcgcgcaaggtgtcgctggtgcgcgccgtgctctacatcgtggcgcagtgcctgggcgccatctgcggcgtggggctcgtcaaggggttccagagcgccttctacgtgcgctacggcggcggcgccaacgagctcagctccgggtacagcaagggcaccggcctcgccgcggagatcatcggcaccttcgtgctcgtctacaccgtcttctccgccaccgaccccaagcgcagcgcccgtgactcccacgtccccgtgctggctcctctgccaatcggcttcgccgtgttcatggtccacttggccaccatccccatcaccggcaccggcatcaacccggccaggagcctgggagctgctgtgatctacaacaacgagaaggcctgggatgaccactggatcttctgggtggggccattcatcggcgccgccatcgccgccgcctaccaccagtacgtcctgagggccagcgccaccaagctcggctcctctgcctccttcaacaggggctagttcgaccgaccggccgccgtctcgatgatcggaggcactgaactgtagatatatcagaggacagaggggcctccagtgtgctgctgttcgggtcctgaattgtgctggtcttgctcgtacgcgtctgtatcttcctgagctcgccgcgtttgctgcttgtttttctaccgatcgagtgtgtttctgtttacagtttacttccatgtaaactatctatgaatgatgatgtatgcatctgggatctgggtaaccagggaaaaatatgaaatgcaatgtgaacgtacggttcggtttgtacctcgtgcc

SEQ ID NO: 15334 - DNA, 971 bp, Raphanus sativus
ggaaacattaaaactcatctatctcttgctctctctgtctctcatcatcatcatcatctttggccatggcaaaggacttggaggtgcaagagaggggagcaacggcggtgagagattacgttgatccgcctccggcgcctttgttagacatggaggaacttgggaagtggtcgctctacagagcggtcatagctgagtttgtggcgacacttctcttcctttacgtctcagtcctcaccgtaatcggctacaaagctcagaccgacgcaaacgcgggaggagttcattgcggcggtgtaggaatattggggattgcgtgggctttcggtggaatgatttttgttctcgtttactgtaccgccggtgtctccggtggtcatataaatccggctgttacgttcggattgttcttagctagaaaagtctcattggtgcggacagtgttatacattgtggctcagtgccttggtgccatctgcggttgcggtcttgtcaaagcattccaaagttcttactacaccagatatggaggtggagctaatgagctagctgacggctacaacaaaggaactggactcggtgcggagatcatcgggacatttgtcctagtctacaccgttttctcggccacagatcccaagcgaagcgcacgtgactctcacattcttgttttggcgccacttcctattggttttgccgtcttcatggttcacttagccaccattcccatcaccggaaccggaatcaaccccgctcgtagcttcggagctgccgttatctacaaccaagaaaaggcctgggacgaccaatggatcttttgggtgggaccattgatcggggcagccgcagctgcgttataccatcagtttgttctaagagcagctgggattaaaagtcttggctcctttaggagctctgcttaattttaattgtttaaattaagccacaagttgatctttattcaaaatgat

SEQ ID NO: 15335 - DNA, 1148 bp, Brassica juncea
tcatcatctttagccatggcaaaggacttggaggtgcaagagggcggagcaatggcggcgagagattaccaggatccgcctccggcgccattgtttgacatggaggagcttaggaagtggtcgctctatagagcggtcatagctgagttcgtggcgacacttctcttcctttacgtctcaatcctcaccgtaattggctacaaagctcagaccgacgcaagcgccggaggagttgattgcggtggcgttggaatattgggtattgcgtgggctttcggtggaatgatctttgttctcgtttactgtaccgccggtatttctggtggtcatataaatccggctgtgacggtgggactgttcttagctagaaaagtatcattggtgcggacagtgttatacattgtggctcagtgccttggtgccatatgtggttgcggtctggtcaaagcattccaaagttcttactacaacagatatggaggtggagccaaccagcttgccgagggctacaacaaaggtaccggactcggtgccgagatcatcggaacatttgtccttgtctacaccgttttctcggccaccgatcccaagcgaagtgcacgtgactctcacattccagttttggcgccacttcccattggttttgccgtcttcatggttcacttggccaccattcccatcactggaaccggaatcaaccccgcccgtagcttcggagccgcagttatctacaaccaagaaaaggcctgggacgaccaatggatattttgggtgggaccaatgatcggagcagcagctgctgcgttataccatcagtttgttctaagagcggctgggatcaaaagtcttggctcctttaggagctctgcttaattttaattgtttgaattgagccacaagttgatcttaaatcaaaatgatgattaccactatatattaagcggaagctacgtgtatcttttatttaattttatgttctgtttttaaatttcaaggaatttcccattggttgtaaatgtggttttaattaatgttgctttaaaacactaattatgggcttttaagtaatttatgtcatcaaaacatacttgggagcggttcatatcactgattcatattacaacatcatcaccagaaaggtctttttt

SEQ ID NO: 15336 - DNA, 1241 bp, Echinochloa colona
atcctgctcctccagggcaagctagccgatcagcagcagcagtgagcttgcattggtgtgatcgagcagaatggccaaggacatcgaggccgcggcggcggcggagggcggcgagtacacgggcaaggactacagcgacccgccgccggcgccgctgatcgacgcggaggagctgaccaagtggtccctgtaccgcgcggtgatcgccgagttcgtggcgacgctgctcttcctctacatcacggtggccacggtgatcgggtacaagcaccagacggacgcggcggcgtcgggcgccgacgcggcgtgcggcggcgtcggcgtcctcggcatcgcctgggccttcggcggcatgatcttcatcctcgtctactgcaccgccggcatctcaggtgggcacatcaacccggccgtgacgttcgggctgttcctggcgaggaaggtgtccctcgtccgcgcggtgctctacatcatcgcgcagtgcctgggagggatctgcggcgtggggctcgtcaagggcttccagagcgcctactatgtgcgctacggcggcggcgccaacgagctcagcgccggctactccaagggtaccggcctcgccgcggagatcatcggcaccttcgtgctcgtctacaccgtcttctccgccaccgaccccaagcgcagcgcccgcgactcccacgtcccggtgttggctcctctcccaattggattcgccgtgttcatggtgcacctggccaccatcccgatcaccggcaccggcatcaacccggccaggagccttggagccgcggtcatctacaataacgacaaggcctgggatgaccaatggatcttctgggtgggcccgctgatcggcgccgccatcgccgccgcctaccaccagtacgtgctcagggccagcgccgccaagctcgggtcctaccggagcaacgcctaagtccggcacggcggcgaggagggggtcaccgaagtgtagatacgcgcacaaccgaggcccgcctccatccgttcagatctccaaattctctgctgcctgttcgtagtagtaatcgtgtcatgctcatgcacgcgggccggggctccgcgccgtgtttcgaagtgttccggtgtcccgccgccacgttcgcttgctgctgtacgttcttcttggaaagaaaagtgtgatatatctttgcttcctgtatgtatgtattccgtatggataatttggaaatgagttatgtgaggttttattatca

SEQ ID NO: 15337 - DNA, 1206 bp, Allium cepa
acagccaccacagcgcatccttaaatacacactcatttatcctcttccccctactaaaaattaaacagctttattccttcctcctttttccttccctgttcaatctttttaagcgatggctaaagatgtagagacggcggaaaaaggcagcggcgagttcaggaccaaggactacacggaccctccgcctgctccttttttcgacatggaggaattgaccaagtggtcgctttaccgggcggtgattgcggagttcatagccacgctgttgtttctgtacataacggtggcgacggtgattgggtacagtcaccagagcgataagacgctgcctggaaacaccgacgcggcgtgcagcggcgttggcgttcttggaattgcttgggcttttgggggcatgattttcgttcttgtttactgcaccgctggaatctctggtgggcacattaacccagcagtgacattcggcctattcctagcaagaaaagtatccctcatccgagcaatcctatacatgatcgcccagtgccttggcgccatatgcggcgttggctttgtaaaagccttccaaagcgcatactacagcaggtacggaggtggagcaaacatgctaagcgttggctacaccaaaggaacagggctcgctgctgaaatcatcggcacttttgtcctagtctacaccgtgttctctgccactgaccctaaacgaagcgctcgcgattcccatgttccagttttggccccacttccaattggctttgctgtgttcatggtccacttggctaccattcctattactggaactggcatcaacccagctagaagctttggagctgcagtcatctacaacaaagacaaagcttgggatgatcattggatcttctgggttggtcccttcattggtgcagctatcgcagcagcatatcatcagtatgtactaagggcaggtgcagtgaaggctttgggatccttcaggagcaacccatgatattgatgatggtctactgcttagaaatatgaagaattgtagatatcatgaagagtgaaaatggtgggggatctgtttgccatgtttgttgattcccctagttgttcatatcatcatttcattatccttctttctcttttgcatttcaatcattgagtgccatttcatttgaacttatctgcatcctatgtttttctcttcttttcaaaaacacacac

SEQ ID NO: 15338 - DNA, 1104 bp, Allium cepa
actaaaaattaaacagctttattccttcctcctttttccttccctgttcaatctttttaagcgatggctaaagatgtagagacggcggaaaaaggcagcggcgagttcaggaccaaggactacacggaccctccgcctgctccttttttcgacatggaggaattgaccaagtggtcgctttaccgggcggtgattgcggagttcatagccacgctgttgtttctgtacataacggtggcgacggtgattgggtacagtcaccagagcgataagacgctgcctggaaacaccgacgcggcgtgcagcggcgttggcgttcttggaattgcttgggcttttgggggcatgattttcgttcttgtttactgcaccgctggaatctctggtgggcacattaacccagcagtgacattcggtctattcctagcaagaaaagtatccctcatccgagcaatcctatacatgatcgcccagtgccttggtgccatatgcggcgttggctttgtaaaagccttccaaagcgcatactacagcaggtacggaggtggagcaaacatgctaagcgttggctacaccaaaggaacagggctcgctgctgaaatcatcggcacttttgtcctagtctacaccgtgttctctgccactgaccctaaacgaagcgctcgcgattcccatgttccagttttggccccacttccaattggctttgctgtgttcatggtccacttggctaccattcctattactggaactggcatcaacccagctagaagctttggagctgcagtcatctacaacaaagacaaagcctgggatgatcattggatcttctgggttggtcccttcattggtgcagctatcgcagcagcatatcatcagtatgtactaagggcaggtgcagtgaaggctttgggatccttcaggagcaacccatgatattgatgatggtctactgctttagaaatatgaagaattgtagatatcatgaagagtgaaaatggtgggggatctgtttgccatgtttgttgattcccctagttgttcatatcatcatttcattatccttctttctcttttgcatttcaatcattgagtgccatttca

SEQ ID NO: 15339 - DNA, 1135 bp, Eutrema halophilum
ccatttttttctaaataataatcatattaaatggcgaaggacgtggaaggagaaggattcacggcgagggactacgaagatccaccgcctactccgttcttcgacgcggaggagctgaccaagtggtctttatacagagcggttattgctgagttcgtagccactctccttttcttatacgtcaccgttttgactgtcatcggctacaagattcagtccgacacagccgccggcggagtcgactgcggcggcgtcggaatcctcggcatcgcttgggctttcggtggcatgatcttcatccttgtttactgcaccgccggtatttcaggtggccacatcaaccctgcggtgacgttcggcttgttcttggcacggaaggtatcgctgattagggcggttctttacatggtggctcagtgtttgggtgcgatttgtggagttggatttgtgaaggcctttcaaagctcttactacgttcgttacggtggaggagccaactctctcgccgatggatacaacacaggcactggcctcgccgcagagatcatcggaacattcgttctcgtctacactgtcttctccgccactgatcccaaacgcaatgctcgagactctcacgttcccgtgttggcgccacttccgatagggtttgcggtgttcatggtacacttggccactattccgataaccggaaccggaattaacccggccaggagtttcggagctgctgttatcttcaacgagtccaagccgtgggacgaccactggattttctgggtgggaccattcatcggagctgctattgctgcattttatcaccagttcgttctaagggcctcaggttctaaatcccttggatccttcagaagtgcggccaacgtttgaatttagccacaaaattaacaacaatgataacaacaattacaaaatggttgttatttattgttatgatgcatgtacaaaattggcaacttttgtttaaaagtaagctctgttttctttctcttttctaatttctggtttcattgtggtgtaatattttcatgtgaatgtttgtgtactcggggaaaaacaatcaatgaaatcaaattgttttttgccttctttctaattttttagtatcatcaatattttc

SEQ ID NO: 15340 - DNA, 1448 bp, Vinca minor
ctttctcctatctcttaattttccatttctgggcttctcttcctagcaccaaatattcttgtttgagtgcacatttttgtgttttcttgaacttatttttggtaaattatggctaaagaagtggggggagtagcagagcaaggttcatttacaacaaaggactaccatgatccaccaccagcagccttctttgatcctcatgaattggtaaaatggtcatttcacagagctctaattgctgaattcatagctacccttcttttcctttacattactgtcctcactgttattggttacaaagcccaaactgaccatgatcttggtaatactgatccttgtaatggtgtgggtattcttggtatttcatgggcctttggtggcatgatctttgttcttgtctactgcactgctggaatttctggtgggcacataaacccagccgtgacatttgggctattattggctcgtaaagtatcactaatacgagcagtgttatacatggtggcccaatgtctaggagccatatgtggcgttggccttgttaaggctttccaaaagtcttactttgtcaaatatggcggcggtgctaatgaactccaagtcggacacagcgtcggagttggtttggcggctgagatcatcggaacttttgttcttgtctacactgtcttctctgctactgatcctaagaggaatgctagagactctcatgttcctgtattggcaccccttccaattggatttgcagtattcatggtacatttggctacaatcccagtaactggcactggtattaaccctgctagaagtcttggatctgctgtcatctacaaccacaagaaagcttgggatgaccattggattttctgggttggaccattcattggggcagcaattgcagcattctaccaccaatttatcttgagagcaggagctgctaaggcacttggctcattcagaagtagctcacatgtttgatcaaaatttcagccttgagaggggaaaatgtgatatttcaaataaattgagagagaagaattattatttttagtgtaatttgtgtttacacaagtctcttttgggtactagttgtggtggggtggatgatagttcttcctctcttaagaatgttcagggttcgaaatgtggtcatagtatttgtatgaagttattgatgttggaagagtcgctcatttcttgagcctctgcagcgtccagtccaatatagattagtcagatctgtcaagtttagacattggtgatctaaaaaaaaaaaaaggtctcttttgggtgctaattattattatgctcctcaattattattatgttgtctaccaaaagatcatgcttgatggggatgtaatttgtactcaattagagccattagaagtgtagataaagggtatttcttttgtcctttagctagactatttggttccttctatata

SEQ ID NO: 15341 - DNA, 1201 bp, Manihot esculenta
gctctctttcttctttataagcactgtcacctaatctcttcacccatcaatcactcgcttacaacaccaccttcaagctcacaaaacacagcttttgcttttgggtttgagagagagagacagagagagagagacagagagaggatggctaaggacgtcaccgaagaaacgcagcctacccatggcaaggattatgttgatccaccaccagctcctctcattgacatggctgagatcaagctatggtctttctaccgtgctcttatagctgagtttatagccactcttcttttcctatacattaccgtagctactgtgattggctacaagaagcaaactgacccttgtggtggagttggccttctgggtattgcatgggcctttggtggcatgatattcatccttgtttactgcactgctggtatttctggtggtcatattaacccagcagtcacctttggactgttcttggcgaggaaggtgtcactgatcagggctgtggcttacatggtggctcagtgcttaggtgcgatttgtggcgtcggattggtgaaggcatttatgaagcattcgtataatgggcttggaggtggtgctaactctgtggcacctggctacagcaagggcaccgctttgggtgctgagatcatcggcacttttgtacttgtctacactgttttctctgccactgaccctaagaggagtgcacgtgactctcacgtccctgtgttggctccacttccaattggttttgctgtgttcatggtccacttggcaacgatccccatcactggaactggtattaatcctgctaggagctttggagctgctgttatctacaacaatgacaaagtctgggatgaccattggattttctgggttggacctttcattggagcacttgcagcagctgcatatcatcaatacatattgagagctgcagccatcaaggctttgggatctttccgcagcaaccccaccaactgatgaaggagaaatccccgccaacaagaaaaagaatggaaaaaagaaaaagcttgtctatctctgcacttccttcttctatctccaattgtttgtttgtgtgtattatgatgaggattatgatgataactcttctttttccacttcaatttttaatctttctttgttagtctctgcctgtgtatcattgttaatgagtagtgctcttttcctttct

SEQ ID NO: 15342 - DNA, 1419 bp, Arabidopsis lyrata
ctctcctctcctactttacttatttcctattcaaagcaagaaatcgaaaaaggacctcaaactttttttctatccttcatttttctctcctcccatcagcatcatcatgtcctcccataccaatctcccctctcccaaaccagttcctaaaccggatcaccgtatctccggtacatcccaaaccaagaaaccaccgtcttcctccgtcgctcaagaccaacaaaacctaaaatgccctcgctgcaactctccaaacacaaagttctgttactacaacaactacagtctctctcagcctcgtcacttctgcaaatcttgtcgccgttactggacacgtggcggcgctttaagaaacgttcccatcggtggtggttgccggaaaaccaaaaaatccatcaaacctaattcctccctgaacacacttccttcgtcttcttcttctcagaggttcttctcttcaatcatggaagattcatccaaattcttccctcctccgacaacaatggattttcagctcgctggcttatctctcaacaaaatgaacgatcttcaacttttgaataaccaagaagttcttgatcttaggcccatgatctcctcgggtcgagaaaacacacccgttgatgtcgggtcgggtttatccttaatgggttttggagattacaacaacaaccattcaccgacggctttcacaaccgccggagcaagcgacgggaacttagcttcttccatagagactttgagttgtttaaaccaagatttacactggaggcttcagcaacagaggatggcgatgctttttggtaattctaatgaagaaactgttgttgtggagaggccacaacctattctttatcggaatcttgagatcgtgaactcatcatcgccgtcgtctccgacgaagaaaggagataatcagacagagtggtattttggtaataatagtgataatgaaggagtgattagtaataatgctaatacaggaggaggaagtgaatggaacaatggaattcaagcttggactgatcttaatcattataatgctttgccttgattcttggtaagtttaagaaactatatatatatatatatatatatatatctataattttatatatatatttgttatgtgtgttgtgatgtaatgccaaaactatttatgtttgtagttttttctttttggggtgttcttttcgttgtcgttgttggtttagtactttaagtttcaatttgtaaacaaaaaaacaaaattgggggagatattcaagaatggagagagatacttacataatatattctatatatttgtgatttgtctataattaatttattttcaagttggaacagaatttactgtgtttaattattgaaaagctcttggtttggtggtgaaatgttcacttaatgacttattggatg

SEQ ID NO: 15343 - DNA, 1457 bp, Eutrema halophilum
acgaaacccttttaacgactgttcatctctctctctctcttcttctcctactttacttatttccttgaaagcaagaaatcgaaaggaaacaaacttttcttcttcctttttcttctctcgtcccatcatcatcatcatgtcctcccataccaccaatctcccctctcctaaaccggatcaccgtatctccggtacatcccaaaccaaaaaaccaccgtcttcctccgtcgcctctcaagaccaacaaaccctaaaatgccctcgatgcaactcctcaaacacaaagttctgttactacaacaactacagcctctctcaacctcgtcacttctgcaaatcctgtcgccgttactggacacgtggcggtgccttaagaaacgtccccatcggtggcggttgccggaaaacaaaaaaatccatcaaacctaacgccataaccccttcttcttcttcgtctcagaggtttttctcttcaatcatggaagattcctccaaattcttccctcctccgacgacgatggattttcagctcgccggattgtctctcaacaaaatcaacgatcttcaacttttgaacaaccaagaagttcttggcctcaggccagtggagcaggtcgaaaccactcccgttgatgtcggttcgggtttatccttgatgggtttcggggaatacaacagcagtaaccattcaccggcgactttcgcaactgccggagcaaacgacgggaacttagctacttcgatagaaactctgagttgtttgaaccaagatttacactggaggcttcagcaacagaggatggcgatgctttttggtaactctaaggaagatactgttgttgtcgagaggccacaacccattctttaccggaatctcgagatcgtgaactcatcgccgtcgccgacgaagaaaggagagaatcagacagagtggtattttggtaataataatgctaacgaaggggtgattaatagcaatgatagtaataataataataataataattcaggaggaagtgatcattggaacaatggaattcaagcttggactgatcttaatcattataatgctttgccatgattcttggtaagttgaagaaactatataattactaatttgttatgtgtgtgtttatgatgcaatgccaaaaatatttatgtttgtagttttttttttcgttttgtttaggcgttctctgtagtcagcttttgttgttgttgttggttactattttagtattgtaagtttcaatttgtaaacaaaagacaaaaattgggggtggaattcaagaatggagagagatattacaatagattcactaaatttgtgatgtgtctgtacttttaattattctaatgttgaaaaaaatcgaaacaggattttactgtgcttaaagcttaattattgaggttcttggtttgatggtgaagcgttcaaattaatgactaattggatg

SEQ ID NO: 15344 - DNA, 1423 bp, Brassica oleracea
ccaaagtgactttaaaaaaaacacaaacacaaacatatcatattcacatacatacacaatcatttgtataaatatataacaccacacgaaacccttgtaccgactgttcctcaacctctctttctctctattctcctactttacttatttccttcaaacttttctcctctcgtcccatcatcatcatgtcctcccataccaatctccactctcctaaaccggatcaccgtaccaccgggacaccccataccaaaaaaccaccgtcctcctccacctctcaagaccaacaaaccctaaaatgccctcgttgcaactcctcaaacacaaagttctgttactacaacaactacagcctctctcagcctcgtcacttctgcaaatcttgccgccgttactggacacgtggtggtgccttaagaaacgtccccatcggaggaggttgtcggaaaaccaaaaaaacattcaaacctaactcagtaataactccttcttcttcttcatctcagagatttttctcttcaatcatggaagactccaccaagttcttccctcctccaacaacaatggattttcagctcgctggtttgtctctcaacaaaatcaacgatcttcaacttatgaataatcaagaagttcttggccttaggcccatggaccaggtcgagacaacacccgttgatgtcgggtcgggtttatctttaatgggttttggagattacagcaacaacaaccattcaacggggacgttcacaaccgccggagcaaccgacggaaacttagcaacttcgatagaaactttgagctctttaaaccaagatttgcactggagacttcagcaacagaggatggctatgctttttggtagctctaaagaagagactgtcgttgtggagaggccacagccgatactttacaggaatctcgagatcgtgaactcatcgcagtcgccgacgaagaaaggagataatcagacagaatggtattttggtaataataatgatactgaaggggtggctaataataataataatacaggaggaagtgagcaatggaacaatggagttcaagcttggactgatcttaaccattataatgctttgccatgattattggtaagttaaaaggaactatattatgtgatcagatatttaaaattatgtgtgtttcttatgtaatgccaaagaatatttatgtttgtagtatttgttgggttgggtgttctttgtagtcagtttttgttgttgttgttggttactatttagatttataagtttcaatttgtaaacaaaaatttaagaattgagagatatactataatagattctctaaacttgtgacttttctgtactcataattatctcaatgttggaaatattcgaaacatgatttactgtgcttaaagcttaattattcaaaggctctt

SEQ ID NO: 15345 - DNA, 1447 bp, Eutrema parvulum
acgaagcccttgtaccgactgttcctcaatctctctctatctcttctcctacatttacttatttccttcaaaccaagaagaaatcggaaaggaacaaacttttcttcttcctttttttctctcgtcccatcatctatcatgtcctcccataccaacctccactctcctaaaccggatcaccgtatctccggtacacctcataccaaaaaaccaccgtcttcctccggctctcaagaccaacaaaccctaaaatgccctcgctgcaactcctctaacacaaagttctgttactacaacaactacagcctctctcaacctcgtcacttctgcaaatcttgccgtcgttactggacacgtggcggtgccttaagaaacgtccccatcggtggtggttgtcggaaaaccaaaaaatcaatcaaacctaacacaataactccgtcttcttcttcgtctcagagatttttctcttcgatcatggaagattcctccaaattcttccctcctccaacaacaatggattttcagctcgccggtttatctctcaacaaaatcaacgatcttcaacttttgaataatcaagaagttcttggccttaggcccatggagcaggtcgaaacaacagcacccgttgatgtcgggtcgggtttatccttaatgggtttcggagattacaacaacaccaacaacatttcaccggcgactttctcaaccaccggagcaaccgacggaaacttagctacttcgatagaaactttgagctgtttaaaccaagatttacactggaggcttcagcaacagaggatggcgatgctttttggcaattctaaagaagagactgtcgttgtcgagaggccacagccgattctttacaggaatctcgagatcgtcaactcgtcgccgtcgccgatgaagaaaggagataatcagacagagtggtattttggtaataataatgataacgaaggggtgactaataacaatgataataataataacaatacaggaggaagtgatcaatggagcaatggacttgaagcttggactgatcttaatcattataatgctttgccatgattcttggtaagttaaaagaaactatatttatatgatcaatatttaaaattatgtatgttcgtgatgtaatgccaacaaatatttatgtttgtagtttttgttttctttgggtgttatttgtagtcagcttttgttgttcttgttggttactactttagtattataagtttcaatttgtaaacaaaaaccaaattggggggtgaaattgaagaatggagagagatactataatagattctctaaatttgtgatttgtctgtattttaaattatttcaatgttgggaaaattccaaacaggatttactgtgcttaaagcttaattattgaaagactcttggtttggtggtcaaacgaataatgactaatcgggtg

SEQ ID NO: 15346 - DNA, 1281 bp, Brassica rapa
accgactgttcctcaacctctctttctctctattctcctactttacttatttccttcaaacttttctcctctcgtcccatcatcatcatgtcctcccataccaatctccactctcctaaaccggatcaccgtaccaccgggacaccccataccaaaaaaccaccgtcctcctccacctctcaagaccaacaaaccctaaaatgccctcgttgcaagtcctcaaacacaaagttctgttactacaacaactccagcctctctcagcctcgtcacttctgcaaagcttgccgtcgttactggacacgtggtggtgccttaagaaacgtccccatcggtggaggatgtcggaaaaccaaaaaatcattcaaacctaacgcagtagcaactccttcttcatctcagagatttttctcttcaatcatggaagattcctccaagttcttccctcctccaacaacaatggattttcagctcgctggtttgtctctcaacaaaatcaacgatcttcaacttatgaataatcaagaagttcttggccttaggcccatggaccaggtcgagacaacaccagtagatgtcgggtcgggtttatctttaatgggttttggagattacagcaacaacaaccattcaacggggacgttcacaaccgccggaggaaccgacggaaacttagctacttcgatagaaactttgagttctttaaaccaagatttgcactggagacttcagcaacagaggatggctatgctttttggtagctctaaagaagagactgtcgttgtggagaggccacagccgatactttacaggaatctcgatatcgtgaactcatcgcagtcgccgacgaagaaaggagataatcagacagagtggtattttggtaataataataataataatgataatgaaggggtggctaataataacaacacaggaggaagtgagcaatggaacaatggagttcaagcttggactgatcttaaccattatgatgctttgccatgattattggtaagttaaaaggaactatattatgtgatcagatatttaaaattatgtgtgtttcttatgtaatgccaaagaatatttatgtttttagtatttgttggtttgggtgctctttgtagtcagtttttgttgttgttgttggttactatttagatttataagtttcaatttgtaaacaaaaatttaagaattgagagatatactataatagattctctaaacttgtgacttttctgtactcataattatctcaatgttggaaatattcga

SEQ ID NO: 15347 - DNA, 1590 bp, Oryza sativa
ggatccctagctatgaagaaggccgccgctgggggcatggctccactgcctccctcgagcagcccaccatcttgcaaggctgggggcggaggaggctctccgcgctggtcactccttcacggcggagggggggagtggggcgtcgttgtgcgcagaaacgtggtgaagtcctccagcctcctgctcctcgtgttcagcaccttcttcgtgttctccgtgctcaggtcctctcagacctctctcgtcccaccgccaccacctgcggctgcgggaccaggagagccggcccttgcccagtccggccatgatgttgccggcgacgatggcggcgagcacgtggccgtggccgtgaacaacgtggccgccgagacacagtccaccccggacgacatctccctcccgtccaccaactcctccgccgctgccgtgccgaccaccaccaacaaggccgagcagcagcagaccggcgccaacaacatggaagaaaagtgcgacatgtccatgggcaagtgggtgcgcgagccgaagggcccagtgtacaccaataccacctgcccgaccctcccggatttcaagaactgccaaaagcacggcaaggacccaggccatctctattggaggtggcagccacatggctgcgatctcccgaggttctccccagatcgcttcctcgccgctgtgcgcggcaagaggctcgccttcatcggcgatagcctcgcccgcaaccagatggattccctcctgtgcctcctgtcgcaggcggagacaccaaccgaggtgtaccgcgacgcccatgataagttccagacctggcgcttcgccgcccatgagttcaccctcatggtgatgtggaccgagttctacgtgcatgccgagccagttgttggcgccgatggcaagccaaccccgtccttcgatatccacctcgacaggctgtcggcgaactggaccaggaggctcccagagctggattatgcggtcattagcgggggcaactggttcaacaggccgaactacctgtgggagggcggcaggagagtcggttgcgtcaagtgcggaggggctgccaatctgactgatgtgggcgtgccatacgctgtgagaagggttgtgagggccgccgtggagggcattgctaggtgcacgggctgcaaggccggcctggtggccttcctcaggaccttctccccggatcatttcgagcatggcgcctggttttctggcggctactgcaataggaccaggccactcgaggaggatgaagtcagcccagattccgccgcctgggagctgcggagggtgcaacgcgaggaggtgatgagggttaaggagactgctgcggctgcggcagcggcttcggggaatgccaggcgcttcgaggtgctcgatgtgaccaaggccatgatgctcagggctgatggccatccaggcgccgcgatcgataagcgctggcaaaagaacatcgtgtccgactgcctccattggtgcatgccaggcccggtggatatgtggaacgagatgctcctccagaggctcacggagatctccaccctcgatcaggatgcctctatcttcgaggccccgtaatga

SEQ ID NO: 15348 - DNA, 1955 bp, Phalaenopsis aphrodite
acaagctcagtaatggctcctcgtagccccaggttagtagtgccgatcgatcccaataagaagccatggcagcagaggcaccctctccacaaccgctggcatcctcacatacccccagttgcagatgtaacagagttagaggtatttcgggtcgagatgatggactggacgggcggagctgtcgccgataatgattcagccatggacatcaaatctttggatctcaccattacgcattatcttagcgggccgataagagtttcagacgagggaggaataccagcaaagccgggtgatcttcttgcgatcgaaatctgtgacttaggtcctcttcctggacatgagtggggttacacagcaacattcgacagagaaaatggaggcggatttttgacggaccacttccccaatgcaacaaaagctatctggtactttgaaggaatatatgcatactccccacagataccaggtgtgcgctttcctggtctaattcacccaggaattgtggggactgcgccatcccttgaacttctgaatatttggaatggaagggagaagaagttggctgaaaatggtcccaattctcttaagatatgcgaagttgtgcaccagagaccgctggcaaacctaccaacagccagaaattgcctccttggaaagattaacgaaggaacagctgaatgggaaagaattgcaaatgaggctgcaagaacaatcccaggaagggaaaacggaggaaattgtgacatcaagaatctaagcagaggttcaaaaatatatcttccagtttttgtggaaggtgcaaacctcagtacaggtgacatgcacttctctcaaggtgatggtgaagtttcattttgtggagcaatagagatgggtggtttcctagagctcaagtgcgagatcataaggggcgggatgaaggaatacctatccccaatggggccaaccacgctgcacgtgaatccgatcttcgagatcggcccagtggagcctcgattctccgaatggttggtgttcgagggcatcagcgtagacgagagcggacggcagcatttcatggacgccacagtggcctacaagcgcgccgtgctgaacgccattgattacatctccaagttcggctattcgaaggagcaggcatacctcctcctctcttgctgtccctgtgagggccgtatctcctgcatcgttcacattcccaatgccgtcgccacctttgctatccccgtcgccattttcgaccaggatatacggccaaaagataggaagttggtggggcccagaattctgaagcagcttccagatgtcatccgatgttggtatgataggaactcgggtagcttcccgtcactcccaaccccagcaaaataataaagaaatttaactattaactttggattcagctcgcgcttctcttgccttcacgccggcgacggtgattgcgatcagaagtcgctcacgaagctctgtagtcttgtcaatctctgtagactactgaatccttgttaaggctctaatggcgaccgtgccggttaacccgaagccattcctgaacaatctgactgggaaacctgtgattgtgaaactgaaatggggaatggaatacaaaggttttcttgtttcagttgattcctacatgaacttgcagcttgctaacaccgaagaatatattgatggcgagttctcaggaaatctcggtgagatacttataaggtgtaacaacgtactttatcttcgaggcgtgcccgaagacgaagaaattgaagacgctgattaagattgagctgagtgttttgaatataggaagattattctgctgctataacttcttattttgatagatttgagctagaaccctaattttatcactttactctatttttttcagcacatgttttggatgaaatgataaaactttgtgggtaatttttatatgaatttgataaagatta

SEQ ID NO: 15349 - DNA, 3559 bp, Setaria italica
ctcgaacaaacgcacccttaaatcccggtcattcacgtgggttcgggagggtgtcgatagccccacctcccccaaactcccataccaccgcgcgcgcgcacgcatggccgccaccgccgctgccgccgccaccacaccctcctcacctctcctccgccgcgccgctgcggcgccgaccaccggccaccactaccagctcaggtgctctgccaagccgtccccgctcgagctgcggcactacgccgcgcgcctcgccccggcgcgggccctgttcccggaccgcgtcacgccgttctccttcgacgcggacggcgatgaccacccccgcgaggagtgcggcgtgttcggtgtcatcggcgacccggacgcgtcgtcgctgtgctacctcggcctgcagaagctgcagcaccgcggggaggagggcgcgggcatcgccgcctcggacgccgatggcaagctcaaatcggtgacggggctcgggctcgtcggggacgtcttcggcgacccgacgcgcctcgccaagctccccggcaacgccgccatcgggcacgtgcgctactccacggccggcgcctcctcgatgcgcaacgtgcagccgttcctcgccgcgtacaggttcgggcagctcgccgtggcgcacaacggcaacctcgtgaactaccaggcgctgcgcaacaagctggaggcgcagggctccatcttcaacacctcgtcggacacggaggtcatcctgcacctcatcgccacctcgctctcccgcccgctgctctcgcgcatctgcgacgcctgcgagcgcctcgccggcgcgtactcgctgctgttcctgacggccgacaagctcttcgccgtgcgcgacccgttcggcttccgccccctggtgatggggcgccgccccaacggcgccatcgtgttcgcgtcggagacctgcgcgctcgacctcatcgacgccgcctacgagcgcgaggtggcgcccggggaggtggtggtcgtggaccgccgcgacatgtcagtgtcctatgcctgcctcgtcccgcaccgcccccgcaagtcgtgcgtcttcgagcacatctacttcgcccttcccaactccgtcgtgtttgggcacgccgtccacgagcgccgcagcgcatacggccgcgcgctcgccgaggagtccccggctccgaccgcggacgtcgtcatccctgtgccggactcggggttctacgccgcgctcggcttcgcgcaggcgtcgggtctcgaattccagcagggccttatccgttggcactacagcggccgcagctttatccaaccgtcgcaagcaatccgcgacctcgcggtcaagctcaagctcgcgcccgtgcgcggcgtcattaccggcaagagcgtggtcgttgtcgacgattcgctcgtgcgcggtaccacctcgagcaagattgtgcgcctgctccgcgacgccggcgcgcgcgaggtgcacatgcgcatcgccagccccccggtcatcggctcctgcctgtacggcatcgacacgccgagcgagggcgagctgatatccaacaggatggacctcgagggcgtgcggaggacgattggctgcgactcgctcgccttcctctctctcgacaagctccacagcatctacggtgatgaagcgcatgagctttgtgacgcctgcttctctaggaactacccagtgctgcccactgtgccagagccggtgccggagctggtgtcagccttcgaagactaacaagaaagggagtggttctatactctgcatgcttactatagaatgtagactcaattttgggcctggcattttttacctttgcaaattgcaattgcattcatccatctgaattttgaggttaaaagctttagacattgatcaaaccgctactacgagtttgatccactcttattgtattgctatgatgatgacgatggataacaagaaaattgtctcagtggcatagggttaaagaactacctttttggcaattcaggtttaatatgatgctattttgggttcgcttcagagtcagctctcaccttgctgcttcttgacgtagttgcataaagtttcatctgttgttgaatactaacaattgacatgttatgcttgtggaattcaattttgatcatcagttttacagcataatacctatcatctattttacttatgctcagtagctagatgaatcctttgactgtgatgtaagcgatacttctccaggtacaaaaattgaaatatttggggggagttcttctactttccttgtcttggtatctgatgttctgttgctctagattggctaacagattatttttcagaatgttggtatgaattagttgcaagctttgcaatgcttctctagaatcaaaggtttaactgacctgtccataaaaaatgttgaccgcgtacgtccttgctgaattggagatcgaatagtatctgctaattacttatttgacaactttgttaatgtgccaagtcaagcatgaaagttccgggaatcttactgctctagcactagaagcatgatagcctgcagattgcagtcaagcctgtgactgtaaatgtcatactagctgcctgtctttcgacaacagtttgtttagattttgatttgcattcaagaaggcagtcaaagcctcagaggtaagccgaacatcacgacgttgacaggattcttgttttatggttattaatcatgtccaaaacaaacgctctttcgacaggggttgctgcttgagctcatctgtagcatatatgttgactcaaatccacttttctgttggagtgcttgcatttgacatcttcaaatttggtccttgaaatctttgccttactctgatatcatcctctgttttgatcgagacgtgtgctgctttcctgatgatggtcatctttctatggtttctctgaatcagtcttatttatgtgaaggtgtaacccatgtctagtgaacttgagctatcagtagcagtgtgatgttatcgatgatgttcttgtgaagtactctttccgaggccatggctaaaggctaacatccaggtctggtcttgtggatatgctctgatcccggtctctatttcaatcgagacatttgctgctttccggataattgtcatattcgcagcgtttcactgaatggctgaatcggtctggttttatgtgaacgtgagctatcagcttctgtgaggtgattttatccacggtctcctttctgaagtactcttccaaaggtcaactggccaaagctgagctaaactgcaggacacaagttttttaaatggtcaggagagactcgcctgttccagtcttccagaggatgagatatggatgatggcatcgggtgacctgtgaggcttcgttcgccttctttcggcagagaatatatcttgttttttccagttacaggaaagacataaaagtacgtaaccagcaggatagagaagcatttgtaccttcgcattgcactgagcataatctttctgtgatcccggtttatctgtcaactgtacttgtacggttgtaccacgcatttttgtattgcgctttgtatgggagaac

SEQ ID NO: 15350 - DNA, 2229 bp, Brachypodium distachyon
tcctccggaagccctcgccctcccacactcccgcacccccacgaatggccgccgccgccgccgccgccaccgcggccccgaccaccacagcatcctcccgcctcctcctcccccgcaccgcccccgttccatcccccatccactaccagctcaggtgctccgccggcccctcgctcctcgcgcggcgccaccgcgcgcctgcgccggcgcgggcctcgcccgaccgcctcacgcccttcaattacgacgacgacagcgacgaccacccccgcgaggagtgcggcgtgttcggcgtcgtcggcgacccggacgcctcgtcgctctgctacctcggcctgcagaagctgcagcaccgcggggaggagggcgccggcatctccgcctctggggacgatggcgatatcaagacggtgacggggctggggctcgtgggcgacgtgttcggggacccggcccgcctcgccggcctccccggccggtccgccatcggccacgtgcgctactccacctccggcgccgccgcctcgctgcgcaacgtgcagcccttccatgctgggtaccggttcggtcagctcgccgtggcgcacaacgggaacctcgtcaactaccagtcgctgcgcaacaagctggaggcgcagggctccatcttcaacacttcctccgacacggaggtcatcctgcacctcatcgccacgtcgctctcgcgcccgctgcttgcccgaatctgcgacgcctgcgagcgcctcgccggcgcctactccctgttgttcctgactgcggacaagctcttcgccgtgcgcgacccgttcggcttccggccgctggtcatgggccgccgtccaaacggcgccgtcgtgttcgcgtcagagacctgcgcgctcgacctcatcgacgccgtgtacgagcgagaggtggagccaggggaggtcgtcgtcgtcgaccgccgcgacatgtcgatgtcctcggcctgcctcgtcccgcaccgcccacgcaagtcctgcgtcttcgagcacatctacttcgccttgcccaactctatcgtcttcggccacgctgtccacgagcgacgcaccgcctacggccgcgctctcgccgaggagtcccctgcccccactgcggacgtcgtcatcccagtgccagattcggggttctacgcggcgctcggcttcgcacaggcttcggggctcgagttccagcagggcctcatccggtggcactacagcggccgcagcttcatccagccgacgcaggcgatccgcgacctcgccgtcaagcttaagctcgctccagtgcgtggcgtcatcgcgggcaagagcgtggtcgtcgtcgacgactcgattgtgcgtggcaccacctcgagcaagattgtccgcctgctccgggacgccggagcacgcgaggtgcacatgcgcatctctagtcccccggtcatcggctcatgcctttatggcatcgacacgccaagcgagggcgagctgatatcgaacaggatggacattgagggcgtgcgcagggcgatcggttgcgactcactcggcttcctctcgcttgacaagctccacagcatctacggagatgaggcgggtgagctctgcgacgcctgcttctcacggaactacccggtgcttcccacagtgcctgagccggtgccggaactggtgtcggcctttgatgattaaccggaatgtgcaactagggaagtggctatataccactctgcatgcttactacaggattttttggtcaattttgggcatgacgaattttgtcattgcaattgcattcatcatctgaatttttgcaggtcttaagtttgtatcagtgagccgttagccttccatgtctctaggctcaagttttccaaacccttttcatgagttaatcaatttataaagaaaggttgacgactcaggacttcctatcttcaatgtaaagagttgtagacctgaattgcttaatcgagtgcatttgttcaagctcccattgattggtgaagcatgtcatttgtaaatatattttcttagtatttacagctgcgaaagcaagcaagaaatgtcatgtacttgttcgcaaaaaagaaaaagaaaagtcatgtactagagtcatgtcagtatactgatgacatggacttgcacacttcagtcagaccatgtatacttcatgtaagttgtcatcagataacaattcttgctttgatattgactacgaatgcaaaacagcatgacattg

SEQ ID NO: 15351 - DNA, 3336 bp, Zea mays
actcgaaagtcgaaatacagatcccacggtccacacgcccgcccgcatgcttaaatcctgccccttcacgtgcgttcgggagggcatccttggaagttggaagcaggcctcacctgcccccaaaggcccaaactcccgaaccgccccgcaccacgcatggccgccacagccgccgccgccgcgacggcctccacgccttcctctcccctccgccgccgagcctctgcggcgcctaccacaagacacaactcccagctcaaatgctccatcaagccctcgcagttcgagctgcggcaccgcgccgcgggtctcgctccggcgcgagctctgctccctgaccgcgtcacgccgttttccttcgacgcggacggcgacgaccatccccgagaggagtgcggcgtgttcggagtcattggcgacccagacgcgtcgtcgctctgctacctcggcctgcagaagctgcagcaccgcggggaggagggcgcgggcatcgttgcgtcggacgccgacggcaagctcaattcagtgacggacctgggtcttgtcggggacgttttccgcgatccggcgcgcctcgccaagctccccggaaacgccgccatcggccacgtgcgctactcaaccgccggcgcctcttcgaggcgcaacgtacaaccgttcctcgccgcgtaccgattcgggcagttggctgtggcacacaacggcaacctcgtgaactaccaggcgctgcgcaacaaactcgaggcgcagggttccatcttcaacacctcgtcggacacggaggtcatcctgcacctcatctcaacctcgctctcgcgcccgctgctctcgcgcatctgcgacgcctgcgagcgcctcgccggtgcgtactcgctgttgttcatgactgccgacaagctttttgccgtgcgcgatccgttcggcttccggcccctggtgatgggccgacgccccaacggcgccgtggtgttctcgtcagagacctgcgcgctcgacctcatcgacgccacctatgagcgcgaggtggagcccggggaggtggtggtcgtggaccgccgcgacatgtcggtgtcctacgcctgcctcgtcccacatcgcccgcgcaagtcatgcgtgttcgagcacatctacttcgcccttcccaactccgtcgtgtttgggcacgccgtccacgagcgccgcaccgcgtacggccgcgcgctcgccgaggagtcgcccgccccgaccgcggacgtcgtcatccccgtgcctgactcggggttctatgcggcgctcggcttcgcgcaggcgtcgggactcgagttccagcaaggtcttatccggtggcactacagcggccgcagcttcatacagccatcgcaggcaatccgtgaccttgccgtcaagctcaaactcgcgcccgtgcgcggcgtcattaccggcaagagcgtggtcgtcgtcgacgactcgctcgtgcgcggcaccacctctagcaagattgtgcgcctgctccgcgatgccggcgcgcgcgaggtgcacatgcgcatctccagccccccagtcgtcgggtcctgcctctacggcatcgacacgccgagcgaaggcgagctgatatccaacaggatggacctcgagggtgtgaggaggaccattggctgcgactcgctcgccttcctctctctcgacaagctccacagcatctacggcaatgaagcacatgagttctgtgacgcctgcttctcacggaactacccggtgctgcccacagtgccggagccagtcccggagctggtgtctgccttcgaagactaacaagaaggggagtggatctatactctgcatgcttactattaccatagaatctagactcaattttgggcatagcatttttgcctttgcaaatgcattcatccatctgaattttgaggttacaaagtttagacactgatcgaactgctattgtgggttcgatctaatctattgtattgctatatgatgatgacgacgacaatgaatgatagaaaaattatttcaatggtacatgtttaccttttcactatatcaggtttagggtctgtttagtttgtggctaattgtattgaataactaaccttagacagaaaagttaggcaaaatataaagttaggcagcaaaccaaacatgccttaatctgctgctgttttgagtttcttcagaggtcgtcctcaccttcttggatcctgcttaacgttcttgcataacttccatatttggctgagtgtctatcgctaacaatgggccagtttaggatatggcaaatatgcattcagagttagtttgtgctagctgaaggctgatgtgtataagcgagtcaaagttaaggaatgcaattgtctagcttttcaaaattcttagcttctacgaattcgttgcaaagtttgcatcaccagagttcgtgatcctttttctagagttgggttgggctgtccataaaatgcgccaacctgaatcactagtgaagtgccttttcctaggtattgttgcattggaccgcgaatagtatatgctacatatattttctaaattttcttaatgtcccaaggcaagcaaggaattcctaggaccttgctgcactagactagcactagtggtatgataccctacacattgtaatcaggactgactacaatactactcccatagttctgaattttaagtgatttcaactcttttggagagtgaaaacaccttaatttagccgaagttaagagaattacaaagattcacgacatcaaggctgtttgagatgcatatattatatgatccaacttattttgaactaacacttagttcaaaataagttagattatataatctgggcaaattataatctcaaacaaataggcatactatgaaaatatgattaaaaaaggatctaataatacttatttaatatcgtaaatgttattgttttattatataaattcggtcaacattaagatgctttgactctccctcaaagttggaaaaaacttataatttaggacggagtgagggcatacttcatgccaattgcctgtcttccgatgagtctttgtttacatgttgatttgcattcaagaaggcattcaatggtaagcagaatgacatgatgttgacatggtccgtttatgatttaatagtagccaaaacaaacacggatttggcagtgttgctgctcatctgatgtagctgcttgtggtcttctttgtattataatacattgactcaaagctggttttctgttggggtacaagcatttgacatgttcagatttggtccttgaaatctttgccctacttcttacggatgccctgatcctaccttctgtttcggtcg

SEQ ID NO: 15352 - DNA, 3025 bp, Sorghum bicolor
cacggaatccacggtccacacgcccgcccgcctgcttaaatcctgccccttcacgtgcgttcgggagggcatcctcgaaagccctcacctgccccaaaggcccaaactcccacaccgccgcgaaccacgcatggccgccacagccgccgccacggccgccgccgcgacgacctccacgccatccacccccctcctccgccgcgccgctgcggcgccgaccacaagccaccactaccagctcaggtgctccaccaagccctcgcagttcgtgctgcggcaccgcgccgcgcgagtcgctcccgcgcgagctctgctccctgaccgcgtcacgccgttttccttcgacgcggacggcgacgaccatccccgagaggagtgcggcgtgttcggagtcattggcgacccggacgcgtcgtcgctgtgctacctcggcctgcagaagctgcagcaccgcggggaggagggcgctggcatcgttgcgtcggacgccgacggcaagctcaattcagtgacggacctgggtctcgtcggggacgttttccgcgacccggcgcgcctcgccaagctccccggaaacgccgccatcgggcacgtgcgctactcaacggccggcgcctcttccaggcgcaacgtgcagccgttcctcgccgcgtacaggttcgggcagctggctgtggcgcacaacggcaacctcgtgaactaccaggcgctgcgcaacaagctggaggcgcagggttccatcttcaatacctcgtctgacacggaggtcatccttcacctcatctcaacctcactctcgcgcccgctgctctcgcgcatctgcgacgcctgcgagcgcctcgccggcgcgtactcgctgctgttcctgacggccgacaagctctttgcggtgcgcgaccccttcggcttccggcccctggtgatgggccgccgccccaacggcgccgtggtgttctcgtcagagacctgcgcgctcgacctcatcgacgccacctatgagcgtgaggtggagcccggggaggtggtagtcgtggaccgccgcgacatgtcggtgtcctacgcctgcctcgtcccgcaccgcccgcgcaagtcatgcgtgttcgagcacatctacttcgcccttccaaactccgtcgtgtttgggcatgccgtccacgagcgccgcagcgcatacggccgcgcgctcgccgaggagtcccccgccccgaccgcagacgtcgtcatccccgtgcctgactcggggttctatgccgcgctcggcttcgcgcaggcgtcggggctcgagttccagcaaggccttatccggtggcactacagcggccgcagcttcatccagccatcgcaggcaatccgtgacctcgccgtcaagctcaaactcgcgcccgtacacggcgtcattaccggcaagagcgtggtcgtcgtcgatgactccctcgtgcgcggcaccacctcgagcaagattgtgcgcctgctccgcgatgccggcgcgcgtgaggtgcacatgcgcatctccagccccccggtcgtcgggtcctgcctctacggcatcgacacgccgagcgaaggcgagctgatatccaacaggatggacctcgagggtgtgaggaggaccattggctgcgactcgctcgccttcctctcgctcgagaagctccacagcatctacggcaatgaagcacatgagttctgtgatgcctgcttctcacggaactacccggtgctgccaaccgtgccggagctggtcccagagctggtgtctgccttcgaagactaaccagaaagggggtggctttatactctgcatgctttactattactatagaatctggactaaattttgggcatagcattttcgtctttgcaattgcattcatccatctgaattttgaggttacaaggtttagacactgatcgaactgctattgtgagtttgatctaatctattgtattgctatatgatgacgatgacaatgaataacaagaaaattatctcagcggttaccttttcacaaattcaggtttaatgtgctactgttttgagtttcttcagaggccgttctcaccttcctggatactgcttagcattcaggtttaccttttcacaaattcaggtttaatgtgctgttgttttgagtttcttcagaggccgttctcaccatcctggatcctgcttagcattcttgcataagttccgtatttcgttgagtgtctatctctaacattgggccagttttggatgtgccaactgtgcattcagagtttaagtttgacccatattagtggcgttgtagctgatagtatagtcctaggctgatgtgtaaaagtgagtgaaagtttatgaatgcaatttcctagcatttttacttttcatccgatgttccttttgttctagactgggtacagagataatttaaaattcttagttggtacgaattagttccaaactttgcatcacttctttagaatcagggtttctgaacctttttctggagttgggctgtccataaaattttttgaccaggacttcctctttcatggtaaatggacatgccaacctcaatcactagtgaagtgccttctccaaggtcttgttgaattacagtgcctagtatctgctacatatattctcaaaaccaagtcaagcaagaaagttcctaggaccttactgcattagcactagtggtatgataccctacacattgtaatcaagcctgtgactacatgcttcataccaattgcctgtcttcccagtcccacgatagtccttttagatgttctttttgacaacagtcctttttagatgttgatttgcattcaagaagaaggtaatcaaaggtaagcagaatgtcatgatgttgacatgatccttgttttttatttaatactggccaaacaaaacacggttttggcagggttgtttctcatcttatgttggtgcttgcggtcttctgtctagtataatatgttggctcaagctggtaacatgtgcagatttgatccttgaaatatttgcccctccttatcg

SEQ ID NO: 15353 - DNA, 2473 bp, Sorghum bicolor
cggcctgcagcaaaattgggcctttgatcatagttccgtgcgtcgagttcttttaacacgggccatgcacataatttcgtacttcctgggcctgtggcccatatgcaatttcgtacttcctgcgcctgtggcccatatgctctgtcttagtgtattgactgtccactacgagtcaaccccatcctggcggtcctggtccggtccacagcacttcaagtcggctgaccgcggcgcgcccagcagcaggagagatacgatacgattgccgacctaatccagcggcagccaggcactcaccaagcaaacgtctttaaatctggccccttgacgcgcagccggagaggggcatcacccctcgtgcgtgtgccctcgcctctcccagcgccgcccgccccaatcccctccatctcaaaaaatgggaattgccgccgccgccgccaccaccaccacgtcccgactcctccactaccacgcagccgctggcacggaccgccatcaccggcaccagctcaggtactccgcgagtccgtttcctctctcgctgcgctgcggctccggccggcgtgaggcggcggcggcccgggcgctcctgcccgaccgcgtcaccccgttctcctacggcgtggatgaggacgcggatgaccacccgcgcgaggagtgcggtctagtcggggtcgtgggcgacccggacgcggcgtcgctctgctatctgggcctgcagaagctgcagcaccgcggggaggagggggccgggatcgtcgccgtgggcggggacggcaagctcaagtccgtcaccgggctgggcctcgtggccgacgtgttcggggacccgtccaggctcgcctcgcttccgggccccgccgccatcgggcacgtgcgctactccacggccggcgccgccgcgtcgctgcgcaacgtgcagccgttcctggccgggtaccggttcgggcaggtcgccgtggcgcataacggcaacctcgtcaactaccaggcgctgcggaacaagctcgaggccaggggatccatcttcaacacgtcctcggacacggaggtcatcctccacctcatcgcgacgtcgctgtcgcggcccctgctcgcccgcgtctgcgacgcctgcgagcgcctcgcgggggcctactcgctcctgttcctcacggccgacaagctcttcgccgtgcgcgacccgcacgggttccgcccgctggtgatgggccgccgccggaacggcgccgtcgtcttcgcgtcggagacctgcgcgctggacctcatcgacgccacctacgagcgcgaggtccagcccggggaggtggtcgtggtcgaccgccgcgacatgtcggtggcctcggcctgcctcgtcccgcaccgcccgcgccgctcctgcgtcttcgagcacatctacttcgcgctgcccaactcggtggtgttctcccacgccgtccacgagcgccgcaccgccttcgggcaggcgctggccgaggagtcccccgccccgggcgccgacgtcgtcatcccggtgcctgactcgggcttctacgccgcgctcgggttcgcgcgcgcgtcggggctcgagttccagcagggtctcatccgctggcactacagcggccgcagcttcatccagccgacacaggcgatccgggacctcgccgtgaagctgaagctcgcccccgtgcgcggcgtcatcacgggaaagagcgtcgtggtggtggacgactccctggtgcgcggcaccacctcgagcaagatcgtgcggctgctccgcgacgccggcgcgcgggaggtgcacatgcggatcgcgagcccgcccgtcgtgggctcctgcctctacggcatcgacacgccgagcgagggcgagctcatctccaaccggatggacctggatggcgtgcgcagggagatcggcagcgactccctcgccttcctgtcgctggacaagctgcacagcatctacggcgaagagtcgggggactactgcgacgcgtgcttctcgcgcaagtaccctgtgctgcccacgctggccgacccggccgtcgagccggacgagtgagccgggagcagccgagcagtcacaggctctcaggctccactgaaggatacaaggcatttctgctgaagtggacacactgaaaacgactgagcgaaccaaagacgtctccaagatacgcgcatgcgcaacacaatcagttgaaaacgggggcagttgcacagacgtacggagtacgtaacgaggaggtcgcgtagttctcttgaattcagtttcagacgtctccaagggcatcgaggatgatggttctatcttctaggccttgtttacttacaaaagtttttgcaaaatatgaatagtacaattttcgtttgtatttgacaaatattatccaattatggattaactaggctcaaaagattcatctcatcaattccgaccaaactgtgcaattagtttttatttttatctatatttaatactccatgc

SEQ ID NO: 15354 - DNA, 2447 bp, Zea mays
gccagagagaggcatcactccgcgtgcccggctcgccccgccgcccgccccaaatcccctcgatctctcaaataagcgggaatgggaattgtcgccgccgccgccgccacgacgtgcacgtcccgtatcctctaccgctacgcagccgctggcagcgaccgccataaccggcaccacctcaggtactacgcgagtccgtatcctctctcgctgcgctgcggctccggccggcgtgaggcggcggcccgggcgctcctgcccgaccgcgttaccccgttctcatacggcgtggatgaggacgcggatgaccacccgcgcgaggagtgcggtgtaatcggggtcgtgggcgacccagacgcgtcgtcgctgtgctatctggggctgcagaagctacagcaccgcggggaggagggggccgggatcgtcgccgtgggcggggacggcaagctcaagtccgtgaccgggctggggctcgtggccgacgtgttcgcggacccgtcccggctcgcctcgctcccgggccccgctgccatcgggcacgtgcgctactccacggccggcgccgccgcgtcgctgcgcaacgtgcagccgttcctggccgggtaccggttcgggcaggtcgccgtggcgcataacggaaacctcgtcaactaccaagctctgcggaacaaactcgaggccaggggatccatcttcaacacgtcctcggatacggaggtcattctccacctgattgcgacgtcgctgtcgcggcccctcctcgcccgggtctgcgatgcctgcgagcgccttgcgggggcctactcgctcctgttcctcacggccgacaagctcttcgccgtgcgcgacccacacgggttccgcccgctggtgatgggccgccgccggaacggcgccgtcgtcttcgcgtcggagacgtgcgcgctggacctcatcgacgccacctacgagcgcgaggtggagcctggggaggtggtcgtggtcgaccgccgcgacatgtcggtggcctcggcctgcctcgtcccgcaccgcccccgccgcgcctgcgtgttcgagcacatctacttctcgctgcccaactcggtggtgttctcgcacgccgtccacgagcgccgtaccgccttcgggcaggcgctggccgaggagtcccctgccccgggcgccgacgtcgtcatcccggtgcccgactcgggtttctacgccgcgctcgggttcgcacgcgcgtcggggctcgagttccagcagggtctcatccggtggcactacagcggccgcagcttcatccagccgacgcaggcgatccgggacctcgccgtgaagctgaagctcgcccccgtgcgcggcgtcatcaccggcaagagcgtcgtggtcgtggacgactccctggtgcgcggcaccacctcgagcaagatcgtgcggctgctccgcgacgccggcgcgcgggaggtgcacatgcggatcgcgagcccgcccgttgtgggctcctgcctctacggcatcgacactccgagcgagggcgagctcatctccaaccggatggaccttgatggcgtgcgccgggagatcggcagcgactccctcgccttcctatcgctggacaagctgcacagcatctacggcgaggagtcggggaactactgcgacgcgtgcttctcgcgcaagtaccctgtgctgcccacgctggccgatccggccgccgagccggaggattgagccaggagccagccaggtgacctactgacctctgctctgcttcgtctgccagtacgtctaggtcgttggattcagctctgattcagctctgttcggagtgttggacaattttgcgcgcctcaacctcaaggctgtagctttataatatggtgaagaagctctttatcatggtactgaaggattaccaataagaaaatgacaagaaaagccaaagtctagtaattgtgtccgcccttgctgtgccgttgtgaacttgtgatcttcatcacgttactgctgatgatcaaattatcatccacggcattgctatgttttggactaattctgaacataaaattttgctttgcgcgcgggggtcaggctgctagctaaacgcaccctaaaaaatcttgttttgcacaattttatgctttgtgaagcacgtaacttcattattattgtgccccacttgtgaccgtagtacacctccattttacaatttcccgatggcctctagtactttgctgtctgcgcgctaaacgcagcccattttagtttgcaaggacactgaagaacgctgccatgcaatccttctatctaaaataaacatacatatgctgacatgcatgcctctgtccacggagattagagattgcctgcctttgtcttgtaaacgtaagacgttgagaagtaagcgaaagcgagaagctccagcgcggcgagcgctgcaaggagcaggtagaagtagtctaggt

SEQ ID NO: 15355 - DNA, 2372 bp, Setaria italica
atcgcccgtgtgccctcgccccgctccaatcccctcctcgctccaatggggatggtcgccgccgccgccgccgccgcgtccacgtctcgcctcctcctcctccaccaccgcgccgccgctggctccgaccgtcaccaccagcaccagctcaggtacgccgcgatccagtaccctctctcgctgcgctgcggctccggccggcgtggggcggcggccggggcgctcctgcccgaccgtgtcaccccgttctcctacggcgtggacgaggacgcggatgaccacccgcgcgaggagtgcggcctggtgggggtcgtcggcgacccggacgcgtcgtcgctgtgctacctggggctgcagaagctgcagcaccgcggggaggagggggctggcatcgtcgccgtgggcggcgacggcaagctcaagtccgtgacggggctgggcctcgtggccgacgtgttcggggacccgtcccgcctcgcctcgctcccgggccccgccgccatcgggcacgtgcgctactccacggccggcgccgctgcgtcgctgcggaacgtgcagccgttcctggcgggataccggttcgggcaggtcgccgtcgcgcacaacggcaacctcgtcaactaccaagcactccggaacaagctcgaggcccggggttccatcttcaacacctcctcggacacagaggtcatcctccacctcatcgcgacgtcgctgtcgcggcccctgctcgcgcgcgtctgtgacgcgtgcgagcgcctcgcgggggcctactcgctcctgttcctcacggccgacaagatgttcgccgtgcgcgacccgcacgggttccgcccgctggtgatgggccgccgccggaacggcgccgtcgtgttcgcgtcggagacctgcgcgctggacctcatcgacgccacctacgagcgcgaggtgcagcccggggaggtggtcgtggtcgaccgccgcgacatgtcggtggcctcggcctgcctcgtcccgcaacgcccgcgccgcgcctgcgtcttcgagcacatctacttctcgctccccaactcggtcgtcttctcccacgccgtccacgagcgccgcaccgcattcggccgcgccctcgccgaggagtccccggccccgggcgccgacgtggtcatcccggtgcccgattctggcttctacgccgcgctcgggttcgcgcgcgcgtcggggctcgagttccagcagggcctgatccggtggcactacagcggccgcagcttcatccagcccacgcaggcgatccgcgacctcgccgtgaagctcaagctcgcccccgtgcgcggcgtcatcgccggcaagagcgtggtggtcgtggacgactcgctggtgcgcggcaccacctcgagcaagatcgtgcggctgctgcgcgacgccggcgcgcgcgaggtgcacatgaggatcgcgagcccgcccgtggtggggtcctgcctctacggcatcgacacgccgagcgagggcgagctcatctccaaccggatggacctggagggcgtgcgcagggagatcggcagtgactcgctcgccttcctgtcgctcggcaagctgcacggcatctacggcgaagaagcgggggactactgcgacgcgtgcttctcgcgcaagtaccccgtgttgcccacgctggccgacccggccgctgagctcgaggagtgaggcggtgagcaggtgagctctgctgctcctctgctctgcatcgcctgtacttgtaggttgttagattcagttctggttggataattttgtgcgcctcaaggctgtagcttaatttggtgaagcattctagtatcatgttgccgaaggaatactcatctttctgttccattaagctgagtaccaataagatcagatgatgaagtgctaacatcttgtctgtgtaaattagctatgccaaaacctgggtaattccaaattcagttcaaagaaaatggcaaaaatcacaaggccaccagggttgtgcatagattactgccggtcaaatttttccatggcattgcaaaatttgggcttcaaaccaaatggatgccgagtttcccgggcaggacctaattttggcttggcacaatggggctgtgaaccaaacaccggtctaaagattctcttctgctcaattttattatgtaatcaagcagttagcaatttttcacctagaagaatcaacagtgaaatcattattgcgccctatgatcttactggtgctgtcattgcaagtttgtaacgcatacctgggccatagttcaccttcttaaccatttccgaaggttgggagttctttcactatagcctgcaggattgtgctgtttgtgtgctaaaaacagcccattatgatttcaccagaacactga

SEQ ID NO: 15356 - DNA, 2449 bp, Aristolochia fimbriata
ctgaaaaaggccgcctctttaccttcgccgatggaatccagccaagccaagccgacagaaatctcaaaatttcggctacaaaaaggaaagcagagggaagcgcagggcgaggttcgaaaaaacaaacggaaaactgcggaaagctcttttcgcttcttataggaaaggataacgagggaggcgtttgattcttcttggaatttttgcttctgttcttctcttcttgctgttgtctaggggaggaagtaaatggcttcttatagagctgaggacgactacgactacctcttcaaggtggttttgatcggcgattccggcgtcgggaagtctaatttgctctctaggttcaccaggaacgagttcagtctcgagtccaagtctacgatcggagtcgagttcgctaccaggagcttgaacgtggatgggaaggttatcaaagctcagatttgggacacggcgggccaagagagataccgtgccataacaagtgcttactatcggggagctgttggtgccttactggtctatgatgttacccgccacgctacttttgagaatgttgaaaggtggttgaaggagctgagggatcatactgaccctaacattgttgttatgctaattggaaacaagtctgatttacgccatcttgttgctgtctctactgaagatggaaaagcttttgcagagaaggaatctctctacttcatggaaacatctgctttggaagctacaaatgtggataatgcttttgctgaggtcctaacccaaatttatcggattgtgagcaaaaaagcagttgaaactggggatgagggagcagcagctgcagttcccagcaaaggggagaggataaatgtgaaggacgatgtgtctgccttgaaaaaggtgggttgctgctcgacttgaggattctgacattgatctgctggcaactcatttcatataagcggtagtttccttttgaagggtttttactttgtttgttgttgagcatagagaggagagcggggggaagctattcagactttctattttgttgaacagcagaggatctttgagtaggaacaaggttgttacagttgttggtttagttagttgaaatgaaatgatggctccaaatcccggaagagtagctgtattttacccgcggaagtggactttgcaaggtgaaatcggtgtggaggctttgtcaagtagatgatgatgtcccacgcaatgggcagttatatacgtaacccaatattttttacctggttgttttcaaagacatgtttcttgattacatttaccctgtgtaaaccgtttccatctattgttggttgtttctagctccaatttctaacatttcttttaaaaaatgtttccatagttctttcctgtattgggtaaaacctttttgacacactagatcttactgtttactagtaaaaccttcgtttattatgtcgttgttgccctgaggcctctggatgagaagataaaaaaagaagaattagataaatgaccgagagggttggatgactgcaaatatttaattgtaaatgattacaagagttcctgcccgctgttattatttgcaggtccagagtcgttgtaaggagaaaacacgtgggtcatggactcttcaaattggtggaaaactaaccggccatcgtacatgatgaagtgaccttaggaagtaaagaattacaacggaggagaaccaacggtccatgctttctgacacctcgaatcctacaagcctcatcgatcgccaccggcgattatataagacaatttagcccatttgaacccccatcaacgtacatcaaaatgcttctagactgtcaccttgtccagtgtcgggactggtggttctccagtcacgtgctacggcagttgtccgtgctttacggttttcacttaaatcttcttttcatatctaaataccgggaagccaatccgagattccgaatgcgttagttcaaagctgagaagttttatgccattttggcaagagctagtagtgcacaaataaagggttttcctcagctttgatgaaatcgtcccgtgaacaatcgaataagcgcatatatcattccagattacacaaaattgtaagacttagagataactgcattcattatccctctctcttcctgtcatttgctctgtctctttttctctctcctcctctctcccctctctgttgtcgacaaatggagcggtcactgcgtgagttgttgtgggtatcgatcgagtagacagagcccgatttttttaatgacgataacggaatgaacgtaattaacagcgaaaatgtcaaaacccatcatacagcaatcactgtttccttttgaacaacgcaccgagacggctcccaggttcccagtaccgcacgttactgatctcgagtctcaatacccaaatgcaaataaaactgagacataatcttcccacactagttaat

SEQ ID NO: 15357 - DNA, 923 bp, Cucumis melo
gcgctaatactgagatctacccatttgcccatttctttctcttactccaaccaaagttcttcttcagaaggggaactccgatggctggttacagagctgaagatgactacgattacctctttaaggtggttttgattggagattccggtgtgggcaagtccaatttgctctcaaggtttaccaaaaacgagtttagtctcgagtccaagtccaccattggggttgagtttgctactcggagtttgaatgttgatcaaggttgtcaaggctcagatttgggatactgctggccaggaaaggtatcgtgcgataaccagtgcttactaccgaggtgccgttggtgcactccttgtctacgatgtcacacgacattccacttttgaaaatgtggagaggtggttaagggagttgcgagaccataccgatcctaacattgtcgtcatgcttgttggtaacaaatcagatcttcgacatctggtggcagtttcaacagaggatgggaaatcttttgctgagaaggagtctctctattttatggagacttctgcactggaagcaaccaatgttgagaactcattcgctgaagtccttactcaaatttatcacattgtaagcaagaaggcaatggaggcaggtgatggcactgctgctgcttccgttcctcctaaaggagagaaaattgatgtcagtaaggatgtttctgctgtaaagaaagctggctgctgttcgagttaggctttgatttgcattttttttttttttgatgtagctgatttgatactgctgcatccttatgtgcaacatagttgagtagaaattctaaagagatgtgttcaataggatatggatgttccctggattgaattttatttactttccaatatattttagtttgaaagtttaagtttgagcccaaaaaaaaa

SEQ ID NO: 15358 - DNA, 1097 bp, Citrullus lanatus
ttctcctcatcccctttctctttggagtccagcccagcacaaacagcggtctctcccatttccaattcacaatctcgaaacaagaagatcgaaaaaacaaaccccaaaaagcgcaaatacagagatctagccattgcccatttctcttctcttactccaaccaaagttcttcttcttcttcttcttctttcagaaggaggactccgatggccggctacagagctgaagatgactatgactacctctttaaggtggttttgattggagattccggtgtgggcaagtccaatttactctccaggttcaccaaaaacgagttcagcctcgagtccaagtccaccattggggtcgagtttgctactcggagcttgaatgttgatggcaaggtcgtcaaggcccagatttgggatactgctggccaagaaaggtatcgtgcgattaccagtgcttactatcgaggcgctgtaggtgctctgcttgtatacgatgtcacacgacattccacttttgaaaatgttgagaggtggttaagggagttgcgagaccatacagatcctaacattgttgtcatgcttgttggtaacaaatcagatcttcgacacctggtggcagtctcaacagaggatgggaagtcttttgctgagaaggagtctctctattttatggaaacttctgcactagaagcaaccaatgtcgagaactcattcgccgaagtccttactcaaatctatcacattgtaagcaagaaagccatggaggctggtgaaggtgctgctgctgcctccgttccttcgaaaggagagaaaattgatgtcggaaaggatgtttccgctgtaaagaaagctggctgctgttcgagttaggcttttgatttgcattttttgatgtggctgatttgatattgctgcatctttatgtgcaccatagttgagtagaaattctgaagagatgtcttcaataggatattgatattccctggattgaattttatttactttccaatatattttggtctgaaaatttaagattgagcccagagagcttgattggtaacttggtaagaaggaatatatgcattaaatctattgatttcactt

SEQ ID NO: 15359 - DNA, 1204 bp, Gossypium hirsutum
tgataaacttgaaactctcccctgtttcacactctctttctcatatttttactccacacaaagcaaaagggaaagtaatatagtatcaacatcattggttttgagaggaaaaaaggaagggtgaaatatggctggttacagagcagaggatgactatgactaccttttcaaggtagttttgatcggtgattcaggtgtggggaagtctaatttactctccaggttcaccaggaacgagttcagcctcgagtccaagtctactatcggcgttgagttcgctactcgtagtttgaatgtggatggcaaggtcattaaagctcagatttgggacactgctggtcaagaaaggtaccgtgcaataacaagtgcctattaccgaggagctgtgggagcactccttgtgtacgacgttacacgccactccacattcgaaaacgtagagaggtggctaagagagttgagggatcacacagatcccaacatcgtagtcatgcttgtcggaaacaaatcagatcttcgtcacctcgtggctgtctcaaccgaggatgggaaatcctttgctgagaaagaatccctttacttcatggaaacttctgctctggaagctactaacgtggaaattgcatttgctgaagttcttactcagatatacaacatcgttagcaagaaagctatggagacaagcgatgatggggccgcttcagccgtgccctccaagggagagaaaattgatgtcggtaaagatgtctcggcaatgaagaaagggggttgctgttcaagctgatatggatctgaaagtctggggtttgttcagctgcattgatttctttgtaaaccattgtttcgtcacatatacgcaaaaagtgtgcattgtggaggcccgaacttggcttgtgaggtattgtccgcttttaacataggtccgagtttaagtctccacatataatatcatggtagatgcttaaaatttcttgatataggattggggtgttacatccataagctaaagtgctaaagtaggggattagcagataatggagattgagttacttgttggaaaatactattttctatcctttttccattttcaggcagatctaaaatgagtgaatggttttaaaggtattactttttaaggaaaaaaacaccttaaatgaagaaaaatatttgttttgtagctttccttcatcttttggtcaattgt

SEQ ID NO: 15360 - DNA, 954 bp, Cucumis sativus
ggtctttcccatttccatttcacaatctcgaaacaacaagatcaaaaatccaccccccaaaaagcgcccattctgagatctacctatttccccatttctttttctcttactccaaccaaagttcttcttcagaaggggaactccgatggctggttacagagctgaagatgactacgattacctctttaaggtggttttgattggagattccggtgtgggcaagtccaatttgctctcaaggttcaccaaaaacgagtttagcctcgagtccaagtccaccattggggttgagtttgctactcggagtttgaatgttgatggcaaggttgtcaaggctcagatttgggatactgctggccaggaaaggtatcgtgcgataactagtgcttactatcgaggtgctgttggtgcactccttgtctacgatgtcacacgacattccacttttgaaaatgtcgagaggtggttaagggagttgcgagaccataccgatcctaacattgtggtcatgcttgttggtaacaaatcagatcttcgacacctggtggcagtctcaacagaggatgggaaatcttttgctgagaaggagtctctctattttatggagacttctgcactggaagcaaccaatgtcgagaactcattcgctgaagtccttactcaaatttatcacattgtaagcaagaaggcaatggaggctggtgatggcactgctgctgcttccgttcctccgaaaggagagaaaatcgatgtcagtaaggatgtttctgctgtaaagaaagctggctgctgttcgagttaggctttaatttgcactttttttgatgtagctgatttgatactgctgcatccttatgtgcaacatagttgagtagaaattctaaagagatgtgttcaataggatatggatattccctggattgaattttatttactttccaatatattttagtt

SEQ ID NO: 15361 - DNA, 1209 bp, Gossypium raimondii
gggacatagaaaaagcatgataaacttgaaactatcccctgtttcacactctctttctcatattgttactccacacaaagcaaaagggaaagtaatatagtatcaacatcagtggttttgagaggaaaaaaggaagggtgaaatatggctggttacagagcagaggatgactatgactaccttttcaaggtagttttgatcggtgattcaggtgtggggaagtctaatttactctccaggttcaccaggaacgagttcagcctcgagtccaagtctactataggcgttgagttcgctactcgtagtttgaatgtggatggcaaggtcattaaagctcagatttgggacactgctggtcaagaaaggtaccgtgcaataacaagtgcctattaccgaggagctgtgggagcactccttgtgtacgacgttacacgccactccacattcgaaaacgtagagaggtggctaagagagttgagggatcatacagatcccaacatcgtagtcatgcttgtcggaaacaaatcagatcttcgtcacctcgtggctgtctcaaccgaggacgggaaatcctttgctgagaaagaatccctttacttcatggaaacttctgctctggaagctactaacgtggaaattgcatttgctgaagttcttacgcagatatacaacgtcgttagcaagaaagctatggagacaagcgatgatggggctgcttcagctgtgccctccaagggagagaaaatcgatgtcggtaaagatgtctcggcaatgaagaaagggggttgctgttcaagctgatatcgatctgaaagtctggggtttgttcagctgcattgatttctttgtaaaccattgtttcgtcacattttcgtaaaaagtgtgcattgtggaggcccgaacccgacttgtgaagtattgtccgcttttaacataggtccgagtttaagtctctacatataatatcgtggtagatgctttgaatttcttgatataggattggggtgttacatccataagctaaagtgctaaagtaggggattagcagataatggagattgagttacttgttggaaaatactattttctatcctcttccattttcaggcagatctaaaatgaatgaatggttttaaaggccttactttttgaggaaaaaaaacaccttaaatgaagaaaaatatttgtgtttgtagcttttctatcatc

SEQ ID NO: 15362 - DNA, 1161 bp, Theobroma cacao
tagagggagagatcttaggcaaggcttaataaccttgaaacaacccgtatttcactctctctttctcatatttccttgaagtaaagcaaaggcgaagtaaaaaagagtgcaacaacggtggttttgagaagagtgaaaagatggctggttacagagcagaggatgactatgactaccttttcaaggtggtgttgatcggtgattcaggagtgggaaagtccaatctgctctcgaggttcaccaggaacgagtttagcctcgagtctaagtccaccattggcgtcgagttcgctactcgtagcttgaatgttgatggcaaggtcatcaaggcccagatttgggacaccgctggtcaagaaaggtatcgtgccataacaagtgcctactaccgaggagctgttggtgcacttcttgtgtacgatgttacgcggcactccacatttgaaaatgttgagaggtggttaagagagttgagagatcacacggatcccaacattgtagtcatgctcattggtaacaaatcagatcttcgtcaccttgtggctgtctcaaccgaagatgggaaatcctttgctgagaaagagtctctctacttcatggaaacttcagctctggaagctactaacgtggaaaacgcatttgctgaagttcttactcagatctaccatattgtgagcaagaaggctatggagacaggcgacgaaggggctgcttcagctgttccttccaagggcgagaaaattgatgtcagtaaagacgtctctgcaatgaagaaaggggggtgctgctcaagctaggatgttaacctgaagtcgattgtcttaaggatgtggctgggggtttgtttctgccgcatggatttctttgtaaaccttggttttgtaaaatttttctcaaaaaggtacctacagtaggggagatcggccgagattgatttaatttacattcaaaatttttccgggtggctgttataacttatttttagtagacaagaggcgaatgaggaacaaggtattacactattgcatttaaataggtgcttaggaaaatctgttggctgagaacagttgttcccggcacttatattgaaattaccatatctagtctttcccttcccaggcagacccaaaatgaatgaatgatggtacttatccttctctc

SEQ ID NO: 15363 - DNA, 1034 bp, Cucurbita pepo
ggacatggacgtcaattcaacaatttgtagagctcaaaataccaaagacgatttcttcataggaattccaaaatttagaaaaggaagacgcatcgtcgtccagcccagcgcagcggcaaacacagcggtctctcccatttccaacccccactgtctcgaaacaagaggaacaaagaaaagaacccccaaaaagcgaacactcgcagagatctgatccaaccaaagttcttcttcttgttcttcagaagggggactgcgatggccggctaccgagctgaagatgactatgattatctctttaaggtcgttttaattggagattctggtgtgggtaagtctaatttgctctccaggttcaccaaaaacgagtttagcctcgaatctaagtccactattggggttgagtttgctactcggagcttgaatgttgatagcaaggtcgtcaaggcccagatttgggatactgctggccaggaaaggtatcgtgcaataaccagtgcatactaccgaggcgctgtaggtgcactgctcgtctatgatgtcacacgacattccactttcgaaaacgtcgagagatggttaagagagttacgagaccatacagatcccaacatcgtcgtcatgcttgttggtaacaaatcagatcttcgacacctggtagcagtctcaacagaggatggaaaatcttttgctgagaaggagtctctgtattacatggaaacttctgcacttgaagcaaccaacgtcgagaacgcgtttgccgaagtccttactcaaatctatcacattgtaagcaagaaggccatggaggctggcgaggacgcagctgctgcttcggttccttcgaaaggagagaaaatcgacgtcggtaaggacgtttctgctgtaaagaaaggcggctgctgttcgagttaggcttttgatttgcatctttttcttatgagctccatagtttagtagaaattcttcagagatgtgttttataggatattgatattgcctggattggatttgatctactttccaatattttt

SEQ ID NO: 15364 - DNA, 639 bp, Linum usitatissimum
atctgtgtgttcgccgccacaaatcgcgaagatgcagattttcgtgaaaaccctgactgggaagaccatcaccctcgaggttgagagcagcgataccatcgacaacgtcaaggctaagatccaggataaggaaggaattcctccggatcagcagcgactgatcttcgctggaaagcagcttgaagatggccgtactctagctgattacaatatccagaaagagtcgactcttcatcttgtactgaggctgaggggaggaatcatcgagccttctttgatggctttggcgcgcaaatacaatcaagataagatgatttgccgcaaatgctatgctcgtctgcatccaagggctgtgaactgccgcaagaagaagtgtggacacagcaatcagttgaggcctaagaagaagatcaagtagactgtcgattgtgatgcagagttcagcagctgggatagcttttgtcgcagtcttcggtatttgtttgtttggtttaaagcttgttttgcagaatagttcggaaacagtatcatgttttcaaaacactttctttcaagtacctctttaaccggctataggaattctcaagacaaatcatgttttcaaaaccgtaccgatatgcattccaaatattcggaatc

SEQ ID NO: 15365 - DNA, 609 bp, Avena sativa
gcgatcgagagggcgcaaagatgcagatcttcgtgaagacgctgacggggaagacgatcaccctcgaggttgagagcagcgacaccatcgacaacgtcaaggctaagatccaagacaaggaaggcatccctccggaccagcagcgtctcatctttgcggggaagcagctcgaggatggccgcaccctagcagactacaacatccagaaagagtcgacgcttcaccttgtgttgcgcctccgtggtggcagcagaggcggccaccccaagaacctcgagcccaatctccgcatcctcgctcaaaagtacaatgagaacaagctggtctgccgcaagtgctacgcacgtcttcccgctagggctacaaattgccgcaagaagaagtgtggccatagcaatgagctgaggccaaagaacaaatttatgtcaaagtttgcaacggactaaacattggaaaggaagcacacatgagatgaatcaactttattggcatcatacaatagatttattatcattagattttaatgtacttgtgttattttaaagttcctgctacatctgaagctttgttacactttcgaacattggcatgaataaataagatgatatg

SEQ ID NO: 15366 - DNA, 1439 bp, Brassica napus
tataaaacgagaagacaagatttgataaatgtcgacagagtaaagagcacagcgaataacaaaagcgtaaaatttttgacgaacacataatgtttctctcaacgtctgcaaccagtaactattgctaggacagagtcacacaacaattaaattatttttttatgaaagagaaaaaggatctctagctcttgggagccaccttttccttggccttttggagcttcaagaccttcttcacaatcttttgctcttccacaaggaaagcacggacgattctctccctaacagccaaagcagacaaaacaccgccataagcacggttcacggtcctcctgtttctggataatcgagacctcttgtactcagcaggcctcaagtgagggataccctggatacgcttgccggtaacggggcattttggtccacttgcacgcttcttagtggtctggtatgtcaatttaccacctggggttttgacgatcctgtgctggttggacttggtggcgtagctgtgacgcgaacggtatacaaggcgctgcaccatttctccttttaggtctttatcctcctcgacgacggagcggatctctatctctctctctccctctctcgattccgaaactattccgcagagtgaagaaggatggggttgtctttcgggaagcttttcagcaggctttttgccaagaaggagatgaggattctgatggttggtcttgatgctgctggtaagaccaccatcttgtacaagctcaagctcggagagattgtcaccaccattcccactattgggttcaatgttgaaactgtggagtacaagaacatcagcttcacagtgtgggatgtcgggggtcaagacaagattcgtccgttgtggaggcactacttccagaacactcaaggtctcatctttgtggtggacagcaatgacagagaccgtgttgttgaggctagagatgaattgcacagaatgctcaatgaggatgagctgcgtgatgctgttctgctcgtgtttgctaacaagcaggatcttccaaatgccatgaacgcagctgagatcaccgataagcttggtctccactctctccgtcagcgtcactggtacatccagagcacatgtgccacttcaggagaggggctttacgaaggtcttgactggttgtccaacaacatcgccggcaaggcgtagagggaaagattgtggttgagctgattttgctgggcaaatctggatgcaggggcaaacattatctgattttttctttattgttctgtttcttttttggtttcgggtatttggatttgattttgtgatcgttgttctgattgtgcaaggaggagtctattgcacgtagaacatagaaactgcctttttatatagtttgtaatcgaagatttactctacttctttctgcttcacgtttcatttttgaatttca

SEQ ID NO: 15367 - DNA, 1382 bp, Aquilegia formosa
caacaacaacaacaacaagctttcttattttgctctcactagctttcaaactttcttcttcttcttttagcttcaagaaacttttttaaacatggcacctaacatcatttcaactgcaactaagactgttggtttcacaaaacaagcgagtataccaagcagagcttttgtaacgtttttggctggtaatggagattatgtgaaaggtgtagttggtttagccaaagggttaagaaaagtgaaatctgcttacccacttgttgtcgcaatcttgcctgacgttccagaagaacatcgtcggattcttgaatctcagggatgtattgttcgtgaaattgaacctgtttatccaccagaaaaccaaactcagtttgctatggcttattacgtcattaactactccaaattacgtatttgggagtttgtggagtatagcaagatgatatacttagatggtgatattcaagtgtttgaaaacattgatcatctttttgatcttcctaacgggtatttttatgctgttatggattgtttctgtgagaaaacatggagtcatactcctcagtataaacttgggtattgccaacagtgtccaaacaaggtgcagtggcctgccgagatgggccaacccccatcactctatttcaatgcaggcatgtttgtgtatgagccaagtttatcaacttatgatgatctattgaagcaagtcaaaaccacccctcctacaccttttgctgaacaagactttttgaacatgttctttaaggatatttacaagcctatccctttggtgtacaacctcgtattagctatgttatggcgccacccagaaaatgtagaactggagaaagtgaaagtggttcattattgtgctgcgggatcaaagccatggaggtatacagggaaggaagaaaacatggacagagaagatataaagatgttagtgaagaaatggtgggacatttacgatgacgcttcacttgattacaagaggagtgttgctccttcaattccagagactggtgaaaaccttcaaccatttctggctgctttatctgaagctggagtggttcactatgttactgctccatcggccgcatgatgcatggaccatctgctgtgctgattgctgagtgtgtgtgtgaagttataatgcagtattaatgtaatagaatagaaattgtatacaggcagatggtctcaaatttctgttttcgtttgttagatttgcgacttggaattggccgtatatgtggctgtttcaaagagatgcaaggcactctagctgtcaatatatatttatacctaatgtaaatggattttgcttgtttattcttttgagcatgagattgattagtaatcctatccaacgcttgaatctt

SEQ ID NO: 15368 - DNA, 1450 bp, Cocos nucifera
ccggaagctgcccccatcacccgtctcgcttccacataaaaagatccggcccgagacgactaaaatctcgcctctcccctataaaaacggggaaagacggacacaaacgcaagccaccgccaccgccaccgccaccgtgcgagaccggggaggaggagaaccctatcgagtccagctctttctttccttcttgttcttgttaattaagatccaagaagaagagagaagtaagggaagaggggaaaaagaagagagggatggcggggtatagggcggaggatgactacgactatctgttcaaggtggtgctgatcggggactcgggggtggggaagtcgaatctgctgtcgaggttcaccaggaacgagttcaacctcgagtccaagtctaccatcggcgtcgagttcgccacccgcagcctcaacgtcgacggcaaggtcatcaaggcccagatttgggacaccgccggccaagaaaggtatcgtgccatcaccagtgcatactaccgaggagctgtaggtgcattgcttgtgtatgatgttactcggcatgcaacattcgagaatgctgagcgctggttgcgggagttgagagaccatacggatccaaatatagttgttatgcttgttggaaacaaatctgatcttcgtcatcttgtagctgtttcaacagaagatgggaaagcttttgcagagagggagtcactctatttcatggagacatccgcattagaagcaacaaatgtggaaaatgcctttgctgaggtcttaactcagatttatcggattgtaagcaaaaaagcagttgaggcaggtgatgattctgcttctgcagtccccagtaaaggggagaaaattaatgtgaaggatgatgtttctgctctaaagagagttggctgctgctcttcttaagttacaacgaaccttttccaaggtaagggcctgtttcagatgaattgtgtgatttggtgtaattccttttctcctctggagactggagtcaagacatggtttgtagctaaaggtttggataggttctgtttttattacttattatccaagaacgggagagcttgcttaggtttggttttactagatctgatatagccaaagttgttctttagagacatacagatttacatttccatgtttagattgtagcaattgcgcacaaattcctagcggattcaaaggttcaaattatgagcaatatatggcaacactggaatccacaggttccaagtgatggtagttcatactttgtaacctaattcagttttcaacctatcatgcaagaaaatttggaccaataatgcagctttttcctgaaatatttcttccttctctggatcaaacacaaccttgtttctggagaggtaaattgcggaataattactcccagagcagcatgattgttgtcgaatccttctgatgtttaaaacgtgaatgtg

SEQ ID NO: 15369 - DNA, 1060 bp, Cocos nucifera
gaagagagagatggccggttacagggcggaggacgactacgactatctgttcaaggtggtgctgatcggagattcgggggtggggaagtcgaatctgctgtcgaggttcaccaggaacgagttcagcctcgagtccaagtccactatcggtgtcgagttcgccactcgcagcctcaatgtcgatgccaaggtcatcaaggcccagatttgggacaccgccggccaagaaaggtatcgtgccatcaccagtgcgtactaccgaggagctgtaggtgcattgcttgtctatgatgttacccggcattcgacttttgagaatgctgagcgctggttgcgggagttgagagaccatacagatccaaacatagtcgttatgctcgttggaaataagtctgatcttcgtcatcttgtggcggtttcaactgaagatgggaaagcttttgcagagagagagtcgctctatttcatggaaacatctgcactagaagccacaaatgtggaaaatgcctttgcagaggtcttgactcagatctatcggattgtaagcagaaaggctgtggaggcagctgatgactctgcctctccagtccccagcaaaggagagaaaattaatgtcaaggatgatgtttctgcactaaagagagttggctgctgctcgtcttaagttacaacggaccttttcagaggtaaggggcctatttcagatgcttctgtgatttgctgtaatagatttctttttctatttggttgagacattgtttgtagctgaagggtttggttaggttctgtttttattacgtgtcattcaagaacatgagaccttgattaggcttggtttttactagatttgttattttgagatgatgaccaagtttattagaaagtcttttattggagacatgtagttctacatttccatgcttacattgtagcagtagcgtgcagattctaagtggattcaaagttttcaagttattggcaatacgtagcagcattgaaaaatccagagttccaagtgatggtaattcttgaaattagaacaagccaatggtgctacctt

SEQ ID NO: 15370 - DNA, 1006 bp, Phalaenopsis aphrodite
cgccgcgggaggaatccacaaaaatacttcgcttccccccgcggcgagagagggagagagagaaagagaggagcaatggcggcgtacagagcagaggacgattacgactacctgtttaaagtggtgctaatcggggactcgggagtggggaaatcgaacctcctctcgaggtttacgaggaacgagttcagtcttgagtcgaagtccaccattggggtggagttcgccaccaggagcgtcaatgtagatggcaaggtcatcaaggcgcagatttgggacaccgcaggccaggaaaggtaccgtgcgatcacgagtgcttactatcggggagccgtcggcgcattgcttgtctacgatgtcactcggcacgccacctttgagaacgcagaacgatggctacgcgaactaagggaccacaccgatccaaatatcattgtcatgcttgtcggaaacaaatccgatctacgtcatctcgtcgccgtcagcaccgaagacagcaaagcctttgcggagaaagaatccctttatttcatggagacgtcggcccttgaagccaccaacgtcgagaatgctttcgccgaggtcttaacgcagatctaccgcattgtgagcaagaagataattgattcgggtgatgatggcacgagttctgttcccggcaaaggggagaagattaatgttaaggatgatgtgtctgctctcaagaaagctggctgctgctcaagttgagcttagaaaatgttgtgggaagtaatattattatatagctttatttgtttttagtttctttgtattttcctattttggaacttttttctaatgtgtttttgaagtgttaaacatctttgatgttgatgcggctgtgtgatttaggaatgaattggtagtttcaaggaagatttgtagtgaaaatattgtagaaaaattatgatttatgtggacgccatcttgttattttgattggagctgtactttgggggaggagttttccatttgtataatattc

SEQ ID NO: 15371 - DNA, 902 bp, Cleome gynandra
tcggggtagaatcttgaaaaatcttaaaaggcaaatccgaagtgagagcttcgggtccgtgaactggaaacgagccataagggttcgttcctctttctctattgggtttcacggatcaaaggagaaattagggtttttaatcgacgtggatcagtcaaagtgaaggttttttttagctgcgttaatggcgggttacagagcagatgacgactacgattaccttttcaaggtggttctgattggtgattctggtgtaggaaagtctaatttactctctcggttcaccaggaacgagtttagtctcgagtccaaatccacgatcggcgttgagttcgcgactcggagcttaactgttgatgggaaagtcatcaaagcccagatttgggatactgctggtcaggaaaggtaccgtgccattacaagtgcttattaccgaggagctgtaggagcgcttcttgtctacgatgtcacacgacactcgacgtttgaaaacgtggagaggtggctgagggaacttagggaccatacggatccaaacatcgtagtaatgcttgtgggaaacaaatctgatttacgtcacctcgtggctgtccaaacagatgattcaaaatcctttgctgaaaaagaatcactttacttcatggaaacgtcggcccttgaatctacgaatgttgaaaatgcatttgcggaagtgcttacgcagatttatcatatcgtgagcaagaaggcgatggaagcgaatgacgaggcggctaatgttccttccaaaggagagaagattgatgtgagtaaagatgtttctgctgtcaagaaaggtgggtgctgttcgaattagggttcttgtttaagaggatcaaatcaaaatgtgttttttttctttactttacactacctaaaatttc

SEQ ID NO: 15372 - DNA, 1117 bp, Arabidopsis lyrata
agctagaaagacaccagtcttaccctaactttattcaaagtctctgtctttctgtagaaatctgggaaaataatttgaatctaaagagaaaaaagaagaaaagcaaaatcgaagtgaaggtgtgggatcaaagagcaattttcttttctttattggtagaaagtgtgaagctttttgatttagtgagaagtgttaatggcgggttacagagctgatgatgattatgattacctattcaaggtggttctgatcggtgattcaggtgttggaaagtccaatttgctttctcgattcaccaggaatgagtttagtctcgagtctaaatcaacgatcggggttgagttcgcgactcgtagcttgaatgttaatgaaaaagttatcaaagcccagatttgggatactgctggtcaagaaagataccgagcaatcactagtgcttactaccgaggagctgttggggcgcttcttgtctacgatgtaacccgacactcaacatttgaaaacgttgagagatggctaagggaactccgtgaccatactgacccaaacatagttgtgatgcttgtgggaaacaaatccgatcttcgccatcttgtggcggtccaaaccgaagatgcaaaatcttttgcagaaaatgaatcactctacttcatggaaacctcagctcttgaatctactaatgttgagaacgcgttttctgaagtactcactcagatttaccatgttgtgagcaagaaagcaatggaggctggtcaagattcgggtaatgttccttcgaaaggagaaaagatcgatgttgatgtctccgctgtgaagaaaaccggttgctgctccaactaaaagactacagattgaggaatttggtctgtgtcctcaaagctgcaatcggtttttaaattttacattcaattttttttttgaagatgtttgcctttttttttttaggaaacaatctatgttatgctttgttttgcttgcttgaaaattgcttaggtttggtctgattctgtaccggtcaagggattttgtaattcaatccgcaaatatctctaaaccaatatttattgtgctaatccttgaacacaaaaactaatttttgttataccaatttagaaaa

SEQ ID NO: 15373 - DNA, 1151 bp, Arabidopsis thaliana
ccagctagaaagacaccagtcttaccctaacttttttcaaagtctgtgtctttctgtagaaatctgaggaataaatatttgaatctaaagagaataaagaagaaagtaaaaaagcaaaatcgaagttttgttcaattttctgggatcatagagcaattttcgtttctttattcgttgaaagtgtgaagcttttttgattcagtgagaagtgttaatggcgggttacagagcagatgatgattacgattacctattcaaggtggttctgatcggtgattcaggtgttggaaagtccaatttgctttctcgattcaccaggaacgagtttagtctcgagtctaaatcaacgatcggggtcgagttcgcgactcgtagcttgaatgttaatgaaaaagtcatcaaagcccagatttgggacactgctggtcaagaaagataccgagcaatcactagtgcttactatcgaggagctgttggggcgcttcttgtttacgacgtaacccgacactcaacattcgaaaacgttgagagatggctaagggaactccgtgaccacactgacccaaacatagttgtgatgcttgtgggaaacaaatccgatcttcgccatcttgtagcagtccaaaccgaagatgcaaaatcttttgcagagaatgaatcactctacttcatggaaacctcagctcttgaatctaccaatgttgagaacgcgttttctgaagtactcactcagatttaccatgttgtgagcaagaaagcaatggaggctggtgaagattccggtaatgttccttcgaaaggagagaagatcgatgttgatgtttccgcagtgaagaaaactggttgctgctccaactaaatggtcttatgtcctaaagctgaaatcggtttttaaattttacattcaaattttgtttttgaagatgtttgcttttttttaggaaaacaaactatgttatgccttttgatttgcttgtttgaaaattgcttagctttggtctgattctgtaccggttaagggattttgtaatttaaccggttctggtctatggtttgtttttaattcaatccgcaaatatctctaaaccaatatttattgtgctaatccttgaacacaactaatttttgttataccaatttagaaaattttc

SEQ ID NO: 15374 - DNA, 864 bp, Pseudoroegneria spicata
ctcccccctgcctcgtcgcggaacagtgctcacaccgccggcgccatgagtaagttgcagagcgacgccctgagggaggcaatcacaaacattaccaatgactgccgtgagaagaaccgcaagttcgttgaaaccattgagctgcagattggtctgaagaactatgacccgcaaaaggacaagcgtttcagtggttctgttaagcttcctcacatccctcgcccaaagatgagggtttgcatgcttggtgatgcccagcacgttgaagaggcagggaaaatgggcctagactgcatggatgtggaatcccttaagaagatgaacaaaaacaagaagctagtcaagaagcttgcaaagaagtatcatgctttccttgcatctgaggctatcattaagcagattccccgacttcttggacctggtcttaacaaggcaggaaagtttccaactttggtgtctcaccaggaatcccttgagtccaaggttaatgagaccaaggccacagtcaagttccagttgaaaaaggtgctttgcatgggtgttgccgttggccacctgggtatggaggagaagcagatcttccagaacgtgcagatgagcgtgaacttcctcgtctctctgttgaagaagaattggcaaaacgtgagatgcttgtacctgaagagcacgatgggaaaggtgtaccggttgttctagactctagtcttctaggatttccaggagattgacaacttgaggacttttgttgttttctcaactatcaaattttcgtgcgtggcaagcgacaattaaaccgttggattattgtcttgtactgagatggtttgttctattgtctggaatttgatgacattttatccaaga

SEQ ID NO: 15375 - DNA, 894 bp, Secale cereale
gtgctcccaccgccggcgccatgagtaagttgcagagcgacgccctgagggaggcaatcacaaacattatcaatgactgccgtgagaagaaccgcaagttcgtcgaaaccattgagctgcagattggtctgaagaactatgacccgcaaaaggacaagcgtttcagtggttctgttaagcttcctcacatccctcgcccaaagatgagggtttgcatgcttggtgatgcccagcacgttgaagaggcagggaaaatgggcctagactgcatggatgtggaatcccttaagaagatgaacaaaaacaagaagctggtcaagaagcttgcgaagaagtatcatgctttccttgcatctgaggctatcattaagcagattccccgacttcttggacctggtcttaacaaggcaggaaagtttccaacgttggtgtctcaccaggaatcccttgagtccaaggttaatgagaccaaggccacagtcaagttccagttgaagaaggttctttgcatgggtgttgccgttggccacctgggtatggaggagaagcagatcttccagaacgtgcagatgagcgtgaacttcctcgtctctctgttgaagaagaattggcaaaacgtgagatgcttgtacctgaagagcacgatgggaaaggtgtaccggttgttctagactatagtcttctaggatttccaggagattgacaacttgggaacttttgttgctttctcaattattatcaaattttcgtgcgtggccagtgacagttaaacagttgcaactattgtcttgtactgagatggtttgttctattgtctggaatttcatgacattttatcctttaaaaaaaaaaaaaactagagactgcagacgacacagggagtagggggggggg

SEQ ID NO: 15376 - DNA, 854 bp, Leymus cinereus x Leymus triticoides
gtgctcccaccgccggcgccatgagtaagttgcagagcgaatccctgagggaggctataacaaacattaccaatgattgccgtgagaagaaccgcaagttcgttgaaaccattgagctgcagattggtctgaagaactatgacccgcaaaaggacaagcgtttcagtggctctgttaagcttcctcacatccctcgcccaaagatgagggtttgcatgcttggtgatgcccagcatgttgaagaggcagggaagatgggcctagactgtatggatgtggaatcccttaagaagatgaacaaaaacaagaagctagtcaagaagcttgcaaagaagtatcatgctttccttgcatctgaggctatcattaagcaaattccccgacttctaggacctggtcttaacaaggcaggaaagtttccaactttggtgtctcaccaggagtcccttgagtccaaggttaatgagaccaaggccacagtcaagttccagttgaaaaaggtgctatgcatgggtgttgccgttggccacctgggtatggaggagaagcagatcttccagaacgtgcagatgagtgtgaacttccttgtctctctgttgaagaagaattggcaaaacgtgagatgcttgtacctgaagagcacgatgggaaaggtgtaccggttgttctagtcttctaggatttccaggagatttgacaacttgagaacttttgttcctttctcaattatcaaactttcgtgcgcgacgagtgacaattattgtcttgtactgagatggtttgttctattgtctggaatttcatgacattttatccgttgtccctgtgccttactactgctctgcctgctgtca

SEQ ID NO: 15377 - DNA, 1015 bp, Secale cereale
tccgtctgacccgcccctcttctccctctctgtcgctgcgcaggaacagtgctcccaccgccggcgccatgagtaagttgcagagcgaagccctgagggaggcaatcacaaacattatcaatgactgccgtgagaagaaccgcaagtttgttgaaaccattgagctgcagattggtctgaagaactatgacccgcaaaaggacaagcgtttcagtggttctgttaagcttcctcacatccctcgcccaaaagatgagggtttgcatgcttggtgatgcccagcacgttgaagaggcaggaaaaatgggcctagactgcatggatgtggaatccctcaagaagatgaacaaaaacaagaagctggtcaagaagcttgcaaagaagtatcatgctttccttgcatctgaggctatcattaagcagattccccgacttcttggacctggtcttaacaaggcaggaaagtttccaactttggtgtctcaccaggaatcgctcgagtccaaggttaatgagaccaaggccacagtcgaagttccagttgaagaaggttctttgcatgggtgtggccgttggccacctgggtatggaggagaagcagatcttccagaacgtgcagatgagcgtgaacttcctcgtctctctgttgaagaagaattgggcaaaacgtgagatgcttgtacctgaagagcacgatgggaaaggtgtaccggttgttctagactctagtcttctaggatttccaggagattgacaacttgggaacttttgtttgctttctcaattattatcaaatttttcgtgcgtgccagtgacagttaaacagttgcaactattgtcttgtactgagatggtttgttctattgtctggaatttcatgacattttatccttttgcccctttgccttactgattgatgcttgctgtcaatcagtttaacactagattcagcattggtatttacgacagtaagctgtgtttgatagagtattataaaaccaagagtattttgcct

SEQ ID NO: 15378 - DNA, 838 bp, Secale cereale
gctcccaccgccggacgccatgagtaagttgcagagcgaagccctgagggaggcaatcacaaacattatcaatgactgccgtgagaagaaccgcaagtttgttgaaaccattgagctgcagattggtctgaagaactatgacccgcaaaaggacaagcgtttcagtggttctgttaagcttcctcacatccctcgcccaaagatgagggtttgcatgcttggtgatgcccagcacgttgaagaggcaggaaaaatgggcctagactgcatggatgtggaatccctcaagaagatgaacaaaaacaagaagctggtcaagaagcttgcaaagaagtatcatgctttccttgcatctgaggctatcattaagcagattccccgacttcttggacctggtcttaacaaggcaggaaagtttccaactttggtgtctcaccaggaatcgcttgagtccaaggttaatgagaccaaggccacagtcaagttccagttgaagaggttctttgcatgggtgttgccgttggccacctgggtatggaggagaagcagatcttccagaacgtgcagatgagcgtgaacttcctcgtctctctgttgaagaagaattggcaaaacgtgagatgcttgtacctgaagagcacgatgggaaaggtgtaccggttgttctagactatagtcttctaggatttccaggagattgacaacttgggaacttttgttgctttctcaattattatcaaattttcgtgcgtggccagtgacagttaaacagttgcaactattgtcttgtactgagatggtttgttctattgtctggaatttcatgacattttatcct

SEQ ID NO: 15379 - DNA, 683 bp, Secale cereale
tgagtaagttgcagagcgacgccctgagggaggcaatcacaaacattatcaatgactgccgtgagaagaaccgcaagttcgttgaaaccattgagctgcagattggtctgaagaactatgacccgcaaaaggacaagcgtttcagtggttctgttaagcttcctcacatccctcgcccaaagatgagggtttgcatgcttggtgatgcccagcacgttgaagaggcagggaaaatgggcctagactgcatggatgtggaatcccttaagaagatgaacaaaaacaagaagctggtcaagaagcttgcgaagaagtatcatgctttccttgcatctgaggctatcattaagcagattccccgacttcttggacctggtcttaacaaggcaggaaagtttccaacgttggtgtctcaccaggaatcccttgagtccaaggttaatgagaccaaggccacagtcgaagttccagttgaagaaggttctttgcatgggtgttgccgttggccacctgggtatggaggagaagcagatcttccagaacgtgcagatgagcgtgaacttcctcgtctctctgttgaagaagaattggcaaaagtgagatgcttgtacctgaagagcacgatgggaaaggtgtaccggttgttctagactatagtcttctaggatttccaggagattgac

SEQ ID NO: 15380 - DNA, 941 bp, Secale cereale
tgagtaagttgcagagcgaagccctgagggaggcaatcacaaacattatcaatgactgccgtgagaagaaccgcaagtttgttgaaaccattgagctgcagattggtctgaagaactatgacccgcaaaaggacaagcgtttcagtggttctgttaagcttcctcacatccctcgcccaaagatgagggtttgcatgcttggtgatgcccagcacgttgaagaggcaggaaaaatgggcctagactgcatggatgtggaatccctcaagaagatgaacaaaaacaagaagctggtcaagaagcttgcaaagaagtatcatgctttccttgcatctgaggctatcattaagcagattccccgacttcttggacctggtcttaacaaggcaggaaagtttccaactttggtgtctcaccaggaatcgctcgagtccaaggttaatgagaccaaggccacagtcaagttccagttgaagaaggttctttgcatgggtgttgccgttggccacctgggtatggaggagaagcagatcttccagaacgtgcagatgagcgtgaacttcctcgtctctctgttgaagaagaattggcaaaacgtgagatgcttgtacctgaagagcacgatgggaaaggtgtaccggttgttctagactatagtcttctaggatttccaggagattgacaacttgggaacttttgttgctttctcaattattatcaaattttcgtgcgtggccagtgacagttaaacagttgcaactattgtcttgtactgagatggtttgttctattgtctggaatttcatgacattttatccttttgcccctttgccttactgcttgatgcttgctgtcaatcagtttaacaccagattcagcattggtatttacgacagtaagctgtgtttgatagcaaagtattataaaaaccagagtatttt

SEQ ID NO: 15381 - DNA, 903 bp, Secale cereale
cgtcccacccgcccggccggcgactgagaagttaggcagagcgaagccctgagggaggcaatcacaaacattatcaatgactgccgtgagaagaaccgcaagtttgttgaaaccattgagctgcagattggtctgaagaactatgacccgcaaaaggacaagcgtttcagtggttctgttaagcttcctcacatccctcgcccaaagatgagggtttgcatgcttggtgatgcccagcacgttgaagaggcaggaaaaatgggcctagactgcatggatgtggaatccctcaagaagatgaacaaaaacaagaagctggtcaagaagcttgcaaagaagtatcatgctttccttgcatctgaggctatcattaagcagattccccgacttcttggacctggtcttaacaaggcaggaaagtttccaactttggtgtctcaccaggaatcgctcgagtccaaggttaatgagaccaaggccacagtcaagttccagttgaagaaggttctttgcatgggtgtggccgttggccacctgggtatggaggagaagcagatcttccagaacgtgcagatgagcgtgaacttcctcgtctctctgttgaagaagaattggcaaaacgtgagatgcttgtacctgaagagcacgatgggaaaggtgtaccggttgttctagactctagtcttctaggatttccaggagattgacaacttgggaacttttgttgctttctcaattattatcaaattttcgtgcgtgccagtgacagttaaacagttgcaactattgtcttgtactgagatggtttgttctattgtctggaatttcatgacattttatccttttgcccctttgccttactgattgatgcttgctgtcaatcagtttaacactagattcagc

SEQ ID NO: 15382 - DNA, 914 bp, Pennisetum glaucum
cagagtacgcggggatccgttcttgtccgcctcttcgcaggaacgctgctcgcaccagcaccgccggcgccatgagtaagttgcagagcgatgttctgagggaggcgattgcctcaattaccaatgacgcccgtgaaaagcagcgcaagtttgttgaaaccattgagctgcagattggactgaagaactatgaccctcaaaaggacaagcgtttcagtggttctgttaagctgcctcacatccctcgccctaagatgaaggtttgcatgcttggtgatgctcagcatgtcgaggaggcagggagaatgggtctggacagtatggatgtggaagccctcaagaagatgaacaaaaacaagaagctagttaagaagcttgcaaagaaataccatgctttccttgcatctgaggccatcattaagcaaattcctcgtcttcttggacctggtcttaacaaggcaggaaagttccctactttggtgtcccatcaggaatcccttgaatccaaggttaacgaaaccaaggctacagttaagttccagctgaagaaggtgctttgcatgggtgttgctgttggcaactgcggcatggacgagaagcagatcttccagaatgtgcaaatgagcgtcaacttccttgtgtcactcttgaagaagaattggcagaatgtgagatgcctgtacctgaagagcactatgggaaaggtgtaccggttgttctaaatctttatcttaggcttgtagaattttcaggagacttactggggtacttttgctattttatctaccaccatttttttgtgccaaccagtgaggattaaggagttaaatccccattgtcttgtgcgagatgttttccttcttgttatcgaacctatggcaatatcttatttcaacatttttgtcgctacctaa

SEQ ID NO: 15383 - DNA, 994 bp, Saccharum officinarum
ccggacgccgacgccgccgccgccgccgctcgctctgtcgcccgctatcctctcccgaccacagcccgaaggaacgttgcttgcacttccagtggcggcgacatgagtaagctgcagagtgatgctctgagggaggcgattgcctcgattactaatgattcccgtgagaagcagcgcaagtttgttgagaccattgagctgcagattggtctcaagaactatgaccctcaaaaggacaagcgtttcagtggttctgttaagctgcctcacatccctcgccctaagatgaaggtttgcatgcttggtgatgctcagcacgttgaggaggcagagagaataggtctagacagtatggatgtggaagccctcaagaagatgaacaaaaacaagaagctagtcaagaagctggcaaagaagtaccatgctttccttgcgtctgaggctatcattaagcaaattcctcgtcttcttggtcctggtcttaacaaggcaggaaaattccctaccttggtgacacaccaggaatctctggagtccaaggttaacgagaccaaggctacagttaagttccagctaaagaaggtgctttgcatgggtgttgctgttggcaactgcggtatggaggagaagcaaatcttccagaatgtgcaaatgagcgtcaacttccttgtgtcactcttgaaaaagaattggcagaatgtgagatgcctgtacctgaagagcactatgggaaaggtgtaccgggtgttctaaactttccaattaggcttagaatttcctggagacttgagtgcttgggcgcctttgcaattttccctaccaaccaatattttgtgcaactactatcgaggattaagtagttaaaaccctggtcttgtatggatgttctggttcatgataccgaacttatgacattatcgtatttcaatgttgctgtcttcactcacgggtacagccgtacaggctttgatgatcttttattttcttgagccct

SEQ ID NO: 15384 - DNA, 993 bp, Distylium racemosum
gactgatcagcggaggtagaagcgaagaacgagcgaggcggctgttctctgtaaatcatgagtaagcttcagagcgatgtgttgagggaggccatcactcaggtgatggcggacagcaaggagaagaatcgcaagttcacggagacgatcgaattgcagattgggctgaagaactatgacccccagaaggacaaacgttttagcggttccgtcaaactcccccacatccctcgccccaaaatgaaggtctgcatgctcggtgatgcccagcatgttgaggaggctgagaaaataggtttggactacatggatgttgaagctttaaaaaagatgaacaaaaacaaaaagcttgttaagaagctggcaaagaaataccatgcttttcttgcatcagaagctatcatcaaacagattcctagactacttggtcctggtcttaacaaggccggtaagtttcctactttggtatcacaccaagagtctttggaggccaaggtgaatgaaacaaaagcaactgtcaagtttcaattgaaaaaggtgctttgtatgggtgttgctgtgggaaactgtggcatggaggagaagcaggtattccaaaatgtccagatgagtgtcaactttctggtttccttgctgaagaagaattggcaaaatgttcgttgtttgtacctgaagagcaccatgggcaagccttctcgaatattctaattgtggaacctaattctagcttttgatgattggaactttgaaattgtttgtagtcttgttggtttaggatacgtattttcaaacagtttactttgatatggtcttgcagttgagttttaatataactttgtgcagaggcagttgttgtcctgtaggcacaatttacattttgtaattgacggattattctattatcatcataaaatagttatgatggtaatttatgggttttttcaacggaatattctattatcattatatgatggtaatttttgtcttcttttc

SEQ ID NO: 15385 - DNA, 1311 bp, Pinus pinaster
attggggggccccgtacatcacatgaatgccatgaaatctatgtaaccttaagccctagcagccacattagaccttaacatgtaattcatgtaaccctaaatctctgtggtcacattagccctatataatgtcagtatattagggtttttatctctcagttcgatcctaaaccctaattgagggccggtcgtgtctaggagagcgcgtgcagaggaaggcgcaaggccagggcaaaaatgagtaagcttcagagtgatgcgttgagggaggccatctcccagatcatgggagatactaaggagaaacaacgtaaattcacagagacaatcgagttacagattggcctaaaaaattatgatcctcaaaaggacaagcggttcagtggttctgttaagttacctcacattcctcgccctaagatgaaggtttgcatgcttggagatgctcagcatgtggaagaggctgaaaaattaggcttggattatatggatgttgaaggactaaagaaaatgaacaaaaacaagaaattggttaagaaacttgcaaagaaatatcatgcctttcttgcttcagaagcaatcattaaacagatacctcggcttcttgggcctggtctcaacaaggctggcaaatttcctacccttgtatctcaccaagagtccctggagggaaaagtgaatgaaaccaaagcaactgtcaaatttcaattaaaaaaggttctatgcatgggggttgctgtggggaactgtggaatggaagaaaaacagatttttcagaatgtgcaattgagtgttaacttccttgtatcactactgaagaagaactggcagaatgttaggtgcctatatttgaagagtaccatgggaaagcctaaccgtgttttctgagtggagcagagtggagatattataatgacactttatttttgtgtaactattaaacataggttatttttacttaatttctaccaaactaattgattttgatgcaaatattgaggaattgagaaatgtaagtgctggtaaattgctgttttgaacaatagaatttgttttctattggaatagctcgggtcatggttttagactttaagcctgacattcaatgttctaaaatcatgttgtggtattgaagtctatctagatttttaattagtgacattattgttagagagccttttgttcaattggaaattatctcatgcaaggggattgtttctttgttgtaaatttatttgatttgtgttcctgatatgccttatttgtggcatcttggaattgttctacaacgataaatctcagacacgcgag

SEQ ID NO: 15386 - DNA, 1005 bp, Pseudotsuga menziesii
cgtaggagagcggagacagaggaaggctccaggtgaacaaatatgagtaagcttcagagtgatgcgttgagggaggccatctcccaggtcatggcagatagtaaggagaaacaacgtaaattcacggagacgattgagttacagattggcctcaagaattatgatcctcaaaaggacaagcggttcagtggctctgtgaagttgcctcacattcctcgccctaagatgaaggtttgcatgcttggagatgcccagcacgtggaagaggctgaaaaattagggttggattatatggatgttgaaggactcaagaaaatgaacaaaaacaagaaattggtcaagaagcttgctaagaaatatcatgcctttcttgcttcagaagcaataatcaaacagatacctcgacttcttgggcctggtcttaacaaggctgggaaatttcctacccttgtttctcatcaagagtccctggagggaaaagtaaatgaaaccaaagcaacggtgaaattccaattaaaaaaggtactatgtatgggggttgctgtgggaaactgtggaatggaagaaaagcagatttttcagaatgtacaattgagtgttaacttccttgtatcgctactgaagaagaactggcagaatgtaaggtgcttatatttgaagagtaccatgggaaagcctaaccggattttctgagtgtggagcagagtagagatattacaatagcactttctttttgtaaactattaaacataggttgtttatttaagttcaactgaactaattaattttgatgcaactattgaggaatagaggtagagatatgctggtaatttgctgttttgaatgatagaatttgcttttgtctattgaaattcctttggtcatggttttagacttaaacctaacattcattgttttataatcatgtgatggtgaagtctatcttgtttttcttagtatcatattgttaaagaaagtgctattgtaaactattaaacataggtt

SEQ ID NO: 15387 - DNA, 966 bp, Cyamopsis tetragonoloba
cacgaggctgtattcttcctgaatttgccgcagacgagagttttggaagatgagtaagcttcagagtgatgctctgcgagaggctatctcaggaatcatgactgattccaaggagaaaaatcgcaaatttgtggagactattgaactccaaattggtttgaagaactacgatccacagaaggataagcgttttagcggctctgtcaagttgcctcacatccctcgccctaagatgaaaatttgcatgcttggtgatgctcaacatgttgaagaggctgagaagataggcttggactacatggatgtcgaagcattgaagaagctaaataagaacaagaagttggtgaagaaacttgctaagaagtaccatgcttttttagcttctgaagctgtcattaagcagattcctcgtcttttgggtcctggtctcaacaaggcagggaagttccctacacttgtcactcaccaggagtcccttgagtcgaaggttaatgagactaaggccatggtcaaatttcaactcaagaaggttctctgtatgggtgtagctgtcggcaatgtcagcatggaggagaagcaaatcttccaaaatgtgcagatgagtgtcaactttctggtctccttgttgaagaagaattggcagaatgttaggtgcttgtatctgaagagtaccatgggaaaatcctacagggtgttttgatgtgttttctcttcattttaatttccgtgaaattgtgttgcgcccaatgcactttatatcttgataactggataaaaatttcatgttacagttttgttgaggttttatggttagtgttgtgttttcatgttcaaacattggataatgatagacttgctactttagcggctgctctcgtctcgtattttcctgttttatggtgcaaccgttccaggtttgtttttatatatttattcataaaggatgatatagattatttaatagta

SEQ ID NO: 15388 - DNA, 933 bp, Glycyrrhiza uralensis
ggctacttggttttcctgcttttcattcctctccgttgttaacgatttttgttttcttgttctctgcaattttattcacagctgtgagacctgtagctgacaagccactaattcaaagaaaaaacaatgagtaagcttcagagtgatgctttgcgagaagctatctccggaatcatggctgattccaaggagaagaatcgcaagttcgtcgagaccattgaactccaaattgggctgaagaactatgacccacagaaggacaagcgtttcagcggctctgtcaagcttccccacattcctcgccccaagatgaagatttgcatgctcggtgatgctcaacacgttgaagaggcagagaagataggattggattatatggatgttgaagctttgaagaagctaaacaaaaataagaagttggtgaagaaactagcaaaaaaataccatgccttcttagcttcggaggcagtcataaagcagattcctcgtcttctgggtcctggtctcaacaaagcagggaagttccctacacttgtcactcaccaagaatctctcgagtcaaaggtgaatgagactaaagctatggtgaaatttcaacttaagaaggtgctctgcatgggagttgccgtgggcaatgttagtatggaggaaaagcaaatctttcaaaatgtacaaatgagtgttaacttcctcgtctccctgttgaaaaagaactggcagaatgttcggtgcttgtatctgaagagtaccatggggaaatcttaccgtgtcttttaagggaattccttttctttacctttttttaaaatattcagtgaacttgtaatcgccctcaatacattgattatcataatagctggatagaaattttcatcttgttacagttttgctggataatttgttgttagagttttgtttctatgtttgaacatt

SEQ ID NO: 15389 - DNA, 791 bp, Glycyrrhiza uralensis
acctagctagagttttgcctccggtgtgagatctgttgccggctagcagctgatttgaatagccccaagtatcgaagatgagtaagcttcagagtgatgctttgagagaagctatctcaggaattatggctgattccaaggagaagaaccgtaaatttgttgagaccattgaactccagattgggctaaaaaactatgacccacagaaggacaagcgttttagcggctctgtcaaattgccccacattcctcgacccaagatgaaaatctgcatgcttggtgatgcccaacacgttgaagaggctgagaagataggactcgactacatggacgtcgaagccttgaagaagctaaacaaaaacaagaaactggtgaagaaactagcgaaaaagtaccatgcttttttagcttctgaagcagtcattaagcagattcctcgtcttttgggtcctggtctcaacaaagcagggaagttcccgacacttgttacccaccaagaatctcttgagtcaaaggttaatgagaccaaggccatggtcaaattccaacttaagaaagtgctctgcatgggagtagctgtaggcaatgtcagtatggaggaaaaacaaatcttccaaaacgtacaaatgagtgttaacttccttgtctccttgttgaaaaagaactggcaaaacgttaggtgcttgtatctgaagagtaccatggggaagtcgtaccgtgtcttttaatttgtttttaatttcagtgaatttctgattgcacttgatattttgattattgtaatagctgtg

SEQ ID NO: 15390 - DNA, 908 bp, Podocarpus macrophillus
ctttcattcttgacatccgagtagggcgaaggcagaggcagaggaactccatcaacaaggaggaggacgatttcttcgcctgtaaatcaccatgagtaagcttcagagcgatgtactgagggagtcaatcacgcagataatgaatgatagcaaggagaagaagcgaaagttctcagagacgattgagctgcagataggcctcaagaactatgatcctcagaaggataagcgtttcagcggctccgtcaagcttccccacatccctcgccccaagatgaaagtctgcatgcttggtgatgcccagcatgttgaagaggctgagaaaataggcttggattacatggatgtggaaggtttgaaaaagatgaataaaaacaagaaacttgtgaagaagttggctaagaaataccatgcatttcttgcttcagaagctatcattaagcagatccctagacttctgggtcctggtcttaacaaagctgggaagtttccgaccttggtatcacatcaagagtccctggaggcgaaggttaatgaaacaaaggcaactgtgaagtttcaattgaagaaggtactttgcatgggtgttgcggtaggaaactgtggcatggaggagaaacaggtattccagaatgtccagatgagtgtcaactttctggtttctttgctgaaaaagaattggcaaaatgtacgctgcttgtatctgaagaccacaatgggcaagccaacccgggtattctgattgtgcaatttagtgtctaatttttattggttgaactttgaaagttgtttttgttggtttaggatagcaagttcaaattctacttttttatgacttttacaattgagtttgatataactttgtaaggaggcatatgttgatcaatatggagggaattgcatgttgt

SEQ ID NO: 15391 - DNA, 857 bp, Cleome spinosa
ataccataggatcttagtcgcttccgaggaaattagggtttctgcagcttcatctttcaggatagggtgtggctgaattgatagaaacagaagatgagtaagcttcagagtgatgctttgagagaagccatctcaatcatcaaagggaaatgtgaggagaagaaacgtaactttgtggagacaattgagcttcagattggtctgaagaactatgatcctcaaaaggacaagcgtttcagtggctctgtcaagcttcctcacattcctcgccctaagatgaaggtttgcatgcttggagatgcccagcatgtggaggaggctgagaagatgggtttggactacatggatgttgaggccttgaagaaactcaacaagaacaagaagctcgtcaagaagcttgctaaaaagtatcatgctttcttggcttctgaatctgtcattaagcagattccccgtcttcttggtcctggtcttaacaaagcaggaaagttcccaactcttgtatcccaccaagagtcattggaatcaaaggtgaacgagacgaaagccacggtcaagttccagctgaagaaggttctatgcatgggagttgctgttggaaaccttgcaatggaagagaagcagatcttccagaatgttcagatgagcgtaaacttcctcgtctccctcctcaagaagaactggcaaaacgttaggtgtttgtatctaaagagcaccatgggcccaccccaacgtatcttctgagtttttcttcattggcgaagtgattataagcagttctggtttgcttttgtttacatctttggaacagtgaaggagatcttgtcttatgttttgttttttcacaaagttttgat

SEQ ID NO: 15392 - DNA, 989 bp, Sarracenia psittacina
atagtcttcgaccttttttgaatagaaatgattgcttttttattctgttttatgtttcggtgacagcacttaaatctgaagaaaggaaatagttttagccatgagtaagcttcagagtgatgccttgagggaggccataactcagattgcaaatgatgccaaggagaaaaagcgtaactttactgaaactattgagctccagattgggctaaaaaactacgatccccaaaaggataagcgtttcagtggttcagtgaagttgcctcacatacctcgccccaaaatgaaggtttgcatgcttggtgatgcgcagcacgtggaggaggctgagaagataggtttggagtatatggatgttgaaggactgaagaagcttaacaaaaacaagaaattggttaagaaacttgcaaagaaataccatgcgttcttagcgtcagaagctgtcatcaagcagattcctcgtttattaggccctggtctcaacaaggcagggaagtttcctaccctcgttagtcaccaggaatccctcgaatctaaagttaatgagaccaaagctacagtaaagtttcaactgaagaaggttctctgcatgggagttgctgttgggaactgcagtatggaggagaagcagatctttcaaaacgtgcaaatgagcgttaattttctagtttcattgttgaagaagaactggcaaaatgtgaggtgcttgtacctgaagagtacaatggggaagccagtccgcatcttttaaggaattctcttagttgagctggagggagttcctaatttgtgagcaaatgcttgaaatattatttcttggatttagcaattttcccttttgttgatcggtctacttcactttactggagtgtgatactgataataaatagttgtactgtttgtttgtgttctttcatctagagattaaaagttaattttgttttgctttttttgcatttgtagtaaaaaagctaaaattgttaattgga

SEQ ID NO: 15393 - DNA, 1013 bp, Fagopyrum esculentum
gtcgccgttcggcaattgatctctagagtttccagattgactggtgcttatttcacacaccggatcattaaccatgagtaagcttcagagtgaagctttgagggaggccatctctggtatcgtgaatgatacaaaggagaaggcaaggaagtttacagagaccattgagcttcagattgggttgaagaattatgacccacaaaaggacaagcgtttcagcggttcggtcaaactcccccacattccccgacccaagatgaaggtgtgcatgcttggagatgctcagcatgttgaagagtctgaaaaaatgggactggattacatggatgttgaagcacttaagaagctgaacaagaacaagaagctggtgaagaagcttgccaagaaataccatgcatttttagcctctgaatctgtcatcaagcagattccgcgtttgcttggtcccggacttaacaaggcaggaaagtttcctactcttgtttcccaccaagaatcattggaatcaaaagttaatgaaatcaaggccacagtgaagttccagctcaagaaggtgctctgcatgggtgttgctgtcggaaactgcggaatggaagagaaacagatcttccagaatgttcaaatgagcgtcaacttccttgtttctttgttgaagaagaactggcaaaatgttcgctgcctatacctcaagagtaccatgggaaagccataccgtatcttttaagctatggttcttagagttttgagttgtttattagtgaaagatcacgacatggaatcaagggatcttctttggttggtcgtctttttgtttgattgcttcatctgtactatctcaagttttggtgatcagttagtatgctgcagagcttcatacataattttggtattcctatagaagtccgaaatttccgcagtctgtcttatatcattcctctcgaaattttaagaagttacaagtttcattcaatcagtgtaaaatcgaagcagctcttgcaagtgaagtcacaaaa

SEQ ID NO: 15394 - DNA, 929 bp, Fagopyrum esculentum
tcgccgtttggcaactgatctctcgagtttttgagattgactggtgcttatttcacacaccggatcattcaccatgagtaaacttcagagtgaagctttgagggaggccatctctggtatcacgaatgattcaaaagagaaggcaaggaaatttacagagaccattgagcttcaaattggtttgaagaattatgatccacaaaaggacaagcgtttcagcggttccgtcaaactcccccacatccctcgtcccaagatgaaggtgtgcatgcttggagatgctcagcatgttgaagagtctgaaaaaatgggactggattacatggatgttgaagctcttaagaagctgaacaagaacaagaaactggtgaaaaagcttgccaagaaataccatgcatttttggcttctgaatcagtcatcaagcagattccgcgtttgcttggtcccggacttaacaaagcaggaaagtttcctactcttgtttcccaccaagaatcattggaatccaaggttaatgaaatcaaggccacagtgaagttccagctcaagaaggtgctttgcatgggtgttgctgtcggaaactgcggaatggaagagaaacagatcttccagaacgttcaaatgagcatcaacttccttgtttctttgttgaagaagaactggcaaaatgttcgctgcctatacctcaagagtacgatgggaaagccataccgtatcttttaacctatggttattagagttttgagtttcttagtgaaagaccacaacatggaatcaaaggatcttgtttggttggtcttctttttgtttaattgtttcatcagtactatctcaagttttggtgatcaattattatgctgcagacttcatacacaattttggtattcctatacgagtctgaaatttcgtagtctgtcttttatatagc

SEQ ID NO: 15395 - DNA, 1058 bp, Abies balsamea
ccctaatcgagggccggtcgtgtgtacgagagcgccgagagaggaaggcgatagacgaaggcaaatatgagtaaacttcagagtgatgcattgagggaggccatctcccaggtcatggcagatagtaaggagaaacaacgtaaattcacagagacgattgagttacagattggcctcaagaattatgatcctcaaaaggacaagcggtttagtggctctgtgaagttgcctcacattcctcgccctaagatgaaggtttgcatgcttggagatgcccagcatgtcgaagaggctgaaaaattagggttggattatatggatgttgaaggactgaagaaaatgaacaaaaacaagaaattggttaagaagcttgcgaagaaatatcatgcgtttcttgcttcagaagcaatcatcaaacagatacctcggcttcttgggcctggtctcaacaaggctggcaagtttcctacccttgtatctcaccaagagtccctggagggaaaagttaatgaaaccaaagcaactgtcaaattcccaattaaaaaaggtactatgtatgggggttgctgtaggaaactgtggaatggaggaaaaacaaatttttcagaatgtgcaattgagtgttaacttccttgtatcactactgaagaagaactggcagaatgtaaggtgcttatatttgaaaagtaccatgggaaagcctaaccggattttctgagtgcggagcagagtgaatatattacaatggcacttcttttttgtataacaattaaatataggttatgttaatttaatatctaccagactaattaattttgatgccgactcttgagcagttgaggaggagatgtgctgttaaattgctattttgaacgatagaatttgtttttccattgaaatagctctggtcatggttttagaccttaaaccttacattcaatgttttaaaatcacgtcgtgatggcgaagtatatcttgtttttaatatgatgtcagattgtcgagagaattgtgcttaccttccctctcattcctgtatgtcacataacaaaataaat

SEQ ID NO: 15396 - DNA, 1058 bp, Elaeis guineensis
cgtatcgccggaacctccactgagacgcgctctctgattagggtctcttcccttcaggaaggagagaagctaatagactatccctttgaggaggagctcgacaaagaaaaactatgagcaagctgcagagtgatgtgttgagagaggctatctctcagattgctaacgatgctagggagaaaaagcgcaacttcattgagaccattgagctgcagattggcctaaaaaattatgatccacaaaaggataagcggttcagtggttctgtgaagttgccacatattccacgtccaaagatgaaggtttgcatgcttggtgatgctcagcatgtggaagaggctgagaaaattggactggattatatggatgttgaagggctgaagaagatgaacaagaataagaagttagtcaaaaagcttgcaaaaaaatatcatgcatttttggcatctgaagctattattaagcagattcctcgacttttaggccctggtcttaacaaggcaggtaaatttcctacattggtcacacatcaggaatctttagaggccaaagtcaatgagaccaaagcgatggtgaagtttcaactgaagaaagttctttgcatgggagttgctgttgggaattgcgcaatggaggagaagcagatttttcaaaatgtgcaacttagcgttaacttcctggtgtctttattgaagaagaattggcaaaatgtgagatgcttgtacctgaagagcaccatgggcaaaccttatcgcgtgttctaagaaaaggcgtgcaaaatctgatgcttgcttaccaatacttggttgagctgctcgagctctttcttttattattgagtcttctcttcgctctctctcttcttagttttgcagtttgaactttctttgaagtgtttatggtcgcctgttgagatgatagttgttgcgtaagcatttcttaccatctggaagttttgtttttcaccacaaccttagtcgatggggtatggttcaaattcagatattgttataccagtttggtttgctgccatctttaaatgataagcatggggtatt

SEQ ID NO: 15397 - DNA, 1056 bp, Nuphar advena
gccctctaccgaataaggttgagctgctgagtcttcttctctctcgtctctctctctgctccgatcccgctagggtttctctgggctcgtgctgaaggtattgcggggaagtcggcaagatgagtaagctccagagtgatgcattaagggaagctatcactcaggtggttggcgaagcaagagacaaaaagcgcaagtttactgagacaattgagcttcaaattggtttgaaaaattatgatccacagaaagacaaacgtttcagtggatctgtgaagctacctcacattccccgtccaaaaatgaaagtttgcatgcttggtgatgctcagcatgtggaggaggctgagaagataggattagattacatggatgttgaaggtttgaagaagatgaacaagaacaagaagttggtgaagaagcttgccaagaagtaccatgcttttcttgcttctgaagctattatcaagcagattccaaggcttcttgggccaggtcttaacaaagctgggaagtttccaacccttgtttcacaccaggagtctctggaatcaaaggtaaatgaaaccaaagcgatggttaaattccaactcaagaaggtcctttgcatgggagttgctgttggaaattgtggcatggaggagaagcagatcttccagaatgtgcaacttagtgtcaacttccttgtttcactgttgaaaaagaactggcaaaatgtgaggtgcttgtatctgaagagtactatgggcagggcaattagagtattctaagcggtacatctggtctaccaccgagcaattccttggctactagcactgaagcaaaaaaaagaaaagtttctttgcagtttttgcacatttttgttataggtgaatctgtttgttcttgttcctgtttaaatgatttttctctgggaaactatattagatagactacatttcctttctgtaactggtgtatccagtttgagcgggacaggattagtatgatatgttgaagttcaaatattgttagagattggaattttcgagtagcctatcatttcatttgttgtgt

SEQ ID NO: 15398 - DNA, 926 bp, Antirrhinum majus
ttcaaagcctatcgatatatttatattgaagagtctctcacttatctttttcatcactcgtcgaaaccctagtctcgtcaggagtgaatttagaagattaggagatcttgaaccatgagtaagcttcagagtgaggctcttagggaagccattacggtcattactgctgacgctaaggaaaagaagcgtaacttcaccgagacggttgagttacaaattggacttaagaactatgatccccaaaaggacaaacgtttcagtggttccgtcaagttgccacacatcccaaggccgaagatgaagatctgtatgcttggagatgctcagcatgttgaggaggcagcaaaaattggcttggaatccatggatgtggaagcactgaagaagttgaacaagaacaagaagttggtgaagaagcttgcaaagaagtatcatgctttcttagcctcagaagcagttatcaagcagattccccgtcttctgggacctggtcttaacaaggctggcaagttccccactcttgtgagtcatcaagaatcacttgagtccaaggtgaatgagaccaaggctaccgtgaagttccagcttaagaaggttctttgcatgggagttgctgttgggaaccttggcatggaagagaagcaaatctttcagaatgtccaaatgagtgtcaactttcttgtttctcttttgaagaagaattggcagaacgtgaggtgcttgtacttgaagagcacaatgggaaagccacaacgcatcttttaagcagttaaatccatttttgtttttgaatgcgtaggatcgaaagtggtatgagaacaattgaatgtttcccagatagtgcagtttttggtgttacttttattgtgatactatgctcatatgtgttacggagactgttttattttgtgattctgttataatgc

SEQ ID NO: 15399 - DNA, 979 bp, Mimulus guttatus
ctcttaaatccatcgacactctcacaaaccctaatcaaggctttctcttaagcttaattttcgttttcggcggcttcgggaatcatgagtaagcttcagagcgatgccgttagggaagcaatcacccagattgccgcagattgtaaggagaagaaccgtaagttcaccgagacgattgagctccagattggactcaagaactacgacccgcaaaaagacaagcgtttcagtggctctgtgaagttgccccatatcccgaggcccaagatgaagatttgcatgcttggtgatgctcagcatgttgaagaggccactaagattggtctcgagtccatggatgtggaggctcttaagaagctaaacaagaacaagaagttggtgaagaagcttgcaaagaaataccatgctttcttggcctccgaagctgtcattaaacagattccccgtctcttaggtcccggtcttaacaaagcaggtaaattcccgacccttgtgtctcaccaggaatctcttgaagcgaaggtgaacgagacaaaggcgactgtcaagttccaattgaagaaggtgctctgcatgggagttgctgttgggaatctatcaatggaggagaagcaaatcttccaaaacgtgcaaatgagcgtcaacttccttgtttcccttttgaagaagaattggcaaaatgtgagatgcttgtacttgaagagcactatgggacgtcctcaacgggtcttttaagaaagttgaatttgagttttgttttgtttcgtttcctatttgcttaggacaaaaaaggttgtaagagagtaacatagatttgaatgttttctccagaaatgggattctttttggttttctgctatggttacattgtgagggatacttttgtttatggattttattttatttgtgatttcattaccatttgtctgttgcttatgttttgttatttaattggttataactgccgggcttgtgatgg

SEQ ID NO: 15400 - DNA, 883 bp, Cleome spinosa
aggggtttctgcagcttcatctctcaggatcgggattcgcttgattgagagatactcaagatgagtaagcttcagagtgaggcccttagagaagccatctcgaccattaaggcgaaatgcgaggaaaagaaacgtaactttgtggagacaatcgagcttcagattggcctgaagaactatgacccgcaaaaggacaagcgtttcagtggctctgtcaagcttcctcacatccccagacctaaaatgaagatctgcatgcttggagatgcccagcacgtagaagaggctgagaagatgggtctggactacatggacgtcgaggccttgaagaaactcaacaagaacaagaagctcgtcaagaagcttgcaaagaaataccatgctttcttggcctctgaatctgtcattaagcagattccccgtcttcttggacctggtctcaacaaggcaggaaagtttccaactctggtgtcccaccaagaatcgttggaatcaaaggtgaacgagaccaaagctacggtcaagttccagctgaagaaggttctctgcatgggtgttgcggttgggaacctctccatggaagagaagcagatcttccagaacgttcagatgagcgtaaacttcctcgtctccctcctcaagaagaactggcaaaatgttaggtgtttgtacctcaagagcaccatgggaccggttcaacgaatcttctgagctttcttcgtttccctccgagggcggaatctgtagggtctaagctgcttttgtttggttttttttgttgtttctgatatcgttttttgaaacagtaaaatgatgtctttgctatgtgtttctgaagttttgttgaatcttgaagcagtgccattgaacttctatgaagtcg

SEQ ID NO: 15401 - DNA, 983 bp, Solanum melongena
cccatttagaactttgctttaaccctcaaaacttcttgccaccactccgccgctaactcaatttgcagagagattcttcccccttctgctttgagcaatgagtaagcttcagagtgatgccctaagagaagccatctctgtgattaagaatgatgcaaatgaaaagaaaaggaagttcaccgaaaccattgagctccagattgggctgaaaaactatgatcctcaaaaggacaagcgtttcagtggttcagttaagttgccacacattcctcgccctaaaatgaagatttgcatgcttggagatgcccagcatgtggaagaggctgaaaagattggtttggagtacatggacgtggaaagcctaaagaagcttaacaaaaacaagaagttggttaagaagctcgcaaagaagtaccatgctttcttggcatcagaagctgttatcaagcagatcccccgtctcttggggcctggcttgaacaaggcaggcaagtttcctacacttgtttcccaccaggaatcactcgagtccaaggttaatgagaccaaggccactatcaaattccagttgaagaaggtgctttgcatgggagttgccgtaggaaatatggatatggaggagaaacaaatcttccagaacgtgcagatgagcgtcaactttctagtgtccttgctaaagaagaattggcaaaatgtaagatgcttgtacttgaagagtacgatgggaaagactcaacgcatcttctaaggatattgtattacaatcttggcagtttcaggcgtcgtttcggcttgtatggcgcgatagatactattgaattttttgtttagttgcactcctggatactctgttgaatatttgatatcaagttttatgatgattttgtttttattttcttctttccaatgctaccaccattaattttcttgaagattgtcaaatttcatcctttttgctcaaaaaaaaaaaaaaaaaacatgtc

SEQ ID NO: 15402 - DNA, 903 bp, Nicotiana tabacum
atcgagggttttctcttacagtgaagcttgaaggagaagatttttgagccatgagtaagcttcagagtgatgcccttagagaagccatctctgtgattaagaatgattgtgcggagaagaaaagaaaattcactgaaactattgagctccagatcgggctgaagaactatgacccccaaaaggacaaacgtttcagtgggtccgttaagttgccccacattcctcgccctaaaatgaagatttgtatgcttggagatgctcagcatgttgaggaggcagaaaagataggtttggagtacatggatgtggaaagcttgaaaaagcttaacaaaaataagaaattggttaagaagcttgcaaagaaataccatgctttcttggcttcagagtctgtcatcaagcagattcctcgtttgttggggcccggcctgaacaaggcgggtaagtttccgagtcttgtttcacaccaggagtcacttgaatccaaggttaatgagaccaaagctactatcaagtttcaattgaaaaaggtgctttgcatgggtgttgctgttggaaacttggatatggaggagaaacagatcttccagaatgtgcaaatgagtgtcaattttctagtgtcgttgctgaaaaagaattggcaaaatgtaaggtgcctgtacttgaagagcaccatgggaaagccacagcgcgtcttttaaggagatttttgtttcgctgttggaagttttcagcattttgggtttgtgagcgatagatactcttgaaatttttgggtagtagttctggttctatttgaatactataacattgttcgggattgttttgcttcaactttgtcttctttaaagatgttagcagtgattgcaatagcattcaaggtgccaatttcttctcaaaaaa

SEQ ID NO: 15403 - DNA, 917 bp, Nicotiana tabacum
acggcgctcacaaaccctaattagggttttctcctacagtgaatttagaaggtaaaagagaagtgcttgagacatgagtaagcttcagagtgatgccctaagagaagcaatctctgtaattaagaatgattgcaatgaaaagaagaggaagttcacagagacaattgagctccagattgggcttaagaactatgatccccaaaaggacaagcgtttcagtggatctgtgaaactgcctcacattcctcgtcctaagatgaagatttgcatgctcggagatgctcaacatgtggaggaggccgaaaagatcgggttggagtacatggatgtggaaagcctcaagaagcttaataagaacaagaagctagttaagaagcttgccaagaagtaccatgctttcttggcctcggaatctgtcatcaagcagattcctcgtctcttgggtcccggtctgaacaaggctggtaaatttcctagccttgtttcccaccaggagtcacttgagtctaaggttaatgaaaccaaggctacaattaagttccaattgaagaaggtgctttgcatgggtgttgctgttggaaatcttgatatggaggagaaacaaatattccagaatgtgcaaatgagtgtgaacttccttgtctcattgctaaagaagaattggcaaaatgtgaggtgcttgtacttgaagagcacaatggggaagacacagcgcgtcttttaagatggttgtctaaatgttgcaactttttgggcattttgcttgtaagagttactgatgaaaattttgaatagtctatcatcctggataatggttttaatgtaatatcattatagggattgttttgccagacatttcctttttaagagatgttagtaatgttaatttttctcttatttttatgaacgaggatttc

SEQ ID NO: 15404 - DNA, 1112 bp, Tabernaemontana elegans
tatatctcaatatcgccgcggccaccgaagtgcccgtcctcccctttaccagtactccactggagcgcaatccgggagtgaagagtgacgaatttcggagattttaaatcatgagtaagcttcaaagtgatgccctcagagaagccatttctcagataaaaaatgatgctgctgagaaaaagcgcaagttcactgagacaattgagctccagattgggctgaaaaattatgatccccagaaggacaaacggtttagtggctctgtgaagttacctcacattcctcgccctaagatgaaagtttgcatgctgggagatgctcagcatgtggaggaggctgaaaaaattggtttggagtacatggatgtcgaaggtctgaagaagcttaacaagaacaagaaattggtgaagaagcttgcaaagaaatatcatgctttcttggcttcagaggctgtgatcaagcagattccccgtctcttagggcctggtcttaacaaggctggcaaattccctaccctcgttacccatcaggaatcacttgaatccaaagttaacgagaccaaggccacagtcaagtttcaattgaagaaggtgctttgcatgggagttgcagttgggaattgcgatatggaggaaaagcaaatctttcaaaatgtgcaaatgagtgtgaacttccttgtttccttgttgaagaagaattggcaaaatgtgaggtgcttgtacctgaagagtaccatggggaaaccacagcgcatcttctaaggagagagtttcctctttgctgctgctgctgctgctttgatgagttttatgatgatatgcatctaatatattgtttttagtatgctggcaattttgttaccttaggtatttgtttagtggttgtctcattttgaaacagtgacccagactatcaactcttttctgttattagtttcattaccgcatactaagattttaaatcttattacctgttccttagggccagaaaataactacgaaatttagcagtggatggaactttcctgcaaatggtattgctttgtatgagtaggctctcgtggcttttgcttgtatggaattttggaattatgttttggtcaattttgcttt

SEQ ID NO: 15405 - DNA, 1027 bp, Cedrus atlantica
gagcgcagacagaggaaagcgctaggagaaggcaaatatgagtaagcttcagagtgatgcattgagggaggccatctcccaggtcatggcagatagtaaggagaaacaacgtaaattcacggagacaattgagttacagattggcctcaagaattatgatcctcaaaaggacaagaggttcagtggctctgtgaagttgcctcacattcctcgccctaagatgaaggtttgcatgcttggagatgcccagcatgttgaagaggctgaaaaattaggtttggattatatggacgtcgaaggactcaagaaaatgaacaaaaacaagaaattggttaagaagcttgcaaagaaatatcatgcctttcttgcttcagaagcaatcatcaaacagatccctcgacttcttgggcctggtctcaacaaggctggcaagtttcctacccttgtatctcaccaagagtccctggagggaaaaattaatgaaaccaaagcaactgttaaattccaattaaaaaaggtactgtgtatgggggttgctgtgggaaactgtggaatggaagaaaagcaaatttttcagaatgtgcagttgagtgttaacttccttgtatcactactgaagaagaactggcagaatgtaaggtgcttatatttgaagagtactatgggaaagactaaccggattttctgattgcggagcagattggggatattacaattgcacgctttttttgtacaactgttaaacataggttatttttatttaatttctacgaaactaattaattttgatgctactattgaggaattggggaagaggtgctggtaaattgctgttttgaacgatagaatttgttttcttactgaaatatatgtggtcatggttttagaccttaaacctaaatagcgttcaatgttttaaaatcatgttttgggtgccttccattatcttagaatttcatcaatcccgtcatacacacaggccacggtatccttttgaatccctgtagacgcgaccaaggttcgaaac

SEQ ID NO: 15406 - DNA, 968 bp, Persea americana
ctatttgtttcttcacagccgtcgctcttcttgttcctctttcatctgagagcggagtcataatcagaggaatctcagaagggagaagtttccagtcatgagtaagctccagagtgatgtgttgagggaggccatctctatagttgttgctgatgccagagagaaaaagcgcaactttacagagaccatcgagctgcagattggtctgaaaaactatgatccacagaaggacaagcgttttagtggttctgtgaagttaccacatatacctcgtcctaaaatgaaagtctgcatgcttggtgatgctcagcatgttgaagaggcagagaagatggggctggagtatatggatgttgagggactgaagaagatgaacaaaaataagaaacttgttaagaagcttgcaaaaaaataccatgcttttctagcatcagaagccatcatcaagcagatccctcggcttcttggtcctggtctcaacaaagcaggaaagttccctacactggtgtctcatcaagaatcgctagagtcaaaggttaatgagacaaaagcaatggtgaaattccaactgaagaaggttttatgcatgggagttgccgtgggcaattgtggcatggaagagaagcaaatatttcaaaatgtacagctcagcgtcaactttctggtatcattgctgaagaagaattggcaaaatgtgaggtgcttgtatctgaagagttcgatgggaaaaccaaaccgcatcttctgagttcccatttgctgtatccaagagtacttgctaatttgaggcttttttttagcattattggaggatactctgattatcgttttgggttttttgtgttttttgtttgatgaacttcccacctcagtattagtttactgtgtactacagcttaatgttgacaatgtggtgttttcatctgctacacaggaggttccattaacgtatttgcgtttatttactg

SEQ ID NO: 15407 - DNA, 1279 bp, Picea glauca
cttggtagttcacatgaattccgagtcatttatgtaacctcgacccttgtagtcacgttagccctttacatgtaatttatgtaaccctaaacccctgtagtcacattagccctttataaagtcgatatattagggtttttatctcttctttcgaatcctaaaccctagtcgagggccggtcgtgcgtaggagagagcagacagaggaggacgctaggcgaaggcaaatatgagtaagcttcagagtgatgtgttgagggaggccatctcccaggtcatggcagatagtaaggagaaacaacgtaaattcacggagacgattgagttacagattggccttaagaattatgatcctcaaaaggacaagcggttcagtggctctgtaaagttgcctcacattcctcgccccaagatgaaggtttgcatgcttggagatgcccagcatgtggaagaggctgaaaaattaggcttggattatatggatgtggaaggactcaagaaaatgaacaaaaacaagaaattagttaagaagcttgcaaagaaatatcatgcctttcttgcttcagaagcaatcatcaaacagatacctcgacttcttgggcctggtctcaacaaggctggcaaatttcctacccttgtatctcaccaagagtccctggaggggaaagttaatgaaaccaaagcaactgtcaaattccaattaaaaaaggtactatgtatgggggttgctgtgggaaactgtggaatggaagaaaagcaaatttttcagaatgtgcaattgagtgttaacttccttgtatcactactgaagaagaactggcagaatgtaaggtgcttatatttgaagactaccatgggaaagcctaaccgcattttctgagtgcggaacagagtggagatatttcaatggcacttcctttttgtataactattaaacataggttatgtttatttagtttcgaccaaacaaatcaattttaatgcaactacttacgaattgaggaagagatgtgctggtaaattgctgttttgaacaataagagttgtttttctattgaaatagctctggtcatggttttagaccttaaacctaacattcaatgttttaaaatcatgccgtggtcgtgaagtctatcttgattttcttataatgtcatattgttagagagaattgtgcttaccttcgtctgccatttctgtattcggtacataacaaaataaatcctagatactgtttttggttggaagttatctaatgtaaggggattgtttcttttgtt

SEQ ID NO: 15408 - DNA, 1253 bp, Zamia vazquezii
ctcgttcttattccagttcgtagggtttctggttgcgaggccgcgaggaaaggtggagaagaggaagcgtagcagcggagattgatctcgttgtaagcaatgagtaagcttcagagcgatgtgttgagggaggccatcacacaggtggtcacagacagcaaggagaagaagcgcaagttctccgagacaatagagttgcagatcggccttaagaactatgatccacagaaggataagcgtttcagtgggtctgtcaaattgcctcacattcctcgccctaagatgaaggtctgcatgcttggtgatgcccagcacgttgaagaggcggagaagataggtttggattacatggatgtagaagggttgaaaaagatgaacaagaacaagaaattggtaaaaaaacttgcaaaaaagtaccatgcctttcttgcttctgaagcaattattaaacagattcctcgtctgcttggtcctggtcttaacaaggctggtaaatttcccacccttgtatcgcaccaagaatctttggaggcaaaagtgaatgaaacaaaggcaatggtcaagtttcaattgaagaaagttctttgtatgggtgttgctgtgggaaactgtggaatggaggagaagcaagttttccaaaatgtgcagttgagcgtaaactttttggtttcgcttctgaaaaagaactggcagaatgtaagatgcttgtatctgaagagtaccatgggcaagccaaatcgcatattctaaatgagcaaattattctttttggtcttgagtcttgggcatttctttgtagaagcattaactgcacatagaaggcattgtagtggatatggtacctattttaacatttatgaatctatctgctgatgaggctgaatgattgtttggtaaactttggtagattttgactgaaattttggttgtctttatgatgtttaaataactattcatagctcagttaagttatagtcctcatctcaggctagcatgtaatgagtgaagcatgatttcatgatgaacattataaacgagtagctggttttagctcagttaagttatagtcctcatctcaggctagcatgcaatgagtgaagcatgatttcatgattaacattataaacgagtagctggttttaatgtttgtcaaagtcttgtgagacatcactgccccagaagtttgcttatgaaggcagttaaagaggtctgctaggtaacattttgaaggagtaacttgttttgccggtagc

SEQ ID NO: 15409 - DNA, 896 bp, Nicotiana tabacum
gggggtcactcgaacggcgcttacaaaccctaatttgggttttctcctacagtgaatttagaaggcaaaagagaagtgcttgagctatgagtaagcttcagagtgaagccctaagagaagcaatctctgtaattaagaatgattgcaatgagaagaagaggaagttcacagagacaattgagctccagattgggcttaagaactatgatccccaaaaggacaagcgtttcagtggatctgtgaaactgcctcacattcctcgtcctaagatgaagatttgtatgctcggagatgctcagcacgttgaggaggctgaaaagatcgggttggagtacatggatgtggaaagcctcaagaagcttaacaagaacaagaagctagttaagaagcttgccaagaagtaccatgctttcttggcttcagaatctgtcatcaagcagattcctcgtctcttgggtcccggtctgaacaaggctggtaaatttcctagccttgtttcccaccaggagtcactcgagtctaaggttaacgaaaccaaggccacaatcaagttccaattgaagaaagtgctttgcatgggtgttgctgttggcaatcttgacatggaggagaaacaaatcttccagaatgtgcaaatgagtgtgaatttccttgtgtcattgctaaagaaaaattggcaaaacgtgaggtgtttgtacttgaagagcacaatggggaagacacagcgtgtcttttaagataattgtctcgttgttgcaactttttgggcattttgcttgtaagagatactaatgaaaattttggatagttgtcatcctggataatggttttattgtaatatcattacagggatcgttttgccagacatttttattttaaaagatgttagcactgtt

SEQ ID NO: 15410 - DNA, 897 bp, Cleome gynandra
tcggggggggtttctgctgcttcaactttcaggatcggaactcgctgaattgatagcaactcaagatgagtaagcttcagagtgaagccctgagagaagccatctcaaccatcaaggggaaatgcgaggaaaagaaacgcaacttcgtagagacaattgagctccaaattggtctgaagaactatgacccccagaaagacaagcgtttcagcggttctgtcaaactgcctcacattccccgccctaagatgaagatttgcatgcttggagatgcccagcatgttgaagaggctgagaagatgggattagactacatggacgttgaggctttgaagaaactcaacaagaacaagaagctcgtcaagaagcttgcgaaaaagtaccatgctttcttggcttctgaatctgtcattaagcagattccccgtcttctcggtcctggtcttaacaaagcaggaaagttcccaacccttgtgagccaccaagaatctttggaatcaaaggtgaatgagaccaaagccaccgtcaaattccagcttaagaaggttctctgcatgggtgttgccgtcgggaacattggaatggaagagaagcagatcttccagaacgttcagatgagcgtaaacttcctcgtctcccttttgaagaagaactggcaaaacgttaggtgtttgtacctgaagagcaccatgggaccaccccaacggatcttctgagctttgtcattgtctttgattccgggaatgaagtattgtgataggatctgaaatatccgtagtgacctttgtctctggtatctttggaacagtaaacattttgtctttgctctgtttttctcaaagttttgttgaatcttgatgctttgccattgaacctctatgaagcttctttttgtta

SEQ ID NO: 15411 - DNA, 876 bp, Nicotiana tabacum
atcgagggttttctcttacagtaaagtttgaaggagaagaattttgagccatgagtaagcttcagagcgatgcccttagagaagccatctctgtgattaagaatgattgtgcagagaagaaaagaaaattcactgagactattgagctccagatcgggctgaagaactatgatccccaaaaggacaaacgtttcagtgggtccgttaaattgccccacattcctcgtcctaaaatgaagatttgtatgcttggagatgctcagcacgttgaggaggcagaaaagataggtttggagtacatggatgtggaaagcttgaaaaagcttaacaaaaataagaaattggttaagaagcttgcaaagaaataccatgctttcttggcttcagagtctgtcatcaagcagattcctcgtttgttggggcccggcctgaacaaggcgggcaagtttccgagtcttgtttcacaccaagagtcacttgaatccaaggttaatgagaccaaagctactatcaagtttcaattgaaaaaggtgctttgcatgggagttgctgttggaaacttggatatggaggagaaacagatcttccagaatgtgcaaatgagtgttaattttctagtgtcgttgctgaaaaagaattggcaaaatgtaaggtgcctgtacttgaagggcaccatgggaaagccacagcgtgtcttttaaggagatttttgtttcgctgttggaagttttcagcattttgggtgtgagctatagatactcttgaaatttttgggtagtagttctggttatctgtttgaatactataacattgttcggtattgttttgcttcaactttgtcttctttaaagatgttagcagtgattaccatagcat

SEQ ID NO: 15412 - DNA, 898 bp, Solanum tuberosum
gaatttgcagacagaattcttcccattctgctttgagccatgagtaagcttcagagtgatgccttaagagaagccatcactgtgattaagaatgattcaagtgagaagaaaaggaagttcaccgaaaccattgagcttcagattgggttgaaaaactatgatcctcaaaaggacaagcgtttcagtggttcagttaagttgccacacattcctcgccctaagatgaagatttgcatgcttggagatgctcagcatgtgggagaggcagaaaagattggtttggagtacatggacgtggaaggcctgaagaagcttaacaaaaacaaaaagttggttaagaagctcgcaaagaagtaccatgctttcttggcatcagaagctgttatcaagcagatcccccgtctcttggggcctggcttgaacaaggcaggcaagtttcctacccttgtttcccaccaggaatcactcgagtctaaggttaacgagaccaaggccactatcaaattccagttgaagaaggttctttgcatgggagttgccgtaggtaatatggatatggaggagaaacaaatcttccaaaacgtgcaaatgagtgtcaactttctagtgtccttgctaaagaagaattggcaaaatgtgagatgcttgtacttgaagagtaccatgggaaagactcaacgcatcttctaaggatattgtattacaatcttggcagtttcaggcgttttgacttgtacgcgttatagatactattgaattttttgtttagttgtgctcctggctggatactgagttgaaaacttgatatcagttttgttatgattttacttttattttctccttttcaatgttaacaccaccagcaccactattcctgttgattttcttgaatactgtc

SEQ ID NO: 15413 - DNA, 974 bp, Solanum phureja
aagcccattgagaactttgctttaaccctcaacttctttgccacccctccgccgctcactcaatttgcagacagaattcttcccattctgctttgagccatgagtaagcttcagagtgatgccttaagagaagccatcacggtgattaagaatgattcaagtgagaagaaaaggaagttcactgaaaccattgagcttcagattgggttgaaaaactatgatcctcaaaaggacaagcgtttcagtggttcagttaagttgccacacattcctcgccctaagatgaagatttgcatgcttggagatgctcagcatgtgggagaggcagaaaagattggtttggagtacatggacgtggaaggcctgaagaagcttaacaaaaacaaaaagttggttaagaagctcgcaaagaagtaccatgctttcttggcatcagaagctgttatcaagcagatcccccgtctcttggggcctggcttgaacaaggcaggcaagtttcctacccttgtttcccaccaggaatcactcgagtctaaggttaatgagaccaaggccactatcaaattccagttgaagaaggttctttgcatgggagttgccgtaggtaatatggatatggaggagaaacaaatcttccagaacgtgcagatgagtgtcaactttctagtatccttgctaaagaagaattggcaaaatgtgagatgcttgtacttgaagagtaccatgggaaagactcaacgcatcttttaagaatattgtattacaatcttggcagtttcaggcattttgacttgtacgcgttatagatactattggattttgttgtttagttgtgctcctggatactgagttgaaaacttgatatcagttttgttatgattttacttttattttctcctatttctgttgattttcttgaatactgtcaactttcatatctaaaggaacactcaaattttgtggtttaactgcta

SEQ ID NO: 15414 - DNA, 1053 bp, Amorphophallus konjac
aagcgggtagagagagagcttagtgagactctcgtcttggcagcgctgcagccatgagcaagctacagagtgatgtgctgagggaagctattggccaacttgttactgactcaaaagagaagaagaggaaattcactgaaacaattgaactgcagattggtttgaaaaactatgatccccagaaagacaagaggttcagtggctcagtgaaactcccacatattcctcgccctaagatgaaggtctgcatgctgggcgatgctcagcatgttgaggaggctgagaagattgggttggactacatggatgttgaagctcttaagaaaatgaacaagaacaaaaagctggtgaagaaacttgcaaaaaagtatcatgctttccttgcatcagaagccataatcaagcagatccctcgccttttgggcccaggacttaacaaggcagggaagttccctaccttagtcacacatcaggagtccctagagtcaaaggtcaatgaaaccaaggcgatggtgaaattccagcttaagaaggtcctttgcatgggtgttgcagtgggaaactgtggaatggaggagaagcagatattccagaatgtgcaactctcggtcaacttccttgtgtcacttcttaaaaagaattggcaaaatgtaaggtgtctgtacctgaagagcaccatggggaagccagttcgtgtgttttaaggagttgctgagtctgtatctttaaattgcttggtgaaatatgaggtgaggacgcgttgatcatccttttttttggttctcgactattagttgaatgtcaaggacagttccgagcagcaagcgtaagccgtgggtgatgctttactttttgtagttgggatattactataattttctggcatatttctgtttggagtatgttctttcaattgttgggcttcggattcgggaaccgggcattcctttgaggaaattattttcttgattgagaaataacttgtctggctgatttggttgttatggtatttttgaacataagaatctaatgcttgtgataactcgagacaat

SEQ ID NO: 15415 - DNA, 942 bp, Chelidonium majus
cggctacatcaagaaaccctagttgagggtttgcacttcgttttctttctatctggacaccaatctgtggaggagttgcatattgaacaaatttgttaaaaatgagtaagctccagagtgatgtattgagggaggcaatcacccagattgttaatgatgccaaagagaaaaagcgcaactttaccgagactattgagctccagattggtcttaagaactacgaccctcaaaaggacaagcgtttcagtggttctgtgaagctgccacatatccctcgtcctaagatgaaggtctgcatgcttggggatgctcagcacgtcgaagaggcagagaagataggtttgtcctacatggatgtcgaagggttgaagaagctcaacaaaaacaagaaattggtcaagaagcttgcaaagaaataccatgcatttcttgcatcagaagctgtaattaagcagattccccgtcttcttggccctggtctcaacaaggcaggaaagtttccaactttggttactcaccaggaatccctggaatcaaaggttaatgagaccaaggctatggtgaagttccaattgaagaaggttctttgcatgggtgtagcagtagggaaccttggaatggaggagaagcagatcttccaaaatgtgcaactcagtgtcaacttccttgtatctttgttgaaaaagaattggcaaaatgtgaggtgcttgtacctgaaaagtacaatggggaagccaaaccgcgtgttttaaggaattcattttacatactattagagctgttgtgtagtgagagcaagacctgagtttaattttgtcaaagatgcttaaattttgattttgagattccttttctcttttactttttctcaatgatatttagtttgattactatcagcagcaatttaatagtttttaacattaatgtgatgttttggttatg

SEQ ID NO: 15416 - DNA, 872 bp, Sarracenia psittacina
ttgctcattcatcggcgatcacatactctagtccagggtttttgttatcagtacataagtctgaggaaaggaaatagtttcagtcatgagtaaacttcagagtgaagccttgagggaagcaatttctcaaatttctaatgatgccaaggagaaaaagcgtaacttcactgaaaccattgagctgcagattgggcttaaaaactatgatcctcaaaaggataagcgtttcagtggttctgtaaagttgcctcacatccctcgtcccaagatgaaggtttgcatgcttggtgatgctcagcacgtggaagaggctgagaagataggtttggagtatatggatgtggaagggctgaagaagcttaacaaaaataagaaactggttaagaaacttgctaagaaataccatgccttcttggcatcagaagctgtcatcaagcagattccccgtctattaggcccaggtctcaacaaagcagggaagtttccgacccttgttagtcaccaggaatctctcgagtctaaagtcaatgaaactaaagcaacagtaaagttccaactgaagaaggttctctgcatgggagttgctgttggaaactgcagtatggaggagaaacagatctttcaaaacgtgcaaatgagtgttaattttctagtttcattgttgaagaagaactggcaaaatgtgaggtgtttgtacctgaagagtaccatggggaagcccgtccgcattttctaagctgtttttttcccctcgttgattattcgattctatggagggattttgtttgagcaaattatcatgtaagatcttcctggattgagcaattttcctttttgtttgcctgctgctgttgaatgcattgaaaccatta

SEQ ID NO: 15417 - DNA, 1199 bp, Picea glauca
atcctaaaccctagtcgagggccggtcgtgcgtaggagagagcagacagaggaagacgctaggcgaagacaaatatgagtaagcttcagagtgatgtgttgagggaggccatctcccaggtcatggcagatagtaaggagaaacaacgtaaattcacggagacgattgagttacagattggccttaagaattatgatcctcaaaaggacaagcggttcagtggctctgtgaagttgcctcacattcctcgccccaagatgaaggtttgcatgcttggagatgcccagcatgtggaagaggctgaaaaattaggcttggattatatggatgtggaaggactcaagaaaatgaacaaaaacaagaaattagttaagaagcttgcaaagaaatatcatgcctttcttgcttcagaagcaatcatcaaacagatacctcgacttcttgggcctggtctcaacaaggctggcaaatttcctacccttgtatctcaccaagagtccctggaggggaaagttaatgaaaccaaagcaactgtcaaattccaattaaaaaaggtactatgtatgggggttgctgtgggaaactgtggaatggaagaaaagcaaatttttcagaatgtgcaattgagtgttaacttccttgtatcactactgaagaagaactggcagaatgtaaggtgcttatatttgaagactaccatgggaaagcctaaccgcattttctgagtgcggaacagagtggagatatttcaatggcacttcctttttgtataactattaaacataggttatgtttatttagtttcgaccaaactaatcaattttaatgcaactacttaggaattgaggaagagatgtgctggtaaattgctgttttgaacaataagagtttgtttttctattgaaatagctctggtcatggttttagaccttaaacctaacattcaatgttttaaaatcatgccgtggtcgtgaagtctatcttgattttcttataatgtcatattgttagagagaattgtgcttaccttcctctgccatttctgtattcggtacataacaaaataaatcctagatactgtttttggttggaagttatctaatgtaaggggattgtttcttttgttagaaaaaaaaaaaaaaaaaaaaagtaactactaccgtagtatacctactacgtacgttctacgtaggaactta

SEQ ID NO: 15418 - DNA, 1183 bp, Picea glauca
actcacattagccccttttataaagtcgatatattagggtttttatctcttctttcgaatcctaaaccctagtcgagggccggtcgtgcgtaggagagagcagacagaggaagacgctaggcgaagacaaatatgagtaagcttcagagtgatgtgttgagggaggccatctcccaggtcatggcagatagtaaggagaaacaacgtaaattcacagagacgattgagttacagattggccttaagaattatgatccgcaaaaggacaagcggttcagtggctctgtgaagttgcctcacattcctcgccccaagatgaaggtttgcatgcttggagatgcccagcatgtggaagaggctgaaaaattaggcttggattatatggatgtggaaggactcaagaaaatgaacaaaaacaagaaattagttaagaagcttgcaaagaaatatcacgcctttcttgcttcagaagcaatcatcaaacagatacctcgacttcttgggcctggtctcaacaaggctggcaaatttcctacccttgtatctcaccaagagtccctggaggggaaagttaatgaaaccaaagcaactgtcaaattccaattaaaaaaggtactatgtatgggggttgctgtgggaaactgtggaatggaagaaaagcaaatttttcagaatgtgcaattgagtgttaacttccttgtatcactactgaagaagaactggcagaatgtaaggtgcttatatttgaagactaccatgggaaagcctaaccgcattttctgagtgcggaacagagtggagatatttcaatggcacttcctttttgtataactattaaacataggttatgtttatttagtttcgaccaaactaatcaattttaatgcaactacttaggaattgaggaagagatgtgctggtaaattgctgttttgaacaataagagtttgtttttctattgaaatagctctggtcatggttttagaccttaaacctaacattcaatgttttaaaatcatgccgtggtcgtgaagtctatcttgattttcttataatgtcatattgttagagagaattgtgcttaccttcctctgccatttctgtattcggtacataacaaaataaatcctagatactgtttttggttggaagttatctaatgtaaggggattgtttcttttgt

SEQ ID NO: 15419 - DNA, 975 bp, Eschscholzia californica
agaaaccctaatccaggatttgcgcttcgtcgtctttctcttggaacctgaatctgcgaagatgagtaagcttcagagtgatgtattaagagaagccatcacccaaattgttggagatgccaaagagaagaaacgcaatttcactgaaactattgaactccagattgggcttaagaactatgaccctcagaaagacaagcgtttcagtggttctgtgaagctaccacatattcctcgccctaaaatgaaggtttgcatgctcggggatgcccagcacgtcgaagaggcagagaagataggattggcctatatggatgtggaatcactgaaaaagctcaacaaaaacaagaaattggtgaagaagcttgccaaaaagtaccacgcttttcttgcatctgaagctgtgattaaacagattccccgtctccttggccccggtcttaacaaggcaggaaagttcccaacattggtttctcatcaagaatctctagaggcaaaagttaatgaaaccaaagctatggtgaagtttcaattgaagaaggttctttgcatgggagtagcagtaggaaacttaggaatggaagagaagcagatcttccagaatgtgcaactcagtgttaacttccttgtatctctgttgaagaagaactggcaaaacgtgaggtgtttgtacttgaagagtaccatggggaagacaaaccgcatcttttaagcagtactactatttacttggttataagagagcttttgtgtggtttagtgagagcttacttggaccttgatttttgtcttttttttttttttttagtttttacgtttcgttcgttccgttagtaactttaactttttaagttttggtttacgtttaccctactactaactaactttaacttaaaggtaggtatagttatttttagttttagtaggtacgttgggtaggggacgaacggaacggaccaacgaagggaagggtag

SEQ ID NO: 15420 - DNA, 908 bp, Eschscholzia californica
ggatttggcacttcgtcgtctttctcttggaactaaaatctgcgaagatgagtaagcttcagagtgatgtattaagagaagccatcacccaaattgttggagatgccaaagagaagaaacgcaatttcactgaaactattgaactccagattggacttaagaattatgaccctcagaaagacaagcgtttcagtggttccgtgaagctaccacatattcctcgccctaaaatgaaggtttgcatgctcggagatgcccagcacgtcgaagaggcagagaagataggtttggcctatatggatgtggagtcgctgaaaaagcttaacaaaaacaagaaattggtcaagaagctagccaaaaagtaccatgcttttcttgcatcagaagctgtcattaaacaaattccccgtctccttggccccggtcttaacaaagcaggaaagttcccaacattggtttctcatcaagaatctctagaggcgaaagttaatgaaaccaaagctatggtgaagtttcaattgaagaaggttctttgcatgggagtagcagtaggaaacttgggaatggaggagaagcagatcttccaaaatgtgcaactcagtgttaacttccttgtatctctgttgaagaagaattggcaaaacgtgaggtgcttgtacttgaagagtaccatggggaagacaaaccgcatcttttaagcaatactttctattacttgttattggagatctgcagtatggtgtagtgagagctgcttcagcaaagactagagtttatcatcttttaaattcttgaattttgaagttccttgtcttgatacttattagttttgttactggataactcttgaatagctataattgtttaatgggatctatggacctggagaatcttgaattttgttctta

SEQ ID NO: 15421 - DNA, 927 bp, Primula obconica
ctctcttccagatttgggttaagctagagtttcagtcatgagtaagctacagagtgatgtcttgagggaggcaataactcagattcacaaggactccactgagaaatcacgcaagttcactgaaacaattgagcttcagattggactgaaaaattatgaccctcaaaaagacaaacgtttcagtggctccgtgaagttgcctcacatccctcgccccaagatgaaggtttgcatgcttggtgatgctcatcatatcaacgaggctgagaagatagggttagaatatatggatgttgaatcgttgaagaagctcaacaagaacaagaaacttgttaagaaacttgccaagaagtatcatgcctttttggcatcagaagctgtcattaagcagattcctcgtcttctaggccctggtctcaacaaagcaggaaagtttcccaccctggtctctcaacaggaatctcttgagtctaaagtcaatgagactaaagcgacagtcaagttccaacttaagaaggttctctgcatgggagttgctgttggaaaccttggaatggaggagaagcaaattttccaaaatgtgcagatgagtgtcaatttcctcgtttctctgttgaagaaaaattggcaaaatgtgaggtgcttgtacttgaagagcaccatggggaagccagtacgtgtattctaagaacttcagcgtttgggttgctgttttctgcttaatttagacagtttttcaggattaagcatttttcatttgctgtcattttgaattctttcccaatattacttgacattatggtgcgctttttatggagagttttaatatttccttgtgaaagtttttaattctacaactcaccagagcttgctcgatctttatcaactttctgatgtcttttttctcaatgttctaatgattgttat

SEQ ID NO: 15422 - DNA, 943 bp, Fraxinus spp
gactcttgccgtcttccaaaccctaatatagaagtgaaacgggaagagaaaaggatctccggccatgagtaagcttcagagtgaggcccttagagaagctatctcagtaattactactgatgtcaaggagaagaatcgtaactttgttgagacaattgagctccagattgggctgaaaaactatgatccacagaaggataaacgttttagtggctcagtgaagttgcctcacattcctcgccccaagatgaagatttgcatgcttggtgatgctcagcatgttgaggaggcagagaaaattggtatggaatccatggacgtagaggctttaaaaaagttgaacaaaaacaagaaactggttaagaagcttgctaaaagatatcatgctttcttagcctccgaagctgttatcaagcagattccccgtctcttaggacctggtcttaacaaggcaggtaagttcccgactcttgtttctcaccaggaatctcttgaatcaaaggtcaacgaaaccaaggccacagtgaaattccaattgaagaaagtgctttgcatgggagttgctgtaggaaactgcggtatggaggagaagcagatctttcagaatgtgcaaatgagtgtcaactttctagtttcacttttgaagaaaaactggcagaacgtgagatgcttgtacctaaaaagtacaatggggaagcctcagcgcatcttttaaggacattatattttatttctgttcgactggttttagagatagttttgtggagctaaagcaatggagttttcccctgtaatagcaagtttttatttatctttggtcttgatactgcgttcagacatcatattgattgttttattttgttgtttttctactgagtcgggatttatttttgcttactgtaccgacatttctatcaggaatagccagtttaccttttgcttg

SEQ ID NO: 15423 - DNA, 1091 bp, Picea glauca
cttctttcgaatcctaaaccctagtcgagggccggtcgtgcgtaggagagagcagacagaggaagacgctaggcgaagacaaatatgagtaagcttcagagtgatgtgttgagggaggccatctcccaggtcatggcagatagtaaggagaaacaacgtaaattcacagagacgattgagttacagattggccttaagaattatgatccgcaaaaggacaagcggttcagtggctctgtgaagttgcctcacattcctcgccccaagatgaaggtttgcatgcttggagatgcccagcatgtggaagaggctgaaaaattaggcttggattatatggatgtggaaggactcaagaaaatgaacaaaaacaagaaattagttaagaagcttgcaaagaaatatcatgcctttcttgcttcagaagcaatcatcaaacagatacctcgacttcttgggcctggtctcaacaaggctggcaaatttcctacccttgtatctcaccaagagtccctggaggggaaagttaatgaaaccaaagcaactgtcaaattccaaattaaaaaaggtactatgtatgggggttgctgtgggaaactgtggaatggaagaaaaacaaatttttcagaatgtgcaattgagtgttaacttccttgtatcactactgaagaagaactggcagaatgtaaggtgcttatatttgaagactaccatgggaaagcctaaccgcattttctgagtgcggaacagagtggagatatttcaatggcacttcctttttgtataactattaaacataggttatgtttatttagtttcgaccaaactaatcaattttaatgcaactacttaggaattgaggaagagatgtgctggtaaattgctgttttgaacaataagagtttgtttttctattgaaatagctctggtcatggttttagaccttaaacctaacattcaatgttttaaaatcatgccgtggtcgtgaagtctatcttgattttcttataatgtcatattgttagagagaattgtgcttaccttcgtctgccatttctgtattcggtacataacaaaataaatcctagatactg

SEQ ID NO: 15424 - DNA, 1027 bp, Amorphophallus konjac
gacctccgcggtttttctctcctcaggaaaacgcgtagagggatacctggaggtaccgtcgacgaggcggcgcggcgaccatgagtaagctacagagtgatgtactgagggaagctattacccagcttgtcactagctcaaatgaaaagaaaaggaagtttactgaaaccattgagctgcaaattggtctgaagaactatgatcctcagaaagacaaacgtttcagtggttcagtgaagctcccacatatacctcgccccaaaatgaaagtatgtatgctcggagatgctcagcatgttgaagaggccgagaagatggggttggattacatggatgttgaagggctaaagaaaatgaacaagaacaagaagcttgtgaagaaacttgcaaaaaagtatcatgcatttcttgcatcagaagctataatcaagcaaattcctcgtcttctgggtccgggacttaacaaggcaggaagtttccaaccctagtctctcatcaggagtccctggaatcaaaagtgaatgagaccaaggcaatggtgaaatttcagcttaagaaagttctttgcatgggtgttgcagtgggtaattgtcaaatggaggagaagcagatctttcagaatgtgcagctctctgtcaacttccttgtgtctctgcttaaaaagaactggcaaaatgttaggtgtttatacctgaagagcaccatggggaaaccgattcgtgtgttctaagttgcagaggctgtatcttttattgctctcttgagcctgccatttcgagggtccggcaacggaagctgatgtcttcctgtcttatcattgtttgcgtaggacaactgtagttttgagcactatgaacacaatcatttttgtcatcagtgtagctggaaattcacttcattctgcttgacattaaacttttaacactctctttggtcttgttctttcaaaaaggtacattttttctcttccattgctagagcatatgacaagtaaaatcattttcttccaagaccattcttggaagag

SEQ ID NO: 15425 - DNA, 1101 bp, Primula obconica
gttatcgatttttgccctcgatttgtatacatatcttgtttagttctcttcgatttattcctaactgtttaattgaaagtgtattcagctatcgtgttttctttttctttgatttgatcttatttttttagtagtttctaatagttttttaaaaaaaatatttgctgttattgttgcagatttgggttaagcaagagtttcagtcatgagtaagcttcagagtgatgtcttgaggaggcgatagctcagattcacaaggacgccactgagaaagcacgcaagttcactgaaacaattgagcttcagattggactgaaaaattacgatcctcaaaaagacaaacgtttcagtggctctgtgaagttgcctcacatccctcgccccaagatgaaggtttgcatgcttggtgatgctcagcatgtcggagaggctgagaagatagggttggaatatatggatgttgaatcgttgaagaagcttaacaagaacaagaaacttgttaagaaacttgccaagaagtatcatgcctttttggcatcagaagctgtcattaagcagattcctcgtcttctaggccctggtctcaacaaagcaggaaagtttcccaccctggtctctcaccaggagtctctggagtctaaagtcaatgagactaaagcgacagtcaagttccaacttaagaaggttctctgcatgggtgttgctgttggaaactgcggaatggaggagaagcaaattttccaaaatgtgcagatgagtgtcaatttcctcgtttctctgttgaagaaaaattggcaaaatgtgaggtgcttgtacttgaagagcaccatggggaagccagtacgcgtattctaagaacttcagcgtttgggttgctgttttctgcttaatttagacagtttttcaggattaagcatttttcatttgctgtcattttgaattctttcccaatattacttgacattatggtgcgctttatatggagagttttaatatttccttgtgaaagttttaattctacaactcaccagagcttgctcgatctttatcaactttctgatgcttttttcttcaatgttctaatgattgttatggtttttt

SEQ ID NO: 15426 - DNA, 906 bp, Fraxinus spp
cggccgggggacgccgtcaattccgtctaacaaactctgatacttctcgtcagaagtggattgagaagaaatagagatattgcacaatgagtaagcttcagagcgaggcgttgagagaagctatctctgtaattgttaccgatactaaggagaaaaaacgcaattttaccgagacaattgagcttcaaattgggctgaaaaactatgatccccagaaggacaagcgattcagtggctcggtgaagttgcctcacattcctcgccccaagatgaagatttgcatgcttggtgatgctcagcatgttgaggaggcagaaaaataggattggagtccatggatgtggaggctctcaagaagttgaacaaaaacaagaagttggttaagaaacttgcaaagaaatatcatgctttcttagcctcggaagctgttatcaagcagattcctcgtctcttaggacctggtcttaacaaggcaggaaagttccctactcttgtgagtcaccaggaatctcttgaatccaaggtcaatgagacgaaggccacagtgaaatttcagctgaagaaggttctatgcatgggagttgctgttggaaatttgggtatggaggagaagcagatctttcaaaatgtgcaaatgagcgtcaactttctagtttcactgctgaagaaaaattggcagaatgtgagatgcttgtacttgaaaagtacgatggggaagcctcagcgtatcttttaagaagatatacgtctcagctgcagctgttttgggagaattgtacgagtttaaacaatcaaatgtttccagagaggaattttgaatgcctatcgtcttgttcttcatgaacgttattttccttaatgttgctgggttgaagcttactattattaatcaactgttgctgtttg

SEQ ID NO: 15427 - DNA, 849 bp, Catharanthus roseus
aaccctagctcatgttagggttttacacatttcctgcctcctctctctgcgttttctgcagtcttccttaggcagtcgactaagcaagtctaatctttcaccatgagtaagctacagagtgatgctgtgagagaagcaatatcaactattgttactgactgcaaagaagtcaagaaacgtaagttcactgagactattgagcttcagattggactgaagaactatgaccctcaaaaggacaagcgtttcagtggatcagtcaagctgccccatattccgcgccccaagatgaaagtttgcatgcttggtgatgctcagcacgtggaagaggctgagaagattggcctcgagtacatggatgttgaagggttgaagaaactcaaacaaaaacaagaagttagtgaaaaagcttgccaagaagtatcatgctttccttgcatctgaagcagttattaagcagatccctcgtcttttgggccctggtcttaacaaggcaggcaaatttcctacattggtgactcaccaagaatccttggagtcgaaagtgaatgaaacaaaggccacggtgaagtttcaattgaagaaggtcctttgcatgggtgttgctgtggggaatttggatatggaggagaagcaaattttccagaatgttcaaatgagcgtcaattttctggtatcactactgaaaaagaattggcaaaatgtgaggtgcttgtacctgaagagtacaatggggaggccacaacgcatcttctgagaagttgttttaatttaccttttttctaagatcagttcagtgagttaaggagttgatagttgaatacactcttctggtgaatgtctcaagta

SEQ ID NO: 15428 - DNA, 911 bp, Saccharum officinarum
cctctcctctcgctccgtcgctcgcctccggccaaaccctaagcagggattcgagtgatcggttgcagccatgagtaagttgcagtccgaggttctcaaggatgccatctcccagattgttggggatgccaaggagaagaataggaagttcaccgagactgttgagcttcagattggtctgaagaattatgatccacagaaggacaagcgtttcagtggctctgttaagttgccccacatccctcgtccgaagatgaaggtgtgcatgcttggtgatgcccagcatgttgaggaggctgagaagatgggacttgactacatggatgttgaggccctgaagaaaatgaacaagaacaagaagcttgttaagaagcttgccaagaagtaccatgctttcttggcatcagaggccatcatcaagcagattccccgtctccttggtcctggtctcaacaaggcaggcaaattccctacgctggttactcaccaggaatcccttgaatccaaggtgaatgagacgaaggctacagtcaagtttcagctgaagaaggttctttgcatgggtgtcgctgtcggtaacttgtccatggaggagaagcagatccagcagaacatccaaatgagcgtcaacttccttgtgtccctcctgaagaagaactggcagaatgtgagatgcctgtacgtcaagagcaccatggggaaaccatacagggtgttctaagtcagctctttgttaagtctgctctttatgaattatgatgctagggttttggaccgaggttgtcttgaactaaactcttgttagagtatgttttgttggcaggatattggagtggtactgccataagtatccgggcatgtgtcttgcacccaaacctttgtattctctatatatgttgcttgagtggttc

SEQ ID NO: 15429 - DNA, 917 bp, Saccharum officinarum
cctctcctctcgctccgtcgctcgcctccggccaaaccctaagcagggattcgagtgatcggttgcagccatgagtaagttgcagtccgaggttctcaaggatgccatctcccagattgttggggatgccaaggagaagaataggaagttcaccgagactgttgagcttcagattggtctgaagaattatgatccacagaaggacaagcgtttcagtggctctgttaagttgccccacatccctcgtccgaagatgaaggtgtgcatgcttggtgatgcccagcatgttgaggaggctgagaagatgggacttgactacatggatgttgaggccctcaagaaaatgaacaagaacaagaagcttgttaagaagcttgctaagaagtaccatgctttcttggcatcagaggccatcatcaagcagattccccgtctccttggtcctggtctcaacaaggcaggcaaattccctacgctggttactcaccaggaatcccttgaatccaaggtgaacgagacgaaggctacagtcaagtttcagctgaagaaagtcctttgcatgggcgtcgctgtcggtaacttgtcaatggaggagaagcagatccagcagaacatccaaatgagcgtcaacttcctcgtgtcccttctgaagaagaattggcagaatgtgagatgcctgtacgtcaagagcaccatggggaaaccatacagggtgttctaagtctgctctttatgaattatgatgctagggttttgaaccgaggttgtcttgaactaaactcttgttagagtatatttggttggcaggatattggagtggtgtcttgcccgcaagcctttgtattctctatgggtctcattggttgtctgcacagaacttgcattgccttgcttgaaattctactttatagttgttt

SEQ ID NO: 15430 - DNA, 942 bp, Actinidia deliciosa
ctcacttgtcggcttatcacgaatccgaagtctagggtttcttctccggacataattcagaagggaaacagattcagccatgagtaagcttcagagtgaagcattgagggaggccatctctcagattgctaatgatgccaaggagaaaaagcgtaacttcactgaaactattgagctccagattgggctgaaaaattatgatccccaaaaggataagcgtttcagtggttcggtgaagttgcctcacatccctcgacccaaaatgaaggtttgcatgctcggtgatgctcaacatgttgaagaggctgagaagataggtttggaatatatggatgtggaagggctgaagaagcttaacaaaaacaagaaattggtcaagaaacttgcaaagaaataccatgccttcttagcgtcggaagctgtcattaagcagattccccgtctgttaggccctggtctcaacaaagcagggaagtttccaacccttgttactcaccaggaatctctcgagtcaaaagttaatgagaccaaagctacagtaaagttccaattgaagaaggttctctgcatgggagttgctgttgggaactgcagtatggaggagaagcagatctttcaaaatgtgcaaatgagcgttaattttctagtttcattgttgaagaagaactggcaaaatgtgaggtgcttgtacctgaagagtaccatggggaagccagtccgcgtcttttaaggagttcttcacctcagctgttgagggacggatttgttgtgagcaaattctcgaaattaaagtcccagattgagcaattttccctttttgttagttgtttgcatcaacactctgaaatgctatgaacattttaatggttgttttccaagttatttaactgaataatctttttctatggtttctgcgtatgagcaaagaacaaaaaaaaaaaa

SEQ ID NO: 15431 - DNA, 917 bp, Petunia hybrida
ggggggcgctcactcactctctttttgcagcccttctcctttcagccatgagtaagcttcagagtgatgccttaagagaagccatctctgttattaagaatgattcaaatgagaagaaaaggaagtttactgaaactgttgagctccagattggtctgaaaaactatgatcctcaaaaggataagcgtttcagtggttcagtcaagttgcctcacattcctcgacccaagatgaaaatttgcatgcttggagatgctcagcatgtggaagaggcagaaaagattggtttggaatacatggacgtggaaggcctgaagaagcttaacaaaaacaagaagttggttaagaagcttgcaaagaaatatcatgctttcttggcatcagaagctgttatcaagcagattccccgtctcttaggccctggtttgaacaaggcaggtaagtttcctacccttgttacccaccaggagtcactcgagtctaaggttaacgagaccaaggccactataaaattccaattgaaaaaggtgctttgcatgggagttgccgtaggtaatctggatatggaggagaaacaaatcttccagaatgtgcagatgagtgtcaactttcttgtgtctttgctaaagaagaattggcaaaatgttagatgcttatacttgaagagtactatggggaagactcaacgtatcttttaaggaaattatattacaatcttggcagttttaaggaattatgcttgtacgagctagttgttgaatttttttgttagttattctggatagtctcttgaacttgatatcggtcgacttttttccccttttcagatggtaccacaactcattctgatatatcttgttttaatttcttgaatattgtcaaattttaatccttaaagtaaaactcaaactgtgttt

SEQ ID NO: 15432 - DNA, 989 bp, Cucumis sativus
gttcttccattatatatttattctctgttcggccgtcgaaaaaccctagcttcctgtcttctcaccagtttgtagctacttcttgggaaagacaaagctccgaaaatgagcaaacttcaaagtgatgcgttgagagaagccatttcatctatcttcgctgatagcggtgaaaagaagcgcaaattcactgagaccattgaacttcagattggacttaagaactatgatccacaaaaggacaagcgtttcagtggttcagtgaagttgccccatatccctcgccctaagatgaagatctgcatgcttggagatgcttcacacgttgaagaggcagagaagattggtttggattatatggatgttgaaggtctgaagaagctaaacaaaaacaagaagttggttaagaaacttgccaagaaataccatgcctttttagcatctgaagctattatcaagcaaattccccgtcttctgggccctggtctcaacaaggcaggaaagttccctaccctggtcactcatcaagaatctcttgaatctaaagtaaatgagactaaggcaatggttaagttccaattgaagaaggttctttgtatgggtgtggccgttggcaatattgccatggaagagaagcaagtttttcagaacgttcaaatgagtgtcaatttccttgtttctttgttgaaaaagaattggcaaaatgtgaggtgcttgtacctgaagagtacaatggggaaggcatatcgagtcttctgaggaattttcataacctagatagttctgtttgtttgtcttaaatggaagaagttgagataagatttctatatttatgattgatgaaaaattttcctgtttgtttccttttagtaaaccattagctgcacaatcgtcaacacttgtgatgggagtaatgtgtttttttgtttcactctatatgttctgtagatttttgtttcaatttatttgattattgcttagtttcaattaaa

SEQ ID NO: 15433 - DNA, 1066 bp, Cucumis melo
cttcgttcttccattatatatttattctcagttcggccgtcgaaaaaccctagcttcgtgtcttctcaccagtctgtagctacttcctgggaaagacaaagctccgaaaatgagcaaacttcagagtgatgcgttgagagaagccatttcatctatctttgctgatagcggtgaaaagaagcgcaaattcactgagaccattgaacttcagattggactgaagaactatgatccacaaaaggacaagcgtttcagtggttcagtgaagttgccccatatccctcgccctaagatgaagatctgcatgcttggagatgcttcacacgttgaagaggcagagaagattggtttggattatatggatgttgaaggtctgaagaagctaaacaaaaacaagaagttggtgaagaaacttgccaagaaataccatgcctttttagcatctgaagctattatcaagcaaattccccgtcttctgggccctgggctcaacaaggcaggaaagttccctaccctggtcactcaccaagaatctcttgaatctaaagtaaatgagactaaggcaatggttaagttccaattgaagaaggttctttgtatgggtgttgccgttggcaatattgccatggaagagaagcaagtttttcagaacgttcaaatgagcgtcaatttccttgtttctttgttgaaaaagaattggcaaaatgtgaggtgcttgtacctgaagagtacaatggggaaggcatatcgagtcttctgaggaattttcatagcctagataacagttctgtttgttcttaaatcgaagaagttgagataagatttctatatttatgattgatgaaaaattttcctgtttgtttccttttagcaaaccattagctgcacaatcgtcaacacttgtgatgggagtaatgtgttttttgtttcactctacatgttctgtagatttttgttttaatttattgtttgattattgtttggtttcaattaaagaacatctaatcaattcgtgcaggtgcttccagttattcaaaattaatgttatgaaaatttttaaaaaaaa

SEQ ID NO: 15434 - DNA, 884 bp, Momordica charantia
gagggtctcttcttttcctccggactgaagtgtatggtattttagcgaaggcgaaggttcgaatatgagtaagcttcagagtgatgcgttgagagaagctatcacatctatcttctctgatagcaatgagaaaaagaggaaatttaccgagaccattgaacttcagatcgggctgaagaactatgaccctcaaaaggataagcgtttcagtggttctgtgaagttgccccacattccccgtccgaagatgaagatttgcatgcttggagatgcattgcacgttgaggaggccgagaagattggtttagattatatggatgtggagggcttgaagaagcttaataagaacaagaaattggtgaagaaacttgccaaaaagtaccatgccttcttggcatctgaagctgtaatcaagcagatccctcgtcttctaggacctgggctcaacaaagcaggaaagttcccaacattggtgacacaccaagaatcgctcgaatccaaagttaacgagaccaaggcaatggtcaagtttcaattgaagaaagtgctttgcatgggagttgcagtgggaaatgtttccatggaggagaagcaagtcttccaaaacgtgcaaatgagtgtcaatttcctggtttctttgttgaagaagaactggcagaatgttaggtgcctgtacctgaagagcacaatggggaagtcgtaccgagttttctaagctctgttagtgatctagtcagtcttgtgttcgatctttctactgttgaagttattttttgaagagcagttttgcgaattgagcgtttttttaatgatcattgaacaaagaaacagggatgcttttttctcctctaaagtgactattgataatgaagttttcaattcct

SEQ ID NO: 15435 - DNA, 879 bp, Petunia hybrida
ttacggtgaagtttcaaggagaaagacagataattttgagccatgagtaagcttcagagtgatgcccttagagaagccatctctgtgattacaaaagattcagcggagaagaaaaggaagttcactgaaacaattgaactccagattggactgaagaactatgacccccaaaaggacaagcgtttcagtggatcagtcaagctgccccacatccctcgtcctaagatgaaagtttgtatgctgggggatgctcagcatgttgaggaggcagaaaagattggattagaatatatggatgtagaaggcttgaagaagcttaacaaaaataagaagttggtcaagaagcttgctaagaaatatcatgctttcttggcttctgaagctgtcatcaagcagattccccgtctcttggggcctggtctgaacaaggcaggaaaatttcccacccttgttacacaccaggagtcactcgaatccaaggttaatgagatcaaggcaactgtcaagtttcagttgaaaaaggtgctttgcatgggagttgctgttggaaacatggatatggaagagaaacaaattttccagaatgtgcaaatgagtgtgaatttcctagtctcattgctgaagaagaattggcaaaatgttaggtgcctgtactcgaagagcaccatgggaaagacacaacgtatcttttaaggagattttcgttttgttctcggaattttcaggcattctgttgtgtgagctataaactctttgaaattttgagtagtaaaaaggggtatctgtttgaatattattatggaagtattagagattgttttgcttcaatgcttgaaatggcagcatttgcattatcttgagatttaagtgattatacca

SEQ ID NO: 15436 - DNA, 1027 bp, Sequoia sempervirens
atgtcattcgtgtgaacacattggcggttgcgggcaatgaagagagtttagcaaaaccctagcttgggtttttttctcttatcgttatcagcccttgctgttgttagggaaagtaaacggaaaagaacagaggagaggagagcagaagggcggcgttgtatcagccatgagtaagcttcagagcgatgttttgagggaggcgataacaggcttggtgggagagagcaaagacaagaagagaaagtttgtggagacgatcgaattgcagattgggctgaagaattatgaccctcagaaggataagcgcttcagtggctctgtcaaactccctcacatccctcgccccaagatgaagctctgcatgctcggtgatgcccagcacgttgaagaggctgagaaaataggattggactacatggatgtcgaaggattaaagaaaatgaacaagaacaagaaattggttaagaagcttgccaagaaatatcatgcttttcttgcatcagaagcaattatcaagcagattcctcgacttcttggccctggtctaaacaaggctggtaagtttcctactttggtgtcacatcaagagtcattggagggaaaagtaaatgaaacaaaagccactatcaagttccaattgaagaaagttctgtgtatgggtgttgccgtgggtaactgtggcatggaggaaaagcaaatattccagaatgttcagttgagtgtcaactttctggtgtccttgctcaagaagaattggcagaatgtcaggtgtctctatctgaagagcaccatgggaaagccatctcggatattctaaatgagcaatttagtcagcttttgctcaatgaacattggtggaatatgttttgttttgttggtttagggttgtcgggtgttcagacaatttattctaatgcaaaattgcatttgatttcaatataacattttgcagaggcatatgttatgcaataggcaggctcagatttatgttgtaactgagggagattctatttttgactcacaattg

SEQ ID NO: 15437 - DNA, 945 bp, Cajanus cajan
tttgtttttcacagctctccgagatcttcagtcgctgatttgaaaagatgagtaagcttcagagtgatgctttgcgagaggccatctcaggaatcatggccgattccaaggagaagaatcgcaaatttgtggagaccattgagctccagattggattgaagaactacgatccacaaaaggacaagcgtttcagcggctctgtcaagttgccccacatccctcgccccaagatgaaaatttgcatgcttggtgatgctcaacatgttgaagaggcggaaaagattggattggactggatggatgtcgaagccctgaagaagctgaataaaaataagaagttggtgaagaagctagctaaaaaataccatgcctttttagcttctgaagcagtcattaagcagattccacgtcttttgggtcctggtctcaacaaggcaggaaagttccctacacttgttactcaccaggaaactcttgagtcaaaggttaatgagtccaaggctatggtcaaatttcaacttaagaaggtgctctgcatgggagtagctgtgggcaatgttagcatggaggaaaagcaaatcttccaaaatgtgcaattgagtgttaacttcttggtatccttgttgaaaaagaactggcagaatgttaggtgcttgtatctgaagagtaccatgggaaaatcttaccgtgtcttttgagggatttcttttttcatttcggtgaatttgtgatcgcgcttgatacattatcttaatagctagatacaaattttcatcttgttacagttttgttggatgatcttttatggttagtgtttcgtgttcatgttcaaagttcaaacattcgattatgatatgcattatttttggtgctgctttcctaattgctataactcaatcccatttcagcttttataaattcctttattttattttggcctcaaaa

SEQ ID NO: 15438 - DNA, 937 bp, Solanum melongena
agcactgaactgagccaaccttcgtctctcttacggcgctcacaaacactaattagggtttactcatacagaagtgaaattttgaaggagaaaggagaagtatttaagccatgagtaagcttcagagtgaggctcttagagaagccatctctgtaattaagaatgattcagctgagaaaaaaagaaagttctctgagactattgagctccagattgggcttaagaactatgatccccaaaaggacaagcgttttagtggatctgttaagttgcctcatattccacgccctaagatgaagatttgcatgctcggagatgctcagcacgtggaggaggcagaaaagattggtttggagtacatggatgttgagagcctcaagaagcttaataagaacaagaagttagttaagaagcttgcaaagaaataccatgctttcttggcttcagaatctgtcatcaagcagattcctcgtctcttgggtcctggcctgaacaaggcaggtaagtttccaacccttgtttcccaccaggagtcacttgagtctaaggttaacgaaaccaaggctaccatcaagttccagttgaagaaagtgctttgcatgggtgttgccgttggtaattgtgatatggaggagaaacaaatcttccagaacgtgcaaatgagtgtcaacttcttagtgtcgttgctaaagaagaattggcagaacgtaaggtgcttgtacttgaagagcaccatgggcaagactcaacgtatcttttaagacaaacgtctcgttactggagcttttcgtgcattctgtaagagagatactaatgaaaattttggatagttaatcatccttgaatatgttttgaatgttacatcactatatggatcgatcatatttccgagacacttttctgttttttcaagcgatattagctctgttctttgttc

SEQ ID NO: 15439 - DNA, 878 bp, Eschscholzia californica
gttgtcgttctgttagggtagaaatctgtagtgggtttcacggaaatcgttaaccatgagtaagcttcaaagtgaagttctaagagaagcaatcacccaaatcacagctgatgctaaggagaaggcaagaaagttcactgagacagttgagctccagattggtcttaagaactatgaccctcaaaaggacaagcgtttcagtggttcagtgaagttgccacatatcccccgccctaagatgaaagtgtgcatgcttggagatgctcaacacgtcgaagaggcagagaaaattgggctagactacatggatgtcgaaggattgaagaagcttaacaagaacaagaaattggtcaagaagcttgcaaagaagttccatgcttttctagcatctgaagctgtcattaagcagattcctcgtcttctcggccctggtctcaacaaggcaggaaaatttccaacacttgtgagtcaccaagaatcattggaagccaaagttaacgaaaccaaggctatggtgaagtttcaactgaagaaggttctctgcatgggtgttgctgtgggtaacctcggaatggaagagaagcagatcttccagaatgtgcaattaagtgtcaacttccttgtatcattgttgaagaagaattggcagaatgtgaggtgcttatacttgaagagtacaatggggaagcctgtccgcatcttctaagtattcaattaccccgaaaaatagatgggtactttttttggttatgatctcaaatttctttgatgttcttttcatgaccctaagcccagtgcttaactgaaatcttgaaaaacaaagttttgttttcttgttgttttgagttgaatagttcttctgtagcagttcatacttt

SEQ ID NO: 15440 - DNA, 719 bp, Elaeis guineensis
acttctcccgccgccttctcctctctctccgagctcttggaaggagcgtcgaagtgaaagcaggagaaatccaccagaacaatgagcaagttgcagagtgacgttttgagggaagcaatctctcagctgacaaatgattctcgggagaagaagcgcaattttactgaaaccatcgagctgcagattggtctgaagaactatgacccccaaaaggacaagcgcttcagtggatctgtgaagttacctcatatccctcgtccaaaaatgaaggtctgcatgcttggtgatgctcaacatgttgaggaggcagagaaaatagggcttgactatatggatgttgaagcactaaaaaagatgaacaaaaacaagaagctggtcaaaaagcttgctaagaagtaccatgctttcctagcatcagaagcaatcattaagcagattcctcgtcttcttggtcctggtctcaacaaagcagggaagtttcccacattggtgactcatcaggaatccctggagtcaaaagttaatgagacaaaagcaatggtgaaatttcagctcaagaaagttttgtgcatgggtgttgctgtgggtaattgtgcaatggaggagaagcagatctttcagaatgtgcaacttagcgttaactttcttgtgtcattgttgaagaagaattggcaaaatgtgaggtgcttgtacctgaagagcaccatgggtaagccgta

SEQ ID NO: 15441 - DNA, 872 bp, Phalaenopsis aphrodite
gccacttttcattctctccgacgaaaaatttagcagctaagtccggcttggaactatgagtaagttacaaagtgatgttttgagggaagcaatatcccaacttgtcaacgactctcgtgaaaaaaagcgcaactttacggaaactattgaactgcaaattggactgaaaaattacgatcctcaaaaggataagcgctttagtggctccgttaagctgccccatattcctcgtcccaagatgaaggtctgcatgcttggcgatgcccaacatgttgaagaggctgagaagataggtttggagtggatggatgttgaagggctgaagaaaatgaataagaacaaaaagcttgtcaaaaagcttgctaagaaatatcatgctttccttgcgtccgaagccatcatcaaacaaattccccgccttcttggccccggtctcaacaaagcaggaaagtttccgacactcgtgactcatcaggaaactctcgaatcaaaagtcaatgagaccaaagcaatggttaagtttcagctgaagaaagttctctgtatgggcgttgctgttggaaattgtgcgatggaagaaaagcagatctttcagaatgttcagctcagtgtgaattttttggtctctcttctgaagaaaaattggcaaaacgtgaggtgcttgtatctgaagagcacaatgggcaagccttacagagtgttctgagcagcttatgaggagttttgcctaggagaaaattatggagacaattacatttttgttttattaaaatatttgcacatctatcccttttttggtgcctgctttatgttgtgaatgattttctgttgctttaatgagatttttctcccttaaaaatattatatttacc

SEQ ID NO: 15442 - DNA, 1091 bp, Elaeis guineensis
gtttaatacgcatggccagaacctccaggggacgctctctctgtgactggtgcccaaacctaaagaaggatagaagctaatagggcaattcctttgaggagtcgtccaacaaaggagaagaaccatgagcaagctgcagagcgatgtgttaagagaggctatctctcagattatgaatgatactaaggagaaaaagcgcaacttcactgagaccattgagctgcagattgggctaaaaaattatgacccacaaaaggataagcggtttagtggttctgtgaagttgccacatattccgcgtccgaagatgaaggtttgcatgcttggtgatgctcaacatgtggaagaggctgagaaaattggactggactacatggatgttgaagggctaaagaagatgaacaagaataagaagttggtcaagaagctcgcaaagaaatatcatgcatttttagcatctgaggctattattaagcagattcctcgacttttgggccctggtcttaacaaggcaggtaaatttccaacattggttacacatcaggaatctttagaggccaaagtcaacgagaccaaagcaatggtgaagtttcagctgaagaaagttctttgcatgggtgttgctgttgggaattgcgcaatggaggagaagcaagtatttcaaaatgtgcaactcagtgtcaacttcctggtgtctttgttgaagaagaattggcagaatgtgagatgcttgtacttgaagagcaccatgggaaaaccttaccgcgtgttctaagaaaactctttgcaaatctgatggttgattaacaatgcttgggttgacctgccagatttctttcttttattatcattatcatgccaaatctcctctctcccccccctagttctttagtttgaactttctttaaatgttcatctgttaaaatgagagttgtaggtcaagtttttttttatttttttgcttataaactgaaagttctgttttggcctcatatttgagaaacttagttgatggttatggttcaaattcagatattgttataccagtttggtttgccaccattattaaatgatcggtgaaattcaccata

SEQ ID NO: 15443 - DNA, 1108 bp, Lippia dulcis
ccccgacagtcttgcaaaccctaattgagggttttctcatcaggagttagctgggaagatacagatatcttgaatcatgagtaagcttcagagcgatgcccttagggaagccatctctgtgatcacttctgatgctaaggagaagaagcgtaacttcactgagacagtcgagctgcaaattggtctgaagaactatgaccctcagaaagacaaacgtttcagtggctctgtcaaactacctcatattcccaggcccaaaatgaaaatttgcatgcttggtgatgcccagcatgttgaagaggcagcaaaaattggtttggagtccatggatgttgaggctctaaagaaattgaacaagaacaagaagttggtgaagaagctggctaagaagtatcatgctttcttagcttccgaagctgttatcaagcagatcccccgtcttttggggcctggtctcaacaaagcaggcaagtttcccacccttgtgactcaccaagaatctcttgagtcaaaggtgaatgagacgaaggctacagtgaagttccaattgaagaaggtgctctgcatgggagtcgctgttggaaacttggacatggaagagaagcaaatcttccagaacgtgcaaatgagtgttaacttcctggtttctcttttgaagaaaaactggcaaaatgtgaggtgcttgtacttgaagagtaccatgggaaaaccacagcgtatcttttaagagaattgttttctgttacaagttcttagcaaagtcagagttgtatgttcgttaagactatgaactatttcccttgcatgggaatttttgtgttttctatcgttgttgtcgagatgcttttgtttgttgatcagatgcttgttatatgctcaaatagccatatttcttgtttgccggcgcagttcgattatttcaagtgatcatcttaagttaaattgtgcgattagatatcagtatttcacatctatatttaggttggcatttgatatgtgaatctgtattttacattacatttaaggtagaaaattgtcgaatgggttgataaggtattgtgctaatatttcttttggaaaattctccaaatatattctatcaaagatt

SEQ ID NO: 15444 - DNA, 912 bp, Fraxinus spp
cggccgggggacgccgtcaattccgtctaacaaactcttgatacttctcgtcagtggattgagaagaaatagagatattgcacaatgagtaagcttcagagcgaggcgttgagagaagctgtctctgtaattgtaaccgattctaaggagaaaaaacgcaatttcaccgagacaattgagcttcaaattgggctgaaaaactatgatccccagaaggacaagcgattcagtggctcggtgaagttgcctcacattcctcgccccaagatgaagatttgcatgcttggtgatgctcagcatgttgaggaggcagaaaaaataggattggagtccatggatgtggaggctctcaagaagttgaacaaaaacaagaagttggttaagaaacttgcaaagaaatatcatgctttcttagcttctgaagctgttatcaagcagattcctcgactcttaggacctggtcttaacaaggcaggaaagttccctactcttgttagtcaccaggaatctcttgaatccaaggtcaatgagacaaaggccacagtgaaattccagctgaagaaggttctttgcatgggagttgctgttggaaatttgggtatggaggagaagcagatctttcaaaatgtgcaaatgagcgtcaactttctagtttcactgctgaagaaaaattggcagaatgtgagatgcttgtacttgaaaagtacaatggggaagcctcaacgtatcttttaagaaaatgcacatctcagccacagctgttttgggagaattgtacgggtttaaacaattaaatgtttccagagaggaattttgaatgcctatcgtcttttttcttcatgaacgttgtcttccttaatgttgttgggttgaagcttactattattaatcaactgttgctgtttgaaacag

SEQ ID NO: 15445 - DNA, 959 bp, Plantago ovata
tgaagtaagaatttggcataaagatcttcttccaccatcatgagtaagcttcagagtgaggccctgagagaagccatcacggctattactgccgatgccaaggagaaaaatcgtaaattcactgagacgattgagctccagattggtttgaagaactatgatccccaaaaggacaagcgtttcagcggctctgtcaagttgccccacatcccaagacctaagatgaaaatctgtatgcttggggatgctcagcacgttgaagaggctgagaaaattggcatggagtccatggatgttgaggctctgaagaagttgaacaagaacaagaaacttgttaagaagcttgcaaagaaataccatgctttcttggcctctgaagctgtgattaagcagattccccgtctcttgggacccggtctcaacaaggcaggtaagttccccacccttgtcagtcatcaggagtcactggagtccaaggtcaatgagaccaaggccacagtcaagttccagttgaagaaggtgctctgcatgggagttgctgttggtaactgtgccatggaagataagcagatcttccagaatgtgcaaatgagcgtcaacttcctcgtttcactcttgaaaaagaattggcagaacgtgaggtgcttgtacctgaagaccacaatgggcaagccacaacgtatcttttaaggagctgtttgagattttatttggaaccgtatgaagagttgtaagggggcagaaactctggaatatttcctttatggaaatttttggtttttaagcactgttatgatactttggccagaaatgttatgggtactttattacagggtatttttggttgcatggtttgttccgccatatggtgaaattagatgctttcatttttgtccatgtttgttctggtatactgtactaccatcatagatgttatttttgtcttctgctcatgtgtt

SEQ ID NO: 15446 - DNA, 1252 bp, Picea glauca
ccctttataaagtcgatatattagggtttttatctcttccttcgaatcctaaaccctagtcgagggccggtcgtgcgtaggagagagcagacagaggaagacgctaggcgaagacaaatatgagtaagcttcagagtgatgtgttgagggaggccatctcccaggtcatggcagatagtaaggagaaacaacgtaaattcacggagacgattgagttacagattggccttaagaattatgatccgcaaaaggacaagcgtttcagtgggtccgtaaaattgccccacattccccgccccaagatgaaggtctgcatgctcggagatgcccaacacattgaagaggctgagaagatcagtcttgactacatggatgttgagggtctgaagaaaatgaacaagaataagaaacttgttaagaagctcgcaaagaagtaccatgcatttcttgcttcggaagcaattattaaacaaattccaagactccttggacctggtcttaacaaggctggtaaatttcccactcttgtttcacaccaagagtccttggagtccaaggtgaacgaaacaaaagcaacggttaagtttcagttgaaaaaagttctatgtatgggggttgctgtggggaactgtggaatggaggagaaacaggtgtttcagaatgttcaattgagtgtgaactttctggtatccttgctgaagaaaaactggcaaaatgtccgatgcttgtatctgaagagtaccatgggcaagccagcacgcgtattctgagttttgcaatattggtgtcagcctgtgttggctgcatatggagaggatttttccttggtttttgttttgcgttggtcagaacattacatttttgtttgtgtggaggggtatgttagccaagtggctttaatctcatgcatttgggagtaaaagggaaattaattattattttactattttgttattgtaatttggcatggtttatcagtcatgctgctggaagatatgtttatctcttcctttattcaagtaatcagaattgagtagatactgaaccaagtttattattgttcttaatttgacataggcatatttattattgtccatgcaggagagatattagaaaatgattgatatattcctggtttgatttctgaaattggcattacaaggcgtactgtgaacaccgaaaacaaactagaaaatggtatacctgtttctgttaattatgttttattcactaacattattaacaaactggc

SEQ ID NO: 15447 - DNA, 777 bp, Utricularia gibba
gcttactcatggttcacgcctttttttacgttctccgaactagcttcgcgatgcgttgagggaagccatatctgttataacggcgcaatgtaaggagaagaagcgcaaattcacggagacaattgaactgcagattggactgaagaactatgacccgcaaaaggacaagcgcttcagtggttccgtcaaattaccacacatcccaagacctaaaatgaaggtctgcatgcttggtgatgcgcagcacgttgaagaggctagaaaaaatcggcctggagtcgatggatgttgaggctttgaagaagttgaacaagaacaagaagctggtgaagaagctcgctaagaaatatcatgcttttctggcatctgaagctgttatcaagcagatcccacgtctccttggtcctggtcttaataaggctggtaaattccctactctggtgacacaccaggaatcactggaatccaaggtgaatgagaccaaggctacagtgaaattccaactgaagaaggttctttgtatgggtgttgctgttgggaacctggatatggaggagaagcagatcttccagaacgtgcaaatgagcgttaatttcctcgtctcccttctgaagaagaattggcagaacgtaagatgcttgtacttgaagagcaccatgggaaaaccccaacgcatcttttgaatagtttctttgatttgtattatggacaagctctatgcatctttgatcatccagaatttcagacgcgattttgctttcgtttatgaagagagct

SEQ ID NO: 15448 - DNA, 922 bp, Phalaenopsis aphrodite
ttttttttccgcgaggcgggcgaggctccgaagaagccagcgatcacactgcgagggttagctgaagagtcggcgcagagagccgcttggaaaaaatgagtaagttgcaaagtgatgttttgagggaagccatctcccagcttctcaacgaaactcgtgagaagaagcgcaacttcacggaaaccattgagctgcaaattggactaaagaactatgatcccaaaaggacaagcgctttagtggttctgtgaagcttccacacattcctcgtccaaagatgaaggtttgcatgcttggtgatgcccagcatgttgaagaggctgagaagatagggctggattggatggatgttgaagctctcaagaaaatgaataagaataagaagcttgtgaaaaagcttgcaaagaagtatcatgctttcttggcctctgaggctataatcaagcaaattccccgccttcttggacctggccttaataaagcagggaagtttcctactctggttactcatcaggaatccttggaatcaaaagtaaatgaaaccaaagcaatggtcaaatttcagctgaagaaagttctgtgtatgggtgttgctgtgggcaactgcgcaatggaggagaaacagatctttcaaaatgttcagctcagcgttaatttccttgtttcccttctgaagaaaaactggcaaaatgtgaggtgcttgtatatgaagagcaccatgggcaagccatacagagtgttctgagttgagcagattccagtgggttttgcagacgctttttttattactgttttttattcttctaattgtgcttcgtagaacatcatctcctcttaatcatcaaagattttggcttctaccttttgttgaatttaactttgtttgccttatatttaattggaaacccctctgtgcttcagt

SEQ ID NO: 15449 - DNA, 1008 bp, Cedrus atlantica
acagaggaagcaaggcgccccactctgtaaacaatgagtaagctccagagtgacgtgttgagggagggaataactcagattatgggagaaagcaaggacaagaagcgaaaatttacagagacgatagagttgcagatcgggctgaagaattatgatccccaaaaggataaacgtttcagtggctccgtaaaattgccccacataaccccgcccaaagatgaaggtctgcatgctcggagatgcccaacatattgaagaggccgaaaagatcagtctggactacatggatgttgagggtctgaagaaaatgaacaagaacaagaaacttgtaaagaagcttgcaaagaagtaccatgcatttcttgcttctgaagcaattattaaacaaattccaagactccttggacctggtcttaacaaggctggtaaatttcccactcttgtttcacaccaagagtccttggagtctaaggtgaatgaaacaaaagcaacggttaagtttcaattgaaaaaagttctatgtatgggggttgctgttgggaactgtgggatggaggagaagcaggtgtttcagaatgttcaattgagtgtgaacttcctggtatccttgctgaaaaaaaactggcaaaatgttcggtgcttgtatcttaagagtaccatgggcaagccagcacgcgtattctgaatgtgcaatattggtgctgtttgtgttggctgcatatggagaggacttttcctaggtttttgttttccgctggttagaacaatacatttttgtttgcgtggaggggtatgttagccaagaggctttaatctcatgcatattggagtaaaaggaaatttaattattattttactattctcttgttgtaacttggcatgttttatcagtcatgctgctggaagtttttgtttctcttccttaattcaagtgatcacaatgcagtagatactgaacccagtttattattgttcttaatttgactataataggcataattattattg

SEQ ID NO: 15450 - DNA, 1038 bp, Abies balsamea
acgacgaagaagaggcggagacaggaggaaggcgcccccttctgtaaacaatgagtaagctccagagtgacgtgttgagggagggaataactcagattatgggagaaagtaaggacaagaagcgaaaattcacagagacgatagagttgcagatcgggctgaagaactatgatccccaaaaggataagcgtttcagtggatccgtaaaattgccccacattccccgccccaagatgaaggtctgcatgctcggagatgcccaacatgttgaagaggctgagaagatcagtctggactacatggatgttgagggtctgaagaaaatgaacaagaacaagaaacttgtaaagaaacttgcaaagaaataccatgcatttcttgcttcagaagcaatcattaaacaaattccaagacttcttggacctggtcttaacaaggctggtaaatttcccactcttgtttcacaccaagagtccttggagttcaaggtgaatgaaacaaaagcaacagttaagtttcaattgaaaaaagttctatgtatgggggttgctgtgggtaattgtggaatggaggagaagcaggtgtttcagaatgttcaattgagtgtgaacttcctggtatccttgctgaagaaaaactggcaaaatgtccgatgcttgtatctgaagagtaccatgggaaagccagcacgtgtattctgaatgcgcaatattggtaacatttgtgttggctgcacacggagaggactttctcttggttttgtttttatgttggttagaacaatacatttttgtttgtgtggaggggtatttcagccacacgtggctttaatctcatgcatattggagtagaagggaaatttaattattattttactattctgttattgtaacttggcatgtttgatcagtcatgctgctggaagttatttttatctcttcctttattcaagtaatcagaattgagtagatactgagtccagtttattattgttcttaattcgacattaaaggcatatttattattgtgcatgcagga

SEQ ID NO: 15451 - DNA, 964 bp, Pennisetum glaucum
gcacaatcctttcctgccaggcggcggcggcggctccactggtataacacccggcgccgccacttcccccgcttctctccctctccctctcggcgcccgccagtccctgacgaagggagctgagtgaccggttgcagccatgagtaagttgcaaactgaggttctcaaagaagccatctctcagatcgttgtggcttccaaggagaagaataggaagttcactgagacagttgagcttcagattggcctgaagaactatgacccacagaaggacaagcgtttcagtggctctgttaagctgccccacatcccccgccccaagatgaaggtgtgcatgcttggtgatgcccagcacgttgaggaggctgagaagctcggacttgactacatggatgtcgagtctctgaagaaaatgaacaagaacaagaagcttgtcaagaagcttgccaagaagtaccatgctttcttggcgtcagaggccatcatcaagcagatcccccgtctccttggtcctggtctcaacaaggcaggcaagtttcccacactggtttctcaccaggagtctcttgaagccaaggtgaacgagacgaaagctacagtcaagttccagctaaagaaggttctttgcatgggtgttgctgttggtaacctgtccatggaggagaagcagatccagcagaacatccagatgagcgtcaacttccttgtgtcccttctgaagaagaattggcagaacgtgaggtgcctgtatgtcaagagcaccatggggaagccgtacagggtgttctaagtcctgccgctatgtgaaggaccttgaactgggctttgccataaacttagatatgtacccatcagttttgtgcctgacaatgagactgttgaaatatctggtccttaaatttattttttcgcttaatggaacctctggaggaatgcttttgcaattatggagtcgcatcttgtg

SEQ ID NO: 15452 - DNA, 916 bp, Pennisetum glaucum
actgactctgcttcaggttccatggcgcaatcctttccgccgccgccacttcccccgcttccccccctctccctctcggcgcccgctaatccctgacgaagggagctgagtgaccggttgcagccatgagtaagttgcaaactgaggttctcaaagaagccatctctcagatcgttgtggcttccaaggagaagaataggaagttcactgagacagttgagcttcagattggcctgaagaactatgacccacagaaggacaagcgtttcagtggctctgttaagttgccccacatcccccgccccaagatgaaggtgtgcatgcttggtgatgcccagcacgttgaggaggctgagaagctcggacttgactacatggatgtcgagtctctgaagaaaatgaacaagaacaagaagcttgtcaagaagcttgccaagaagtatcatgctttcttggcgtcagaggccatcatcaagcagattccccgtctccttggtcctggtctcaacaaggcaggtaagtttcctacactggtttctcaccaggagtctcttgaagccaaggtgaacgagacgaaagctacagtcaagttccagctaaagaaggtcctatgcatgggtgttgctgttggtaacctgtccatggaggagaagcagatccagcagaacatccagatgagcgtcaacttccttgtgtcccttctgaagaagaattggcagaacgtgaggtgcctgtacgtcaagagcactatggggaagccgtacagggtgttctaagtcttgccgctatccttgtgaaggacctcgaactgggcttgccataaacttagattgtacccatcagttttgtgcctgtcaatgagactgttgaaatatcttgtccttaaatttagtgttttgcttaatagaacctgtgg

SEQ ID NO: 15453 - DNA, 926 bp, Pennisetum glaucum
ataacacccggcgccgccacttcccccgcttctctccctctccctctcggcgccctccagtccctgacgaagggagctgagtgaccggttgcagccatgagtaagttgcaaactgaggttctcaaagaagccatctctcagatcgttgtggcttccaaggagaagaataggaagttcactgagacagttgagcttcagattggcctgaagaactatgacccacagaaggacaagcgtttcagtggctctgttaagttgccccacatcccccgccccaagatgaaggtgtgcatgcttggtgatgcccagcacgttgaggaggctgagaagctcggacttgactacatggatgtcgagtctctgaagaaaatgaacaagaacaagaagcttgtcaagaagcttgccaagaagtaccatgctttcttggcgtcagaggccatcatcaagcagatcccccgtctccttggtcctggtctcaacaaggcaggcaagtttcccacactggtttctcaccaggagtctcttgaagccaaggtgaacgagacgaaagctacagtcaagttccagctaaagaaggttctttgcatgggtgttgctgttggtaacctgtccatggaggagaagcagatccagcagaacatccagatgagcgtcaacttccttgtgtcccttctgaagaagaattggcagaacgtgaggtgcctgtacgtcaagagcactatggggaagccgtacagggtgttctaagtcttgccgctatccttgtgaaggacctcgaactgggcttgccataaacttagaattgtacccatcagttttgtgcctgtcaatgagactgttgaaatatcttgtccttaaatttagtgtttcgcttaatagaacctgtggagggatgcttttggaattatggagttgcatcttgtgtt

SEQ ID NO: 15454 - DNA, 1246 bp, Aristolochia fimbriata
tctctttgcactcttgtgacgccgccgcatcggctctgaagcacccctgctccgggagtttagcaccgctattttgtagtgaaatatatacttggagcaacgatgagtaagcttcagagtgatgtcttgagggaggccattggtcaggtcatggatgttgcaaaggataaaaaccgtaactttaccgagactattgagctccaaattggactcaagaactatgacccacagaaggacaagcgtttcagtggctctgtgaaactgcctcatattcctaggccaaaaatgaaagtttgcatgcttggtgatgcacagcatgttgaagaggctgagaagataggtttagattatatggatgttgaagcactgaagaaaatgaacaagaataagaagctagtgaaaaagcttgcaaagaagtaccatgctttccttgcttctgaggcaattattaagcagattccaaggcttcttggtcctggtcttaacaaagctggaaagttccctactctggtctctcaccaggagtctctggagtcaaaggtaaatgagaccaaagcaatggttaagtttcagcttaagaaggtgctgtgcatgggtgttgctgttggcaattgtggaatggaggagaaacaagttttccagaatgtgcagctcagtgtcaacttccttgtttctctccttaaaaagaactggcagaatgttaggtgcttgtatctgaaaagtacaatgggaaagcctgtccgtgtgttctaatctggatccatattgctttactgagagtgaaacccggcgaaaccgagttttgattgtaggttaatctgtttttctgtttttcattccagtgaagaatagatacatacacataaattgatttgtttggagtgacaagggtgtgtcattatgaaaaaatttcttagctctgtggtaggtatttttgttttttttattgtttcttcaattttgacaattagtccatttccctgcgataatgttgccagtttattttgtgctggatgtcgtaattagaggcttcagcgagattgggaaacttgtgtatgagttgagtccgagcaaaatatgtaatcaccttttcttgtgttaagaaagcagttgtttctcgtttctctcgttctggaaattccttacattttgtttctcgtttatgcttgtgtcatccttgttgggaatgtgcaaggattatctactctaattctttctcccgaattaaatgaatcagttttcgtaa

SEQ ID NO: 15455 - DNA, 959 bp, Liriodendron tulipifera
gcctcttagggtttttctctcttcaacctccgcctcttctcttctccactggagagtaatttctgaaggaatttcagaaaggagaaaatcaaaatcatgagcaagctccagagtgaggcattgagggaggcgatcacccaacttgtcagtgatgccaaggagaaaaaacgcaactttacagagaccatagagctgcagattgggctgaaaaattatgatccacaaaaggataagcgtttcagtgggtctgtgaagttgccacacattcctcgtcctaaaatgaaggtctgcatgcttggtgatgcccagcatgttgaagaggcagagaggataggattggactatatggatgttgaaggactcaagaggatgaacaaaaacaagaagttggtcaagaagcttgcgaagaaataccatgcttttctagcatcagaagcgatcatcaagcagatccctcgacttctgggccctggtctcaacaaagcaggaaagttccctacattggtgtctcatcaggaatccctagaggcaaaagttaatgagacaaaagctatggtgaagttccaactgaagaaggtgctttgcatgggagttgctgttgggaactgtgggatggaagagaagcaaatctttcagaatgtgcaacttagtgtcaacttccttgtatcgttgctgaagaagaactggcaaaacgtgaggtgcctgtacttgaagagcacaatggggaagccgaaccgcatcttctgaggtactcctttctatacgatgtttttgtttaggtggttttcaagcaaaagctcacttgcatttctgtaggaaatactgagctatcattttagattttttttccttcttttttccttttattaaatactgaatatactgcagcctgagcaactactaccaatgttaaattcattggacaccgaacctgtagattgattttcatctgttgcagc

SEQ ID NO: 15456 - DNA, 1084 bp, Lotus japonicus
ttttttctaaggaaaaccaaacccggcctagtacttatatcggttcacagtgtgctcagcttcttcccagctccagccgccaaatctcattagggtttcgccactgctgtgagctcttcttccactgattccaaacgatgagtaagcttcagaatgatgctgtcagagaagctatctctggaatcatgactgattccaaggagaagaatcgcaaatttgtggagaccattgaactccagattggtctcaagaactatgatccccagaaagacaagcgtttcagtggctctgtcaagttgcctcatatccctcgacccaagatgaagatttgcatgcttggtgatgctcaacacgtcgaagaggcggagaagattggattggactggatggatgtcgaagcattgaagaagctgaacaaaaataagaagttggtgaagaagctagctaagaaataccatgcatttttagcttctgaggctgtcattaagcagattcctcgtcttttgggtcctggtctcaacaaggcaggcaagttccctacacttgtcactcaccaagaatcccttgaagcaaaggttaacgagaccaaggctatggtcaaatttcagctaaaaaaggtgctctgcatgggagtcgccgtgggtaatgttagcatggaggaaaaacagatctttcaaaacgtgcaactgagtgttaacttccttgtctctttgttgaaaaagaactggcaaaatgttaggtgcttgtatctgaagagtaccatggggaaatcgtaccgcgtcttttaagggatttattatgctactgtttttggataaaaattttggttttatatttgaatattgggtaatgttaagtttgctacattcagtgctgcttgtgtacgctttctaattgttataattcaaatctgtagtacccgctgcttctagtcgaaaatgccactattccagtgtcgcatgttctggtttttaactgaatactgtttcaatagggttctggtggatgctgttcacttgttcgatggcgattattgtcactttaaaattgtgtacatcatataactctagttttcttgaagact

SEQ ID NO: 15457 - DNA, 939 bp, Solanum tuberosum
cctaaatccagggttttctcttacaggtgagtttgacagagaaggagagctttttgagccatgagtaagcttcagagtgaggctctcagagaagccatcactgtgattaagaatgattcagcagagaagaaaaggaagttcagtgagaccattgagctccagattggactgaagaactatgatccccaaaaggacaagcgtttcagtggatctgttaagttaccacacattcctcgccctaagatgaagatctgtatgcttggagatgctcagcatgttggggaggcagagaagattggtttggagtacatggatgttgaaggcttgaagaagctcaacaagaacaagaaactggtcaagaagcttgcaaagaaataccatgctttcttggcttcagaatctgtcatcaagcagattccccgtttgttggggcctggtctgaacaaggcaggtaagtttcccacccttgtttcccaccaagagtctcttgaatccaaggttaatgagaccaaggccacaatcaagtttcaattgaaaaaggtgctctgcatgggtgttgctgttggaaacatggatatggaggagaagcagatcttccagaatgtgcaaatgagtgtcaactttcttgtttcattgctgaagaagaattggcaaaatgttaggtgcttgtacttgaagagcaccatgggaaaaacacaacgtatcttttaagaagattttctgtttctgttggaaattttcaggctttctggttgtgagctattgacacttgaaaattttgggtagttgtgatttttgttatcttgttttgaatatctataaaacttttaggggtatgtttgctttcaacttttattcgttaatgatgttatcactgatcccagtagcatccaagatgccaattgcagtgcattactttattctgtcgttttgacaacg

SEQ ID NO: 15458 - DNA, 867 bp, Solanum phureja
ctcatcatcggcttacaaaccctaaatcgagggttttctcttacaggtgagtttgacagagaaggagagctttttgagccatgagtaagcttcagagtgaggctctcagagaagccatcactgtgattaagaatgattcagcagagaagaaaaggaagttcagtgagaccattgagctccagattggactgaagaactatgatccccaaaaggacaagcgtttcagtggatccgttaagttaccacacattcctcgccctaagatgaagatctgtatgcttggagatgctcagcatgttggggaggcagagaagattggtttggagtacatggatgttgaaggcttgaagaagctcaacaagaacaagaaactggtcaagaagcttgcaaagaaataccatgctttcttggcttcagaatctgtcatcaagcagattccccgtttgttggggcctggtctgaacaaggcaggtaagtttcccacccttgtttcccaccaagagtctcttgaatccaaggttaatgagaccaaggccacaatcaagtttcaattgaaaaaggtgctctgcatgggtgttgctgttggaaacatggatatggaggagaagcagatcttccagaatgtgcaaatgagtgtcaactttcttgtttcattgctgaagaagaattggcaaaatgttaggtgcttgtacttgaagagcaccatgggaaaaacacaacgtatcttttaagaagattttctgtttctgttggaaattttcaggctttctggttgtgagctattgacactcttgaaaattttgggtagtgatttttgttatcttgttttgaatatctataaaactttttaggggtatgtttgctttc

SEQ ID NO: 15459 - DNA, 1074 bp, Cephalotaxus harringtonia
catgtcgagaaaccctaaaccactaatgctaggcgcgtgaacacattgggtggtttgggggatgtttaagaaataacaaaaaccctagctttggtctcgtttggttctttccccaaccagtcttcagtttgttaggaagatcgaaataaactggaggggaggagaggagttgagttggtgcggcgataacaagcatgagtaagcttcagagtgatgtgttgagggaggcgattacaggggtggtggcagagagcaaggagaagaagaggaagtttgtggagactttagagttgcagataggcctcaagaactatgatccccagaaggacaagcgcttcagcggctccgtcaaactcccccacattcctcgacccaagatgaagctctgcatgctcggcgatgcccagcatattgaagaggcagaaaaaataggtttggactacatggatgtggaaggactaaagaaaatgaacaagaacaagaagctggttaagaagcttgcaaagaaataccatgcttttcttgcctcagaagcaattattaagcagattcctcgacttcttggtcctggtctaaacaaggctggtaaatttcctactttggtgtcccaccaagagtcattggagggaaaagtaaacgaaacaaaagccacaatcaagttccaattgaagaaagtcctgtgtatgggtgttgctgtgggtaactgtggcatggaggaaaagcaaatattccagaatgttcagttgagtgtcaactttctggtgtccttgcttaagaagaactggcaaaacgtacgttgcctctatctgaagagcaccatgggcaagccatctcggatattctaattgtccaatttattgtgagcttttgctcaatgaattttagaatgtgttttctgttttttggtttagagtagggggttcaaacaatttactttaatactatgcatttaattttgatataatgttttgcagaggcgttttattgcaaataggcagggtgtgatgcatgatgtaattgagggaaatcctatttttatcttacaattacaataatgctggaagttgttgcttt

SEQ ID NO: 15460 - DNA, 1002 bp, Euonymus alatus
gggttttgggttgttagatactatcaacacacgttgatatatagggtttatataattcgtcgggtacgcatccgctagctagggtttctttcaccttctgtagaactatcggcgaacgggcttgttggaagggcaaacatgagtaagcttcagagtgatgccctgagagaagctatctcaaccattgtcaaagattgcacagagaagaagcgaaactttgtgcagactattgaactccagatcgggttgaagaattatgatccccaaaaagataagcgtttcagtggttctgtgaagctgccacatattcctcgtccgaaaatgaaagtatgcatgcttggagatgctcagcatgtagaacaggcagagaaaattggtttggattatatggacgtggaagcattgaagaagctaaacaagaacaaaaaacttgttaagaagcttgccaagaagtaccatgcctttttggcttcagaatctgtcatcaaacagatccctcgtcttttgggtcctggtcttaacaaggcaggaaagttccctacacttgttagtcatcaggagtcccttgagtctaaagtcaacgagaccaaggcaacagtgaagttccagttgaagaaggttctctgcatgggagttgcagtgggaaatgtctctatggaggagaagcagatatttcagaatgttcaaatgagtgtcaacttccttgtttccttgttgaagaagaactggcagaatgtgaagtgcttgtacctgaagagcaccatgggcagtcccaaccgtatcttctgagttaaatttttatctgtggaagttgtgcaaggagaactattgtgacaaaaaaaagtattttatcagaatgctcatgttttccttttgtttggttacttactttgtttccttggtgagtagtattaaaatgtgaagacttgcactagattttgttggagaaatttaatcttttgcattaaaatttgaacctcaattggaactttgttattttcg

SEQ ID NO: 15461 - DNA, 963 bp, Pteridium aquilinum
tccatagctgggtgagttctttctctcactcacagcagcgcatccgcagggaggcggcgagcaaccaagcaagcaagcatgagtaagcttcagagcgatgtgctgagggaagcgatcacacagattttggcggattccaaggagaagaacaggaagttcgtagagactgttgagcttcagattgggctcaagaactatgatcctcaaaaggacaagaggttcagcgggtcagtgaagcttgctcacatccctcggcccaagatgaaagtgtgtatgcttggagatgctcagcatgtggaggaggccgaaaagattggcttggactgcatggatgttgatgcattgaagaaaatgaacaagaacaagaagcttgtaaagaagctggcgaagaagtatcatgctttcttggcctctgaggcagtcattaagcagattcctcgtctccttggccctggtttgaacaaagccggaaagtttcctactcttgtccagcaccaagagtcacttgagggtaaggtgaatgagacaaaagcgacggttaagtttcagctcaagaaggtgctctgtatgggtgttgctgttgggaatttggaaatggaagagaagcagttgttccagaatgtccagcttagcgtgaactttctggtttctcttttgaagaagaattggcaaaatgtaagagttttgtacttgaagactaccatgggaaagccagtgcgaatcttttaagctgatgtggaagcggaacttcagactagatgttttaatggagagcccacaagctgcaagttgctctaacgtgtatgccttttgtggggctaatggctgcctcacactgtttgcacatttaaagaccatgacaagagtttctatgaattcaattttggctcgagtcttacttttctgatttgataatgtagttttggcatggttttcatgcgaagtaaattaccaaggaatttc

SEQ ID NO: 15462 - DNA, 1079 bp, Citrullus lanatus
gcccttcttgctggatcgcctctcttcggtcttccattatatatctattctcagtttagccgtcgaaaaaccctagcctcgtttcttctcaccagtctgtagctgctccttaggaaagacgaagctccgaaaatgagcaaacttcagagcgatgctttgagagaagccatttcatctatcttcgctgatagcagtgaaaagaagcgcaactttactgagaccattgagcttcagattggactgaagaactatgatccacaaaaggacaagcgtttcagtggatcagtgaagttgccccatatccctcgccctaagatgaagatttgcatgcttggagatgcctctcacgttgaagaggcagagaaaattggtttggattatatggatgttgaaggtctgaagaagctaaacaaaaacaagaagttggtgaagaaacttgccaagaagtatcatgcctttttagcatccgaagctattattaagcaaattccccgtcttctgggccctgggctcaacaaggcagggaagttccctaccctggtcactcaccaagaatctctcgaatctaaagtaaatgagactaaggcaatggttaagttccaattgaagaaggttctttgtatgggtgtggccgtaggcaatgtggccatggaagagaaacaagttttccagaacgttcaaatgagtgtcaatttccttgtttccttgttgaaaaagaattggcaaaacgtgaggtgcttgtacctgaagagtacaatggggaaggcatatcgagtcttctgaggaattttcataacttagatagtactgtttgttcttaaattgaagaaccaagttgagatgaaattctatatttatgattgatgaaaaattttcctgcttgtttttttgtttagtaaaaaccattagctgcacaatcgttaacacttgtgatgggagtaatgtgttttttttgttcactttcttgtttcactttacatgttttatagatttatttcggttttaatttattgttctgatattgcttaatttcaactagagatattaaatcagttagcgcaagctcttccagcttgagg

SEQ ID NO: 15463 - DNA, 905 bp, Fagopyrum esculentum
gggttcgactcatcatctagggttgtctcagggtgacattcgtttatcttggacaaaaccgagtagtcgccatgagtaagctttcaaatgaagctttaagagaggcagttggcagcattaagaaggatgccactgaaaagcaaaagaagtttacggaaaccattgaacttcagattggtttgaagaattacgacccacaaaaagataagcgtttcagtgggtctgtcaagcttccccatatccctcgtcctaagatgaaggtctgcatgcttggagatgcccagcacgttgaagagtctgagaaaatgggcttggactccatggacgttgaagctcttaagaagttgaacaaaaacaagaagcttgttaagaagcttgccaagaaatatcatgcctttttagcttctgaagctgtcatcaagcagatcccacgtttgcttgggcctggtcttaacaaggcaggaaagttcccgactctagtttcacatcaggaatctttggagtcgaaagtgaatgaaatcaaagcaacagtgaagttccagctgaagaaggttctttgcatgggtgttgctgtcggaaactgtggcatggaggagaaacaaatcttccagaatgtgcagatgagtgtcaatttccttgtttcattgttgaagaagaattggcaaaacgtccgctgcttgtacctgaagagcacaatgggaaagccataccgtatcttttaagctatatccagttttgatttggttttgcagtgaggattggcaattttctgttggttggtctatttgtacttcaattgagcctggacttctgaaatattgggttttctttggactctcgagtagttgatacatttctcaatttatcatagcctttgatctatagagtattgattcttccatctc

SEQ ID NO: 15464 - DNA, 919 bp, Trigonella foenum-graecum
atcatttcgtgcgcctccaatcttcttcctcttcctcgcaccaaggtattagatccaattcctgcaagactctgattcaagatgagtaagcttcagagtgatgctgtgagagaagcaattacaggaatcatggctgattccaaggagaaaaaccgtaaatttgttgagacgattgaactccagattgggcttaagaactacgacccccaaaaggataagcggttttctgggtctgtcaaattgccccacattcctcgacccaagatgaagatttgcatgcttggagatgcccagcatgttgaggaggctgagaaaataggactggaatcaatggatgttgaagctttgaagaagctcaacaaaaacaaaaaattggttaagaagttggcgaagaagtaccatgcctttttagcatctgaagctgttatcaagcagattcctcgtcttttgggtcctggtcttaacaaggcaggaaagttccctacgcttgtttcccaccaagaatctcttgaagctaaggttaatgagactaaggctatggtcaaattccagcttaagaaagtgctgtgcatgggagtagctgttggcaatgtgagtatggatgagaaacaaatcttccagaatgtgcaactgagtgttaacttcctcgtgtctctgctgaagaaaaactggcagaacgtgaggtgcttgtaccttaagagctcgatgggaaaatcttaccgcgtcttttaaatggctgtttttaaattcagtgtatttgaaattgcgcttactattttgattactgtaagagctgagacaggaggtttactttttcttcagttttgtttgatgagattttgttgtcagtatttcttgttcttgattggtgttaaattgcttagcaacattaatgtcaagggtgctaattttattccct

SEQ ID NO: 15465 - DNA, 1200 bp, Cajanus cajan
attccacgggtccacgctatatacttgttcctcccgccgcgcgaaaccctagctagggtttggcctgcggtactttctctgctctcacaagactttcctattagattttctaccatttttcttctgcttccttcgccgagtccaattctcactttctctttctctgcatttttgttcgcagcttttagatctatatccacctagcccttcatttggaaaaccccaagtttcaaacatgagtaagcttcagagtgatgctcttagggaggcaatctcaggaatcatggctgattccaaggagaagaaccgtaaatttgtggagaccattgagctccaaattggactgaaaaactatgatccccaaaaggacaagcgttttagtggctctgtcaagttgccccacatccctcgccccaagatgaagatatgcatgcttggtgatgcccaacacgttgaggaggccgagaagataggattggattacatggatgtagaggcattgaagaagcttaacaaaaataagaaattggtgaagaagctagccaaaaaatatcacgcttttttggcttctgaagcagtcatcaagcaaattcctcgtctcttgggacctggtctcaacaaggcagggaagttcccaacacttgtgactcaccaagaaactctcgagtcaaaggttaatgagagtaaggctatgatcaaattccagcttaagaaggtgctctgcatgggagtagctgtggggaatgttagcatggaggaaaaacaaatcttccaaaatgtacaactgagtgttaacttccttgtctcattgttgaaaaagaactggcagaatgtaaggtgcttgtatctgaagagttccatggggaaatcgtaccgtgtcttttgagtggctgttctttaattcagtgaatttctgatcgcacttagtttgcttatttatcttgataggtggacataatttttcatcgttctacaattttgttggatgagtatttttggttaatatttcttgttattgatatgctatgtttcaagtgctttgcaatgtcggataattttaggggtactaaatttaagctacccgtgtttttactatacaactcattgcgctgactatcatgactacatcgtgtttgagtgtattctataattttaggatttcgggtttatttaatatatcttttttttatttataagaaa

SEQ ID NO: 15466 - DNA, 885 bp, Brassica napus
ctgcttcacctctcaggttcagagattcgttcaaccgagagaaactcaagatgagtaagcttcagagtgaggctcttagagaggccatcacaaccatcaagggcaaatctgaggacaagaagcgtaactttgtggagacgattgagcttcagattggtctgaagaactacgacccgcaaaaggacaagcgtttcagtggatctgtcaagctcccacacattcctcgccctaagatgaaggtctgcatgcttggagatgctcagcacgttgaggaggctgagaagatggggctagactctatggatgttgaggctttaaagaagcttaacaagaacaagaagcttgttaagaagcttgcgaagaagtaccatgctttcttggcttctgagtcagtcatcaagcagattccccgtcttcttggtcctggtcttaacaaagctggaaagttcccaacgctagtgagtcaccaggagtcgttggaagggaaggtgaatgagaccaaagcgactgtgaagtttcagttgaagaaggttctgtgtatgggtgttgccgttggtaacctttccatggaggagaagcagctcttccagaatgttcagatgagcatcaacttccttgtctccctcttgaagaagaattggcaaaacgtgaggtgtttgtacttgaagagcaccatgggcccaccacaaaggatcttttgagttctatactctttcatcttcaaacttttgcgttgtggtttttgtttgtttcagagaacttaagttatggttttgtttggtattagcagaactgaagtgttagtttgctttttgtcaagacattataatatgcactgtttgattctacaatgtcgactctccagttcaattttatctttatcaa

SEQ ID NO: 15467 - DNA, 1034 bp, Eucalyptus grandis
atgcttcctgcatcagccgtcgaagaaacctgaccggcgccatcaatcttctctcgggagagcgactcgttcgtgttcggtcccgtagagtttcctcaacatgagtaagcttcagagtgacgctcttagagaagctatctcggggatctttagtgattgcaatgagaagaaaaggaagttcaccgagaccattgaactccagattgggttgaagaattatgatccccagaaagataagcgtttcagtggttccgttaagttgccgcacattcctcgtccaaagatgaaggtctgcatgctgggtgatgcacagcatgtggaagaggcagagaagataggcctggcttatatggatgtggaagcgttgaagaagctcaacaagaataagaaactggtcaagaaactggcaaagaagtaccatgcctttttggcttcagaagctgtaattaagcagatcccccgtcttctaggccctggtctaaacaaggcagggaagttcccaaccctggttactcatcaggaatctctggaatctaaagtcaacgagacaaaggccatggtgaagttccaactgaagaaggtcctttgcatgggtgttgccattggcaacctcagtatggaagaaaaacaggttttccaaaatgttcagctcagcgtgaatttccttgtttccttgctgaagaaaaactggcaaaatgtcaagtgtctgcacttgaaaagcactatgggaaagccatatcgcgttttctaagccatttcgctcgatcatctgaagagttttgtaggcagagaattagtcagtttttggtggctgatgtggatggttctcttttggttggtttttttccctcaaagaatatgttattcaataccatctgtcttattgtgaaatttcgcttttgaagatattgaattcttcttgacttcacagtttcgtaaacgataaatctatgtcggaatgctctttatggattgaatgcttattctgtcatgctgctctcgaagagagctaaagaggagcgaaatgcataact

SEQ ID NO: 15468 - DNA, 1054 bp, Pseudotsuga menziesii
tgagtaagcttcagagtgatgtgttgagggagggaataagtcagattatgggagaaagcaacgacaagaagcgaaaatttactgagacgatagagttacagatcgggttgaagaactatgatccccaaaaggataagcgtttcagtggttccgtaaaattgccccacattccccgccccaagatgaaggtctgcatgctcggagatgcccaacacgttgaagaggctgaaaagatcagtctggactacatggatgtcgagggtctgaagaaaatgaacaagaataagaaacttgttaagaagcttgcaaagaagtaccatgcatttcttgcttcagaggcaatcataaagcaaattccaagactccttgggcctggtcttaacaaggctggtaaatttcccactcttgtttcacaccaagagtccttggagtccaaggtaaacgaaacaaaggcaacggtcaagtttcaattgaaaaaagttctatgtatgggcgttgctgtggggaactgtggaatggaggagaaacaagtgtttcagaacgttcaattgagtgtgaacttcctggtatccttgctgaagaaaaactggcaaaatgtccgatgcttgtatctgaagagtaccatgggcaagccagcacgcgtattttgaatgtgcaatattggcaccaccttgtgttggctgcatatggagaggacttttccttggtttttgttttacgttggttagaacaatacagttttgtttgtgtggagggctatattagcgaagtggctctaatctcgtgcatattattggagtaaaagggaaatttaattattatttcactattctgttattgtaacttggcatgttttatcagtcatgccgcgggaagttatgtttatctcttcctggattcaagtaatcagaattgagtagatactgaacccagcttatcattgttcttaatttgacagtcatatttattattgtgcattcagtaaagtacttaaaaaatggtagatgtattccccagtgtgatttatgaaattgacataacaggcatactgcga

SEQ ID NO: 15469 - DNA, 1236 bp, Orobanche aegyptiaca
aaatataattagaaaatgtaaattatcaaatgaatgagtaatatgcaaagattcccaccatcttaataataacgagaaaagcatatacaataatccaaaccctattataactaagcccaataaagaacccaattactattaaagtgggctcgttaaagcccaaatcgagagcccgaccgtcgacctgttctagggtttgggataccaatatttagccgttttcacttcactcacattcacaaaccctagtcgcggttttcctatcagaagtgaattcaggaagataagaagacttgaaccatgagtaagcttcagaatgaagccttgagggaagccattactcagattgtcgctgactgtaaggagaagaagaggaatttcattgaaactattgagcttcagattggattgaagaactatgacccacagaaggataagcgtttcagtgggtctgttaagttgccccacatcccaaggccaaaaatgaagatctgcatgcttggtgatgctcagcatgttgaagaggcagaaaagattggccttgagtctatggatgtggaggccctgaagaagttaaacaaaaacaagaagttagtgaaaaagcttgcaaagaagtatcatgctttcttagcctcggaggcagttatcaagcagattccccgtcttttgggaccgggccttaacaaggcaggtaagttccccactcttgtgactcaccaggagtcacttgagtcgaaggtgaacgagaccaaggctactgttaagttccaactgaaaaaggtgctttgcatgggggttgctgttgggaaccttgacatggaggagaagcaaatctttcaaaatgtccaaatgagcataaacttccttgtttctcttcttaagaaaaattggcagaatgtgaagtgcctgtatttgaagagtactatggggaagccccagcggatcttctaagctgttgatttgattttggtttgacgagtagttgtacgtgcaaaaatatgactggatatttctcagaaatgggaagttttttgaatttctattgttgtgatagtgctgagttcgactttggatatttattatctttatttgatctatatttttgcgtacaagtttctgttctggccggtacctggttattgataattgccgtgttcttgttcagctgtgtgtcggtttatttgacagtaactctataatatgcttctgaatttgttaaaatctgagaagttgatt

SEQ ID NO: 15470 - DNA, 935 bp, Petunia hybrida
ttcacgccgctctcaaccctaatcagggtttctctcacacagaagtgaaatattgaagcatttgagccatgagtaagcttcagagtgatgccctcagagaagccatctctgtaattaagaaagcttcagaggataagaagagaaaattcacggaaactattgagctccagattgggcttaagaactatgatcctcaaaaagacaagcgtttcagtgggtctgttaagcttccccacattccacgccctaagatgaagatttgcatgctgggagatgctcagcatgtggaggaggcagaaaagattggcctggaatacatggatgtggaaggcctcaagaagcttaacaagaacaagaagttggtcaagaagcttgcgaagaagtaccatgctttcttggcttcagaagctgtcatcaagcagattccccgtctcttgggtcctggtctgaacaaggcagggaagtttcccacccttgttacccaccaggagtcccttgagtctaaggttaatgagaccaaggctactgtaaagtttcagttgaagaaggttctctgcatgggtgttgctgttggaaatcttgatatggatgagaaacaaatcttccaaaatgtgcaaatgagtgtgaatttcctggtgtcattgctaaagaagaattggcaaaacgtaaggtgcttgtacttgaagagcacaatgggaaagacacagcgtgtgttctaagatgattgtcttgattttggaacttttcgagcattctgctttgtaagagatatcgttaaaattttggatagatgtcatcctggataatggaatgtttaatcatgatagggattgtttgccacaggcattttgttttgaagagatagtgctgatcttgttctcttatatatttatcaatggtgatttctatggcatgataaacaagaaaaaaaaaaa

SEQ ID NO: 15471 - DNA, 978 bp, Actinidia deliciosa
tcctcatacccccagtaggttccctccctcgcatcgatttgctgctaatctctttctttggttgtgtaaacaggtgatctacagatcatttgttgaaagcgaaactcattaaccatgagtaagctccaaagcgacgctgtcagggaagccatctcccagattgctggagatgccaaggaaaaaaagcggaagtttgtggagaccattgagcttcaaattggtttaaagaactatgatccccagaaggataagcgtttcagtggttctgtgaaactgccacacatcccccgtcctaagatgaaggtttgcatgcttggtgatgctcagcatgtagaagaggcagagaagataggaatggattatatggatgtggaagggctgaagaagcttaacaagaacaagaaattagtcaagaagctagcgaaaaagtaccatgcatttctagcatctgaagctgtcatcaagcagatccctcgcctcttgggccctggcctgaacaaggcaggaaagtttccaactctagtgactcatcaagagtcccttgagtcaaaagttaatgaaacaaaagcaacagtgaagtttcaacttaagaaggttctttgcatgggtgttgctgtgggcaattgtggtatggaggataagcagatcttccagaatgttcaaatgagtgtaaactttcttgtttcattgctgaagaagaattggcaaaatgtccggtgcttgtcccttaggagtactatgggaaggccggcccgcatcttttaagaagatatatatacttgttgggaactccgcagggtgagaccaagcccggacaagacttcattacatttttggagttcatcagatcccctttttgtttgttttctgagattattagctttcttgtctgaactagtgaatgctgcgactaaagaattcttatggtggttgagaattataagattcgttgttttttgtttctttaaaaaaaaaaaa

SEQ ID NO: 15472 - DNA, 836 bp, Taxus baccata
aaggaaagcaagagaagagggggtgcggcggacgcctgtatcaaaccatgagtaagctccagagcgacgtgttgagggaggcgattacgggggtagtgacagagagtaaggagaagccaaagaagttcgtggagacgatagagttgcagataggccttaaaaattatgacccccaaaaggataagcgtttcagcggctccgtcaagcttccccacatccctcgtcccaagatgaagctctgtatgctcggagacgcacaacatgttgaagaggctgtgaaaataggcttggactacatggatgtggaaggattaaagaaaatgaacaagaacaaaaaacttgttaagaagctggcaaagaaataccatgcttttctagcatcagaagcaattattaagcagattcctcgactccttggtcctggtctaaacaaggctggtaagtttccgactttggtgtctcaccaagagtcattggaggcaaaaatgaacgaaacaaaagccacaataaaatttcaattgaaaaaagttctctgtatgggtgttgctgtgggtaactgtggaatggaggacaaacaaatattccaaaatgtccagttgagtgtcaactttctggtgtccctgcttaagaagaactggcaaaatgtacgttgtctctacctgaagagcaccatgggcaagccgactcgaatattctaattgtgcattttattgatagcttctgctcaaggagcattggaaaatgtttgtttgttaaacgatttgtttgttgatttgatatagttttatgcagaggcatatgttagctgataggcagggtctgatgcatgttgtaac

SEQ ID NO: 15473 - DNA, 907 bp, Solanum melongena
atcatcggcgcttacaaaccctaaatcaagggttttatcttacaggtgagtttgaaggagaacgagagatttttcagccatgagtaagcttcagagtgacgccctcagagaagctatctctgttattaagaatgaatcagcagagaagaaaaggaagttcagcgagaccattgagctccagattggactgaagaactatgatccccaaaaggacaagcgtttcagtggatctgtgaagttaccacacattcctcgccctaagatgaagatctgtatgcttggagatgctcagcatgttggggaggcagaaaagatcggtttggagtacatggatgttgaagggttgaagaagcttaacaagaacaagaagctggtcaagaagcttgcaaagaaataccatgctttcttggcttcagaatctgtcatcaagcagattccccgtttgttggggcctggtctgaacaaggcaggtaagtttcccaccctcgtttcgcaccaggagtcgcttgaatccaaggttaatgaaaccaaggccacaatcaagtttcaattgaaaaaggtgctctgcatgggtgttgctgttggaaacatggatatggaggagaagcagatcttccagaatgtgcaaatgagtgtcaattttcttgtttcattgctgaagaagaattggcaaaatgttaggtgcttgtacttgaagagcaccatgggaaagccacaacgtatcttttaagaagatttctgtttctgtcgttggaaattttcaggctttctggttgtgtgagctatagacactcttgaaaattttgggtagttgttattcttgtttcttgttttgaatttctatataaactatttttagagttatgtttgccttagacgtctcttcgttaatgagaatgatgttatc

SEQ ID NO: 15474 - DNA, 943 bp, Solanum tuberosum
gctcttacggcgctcacaaaccctaattagggttttctcatacagaagtgaagttttgaaggagaaaggagaagtatttgagccatgagtaagcttcagagtgaggcccttagagaagccatctctataattaagaatgattcggctgagaaaaagaggaagttctccgagactattgagctccagattgggcttaagaactatgatccccaaaaggacaagcgtttcagtggatctgtgaggttgcctcacattccacgccctaagatgaagatttgcatgctcggagatgctcaacacgtgggggaggcagagaagatcggtttggagtacatggatgttgagagcctcaagaagcttaacaagaacaagaagttggttaagaagcttgcaaagaaataccatgctttcttggcttcagaatctgtcatcaagcagattcctcgtctcttgggtcctggtctgaacaaggcaggtaagtttccaacccttgtctcccaccaagagtcactcgagtctaaagttaatgagaccaaggctaccatcaagttccagttgaagaaggtgctttgcatgggtgttgccgtcggtaattgtgatatggaggagaaacaaatcttccagaatgtgcaaatgagcgtgaacttcttagtgtctcttctaaagaagaattggcagaacgtacggtgcttgtacttgaagagcaccatggggaagactcaacgtgtcttttaggaaggacaagtctgttattggagcttttcgtgcattcttcttgtaagagagatagatacactaatgaaaattttggatagtagtcatccgtgattatgttttgaatgttacatcactacaaggatcgatcatattgctgagacattttcttcttttcaagagctctgttctttgttctctttgtttattgatgatgatttcatttgaa

SEQ ID NO: 15475 - DNA, 990 bp, Solanum phureja
atatatcactatactaagccacccttcgtcactcttacggcgctcacaaaccctaattagggttttctcatacagaagtgaagttttgaaggagaaaggagaagtatttgagccatgagtaagcttcagagtgaggcccttagagaagccatctctataattaagaatgattcggctgagaaaaagaggaagttctccgagactattgagctccagattgggcttaagaactatgatccccaaaaggacaagcgtttcagtggatctgtgaggttgcctcacattccacgccctaagatgaaaatttgcatgctcggagatgctcaacacgtgggggaggcagagaagatcggtttggagtacatggatgttgagagcctcaagaagcttaacaagaacaagaagttggttaagaagcttgcaaagaaataccatgctttcttggcttcagaatctgtcatcaagcagattcctcgtctcttgggtcctggtctgaacaaggcaggtaagtttccaacccttgtctcccaccaagagtcactcgagtctaaagttaatgagaccaaggctaccatcaagttccagttgaagaaggtgctttgcatgggtgttgccgtcggtaattgtgatatggaggagaaacaaatcttccagaatgtgcaaatgagcgtgaacttcttagtgtctcttctaaagaagaattggcagaacgtacggtgcttgtacttgaagagcaccatggggaagactcaacgtgtcttttaggaaggacaagtctgttattggagcttttcgtgcattcttcttgtaagagagatagatacactaatgaaaattttggatagtagtcatccgtgattatgttttgaatgttacatcactacaaggatcgatcatattgctgagacattttcttcttttcaagatctctgttctttgttctctttgtttattgatgatgatttcatttgaatgatatgcagtatttct

SEQ ID NO: 15476 - DNA, 2137 bp, Brassica rapa
atgaggcgtattggatttcacaacttaaatcaacaaagaacaaggagggtacttacttcttcttcttcttcttcttcttcaactgttcttcctcatcttgcaccatcatgtcaagaaaccattctctcaccccaagatccaaaacccaaaacagatcttccaagcagtttcagcttcttgcgagaaacaaagccatgcatttcttgcccgaggaatcaagttacagattcagtgaacagagttaagctccgagatgggagattccttgcttataaagagagaggtgttccaaagaacgaagctaaatacaagatcattcttattcatgggtttggaagctccaaagagatgaacttctctgcttcaaaagagttgatagaagagctaggcgtatattttctactctacgaccgagctggatatggagattctgatccaaacccggaacgttcgttgcaaagcgaagcacttgacatagaagaacttgctcataatttgcagataggacccaagttttacttaattggagtttccatgggatcatatcccacgtggagttgtcttaaacacatacctcacaggctagctggagtggcgtttgtagctccagtggtaaactatggatggcggtcgctttctaagaagcttataaagaaagactacaggagggggattataaaatggtgttttcgactatcaaaatatgcacctgggcttttacattggtggatcagtcagaaactcttcccatcaactacttcagtccttgaaagcaatcaactctatttcaacaccagtgatattgaagtactcaagagaactaccggttttcctatgcttactaaggataaactacgggaaaggagtgtatttgatactctaaaagacgatttcttggcgggcttcgggcaatgggactttgatccatctgatgtaagaatgagtggagagaactctgttcatatatggcatggaaaggaagacaaggtggttccgtttcaacttcatagatgcatcttgaagaagctgccttggatcaagtatcatgagatacctcatggaggacatttgatcgtacactatgatgtagtaagacccattgctctggcacgtaccttccgcatacttcaatgggtgctgaaactatgcaaagcactttatattgatcatgaagaggatcatgtccgatatatatgccgcctcaaacgcagagtaagggtttcctctgcttcacctctcaggttcagagattcgttcaaccgagagaaactcaagatgagtaagcttcagagtgaggctcttagagaggccatcacaaccatcaagggcaaatctgaggacaagaagcgtaactttgtggagacgattgagcttcagattggtctgaagaactacgacccgcaaaaggacaagcgtttcagtggatctgtcaagctcccacacattcctcgccctaagatgaaggtctgcatgcttggagatgctcagcacgttgaggaggctgagaagatggggctagactctatggatgttgaggctttgaagaagcttaacaagaacaagaagcttgttaagaagcttgcgaagaagtaccatgctttcttggcttctgagtcagtcatcaagcagattccccgtcttcttggtcctggtcttaacaaagctggaaagttcccaacgctagtgagtcaccaagagtcgttggaagggaaggtgaatgagaccaaagcgactgtgaagttccagttgaagaaggttctgtgtatgggtgttgctgttggtaacctttccatggaggagaagcagctcttccagaatgttcagatgagcatcaacttccttgtctccctcttgaagaagaattggcaaaacgtgaggtgtttgtacttgaagagcaccatgggcccaccacaaaggatcttttgagttctatactctttcatcttcaaacttttgcgttgtggtttttgtttgtttcagagaacttaagttatggttttgtttggtattagcagaactgaagtgttagtttgctttttgtcaagacattataatatgcactgtttgattctacaatgtcgactctccagttcaattttatctttatcaattatcgaaaacatcatttgagatttcc

SEQ ID NO: 15477 - DNA, 1037 bp, Eschscholzia californica
tacattgtcgtctaccctagtttatctctctacgaataaaaagctcggaaaccctagtgtagggttttccatctccgctctctcgttaggttagaactttttagaggacctcagtaaaaggttccaaaatgagtaagcttcaaagtgaagttttgagagaagcaatcacccagatctctggagatgctaaggagaaagcccgtaagttcactgagacagtggaactacagattggtctgaagaactacgaccctcaaaaagataagcgtttcagtggttccgtaaagttgccacatatccctaggcctaagatgaaagtttgcatgcttggggatgctcaacatgtggaagaggctgagaagataggtttggactacatggatgtagaagggctaaagaagcttaacaagaacaagaaattggtcaaaaagcttgctaagaggtttcatgcttttctagcatcagaagctgtcattaagcagattcctcgtctactcggacctggtctcaacaaggcaggaaagttccctacccttgtgtctcatcaagaatcactggaagccaaagttaacgaaaccaaggctatggttaagtttcaactaaagaaggttttgtgcatgggtgttgctgtgggtaaccttggaatggaagagaagcaaatcttccaaaatgttcaactcagtgtcaacttccttgtttcattgttgaagaagaactggcaaaatgttcgctgcttgtacttgaagagtaccatgggaaagcccgtccgcattttctaggtattttgttattaagttgaagagatctaggtgttagacaattgtagacgtctcctcctcagaattggttaacctttttgtttcgcgctcaaatttcatttctgttttcttctggaccttgagtagcaactgaaactttgaaacattagtcttttttaatgtttaaatcgaagatatttttggaatttcatgcaaaaaaaaaagtaacgtgggtagggacgaacggacgacacaagggagtaggagcccccccccccc

SEQ ID NO: 15478 - DNA, 935 bp, Tabernaemontana elegans
gtctttctgaactccatagagtcggtggacctattcacttgtggaaggcaaagactaatcttttaccatgagtaagctacagagtgatgcagtgagagaagcgatctcccagattgttagcgattctaaaggggagaaaaaacgtaagttcactgagactattgagcttcagattgggctgaaaaactatgacccccaaaaggataagagatttagtggctcagtcaaacttcctcatatcccgcgccccaagatgaagatttgcatgcttggtgatgctcagcatgtggaagaggcagagaagatcggtcttgagtacatggatgttgagggcctgaagaaactcaacaaaaacaagaagttggtgaaaaagcttgccaagaagtatcatgctttcctggcatctgaagcagttataaagcagatcccgcgtcttttgggccccggtcttaataaggcaggcaaatttcctacacttgtcactcaccaagaatccttggagtcaaaagtaaatgaaaccaaagctacagtcaagtttcaactcaagaaggttctatgtatgggtgttgctgtgggcaatttggacatggaggagaagcaaattttccaaaatgttcaaatgagtgtcaactttcttgtttcgctattaaaaaagaattggcaaaatgtgaggtgcttatatctgaagagtaccatgggcaggccacaacgcatcttctgagcagttgttttatttactttgttttgagaccatcagtttagtgcgagttaaagtgtgggcagttgcatacactttttggtgaatgtttccgatatttttgctcaactattttaacggattcttcaatcttgaaccaagaaatgaaattttagttccagtctagacaatattcacttgtaacagtttctcctgagctgtgatatctttgcatctg

SEQ ID NO: 15479 - DNA, 816 bp, Bupleurum chinense
aagcgcagtcgccagccgcaaattagggtttcgtttcaaggtctatagacgaaaccagatttcagccatgagtaagttgcagagtgaagccttgagggaagctatctctcagattacgaaagaagccgttgagaaaaagaggaactttaccgagactattgaactccagattggtctgaagaactatgatccacaaaaggataagcgtttcagtgggtctgtgaagttgcctcacattcctcgtcctaagatgaaggtttgcatgcttggtgatgctcagcatgtgggagaggcagagaaaattggtttagaatacatggatgttgaagggttgaagaagctgaacaagaacaagaaacttgttaagaaacttgcaaagaagtaccatgcttttctagcttctgaagctgtcatcaagcagatccctcgtcttttgggaccagggctcaacaaagcaggcaagtttcctacacttgtttcacatcaggagtcccttgaggctaaagtgaatgagaccaaggctacagtcaaatttcagttgaagaaggtactttgcatgggggttgctgttgggaactgcagtatggaggagaagcagatcttccagaatgtccagatgagtgtgaatttcctagtttcgctgttgaagaagaactggcaaaatgtcagatgtttgtacctgaagagtacaatgggaaagactgtccgcattttttaaaacagttttatattttcggttgaaggtagttggtgtatgaatgagatgtgttttttcccaaatactgttgtggggcatgttctcataagatagctgat

SEQ ID NO: 15480 - DNA, 864 bp, Catharanthus roseus
caggagtgaagaatttcagggacattaaatcatgagtaagcttcagagtgatgccctcagagaagccatttctcagattaagaatgacgctgatgctaaaaaacggaactttacggagacagttgagcttcagattggactgaaaaattatgatccccagaaggacaaacgtttcagtggctctgtgaggttaccacacattcctcgtccaaagatgaaagtttgcatgcttggagatgctcagcacgttgaggaggccgaaaagattggtctggagtacatggatgtggaaggcctgaagaagctgaacaaaaacaagaaattggtcaagaagcttgctaagaaatatcatgctttcttggcttcagaagctgtgataaagcagataccgcgtctcttagggcctggtcttaacaaggctggcaaatttcctacccttgttacacaccaggaatcccttgaatctaaagttaacgaaaccaaggcaacagtaaagtttcagttgaagaaggtgctttgcatgggagttgcagtggggaattgtgctatggaggaaaagcaaatctttcaaaatgtgcagatgagtgtgaatttccttgtttccttgttgaagaagaattggcaaaatgtgaggtgcttgtacctcaagagtacaatgggcaaaccacagcggatcttttgaagagagagtttcttctttactgctgctgtttttttatgtatgagataagcatatctagtaatatattgtttttagtatgatggcaatttaattacgctgtttggtgattgttttagcttgaaaagtgatcaagatcaacaactcttgtttggtaccaagttttgtttgttactgtgatatta

SEQ ID NO: 15481 - DNA, 894 bp, Gossypium hirsutum
ttttcctcctcagctgcgttagggtttctctcttcaggtaaattcttggtagtttcgttcgttttaagaacagagattcgaagatgagtaagcttcagagtgatgcccttagagaagctatttcaaccattgtggctaattccaaggagaaaaatcgcaagttcaccgagaccattgaactccagattgggctgaaaaactatgatccccaaaaagacaagcgtttcagtggttccgtgaagctaccacacattcctcgtcccaagatgaagatttgcatgcttggagatgctcaacatgttgaagaggctgagaagattggtttggattatatggatgtagaagcattgaagaagctaaacaagaacaagaagttggtcaagaagcttgctaagaaatatcatgcatttttggcctctgaatctgtcatcaaacagatcccccgtctcttgggtcctggtctcaacaaagcagggaaattcccaacccttgttactcaccaggaatctttggagtccaaagtgaatgagacaaaggcaatggtgaagttccaattgaagaaagttctttgcatgggagtcgccgttgggaatgtagcaatggaggagaagcagatcttccaaaacgtgcaaatgagcgtcaatttccttgtttcattgttgaagaaaaactggcaaaatgtgaggtgcctttacttgaagagtaccatgggaccttcaaacaggatcttttgaattatgcatggagtgaaatcatttttttaattgagaatgtttcaaaaattatgttatttgatgttggaaatcatgaatttttgagacattgaaaagtttttgttttgcatttgcttcgtgcgcgaattcttctggatcgcaataagtgtcgagcctgcag

SEQ ID NO: 15482 - DNA, 878 bp, Platanus occidentalis
ggagttcatcgttttctccctccaaaatccctgtcgagatctttggtttaggttctcaatttttgcattagaaaatgagtaagcttcagagtgatgttctgagggaggccatcggccaggtcatgggtgctgccaaagaaaagaaccgcaagtttactgagactctcgagcttcaaatcggtctgaagaactatgacccacaaaaagacaagcgtttcagtggttctgtgaaattgcctcatatccctcgccccaagatgaaggtctgcatgcttggggatgcacagcatgtcgaggaggctgagaggattggattggagtccatggatgttgaagccttgaagaaaatgaacaagaacaagaagctggtgaagaagcttgctaagaagtaccatgctttccttgcttcggaggcaatcattaagcaaatcccaaggcttctgggtccaggtctcaacaaggccggtaagtttccgactttggtttcccaccaggagtctttggagtcaaaggtgaatgagaccaaggccatggttaagttccagcttaagaaagttctttgcatgggggttgctgtgggaaactgtggcatggatgagaagcaagtcttccagaatgtgcaactcagtgtcaatttcctggtttcactgttgaaaaagaactggcaaaatgtgagatgcttatatctgaagagtacaatgggcaagccatacagaatattttgagttagctttatgaaccgtttgatagcagttttcatttgaattcggtggtgagaagtcaacaaggtggtattttctcttttttcactagagctttaggattttagtttgcggcttcaatcgttctttaccaaatcaaaatagatctttcttttt

SEQ ID NO: 15483 - DNA, 882 bp, Pteridium aquilinum
gatttctcacatctctggtaaatattatagttttattcgtggaaataacagagattcagggatgagtaagcttcagagtgatgcccttagagaagctatttccaccattgtggctcaagtccaaggaaaaaaccgtaagttcactgagaccattgaactccagattgggctgaaaaactatgatccccaaaaggacaagcgtttcagtggatctgtgaagctgccacacattcctcgccctaagatgaagatctgcatgcttggagatgctcaacatgttgaagaggcagagaagataggcttggattatatggatgttgaagcactgaagaagcttaacaagaacaagaagttggtcaagaagcttgccaagaagtatcaggcctttttggcatctgaagctatcatcaagcagatccctcgtctcttgggtcctggtctcaacaaagcagggaaattcccaacccttgttactcaccaggaatccctagagtccaaggtgaatgagaccaaggcaatggtgaagttccaactgaagaaggttctttgcatgggagttgctgttgggaatgtagctatggaggagaagcagatcttccaaaatgtgcaaatgagtgtcaatttccttgtttcattgttgaagaaaaactggcaaaatgtgaggtgcctctacctgaagagtaccatgggcccttcaaacaggatcttttgagatgatatttactttctattagtgttatgtacggagtgaaagtagttgttgggattaatagtaaatcagttttttactcagaatgttcaaattttgtgttatgttttgttgctggaatccgtagaaatattatgaatttgagaccttggaagttttgttttgcatatcaa

SEQ ID NO: 15484 - DNA, 1079 bp, Amsonia hubrichtii
tggtatatctcgaacatagccgcgaccaccaagtgcccgccctcccctccaccagaactctattggagcaccatccaggagtgaagagggaagaatttcggagattttaaatcatgagtaagcttcagagtgatgccctcagagaagccatttctgtggtaaagaatgatgctgctgagaaaaagcgcaacttcacagagacaattgagctgcagattgggctgaaaaattatgatcctcagaaggataaacgtttcagtggctctgtgaagttacctcacattcctcgccctaagatgaaagcttgcatgctgggagatgctcagcatgttgaggaggctgaaaaaattggtctggagtacatggatgtggaaggtctgaagaagcttaacaaaaacaagaaattggtgaaaaagcttgccaagaaatatcatgcttttttggcttcagaagctgtgatcaagcagattccccgtctcttgggacctggtcttaacaaggctggcaagttccctacccttgttacccaccaggaatcacttgaatctaaagttaatgagatcaaggccacagtaaagtttcaattgaagaaggtgctttgtatgggagttgcagtcgggaattgcgatatggaggaaaagcaaatatttcaaaatgtgcagatgagtgtgaattttctggtttccttgttgaagaagaattggcaaaatgtgaggtgcttgtacctaaagagtaccatggggaaaccacagcgcatcttctgaggagagtttcctgttgttactgctgttttgatgggttttatgatgattgcatctaatatattgttcttagtatgatggcaaattttgttaccttaggtattgttttagctattgtctcggcttgaaaaggtgaccaagaccatcaactcttttgttttattagtttcattactgcatatttattatgattttaaatatttatcccctgttataaatttttgcgcatagaaggaagtttcctgcatctggtattgcttttctttgtttggatttctggaattaaattttggttatgtttgctctggatgttcaaaa

SEQ ID NO: 15485 - DNA, 988 bp, Euonymus alatus
ggctagggtttttttcacctcctgaactatctgcgagccagcgagcgggctcgttgaagggcaaacatgagtaagcttcagagtgacgccctgagagaagctatctcaaccattgtgaaagagtgcgcagagaaaaagaggaactttgttcagactattgaactccagattgggttgaagaattatgatccccaaaaagataagcgtttcagtggttctgtgaagttgccgcatattcctcgtccgaaaatgaaagtatgcatgcttggagatgctcagcatgtagaagaggcagagaaaattggtttggattatatggatgtggaagcattgaagaagctaaacaagaacaaaaaactagttaagaagctcgcaaagaagcaccacgcctttttggcttcggaatccgtcatcaaacagatccctcgtcttttggggcctggtctaaacaaggcagggaagtttcctactcttgtttctcatcaagagtcccttgagtctaaaattaatgagaccaaggcaacagtgaagttccagttgaagaaggtgctctgcatgggagttgctgtgggtaatgtctctatggaggagaagcagatattccagaatgtgcaaatgagtgtgaacttccttgtttcattgttgaagaaaaactggcagaatgtgaggtgcctgtacctgaagagcaccatgggcagtccaaatcgcatcttctgagttgaatttttatctgttgacgttgtgtaaggagagaactagttggtcacattcagaaaagtgtctaaccagaatgttacgttttccttctgttttgttagctcccttggtgagtagaattaaaatgttaagacgtacccaagaagatttagtgggagaagttgattatttgcattattatgattttgaaccacaactggagctttggttttattgttggcatttcttcccgttgcaatgtcttctatactcactcgttccagccattctc

SEQ ID NO: 15486 - DNA, 992 bp, Euonymus alatus
gttgctggctattgctgtatatatacactctggagcgcagtcgcggctagggtttctttcacctcctgaactatctgcgagcgggctcgttgaagggcaaacatgagtaagcttcagagtgacgccctgagagaagctatctcaaccattgtgaaagagtgcgcagagaaaaagaggaactttgttcagactattgaactccagattgggttgaagaattatgatccccaaaaagataagcgtttcagtggttctgtgaagttaccgcatattcctcgtccaaaaatgaaagtatgcatgcttggagatgctcagcatgtagaagaggcagagaaaattggtttggattatatggatgtggaagcattgaagaagctaaacaagaacaaaaaactagttaagaagctcgcgaagaagcaccacgcctttctggcttcggaatccgtcattaaacagatccctcgtcttttggggcctggtctaaacaaggcagggaagtttcctactcttgtttctcatcaagagtcccttgagtctaaaattaatgagaccaaggcaacagtgaagttccagttgaagaaggtgctctgcatgggagttgctgtgggtaatgtctctatggaggagaagcagatattccagaatgtgcaaatgagtgtgaacttccttgtttcattgttgaagaaaaactggcagaatgtgaggtgcctgtacctgaagagcaccatgggcagtccaaatcgcatcttctgagttgaatttttatctctgttgaatttttatctgttgacgttgtaaggagagaactagtcagaatgttacgttttccttctgttttgttagctcccctggtgagtagaattaaaatgttaagacgtacccaggaagatttagtgggagaagttgattttttgcattattataattttgaacctcaactggagctttggttttgttgttggcatttctccccgttgcaatgtcttctatat

SEQ ID NO: 15487 - DNA, 1028 bp, Tripterygium wilfordii
agagaactatcggcgagcgagctttttggaagggcaagcatgagtaagcttcagagtgatgccctgagagaagctatcgcaaccattgtgaaagagtccacagagaaaaagagaaactttgttcagactattgaactccagattgggttgaagaattatgatccccaaaaagataagcgtttcagtggttctgtgaaattgccgcatattcctcgtccgaaaatgaaagtatgcatgcttggtgatgctcagcatgtggaagaggcagagaaaattggtttggattatatggatgtggaagcattgaagaagctaaacaagaacaaaaaacttgttaagaagctcgcaaagaagcaccatgcctttttggcttcagaatctgtcatcaaacagatccctcgtcttttggggcctggtctcaacaaagcaggaaagtttcctacacttgtttctcatcaagagtcccttgagtctaaagttaacgagaccaaggcaacagtgaaattccagttgaagaaggttctctgcatgggagttgctgtgggaaatgtttctatggaggagaagcagatattccagaatgttcaaatgagtgttaacttcctggtttccttgttgaagaagaattggcagaatgtcagatgtttgtacctgaagagcaccatgggcagtccaaaccgcatcttctgagttaaatttatatatgttgaagatgcgtaaggagagaactagttgaacaaatactgaaaagttttctatcagaatgctcatgttttccttctgttttgctagttactttgtttccttggtgagtagtgttaaaattttaagacgtacccaagattttggagaaggtgatttttttttgctttttaattttgaacctcaactggaactttggtattattgttctgtcactacctctttgcaatgccttctatattcagattagcttatgctactggctttggcgtagtggtagtttgttggtatcaatcgacatttactcgttaattttgtcaggaaaa

SEQ ID NO: 15488 - DNA, 1014 bp, Tripterygium wilfordii
ggacaactatcggcgagcgggcttgttggaagggcaaatatgagtaagcttcagagtgatgccctgagagaggctatatcaaccattgtcaaggagtccgcagagaaaaagagaaactttgttcagactattgaactccagattgggttgaagaattatgatccccaaaaggataagcgtttcagtggttctgtgaagttgccgcatattcctcgtccaaaaatgaaagtatgcatgctgggagatgctcagcatgtagaagaggcagagaaaatggggttggattatatggacgtggaagcattgaagaagctaaacaagaataaaaaacttgtcaagaagcttgcaaagaagtaccatgcctttttggcttcagaatctgtcatcaaacagatcccccgtcttttggggcccggtctcaacaaggcaggaaagtttcctacacttgtcagtcatcaagagtcccttgagtctaaagttaacgagaccaaggcaatggtgaagttccagttgaagaaggttctctgcatgggagttgctgtgggaaatgtctcaatggaggagaagcagatatttcagaatgtgcaaatgagtgttaacttccttgtttcgttgttgaagaagaattggcagaatgtgaagtgcttgtacctgaagagcaccatgggcagtccaaaccgcatcttttgattttaaactattctgttgaagttgtgcaaggagaactagtgtgacaaaatacttaagaaagtgttttatcagaatggccatgttttcattctgtttgacatgcacaatatttttgttggaatttttttttcgcattctagttttggacctcaactggatcttttggtattattgtttttgtcattaatttctttgtgcaataggttctatgttcagattcgttgtcatgctgatgcttttgtaggattccatagtttgtgctactggcatccatcgcatttgtggcctttttcggatggcagtgttggtattgttactcaacct

SEQ ID NO: 15489 - DNA, 1055 bp, Platanus occidentalis
gaaccccctgtcggcagctttgttttaggttctcacttctgcaaaaaaagaaagcgttgcagcaatgagtaagcttcagagtgatgttctgagggaggccattggccagatcatgggtgctgccaaggaaaagaaccgtaagttcactgagaccattgaacttcagattggtctgaagaactatgacccacagaaggacaagcgtttcagtggttctgtaaaattgcctcatatccctcgtcctaaaatgaaggtgtgcatgcttggagatgcacagcatgttgaggaggctgagaggatgggattggagtctatggacgttgaagcattgaagaaaatgaacaagaacaagaagttggttaagaagcttgctaagaaataccatgctttccttgcttcagaggcaatcatcaagcaaattccaaggctccttggtcctggtctcaacaaggccggtaaatttcctactttggtttcccatcaggagtcgttggagtcaaaggtcaacgagaccaaggccatggtcaagttccagcttaagaaagttctctgcatgggtgttgctgtggggaactgtgacatggatgagaagcaagtctttcagaatgtgcagctcagtgtcaatttccttgtctccctgttgaagaagaattggcaaaatgtccgatgcttaaatctgaagactacgatgggcaagccatacagaattttctgagttaagtattttgttccttttgttcgcagtacacacttaaattcatggtggatgagaattcatagttgtgggctatctttttctgttacaaaagcattaaggttttacatcttgttgctttgttttttatctagttagactggacctttgtttaaagttgattattttgttttctaaaggagacaataccaagtaagcaaatctggatttttgagacttcattaattattggatggtaacatgtacttgtgatatttgggaattctgcttctccaccttctaatccttttacattgttgtatgtttttgtcttttgctgtatcgttaaataaaataaaat

SEQ ID NO: 15490 - DNA, 1154 bp, Citrullus lanatus
ttctcctttgtttcaccttcatattcttaatagcattactttaatccccacttcatgtttttctggattttgcgcatttttatgtctgttgggtgcttttcttttgggttcgatttgcagttttcctttgcttactgctcatgattatatcaattgctccattgttatttgcttttttttgaagtttcttaccgtttctgtactctgtttgtgcacaggactgaagtgtatagtgtctttgcgaaggcgaagattcgaaaatgagtaagcttcagagtgatgcattgagagaagctatctcatctatcttcactgatagcaatgagaaaaagaggaagtttactgagaccattgagcttcagatcgggctgaagaactatgatcctcaaaaggacaagcgtttcagtggttctgtgaagttgccacacattccccgtcccaagatgaagatatgcatgctaggggatgcctcgcacgttgaagaggccgagaaaattggcttagactatatggatgtggaaggcttgaagaagctaaataagaacaagaaattggtgaagaagcttgccaaaaaataccatgcctttttggcatctgaagctataatcaagcagatccctcgtcttctaggccctggtctcaacaaagcaggaaagttcccaacattggtgacacaccaagaaacgcttgaatccaaagttaacgagaccaaggcaatggtcaagtttcaactgaagaaggtcctttgtatgggagttgccgttggaaatgttgccatggatgagaagcaagtcttccagaatgttcaaatgagtgtcaatttcctggtttctttgttgaaaaagaactggcagaatgtcaggtgcctgtacctgaagagcacgatgggcaagtcataccgggttttctaagctctattagcaatctagtcagtcttgtgttcgatctttttactgttgacgttattttttgaagagcagttttgtgaattgagcgtttttgaatgattattgaacaaagaaacagggatgattttttctcctttaaagtgacaattgataacgaagttttttattcccatcaaccaaacccatcatgaacgttcgtttacgtttttactgtgcctggtctgatactattataattgttggttt

SEQ ID NO: 15491 - DNA, 910 bp, Brassica napus
gattcgttcaaccgagagaaactcaagatgagtaagcttcagagtgaggctcttagagaagccatcacaaccatcaagggcaaatctgaggacaagaagcgtaactttgtggagacgattgagcttcagattggtctgaagaactacgacccgcaaaaggacaagcgtttcagtggatctgtcaagctcccgcacattcctcgccctaagatgaaggtctgcatgcttggagatgctcagcacgttgaggaggctgagaagatgggtctagactctatggatgttgaggctttgaagaagcttaataagaacaagaagcttgttaagaagcttgcaaagaagtaccatgctttcttggcttctgagtcagtcatcaagcagattccccgtcttcttggtcctggtcttaacaaagctggaaagttcccaactctagtgagtcaccaggagtccttggaagggaaggtgaatgagacaaaagcgactgtgaagttccagttgaagaaggttctgtgtatgggtgttgctgttggtaacctttccatggaggagaagcagctcttccagaatgttcagatgagcatcaacttccttgtctccctcttgaagaagaattggcaaaacgtgaggtgtttgtacttgaagagcaccatgggaccaccacaaaggatcttttgagttctctgctctttcatcttcgaacttttgctttgtggtttttgtttgtttcagagaacttaagttatggttttgtttggtattagcagaactgaagtgttagtttgctttttgttaagacattataatatgcactgttggattctacaatgtcgactctccagttcaattttatctttatcaattattcgtaaaacaactctattcgtaactagtagactagccaacgaca

SEQ ID NO: 15492 - DNA, 1127 bp, Picea glauca
attcacatgtgaacataagtgggatttgtgcaaaaccctagcttggcctcaggattttatttgtgactattcgagggtcgtttggagaagagcagcagtaggacgacgaagaagaggcagaggcagaggaagcaaggcgccccctcctgtaaacaatgagtaagcttcagagtgacgtgttgagggagggaataactcaggttatgggagaaagcaaggacaagaagcgaaaattcacagagacaatagagttacagatcgggctgaagaactatgacccccaaaaggacaagcgtttcagtgggtccgtaaaattgccccacattccccgccccaagatgaaggtctgcatgctcggagatgcccaacacattgaagaggctgagaagatcagtcttgactacatggatgttgagggtctgaagaaaatgaacaagaataagaaacttgttaagaagctcgcaaagaagtaccatgcatttcttgcttcggaagcaattattaaacaaattccaagactccttggacctggtcttaacaaggctggtaaatttcccactcttgtttcacaccaagagtccttggagtccaaggtgaacgaaacaaaagcaacggttaagtttcagttgaaaaaagttctatgtatgggggttgctgtggggaactgtggaatggaggagaaacaggtgtttcagaatgttcaattgagtgtgaactttctggtatccttgctgaagaaaaactggcaaaatgtccgatgcttgtatctgaagagtaccatgggcaagccagcacgcgtattctgagttttgcaatattggtgtcagcctgtgttggctgcatatggagaggatttttccttggtttttgttttgcgttggtcagaacattacatttttgtttgtgtggaggggtatgttagccaagtggctttaatctcatgcatttggagtaaaagggaaattaattattattttactattttgttattgtaatttggcatggtttatcagtcatgctgctggaagatatgtttatctcttcctttattcaagtaatcagaattgagtagatactgaaccaagtttattattgttcttaatttgacataggcatatttattattg

SEQ ID NO: 15493 - DNA, 1238 bp, Picea glauca
agagatattgaccaaaatataggatctcactcggggtcacaaaaaaggccatagaaggtgtatacgaggaaaccgaaccctaatcaatgattttcacatgtgaacataagtgggatttgtgcaaaaccctagcttggcctcaggattttatttgtgactattcgagtgtcgtttggagaagagcagcagtaggacgacgaagaagaggcagaggaagcaaggcgccccctcctgtaaacaatgagtaagcttcagagtgacgtgttgagggagggaataactcaggttatgggagaaagcaaggacaagaagcgaaaattcacagagacaatagagttacagatcgggctgaagaactatgacccccaaaaggacaagcgtttcagtgggtccgtaaaattgccccacattccccgccccaagatgaaggtctgcatgctcggagatgcccaacacattgaagaggctgagaagatcagtcttgactacatggatgttgagggtctgaagaaaatgaacaagaataagaaacttgttaagaagctcgcaaagaagtaccatgcatttcttgcttcggaagcaattattaaacaaattccaagactccttggacctggtcttaacaaggctggtaaatttcccactcttgtttcacaccaagagtccttggagtccaaggtgaatgaaacaaaagcaacggttaagtttcagttgaaaaaagttctatgtatgggggttgctgtggggaactgtggaatggaggagaaacaggtgtttcagaatgttcaattgagtgtgaactttctggtatccttgctgaagaaaaactggcaaaatgtccgatgcttgtatctgaagagtaccatgggcaagccagcacgcgtattctgagttttgcaatattggtgtcagcctgtgttggctgcatatggagaagatttttccttggtttttgttttgcgttggtcagaacattacatttttgtttgtgtggaggggtatgttagccaagtggctttaatctcatgcatattggagtaaaagggaaattaattattattttactattttgttattgtaatttggcatggtttatcagtcatgctgctggaagatatgtttatctcttcctttattcaagtaatcagaattgagtagatactgaaccaagtttattattgttcttaatttgacataggcatatttattattgtccatgcaggagagatattagaaaa

SEQ ID NO: 15494 - DNA, 988 bp, Taxus baccata
taacgcaagctgcgtgaacaaagtttaacaaaaccctagcttatggcctcgttagtttcttttcccacctgtgcttccgattgctaggggacacgacgagagggttgtgcggcggcataagcatgagtaagcttcagagtgatgtgttgagggaagcgataacgggggtggttgcagagagcaacgagaagaaaggaagtttgtcgaaacactagagttgcagattggcctgaagaactatgatcctcagaaggacaagcgcttcagcggctccgtcaagctcccccacattcctcgccctaagatgaagctctgcatgctcggcgatgcccagcatattgaagaggcagagaaaataggtttggactacatggatgtagaaggactaaagaaaatgaacaagaacaagaagctggttaagaagcttgcgaagaaataccatgcttttcttgcatcagaagcgattattaagcaaattcctcgacttcttggtcctggtctaaacaaggctggtaagtttcctactttggtgtcccaccaagagtcattggaggcaaaagtaaatgaaacaaaagccactatcaagttccaattgaagaaagttctgtgtatgggtgttgctgtgggtaattgtggcatggacgaaaaacaaatattccagaatgttcagctgagtgttaactttctggtgtccttactaaagaagaactggcaaaacgtacgttgcctttatttgaagagtaccatgggcaagccttcccggatattctaattctgcaatttatcgacagcttttgctaaatgaaacactggaatatatgttttgttttgttgacttacgaggttcaagcaatttattttattaggactttgcacttgatttcaacataacgttttgcaaaggcataggtccgaggcatgatgcagtcgagggaaatttaatttgattttcttacaaattcaataatgattgatgttctctttctcc

SEQ ID NO: 15495 - DNA, 798 bp, Brassica napus
tcgttcaaccgagagaaactcaagatgagtaagcttcagagtgaggctcttagagaggccatcacaaccatcaagggcaaatctgaggacaagaagcgtaactttgtggagacgattgagcttcagattggtctgaagaactacgacccgcaaaaggacaagcgtttcagtggatctgtcaagctcccacacattcctcgccctaagatgaaggtctgcatgcttggagatgctcagcacgttgaggaggctgagaagatggggctagactctatggatgttgaggctttaaagaagcttaacaagaacaagaagcttgttaagaagcttgcgaagaagtaccatgctttcttggcttctgagtcagtcatcaagcagattccccgtcttcttggtcctggtcttaacaaagctggaaagttcccaacgctagtgagtcaccaggagtcgttggaaggaaggtgaatgagaccaaagcgactgtgaagtttcagttgaagaaggttctgtgtatgggtgttgccgttggtaacctttccatggaggagaagcagctcttccagaatgttcagatgagcatcaacttccttgtctccctcctgaagaagaattggcaaaacgtgaggtgtttgtacttgaagagcaccatgggcccaccacaaaggatcttttgagttctctactctttcatcttcaaacttttgcgttgtggtttttgtttgtttcagagaacttaagttatggttttgtttggtattagcagaactgaagtgttagtttgctttttgtcaagacatt

SEQ ID NO: 15496 - DNA, 1102 bp, Picea glauca
ggagaagagcagcagtaggacgacgaagaagaggcagaggcagaggcagaggaagcaaggcgccccctcctgtaaacaatgagtaagcttcagagtgacgtgttgagggagggaataactcaggttatgggagaaagcaaggacaagaagcgaaaattcacagagacaatagagttacagatcgggctgaagaactatgacccccaaaaggacaagcgtttcagtgggtccgtaaaattgccccacattccccgccccaagatgaaggtctgcatgctcggagatgcccaacacattgaagaggctgagaagatcagtcttgactacatggatgttgagggtctgaagaaaatgaacaagaataagaaacttgttaagaagctcgcaaagaagtaccatgcatttcttgcttcggaagcaattattaaacaaattccaagactccttggacctggtcttaacaaggctggtaaatttcccactcttgtttcacaccaagagtccttggagtccaaggtgaacgaaacaaaagcaacggttaagtttcaagttgaaaaaagttctatgtatgggggttgctgtggggaactgtggaatggaggagaaacaggtgtttcagaatgttcaattgagtgtgaactttctggtatccttgctgaagaaaaactggcaaaatgtccgatgcttgtatctgaagagtaccatgggcaagccagcacgcgtattctgagttttgcaatattggtgtcagcctgtgttggctgcatatggagaagatttttccttggtttttgttttgcgttggtcagaacattacatttttgtttgtgtggaggggtatgttagccaagtggctttaatctcatgcatattggagtaaaagggaattaattattattttactattttgttattgtaatttggcatggtttatcagtcatgctgctggaagatatgtttatctcttcctttattcaagtaatcagaattgagtagatactgaaccaagtttattattgttcttaatttgacataggcatatttattattgtccatgcaggagagatattagaaaatgattgatatattcctggtttgattt

SEQ ID NO: 15497 - DNA, 1043 bp, Citrus clementina
tacgagcgttcgccgctcccaagtctctagggtttctttttcgtatttgaagaaaaaaaattctgtaaaggactccaagcgcttcaatcatgagtaagcttcagagtgatgcactgagagaggccgtctctagtattgtgcaatactctaaggagacaaagaagaggaacttcaccgagactattgagcttcagattggtctcaagaactatgatccacaaaaggacaagcgtttcagtggctctgttaagttgcctcacattccccgccccaagatgaaggtctgcatgcttggtgatgctcaacatgttgaagaggccgagaagattggtttggactacatggatgttgaaggattgaaaaaattgaacaagaacaagaaattggtgaagaaacttgccaagaaatatcatgctttcttggcatcagagtctgtcatcaagcagattcctcgtttgttgggtcctggtctcaacaaggcaggaaagttccctacccttgttactcaccaagaatccctggagtccaaagtcaacgagactaaggcaacagtgaagttccaattgaagaaggtgctttgcatgggagttgctgttggaaacctttcaatggaggagaagcagatcttccagaatgttcaaatgagtgttaacttccttgtctcattgttgaagaaaaactggcagaatgtcaggtgcctctatctgaagagtaccatgggtccttcaaaccgcatcttttaagaaattctgctttatgttggagttttgtagggaaaacctagtgtgatcttattatacccaaaatgtctttctttgaatggtcacaacctgcaattttctttttctttttctttttcttttctgaatttaatgcactagtaatcttataatatggtagacttgtacgaatttttttgttggagagatgttgaattgaatcatgattgctttctgttagatcgatggttattcattctctatgtgaggtctgtatttctggggttgcattaattcccaggctttttggctgcaagacctttt

SEQ ID NO: 15498 - DNA, 1037 bp, Citrus sinensis
tacgagcgttcgccgctcccaagtctctagggtttctttttcgtatttgaagaaaaaaaattctgtaaagggctccaagcgcttcaatcatgagtaagcttcagagtgatgcactgagagaggccgtctctagtattgtgcaatactctaaggagacaaagaagaggaacttcaccgagactattgagcttcagattggtctcaagaactatgatccacaaaaggacaagcgtttcagtggctctgttaagttgcctcacattccccgccccaagatgaaggtctgcatgcttggtgatgctcaacatgttgaagaggccgagaagattggtttggactacatggatgttgaaggattgaaaaaattgaacaagaacaagaaattggtgaagaaacttgccaagaaatatcatgctttcttggcatcagagtctgtcatcaagcagattcctcgtttgttgggtcctggtctcaacaaggcaggaaagttccctacccttgttactcaccaagaatccctggagtccaaagtcaacgagactaaggcaacagtgaagttccaattgaagaaggtgctttgcatgggagttgctgttggaaacctttcaatggaggagaagcagatcttccagaatgttcaaatgagtgttaacttccttgtctcattgttgaagaaaaactggcagaatgtcaggtgcctctatctgaagagtaccatgggtccttcaaaccgcatcttttaagaaattctgctttatgttggagttttgtagggaaaacctagtgtgatcttattatacccaaaatgtctttctttgaatggtcacaacctgcaattttctttttctttttcttttcagaatttaatgcactagtaatcttataatatggtagacttgtacgaatttttttgttggagagatgttgaattgaatcatgattgctttctgttagatcgatggttattcattctctatgtgaggtctgtatttctggggttgcattaattcccaggctttttggctgcaagacctttt

SEQ ID NO: 15499 - DNA, 787 bp, Scabiosa columbaria
tagggttttcagtgttcttacattatttctccccttcattcttcgtatcagtagcagtcaaaaaattcagttttgaagcttgaggaagacaacaacttcaaatatgagtaagcttcagagtgaagcccttagagaagcaatttctcaaattgctacagctgcagcaggagagaacaagcgtaatttcgttgagacaattgagcttcagattggtctgaagaattatgatccccaaaaggataagcgtttcagtggatctgtgaaacttcctcacattcctcgccctaagatgaaggtttgcatgcttggagatgctcagcatgttgaagaggcagagaaaattggtctagaatacatggatgttgaagggctaaagaagttgaacaagaacaaaaagttggtgaagaagcttgcaaagaaataccatgctttcttggcatcagaggctgttattaaacagattcctcgtcttctcggccctggtctcaacaaggctggtaagtttccgacattggttactcatcaagaatcgctggagtcgaaagtaaacgagatcaaggcaactgttaaatttcagttgaagaaggttttgtgcatgggagttgctgttgggaactgcagcatggaagagaaacaaatctttcagaatgttcagatgagcgttaattttcttgtttctttgctcaagaagaactggcaaaatgtgaggtgcttgtacttgaagagtacaatggggaagccggttcgcatcttttaagttgcttatttcgtgttttttgtttcttac

SEQ ID NO: 15500 - DNA, 828 bp, Vinca minor
ccccttcagtcttccatagaggcattgatcctgtggaaaacaagactgatttgtcaccatgagcaagctacagagcgatgctgttagggaagcaattacccagattgttactgactgtaataaagaggataagaagcgcaagtttactgagaccgttgagcttcagattggactgaagaactatgacccccaaaaggacaagcgtttcagtggctcagtcaaactgccacatatccctcgccccaagatgaaggtttgcatgcttggtgatgctcagcatgttggagaggctgaaaagattgggctcgagtacatggatgttgagggtttgaaaaaacttaacaagaataaaaaacttgttaagaagcttgccaagaagtatcatgctttcctggcatctgaagcagttatcaaacagattccccgtcttctgggccctggtcttaacaaggcaggtaaatttcctacacttgtcagtcaccaggaatccttggagtcaaaagtgaatgaaataaaagccacagtgaagtttcaactcaagaaggttctctgcatgggtgtcgctgtgggtaatttggacatggaagagaagcaaatttttcagaatgttcaaatgagtgtcaactttctcgtatcactgctgaagaagaattggcagaatgtgaggtgcttgtatctgaagagtactatgggaaggccgcagcgcatcttctgatcagttgtttttatttactttgttttaagatcagttcatttcgagtcaaaagagttggcagttgaatacacttttttgtggtcaaagcctagaatatttttgctttttttttt

SEQ ID NO: 15501 - DNA, 839 bp, Cynodon dactylon
ctcatcccacatataaccatccgcgccgccgccgccgccgccgcttctgcgtcttctctcttgctcctttgttcgcctcgcgcccagtcctccagggagttgagcggtagatttgccaccatgagtaagttgcaaaccgaggttctcaaggatggcatccccaatgtcctccaggatgcccaggagaagaacaggaagttccctgagaccattgagcttccgattggtccccagaactatgacccccagaaggacaagcgattcagcggctctgttaagctgccccatatcccccgcccaaagatgaaggtgtgcatgcttggtgatgcccagcatgtggaggaggctgagaagatggggcttgactacatggatgtcgaagctctcaagaaaatgaacaagaacaagaagctcgttaagaagcttgccaagaagtaccacgctttcttagcatcagaggccatcatcaagcagattccccgtctccttggtcccggtctgaacaaggcaggcaaattccctacactggttactcaccaggagtctcttgaatccaaggtcaacgagacaaaagccacggtcaagttccagctgaagaaggttctttgcatgggtgttgctgtgggcaacctatcgatggaggagaagcagatccagcagaacatccagatgagcgtcaacttcctcgtgtcccttctgaaaaagaactggcagaatgtgaggtgcctgtacatcaagagcaccatggggaaaccgtaccggttgttctaagttcttgtgaagttgatcagatactgggccctttgaactgagcttgtcttaaaacctagatatgttga

SEQ ID NO: 15502 - DNA, 982 bp, Carica papaya
cttgtctcttctcgcctttctccctagttcctctgccagccgcggaatctggttcttctggcaggaggcaaatctagattctcagtatgagtaagcttcagagtgacgcactgagggaagctatttccactgttgtgaatgcttccaaagagaaaaagcggaactttactgagaccattgaactccagattgggttgaagaactatgatccccaaaaggacaaacgtttcagtggttctgttaagttgccacatattccccgcccaaagatgaaggtctgcatgcttggagatgcccaacatgtggaagaggccgagaagattggtttggactatatggatgtggaaggcttgaagaaactaaacaagaacaagaaactggttaagaaacttgccaagaagtatcacgcattcttagcatcagaatcagttatcaagcagattccccgtcttctaggccctggtctcaacaaggcaggaaaattccctacccttgttactcaccaagaatctctcgagtctaaagtcaatgagatcaaagccacagtgaagttccagctgaagaaagttctttgcatgggagttgcagtcgggaactgtgctatggaagagaaacagattttccagaatgtgcagatgagcgtcaatttccttgtttccttactgaagaaaaattggcaaaatgttaggtgcttgtatttgaagagtaccatgggcccatctaaccgggttttctaagttccttcttatcttcaagatatgctgtgagtgatccggtatggcaaattagggttcgcagaatggttttcggggttatatcttttctttttgttaagttggatggtagaaatcttgcaatgttagacttccacaaatcattgtaaggtaatttttaacagatacgtactatttgggaacttttagatgcaaatttttaaaattttgtatgccttgcattttataattattagcttttctttact

SEQ ID NO: 15503 - DNA, 1059 bp, Gossypium hirsutum
tcatctcttgttggtggcggtaaaattttattgtttgtggaaagaacaaagattcgaagatgagtaagcttcagagtgatgcgcttagagaagctatttcaaccattgtagctcagtcaaaggagaaacagcgcaaatttactgagaccattgaactccagattggtctgaaaaactatgatcctcaaaaagacaagcgattcagtggatctgtgaagctgcctcatattcctcgccccaagatgaagatttgcatgcttggagatgctcaacacgttgaagaggcagagaagataggtttggattatatggacgtggaagcattgaagaaactgaacaagaataagaagttggtgaagaagcttgcgaagaagtatcatgcctttttggcttctgaatctgtcatcaagcaaatcccacgtcttctgggtcctggtctcaacaaagcaggtaaattcccaacccttgtcactcaccaggaatcactagagtcgaaggtgaatgagacaaaggcaatggttaagttccagctgaagaaagttttatgcatgggagttgctgttgggaatgttgcaatggaggagaagcagatcttccaaaatgtgcaaatgagcgtcaatttccttgtttccttgttgaagaaaaattggcaaaatgtgaggtgcctctacttgaagagcaccatgggtccttcaaacaggatcttttgagttcatatttttaccttctgttatgtacggactgaaagtagtagtggggatttaatactaaaatcagtttttttcttctcttttacttagaatgtttaagtttatgttatgttctgttgttccctagaaatgttatgaatacgagacattgtaattttgatttgcttatcaacttgggtttcacattatttgcttaatccacacaaaaatttcccttaacaaatggttggcaattggcgtccttgttgggcttatggatattgactgctgattgtcactatgtgggagtgtggtggatatcctggacttataccggcctcggttttgatgtgagcttttgagtaagagt

SEQ ID NO: 15504 - DNA, 1064 bp, Gossypium hirsutum
tcatctcttcttggcggtgccggggtaaaagtttattgtttgtggaaagagcagagattcggagatgagtaagcttcagagtgatgcgcttagagaagctatttcaaccattgtagctcagtcaaaggagaaacagcgcaaatttactgagaccattgaactccagattggtctgaaaaactatgatccccaaaaagacaagcgtttcagtgggtctgtgaagcttccacatattcctcgccccaaaatgaagatttgcatgcttggagatgctcaacacgttgaagaggcagagaagataggtttggattatatggatgtggaagcattgaagaaactaaacaagaataagaagttagttaagaagcttgccaagaagtatcatgcctttctggcttctgaatctgtcatcaagcaaatccctcgtcttttgggtcctggtctcaacaaagcaggtaaattcccaacccttgtcactcaccaggaatccctagagtcgaaggtgaatgaaacaaaggcaatggttaagttccagctgaaaaaggttctatgcatgggagttgctgttgggaatgttgcaatggaggagaagcagatcttccaaaatgtgcaaatgagcgtcaatttccttgtttctttgttgaagaaaaattggcaaaatgtgaggtgcctctacttgaagagcaccatgggtccttcaaacaggatcttttgagtttatgttttaccttctgttatgtacggactgaaagtagtagtggggatttaatactaaaagcggtttttttcttctcttttacttagaatattcaagtttatgttatgttctgttgttccctagaaatgttataaatattagacattgaagttttgatttgcttatcaacttgagtttcatgttagtattaaattgccatctgatatttgcttagtccacacgaaaatcttccttagcaaatggttggcaattggcatccttgttaggcgtatggattttgactgctgattgtaaccatgtggtagaaatcctggaatgatactggccttggttttggtgcaaaaaa

SEQ ID NO: 15505 - DNA, 712 bp, Adiantum capillus-veneris
tctcgcccacagcacagtcgcgggagggagcggaaggagcaaagcaatcatgagcaagcttcagagcgatgtgctgagagaagccatcacgcagctcgtgtcggaatcgaaggagaagaagagaaagtttgtggagacggttgagcttcagattgggttgaagaactatgaccctcaaaaggacaagcgtttcagcgggtcagttaagctcgcacacatcccgcgacccaagatgaaagtgtgcatgctaggagatgcccagcatgtggaagaggcggagaagattggcctggattgtatggatgtcgatgcgctgaagaaaatgaataagaataagaagcttgtgaagaagctggcaaagaagtatcatgcctttttggcctctgaagctgtcattaagcagattcctcgtctcctgggtcctggtttgaacaaggcggggaaattccctactctcgtctctcaccaagagtcattggaggggaaattaaatgagacgaaggccactgttaaatttcagctgaagaaggtgctgtgcatgggtgttgctgtgggaaaccttgaaatggaggaaaagcagctttttcagaatgtgcagctgagcgtgaactttctcgtatccctcttgaagaagaactggcaaaatgtgcgagttttgtatttgaagtcgactatggggaagcctcaaagaatcttttgagctcgtgctgaa

SEQ ID NO: 15506 - DNA, 900 bp, Tropaeolum majus
actactatcttcaattcattatatttgcagccactttagttttcagcgtctgaatctccttctacttgtttttaggagtttaccctttgtagaattttcagtgtttcaacatgagtaagctccagagtgaggcacttagggaagccatcaccaccattgtgactgcttctaaggagaagcagaggaagttcactgagaccattgaactccaaattggtttgaagaactatgatcctcaaaaggacaagcgtttcagtggatcagtgaagttgccacacattcctcgcccaaagatgaaggcctgcatgcttggagatgcccaacacgtagaagaggcagaaaagattgggcttgactacatggatgttgaggctttgaaaaagctcaacaagaacaagaagttggttaagaaactagctaagaaataccacgctttcttggcatccgaatctgttatcaagcagattcctcgtctcttgggccctggtctcaacaaagcaggaaagttccctacccttgttagtcaccaggagtctcttgaggctaaggttaacgagattaaggcaacagtgaagtttcaattgaagaaggtgctatgcatgggtgtggctgttggtaactgtgctatggaggaaaaacagattttccagaatgttcaaatgagtgtcaactttctcgtgtccctgttgaagaagaattggcaaaatgtgcggtgcttgtatctgaagagtacaatgggtccttcaaacagagtgttttaggttagcctcaagtatctgggagcattataatatctaaactgtttgttttactttgttttagttggacgagtagaaaacctatctttattgaaacaaaaattttgtttgagattttgattattgtctaattacatttgga

SEQ ID NO: 15507 - DNA, 916 bp, Raphanus sativus
agagtaaggctttcctctgcttcacctttcaggttcagagattcgtcaactgagagaaactcaagatgagtaagcttcagagcgaggctcttagagaagccatcacgaccatcaagggcaaatctgaggagaagaagcgtaactttacggagacggttgagcttcagattggtctgaagaactatgacccgcaaaaggacaagcgtttcagtggatctgtcaagctccctcacattcctcgccctaagatgaaggtctgcatgcttggagatgctcagcatgttgaggaggctgagaagatgggactagactctatggatgttgaggctttgaaaaagctcaacaagaacaagaagcttgttaagaagcttgccaagaagtaccatgctttcttggcttctgagtctgtcatcaagcagattccccgtcttcttggtcctggtcttaacaaagcaggaaagttcccaacactggtgagtcaccaagagtcgttggaagggaaggtgaacgagaccaaagcgacagtcaagttccagttgaagaaggttctgtgtatgggtgttgctgttggtaacctttccatggaagagaagcagctctttcagaatgttcagatgagcatcaacttccttgtctctctcttgaagaagaattggcaaaacgtgaggtgtttgtacttgaagagcaccatgggaccaccacagagaatcttttgagttctccactcctatcatcttggaacttttgctttgtggtttttgtttgtttcagagatcttgagttatggttttgtttgttattagcagaactgaggtgttagttttctttttgttaagacattataatatgcaatgttggattttacaatatcgactctccgattcagttttatcttatctattccgtgaattgctca

SEQ ID NO: 15508 - DNA, 908 bp, Raphanus sativus
aaggctttcctctgcttcacctttcaggttcagagattcgtcaactgagataaactcaagatgagtaagcttcagagcgaggctcttagagaagccatcacgaccatcaagggcaaatccgaggagaagaagcgtaactttacggagacggttgagcttcagattggtctgaagaactatgacccgcaaaaggacaagcgtttcagtggatctgtcaagctcccgcacattcctcgccctaagatgaaggtctgcatgcttggagatgctcagcatgttgaggaggctgagaagatgggactagattctatggatgttgaggctttgaaaaagctcaacaagaacaagaagcttgttaagaagcttgccaagaagtaccatgctttcttggcttctgagtctgtcatcaagcagattccccgtcttcttggtcctggtcttaacaaagcaggaaagttcccaacactggtgagtcaccaagagtcgttggaagggaaggtgaacgagaccaaagcgactgtgaagttccagttgaagaaggttctgtgtatgggtgttgctgtcggtaacctttccatggaagagaagcagctcttccagaatgttcagatgagcatcaacttccttgtctcgctcttgaagaagaattggcaaaacgtgaggtgtttgtacttgaagagcaccatgggaccaccacagagaatcttttgagttctcgactcctgtcatcttggaacttttgctttgtggtttttgtttgcttcagagatcttgagttatggttttgtttgatattagcagaactgaggtgttagtttgctttttgttaagacattataatatgcaatgttggattctacaatatcgactctccgattcagttttatcttatctattccgtgaattgc

SEQ ID NO: 15509 - DNA, 914 bp, Raphanus sativus
gcagagtaaggctttcctctgcttcacctttcaggttcagagattcgtcaactttagagaaactcaagatgagtaagcttcagagcgaggctcttagagaagccatcacgaccatcaagggcaaatctgaggagaagaagcgtaactttacggagactgttgagcttcagattggtctgaagaactatgacccgcaaaaggacaagcgtttcagtggatctgtcaagctcccgcacattcctcgccctaagatgaaggtctgcatgcttggagatgctcagcatgttgaggaggctgagaagatgggactagactctatggatgttgaggctttgaaaaagctcaacaagaacaagaagcttgttaagaagcttgccaagaagtaccatgcttttttggcttctgagtcggtcatcaagcagattccccgtcttcttggtcctggtcttaacaaagcaggaaagtttccaacactggtgagtcaccaagagtcgttggaagggaaggtgaacgagaccaaagcgacagtgaagttccagttgaagaaggttctgtgtatgggtgttgctgttggtaacctttccatggaagagaagcagctctttcagaatgttcagatgagcatcaacttccttgtctcgctcttgaagaagaattggcaaaacgtaaggtgtttgtacttgaagagcaccatgggaccaccacagagaatcttttgagttctctactcctgttatcttggaacttttgctttgtgggttttgttttgtttcagagatcttgagttatggttttgtttgatattagcagaactgaggtgttagtttgctttttgttaagacattataatatgcaatgttggattctacaatatcgactctccaattcagttttatcttatgaaatgctttcta

SEQ ID NO: 15510 - DNA, 876 bp, Raphanus sativus
ccgtctcatcatccaggatcagatcttttgagacaagctcaaaatgagtaagcttcagagtgaggctgttaaagaagccataactgtaatccgaggaaaatcagaagagaagaaacgcaactttgttgagactctcgagctccagattggtctgaaaaattatgaccctcaaaaggacaagcgtttcagtggttccgtcaagttaccccacattccccgtcccaagatgaagatctgcatgctcggagacgcccagcacgtcgaggaggctgagaaaatggggctagactctatggacgtggagtctctgaaaaaactgaacaagaacaagaagctcgtcaagaagcttgccaagaagtaccacgccttcttggcctctgaatccgtcatcaagcagatccctcgtcttctcggtcctggactcaacaaggcaggcaagttcccgacgcttgtgagccaccaggaatcgctggaggggaaggtgaatgaaactaaggctacagtgaagtttcagctgaagaaggttctgtgtatgggtgttgctgttggtaacctctccatggaggagaagcacatctttcagaatgtccagatgagtgtcaacttcctcgtctctctcttgaagaagaactggcaaaacgtgaggtgtttgtacctcaagagcacaatgggaccaccacaaagaatcttctgagctctcgcagctgcttctatggtggctattacacttgcccttttacttttatttcagacatatttgaaagtagcaagaattgtgttgctgtgactctggttgctggattttgtagcttatattatcaatgaggattcaacaaacaaataatgttctaaatgaaaacaagaatgtttttgcca

SEQ ID NO: 15511 - DNA, 897 bp, Raphanus sativus
cttccgtctcatcattaggatcagatcttttgagacaagctcaaaatgagtaagcttcagagtgaggctgttaaagaagccataactgtcatcagaggaaaatcagaagagaagaaacgcaacttcgttgagactctcgagctccagattggtctgaaaaattatgaccctcaaaaggacaaacgtttcagtggttccgtcaagttaccacacattccccgtcccaagatgaagatctgcatgctcggagacgcccagcacgtcgaggaggctgagaaaatggggctggactctatggacgtggagtctctgaaaaagctcaacaagaacaagaagctcgtcaagaagcttgccaagaagtaccacgccttcttggcctctgaatccgtcatcaagcagatccctcgtcttctcggtcctggactcaacaaggcaggcaagttcccgacgcttgtgagccaccaggaatcgctagaggggaaggtgaatgaaactaaggctacagtgaagtttcagctgaagaaggttctgtgtatgggtgttgctgttggtaacctctccatggaggagaagcacatttttcagaatgtccagatgagtgtcaacttcctcgtctctttgttgaagaagaactggcaaaacgtgaggtgtttgtacctcaagagcacaatgggaccaccacaaagaatcttctgagctcctcaagcagctgcttcaatggtggctattacacttgcccttttgtttttgtttcggacatatttgaaaggctgtaagaattgtgttggctttggttgatggattttgtagcttatattatcttgaattatttgttcatgaagattcagcaaacaaataatgttctaaatgaaaacaataatgtctttgccagtgcta

SEQ ID NO: 15512 - DNA, 918 bp, Secale cereale
gccgccgcgtcgacaaaatccgtaagggcgtcagctaatcggcggcagccatgagtaagctccaaagtgaagccgtgaaggatgccatcactcagattgttggggaggccagagaaaagaagcgcaagttcactgagactgtggagcttcagatcggtctcaagaactacgatccacaaaaggacaaacgtttcagcggctccgtgaagctgccccatatcccccgcccaaagatgagggtgtgcatgcttggtgatgcccagcatgtcgaccaggctgagaaaatgggacttgactacatggatgttgaaagtctcaagaagatgaataagaacaagaagcttgttaagaagctagccaaaaagtaccatgctttcttggcatcagaggccataatcaagcagatccctcgtctccttggccctggtcttaacaaggcaggcaagtttcccactctggtaagtcaccaggaatctcttgaagccaaggtcaacgagacaaaagctacaatcaagttccagctaaagaaggttctttgcatgggtgttgctgtgggcaacttgtcgatggacgagaagcagatccaacaaaacatccaaatgagcgtcaacttccttgtgtccctcctgaagaagaattggcagaatgtgaggtgcctgtacgtgaagagcaccatggggaagcgtgtacgtgtgttctaagtgggtgttctaagtgggtgtgctccagtgaaagttgataagatactgtcctgccgacccctgcttgtctttggattagatctgtttgactgataccaattttatgttttcctaagcgaatatcaacaagcattttcttgaacagaaatcatgggagcaatggaactgagttttctgttatgattctgcgttctgttgttagagatctatatatgat

SEQ ID NO: 15513 - DNA, 1037 bp, Chelidonium majus
ccaattctaacatttgctgcctcttagtattctccattttctcataaatctctccaaatttctgaatagaatccgcaagcaacctaaatgaagacctctcaacaccattctccttaaatctttagggtagaaatttgtagaggatctcaaggaatagtttcacgatgagtaagcttcagagtgaagtgttgagggaagcaatcacccagattaatggtgaagctaaggagaaaaagcgtaacttcactgagactgttgagctccagattggtcttaagaactacgacccccaaaaagacaagcgtttcagtggttccgtgaagttgccacacattcctcgccctaagatgaaagtgtgcatgcttggagatgctcagcatgttgaggaggcagagaagattgggctggcctacatggatgttgaagggttgaaaaagcttaacaagaataagaaattggtcaagaagctcgctaagaaataccatgcttttctagcatcagaggctgttattaagcagatcccccgtctccttggccctggtctcaacaaggcaggaaagttccctactcttgtgactcaccaggaatcgttggagtccaaagtgaacgaaaccaaggctatggttaagtttcaactgaagaaggttctctgcatgggtgttgctgtgggtaaccttggaatggaagagaagcagatcttccagaatgtgcaactcagtgttaacttccttgtgtccttgttgaagaagaactggcaaaatgtgaggtgtctatacttgaagagtaccatggggaagcccgtccgcatcttctaagccctttatttattaattacaagaggtgtagtaagagatttagcgtttgcaagagtagacattttctgagaatgcttgcatatctttttgttttatgctcaaatttcgtttttgttcacttgacatttttagttcagtgattggaaaatcttgaaatattaagtgcttttttcatgttgtccaatgggatagtgttattagtagcaattcatacacttgttt

SEQ ID NO: 15514 - DNA, 941 bp, Humulus lupulus
ggaaaagttctaagcttcaaacatgagtaagcttcagagtgaagtcctcagagaggctattgctaccataatgaacgaatcaagggaaaagaagcgtaacttcactgagacaattgaactccagattggtttgaagaactacgatcctcaaaaggacaagcgtttcagtggttccgtgaagttgccccacattcctcgtcccaagatgaaggtttgcatgcttggagatgctcagcatgttgaggaggctgagaaaataggtttggactacatggatgttgaagggttgaagaagttgaacaagaacaaaaagctggttaagaagcttgcaaagaagtaccatgcctttttagcatcagaagctgttattaagcagattcctcgtcttttaggccctggtctcaacaaggccggtaaatttcccacccttgtaactcaccaagaatccctggagtctaaagtcaatgagactaaggccatggttaagttccagctgaagaaggttctctgtatgggtgttgctgttggaaacctctccatggaggagaagcaggtcttccaaaacgtgcagatgagtgttaatttccttgtttcactcttgaagaagaactggcaaaacgtgaggtgcttgttcctgaagaccaccatggggaagccacaacgcgtgttttaaacttttaatctatttttacatgtatggtggagttttgtagtgaggttttatgaggttgatacttatataaagtattcagatggaattctcaaagttgctgcattacttagctgtttaaggtttataacatcgacatatgttatgttaaaattactttttttattcttgttggataatcaattttttttgtctactcgtgcccctaatttttggaacacaagatacaattgtctttaatatttcgagaacgacaagccgtttagatttc

SEQ ID NO: 15515 - DNA, 1073 bp, Beta vulgaris
aaaaccctagcaatttctctggttttcgactttgctcaatctaagctttaatcatgagtaagcttcagggagaagctgtgagagaagctatatctggaattgcaaatgatgcgaaagagaagaatcgcaagttcacggagacaattgagctccagattggtttgaaaaattatgatccccaaaaggataagcgtttcagtggctctgttaagttgccacacatccctcgtcccaagatgaaagtttgcatgctcggagatgcacaacatgttgaagaggctgagagaataggtctagaatggatggatgtagaagcattgaagaaacttaacaagaacaagaaattggttaagaagcttgctaagaagtaccatgctttccttgcatctgaagcagttattaagcagattccccgtttgctcggtcccggtctcaacaaggcaggtaagttccccacacttgtcacccaccaagagccgttggaaaacaaagtaaatgagatcaaggctaccgtgaagtttcagctcaagaaagttctctgcatgggagttgctgttggtaactgtagtatggaagagaagcagatcttccaaaacgtgcaaatgagtgtcaactttcttgtttcactattgaagaagaattggcaaaatgtacgatgcttataccttaagagtaccatgggcaagccataccgcatcttctaagagattgcccatcgccatttttggttaaattggaagttttgttgatcgccttcgagtactacaattatatttgttgtgagctttagtatacttggattatgtcctcgaatgtaatggctaaaaaatttcttcttagtttcattgtccttggcaactttgatatctatgatattttgacccttttggcagttttgaatttccatttgttttaggagctatatatctttggacggtttatcttccattagttttaagataggttatgatattggcaattttaacgtagtacctcttggagttgttagatcgagctgtcgtgcttatttcatgagaagcatttggaaaatgtttatgaacagtatttattat

SEQ ID NO: 15516 - DNA, 1079 bp, Gossypium hirsutum
cggctagggttttctcttctctggtaaatgttatagttttgttcgtggaaagaacagagattcagagatgagtaagcttcagagtgatgcccttagagaagctatttcaaccattgtagctcagtccaaggagaagcagcgtaagtttactgagactattgaactccagattgggttgaaaaactatgatccccaaaaagacaagcgtttcagtggttctgtgaagttgccacacattcctcgccctaaaatgaagatctgcatgcttggagatgcccagcatgttgaagaggcagagaagataggtttggattatatggatgttgaagcactgaagaagctaaacaagaacaaaaagttggtcaaaaagcttgccaagaagtatcatgcttttttggcttctgaatctgtcatcaagcagatccctcgtctcctgggtcctggtctcaacaaagcagggaaattcccaacccttgttactcaccaggaatcgctagagtccaaagtgaatgagaccaaggcgatggttaagttccagctgaagaaggttctttgcatgggagttgccgttgggaatgttgcgatggaggagaagcagatcttccaaaatgtgcaaatgagtgtcaatttcctggtttcattgttgaagaaaaactggcaaaatgtgaggtgcctctacttgaagagtaccatgggcccatcaaacaggatcttttgagttatttacccatgtgttaagagttttgtatgtggacaaattttctgctatgttttgtcgttggaatcttagagttgtgattttgagacattggaagttttgttttgcatatcaacataaaatgtcaatttccatcttatttttaatcgttaaaaaaggccctaatgtggtggcatattggattggctcattggacatgctctatgatggcggaaaatagttatttgggcatggttatggctgtggttttgctggaaaaagaagatttgcatagtagggtttgaatgaactacattcattacaccatgaccgctgataatcttttagtaaataatcacgtcggaattctagctagttaggg

SEQ ID NO: 15517 - DNA, 1117 bp, Gossypium hirsutum
aggtttttctcatctcttgttggcggtgccggggatcgtacttactacctctttctctctaaaccctcttttaccgtaaaagtttattgtttgtggaaagagcagagattcggagatgagtaagcttcagagtgatgcgcttagagaagctatttcaaccattgtagctcagtcaaaggagaaacagcgcaaatttactgagaccattgaactccagattggtctgaaaaactatgatccccaaaaagacaagcgtttcagtgggtctgtgaagcttccacatattcctcgccccaaaatgaagatttgcatgcttggagatgctcaacatgttgaagaggcagagaagataggtttggattatatggatgtggaagcattgaagaaactaaacaagaataagaagttggtgaagaagcttgccaagaagtatcatgcctttttggcttctgaatctgtcatcaagcaaatccctcgtcttttgggtcctggtctcaacaaagcaggtaaattcccaacccttgtcactcaccaggaatcactagagtcgaaggtgaatgagacaaaggcaatggttaagttccagctgaaaaaggttctatgcatgggagttgctgttgggaatgttgcaatggaggagaagcagatcttccaaaatgtgcaaatgagcgtcaatttccttgtttctttgttgaagaaaaattggcaaaatgtgaggtgcctctacttgaagagcaccatgggtccttcaaacaggatcttttgagtttatgttttaccttctgttatgtacggactgaaagtagtagtggggatttaatactaaaagcagttttttttcttctcttttacttagaatgttcaagtttatgttatgttctgttgttccctagaaatgttatgaatatgagacattgaagttttgatttgcttatcagcttgagttttatgttagtgttaaattgccatctaatatttgcttagtccacacgaaaatcttccttagcaaatggttggcaattggcatccttgttaggcgtatggattttgactgctgattgtaaccatgtggtagaaatcctggaatgatactggccttggttttgatgtgaacttt

SEQ ID NO: 15518 - DNA, 916 bp, Gossypium hirsutum
ttttctcatctcttgttggcggtaaaattttattgtttgtggaaagaacaaagattcaaagatgagtaagcttcagagtgatgcgcttagagaagctatatcaaccattgtaactcagtcaaaggagaaacagcgcaaatttactgagaccattgaactccagattggtctgaaaaactatgatcctcaaaaagacaagcgattcagtggatccgtgaagctgccacatattcctcgccccaagatgaagatttgcatgcttggagatgctcaacacgttgaagaggcagagaagataggtttggattatatggatgtggaagcattgaagaaactgaacaagaataagaaattggtgaagaagcttgcgaagaagtatcatgcctttttggcttctgaatctgtcatcaagcaaatcccacgtcttctgggtcctggtctcaacaaagcaggtaaattcccaacccttgtcactcaccaggaatcactagagtcgaaggtgaatgagacaaaggcaatggttaagttccagctgaagaaggttctatgcatgggagttgctgttgggaatgttgcaatggaggagaagcagatcttccaaaatgtgcaaatgagcgtcaatttccttgtttccttgttgaagaaaaattggcaaaatgtgaggtgcctctacttgaagagcacaatgggtccttcaaacaggatcttttgagtttatatgtttaccttctgttatgtacggactgaaagtagtagtggggatttaatactaaaatcagtttttttcttctcttttacttgttcaagtttatgttttgttctgttgttccctagaaatgttatgaatacgagacattggaatattgatttgcttatcaactttggttttacattatttgcttaatccacacgaaaa

SEQ ID NO: 15519 - DNA, 839 bp, Gossypium hirsutum
gcggctagggttttctcttctctggtaaatgttatagttttgttcgtggaaagaacagagattcagagatgagtaagcttcagagtgatgcccttagagaagctatttcaaccattgtagctcagtccaaggagaagcagcgtaagtttattgagactattgaactccagattgggttgaaaaactatgatccccaaaaagacaagcgtttcagtggttccgtgaagttgccacacattcctcgacctaaaatgaagatctgcatgcttggagatgcccagcatgttgaagaggcagagaagataggtttagattatatggatgttgaagcactgaagaagctaaacaagaacaagaagttggtcaaaaagcttgccaagaagtatcatgcttttttggcttctgaatctgttatcaagcagatccctcgtctcctgggtcctggtctcaacaaagccgggaaattcccaacccttgttactcaccaggaatcgctagagtccaaagtgaatgagaccaaggcgatggttaagttccagctgaagaaggttctttgcatgggagttgccgttgggaatgttgcgatggaggagaagcagatcttccaaaatgtgcaaatgagcgtcaatttcctggtttcattgttgaagaaaaactggcaaaacgtgaggtgcctctacttgaagagtaccatgggcccatcaaacaggatcttttgaattggtagttacccatgtgttaagagttttgtatgtggacaaattttctgctatgttttgtcgttggaatcttagagttgtgattttgagacattggaagttttgttttgcatatcaaca

SEQ ID NO: 15520 - DNA, 813 bp, Cucurbita pepo
ggactgaagtgtagagcatctttgcaaaggcgaagattcgaatatgagtaagcttcagagtgaggcattgagagaagctatctcatctatcttcactgatagcaatgagaaaaagagaaattttactgagaccattgagcttcagatcgggctgaagaactatgaccctcaaaaggacaagcgtttcagtggttctgtgaagttgccgcacattccccgtcccaagatgaagctttgcatgcttggagatgccttgcacgttgaggaggccgaaaagattggtctagactacatggatgtggaaggcttgaagaagctaaacaagaacaagaaattggtgaagaagctcgccaagaaataccatgcctttttggcatctgaggctgtaattaagcagataccacgtcttctcggccctggtctcaacaaagcaggaaagttcccaacattggtgacacaccaagaatcgctggaatcgaaagttaacgagaccaaggcaatggtcaaatttcaacttaagaaggttctgtgcatgggggttgccgttgggaatgttgccatggaggagaagcaagtcttccaaaacgtgcaaatgagcgttaatttcctggtttcgttgttgaaaaagaactggcagaacgttaggtgcctgtacctgaagagcacaatggggaagtcataccgggttttctaagctctgttaggaaacttgtcaatcttgtgttcgttccttttatcgttgaagttattttctcgaagagcagttttgtgaattgagcgtttttggatatgattcttgaattaagaaacaaa

SEQ ID NO: 15521 - DNA, 961 bp, Cucurbita pepo
tttcgtttcttcttaccagccagtttgtagctgctgcttagggaagacaaggctccgaaaatgagcaagcttcagagcgaagcgttgagagaagccatttcctctatcttcggtgatagcagtgaaaagaaacgcaactttactgagaccattgaacttcaaattggactcaagaactatgatccacagaaggacaagcgtttcagtggatcagtgaagttgccccatatccctcgccctaagatgaagatttgcatgcttggagatgctttgcacgttgaagaggcagagaagattggtttagattatatggacgtggaaggtctgaagaagctaaacaagaacaagaaattggtgaagaaacttgccaaaaaatatcacgcctttttagcttctgaagctgttatcaagcaaattccccgtcttctgggccctgggctcaacaaggcaggaaagttccctacccttgttactcaccaagagtcccttgagtctaaagtaaatgagacgaaggcaatggttaagtttcagttgaagaaggttctttgcatgggtgtggccgtgggcaatgttgccatggaggagaagcaagtttttcagaacgttcaaatgagtgtcaatttcctcgtttccttgttgaaaaagaactggcaaaacgtgagatgcttgtacctgaagagtactatggggaaggcatatcgagtcttctgaggaattttcaaaacttagaacagtactgtttgctcttaaattgaagaaccaggttgagatgaaaattctatgtttatgattgatgaaaatttcctgtttgttcttttttgttattaaaccattagctgcacaatcgttaacacttatgatgggtgtaatgctttttatttttccatcttgtttcacgatacatgttttgtagatgtattttttaaaaaagtatgattcatatctcataattcaaacaaac

SEQ ID NO: 15522 - DNA, 958 bp, Euonymus alatus
tctcactggtagcagccgcgagttcaagctctagctagggtttctttcccctttaggacaactatcggcaagcgggcttttttgaagggcaaacatgagtaagcttcagagtgatgccctgagagaagctatcacaaccattgtaaaagagtccacagagaaaaagaaaaactttgttcagactattgaacttcagattgggttgaagaattatgatccccaaaaagataagcgtttcagcggttctgtaaagttgcctcatattcctcgtccaaaaatgaaagtatgcatgcttggagatgctcagcacgtagaacaggcagagaaaataggtttggattatatggacgtggaagcattgaagaagctaaacaagaataaaaaacttgtcaagaagctcgccaagaagtaccatgcttttttggcttcagaatctgtcatcaaacagatccctcgtcttttggggcctggcctcaacaaggcaggtaagtttcctacacttgttagtcatcaagagtcccttgagtcgaaagttaacgagactaaggcaacggtgaagttccagttgaagaaggttctctgcatgggagttgctgtgggaaatgtctctatggaggagaaacagatatttcagaatgtgcaaatgagtgttaacttccttgtttccttgttgaagaagaactggcagaatgtgaagtgcctttacctgaagagcaccatgggcagtccaaaccgcatcttctaagttatttttcccccccgttgaatttgtgtaaagagagaactagtgcgacaaatgcctaaaaagtgtttggcagaatggtcatgccttctgtttggctggtcactttttttccccttgcgactagtgttaaaatattgacacatgcacaagattttgtgggagaagttgatttttttgcattctaattttggagctcaactggagcttttagag

SEQ ID NO: 15523 - DNA, 771 bp, Euonymus alatus
ggcagctgcgagttctagctctagctagggtttctctcccctttggacaactatcggcgaacgggcttgttggaagggcaaacatgagtaagcttcagagtgatgccctgagagaagctattacaaccattgtgaaagagtccacagagaaaaagaaaaactttgttcagactattgaacttcagattgggttgaagaattatgatccccaaaaagataagcgtttcagcggttctgtaaagttgcctcatattcctcgtccaaaaatgaaagtatgcatgcttggagatgctcagcacgtagaacaggcagagaaaataggtttggattatatggacgtggaagcattgaagaagctaaacaagaataaaaaacttgtcaagaagctcgccaagaagtaccatgcttttttggcttcagaatctgtcatcaaacagatccctcgtcttttggggcctggcctcaacaaggcaggtaagtttcctacacttgttagtcatcaagagtcccttgagtcgaaagttaacgagactaaggcaacggtgaagttccagttgaagaaggttctctgcatgggagttgctgtgggaaatgtctctatggaggagaaacagatatttcagaatgtgcaaatgagtgttaacttccttgtttccttgttgaagaagaactggcagaatgtgaagtgcctttacctgaagagcaccatgggcagtccaaaccgcatcttctaagttattttaccccacgttgaatttgtgtaaagagaga

SEQ ID NO: 15524 - DNA, 871 bp, Brassica napus
gcgagaaactcaagatgagtaagcttcagagcgaggctcttagagaagccatcacaaccatcaagggcaaatctgaggacaagaagcgtaactttgtggagacggttgagcttcagattggtctgaagaactatgacccgcaaaaggacaagcgtttcagtggatctgtcaagctcccgcacattcctcgccctaagatgaaggtctgtatgcttggagatgctcagcacgttgaggaggctgagaagatggggctagactctatggatgttgaggctttgaagaagctcaacaagaacaagaagcttgttaagaagcttgcgaagaagtaccatgctttcttggcttctgagtcagtcatcaagcagattccccgtcttcttggtcctggtcttaacaaagctggaaagttcccaacgctagtgagtcaccaagagtccttggaagggaaggtgaacgagaccaaagcgactgtgaagttccagttgaagaaggttctgtgtatgggtgttgctgttggtaacctttccatggaagagaagcagctctttcagaatgttcagatgagcatcaacttccttgtctcgctcttgaagaagaattggcaaaacgtgaggtgtttgtacttgaagagcaccatgggaccaccacaaaggatcttttgagttctctactatttcatcttcgaacttttgcgttgtggtttttgtttgtttcagagatcttgagttatggttttgtttggtattagcagaactgaagtgttagtttgctttttgtcaagacattataatatgcattgttggattctaccatatcgactctccagttcaattttatctttatacaaattaaaaaaaaaacagtacgt

SEQ ID NO: 15525 - DNA, 1074 bp, Trigonella foenum-graecum
tctgtagcagcaagccaccgattcaatcaaaatgagtaagcttcaaagtgaggcagtgagagaagcgatctcaggaatcatgggtgattccaaggagaaaaaccgtaagtttgttgagaccattgaacttcaaattggtctcaagaactatgaccctcaaaaggataagcggttcagtgggtcagttaagttgccacatattcctcgtcctaagatgaagatttgtatgctcggagacgcccaacatgttgaagaggcagagaagataggtttggaatcgatggatgttgaagctttaaagaagctaaacaaaaataaaaaattggtgaagaagctcgccaagaagtaccatgctttcttagcttctgaggcagtcattaagcagattcctcgacttttgggtcctggtctcaacaaggcaggaaagttcccaacacttgtctctcaccaagaatctcttgaggggaaggttaatgagacaaaggctatggtgaaatttcagcttaagaaggtactctgcatgggagtggccgtgggtaatgttagcatggatgaaaagcaaatctttcaaaacgttcaactcagtgtcaacttccttgtctccttgttgaagaagaattggcagaacgtacgctgcctgtatttgaagagctccatggggaaatcgtaccgtgtcttttaagggaacttatttccatttttcaatattcagtgaacttgtcatcaccttcaatacatttgtcctaatagcttgatagaaatttcatcttattacagttttcctggatcatttatggataagttttgttttatgtttcaaatatttcataattttagtcgtgctattattggtgctactcctatctgattggcgttgaacttgtttatgaaatccaatgaagtgaacattgcaaaatttcggagaaatgcaagagataaccacgcatacggagaaaataaccctatttaaagttgctttttaattactttttatactatcaattgaaccccatttacggtgtctcgtgacacttgccgtcaaaattatgctatatcaattttattgttattaac

SEQ ID NO: 15526 - DNA, 1255 bp, Pinus pinaster
agacacatagaccaaactacaggatctgactcggactccaatcaatggtattaacatgtgaacatgagtgggttttgtgcaaaaccctagcctggccttcatagtatcatatttgttacctttgcagtgtcaattggacgagggcagcacgagaacgaccaagaggcacaggtagaggaagcaaggcgccccttacctgtaaacaatgagtaagcttcagagcgacgtgttgagggagggaataactcaggtaatgggagaaagcaaggacaaaaaacgaaaatttacagagacgatagagttacagatcgggctgaagaactatgacccccaaaaggacaagcgtttcagtgggtccgtaaaattgccccacattccccgccccaagatgaaggtctgcatgctcggagatgcccaacacgttgaagaggctgagaagatcagtctggactacatggatgttgagggtctgaagaaaatgaacaagaataagaaacttgttaagaagcttgctaagaagtaccatgcatttcttgcttcagaagcaattattaaacaaattccaagactccttggacctggtctgaacaaggcaggtaaatttcccactcttgtttcacaccaagagtccttggaggccaaggtgaatgagacaaaggcaatggttaagtttcaattgaaaaaagttctatgtatgggggttgctgtggggaactgtggaatggaggagaagcaggtgtttcagaatgttcaattgagtgtgaacttcctggtatccttgctgaagaaaaactggcaaaatgttcgatgcttgtatctgaagagtaccatgggcaagccagcacgtgtattctgagtagtgcaattttggtgctagcttgtgttggttgcatatggagaggacttttccttgtttttttgttacgtttggtcaggacattacatttttgttttaggggtatgttacccaagtggctttaatctcgggcattttggagtaaaagggaatttaattattattttactattctgttattgtaacttcggcatgcttctctttctttattcaagtaatcagaattgagtaaatactaaacccagttttttttgtacttttgaaataggcatattcattattgtgtatgcgggagagaactgttattgtttgatatattcctggtttgatttccgaaatggacgttacaggcatactgtgaatactgaaaacaaactagaagagggtacacctgtttac

SEQ ID NO: 15527 - DNA, 867 bp, Cucurbita pepo
cacaggactaagtgtatagtgtccttgagacggcgaagattcgaaaatgagtaagcttcagagtgaagcattgagagaagccatctcatctatcttcactgatagcaatgagaaaaagaggaagtttaccgagaccattgagcttcagatcgggctgaagaactatgatcctcaaaaggacaagcgtttcagtggttctgtgaagttgccccacattccccgccccaagatgaagatttgcatgcttggtgatgccttgcacgttgaagaggccgaaaagattggtctagactatatggacgtggaaggcttgaagaagctaaataagaacaagaaattggtgaagaagctcgccaaaaataccacgcctttttggcttctgaagctgttatcaagcagatccctcgtcttctgggccctggtctcaacaaagcaggaaaattcccaacattggtgacacaccaagaatcgcttgagtccaaggttaatgagaccaaggcaatggttaagtttcaactgaagaaggttctttgcatgggagtggccgtgggaaatgtcgccatggaggagaagcaagtcttccaaaatgttcaaatgagcgtcaatttcctggtttctttattgaaaaagaactggcagaatgttaggtgcctgtacctgaagagcacaatggggaagtcgtaccgggttttctaagctctgttagcaatctagtcagttttatgtttgatctttttactgttgacgttatttttgaagagcagttttgtgaattgagcgtttttgattgaatgattcttcaacaaagaaacaaggatgctttttgtcctttaaaagacaattgataatgaagtttttattcccatc

SEQ ID NO: 15528 - DNA, 940 bp, Vinca minor
tttcttccttcagtagtcttccatagagttaatccgtgaagatcaagactgatccttcacaatgagtaagctacagagtgatgctgtgagagaagccatttctcagattgttgctgactgtaataaagaggataagaaacgtaagtttactgagaccgttgagcttcagattggactgaagaactatgacccccaaaaggacaagcgtttcagtggctcagtcaaactgccacatatccctcgccccaagatgaaggtttgcatgcttggtgatgctcagcatgttggagaggctgaaaagattgggctcgagtacatggatgttgagggtttgaaaaaacttaacaagaacaagaaacttgttaagaagcttgccaagaagtatcatgctttcctggcatctgaggcagttatcaagcagattccccgtcttctgggtcctggtcttaacaaggcaggtaaatttcctacattggtcagtcatcaggaatccttggagtcgaaagtgaatgaaataaaagccacagtgaagtttcaactcaagaaggttctttgcatgggtgttgctgtgggcaatttgtccatggaagagaagcaaattttccagaatgttcaaatgagcgtcaactttctcgtatcactgctaaagaagaattggcaaaacgtgaggtgcttgtatcttaagagtaccatggggaggcctcaacgtatcttctgagcagttgttcttatttactttgttttaagatcagtttagtgcatgtcaaagagttggcatctgaacacacttcgtggtgaatgtcccgaatatttttgcttactttttaaaatgtattctgtgattttgaaccttgctatgaaattttatatttacctttgtcaacgcttataattgtaagacagttattacaggttggtgggcgtttgaacagtaaattga

SEQ ID NO: 15529 - DNA, 894 bp, Vinca minor
cagtcttccatagagggtctctctctctcgaacatctcataggcagtgcacttgtggaaagctagactgaattttcaccatgagtaagctgcagagtgatgctgttagagaagcaatttctcagattgttgctgactgtaataaagaagataagaaacgcaagtttactgagactgttgagcttcagattggactgaagaactatgacccacaaaaggacaagcgtttcagtggctcggtcaaactgccacatatccctcgtcccaagatgaaggtttgcatgcttggtgatgctcagcatgttggagaggctgagaagattgggcttgaatacatggatgttgagggtttgaagaaacttaacaagaacaagaaacttgttaagaagcttgcgaagaagtatcatgctttcctggcatctgaagcagttatcaagcagattccccgtcttctgggccctggtcttaacaaggcaggaaaatttcctacactggtcagtcatcaggaatccttggagtcgaaagtgaatgaaataaaagccacagtgaagtttcaactcaagaaggttctttgcatgggtgttgctgtgggcaatttgtccatggaagagaagcaaattttccagaatgttcaaatgagtgtcaactttcttgtatcactgctaaagaagaattggcagaatgtgaggtgcttgtatctgaagagtaccatgggaaggcctcaacgtatcttctgagcagttgtttttattcactccgttttaagttcagtttagtgcgaatcaaaagagttggcagtttaatacacttttgtggtgaatgtgtggaatatttttacttaattttttaaatggattctgcaattttgaacctatcaatgaaattctagtttcct

SEQ ID NO: 15530 - DNA, 1027 bp, Brassica rapa
gccgttctctctctctgtttccgatcttccacaggtggaacagtatctgagaaactgccaaaatgagtaagctccagagtgaagccgtgagagaggcgatctcctcaatgatcactcactgcaaggagacaaagccacgcaagttcaccgagaccatcgaactccagattggtctcaagaactatgacccacaaaaggacaaacggtttagcggatccgttaagttgcctcacattccaaggcccaagatgaagatctgcatgctcggtgacgcccagcacgttgaagaggctgagaagattgggttagactctatggatgttgaagctcttaagaagttgaacaagaacaagaaacttgttaagaagctagccaagaagtttcatgctttccttgcttctgagtctgtcattaaacagattcctcgtcttcttggtcctggtctcaacaaggcaggaaagttccctacacttgttagccaccaagagtctttggaggccaaggtgaatgagactaaggcaacagtgaagttccagctcaagaaggttttgtgcatgggtgtcgctgttgggaatctcggcatggaggagaagcagatcttccagaacgttcagatgagcgttaacttccttgtttcactcttgaagaaaaactggcaaaacgtgaggtgtttgtacttgaagagcacaatgggtccaccaaaccgtgttttctaagatgtttttatctcaaagtttctctcaaggtgtcatcagactgagaggaaatttgattttcttctcagtcatgagccttcttcttggattacttcctgaatctttactttgtaggatcaagcttttgtttaaagacaattttgtttctgttattattagtgggattttctctattttaagtttttaagatttgcgattatgtgaagacaacacatcgtttgaagtttagtctggtttgattatgagtcaaaacaaatgatccgtcctgtctttactttaacattcctctaatcaaccgaacatgattctta

SEQ ID NO: 15531 - DNA, 962 bp, Coffea canephora
cggccggggggtccctgaaaaccctacaaataaattcccaccctcgcctcgccgctctactctctgctagtcggctcttgcagaactcccccaccattcaggataatcgcctaggcaagacgagacagaatttctcaccatgagcaagctacagagtgatgctgttagagaggcaattggcgtaattatgaccgaagctaagggtgataaaaagcgtaacttcaccgagactattgagcttcagattggtttgaagaactatgatccccagaaggacaagcgtttcagtggctctgttaaattaccacacattcctcgacccaagatgaaggtttgcatgcttggtgatgctcagcatgttgaagaggcagagaagattggtctggaatatatggatgttgaagggttgaagaaactcaataagaacaagaaattggtgaagaagctggcaaagaagtatcatgctttcttagcctctgaagcagtcatcaagcagattcctcgtcttctgggccctggtctaaacaaggcaggaaagttccccacgcttgtgactcatcaggaatctttggagtcaaaagttaatgagactaaagcaacagtgaaattccagcttaagaaggttctttgtatgggtgttgctgtgggtaattgtgatatggaggagaagcagatcttccagaatgtccaaatgagtgtcaactttcttgtctcattactcaaaaagaattggcaaaatgtgaggtgcttgtacctgaagagtaccatgggaaagccaaatcgcatcttttgagctgtattggttttgctttgttttgaatcagtttagcaagattaagagtgttggccaagtaatacatttttcagcgaatgtttcagatatttttgtttccttgctatgttgatttgttggttctcaaaactaagaatgaaattttagttacagttgaccccttttgggt

SEQ ID NO: 15532 - DNA, 1495 bp, Brassica napus
aggcaaataattctttcatgtattcatagctccctttggaagaacatttacctgggaaaagcttagctaattgtaaactgacgtttgaagctttgcatagttcagagtttgagacaaaaaaaaagaaacggataagagttagatagaacttttgtttgtattttgggcttggaagtatataatagccagcaaacacccaattgttggatattttaaatatgggcctatatcatattgggctttccattagttgaaacagaatgggcttagggtttcgttcccttctgtcttgctcatatatcatataagttgcacaaaccttctttcgctgtttccgatcttccacaggtattcattcttcttcgtcttcatcgaaacgtttctccttgtgatctgacatcctcttgactttacgtttcaggtggaacagtatctgagaaactccccaaaatgagtaagctccagagcgaagccgtgagagaggcgatatcctcaatgatcacccactgcaaggagacaaagccacgcaagttcactgagaccatcgaactccagattggtcttaagaactatgacccacaaaaggacaagcggtttagcggatccgttaagttgcctcacattccaaggcccaagatgaagatctgcatgctcggtgacgcccagcacgttgaagaggctgagaagattggattggactctatggatgttgaagctctcaagaagttgaacaagaacaagaaacttgttaagaagctcgccaagaagttccatgctttccttgcttctgagtctgtcattaagcagattcctcgtcttcttggtcctggtctcaacaaagcaggaaagttccctacacttgttagccaccaagagtctttggaggccaaggtgaatgagactaaagcaacagtcaagttccagctcaagaaggttctctgcatgggtgtcgctgttgggaatctcggcatggaggagaagcagatctttcagaatgttcagatgagcgttaacttccttgtttcgctcttgaagaaaaactggcaaaacgtgaggtgtttgtacttgaagagtacaatgggtccaccaaaccgtgttttctaagatgtttttatctcaaagtttctcccaaggtgtcatcagactcggaggacaattgatgagccttcttcttggattactttgtaggatcaagcttttgtttcattacagttttgtttctgttattattagtgggattttctctattttgagttttcaagatttgcgatttcgtgacaaacacattgtttagactttaaagcttagtcttggactcttggatgaatttgaccaatcaaatggtccgtcttttctttacttaacattccttgaatcaaccaaactagattcttagtcagtgcaacaatatttgatttgatttttttactgtggtatatcgattttggctttcacttaaaccgaaagacataaacttgctttttttactctgttt

SEQ ID NO: 15533 - DNA, 893 bp, Brassica napus
ggtttccgatcttccacaggtggaacagtatctgagaaactgccaaaatgagtaagctccagagtgaagccgtgagagaggcgatctcctcaatgatcactcactgcaaggagacaaagccacgcaagttcaccgagaccatcgaactccagattggtctcaagaactatgacccacaaaaggacaaacggtttagcggatccgttaagttgcctcacattccaaggcccaagatgaagatctgcatgctcggtgacgcccagcacgttgaagaggctgagaagattgggttagactctatggatgttgaagctcttaagaagttgaacaagaacaagaaacttgttaagaagctagccaagaagtttcatgctttccttgcttctgagtctgtcattaaacagattcctcgtcttcttggtcctggtctcaacaaggcaggaaagttccctacacttgttagccaccaagagtctttggaggccaaggtgaatgagactaaggcaacagtgaagttccagctcaagaaggttttgtgcatgggtgtcgctgttgggaatctcggcatggaggagaagcagatcttccagaacgttcagatgagcgttaacttccttgtttcactcttgaagaaaaactggcaaaacgtgaggtgtttgtacttgaagagcacaatgggtccaccaaaccgtgttttctaagatgtttttatctcaaagtttctctcaaggtgtcatcagactgagaggaaatttgattttcttctcagtcatgagccttcttcttggattacttcctgaatctttactttgtaggatcaagcttttgtttaaagacaattttgtttctgttattattagtgggattttctctattttaagtttttaagattt

SEQ ID NO: 15534 - DNA, 906 bp, Raphanus sativus
gggttctctctctctgtctccgatctatcacaaaggagagaatagaggaagtgccaaaatgagtaagctccagagtgaagcagtgagagaggcgatatcgtcaatcatcactcactgcaaggagacaaagcctcgcaagttcaccgagacaatcgagctccagattggtcttaagaactatgaccctcaaaaggacaagaggtttagcggttccgttaagctgcctcacattcctaggcctaagatgaagatttgcatgctcggtgacgcccagcacgttgaagaggctgagaaaattgggttagagtctatggatgtggaagctcttaagaagctgaacaagaacaagaagcttgttaagaagctagctaagaagttccatgctttccttgcttctgaatcggtcatcaagcagattccccgtcttcttggtcctggtctcaacaaggcaggaaagttcccaactcttgtcagccaccaagagtctttggaatccaaagtgaatgagacaaaggcaacagtgaagttccagctcaagaaggttctttgcatgggtgtcgctgttggaaatctcggcatggaggagaagcagatcttccagaatgttcagatgagcgtcaacttccttgtttccctcttgaagaaaaactggcaaaatgtgaggtgcttgtacttgaagagcacaatgagtccacccacccgtgttttctaagatttttgttttatcttttaaggtatcataagaaatttgattttcttttgtcatgagccttcttcttcttcttggattacttccagaactctgtaggatgatcaagattttgtttaaagacatttttatttttactattgttattgctctttggttggtgttctctatttatctactcaatcttattattacca

SEQ ID NO: 15535 - DNA, 899 bp, Raphanus sativus
gttctctctctctgtctccgatctatcacaaaggagagaatagtagctctcaggaagtgccaaaatgagtaagctccagagtgaagccgtgagagaggcgatatcgtccatcatcactcactgcaaggagacaaagcctcgcaagttcaccgagacaatcgagctccagattggtcttaagaactatgaccctcaaaaggacaagaggtttagcggttccgttaagctgcctcacattcctaggcctaagatgaagatttgcatgctcggtgacgcccagcacgttgaagaggctgagaagattgggttagagtctatggatgtggaagcacttaagaagctgaacaagaacaagaagcttgttaagaagctagctaagaagttccatgctttccttgcttctgaatctgttattaaacagattccccgtcttcttggtcctggtctcaacaaggcaggaaagttcccaactcttgttagccaccaagagtctttggaatccaaagtgaatgagaccaaggcaacagtgaagttccagcttaagaaggttctttgcatgggtgtcgctgttggcaatctcggcatggaagagaagcagatcttccagaatgttcagatgagcgtcaacttccttgtttccctcttgaagaaaaactggcaaaatgtgaggtgcttgtacttgaagagcacaatgagtccacccacccgtgttttctaagatttttttgttttatcttttaaggtatcataaaagaaatttgattttctttttgtcatgagccttcttcttcttcttggattacttccagaactctgtaggatgatcaagattttgtttaaagacatttttatttctactttgttggtgttctctatttatctactcaatcttattatta

SEQ ID NO: 15536 - DNA, 916 bp, Valeriana officinalis
tctttgccgcacctcaaaactagggttcttcgtccagttgcgaagcttaatctccaaacatgagtaagctacagagtgaggctctgagagaagcaatcactcagattgctggagatgcccgaggtgataagaagagaaatttcacagagacgattgagcttcagatcggtctcaagaactacgatccacaaaaggacaaacgtttcagtggctctgtcaaattgccccacattcctcgtcctaagatgaaggtttgcatgcttggagatgcccagcatgttgaagaggcagaaaagattggtttggaatacatggacgtagaagggctaaagaagctaaacaaaaacaagaaattggtcaagaaacttgctaaaaagtaccatgctttcttagcttctgaggctgttatcaagcaaattccccgtcttctcggccctggtctcaacaaagcaggaaagtttcctactcttgttactcaccaagaatcactggagtctaaagtgaacgagattaaagcgacagttaagtttcagttgaagaaagttctgtgtatgggagttgctgttggaaattgcgctatggatgacaagcaaattttccagaatgtgcagatgagtgtcaattttctcgtctctttgttgaagaaaaactggcaaaatgtgagatgtttgtacttgaagagcaccatgggaaagccgcagcgcatcttttaagctcaagtttgttttttcaattaggttaaacttattttgagcacttatcaaactttgatatatttctatcattacttgagattttgtgttgattttcatatttggtaatctattctcctttggtttttatgtttgtaagttggatttatcaaagattgatcatgaaggttagaatttcatcaattattgcaatcgttactagt

SEQ ID NO: 15537 - DNA, 875 bp, Valeriana officinalis
gggaggtttaattttcaaacatgagtaagctacagagtgaggctctgagagaagcaatcactcagattgctggagacgcaagaggtgataagaagagaaatttcacagagacgattgagcttcagatcggtctcaagaactacgatccacaaaaggacaaacgtttcagtggatctgttaaattgccgcacattcctcgtcctaagatgaaggtttgcatgcttggagatgcccagcacgttgaggaggcagaaaagattggattggaatacatggacgtggaagggctaaaaaagctaaacaagaacaagaaattggtcaagaaactcgccaaaaagtaccatgctttcttagcttctgaggctgttatcaagcaaattccccgtcttctaggccctggtctcaacaaagcaggaaagtttcctacacttgttactcaccaagaatcactggagtctaaagtgaacgagattaaagcgacagttaagtttcagttgaagaaagttctgtgtatgggagttgctgttggtaactgcgctatggatgataagcaaattttccagaatgtgcagatgagcgtcaatttcctcgtctctttgttgaagaaaaattggcaaaatgtgaggtgtttgtacctgaagagcaccatgggaaagccccagcggatcttttgagctctttcaattaggttaaacttgttttgagcacttatcaaactttgagatatttttatcactacttgaaattttgtgtgttgattttcgtttctggtaatctgttcttggatttttgtgtttgtaagttgaatttatcaaaaattgatcatgaaggctagaattttatcaattattggaatcttcatttctcctcaaaaa

SEQ ID NO: 15538 - DNA, 864 bp, Curcuma longa
gcctcaggtttgaaggaggaagacgtagacgtgaaaaatgagcaagttgcagagtcatttactcagggaagcaatctctctgatgttggcgattgtctagagaagaagcgcaacttcactgaaacaattgagttgcaaattggtctgaaaaattatgatccccaaaaagatcagcgattcagtggttctgtgaagctcccacacattccacgccctaaaatgaaagtttgcatgttgggtgacgcacaacatatcgaggaggctgagaagataggacttgattacatggatgttgaaagtttgaaaaagatgaacaaaaataagaagcttgtcaagaaacttgctaagaagtaccatgctttccttgcatcagaggctatcattaagcagattcctcgtcttcttggtcctggccttaacaaggcagggaaatttcccacattggttactcaccaagaaactttggaatctaaagtcaatgagaccaaggcaatggtaaaatttcaactgaagaaggtgctttgcatgggtgttgcagttggcaacgttgccatggaggaaaagcatatttttcagaatgtgcaaatgagtgtgaatttacttgtgtcattgctgaagaagaactggcaaaatgtgagatgcctgtatctgaagagcacaatggggaaaccatctcgcattttctaactcattgcttgctcgggttggccatcaaagagatcatatttctctgtttttccccttgaactatgttcagagttggatcgtagaaactttatgttgttgctgtcttaacattctgtggattttgaatgatttgctattcaagtgtgataaatttgctgtttcatttaacacaaaaac

SEQ ID NO: 15539 - DNA, 1002 bp, Secale cereale
gccgccgccgctccccaaaccctagaccagccaggtgaatcggcgaccggcgaatcgacccgtcccggccggtcgagccatgagtaagctctcgaccgaagccctcaagggaggccatcacccaggtggtggcggatgccaaggagaagaacaggaagttcaccgagacggtcgagctccagatcggcctcaagaactacgacccgcaaaaggacaagcgtttcagtggctccgtcaagctgccccatgtccctcgccccaagatgagggtctgcatgcttggtgatgcccagcatgtgggagaggctgacaagattggtcttgattccatggatgttgaagctcttaagaagatgaacaagaacaagaagcttgtcaagaggcttgccaagaagtaccatgctttcttggcctctgaggctattatcaagcagattccacgtctccttggtcctggtctgaacaaggcaggaaagttcccgaccctggtttctcaccaggagtctctggaagccaaggtgaacgagacgaaagccacaatcaagttccagctcaagaaggtgctgtgcatgggcgtcgccgtgggcaacctgtcgatggaggagaagcagatccagcagaacatccagatgagcgtcaacttcctggtttccctgctcaagaagaactggcagaacgtgaggtgtctgtacatcaagagcaccatggggaagcccgtccgggtgttctaagctcgtgccccagccgccctatatctatgctacctacagtactggacctcctttctatgttcaagcttaaatatgtctactttttatggccaaggcctcctgacactatttatggtcatattgtgaacattaaccaaaaaaattgtaattgtttcaaaaaattctgaatatttgtgtggatgtctgtgttactgtcgcaagtatgcttgacaattttcatgtgagaaggagcagtagtgttttgtcggtgaataaaaatacaaatttaggg

SEQ ID NO: 15540 - DNA, 1045 bp, Picea glauca
cctcaggattttatttgtgactattcgagggtcgtttggagaagagcagcagtaggacgacgaagaagaggcagaggcagaggaagcaaggcgcccctcctgtaaacaatgagtaagcttcagagtgacgtgttgagggagggaataactcaggttatgggagaaagcaaggacaagaagcgaaaattcacagagacaatagagttacagatcgggctgaagaactatgacccccaaaaggacaagcggttcagtggctctgtgaagttgcctcacattcctcgccccaagatgaaggtttgcatgcttggagatgcccagcatgtggaagaggctgaaaaattaggcttggattatatggatgtggaaggactcaagaaaatgaacaaaaacaagaaattagttaagaagcttgcaaagaaatatcatgcctttcttgcttcagaagcaatcatcaaacagatacctcgacttcttgggcctggtctcaacaaggctggcaaatttcctacccttgtatctcaccaagagtccctggaggggaaagttaatgaaacctaagcaactgtcaaattccaattaaaaaaggtactatgtatggggttgctgtgggaaactgtggaatggaagaaaagcaattttttcagaatgtgcaattgagtgttaacttccttgtatcactactgaagaagaactggcagaatgtaaggtgcttatatttgaagactaccatgggaaagcctaaccgcattttctgagtgcggaacagagcggagatatttcaatggcacttccttttgtataactattaaacataggttatgtttatttagtttcgaccaaacaaatcagttttaatgcaactacttacgaattgaggaagagatgtgctggtaaattgctgttttgaacaataagagttgttttctattgaaatagctctggtcatggttttagaccttaaacctaacattcaatgttttaaaatcatgccgtggtcgtgaagtctatcttgattttcttataatgtcatattgttagagag

SEQ ID NO: 15541 - DNA, 1376 bp, Aquilegia formosa
aagcagtaagcgctctctctctctctctcgccttgtatctatttccaaattcacaaaaggatgaaatagatgttagatctgtttaatagaacatcagatctacttgttatttgaagctctagtaccaatttctaacttcgattgatttctcaataggttttttttttttttttttttatcagttgaagtggtttgggaacgagaaattctgaaatatgagtaagcttcagagtgatgtactacgagaaggtatctcacagattgtcaatgaatccaagcaaaaagaacgcaagtttgtaggaacaattgagctccagattgggttgaagaattatgacccacaaaaagacaagcgtttcagtggatctgtgaagctgccacatatccctcgtcctaagatgaaggtctgcatgcttggtgatgctcagcatgttgaagaagcggaaaagattggattggaatatatggatgtagaggggctcaagaagctgaacaaaaacaagaagttggtcaagaagcttgcaaagaaattccatgcttttcttgcttcagaagctgtcatcaagcaaattccccgtcttctgggccctggtctgaataaggcaggaaagttcccaactcttgtaactcatcaagaatctcttgagagtaaagtcaatgaaaccaaggctatggtgaagttccaactgaagaaagtactatgcatgggagttgctgtggggaaccttggaatggatgagaagcagatatttcaaaatgtccaactcagtgtcaacttccttgtatctttgttgaaaaagaactggcaaaatgttcgatgcttgtatctgaagagcacaatggggaagccattccgcatcttctaaggactttacttacttcattatatgggcagtgttgaagcaaccttgagcaaattttttgttctatttgtggaaattttgtttaatgttctctttgaccttatgacgtggataacagttttgaagttcttttatggatacgattgtgatctgacttttaaattacatttcatatgttgatgttttgtactctggatccccagtcttgggcatgtagtaaattatctttaatttgcagcaatgctttgtatacccagaaacgtgcaggagtgagcagatgatctatggccttttctgccagaaataatacacgttcacatctaatatggatgataatagcatctgatgacctagcaatagtaaatttgatgtgcaactgatatttatgcatatagttatagtctgccaatagtgggagaatggcgttcgtatgctttatgactccagctagacttccccacttcgaaagatattgatatgtttttaaggcttagctaattgtcagttgcaact

SEQ ID NO: 15542 - DNA, 1820 bp, Amborella trichopoda
ataaatgcaggcttcgagagaaggagagagaggcttggcctctctttttgagcgttccaaaacgaagaaaatatatatatatatatatatctattttttttatctaaggccttgtgatgatgggtaaatcctgcccatgatggattgcgttaatcatgaagaacacaaagtttccatgatccgcgaaaacgaaaaagcacgaaacattcatatggcaagacgaccatcgattcttaaacaacctatattttatacatttaacaattatacacttcgtacttgtccctttgttctctctctaaaacaatttctctctcctctccagtcccttcgcaattaaaaccctattttgctctctctggccaataaaaccgtactttatcttctctcaacgctgatctatatcgcagatacaggaaggagaaacttaccgattgcatgtacaggaccttttgttaaagccagaaagggaattccagaggtgccgtgatgagtaagctgcagagtgatacattgagggaggtgattagcaaggtggtaggtgatgccaaaagaaagccacgtaagttcaccgagaccattgaacttcaaattgggttgaagaactatgatccccaaaaggacaagcgcttcagtggatcagtcaagctaccccatattcctcgccctaagatgaaactatgcatgctcggagatgctcaacatgttgaagaggctgagaagatgggattggattatatggatgttgaagggttgaagaagatgaacaagaataagaagctggtgaagaaactcgccaagaaataccacgcctttcttgcatcagaagcagtcatcaagcagatcccaaggcttttgggtcctggtcttaacaaggcagggaagtttcctaccctggtttctcaccaggaatcactggaggcaaaggtgaatgagacaaaggccattgtcaaattccaacttaagaaggttctctgcatgggggttgctgttggcaattgtgctatggaggagaagcaggtctttcagaatgtccaaatgagtgttaacttcttggtttcactgttaaagaagaattggcagaatgtgaggtgcttgtacctgaagagtaccatgggtagggctcacccactcttctaaattgggttttgttagataatcaggagaaaagacaattttgtatttcagcgaggtagtgtactatttctgtccctatctagcagaaagagtgaatctctctttttaatgttttctggttacatactgctgtctattcagatcctagaataacgtggctcagggtttatctattattttaaagaatttacacatgggaggtctcagcatattggtttactcttcattggggtttctagcttcaatgaccatccataatgaatgggttaaggttggttggttaagtccctggttaccaaactactgttatcttatactagccttgttattttagttagttcttgatcaacgagctgtttatcataaatggatggcttatagagagtgtttgggaacgcgtggaaacagtgtttcagggcttagtgcctccttttcccaaggcagtcaaggctccaaaatggaagggtgtttggggactatcaaaacactttctcgacttaatgtaaaaaccccaagaagagggctttttatcatatccccaagaagaggactttttatcatatcctccgaaatatttcaaaatgaacgtatctaattttcttgttcattacatgtgtgctcatttttttttatttttttatatgcccacattacaacctaattaggtccgaaaaaggctctat

SEQ ID NO: 15543 - DNA, 1099 bp, Eucalyptus grandis
gaaaccaagattgacagtgaaaccctagtcgcgggtttcgctctctcgagtcttcggaggcaaatcttttgggcggtctctggaaaggacgagaaaatgagtaagcttcaaagtgaggcattgagagaagctatcacggggatcaagaatgattgcaatgagaaaaaacgtaattttactgagacaatcgagcttcagattggattgaagaactacgatccccagaaagataagcgtttcagtggttctgtgaagttaccacacattcctcgccctaagatgaaagtctgcatgctcggtgatgctcaacacgtggaagaagcagagaagattggcctggattatatggacgtcgaagggttgaagaagttgaacaaaaacaagaagttggttaagagactagcaaagaagtaccatgcttttctagcatctgaagctgtgattaagcagattccccgtcttctgggccctggtttgaacaaggcaggaaagtttcccaccctcgtcactcatcaggaatcccttgatgccaaagttaatgagatgaaggctatggtaaagttccaactcaagaaggtgctctgcatgggtgttgctgtcggcaacctttctatggaggacaagcagatcttccagaatgttcaacttagtgtgaacttcctggtttcgttgttgaagaaaaattggcaaaatgtcaagtgcctctacttgaagagctccatggggaagccgtaccgagtcttctgaggcgtcctttgtatccgtagggagttactagaaaagagaagttgcgtggccccaaccattgagaagttacgttggtgttccttcttgtcagctgtttttgtcaaaagttttgagagttaacgacaatctttagttgaaatgtttcattttgttgtggattttttctgtcacgatggtttaatgacgatcctggttggactggtgatacatgtgaaatcagaattctacaacgcctcatttcgagttatttcttggtaggggaggtctctttggattgttacatagctagtcatactatctattgggagattttactttttcaacttccttatttttgcagcattcgaaattt

SEQ ID NO: 15544 - DNA, 1029 bp, Pseudoroegneria spicata
ctccactcctccccaaaccctagacacaccaggtgaatcggcgaccggcgatccatctccgcggcgagccatgagtaagctgcagaccgacgtcctcaaggaggccatcacccaggtggtggcggatgccaaggagaagaacaggaagttcactgagacggtcgagctccagatcggtctcaagaactacgacccgcaaaaggacaagcgtttcagtggctccgtcaagctgccccacgtccctcgccccaagatgagggtctgcatgctcggtgacgcccagcatgtgggagaggctgagaagattggtcttgatgccatggatgttgaagctcttaagaagatgaacaagaacaagaagcttgtcaagaggcttgccaagaagtaccatgctttcttggcctcggaggctatcataaagcagattccacgtcttcttggtcctggtctcaacaaggcaggcaagttcccgactctggtttctcaccaggagtctcttgaagccaaggtcaacgagacgaaagcaacaatcaagttccagctcaagaaggtgctgtgcatgggcgtcgccgtgggcaacctgtcgatggaggagaagcagatccagcagaatatccagatgagcgtcaacttcctggtttccctgctcaagaagaactggcagaacgtgaggtgcctgtacatcaagagcaccatggggaagccggtccgtgtgttctaagcctgtacccctgccgtccgtctatatcgatgctacctagaataccggacttactatgtttacgcataaatgtcagtgtcgtgtctgtagtttttatcgaattttgcgcgtgccctggtgaagatgacagaaagaccactactgtttctcttgagttgtgatgccgctggagcaatatgctcatcaaaatcatgccagaacctgttatatatatatatatgctgtggatgcatgttgtgtaccctgtatgtttgcccacgatgcgatctgtttgtcttcgtggctttctagtccaatctttaacttca

SEQ ID NO: 15545 - DNA, 790 bp, Heritiera littoralis
ggctattagggttgctctgttctctggtagattttatagtttgttcgtggaaagaacagatattcagagatgagtaagcttcagagtgatgccctcagagaagccatatcgaccattgtggctcagtccaaggagaggcaacgaaagtttactgaaaccattgaactccagattgggctgaaaaactatgatccccagaaagacaaacgtttcagtggttctgtgaagctaccacacattccacgcccgaagatgaaaatctgcatgcttggagatgctcaacatgttgaagaggcagagaagataggcttggattatatggatgtggaagcgctgaaaaagctaaacaagaataagaagttggtcaagaagcttgccaagaagtatcatgcctttttggcttctgaatctgtcatcaagcaaatccctcgtctcttgggtcctggtctcaacaaagcagggaaattcccaacccttgttactcaccaggaatccctagagtccaaagtgaatgagaccaaggcaatggtgaagttccagctgaagaaggttctttgcatgggagttgctgttgggaatgtggctatggaggagaagcaaatcttccaaaatgtccaaatgagtgttaattttctggtctccttgttgaagaaaaactggcagaatgttaggtgcctctacttgaagagtaccatgggcccttcaaacagggtcttttgagctgatacttatcttctgttagagttctgtaaggagtgaaagtagttgtggggataaatgccaagttttt

SEQ ID NO: 15546 - DNA, 1015 bp, Ipomoea nil
gaccctctctcagctccgattcagatattttgaagggaaagaaaaatctttcgccatgagcaagttgcaaagtgatgccgtgagggaagcaatctcccaattaatgggggattctaaggagaagaaccgcaagttcactgagaccattgagcttcaaattgggctgaagaactatgatccccagaaggacaagcgtttcagtggttcagtcaaattgcctcacattccacgccctaagatgaaagtatgcatgcttggtgatgctcagcatgtggaggaggctgaaaaaattggcatggagtatatggatgttgaggggttaaagaagctcaacaaaaacaagaagctggtgaagaagcttgcaaagaagtaccatgctttcttggcatctgaagctgtaattaaacagatccctcgtctcttgggccctggtcttaacaaggcaggcaagttcccaaccttggtgacacatcaggagtccttggagacgaaggttaatgaaacaaaggctactgtaaaatttcagcttaagaaggtcctctgtatgggtgttgctgttggtaatgttgccatggaggaaaagcagatcttccagaatgttcaaatgagcgtgaactttctggtatcattgctgaaaaagaactggcagaatgtgaggtgcctatatctcaagacaacaatgggaaggcctattcgggtcttttaacttggaattgtgtcttttgtattctttatttaagctctataggtagacattgcacaatcagtcttgtactctgccattgtctagaaccatttttgtttcgatgtcctcgtggatttccctgttattgttcaaggcttatcactgggtatttggatttgttgagatttttgatatcagtctctctttgatttcatttttgaagagtgtaggacgagtggattagataccattttactacaacatacttaatcctgcacacttttatctaatccttgtttgcgtactgtagtaatgtcttgagaatatttt

SEQ ID NO: 15547 - DNA, 1085 bp, Aquilegia formosa
gttttcgtttcttgcagtcgggtaagcattgaagtggtttgggaacgagaaattctgaaatatgagtaagcttcagagtgatgtactacgagaaggtatctcacagattgtcaatgaatctaagcaaaaagaacgcaagtttgtaggaacaattgagctccagattgggttgaagaattatgacccacaaaaagacaagcgtttcagtggatctgtgaagctgccacatatccctcgtcctaagatgaaggtctgcatgcttggtgatgctcagcatgttgaagaagcagaaaagattggattggaatatatggatgtagaggggctcaagaagctgaacaaaaacaagaagttggtcaagaagcttgcaaagaaattccatgcttttcttgcttcagaagctgtcatcaagcaaattccccgtcttctgggccctggtctgaataaggcaggaaagttcccaactcttgtaactcatcaagaatctcttgagagtaaagtcaatgaaaccaaggctatggtgaagttccaactgaagaaagtactatgcatgggagttgctgtggggaaccttggaatggatgagaagcagatatttcaaaatgtccaactcagtgtcaacttccttgtatctttgttgaaaaagaactggcaaaatgttcgatgcttgtatctgaagagcacaatggggaagccattccgcatcttctaaggacttcgcttacttcgttatatgggcagcgttgaagcaaccttgagcaagttttgtgttctctttgtggaaattttgtttaatgttctctttgcccttatgacgcggataacagttttgaagttcttttatggatacagttgtgatctgacttttaaatcacatttcatattgtgggagagtggtgttcatatgctttatgactccaagtagacttccaacctcgaaagatgtattgatatgtttttaagccttagctaattgtccgttgcaacttctggtcaaaaaagcttctggtctaaaacaagctatggggtatttcagcttatggttgcagttctgtatttcagttttcaacaaacttttcagcagg

SEQ ID NO: 15548 - DNA, 1073 bp, Ipomoea batatas
tttaggaagcaacgtcggccactcgcccctgcaggctcgctgtcgcgactccaaagaattcggcagaggctctcttgccctcctttccatccacttctgtttttttacaggtgttcatttgtgtttgcctatgaatcctaactcttttttgtttttgttggattatgcagatacttagaagggaaagaaaaatctttcgccatgagcaagttgcaaagtgatgctgtgagggaagcaatctcccaattgatgggggattccaaggagaagaaccgcaagttcactgagaccattgagcttcaaattgggctgaagaactatgatccccagaaggacaagcgtttcagtggttctgtcaaattgccacacattccacgccctaagatgaaagtatgcatgcttggtgatgctcagcacgtggaggaggctgaaaaatttggcatggagtatatggatgtggaggggttaaagaagctcaacaaaaacaagaagcttgtgaagaagcttgcaaagaagtaccatgctttcttggcatctgaagctgtaattaaacagatccctcgtctcttgggccctggtcttaacaaggcaggcaagttcccaaccttggtgacacatcaggagtccttggagacaaaggttaatgaaacaaaggctactgtaaaatttcagcttaagaaggtcctctgtatgggtgttgctgttggtaatgttgccatggaggagaagcagatcttccagaatgttcaaatgagcgtgaactttctggtatcattgctgaaaaagaactggcagaatgtgaggtgcctatatctcaagacaacaatgggaaggcctattcggatcttttaactcggagttgtctctcttgtattctttatttaagctctataggtagacattgcacaatcagtcttgtactctgccattgtctagaaccatttttgtttcgatgtcctcttggatttccctgtttttgttcaagccttattactgggtatttggatttgttgaggtttgtgatatcagtctctttgattccgtttatgaaattgctgtagaaatgagagagc

SEQ ID NO: 15549 - DNA, 856 bp, Tropaeolum majus
aggctcttatattagctgctatcttgctacattcagcgtctcttgtttcctccatatttccaggagctcttcctccgtagaatttccagtgtttcatcaacatgagtaagcttcagagcgaggcacttagggaagccatctcaaccattatgactgcttccaaggagaagcagcgtaacttcacagagaccattgaacttcaaattggtttgaagaactatgatccccaaaaggataagcgtttcagtggctccgtcaagttgccccacattcctcgcccaaagatgaaggcctgcatgcttggagatgcccagcatgtagaagaggcaacgaagattggtttggattatatggatgttgaagctttgaagaagcttaacaagaacaagaagcttgttaagaagctagcaaagaagtaccatgctttcttagcatcggagtctgtcatcaagcagatccctcgtcttttgggccctggtcttaacaaagcaggtaagtttcctacacttgttagccaccaagagtctcttgaggctaaggtcaacgagatcaaggcaactgttaagttccagttgaagaaggttctatgcatgggtgttgctgtcggtaactgcggtatggaggagaagcagattttccagaatgtgcaaatgagcgtcaactttcttgtttctttattgaaaaagaattggcaaaacgtgaggtgcttgtatctgaagagtacgatgggcccttcaaacagagtgttttaagttgttttgttttgaaaaagagcttgggattgttctcctgtttgtttttaatttatgtttcagttgaaccactagaaactttaacagtaatatttgagattttt

SEQ ID NO: 15550 - DNA, 1044 bp, Taraxacum officinale
ggggggaaggtttccctcatatatatcagctgcttctgctgcgtaactacatcggcactttcaaccctactcgcagggttcttacgggagaagtgaagcttgacgaaaagaaaagcttttgaatatgagtaaacttcaaagcgaagccctcagagaggcgatcactcaaattaccaccgatgccaaagaaaagtcaaggaagttcactgagaccattgagcttcaaattggtttgaagaattacgatccacaaaaggacaaacgtttcagtggtaccgtgaaattacctcacattccccgccctaaactcaaggtctgcatgcttggagatgcccagcatgttgaagaggctcaaaagattggcctcgaatacatggatgttgaaggtctaaagaaactgaacaagaacaagaagttggtgaagaagcttgcaaagaaacatcaagctttcttggcttctgaatctgtcatcaagcagattccccgtttgttgggacctggtttgaacaaagccggtaagtttcctactcttgtttcccaccaagaatcccttgaggcaaaggtgaatgagaccaaagcaactgtcaagttccaactgaaaaaggtgctttgtatgggagttgctgttggaaactgcagcatggaagagaagcagatcttccagaatgttcaaatgagtgttaacttcttggtttctttgttgaagaagaattggcaaaatgtgaggtgcttatacttgaaaacaacaatgggaaagccagtgcgtatcttttaagaagtttgcttgttcttgtgttttgattttgggttaatgttaaggtcggcacttgagaaaacatgtatttcccttcaacaggaaatagttatttttgtctttttacatgtttgtttcgtaatttataatattagacaccctgttttagttattctgttgatgatttttatatggtttattctgtcttctatatattcaagtgtcaattgtgacatctaaaaactgctgttttgatcggtattcctctattaacaaaaaatttattgttc

SEQ ID NO: 15551 - DNA, 990 bp, Humulus lupulus
ctctcttcgccttgctcagctgcggttgcagaccagtgtttggttcttctctattagagtattcatctgggagaaactgtagtgaggaagtatgagtaagctcagtagtgatgctgtgagagagggcatcgcccagattgttatcaactcgaaagagaagaaccgtaagttcactgagaccattgagcttcaaattggattgaagaactatgacccccaaaaagacaagcgtttcagtgggtctgttaagcttcctcacattcctcgtcctaagatgaagatttgcatgttgggagatgctcaacacgttgaagaggctgagaaaataggattggactatatggatgtagaaggattgaaaaagcttaacaagaacaagaaattggtcaagaagctcgccaagaagttccatgcttttttggcttctgaagctgtcattaagcaaattcctcgtcttctgggtcctggactcaacaaggcaggtaagtttccaacattggtcacccaccaggaatctttggagtcgaaagtcaacgaaaccaaagccatggtgaagttccaacttaagaaggtcctttgtatgggagttgctgttggaaatttatccatggaggagaagcagatcttccagaatgtgcaaatgagtgtcaattttctagtgtcattattgaagaagaactggcaaaatgtgaggtgcttgtacctgaagagtaccatgggaagtgcaatccgtatcttttaatttcccatatgctctatgaaattgtggtagtagtgggaggaaagcattgcaaacatttaagcaagacatttttgttttgagattgcgtcaacctgcaattttgtttttgttggattcgcctagtttgtaatttttataactactgtgacattaagattttgtggcttttaaaggagaattatttatttcttcacgttttggctttgctttcttttgccaccgggctattgaatttggtatttaatttg

SEQ ID NO: 15552 - DNA, 1022 bp, Cucurbita pepo
ttcggtcttccattatatatctattatcagctgccgtcgaaaaccctagcttagcttcttctcaccagtgagtctgtagctgctccttgaaaagaaagggttccgaaaatgagcaaacttcagagtgaagcgttgagagaagccatttcatctatctttggtgatagcactgaaaagaagcgcaactttactgagactattgaacttcagattggactgaagaactatgatcctcagaaggacaagcgtttcagtggatcagtgaagttgcctcatatccctcgccctaagatgaagctttgcatgcttggagatgctttgcacgttgaagaggcagagaagattggtatggattatatggatgtggaaggtttgaagaagctaaacaagaacaagaagttggtgaagaaacttgccaagaaatatcatgcctttttggcatctgaagctgttatcaagcaaattccccgtcttctgggccctgggctcaacaaggcaggtaagttccctaccctggttactcaccaagaatccctcgagtcgaaagtcaacgagacaaaggcaatggttaaatttcaactaaaaaaggttctttgcatgggtgttgccgtcggtaacgtcgccatggaggagaagcaagttttccagaacgttcaaatgagtgtcaatttccttgtttccttgttgaaaaagaattggcaaaacgtgaggtgcttgtacctgaagagtactatgggaaaggcatatcgagtcttctgagaacttttcaaattttagatagtactgtttgctctttcgtttaagacccaaccagttgaggtgaaattctatattatgattggttaaagttttcctgtttattttctttattatttttgtttagcacaaaacaaaaccactagctgcacaaccgttaacactcatgatggaagtaatgttttcttttttcctatttgttcttcttattgttttgttcgtattttttttcctaatttattatacgttcttattttgtcttaaat

SEQ ID NO: 15553 - DNA, 894 bp, Arnica chamissonis
tctaccgaaggcagtgagaggtgtaaggaaggaaaacctaacggaaaatgagtaagcttcaaagcgaagcccttagggaagccattactcaaattaccaccgatgctagagaaaagaaacggaattttactgagaccattgagcttcagatcgggctcaagaactacgaccctcaaaaggacaaacgttttagtggtactgtaaagttgcctcacattcctcgacccaagttgaaagtttgcatgcttggagatgcccagcatgtcgaagaggctcaaaagattggtcttgaatacatggatgttgaaggactcaagaagctcaacaagaacaagaagctggtgaagaagcttgccaagaaacaccaagcgtttttggcttctgaatccgttatcaagcaaattcctcgtttgttgggccctggtctaaacaaggcaggaaagtttccgacacttgtttctcaccaagaatcccttgaggctaaggtgaatgaaaccaaggcaacggttaagtttcaactgaaaaaggtgttgtgcatgggagttgctgttggtaactgcagcatggaggagaaacagattttccaaaatgtgcagatgagcgttaacttcctcgtttcattgctgaagaaaaactggcagaatgtgagatgtttgtacttgaagacaacaatgggaaagccagttcgcatcttctaggcgttccatcggttctttctttcaaatctgttgcgagctcagtactttgaagcattttcttttaataggtggtgtcggttttgatttatcggatgtttgtttttgtatcagatgatgctatgatcgttatgtttaatggttatagcgctgctgtctctgtattctttaaggataatatctgtttaaagccggtttt

SEQ ID NO: 15554 - DNA, 793 bp, Ambrosia trifida
gggttcttaccgaagaagtgaagctaacgagaacagacatatcccagaatgagtaagctacagagtgaagctttgagagaggcaattacacagatcacaactgatgctaaagaaaagaaacgtaattttactgaaactattgagctacaaattggtttgaagaattatgatccacaaaaggataagcgtttcagtggtacagtgaagttgcctcacattcctcgccctaagttgaaagtttgcatgcttggtgatgcccaacatgttgaagaggcccaaaaaattggacttgagtatatggatgttgagagtttgaagaagctgaacaagaataagaagttggtgaagaaacttgctaaaaaacaccaagctttcttggcttctgagtctgtcatcaagcagattccccgtttgttgggtcctggtctaaacaaagctggtaagtttcccacacttgttagccatcaggaatcccttgaggcgaaagtcaatgagaccaaagcgacagtcaagtttcaactaaagaaggtgctctgcatgggagtcgctgttggaaactgcagcatggaggagaagcaaattttccaaaacgttcaaatgagtgtcaatttcttagtttctttgctaaagaagaattggcaaaatgtgcgatgcttatacttgaagacaacaatggggaagccggttcgcatcttttaaggaagagtttatttgtttgtatgtttttctttgggttaatgttaaggtcagtgttggaaagtatatttctcatgaacacaagaacagttttttt

SEQ ID NO: 15555 - DNA, 850 bp, Ambrosia trifida
agggttctcactaaaggttgaagttaacaagaggaaaagttactgaaaatgagtaagcttcaaagtgaagcccttagagaggcaattactcagatcactactgatgcgagggaaaagaaacgtaactttactgaaaccattgagcttcaaattggtttgaagaattacgatccacaaaaggacaagcgtttcagtggtaccgtgaaattgcctcacattcctcgccccaagcttaaagtttgcatgcttggagatgctcaacatgttgaagaggctcaaaaaattggccttgaatacatggatgtcgagagtctgaagaagttgaacaagaacaagaagttggtgaagaaacttgctaagaaacatcaagctttcttggcttctgagtcagtcatcaagcaggttccccgtttgttgggccccggtcttaacaaagcaggtaagttccctactcttgtttcccaccaagaatctctagaggcaaaggtcaacgagacgaaagcaacagtcaagtttcaacttaagaaggtgctctgcatgggagttgccgtcggaaactgcagcatggaagaaaagcaaatcttccagaatgttcaaatgagtgtcaacttcttggtttctttacttaagaagaattggcaaaatgtgcggtgcttgtacttgaagacgacaatgggaaagccggttcgcatcttttaaagagtttatttgttatgttttcatttcatttcgggttaatgttgaggtcagtactggaaaacatatttcccatgaacagggaatggtcctttttggctttttacatgtttgtttggtactatagctttggactccttcggttatatcattg

SEQ ID NO: 15556 - DNA, 820 bp, Ambrosia trifida
cgtctctgtcgccactatcaaaccctaatctcagggttcttaccgaagaagtgaagctaacgagaacagacataacccagaatgagtaagctacagagtgaagctctgagagaggcaattactcagatcacaactgatgctaaagaaaagaaacgtaatttcactgaaacaattgagctacaaattggtttgaagaattatgatccacaaaaggataagcgtttcagtggcacagttaaattgcctcatattcctcgccctaagttgaaagtttgcatgcttggtgatgcccaacatgttgaagaggctcaaaaaattggacttgagtatatggatgttgagagtctgaagaagctgaacaagaacaagaagctggtgaagaaacttgctaaaaaacaccaagctttcttggcttccgagtctgtcatcaagcagattccccgtttgttgggtcctggtctgaacaaagctggtaagttccccacacttgttagtcatcaggaatctctagaggcgaaagtcaatgagaccaaagcaacagtcaagttccaactgaagaaggtgctctgcatgggagtggctgttggaaactgcagcatggaggagaagcaaattttccaaaacgttcaaatgagtgtcaatttcttggtttctttgctaaagaagaattggcaaaatgtgcgatgcttatacttgaagacaacaatggggaagccggttcggatcttttaaggaagagtttatttgtttgtatgtttttcttttgggataatgttaaggtcagtgttggaaagtatatttctcatgaacacaagaacag

SEQ ID NO: 15557 - DNA, 774 bp, Flaveria ramosissima
cagttgtttctggtgaaactgtcggcactttgaaaccctaatcttagggttctcaccggagaattgaaggtaaggagaacggaagtttccgataatgagcaagcttcaaagtgatgccctcagagaggcaattactcagatcaccactgatgccaaagaaaagaaacgtaatttcactgagaccattgagcttcaaattggtttgaagaattacgacccacaaaaggacaaacgttttagtggtacagtgaagttgcctcacattcctcggcccaagttgaaagtttgcatgcttggagatgcccaacatgttgaagaggctcaaaaaattggcctagaatatatggatgttgagagtctgaagaagcttaacaagaacaaaaagttagtgaagaaactcgctaaaaaacaccaagctttcctggcttctgagtctgtcatcaagcagattcctcgtttgttgggccctggtcttaacaaagctggtaagtttccgacacttgtgacccaccaagagtcccttgaggcgaaggtgaacgagactaaagcaacagtgaagtttcaactaaagaaggtgttgtgcatgggagttgctgttggaaactgcagcatggaggaaaagcaaatttttcaaaacgttcaaatgagtgtcaattttcttgtttctttgctcaagaaaaattggcaaaacgtccggtgcttatacttgaagacaacaatggggaagcctgttcgcatcttttaaggtgtttatttgttatgttttgatgaaca

SEQ ID NO: 15558 - DNA, 776 bp, Flaveria ramosissima
tatttgggttctcaccggagaagtgaaggtaaggagaacagaagtttccgaaaatgagcaagcttcaaagtgatgccctcagagaggcaattactcagatcaccactgatgccaaagaaaagaaacgtaatttcactgagaccattgagcttcaaattggtttgaagaattacgacccacaaaaggacaaacgttttagtggtacagtgaagttgcctcacattcctcggcccaagttgaaagtttgcatgcttggagatgcccaacatgttgaagaggctcaaaaaattggcctagaatatatggatgttgagagtctgaagaagcttaacaagaacaaaaagttggtgaagaaactcgctaaaaaacaccaagctttcttggcttctgagtctgtcatcaagcagattcctcgtttgttgggccctggtcttaacaaagctggtaagtttccgacacttgtgacccaccaagagtcccttgaggcgaaggtgaacgagaccaaagcaacagtgaagtttcaactaaagaaggtgctgtgcatgggagttgctgttggaaactgcagcatggaggaaaaacaaattttccaaaacgttcaaatgagtgtcaattttcttgtttctttgctcaagaaaaattggcaaaatgtccggtgcttatacttgaagacaacaatggggaagcctgttcgcatcttttaaggcgtttatttgttatgttttgatgaacacgttgatagctttttttggctcgtcacatgtttgttttgtaac

SEQ ID NO: 15559 - DNA, 950 bp, Plantago ovata
caggagaaatcggagaagaagcataacaacgcaacaatcatgagtaagctttcgagtgacgccaccaaggaggcaatcacctcaattatggctgatgctaccgaccctgagaagaagaagaacttcactgagactattgagctccagattggtctcaagaactacgatcctcaaaaggacaaacgtttcagtgggtctgttaagctgccccatatcccaaggcctaaaatgaagatctgtatgctcggagatgcccagcatgttgaggaggctgagaaaattggcctggaatctatggatgttgaggctcttaagaagcttaacaagaacaagaaattggttaagaagctggccaagaagtatcacgctttcttagcctcagaatctgttatcaagcagattccccgtctcttgggacctggtcttaacaaagcaggtaagttccctacccttgtgagtcaccaggaatcccttgaatccaaggttaacgagaccaaagccaccgtgaagttccaattgaagaaagttctctgcatgggagttgctgttggcaactgtggcatggaggagaagcaaatcttccaaaatgtccaaatgagtgttaacttcctagtttctcttttgaagaaaaactggcaaaatgtgaggtgcttgtacctgaagagtaccatggggaagccagtgcgcatattctaagaagcttttgatatttgtttgaaatgcttaggaacagaatttgtaagacagcgcagacaattcagtatctccttgttacaggagttcctatttgtttagttttgttgtgtcaaaataccttaaattggtactcttgtcgtttattttcgttgagaactatcattttctttttaaccagatttagcatctgcttttgttgttatgtctgaattctgaacctggtcctagtgtgaagtcttctatagcagttggcc

SEQ ID NO: 15560 - DNA, 802 bp, Aquilegia formosa
gggaagcaaaccggtgaaatctctgttgaaagatgagtaagcttcagagtgatgtgctgagagagggaatcacccaaattactaatggagccaaagagaagaagcgtaactttactgagacagttgagctccagattggtcttaagaactatgacccccaaaaagataagcgattcagtggttcagtcaagttgccacacatcccccgtcctaagatgaagatctgcatgcttggagatgctcagcatgtcgaagaggcagagaaaatcggtttagagtatatggatgtggagggtttaaagaagctgaacaaaaacaagaaactggtgaaaaagcttgcaaagaaataccatgcttttctagcatcagaagctgtcattaagcagattcccagacttcttggtcctggtcttaacaaggcaggaaaattcccaactcttgttacccatcaggaatcattggaatcaaaagttaacgaatcgaaggctatggtgaagtttcaattgaaaaaggttctttgcatgggagttgctgtgggaaatctcggaatggatgagaagcagatcttccagaatgttcaactcagtgtcaactttctcgtctcactgttgaaaaagaactggcagaatgtgagatgtttgtacctgaagagttcaatggggaagccagtccgtatcttctaaacatttgaatttttttaagttgagtacattgtgtactgagttagtgagcaggattataaacgtattttggaaattctcagatttgtcatggttgtactattgagatctttagttgaatg

SEQ ID NO: 15561 - DNA, 998 bp, Brassica napus
atccaaaaggtatacttcttctttaattctctttcttcacctcttcacggctactcttcatcgattctaaacgttcgttgataaaaccttgttttcaggagagaatagtagctgaggaagtgccaaaatgagtaagctccagagtgaagccgtgaaagaggcgatatcaaccattatcactcactgcaaggagacgaagcctcgcaagttcaccgagactatcgagctccagattggtctcaagaactatgaccctcaaaaggacaagaggtttagcggttccgttaagttgcctcacattcctaggcccaagatgaagatttgcatgctcggtgacgcccagcacgttgaagaggctgagaagattgggttagagtctatggatgtggaagctcttaagaagctgaacaagaacaagaagcttgtcaagaagctagctaagaagttccatgctttccttgcttctgaatctgtcatcaagcagattccccgtcttcttggtcctggtctcaacaaggcaggaaagttcccaactcttgttagccaccaagagtctttggagtccaaagtgaatgagacaaaggcaacagtgaagttccagctcaagaaggttctttgcatgggtgtcgccgttgggaatctcggcatggaagagaagcagatcttccagaatgttcagatgagcgtcaacttccttgtttccctcttgaagaaaaactggcaaaacgttaggtgcttgtacttgaagagcacaatgagtccacccacccgtgttttctaagattattttatctcaaagtttctctcaaggtgtcatctggctgagaggagatttcattttcatttctgtcatgattaagattttgtttaaagacggagttatttataatattccgattactcttggtgaattctctctatttatgttagtttaacccaatcttattacaaaataatggaatacaatcacaagaaatcaataaacagtgttttattat

SEQ ID NO: 15562 - DNA, 870 bp, Cucumis sativus
ggactgaagggtatactgtctttgcgaaggcgaagattcgaaaatgagtaagcttcagagtgatgcattgagagaagctatctcatctatcttcactgatagcaatgagaaaaagaggaagtttactgagaccattgagcttcagatcgggctgaagaactatgatcctcaaaaggacaagcgtttcagtggttctgtgaagttgccacacattccccgtcccaagatgaagatatgcatgcttggggatgcctcacacattgaagaggctgagaagattggtctagaatatatggatgtggaaggcttgaagaagcttaataagaacaagaaattggtgaagaaacttgccaaaaaataccatgcctttttggcatcagaatctataatcaagcagattcctcgtcttctaggccctggtctcaacaaagcaggaaagttcccaacattggtgacacatcaagagacgcttgaatctaaagttaatgagaccaaggcgatggtcaagtttcaactgaagaaggttctttgtatgggagttgctgttggaaacgtttccatggatgagaagcaagtcttccaaaatgtccaaatgagcgtcaatttcctagtttctttgttgaaaaagaactggcagaatgttaggtgcctgtacctgaagagcacaatggggaagtcgtatcgagttttctaagctttgttagcaatgtagtcagtcttgtgtgttcaatctttttattatcaacgttatttctcgaagagcagttttgtgaaatgagcgtttttgaatgattcttgaacaaagaaacaggaatgttttcttctcttttaaagtgacaattgataatgaagtttttaattcccacccaa

SEQ ID NO: 15563 - DNA, 955 bp, Cucumis melo
tttcgttttctttcttctcggactgaagggtatactgtctttgcgaaggcgaagattcgaaaatgagtaagcttcagagtgatgcactgagagaagctatctcatctattttcactgatagcaatgagaaaaagagaaagtttactgagaccattgagcttcagatcggactgaagaactatgatcctcagaaggacaagcgtttcagtggttctgtgaagttgccacatattccccgtcccaagatgaagatatgcatgcttggggatgcctcacacattgaagaggctgagaagattggtctagaatatatggatgtggaaggcttgaaaaagctaaataagaacaagaaattggtgaagaaacttgccaaaaaataccatgcctttttggcatcagaatctataatcaagcagattcctcgtcttctaggccccggtctcaacaaagcaggaaagttcccaacattggtgacacaccaagaaacgcttgaatctaaagttaatgagaccaaggcgatggtcaagtttcaactgaagaaggtcctttgtatgggagtcgctgttggaaacgtttccatggatgagaagcaagtctttcaaaatgttcaaatgagcgtcaatttcttggtttctttgttgaaaaagaactggcagaatgttaggtgcctgtacctgaaaagcacaatggggaagtcatatcgggttttctaagcactgttagcaatgtagtcagtcttgtgtgttcgatcttttattgtcgacgttatttctcgaagagcagttttgtgaaatgagcgtttttgaatgattcttgaacaaagaaacaggaatgttttcttctcttttaaagtgacaattgataatgaagtttttaattcccctccccaacctcacctattatgaacttgtgtttgcatttactttgatcgtattgtagtttttattaaaaaaaa

SEQ ID NO: 15564 - DNA, 884 bp, Taraxacum officinale
tcggccgggggggacttcatcggcactgctgctagggttctcaccaaagaactgaaggttacggcagcaaaactcagcaaccatgagtaagcttcagagtgaagcccttagagaagcaattactcagattaccaccgatgcgaaggagaagaagcgcaacttcacagaaaccatcgagctccaaattggactcaagaactacgacccccaaaaggacaaacgtttcagtggtacagtgaagttgcctcacatcccaaggcccaaattgaaggtttgcatgcttggagatgcccaacatgttgaagaggcccaaaagatcggccttgagtacatggatgttgaaggcctcaagaagctcaacaagaacaagaagcttgtaaagaagcttgcaaaaaagcaccaagcttttttggcttctgagtctgtgatcaagcagattcctcgtttgttaggccctggtctaaacaaagcaggaaagtttccaacacttgtgagtcaccaagaatcccttgaagccaaggtgaatgagacaaaagcaacagtgaagtttcaattgaagaaggtgttgtgtatgggagttgctgttggaaactgcagcatggaagagaagcagatcttccagaatgttcaaatgagtgttaactttttggtttctttgctcaagaagaattggcaaaatgtgaggtgtttgtatttgaagacaacaatgggaaagcctgtgcgtattttctaggtgtttttttttttgaaaattgttctgagacagtgatagggaggttttctgtacttgggagcatttgttggttatcgtttttgggtttgttggatgattaatttttaattgtattggattttgatgtgagcgttatgtttaatatgtttac

SEQ ID NO: 15565 - DNA, 917 bp, Helianthus annuus
gggtttctgtttcacctcatatattacgataagccatttctgtgcgtgactctgtcgccattttgaaaccctaatctcagggttctttgctggagaagttaagctaacgagaagaaaagtttccgagaatgagtaagcttcaaagtgaagccctcagagaggcaattactcagatcactactgatgctaaagaaaagaagcgtaattttactgaaaccattgagcttcaaattggtttgaagaattatgatccgcaaaaggacaaacgtttcagcggtacagtgaagttgcctcacattcctcgacccaaattgaaagtttgcatgcttggagatgcccaacatgtggaagaggcccaaaaaataggactcgagtatatggatgttgagggactgaagaagctgaacaagaacaagaagttggtgaagaagcttgctaaaaaacaccaagctttcttggcttctgagtctgtcatcaagcaaattcctcgtttgttgggtcctggtctaaacaaagctggtaagttccccacacttgttagtcatcaggaatccctggaggcgaaagtcaatgagaccaaagcaacagtcaagtttcaactaaagaaggtgctctgcatgggagtggctgttggaaactgcagcatggaggaaaagcaaattttccaaaacgttcaaatgagtgtcaatttcttagtttctttgctaaagaagaattggcaaaatgtgagatgcttatacttgaagacaaccatggggaagccagttcgcatcttttaaggaagagcttatttgtttgtatgttttaattttgggttaatgttaaagtcagtgttggaaagtatatttctcatgaacacaggaataggtttttctttggcttgttacatgtttgtttttgtagcactataaaatcta

SEQ ID NO: 15566 - DNA, 930 bp, Helianthus annuus
ctcgaacttcatcggcgctgctgttagagtaagaagagggttttcaggaagcaaaacctaacaaaaaatgagtaagcttcagagtgaagcccttagggaagccattacccaaatcaccacagatgccaaagaaaagaagcgtaacttcaccgagactatcgagcttcagatcggtctcaagaactacgacccacaaaaggacaagcgtttcagcggtactgtaaagctgcctcacattcctcgtcccaaattgaaggtttgcatgcttggagatgcccagcacgtggaagaggctcaaaagattggtcttgaatacatggatgttgaaggactcaaaaagctcaacaagaacaagaagctggtgaagaagcttgccaagaaacaccaggcttttttggcttctgaatccgttatcaagcaaattcctcgtttgttgggccctggtctaaacaaggcaggaaagttcccgacacttgttagtcaccaagaatctctcgaggctaaggtgaatgaaaccaaggcgacagttaagtttcaactgaaaaaggtgttgtgcatgggagttgctgttggtaactgcagcatggaggaaaaacagattttccaaaacgtgcagatgagcgttaatttccttgtttcattgttgaagaagaactggcagaatgtgagatgtttgtacttgaagacaacaatgggaaagccggttcgcatcttttaagtaccctgtctgtttttctttcaaagttgttgtgaggtcggtacttgaagcctttcgtgttagcaggctgtttcggttttgattatggctgttcgttatcgttttgaattagtagatgctatgaacattcttgtgttttgttatttattaaagataatacatgctttaaagagtggaaaattaaaaggtcaagaacttgaacagctcctgtc

SEQ ID NO: 15567 - DNA, 927 bp, Helianthus annuus
gcgggggggtcaggtgttcaacccagcccattagggtttcatcttattactaagttgaatatactataacactcagccgctgtcttcctccctgctgcagttagggtttataccgaagaagtgaagtttcaccaaggaaaacctaacaaaaatgagtaagcttcagagtgaagccctgcgtgaggccattactcaaattaccaccgatgccaaagaaaagaagcgtaacttcaccgagactatcgagcttcagattggactcaagaactacgacccgcaaaaggacaaacgtttcagtggtaccgtgaaattgcctcacattcctcgtcccaagttgaaagtttgcatgctcggggatgctcagcatgtggaagaggcccaaaagattggtcttgaatacatggatgttgaaggtctcaagaagctcaacaagaacaaaaagctcgtgaagaagcttgccaagaaacaccaggcttttttggcttctgaatctgttatcaagcagattcctcgtttgttgggtcctggtctaaacaaggccggtaaattcccgacacttgtttcccaccaggaatccctcgaggctaaggtgaatgaaaccaaggcaactgtcaagtttcaactgaaaaaggtgttgtgcatgggagttgccgtcgggaactgcagcatggaggagaaacagatttttcaaaacgttcagatgagcgttaattttcttgtttcgttgttgaagaaaaactggcagaatgtccgatgtttgtacttgaagacgacaatgggaaagccggttcgcatcttttaggtgtttaactttgtttttggttgttggaagcatttccctttaatgggtgctactgtttttgacttgttggatgtttgttttgttattgtattagatgctgctatgaacattatggttaatggtta

SEQ ID NO: 15568 - DNA, 960 bp, Helianthus annuus
ttttggtgcgtaactcttatcggcacttcgaaaccctaactctcagagaattgaaggtatcgagaggaaaagtttcaaaaatgagtaagcttcaaagcgaagcccttagagaggcaattactcagatcactacggatgcaaaggaaaagaaacgtaactttactgaaaccattgagctacaaattggtttgaagaattacgatccacaaaaggacaaacgtttcagtggaaccgtgaagttgccacacattcctcgccccaagcttaaagtttgcatgcttggagatgctcaacacgttgaagaggctcaaaaaattggtcttgaatatatggatgttgagggtttaaaaaagctgaacaagaacaagaaattggtgaagaaacttgctaagaagcatcaagctttcttggcttctgagtctgttatcaagcagattcctcgtttgttgggccccggtcttaacaaagcaggtaagttccctactcttgtttcccaccaagaatctctcgaggcaaaagtcaacgagacgaaagcgacagtcaaattccaacttaagaaggtgctttgcatgggagttgctgttggaaactgcagcatggaagagaagcaaatcttccaaaatgttcaaatgagtgtcaatttcttggtttctttacttaaaaagaattggcaaaacgtgcggtgcttgtacttgaagacaacaatgggaaagccggttcgcatcttttaagaagtggctttggttatgtttttattttgggttaatgttgaggtcagtactggaaaatgtatttcccatgaatgggaaataatcctttttggctttttactatgtttgtttggtactgtatttttggaccctcttcttatatcattgttttgattttgccagtcttttaggcattattattgaactaggtttaaataagttcgtcgcgttgcggcgaatttattttgtt

SEQ ID NO: 15569 - DNA, 876 bp, Helianthus annuus
gctgcagttagggtttataccgaagaagtgaagtttcactaaggaaaacctaacaaaaatgagtaagcttcagagtgaagccctgcgtgaggccattactcaaattaccaccgatgccaaagaaaagaagcgtaacttcaccgagactatcgagctccagattggactcaagaactacgacccacaaaaggacaagcgtttcagtggcaccgtgaaattgcctcacattcctcgccctaagttgaaagtttgcatgcttggagatgctcagcatgtggaagaggcccaaaagattggtcttgaatacatggatgttgaaggtctcaagaagctcaacaagaacaaaaagctcgtgaagaagcttgccaagaaacaccaggcttttttggcttctgaatctgttatcaagcagattcctcgtttgttgggtcctggtctaaacaaggccggtaaattcccgacgcttgtttcccaccaggaatccctcgaggctaaggtgaatgaaaccaaggcaactgtcaagtttcaactgaaaaaagtgttgtgcatgggagttgctgtcgggaactgcagcatggaggagaaacagatttttcaaaacgttcagatgagcgttaattttcttgtttcattgttgaagaaaaactggcagaatgtccgatgtttgtacttgaagacgacaatgggaaagccggttcgcatcttttaggtgttttatctttgtttttggttgagccagtttcaggaagcatttccatttaatgggtgctattgtttttgacttgttggatgtttgttttcttattgtattagatgctgctatgaacattatggttaatggttacagaccatttattcttatttctatatgtttca

SEQ ID NO: 15570 - DNA, 717 bp, Parthenium argentatum
cttcataggtgctggcattatagggttcatacaaaagacgtgaagtttaacgaaggaaaacctaacaaaaatgagtaagcttcaaagtgaagccctgcgtgaagccattactcaaattaccaccgatgctaaggaaaagaaacgtaacttcactgagacaattgagctgcagattgggctcaagaactacgacccacaaaaggacaagcgtttcagtggaaccgtgaaattgccgcacattcctcgtcctaaactgaaagtgtgcatgctcggggatgcccagcatgtagaagaggcccaaaagatcggtcttgaatacatggatgttgaaagtctcaaaaagctcaacaagaacaagaagctggtgaagaagcttgcaaagaaacaccaggcctttttggcttctgaatctgttatcaagcagatccctcgtttgttgggtcctggtttaaacaaggccggtaaattcccgacacttgtttcccaccaggaatccctcgaggctaaggtgaatgaaacgaaagcaactgtcaagtttcaactgaaaaaagtgttgtgcatgggagttgctgtcggaaactgcagcatggaggaaaaacagattttccaaaacgtgcagatgagcgttaattttcttgtttcgctgttgaagaaaaactggcaaaatgtgcgatgtttgtacttgaagacaacaatgggaaagccggttcgcatctt

SEQ ID NO: 15571 - DNA, 1066 bp, Secale cereale
ctccatccaggcgccgaatccagcggccgccacgccacccctctccccccaaagcctggggtttccacagaccacgagagccacagccattcctcctcctcctcctgccgccgccgctccccaaaccctagaccagccaggtgaatcggcgaccggcgaatcgacccgtccgtccccgcggcgagccatgagtaagctatcgaccgaagccctcaaggaggccatcacccaggtggtggcggatgccaaggagaagaacaggaagttcaccgagacggtcgagctccagatcggcctcaagaactacgacccgcaaaaggacaagcgtttcagcggctccgtcaagctgccccatgtccctcgccccaagatgagggtctgcatgctcggtgatgcccagcatgtgggagaggctgacaagattggtcttgattccatggatgttgaagctcttaagaagatgaacaagaacaagaagcttgtcaagaggcttgccaagaagtaccatgctttcttggcctctgaggctattatcaagcagattccacgactccttggtcctggtctgaacaaggcaggaaagttcccgaccctggtttctcaccaggagtctctggaagccaaggtgaacgagacgaaagccacaatcaagttccagctcaagaaggtgctgtgcatgggcgtcgccgtgggcaacctgtcgatggaggagaagcagatccagcagaacatccagatgagcgtcaacttcctggtttccctgctcaagaagaactggcagaacgtgaggtgtctgtacatcaagagcaccatggggaagcccgtccgggtgttctaagctcgtgccccagccgccctatatctatgctacctacagtactggacctcctttctatgttcaagcttaaatatgtctactttttgtagtttttatcgaattttgcgcgtgtcctggttaatgaagatgatgaaagaccactactgtttcccctgagttgtgattccgatggaacaatatgctcatcaagatcattccagtacccgttatatataatgttgtggttgc

SEQ ID NO: 15572 - DNA, 1025 bp, Secale cereale
ttggggggggtttccacagaccacgagagccacagccactcctcctcctcctgccgccgccgctccccaaaccctagaccagccaggtgaatcggcgaccggcgaatcgacccgtcccggcggtgagccatgagtaagctctcgaccgaagccctcaaggaggccatcacccaggtggtggcggatgccaaggagaagaacaggaagttcaccgagacggtcgagctccagatcggcctcaagaactacgacccgcaaaaggacaagcgtttcagtggctccgtcaagctgccccatgtccctcgccccaagatgagggtctgcatgcttggtgatgcccagcatgtgggagaggctgacaagattggtcttgattccatggatgttgaagctcttaagaagatgaacaagaacaagaagcttgtcaagaggcttgccaagaagtaccatgctttcttggcctctgaggctattatcaagcagattccacgtctccttggtcctggtctcaacaaggcaggaaagttcccgaccctggtttctcaccaggagtctctggaagccaaggtgaacgagacgaaagccacaatcaagttccagctcaagaaggtgctgtgcatgggcgtcgccgtgggcaacctgtcgatggaggagaagcagatccagcagaacatccagatgagcgtcaacttcctggtttccctgctcaagaagaactggcagaacgtgaggtgtctgtacatcaagagcaccatggggaagcccgtccgggtgttctaagctcgtgccccagccgccctatatctatgctacctacagtactggacctcctttctatgttcaagcttaaatatgtctactttttgtagtttttatcgaattttgcgcgtgtcctggttaatgaagatgatgaaagaccactactgtttcccctgagttgtgattccgatggaacaatatgctcatcaagatcattccagtacccgttatatataatgttgtggttgcatgtttaaaaaaaaaaa

SEQ ID NO: 15573 - DNA, 926 bp, Secale cereale
aatcggcgaaccggcgaatcgacccgtccgtccccgcggcgagccatgagtaagctatcgaccgaagcactcaaggaggccatcacccaggtggtggcggacgccaaggagaagaacaggaagttcaccgagaccgtcgagctccagattggcctcaagaactatgacccgcaaaaggacaagcgtttcagcggctccgtcaagctgccccatgtccctcgccccaagatgagggtctgcatgctcggtgacgcccagcatgtgggagaggctgacaagattggtcttgattccatggatgttgaagctcttaagaagatgaacaagaacaagaagcttgtcaagaggcttgccaagaagtaccatgctttcttggcctcggaggctatcatcaagcagattccacgtctccttggtcctggtctcaacaaggcaggcaagttcccgactctggtttctcaccaggagtctctggaagccaaggtgaacgagacgaaagccacaatcaagttccagctcaagaaggtgctgtgcatgggcgtcgcggtgggtaacctgtcgatggaggagaagcagatccagcagaacatccagatgagcgtcaacttcctggtttccctgctcaagaagaactggcagaacgtgaggtgtctgtacatcaagagcaccatggggaagccggtccgggtgttctaagctcgtgccccagccgccctatatcgatgctacctacagtactggacctccttactatgttcaagcttaaatatgtctacttgtcgtagcttttatcgaattttgtgcgtgtcctggttaatgaagatgatgaaagaccactactgtttcccctgagttgtgattccgatggaacaatatgctcatcaagatcattccagtacccggttatatataatgttgtggttgca

SEQ ID NO: 15574 - DNA, 909 bp, Secale cereale
ccgtcccggcggtgagccatgagtaagctatcgaccgaagccctcaaggaggccatcacccaggtggtggcggacgccaaggagaagaacaggaagttcaccgagaccgtcgagctccagatcggcctcaagaactacgacccgcaaaaggacaagcgtttcagcggctccgtcaagctgccccatgtccctcgccccaagatgagggtctgcatgctcggtgacgcccagcatgtgggagaggctgacaagattggtcttgattccatggatgttgaagctcttaagaagatgaacaagaacaagaagcttgtcaagaggcttgccaagaagtaccatgctttcttggcctcggaggctatcatcaagcagattccacgtctccttggtcctggtctcaacaaggcaggcaagttcccgactctggtttctcaccaggagtctctggaagccaaggtgaacgagacgaaagccacaatcaagttccagctcaagaaggtgctgtgcatgggcgtcgcggtgggtaacctgtcgatggaggagaagcagatccagcagaatatccagatgagcgtcaacttcctggtttccctgctcaagaagaactggcagaacgtaaggtgtctgtacatcaagagcaccatggggaagccggtccgtgtgttctaagctcgtgccccagccgccctatatcgatgctacctacagtactggacctccttactatgttcaagcttaaatatgtctacttgtcgtagcttttatcgaattttgcgcgtgtcctggttaatgaagatgatgaaagaccactactgtttcccctgagttgtgattccgatggaacaatatgctcatcaagatcattgcagtacccattatatataatgttgtggttgcatgttttgtact

SEQ ID NO: 15575 - DNA, 984 bp, Secale cereale
cctctcccccaaagcctggggtttccaccgaccacgagagccacagccattcctcctcctcctcctgccgccgccgctccccaaaccctagaccagccaggtgaatcggcgaccggcgaatcgacccgtccgtccccgcggcgagccatgagtaagctatcgaccgaagccctcaaggaggccatcacccaggtggtggcggacgccaaggagaagaacaggaagttcactgagacggtcgagctccagatcggcctcaagaactacgacccgcaaaaggacaagcgtttcagtggctccgtcaagctgccccatgtccctcgccccaagatgagggtctgcatgcttggtgatgcccagcatgtgggagaggctgacaagattggtcttgattccatggatgttgaagctcttaagaagatgaacaagaacaagaagcttgtcaagaggcttgccaagaagtaccatgctttcttggcctctgaggctattatcaagcagattccacgtctccttggtcctggtctgaacaaggcaggaaagttcccgaccctggtttctcaccaggagtctctggaagccaaggtgaacgagacgaaagccacaatcaagttccagctcaagaaggtgctgtgcatgggcgtcgccgtgggcaacctgtcgatggaggagaagcagatccagcagaacatccagatgagcgtcaacttcctggtttccctgctcaagaagaactggcagaacgtgaggtgtctgtacatcaagagcaccatggggaagcccgtccgggtgttctaagctcgtgccccagccgccctatatctatgctacctacagtactggacctcctttctatgttcaagcttaaatatgtctactttttgtagtttttatcgaattttgcgcgtgtcctggttaatgaagatgatgaaagaccactactgtttcccctgagttgtgattccgatggaacaatatgcgcat

SEQ ID NO: 15576 - DNA, 907 bp, Thalictrum flavum
tctaaccctagtttctgctaagggagtaaaccgtgggaatagctgttgaaagatgagtaagcttcagagtgatgtgctgagagaggcaatcacccaggttactggagaagccaaagagaaaaagagaaaatttactgagacagttgagctccagattggccttaagaactatgatcctcaaaaagataagcgtttcagtggctctgttaagctgccacacattccccgtcctaagatgaagatttgcatgcttggagatgctcagcacgttgaagaggcagagaaaataggtttggagtatatggatgtagaagggctaaagaaactgaacaaaaacaagaaacttgtgaaaaagctagcaaaaaaataccatgcttttctagcatcagaagctgtcattaagcagattcctcgtcttcttggccctggtcttaacaaggctggaaaattcccaactcttgtgactcatcaggaatcattggaatcaaaagttaacgaatccaaggctatggtgaagttccaacttaagaaggttctttgcatgggggttgctgtgggtaatcttggaatggatgagaagcagatcttccaaaatgttcaactcagtgtcaactttcttgtctcattgttgaaaaagaactggcagaatgtgaggtgcttgtacctgaagagctcaatggggaagccattccgtatcttctaaaacattataatttcgtttgattgagtacactatgtaccgaggtagtgaccaggattagaaacttattttggaaatgctcagatttgtcgtggttgtactattgagatctttagttgaatgctgttggaattttgaaagttgaaacattagtttgtactattgagatctttagttgaatgctagaataggaatttagaaatagtt

SEQ ID NO: 15577 - DNA, 984 bp, Cannabis sativa
atctttcataaaaaccctagctaccattgtcatctcctctcttctccttttataataaaagtttgtttcagtcggcactctaaaccctacctctcctccatcaacatccatatctgggtactattttctcggagagagaaagtatgagtaagctgagtagtgatgctgtgagagagggcatagctcagattgttatcaactcgaaagagaagaatcgtaagtttactgaaaccattgagcttcaaatcggtttgaagaactatgacccccaaaaagacaagcgtttcagtggctctgttaagcttcctcacattcctcgtcctaagatgaagatttgcatgttgggggatgctcaacacgtggaagaggctgtgaaaataggattggactatatggatgtggagggattgaaaaagcttaacaagaacaagaaacttgtgaagaagcttgccaagaagtttcatgcttttttggcttctgaagctgttattaagcaaattcctcgtcttctgggtcctggactcaacaaggcaggtaagtttccaacattggttacccatcaggagtctttggaggcaaaggtcaatgaaaccaaagccatggtgaagttccaacttaagaaggtgctttgtatgggagttgctgttggaaatttatccatggaggagaagcagatctttcagaatgtgcaaatgagtgtcaattttctagtgtcactattgaagaagaattggcaaaatgtgaggtgcttgtatttgaagagtaccatgggaagtgcaatccgtatcttttaagttaacgtatgcaaactaaaatttaattaagcaagacatttttgttttgagattattgcttcattaaagttgcaattttgtttttgttggattcattcgtccagtttgtaattttgacattaagattttgtggcttctaaaggagaattagcttatctttctttatttcatttcacaccaacttagccat

SEQ ID NO: 15578 - DNA, 973 bp, Ambrosia trifida
ggtttatacagaagacgtgaaactaaggaaaacctaacaaaaatgagtaagcttcagagtgaggccctgcgtgaagccattactcaaattaccaccgctgccaatgaaaagaagcgtaatttcactgagacaattgagctccagattgggctcaagaactacgacccacaaaaggataagcgtttcagtggcaccgtgaaattgcctcacattcctcgtcctaagttgaaggtttgcatgcttggggatgctcaacatgtagaagaggcccaaaagatcggtcttgaatacatggatgttgaaagtctcaagaagctcaacaagaacaagaagctagtgaagaagcttgccaagaaacaccaggcttttttggcttctgaatctgttattaagcagattcctcgtttgttgggccctggtctaaacaaggctggtaaattcccgacacttgtatcccaccaggaatccctcgaggctaaggtgaatgaaacgaaggcaactgtcaagtttcaactgaagaaagtgttgtgcatgggagttgctgttgggaactgcagcatggaggaaaaacagatttttcaaaacgtgcagatgagcgttaattttcttgtttcattgttgaagaaaaactggcagaatgtgcgatgtttgtacttgaagactacaatgggaaagcctattcgcatcttttaggtgtttatccttgtttttgctggaggccagttcttggaagcatttcccttcaatgggtgctattgtttttgacttgtcggatgtttgttttctttttgtgttagatgctgttatgaacattctgtttaatggttacagaccttttttctttttcatcaaatccaattcatctataaactcttcaaacaccagagtaaatccgaatccaactactacaaataaccagtagcaaaactgtgtacaacactagcatttttcacacgacggttgcttcatttga

SEQ ID NO: 15579 - DNA, 920 bp, Ambrosia trifida
agagtaacgcggagacaataagtctgttttttgttgcagaactactacggtcacttccaaaccctattcttaggtttcttactaaaggttgaagataacaagaggaaaagttaactgaaaatgagtaagcttcaaagtgaagcccttagagaggcaattactcagatcactactgctgcaactgaaaagaaacgtaactttactgaaaccattgagcttcaaattggtttgaagaactacgacccacaaaaggacaaacgtttcagtggtaccgtgaaattgcctcacattcctcgccccaagcttaaagtttgcatgcttggagatgctcaacatgttgaagaggctcaaaaaatcggccttgaatacatggatgttgagagtttgaagaagttgaacaagaacaagaagttggtgaagaaactcgctaagaaacatcaagcttttttggcttctgagtctgtcattaagcagattccccgattgttgggccccggtcttaacaaagcaggtaagttccctactcttgtttcccaccaagaatctctagaggcgaaggtcaacgagacaaaagcgacggtcaaatttcaacttaagaaggtgctctgcatgggagttgccgttggaaactgcagcatggaagaaaagcaaatctttcagaatgttcaaatgagtgtcaacttcttagtttctttgcttaagaagaattggcaaaacgtgcgatgcttgtacttgaagacaacaatgggaaagccgattcgcatcttttaaagagtttatttgttatgttttcgttttggattaatgttgaggtcagtactggaaaacatatttcctatgaacagggaatagtccttttttggctttttacatgtttgtttggtactatagtttggaccctgctgctgcttatatcattg

SEQ ID NO: 15580 - DNA, 850 bp, Arnica chamissonis
catacagaagaaggtgaactctagcgaaggaaaacctaaaaaaaatgagtaagcttcagagtgaagccctacgtgaagcgattactcaaattaccaccgatgccaaggagaagaaacgtaatttcactgagactattgagctccagattgggctcaagaactacgacccacaaaaggacaaacgtttcagtggcactgtgaaattgcctcacattcctcgtcctaaactgaaagtttgcatgcttggggatgctcagcatgtagaagaggctcaaaagattggtcttgaatacatggatgtagaaggactcaagaagctgaacaaaaacaaaaagctggtgaagaagcttgccaagaaacaccaggcttttctggcttctgaatctgttatcaagcagattcctcgtttgttgggccctggtttaaacaaggctggtaaattcccgacacttgttagtcaccaggaatcccttgaggctaaggtgaatgaaacgaaggcaactgtcaagtttcaactgaaaaaagtgttgtgcatgggagtggctgtcgggaactgcagcatggaggaaaaacagatttttcagaacgtgcagatgagtgttaattttcttgtttcgctgttgaagaaaaactggcagaatgttcgttgtttgtacttgaagacgacaatgggaaagccggttcgcatcttttaggtgtttatctctgattttgattgaggtccgttcttggaagcattttcatttgataggtgctgttgtttttgacttgttgaattttgtcttccttttgtattagatgctgctatgaacattatgtttaatggttacgaacttttttaattaaactt

SEQ ID NO: 15581 - DNA, 856 bp, Flaveria ramosissima
ctgctgttagggttcctaccgtagaagtgaagcttaaggaaggagaacggaacgaaaatgagtaagcttcagagtgatgccctacgtgaagccattactcaaattaccactgatgctaaggaaaagaaacgtaacttcactgagaccatcgagctccagattgggctcaagaactatgacccacaaaaggacaagcgtttcagtggaactgtgaaattgcctcacattcctcgtcctaaattgaaagtttgcatgctcggggatgctcagcatgtagaagaggctcaaaagatcggtcttgaatacatggatgtagaaggactcaagaagctcaacaagaacaagaagctggtgaagaagcttgctaagaaacaccaggcttttttggcttctgaatctgttattaagcagattccccgtttgttgggccctggtctaaacaaggcaggtaaatttccaacacttgttactcaccaagaatctctcgaggctaaggtgaatgaaacaaaggcaaccgtcaagtttcaactgaaaaaggtgttgtgcatgggtgttgctgtcgggaactgcagcatggaggaaaaacagatttttcaaaatgtgcagatgagcgttaattttcttgtttctttgttgaagaaaaactggcagaatgtgcgatgtttgtacttgaagactacaatgggaaagccggttcgtatcttttaggtgttcattgtttttgcttgaggtcagttcttggaagcatttccctttaatgggtgctattgtttttgacttgttggatgttggttttcttattgtattagactgctatgaacattatgtttaatggttactaaaccttttattatac

SEQ ID NO: 15582 - DNA, 975 bp, Flaveria ramosissima
cctcgaacttcattcggcgttgctgttagggttctaccgaagaagagaggtttaagggaggaaaacctaacgaaaaatgagtaagcttcagagtgatgcccttagggaagctattacccaaattaccaccgatgctaaagaaaagaaacggaatttcactgagaccattgagcttcagattggtctcaagaactacgacccacaaaaggacaaacgtttcagcggaactgtgaagttgcctcacattcctcgacccaaattgaaagtttgcatgcttggagatgcccagcatgtagaagaggctcaaaagattggtcttgaatacatggatgttgaaggactcaagaagctcaacaagaacaagaagctggtgaagaagctcgccaagaaacaccaggcttttttggcttctgaatccgtcatcaagcaaattcctcgtttgttgggccctggtcttaacaaggcaggaaagttcccgacacttgttactcaccaggaatcccttgaggctaaggtgaatgaaactaaggcgacagtcaagttccaactgaaaaaggtgttgtgcatgggagttgctgttggtaactgcagcatggaggaaaaacagattttccaaaatgtgcagatgagcgttaatttcctcgtttcattgctgaagaaaaactggcagaatgtgagatgtttgtacttgaagacaacaatgggaaagccagttcgtatcttttaggtattcagtctgtttttctcttacaaatttgttgtgaagtggtgtccgttttgacttatcaggtctctgttatgtgttatcttctcgttttagatgataccatgaacgctatgtttactggttacaagtattttaacaatgtttttgtcatctcaaggagagtgtttgttttagaaaaaaaaaaaaaaaaagaaatactgtgtgtgtacacatctacttgtagactagcgacgaagcacaggaggtag

SEQ ID NO: 15583 - DNA, 806 bp, Flaveria ramosissima
agaattgaagctgacgagaggagaagtctctgaaaatgagtaagcttcaaagtgatgcccttagagaggcgattactcagatcaccactgatgctaaggaaaagaagcgtaacttcaccgaaaccattgagcttcaaattggtttgaagaattacgatccacaaaaagacaaacgtttcagtggtaccgtgaagttgcctcacatacctcgccccaagcttaaagtttgcatgcttggagatgctcaacatgttgaggaggcacaaaaaattggtcttgaatatatggatgttgaggggttgaagaaactgaacaagaacaagaagttggtgaagaaacttgctaagaaacatcaagcttttttggcttctgagtctgtcatcaagcagattccccgtttgttgggccccggtctaaacaaagcaggcaagttcccaactctcgttacccaccaagaatcactcgaggctaaagtcaatgagactaaagcaacagtcaagttccaactgaagaaggtgctctgcatgggagttgctgttggaaactgcagcatggaagaaaagcaaatcttccaaaacgtccaaatgagtgtcaacttcttagtttctttgcttaagaagaattggcaaaatgtgcggtgcttgtacttgaagacaacaatgggaaagccggtgcgcatattttaagttcatctgttatgtttttattttggtttaatgttgaggttagtacccaaaaacaaatttcccatgaactgggagtaatcttttttggctctttacatgtttgtttggcacaatattttt

SEQ ID NO: 15584 - DNA, 983 bp, Flaveria ramosissima
tactcacactttgatagcagataatgacgattctgttgtaattcgatgcgtattgttatttaacaagcttgtggttatcacttatcaatcatatgaacttagatcttgtttcgatgattttttgatgcgtaggattcattgatgtgaaatttttgttttttgtgtttgattatttgcagaattgaagctgacgagaggagaagtctctgaaaatgagcaagcttcaaagtgatgcccttagagaggcgattactcagatcaccactgatgctaaggaaaagaagcgtaacttcactgaaaccattgagcttcaaattggtttgaagaattacgatccacaaaaagacaaacgtttcagtggtactgtgaagttgcctcatatccctcgccccaagcttaaagtttgcatgcttggagatgctcaacatgttgaagaggcacaaaaaattggtcttgaatatatggatgttgaggggttgaagaagctgaacaagaacaagaagttggtgaagaaacttgctaagaaacatcaagctttcttggcttccgagtctgtcatcaagcagattcctcgtttgttggggcccggtctaaacaaagcaggcaagttcccaactcttgttacccaccaagaatcactcgaggctaaagtcaacgagactaaagcaacagtcaagttccaactgaagaaggtgctctgcatgggagttgctgttggaaactgcagcatggaagaaaagcaaatcttccaaaacgttcaaatgagtgtcaacttcttagtttctttgcttaagaagaattggcaaaatgtgcggtgcttgtacttgaagacaacaatgggaaagccggtccgcatcttttaagttcatttgttatgtttttattttggtttaatgttgaggttagtacccaaaaacaaatttcccatgaactgggagtaatcttttttggctcttcacatgtttgtttggcacaatattttt

SEQ ID NO: 15585 - DNA, 834 bp, Flaveria ramosissima
cctaacgtagaagtgaagcttaacgaaggagagcgtaacgaaaatgagtaagcttcagagtgatgccctacgtgaagccattactcaaattaccactgatgctaaggaaaagaaacgtaacttcactgagaccatcgagctccagattgggctcaagaactatgacccccaaaaggacaagcgtttcagtggaaccgttaaattgcctcacattcctcgtcctaaattgaaagtttgcatgcttggggatgctcagcacgtagaagaggctcaaaagatcggtcttgaatacatggatgtagaaggactcaagaagctcaacaagaacaagaagctggtgaagaagcttgctaagaaacaccaggcttttttggcttctgaatctgttatcaagcagattccccgtttgttgggccctggtctaaacaaggcaggtaaatttccaacacttgttactcaccaagaatctctcgaggctaaggtgaatgaaacaaaggcaaccgtcaagtttcaactgaaaaaagtgttgtgcatgggagttgctgttgggaactgcagcatggaggaaaaacagatctttcaaaacgtgcagatgagcgttaattttctcgtttcattgttgaagaaaaactggcagaatgtgcgatgtttgtacttgaagactacaatgggaaagccagttcgcatcttttaggtgtttatctttctttttgcctgaggtcagttcttggaagcacttccctataatgggtgccattgtttttgttttgttggatgtttgttttcttattgtattagatgctgttatgaacattatgtttaatggttacaaac

SEQ ID NO: 15586 - DNA, 842 bp, Flaveria ramosissima
ggtgctgctgttagggttcccaacgtagaagtgaagcttaacgaaggagagcgtaacgaaaatgagtaagcttcagagtgatgccctacgtgaagccattactcaaattactaccgatgctaaggaaaagaaacgtaactttactgagaccatcgagctccagattggactcaagaactatgacccacaaaaggacaagcgtttcagtggcaccgtgaaattgcctcacattcctcgtcctaaattgaaagtttgcatgctcggggatgctcagcatgttgaagaggctcaaaagatcggtcttgaatacatggatgtagaaggactcaagaagctcaacaagaacaagaagctggtgaagaagcttgctaagaaacaccaggcttttttggcttctgaatctgttatcaagcagattccccgtttgttgggccctggtctaaacaaggcaggtaaatttccaacacttgttactcaccaggaatctcttgaggctaaggtgaatgaaacaaaggcaaccgtcaagtttcaactgaaaaaagtgctgtgcatgggagtggctgtcgggaactgcagcatggaggaaaaacagatttttcaaaacgtgcagatgagcgttaattttcttgtttcgttgttgaagaaaaactggcagaatgtgcgatgtttgtacttgaagacaacaatgggaaagccggttcgcatcttttaggtgttcatcattttttttgcttgaggtcagttcttggaagcatttccatttaatgggtgctattgtttttgacttgttgaatgtttgttttcttattgtattagatgctgctatgaacattatgtttaat

SEQ ID NO: 15587 - DNA, 788 bp, Flaveria ramosissima
tcggcgttgctgttagggttctaccgaagaagagaggtttaaggaaggaaaatctaacaaaaaatgagtaagcttcagagtgatgcccttagggaagctattacccaaattaccaccgatgctaaagaaaagaaacgtaatttcactgagaccattgagcttcaaattggtcttaagaactacgacccacaaaaggacaaacgttttagcggaactgtgaagttacctcatattcctcgacccaaattgaaagtttgcatgcttggagatgcccagcatgtggaagaggctcaaaagattggtcttgaatacatggatgttgaaggactcaagaagctcaacaagaacaagaagctggtgaagaagcttgccaagaaacaccaggcttttttggcttctgaatccgttatcaagcaaattcctcgtttgttgggcccaggtttaaacaaggcaggaaagttcccaacacttgttacccaccaggaatccctcgaggctaaggtgaatgaaactaaggcgacagtcaagtttcaactgaaaaaggtgttgtgcatgggagttgctgttggtaactgcagcatggaggaaaaacagatcttccaaaatgtgcagatgagcgttaatttcctcgtttcattgctgaagaaaaactggcagaatgtgagatgtttgtacttgaagacaacaatgggaaagccagttcgcatcttttaggtatcaagtctgtttttctttcaaatttgttgcgaggtggtgactgttttgacttatcagatatctgttatgtg

SEQ ID NO: 15588 - DNA, 777 bp, Flaveria ramosissima
tcggcgttgctgttagggttctaccgaagaagcgaggtttaagggaggaaaacctaacgaaaaatgagtaagcttcagagtgatgcacttagggaagctattacccaaattaccaccgatgctaaagaaaagaaacgtaatttcactgagaccattgagcttcagatcggtctgaagaactatgatccacaaaaggacaaacgttttagcggaactgtgaagttgcctcacattcctcgtcccaaattgaaagtttgcatgcttggagatgcccagcatgtagaagaggctcaaaagattggtcttgaatacatggatgtcgaaggactcaagaagctcaacaagaacaaaaagctggtgaagaagcttgccaagaaacaccaggcttttttggcttctgaatccgtcatcaagcaaattcctcgtttgttgggcccaggtttaaacaaggcaggaaagtttccgacacttgttactcaccaggaatcccttgaggctaaggtgaatgaaaccaaggcaacagttaagtttcaactgaaaaaggtgttgtgcatgggagttgcggttggtaactgcagcatggaggaaaaacagattttccaaaacgtgcagatgagcgttaatttcctcgtttcattgctgaagaaaaactggcagaatgtgagatgtttgtacttgaagacaacaatgggaaagccagttcgcatcttttaggtattcagtctgttttttcttacaaatttgttgtgaggtggtgtcggttttgacttatatatt

SEQ ID NO: 15589 - DNA, 953 bp, Helianthus annuus
gatagccatttctgtgcgtgactctgtcgccactttgaaaccctaatctcagggttctttactggagaagttaagctaaccagaagaaaagtttccgagaatgagtaagcttcaaagtgaagccctcagagaggcaattactcagatcactactgatgctaaagaaaagaagcgtaattttactgaaaccattgagcttcaaattggtttgaagaattatgatccgcaaaaggacaaacgtttcagtggtacagtgaagttgcctcacattcctcgccccaaattgaaagtttgcatgcttggagatgcccaacatgttgaagaggcccaaaaaataggacttgagtatatggatgttgagggactgaagaagctgaacaagaacaagaagttggtgaagaagcttgctaaaaaacaccaagctttcttggcttctgagtctgtcatcaagcaaattcctcgtttgttgggtcctggtctaaacaaagctggtaagttcccgacacttgttagtcatcaggaatccctcgaggcgaaagtcaatgagaccaaagcaacagtcaagtttcaactaaagaaggtgctctgcatgggagtggctgttggaaactgcagcatggaggaaaagcaaattttccaaaacgttcaaatgagtgtcaatttcttagtttctttgctaaagaagaattggcaaaatgtgagatgcttatacttgaagacaacaatggggaagccagttcgcatcttttaaggaagagtttatttgtttgtatgttttaattttgggttaatgttaaagtcagtgctggaaagtatatttctcatgaacacaggaataggtttttctttggcttgttacatgtttgtttttgtagcactataaaatctatttactttgaggttaaaaaaatactcttatccgggaaaaaacaaacaggaaatctaatagcaaa

SEQ ID NO: 15590 - DNA, 836 bp, Helianthus annuus
taacaaaaaatgagtaagcttcagagtgaagcccttagggaagccattacccaaattaccaccgatgccaaagaaaagaagcgtaacttcaccgagaccattgagcttcagatcggtctcaagaactacgacccacaaaaggacaagcgtttcagcggtaccgtaaaattgcctcacattcctcgcccaaagttgaaggtttgcatgcttggagatgctcagcatgttgaagaggctcaaaagattggtcttgaatacatggatgttgaaggactcaaaaagctcaacaagaacaagaagctggtgaagaagcttgccaagaaacaccaggcttttttggcttctgaatccgtcatcaagcaaattcctcgtttgttgggccctggtctaaacaaggcaggaaagttcccgacacttgttagtcaccaagaatctctcgaggctaaggtgaatgaaaccaaggcgacagttaagtttcaactgaaaaaggtgttgtgcatgggagttgctgttggtaactgcagcatggaggaaaaacagattttccaaaacgtgcagatgagcgttaatttccttgtttcattgttgaagaagaactggcagaatgtgagatgtttgtacttgaagacaacaatgggaaagccggttcgcatcttttaagtaccctgtctgtttttctttcaaagttgttgtgaggtcggtacttgaagcctttcgtgttagcaggctgtttcggttttgattatggctgttcgttatcgttttgaattagtagatgctatgaacattcttgtgttttgttatttattaaagataatacatgctttaaaagagtt

SEQ ID NO: 15591 - DNA, 840 bp, Helianthus annuus
taacaaaaaatgagtaagcttcagagtgaagcccttagggaagccattacccaaatcaccacagatgccaaagaaaagaagcgtaacttcaccgagactatcgagcttcagatcggtctcaagaactacgacccacaaaaggacaagcgtttcagcggtactgtaaagttgcctcacattcctcgtcccaaattgaaggtttgcatgcttggagatgcccagcacgtggaagaggctcaaaagattggtcttgaatacatggatgttgaaggactcaaaaagctcaacaagaacaagaagctggtgaagaagcttgccaagaaacaccaggcttttttggcttctgaatccgttatcaagcaaattcctcgtttgttgggccctggtctaaacaaggcaggaaagttcccgacacttgttagtcaccaagaatctctcgaggctaaggtgaatgaaaccaaggcgacagttaagtttcaactgaaaaaggtgttgtgcatgggagttgctgttggtaactgcagcatggaggaaaaacagattttccaaaacgtgcagatgagcgttaatttccttgtttcattgttgaagaagaactggcagaatgtgagatgtttgtacttgaagacaacaatgggaaagccggttcgcatcttttaagtaccctgtctgtttttctttcaaagttgttgtgaggtcggtacttgaagcctttcgtgttagcaggctgtttcggttttgattatggctgttcgttatcgttttgaattagtagatgttatgaacattcttgtgttttgttatttattaaagataatacatgctttaaaagagtttttc

SEQ ID NO: 15592 - DNA, 901 bp, Helianthus annuus
ttactaagttgaataatactataactcagccgctgtcttcctccctgcttgcagttagggtttataccgaagaagtgaagtttcactaaggaaaacctaacaaaaatgagtaagcttcagagtgaagccctgcgtgaggccattactcaaattaccaccgatgccaaagaaaagaagcgtaacttcaccgagactatcgagctccagattggactcaagaactacgacccacaaaaggacaagcgtttcagtggcaccgtgaaattgcctcacattcctcgtcctaagttgaaagtttgcatgctcggggatgctcagcatgtagaagaggcccaaaagatcggtcttgaatacatggatgttgaaggacttaagaagctcaacaagaacaaaaagttggtgaagaagcttgccaagaaacaccaagcgtttttggcttctgaatctgttatcaagcagatccctcgtttgttgggccctggtctaaacaaggccggtaaattcccgacacttgtttcccaccaggaatccctcgaggctaaggtgaatgaaaccaaggcaactgtcaagtttcaactgaaaaaagtgttgtgcatgggagttgctgtcgggaactgcagcatggaggagaaacagatttttcaaaacgttcagatgagcgttaattttcttgtttcgttgttgaagaaaaactggcagaatgtccgatgtttgtacttgaagacgacaatgggaaagccagttcgcatcttttaggtgttttatcgttgtttttggttgagccagtttcaggaagcatttccatttaatgggtgctattgtttttgacttgttggatgtttgttttcttattgtattagatgctgctatgaacattatggttaatggttacagaccattt

SEQ ID NO: 15593 - DNA, 938 bp, Helianthus annuus
ttcacagaacatttagggtttcagcctcatatattacaatcagctgtttttggtgcgtaactcttatcggcactttgaaaccctaactctcagagaattgaaggtatcgagaggaagagtttccgaaaatgagtaagcttcaaagtgaagcccttagagaggcaattactcagatcactacagatgcaaaggaaaagaaacgtaacttcactgaaaccattgagctacaaattggtttgaagaattacgatccacaaaaggacaaacgtttcagtggaaccgtgaagttgccccacattcctcgccccaagcttaaagtttgcatgcttggagatgctcaacacgttgaagaggctcaaaaaattggtcttgaatatatggatgttgagggtttaaaaaagctgaacaagaacaagaaattggtgaagaaacttgctaagaagcatcaagctttcttggcttctgagtctgttatcaagcagattcctcgtttgttgggccccggtcttaacaaagcaggtaagttccctactcttgtttcccaccaagaatctctcgaggcaaaagtcaacgagacgaaagcgacagtcaaattccaacttaagaaggtgctttgcatgggagttgctgttggaaactgcagcatggaagagaagcaaatcttccaaaatgttcaaatgagtgtcaatttcttggtttctttacttaaaaagaattggcaaaacgtgcggtgcttgtacttgaagacaacaatgggaaagccggttcgcatcttttaaggagtggctttggttatgttttttattttgggttaatgttgaggtcagtactggaaaatgtatttcccatgaatggggaataatcctttttggctttttacatgtttgtttggtactgtatttttggaccctcttcttatatcattgttttgattttgc

SEQ ID NO: 15594 - DNA, 824 bp, Helianthus annuus
caaagaagtgaagtttcactaaggaaaacctaacaaaaatgagtaagcttcagagtgaagccctgcgtgaggccattactcaaattaccaccgatgccaaagaaaagaagcgtaacttcaccgagactatcgagctccagattggactcaagaactacgacccacaaaaggacaagcgtttcagtggcaccgtgaaattgcctcacattcctcgtcccaaattgaaagtttgcatgcttggagatgctcagcatgtggaagaggcccaaaagattggtcttgaatacatggatgttgaaggtctcaagaagctcaacaagaacaaaaagctcgtgaagaagcttgccaagaaacaccaggcttttttggcttctgaatctgttatcaagcagattcctcgtttgttgggtcctggtctaaacaaggccggtaaattcccgacgcttgtttcccaccaggaatccctcgaggctaaggtgaatgaaaccaaggcaactgtcaagtttcaactgaaaaaagtgttgtgcatgggagttgctgtcgggaactgcagcatggaggagaaacagatttttcaaaacgttcagatgagcgttaattttcttgtttcgttgttgaagaaaaactggcagaatgtccgatgtttgtacttgaagacgacaatgggaaagccggttcgcatcttttaggtgttttatctttgtttttggttgagccagtttcaggaagcatttccatttaatgggtgctattgtttttgacttgttggatgtttgttttcttattgtattagatgctgctatgaacattatggttaatggtta

SEQ ID NO: 15595 - DNA, 825 bp, Helianthus annuus
accgaagaagtgaagtttcagtaaggaaaacctaacaaaaatgagtaagcttcagagtgaagccctgcgtgaggccattactcaaattaccaccgatgccaaagaaaagaagcgtaacttcaccgagactatcgagctccagattggactcaagaactacgacccgcaaaaggacaagcgtttcagtggcaccgtgaaattgcctcacattcctcgtcctaagttgaaagtttgcatgctcggggatgctcagcatgtggaagaggcccaaaagattggtcttgaatacatggatgttgaaggtctcaagaagctcaacaagaacaaaaagctcgtgaagaagcttgccaagaaacaccaggcttttttggcttctgaatctgttatcaagcagattcctcgtttgttgggtcctggtctaaacaaggccggtaaattcccgacacttgtttcccaccaggaatccctcgaggctaaggtgaatgaaaccaaggcaactgtcaagtttcaactgaaaaaggtgttgtgcatgggagttgctgtcgggaactgcagcatggaggagaaacagatttttcaaaacgttcagatgagcgttaattttcttgtttcgttgttgaagaaaaactggcagaatgtccgatgtttgtacttgaagacgacaatgggaaagccggttcgcatcttttaggtgtttatcgttgtttttggttgagccagtttcaggaagcatttccatttaatgggtgctattgtttttgacttgttggatgtttgtttttctattgtattagatgttgctatgaacattttggttaatggtta

SEQ ID NO: 15596 - DNA, 842 bp, Helianthus annuus
gctgcagttagggttataccgaagaagtgaagtttcactaaggaaaacctaacaaaaatgagtaagcttcagagtgaagccctgcgtgaggccattactcaaattaccaccgatgccaaagaaaagaagcgtaacttcaccgagactatcgagctccagattggactcaagaactacgacccacaaaaggacaaacgtttcagtggcaccgtgaaattgcctcacattcctcgtcccaaattgaaagtttgcatgcttggagatgctcagcatgtggaagaggcccaaaagattggtcttgaatacatggatgttgaaggtctcaagaagctcaacaagaacaaaaagctcgtgaagaagcttgccaagaagcaccaggcttttttggcttctgaatctgttatcaagcagattcctcgtttgttgggtcctggtctaaacaaggccggtaaattcccgacgcttgtttcccaccaggaatccctcgaggctaaggtgaatgaaaccaaggcaactgtcaagtttcaactgaaaaaagtgttgtgcatgggagttgctgtcgggaactgcagcatggaggagaaacagatttttcaaaacgttcagatgagtgttaattttcttgtttcgttgttgaagaaaaactggcagaatgtccgatgtttgtacttgaagacgacaatgggaaagccggttcgcatcttttaggtgtttatctttgtttttggttgagccagttgttggaagcatttccctttaatgggtgctattgttttcgacttgttggatgtttgttttcttattgtattagatgctgctatgaacattatggttaatggtta

SEQ ID NO: 15597 - DNA, 911 bp, Helianthus annuus
cgataagccatttttggtgcgtgactctgtcgccactttcaaaccctaatctcagggttctttacaggagaagttaagctaacgagaagaaaagtttccgagaatgagtaagcttcaaagtgaagccctcagagaggcaattactcagatcactactgatgctaaagaaaagaagcgtaattttactgaaaccattgagcttcaaattggtttgaagaattatgatccgcaaaaggacaaacgtttcagtggtacagtgaagttgcctcacattcctcgccccaaattgaaagtttgcatgcttggagatgctcaacatgtggaagaggcccaaaaaataggacttgagtatatggatgttgagggactgaagaagctgaacaagaacaagaagttggtgaagaagcttgctaaaaaacaccaggctttcttggcttctgagtctgtcatcaagcaaattcctcgtttgttgggtcctggtctaaacaaagctggtaagttcccgacacttgttagtcatcaggaatccctcgaggcgaaagtcaatgagaccaaagcaacagtcaagtttcaactaaagaaggtgctctgcatgggagtggctgttggaaactgcagcatggaggaaaagcaaattttccaaaacgttcaaatgagtgtcaatttcttagtttctttgctaaagaagaattggcaaaatgtgcgatgcttatacttgaagacaaccatggggaagccagttcgcatcttttaaggaagagcttatttgtttgtatgttttaattttgggttaatgttaaagtcagtgttggaaagtatatttctcatgaacacaggaataggtttttctttggcttgttacatgtttgtttttgtagcactataaaatctatttactttgaggttaaaaa
